United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 224

SEQ ID NO: 9276755 - DNA, 22 bp, Homo sapiens
agggcagactaggatggaagtg

SEQ ID NO: 9276756 - DNA, 22 bp, Homo sapiens
agggcagaagtacagacactta

SEQ ID NO: 9276757 - DNA, 22 bp, Homo sapiens
agggcagaagtacagacactta

SEQ ID NO: 9276758 - DNA, 22 bp, Homo sapiens
agggcagaccacgtgcaaggat

SEQ ID NO: 9276759 - DNA, 22 bp, Homo sapiens
agggacccatagagagaccagt

SEQ ID NO: 9276760 - DNA, 22 bp, Homo sapiens
agggactatttacccatctcac

SEQ ID NO: 9276761 - DNA, 22 bp, Homo sapiens
agggactatttacccatctcac

SEQ ID NO: 9276762 - DNA, 22 bp, Homo sapiens
agggacctcttcttgcagctga

SEQ ID NO: 9276763 - DNA, 22 bp, Homo sapiens
cccaggccccagggcttgtcag

SEQ ID NO: 9276764 - DNA, 22 bp, Homo sapiens
cccaggccagaacttggttgct

SEQ ID NO: 9276765 - DNA, 22 bp, Homo sapiens
agggactatttacccatctcac

SEQ ID NO: 9276766 - DNA, 22 bp, Homo sapiens
cccaggaatgagcaggcagggg

SEQ ID NO: 9276767 - DNA, 22 bp, Homo sapiens
agggacagtctactgttcactg

SEQ ID NO: 9276768 - DNA, 22 bp, Homo sapiens
agggacagtctactgttcactg

SEQ ID NO: 9276769 - DNA, 22 bp, Homo sapiens
cccaggcctggtctgggccagt

SEQ ID NO: 9276770 - DNA, 22 bp, Homo sapiens
cccaggcctggtctgggccagt

SEQ ID NO: 9276771 - DNA, 22 bp, Homo sapiens
agggagccttcctggctgtggt

SEQ ID NO: 9276772 - DNA, 22 bp, Homo sapiens
agggagccctgaaccagagggt

SEQ ID NO: 9276773 - DNA, 19 bp, Homo sapiens
cccaggaagcggaggttgc

SEQ ID NO: 9276774 - DNA, 22 bp, Homo sapiens
cccaggaagggatgccaaggaa

SEQ ID NO: 9276775 - DNA, 23 bp, Homo sapiens
agggaaagtagtaatggcctttg

SEQ ID NO: 9276776 - DNA, 23 bp, Homo sapiens
agggaaagtagtaatggcctttg

SEQ ID NO: 9276777 - DNA, 22 bp, Homo sapiens
agggaaagtaagcatttcatta

SEQ ID NO: 9276778 - DNA, 22 bp, Homo sapiens
cccaggaaatgggctcttgcct

SEQ ID NO: 9276779 - DNA, 22 bp, Homo sapiens
cccaggaaatgggctcttgcct

SEQ ID NO: 9276780 - DNA, 22 bp, Homo sapiens
cccaggaactccagagctcctc

SEQ ID NO: 9276781 - DNA, 22 bp, Homo sapiens
aggctttcctgtcactcatgct

SEQ ID NO: 9276782 - DNA, 22 bp, Homo sapiens
agggaaaggctgatgctgtggg

SEQ ID NO: 9276783 - DNA, 22 bp, Homo sapiens
agggaaaggctgatgctgtggg

SEQ ID NO: 9276784 - DNA, 21 bp, Homo sapiens
agggaaagaaaatgagctaat

SEQ ID NO: 9276785 - DNA, 21 bp, Homo sapiens
agggaaagaaaatgagctaat

SEQ ID NO: 9276786 - DNA, 22 bp, Homo sapiens
agggaaaggtagtgaggtcaca

SEQ ID NO: 9276787 - DNA, 22 bp, Homo sapiens
agggaaactagactgcctttct

SEQ ID NO: 9276788 - DNA, 22 bp, Homo sapiens
aggctttgtacctggggtctta

SEQ ID NO: 9276789 - DNA, 22 bp, Homo sapiens
cctcagtcattggcctacactt

SEQ ID NO: 9276790 - DNA, 22 bp, Homo sapiens
cctcaggtgtgggccagctgtc

SEQ ID NO: 9276791 - DNA, 22 bp, Homo sapiens
agggctgggctgcttgttgtca

SEQ ID NO: 9276792 - DNA, 22 bp, Homo sapiens
cctcagggtctgaggagaccgt

SEQ ID NO: 9276793 - DNA, 22 bp, Homo sapiens
cctcaggggtgcccacagctgc

SEQ ID NO: 9276794 - DNA, 18 bp, Homo sapiens
cctcaggggacctggcag

SEQ ID NO: 9276795 - DNA, 22 bp, Homo sapiens
agggctgagaatgacagggccg

SEQ ID NO: 9276796 - DNA, 22 bp, Homo sapiens
agggctgagactaaggccagat

SEQ ID NO: 9276797 - DNA, 22 bp, Homo sapiens
agggctgagactaaggccagat

SEQ ID NO: 9276798 - DNA, 22 bp, Homo sapiens
agggctgagaatgacagggccg

SEQ ID NO: 9276799 - DNA, 22 bp, Homo sapiens
agggctgagactaaggccagat

SEQ ID NO: 9276800 - DNA, 20 bp, Homo sapiens
agggctgagaagggactagc

SEQ ID NO: 9276801 - DNA, 20 bp, Homo sapiens
agggctgagaagggactagc

SEQ ID NO: 9276802 - DNA, 22 bp, Homo sapiens
agggctgagaatgacagggccg

SEQ ID NO: 9276803 - DNA, 20 bp, Homo sapiens
agggctgagaagggactagc

SEQ ID NO: 9276804 - DNA, 22 bp, Homo sapiens
agggctgaggcgagggagatgc

SEQ ID NO: 9276805 - DNA, 22 bp, Homo sapiens
agggctgaggcgagggagatgc

SEQ ID NO: 9276806 - DNA, 22 bp, Homo sapiens
cctcagggaggcctctgtggct

SEQ ID NO: 9276807 - DNA, 22 bp, Homo sapiens
agggctgagcccaggcatgtag

SEQ ID NO: 9276808 - DNA, 22 bp, Homo sapiens
agggctgagactaaggccagat

SEQ ID NO: 9276809 - DNA, 22 bp, Homo sapiens
agggctgagcccaggcatgtag

SEQ ID NO: 9276810 - DNA, 22 bp, Homo sapiens
agggctgagcccaggcatgtag

SEQ ID NO: 9276811 - DNA, 22 bp, Homo sapiens
cctaccagtaggaggccagaga

SEQ ID NO: 9276812 - DNA, 22 bp, Homo sapiens
cctactctgagcgcctccgcat

SEQ ID NO: 9276813 - DNA, 22 bp, Homo sapiens
cctactctgagcgcctccgcat

SEQ ID NO: 9276814 - DNA, 22 bp, Homo sapiens
cctactctgagcgcctccgcat

SEQ ID NO: 9276815 - DNA, 22 bp, Homo sapiens
cctacattctctgagttttcct

SEQ ID NO: 9276816 - DNA, 22 bp, Homo sapiens
cctactctgagcgcctccgcat

SEQ ID NO: 9276817 - DNA, 22 bp, Homo sapiens
agggctcttcctttgcctctca

SEQ ID NO: 9276818 - DNA, 22 bp, Homo sapiens
agggctgacagtggcgtggcgt

SEQ ID NO: 9276819 - DNA, 22 bp, Homo sapiens
agggctgacctaagctccactt

SEQ ID NO: 9276820 - DNA, 22 bp, Homo sapiens
agggctgacagtggcgtggcgt

SEQ ID NO: 9276821 - DNA, 22 bp, Homo sapiens
agggctgacagtggcgtggcgt

SEQ ID NO: 9276822 - DNA, 22 bp, Homo sapiens
agggcctggcttcactttctca

SEQ ID NO: 9276823 - DNA, 22 bp, Homo sapiens
ccctggccagctcatgtctgag

SEQ ID NO: 9276824 - DNA, 22 bp, Homo sapiens
ccctggcagagggggcaggtgc

SEQ ID NO: 9276825 - DNA, 22 bp, Homo sapiens
agggccccagtaagattacatg

SEQ ID NO: 9276826 - DNA, 22 bp, Homo sapiens
agggcccatgtgggagcacttg

SEQ ID NO: 9276827 - DNA, 22 bp, Homo sapiens
agggcccatagatcgtcagctt

SEQ ID NO: 9276828 - DNA, 22 bp, Homo sapiens
agggcccatagatcgtcagctt

SEQ ID NO: 9276829 - DNA, 22 bp, Homo sapiens
agggcccagtggagagctgagc

SEQ ID NO: 9276830 - DNA, 22 bp, Homo sapiens
agggcccaggacagcatcaggg

SEQ ID NO: 9276831 - DNA, 22 bp, Homo sapiens
agggcctgtgaattctccctgc

SEQ ID NO: 9276832 - DNA, 21 bp, Homo sapiens
agggcctgtgctctccaggtc

SEQ ID NO: 9276833 - DNA, 22 bp, Homo sapiens
agggcctgtgctgagtagacga

SEQ ID NO: 9276834 - DNA, 21 bp, Homo sapiens
agggcctgtgctctccaggtc

SEQ ID NO: 9276835 - DNA, 22 bp, Homo sapiens
agggcctgtcagcggtgtcctg

SEQ ID NO: 9276836 - DNA, 22 bp, Homo sapiens
agggcctggcttcactttctca

SEQ ID NO: 9276837 - DNA, 22 bp, Homo sapiens
agggcctgtctgtagaactgaa

SEQ ID NO: 9276838 - DNA, 19 bp, Homo sapiens
cctaagtaacaacagttgt

SEQ ID NO: 9276839 - DNA, 22 bp, Homo sapiens
cctaagtaagttgactttcaga

SEQ ID NO: 9276840 - DNA, 22 bp, Homo sapiens
cctacagttatattcttgattg

SEQ ID NO: 9276841 - DNA, 22 bp, Homo sapiens
cctacagttatattcttgattg

SEQ ID NO: 9276842 - DNA, 22 bp, Homo sapiens
cctacagacaaaccagtgacta

SEQ ID NO: 9276843 - DNA, 22 bp, Homo sapiens
cctacaggaaattgtatcaaaa

SEQ ID NO: 9276844 - DNA, 20 bp, Homo sapiens
agggcctgttgcaagcgttt

SEQ ID NO: 9276845 - DNA, 22 bp, Homo sapiens
aggggtgaaggcccgataggag

SEQ ID NO: 9276846 - DNA, 22 bp, Homo sapiens
cctgcagaccacactcagtcct

SEQ ID NO: 9276847 - DNA, 22 bp, Homo sapiens
aggggtcttgggagtcctggct

SEQ ID NO: 9276848 - DNA, 22 bp, Homo sapiens
aggggtcttgaggactccagca

SEQ ID NO: 9276849 - DNA, 22 bp, Homo sapiens
aggggtctttaggaacgtcggg

SEQ ID NO: 9276850 - DNA, 20 bp, Homo sapiens
aggggtctagcagcagtgct

SEQ ID NO: 9276851 - DNA, 22 bp, Homo sapiens
aggggtctatcctgagatggtc

SEQ ID NO: 9276852 - DNA, 22 bp, Homo sapiens
agggggtgggaagtctagaatc

SEQ ID NO: 9276853 - DNA, 22 bp, Homo sapiens
agggggtgggaagtctagaatc

SEQ ID NO: 9276854 - DNA, 22 bp, Homo sapiens
agggggtgtctctgattgggtt

SEQ ID NO: 9276855 - DNA, 22 bp, Homo sapiens
agggggtgtctctgattgggtt

SEQ ID NO: 9276856 - DNA, 22 bp, Homo sapiens
agggggtgtctctgattgggtt

SEQ ID NO: 9276857 - DNA, 22 bp, Homo sapiens
agggggtgcatttgtgaatgaa

SEQ ID NO: 9276858 - DNA, 22 bp, Homo sapiens
agggggtgcatttgtgaatgaa

SEQ ID NO: 9276859 - DNA, 22 bp, Homo sapiens
agggggtgcccagatgaaggat

SEQ ID NO: 9276860 - DNA, 22 bp, Homo sapiens
agggggtgcatttgtgaatgaa

SEQ ID NO: 9276861 - DNA, 22 bp, Homo sapiens
agggggtgcatttgtgaatgaa

SEQ ID NO: 9276862 - DNA, 22 bp, Homo sapiens
cctctgtggtctgtctaatgca

SEQ ID NO: 9276863 - DNA, 22 bp, Homo sapiens
cctctgtggtctgtctaatgca

SEQ ID NO: 9276864 - DNA, 22 bp, Homo sapiens
cctctgtgggccgggcctgctg

SEQ ID NO: 9276865 - DNA, 22 bp, Homo sapiens
cctctgtgtcctggtcattgaa

SEQ ID NO: 9276866 - DNA, 22 bp, Homo sapiens
cctctgtgtcagggaagagact

SEQ ID NO: 9276867 - DNA, 22 bp, Homo sapiens
cctctgtgtcagggaagagact

SEQ ID NO: 9276868 - DNA, 22 bp, Homo sapiens
cctctgtgtcctggtcattgaa

SEQ ID NO: 9276869 - DNA, 20 bp, Homo sapiens
cctctgtgtcctgtgtcata

SEQ ID NO: 9276870 - DNA, 20 bp, Homo sapiens
cctctgtgtcctgtgtcata

SEQ ID NO: 9276871 - DNA, 22 bp, Homo sapiens
cctctgtgtgtgcatgcatgcg

SEQ ID NO: 9276872 - DNA, 22 bp, Homo sapiens
cctctgtgtgtgcatgcatgcg

SEQ ID NO: 9276873 - DNA, 22 bp, Homo sapiens
cctctgtgtgatgcgcaaagta

SEQ ID NO: 9276874 - DNA, 22 bp, Homo sapiens
agggggtgaatgtctgtctaca

SEQ ID NO: 9276875 - DNA, 22 bp, Homo sapiens
agggggctcctccggtgcttcc

SEQ ID NO: 9276876 - DNA, 22 bp, Homo sapiens
agggggagcttggctactcctg

SEQ ID NO: 9276877 - DNA, 22 bp, Homo sapiens
aggggctctaaagatcatggaa

SEQ ID NO: 9276878 - DNA, 22 bp, Homo sapiens
aggggctcctttgtgctgcgtc

SEQ ID NO: 9276879 - DNA, 22 bp, Homo sapiens
aggggctcctctctgagagtag

SEQ ID NO: 9276880 - DNA, 22 bp, Homo sapiens
aggggctcctctctgagagtag

SEQ ID NO: 9276881 - DNA, 22 bp, Homo sapiens
cctctgtgggccgggcctgctg

SEQ ID NO: 9276882 - DNA, 22 bp, Homo sapiens
aggggctgactggaaagtgcca

SEQ ID NO: 9276883 - DNA, 22 bp, Homo sapiens
aggggctctgagtgggccagga

SEQ ID NO: 9276884 - DNA, 22 bp, Homo sapiens
aggggctccaaggaagtttggg

SEQ ID NO: 9276885 - DNA, 22 bp, Homo sapiens
aggggctcaagcagtgtggtct

SEQ ID NO: 9276886 - DNA, 22 bp, Homo sapiens
aggggcgtctgtaggcagtggg

SEQ ID NO: 9276887 - DNA, 22 bp, Homo sapiens
aggggctcaaagtgtgcaggga

SEQ ID NO: 9276888 - DNA, 22 bp, Homo sapiens
aggggcgctgcggtcctcagcc

SEQ ID NO: 9276889 - DNA, 22 bp, Homo sapiens
aggggcctggttggcctctgtt

SEQ ID NO: 9276890 - DNA, 18 bp, Homo sapiens
aggggcagcttgtgtgga

SEQ ID NO: 9276891 - DNA, 18 bp, Homo sapiens
aggggcagcttgtgtgga

SEQ ID NO: 9276892 - DNA, 22 bp, Homo sapiens
cctcctggtgacaaggcaaagc

SEQ ID NO: 9276893 - DNA, 22 bp, Homo sapiens
aggggaatgggtagactgttga

SEQ ID NO: 9276894 - DNA, 22 bp, Homo sapiens
cctcctggtgacaaggcaaagc

SEQ ID NO: 9276895 - DNA, 21 bp, Homo sapiens
aggggaagtagagttttgatt

SEQ ID NO: 9276896 - DNA, 22 bp, Homo sapiens
aggggaatgggtagactgttga

SEQ ID NO: 9276897 - DNA, 22 bp, Homo sapiens
aggggaatgggtagactgttga

SEQ ID NO: 9276898 - DNA, 22 bp, Homo sapiens
aggggaagagccctttacatgg

SEQ ID NO: 9276899 - DNA, 22 bp, Homo sapiens
aggggaaatgccttggtggtac

SEQ ID NO: 9276900 - DNA, 22 bp, Homo sapiens
aggggaaggccagcctgtagag

SEQ ID NO: 9276901 - DNA, 22 bp, Homo sapiens
aggggaaggccagcctgtagag

SEQ ID NO: 9276902 - DNA, 22 bp, Homo sapiens
aggggaagattatacttttgaa

SEQ ID NO: 9276903 - DNA, 22 bp, Homo sapiens
aggggaaggccagcctgtagag

SEQ ID NO: 9276904 - DNA, 22 bp, Homo sapiens
cctcctggtgggcgcttctggc

SEQ ID NO: 9276905 - DNA, 22 bp, Homo sapiens
cctccttcctgggacagagctg

SEQ ID NO: 9276906 - DNA, 22 bp, Homo sapiens
cctccttctggggccttctgct

SEQ ID NO: 9276907 - DNA, 22 bp, Homo sapiens
cctccttctggggccttctgct

SEQ ID NO: 9276908 - DNA, 22 bp, Homo sapiens
cctcgacctccccaggctcagg

SEQ ID NO: 9276909 - DNA, 22 bp, Homo sapiens
cctcgacctccccaggctcagg

SEQ ID NO: 9276910 - DNA, 23 bp, Homo sapiens
agcttcgccttcctttctctgca

SEQ ID NO: 9276911 - DNA, 22 bp, Homo sapiens
caggctctgctgctacagctgt

SEQ ID NO: 9276912 - DNA, 21 bp, Homo sapiens
caggctctgctgggtgctggg

SEQ ID NO: 9276913 - DNA, 22 bp, Homo sapiens
caggctctgctgctacagctgt

SEQ ID NO: 9276914 - DNA, 22 bp, Homo sapiens
agcttcctgttgagagagggag

SEQ ID NO: 9276915 - DNA, 22 bp, Homo sapiens
agcttccttgaattctgtagaa

SEQ ID NO: 9276916 - DNA, 22 bp, Homo sapiens
agcttcctgttgagagagggag

SEQ ID NO: 9276917 - DNA, 22 bp, Homo sapiens
agcttccttggcgctgaggcct

SEQ ID NO: 9276918 - DNA, 22 bp, Homo sapiens
agcttcctgtcttctgcacaaa

SEQ ID NO: 9276919 - DNA, 22 bp, Homo sapiens
agcttcctgatgcaagagggct

SEQ ID NO: 9276920 - DNA, 22 bp, Homo sapiens
agcttcctgatgcaagagggct

SEQ ID NO: 9276921 - DNA, 22 bp, Homo sapiens
agcttcctgactggtgctctta

SEQ ID NO: 9276922 - DNA, 21 bp, Homo sapiens
agcttcctgcagtgggaggtc

SEQ ID NO: 9276923 - DNA, 22 bp, Homo sapiens
agcttcccaaggttggaaggtt

SEQ ID NO: 9276924 - DNA, 18 bp, Homo sapiens
agcttccctctgagaggg

SEQ ID NO: 9276925 - DNA, 22 bp, Homo sapiens
agcttcctacaaccatctcaga

SEQ ID NO: 9276926 - DNA, 22 bp, Homo sapiens
agcttcctacaaccatctcaga

SEQ ID NO: 9276927 - DNA, 23 bp, Homo sapiens
agcttcctagtgacctggagtct

SEQ ID NO: 9276928 - DNA, 22 bp, Homo sapiens
agcttcctcacctcagaggtct

SEQ ID NO: 9276929 - DNA, 22 bp, Homo sapiens
agcttcctcacctcagaggtct

SEQ ID NO: 9276930 - DNA, 22 bp, Homo sapiens
agcttcctgactggtgctctta

SEQ ID NO: 9276931 - DNA, 21 bp, Homo sapiens
agcttacattaccattgttgc

SEQ ID NO: 9276932 - DNA, 22 bp, Homo sapiens
agctgtctggaagttcctcatg

SEQ ID NO: 9276933 - DNA, 22 bp, Homo sapiens
agctgtctgtctcctgaggaga

SEQ ID NO: 9276934 - DNA, 22 bp, Homo sapiens
agctgtctttctgcctcctgat

SEQ ID NO: 9276935 - DNA, 22 bp, Homo sapiens
agctgtctttcattacctcatt

SEQ ID NO: 9276936 - DNA, 22 bp, Homo sapiens
caggcccagtgatcagggctct

SEQ ID NO: 9276937 - DNA, 22 bp, Homo sapiens
caggcccagtgatcagggctct

SEQ ID NO: 9276938 - DNA, 22 bp, Homo sapiens
agctgtcctggctcaggctgtg

SEQ ID NO: 9276939 - DNA, 22 bp, Homo sapiens
agctgtcctggctcaggctgtg

SEQ ID NO: 9276940 - DNA, 22 bp, Homo sapiens
agctgtcagtgctgtgcctgta

SEQ ID NO: 9276941 - DNA, 22 bp, Homo sapiens
agctgtctacctgcagagtcct

SEQ ID NO: 9276942 - DNA, 22 bp, Homo sapiens
agctggttgcttaacctctctg

SEQ ID NO: 9276943 - DNA, 22 bp, Homo sapiens
agctggttgacgttatccagga

SEQ ID NO: 9276944 - DNA, 22 bp, Homo sapiens
agctgtaatataagcaatgaaa

SEQ ID NO: 9276945 - DNA, 22 bp, Homo sapiens
agctgtaagctttgggcaagtc

SEQ ID NO: 9276946 - DNA, 22 bp, Homo sapiens
agctgtcaccaggagccggacc

SEQ ID NO: 9276947 - DNA, 22 bp, Homo sapiens
agctgtaatataagcaatgaaa

SEQ ID NO: 9276948 - DNA, 22 bp, Homo sapiens
agctggtggaagggagcccaaa

SEQ ID NO: 9276949 - DNA, 22 bp, Homo sapiens
agctggtggagaagcagacctc

SEQ ID NO: 9276950 - DNA, 22 bp, Homo sapiens
agctggttcattcattcatggt

SEQ ID NO: 9276951 - DNA, 22 bp, Homo sapiens
agctggtggaagggagcccaaa

SEQ ID NO: 9276952 - DNA, 22 bp, Homo sapiens
caggcagtgtcccaggaagcca

SEQ ID NO: 9276953 - DNA, 22 bp, Homo sapiens
caggcaggtgcagattcctctt

SEQ ID NO: 9276954 - DNA, 22 bp, Homo sapiens
caggcaggtgcagattcctctt

SEQ ID NO: 9276955 - DNA, 22 bp, Homo sapiens
caggcagcgtcctgcttcctgt

SEQ ID NO: 9276956 - DNA, 22 bp, Homo sapiens
caggcagcgctcgtggcctggc

SEQ ID NO: 9276957 - DNA, 22 bp, Homo sapiens
caggcagcgtcctgcttcctgt

SEQ ID NO: 9276958 - DNA, 22 bp, Homo sapiens
caggcagcgctcgtggcctggc

SEQ ID NO: 9276959 - DNA, 22 bp, Homo sapiens
caggcagcgctcgtggcctggc

SEQ ID NO: 9276960 - DNA, 22 bp, Homo sapiens
caggcagcctgcggtctgcaca

SEQ ID NO: 9276961 - DNA, 22 bp, Homo sapiens
caggcagcctgcggtctgcaca

SEQ ID NO: 9276962 - DNA, 22 bp, Homo sapiens
caggcagctagatttataacaa

SEQ ID NO: 9276963 - DNA, 22 bp, Homo sapiens
caggcagctcaaccttgggagc

SEQ ID NO: 9276964 - DNA, 22 bp, Homo sapiens
caggcagctcgatgccttgttg

SEQ ID NO: 9276965 - DNA, 18 bp, Homo sapiens
caggagcaggagttgaac

SEQ ID NO: 9276966 - DNA, 22 bp, Homo sapiens
caggagcagagggtggtcagca

SEQ ID NO: 9276967 - DNA, 22 bp, Homo sapiens
caggagcccagagtcctcagct

SEQ ID NO: 9276968 - DNA, 22 bp, Homo sapiens
caggagtgaaatgaggcccagg

SEQ ID NO: 9276969 - DNA, 22 bp, Homo sapiens
caggatggccccggggctgtgc

SEQ ID NO: 9276970 - DNA, 22 bp, Homo sapiens
caggatggccccggggctgtgc

SEQ ID NO: 9276971 - DNA, 22 bp, Homo sapiens
caggatggagggagggctgtta

SEQ ID NO: 9276972 - DNA, 22 bp, Homo sapiens
caggatggagggagggctgtta

SEQ ID NO: 9276973 - DNA, 22 bp, Homo sapiens
caggcacacagcacatggcctg

SEQ ID NO: 9276974 - DNA, 22 bp, Homo sapiens
caggcacacatccgtgagagat

SEQ ID NO: 9276975 - DNA, 22 bp, Homo sapiens
caggcacacatccgtgagagat

SEQ ID NO: 9276976 - DNA, 20 bp, Homo sapiens
caggcacactcattcctgct

SEQ ID NO: 9276977 - DNA, 20 bp, Homo sapiens
caggcacactcattcctgct

SEQ ID NO: 9276978 - DNA, 22 bp, Homo sapiens
caggatggtcagatgcattgtc

SEQ ID NO: 9276979 - DNA, 22 bp, Homo sapiens
caggatgggatgtagtgggccc

SEQ ID NO: 9276980 - DNA, 22 bp, Homo sapiens
caggatgggatgtagtgggccc

SEQ ID NO: 9276981 - DNA, 22 bp, Homo sapiens
caggatgggatgtagtgggccc

SEQ ID NO: 9276982 - DNA, 22 bp, Homo sapiens
cagctgttcttgggacagacag

SEQ ID NO: 9276983 - DNA, 22 bp, Homo sapiens
cagctgttgactggtacatgaa

SEQ ID NO: 9276984 - DNA, 22 bp, Homo sapiens
cagctgttgactggtacatgaa

SEQ ID NO: 9276985 - DNA, 22 bp, Homo sapiens
cagctgttcttgggacagacag

SEQ ID NO: 9276986 - DNA, 20 bp, Homo sapiens
caggacagcgcaatcggagg

SEQ ID NO: 9276987 - DNA, 22 bp, Homo sapiens
cagctgttgcagcactgagaga

SEQ ID NO: 9276988 - DNA, 22 bp, Homo sapiens
cagctgttgatctcttaagcct

SEQ ID NO: 9276989 - DNA, 22 bp, Homo sapiens
caggaccccatattcactgaac

SEQ ID NO: 9276990 - DNA, 22 bp, Homo sapiens
caggacctaactcacctgtctc

SEQ ID NO: 9276991 - DNA, 22 bp, Homo sapiens
caggacctggaatgcttgtgaa

SEQ ID NO: 9276992 - DNA, 22 bp, Homo sapiens
caggagaaacataattttctgg

SEQ ID NO: 9276993 - DNA, 22 bp, Homo sapiens
caggagcaaggagcagtgggat

SEQ ID NO: 9276994 - DNA, 22 bp, Homo sapiens
caggagaaggtttggagtgcag

SEQ ID NO: 9276995 - DNA, 22 bp, Homo sapiens
caggactggctcgcagtgggtg

SEQ ID NO: 9276996 - DNA, 22 bp, Homo sapiens
caggactgatgttcctccagcc

SEQ ID NO: 9276997 - DNA, 22 bp, Homo sapiens
caggactgaagggcacagggaa

SEQ ID NO: 9276998 - DNA, 22 bp, Homo sapiens
cagctgttcacatttccaaaac

SEQ ID NO: 9276999 - DNA, 22 bp, Homo sapiens
cagctgttatgaggtgtacatg

SEQ ID NO: 9277000 - DNA, 22 bp, Homo sapiens
cagctgttcacatttccaaaac

SEQ ID NO: 9277001 - DNA, 22 bp, Homo sapiens
cagctgttactctgagtaaatg

SEQ ID NO: 9277002 - DNA, 22 bp, Homo sapiens
cagctgttactgaagtaaaatg

SEQ ID NO: 9277003 - DNA, 22 bp, Homo sapiens
cagctgttcggggctggcatgt

SEQ ID NO: 9277004 - DNA, 22 bp, Homo sapiens
cagctgttcctggaaggagacc

SEQ ID NO: 9277005 - DNA, 22 bp, Homo sapiens
cagctgttcctggaaggagacc

SEQ ID NO: 9277006 - DNA, 22 bp, Homo sapiens
cagctgttcattgttgccaccc

SEQ ID NO: 9277007 - DNA, 22 bp, Homo sapiens
cagctgttcagcaactcgcaga

SEQ ID NO: 9277008 - DNA, 22 bp, Homo sapiens
cagctgttactctgagtaaatg

SEQ ID NO: 9277009 - DNA, 22 bp, Homo sapiens
cagctgtgtatgagagcatgct

SEQ ID NO: 9277010 - DNA, 22 bp, Homo sapiens
cagctgtgtatgagagcatgct

SEQ ID NO: 9277011 - DNA, 22 bp, Homo sapiens
cagctgtccaaacacattaact

SEQ ID NO: 9277012 - DNA, 22 bp, Homo sapiens
cagctgggtttagtggggtgtg

SEQ ID NO: 9277013 - DNA, 22 bp, Homo sapiens
cagctggtcaactgaatgaaca

SEQ ID NO: 9277014 - DNA, 23 bp, Homo sapiens
cagctggttgtgggagtggctgc

SEQ ID NO: 9277015 - DNA, 22 bp, Homo sapiens
cagctggttggaagggagctga

SEQ ID NO: 9277016 - DNA, 22 bp, Homo sapiens
cagctggttggaagggagctga

SEQ ID NO: 9277017 - DNA, 22 bp, Homo sapiens
cagctggtgtccagggaagtgg

SEQ ID NO: 9277018 - DNA, 22 bp, Homo sapiens
cagctggtgtccagggaagtgg

SEQ ID NO: 9277019 - DNA, 23 bp, Homo sapiens
cagggctgggcttggtgttaggc

SEQ ID NO: 9277020 - DNA, 22 bp, Homo sapiens
cagggctgggttaaaagcaggg

SEQ ID NO: 9277021 - DNA, 22 bp, Homo sapiens
cagggctggcttccaagttgtt

SEQ ID NO: 9277022 - DNA, 22 bp, Homo sapiens
aggaaaggattggcttctctgt

SEQ ID NO: 9277023 - DNA, 19 bp, Homo sapiens
aggaaaggatcaaaatagc

SEQ ID NO: 9277024 - DNA, 22 bp, Homo sapiens
aggaaaggattggcttctctgt

SEQ ID NO: 9277025 - DNA, 22 bp, Homo sapiens
aggaaaggattggcttctctgt

SEQ ID NO: 9277026 - DNA, 19 bp, Homo sapiens
aggaaaggatcaaaatagc

SEQ ID NO: 9277027 - DNA, 22 bp, Homo sapiens
cagggctgggttaaaagcaggg

SEQ ID NO: 9277028 - DNA, 22 bp, Homo sapiens
aggaagaaacctactagagttt

SEQ ID NO: 9277029 - DNA, 22 bp, Homo sapiens
aggaagaaaactaattagatgg

SEQ ID NO: 9277030 - DNA, 22 bp, Homo sapiens
aggaaaggcctttgcatttggt

SEQ ID NO: 9277031 - DNA, 22 bp, Homo sapiens
aggaaaggcctttgcatttggt

SEQ ID NO: 9277032 - DNA, 21 bp, Homo sapiens
aggaaaggccagcacgtaggg

SEQ ID NO: 9277033 - DNA, 21 bp, Homo sapiens
aggaaaggccagcacgtaggg

SEQ ID NO: 9277034 - DNA, 22 bp, Homo sapiens
aggaaaggcctcagcagaaacc

SEQ ID NO: 9277035 - DNA, 22 bp, Homo sapiens
aggaaaggcctcagcagaaacc

SEQ ID NO: 9277036 - DNA, 18 bp, Homo sapiens
cagggctgtggggtcact

SEQ ID NO: 9277037 - DNA, 22 bp, Homo sapiens
cagggctgttagctgctgctct

SEQ ID NO: 9277038 - DNA, 18 bp, Homo sapiens
cagggctgtggggtcact

SEQ ID NO: 9277039 - DNA, 22 bp, Homo sapiens
aggaagagcccgggtgacataa

SEQ ID NO: 9277040 - DNA, 22 bp, Homo sapiens
aggaagagcccgggtgacataa

SEQ ID NO: 9277041 - DNA, 22 bp, Homo sapiens
aggaagagcccgggtgacataa

SEQ ID NO: 9277042 - DNA, 22 bp, Homo sapiens
aggaagagctggaccagaggac

SEQ ID NO: 9277043 - DNA, 22 bp, Homo sapiens
aggaagagctggaccagaggac

SEQ ID NO: 9277044 - DNA, 22 bp, Homo sapiens
aggaagagctggaccagaggac

SEQ ID NO: 9277045 - DNA, 22 bp, Homo sapiens
aggaagagctggaccagaggac

SEQ ID NO: 9277046 - DNA, 22 bp, Homo sapiens
caggctgaagtgcagtggtgtg

SEQ ID NO: 9277047 - DNA, 22 bp, Homo sapiens
caggctgaagtgcagtggtgtg

SEQ ID NO: 9277048 - DNA, 22 bp, Homo sapiens
caggctcttccatcctgctgag

SEQ ID NO: 9277049 - DNA, 22 bp, Homo sapiens
cagggcaggatgctgtgattat

SEQ ID NO: 9277050 - DNA, 22 bp, Homo sapiens
cagggcaggatgctgtgattat

SEQ ID NO: 9277051 - DNA, 22 bp, Homo sapiens
cagggattcagctgaaggaggc

SEQ ID NO: 9277052 - DNA, 22 bp, Homo sapiens
caggctgacaactgagcatttt

SEQ ID NO: 9277053 - DNA, 22 bp, Homo sapiens
cagggcagtaacgggaacatct

SEQ ID NO: 9277054 - DNA, 22 bp, Homo sapiens
cagggcagtaacgggaacatct

SEQ ID NO: 9277055 - DNA, 22 bp, Homo sapiens
cagggcagggatgttgcggcag

SEQ ID NO: 9277056 - DNA, 22 bp, Homo sapiens
cagggcagggagcttagaatga

SEQ ID NO: 9277057 - DNA, 22 bp, Homo sapiens
agctttgaaaatccaaattaca

SEQ ID NO: 9277058 - DNA, 22 bp, Homo sapiens
agctttgaagtatttggtctcc

SEQ ID NO: 9277059 - DNA, 22 bp, Homo sapiens
agctttgaatctggtgtttgca

SEQ ID NO: 9277060 - DNA, 22 bp, Homo sapiens
agctttgaatcctggctctgtc

SEQ ID NO: 9277061 - DNA, 22 bp, Homo sapiens
agctttggagctgggtgaaaga

SEQ ID NO: 9277062 - DNA, 23 bp, Homo sapiens
agctttgaggactttaaaagata

SEQ ID NO: 9277063 - DNA, 22 bp, Homo sapiens
agctttgaatgagtgcattgca

SEQ ID NO: 9277064 - DNA, 22 bp, Homo sapiens
agctttgggattcaggcaggaa

SEQ ID NO: 9277065 - DNA, 22 bp, Homo sapiens
agctttgggattcaggcaggaa

SEQ ID NO: 9277066 - DNA, 22 bp, Homo sapiens
agctttggccctggaggttact

SEQ ID NO: 9277067 - DNA, 22 bp, Homo sapiens
agctttgggcagaagaggattc

SEQ ID NO: 9277068 - DNA, 22 bp, Homo sapiens
agctttgggattcaggcaggaa

SEQ ID NO: 9277069 - DNA, 22 bp, Homo sapiens
cagggctggctgtggcaatctc

SEQ ID NO: 9277070 - DNA, 22 bp, Homo sapiens
cagggctggctgtggcaatctc

SEQ ID NO: 9277071 - DNA, 22 bp, Homo sapiens
cagggctggctgtggcaatctc

SEQ ID NO: 9277072 - DNA, 22 bp, Homo sapiens
cagggctggctcatgaaaagtt

SEQ ID NO: 9277073 - DNA, 22 bp, Homo sapiens
cagggctggctcatgaaaagtt

SEQ ID NO: 9277074 - DNA, 22 bp, Homo sapiens
cagtatgtgatgcaacggaata

SEQ ID NO: 9277075 - DNA, 22 bp, Homo sapiens
cagtatgtctactggacaaagt

SEQ ID NO: 9277076 - DNA, 22 bp, Homo sapiens
cagtatgactacaaacagcttt

SEQ ID NO: 9277077 - DNA, 22 bp, Homo sapiens
cagtatgagagttgaatcaagg

SEQ ID NO: 9277078 - DNA, 22 bp, Homo sapiens
cagtatgtttgggagacatgac

SEQ ID NO: 9277079 - DNA, 20 bp, Homo sapiens
cagtattgatccattgtctg

SEQ ID NO: 9277080 - DNA, 22 bp, Homo sapiens
cagtatttgttccctatcaatg

SEQ ID NO: 9277081 - DNA, 22 bp, Homo sapiens
cagtatttggtaattggctacc

SEQ ID NO: 9277082 - DNA, 22 bp, Homo sapiens
cagtatttggtaattggctacc

SEQ ID NO: 9277083 - DNA, 22 bp, Homo sapiens
aggacagagggaccagagccca

SEQ ID NO: 9277084 - DNA, 22 bp, Homo sapiens
cagtaacaggctctgtggtata

SEQ ID NO: 9277085 - DNA, 22 bp, Homo sapiens
cagtaacagtgatcacctgtgg

SEQ ID NO: 9277086 - DNA, 22 bp, Homo sapiens
cagtaacatgaagagacatgga

SEQ ID NO: 9277087 - DNA, 22 bp, Homo sapiens
cagtaacatgtctgttaagaaa

SEQ ID NO: 9277088 - DNA, 22 bp, Homo sapiens
cagtaacatgtctgttaagaaa

SEQ ID NO: 9277089 - DNA, 22 bp, Homo sapiens
cagtaacatttcaaggtagagg

SEQ ID NO: 9277090 - DNA, 22 bp, Homo sapiens
cagtaacatttcaaggtagagg

SEQ ID NO: 9277091 - DNA, 22 bp, Homo sapiens
cagtaaatggtacgtatatttt

SEQ ID NO: 9277092 - DNA, 22 bp, Homo sapiens
cagggcttcgctcctggtgcac

SEQ ID NO: 9277093 - DNA, 22 bp, Homo sapiens
cagggcttcgctcctggtgcac

SEQ ID NO: 9277094 - DNA, 22 bp, Homo sapiens
cagggcttcgtgtctcagtgct

SEQ ID NO: 9277095 - DNA, 22 bp, Homo sapiens
caggtggttatgaggaaggtga

SEQ ID NO: 9277096 - DNA, 22 bp, Homo sapiens
caggtgggattttgctgcttga

SEQ ID NO: 9277097 - DNA, 22 bp, Homo sapiens
caggtgtctaattctcaccccc

SEQ ID NO: 9277098 - DNA, 22 bp, Homo sapiens
aggaagtgaaagggaaggagtt

SEQ ID NO: 9277099 - DNA, 21 bp, Homo sapiens
aggaagtggccagattgggaa

SEQ ID NO: 9277100 - DNA, 21 bp, Homo sapiens
aggaagtggccagattgggaa

SEQ ID NO: 9277101 - DNA, 22 bp, Homo sapiens
aggaagtgctaagagaacatca

SEQ ID NO: 9277102 - DNA, 22 bp, Homo sapiens
caggtggttgagagctgtaggc

SEQ ID NO: 9277103 - DNA, 22 bp, Homo sapiens
caggtggttgtttggattctaa

SEQ ID NO: 9277104 - DNA, 22 bp, Homo sapiens
caggtgtcaaaatactaagtgg

SEQ ID NO: 9277105 - DNA, 22 bp, Homo sapiens
caggtgtacacattgtgtttat

SEQ ID NO: 9277106 - DNA, 22 bp, Homo sapiens
aggaatcaggagatgagcacgg

SEQ ID NO: 9277107 - DNA, 22 bp, Homo sapiens
aggaatatgagctgctgcagtg

SEQ ID NO: 9277108 - DNA, 22 bp, Homo sapiens
aggaataacctcattgcttttt

SEQ ID NO: 9277109 - DNA, 22 bp, Homo sapiens
aggaataacctcattgcttttt

SEQ ID NO: 9277110 - DNA, 18 bp, Homo sapiens
aggcaggatcctggcctc

SEQ ID NO: 9277111 - DNA, 18 bp, Homo sapiens
aggcaggatcctggcctc

SEQ ID NO: 9277112 - DNA, 22 bp, Homo sapiens
aggcaggaggatcatggatgca

SEQ ID NO: 9277113 - DNA, 22 bp, Homo sapiens
aggcaggagtgaccctgacagg

SEQ ID NO: 9277114 - DNA, 22 bp, Homo sapiens
aggcaggaggatcatggatgca

SEQ ID NO: 9277115 - DNA, 17 bp, Homo sapiens
aggcaggagattggaga

SEQ ID NO: 9277116 - DNA, 22 bp, Homo sapiens
aggcaggaaccctgtgtgcgcc

SEQ ID NO: 9277117 - DNA, 23 bp, Homo sapiens
ccacagagctgccaattcctgtg

SEQ ID NO: 9277118 - DNA, 22 bp, Homo sapiens
ccacagagcattagatttcaga

SEQ ID NO: 9277119 - DNA, 22 bp, Homo sapiens
ccacagagcattagatttcaga

SEQ ID NO: 9277120 - DNA, 22 bp, Homo sapiens
ccacagagagtgtcagcctttg

SEQ ID NO: 9277121 - DNA, 22 bp, Homo sapiens
ccacagaatgatgacacttcag

SEQ ID NO: 9277122 - DNA, 22 bp, Homo sapiens
ccacagaccttggcttccacct

SEQ ID NO: 9277123 - DNA, 22 bp, Homo sapiens
ccacagagacagggtccttgct

SEQ ID NO: 9277124 - DNA, 22 bp, Homo sapiens
ccacagagacagggtccttgct

SEQ ID NO: 9277125 - DNA, 22 bp, Homo sapiens
ccacagagacagagcccagggt

SEQ ID NO: 9277126 - DNA, 22 bp, Homo sapiens
catttgaaacctggaatctacc

SEQ ID NO: 9277127 - DNA, 22 bp, Homo sapiens
ccaatgaaaggtcaattctata

SEQ ID NO: 9277128 - DNA, 22 bp, Homo sapiens
catttctgttctcttcctgtac

SEQ ID NO: 9277129 - DNA, 23 bp, Homo sapiens
catttctgggagatttataaaat

SEQ ID NO: 9277130 - DNA, 22 bp, Homo sapiens
catttctgggagacatgctaga

SEQ ID NO: 9277131 - DNA, 22 bp, Homo sapiens
catttctgcagaattgctcttc

SEQ ID NO: 9277132 - DNA, 22 bp, Homo sapiens
catttctgttctcttcctgtac

SEQ ID NO: 9277133 - DNA, 22 bp, Homo sapiens
catttctgtgacacttccatct

SEQ ID NO: 9277134 - DNA, 22 bp, Homo sapiens
catttctgtcacgttcttttat

SEQ ID NO: 9277135 - DNA, 22 bp, Homo sapiens
ccaccaggcactcacagggaag

SEQ ID NO: 9277136 - DNA, 21 bp, Homo sapiens
ccaccaggtcttctgctcggg

SEQ ID NO: 9277137 - DNA, 22 bp, Homo sapiens
ccaccatgggaagagagactaa

SEQ ID NO: 9277138 - DNA, 22 bp, Homo sapiens
ccacccacaaccagctggctgt

SEQ ID NO: 9277139 - DNA, 22 bp, Homo sapiens
ccacagtgggcacagcaggact

SEQ ID NO: 9277140 - DNA, 20 bp, Homo sapiens
ccacagtggagactggagac

SEQ ID NO: 9277141 - DNA, 22 bp, Homo sapiens
ccacagtggttgtggcatgtgg

SEQ ID NO: 9277142 - DNA, 22 bp, Homo sapiens
ccacccagccagatgcaggaag

SEQ ID NO: 9277143 - DNA, 22 bp, Homo sapiens
ccacccagccagatgcaggaag

SEQ ID NO: 9277144 - DNA, 22 bp, Homo sapiens
ccacccagccagatgcaggaag

SEQ ID NO: 9277145 - DNA, 22 bp, Homo sapiens
ccacccagccagatgcaggaag

SEQ ID NO: 9277146 - DNA, 22 bp, Homo sapiens
ccacctgtgcttggtactccat

SEQ ID NO: 9277147 - DNA, 22 bp, Homo sapiens
ccacccagaccagggatctggg

SEQ ID NO: 9277148 - DNA, 22 bp, Homo sapiens
ccacccagaccagggatctggg

SEQ ID NO: 9277149 - DNA, 22 bp, Homo sapiens
ccacccagaccagggatctggg

SEQ ID NO: 9277150 - DNA, 22 bp, Homo sapiens
ccacccagaccagggatctggg

SEQ ID NO: 9277151 - DNA, 22 bp, Homo sapiens
ccacccagccagatgcaggaag

SEQ ID NO: 9277152 - DNA, 22 bp, Homo sapiens
ccacccagcagaggaggcaaga

SEQ ID NO: 9277153 - DNA, 22 bp, Homo sapiens
ccacccagcagaggaggcaaga

SEQ ID NO: 9277154 - DNA, 22 bp, Homo sapiens
ccacccagcagaggaggcaaga

SEQ ID NO: 9277155 - DNA, 22 bp, Homo sapiens
ccactcaggcctcctgctctcc

SEQ ID NO: 9277156 - DNA, 22 bp, Homo sapiens
ccactagtttaataccttcctt

SEQ ID NO: 9277157 - DNA, 23 bp, Homo sapiens
ccactagcacctgttcaacttct

SEQ ID NO: 9277158 - DNA, 22 bp, Homo sapiens
ccacgtccagctaattttcgta

SEQ ID NO: 9277159 - DNA, 23 bp, Homo sapiens
ccacgtctgcactgtagctgttg

SEQ ID NO: 9277160 - DNA, 22 bp, Homo sapiens
cattggcacaagtagcttcatc

SEQ ID NO: 9277161 - DNA, 20 bp, Homo sapiens
cattggcattcacagaagct

SEQ ID NO: 9277162 - DNA, 22 bp, Homo sapiens
cattggcacctcacaggataga

SEQ ID NO: 9277163 - DNA, 21 bp, Homo sapiens
aggcactgtttgtggtttggg

SEQ ID NO: 9277164 - DNA, 21 bp, Homo sapiens
aggcactgtttgtggtttggg

SEQ ID NO: 9277165 - DNA, 22 bp, Homo sapiens
aggcactgttcccagttatcct

SEQ ID NO: 9277166 - DNA, 20 bp, Homo sapiens
aggcactgttgtctgtatcc

SEQ ID NO: 9277167 - DNA, 21 bp, Homo sapiens
catttcaaagagctggaaatc

SEQ ID NO: 9277168 - DNA, 22 bp, Homo sapiens
catttcaaaagaattgccagaa

SEQ ID NO: 9277169 - DNA, 22 bp, Homo sapiens
catttattggttaggccagcag

SEQ ID NO: 9277170 - DNA, 22 bp, Homo sapiens
catttctcataatattagcact

SEQ ID NO: 9277171 - DNA, 22 bp, Homo sapiens
catttctccgccgagatcactg

SEQ ID NO: 9277172 - DNA, 22 bp, Homo sapiens
catttctccgccgagatcactg

SEQ ID NO: 9277173 - DNA, 22 bp, Homo sapiens
catttctcctgggtgataaatt

SEQ ID NO: 9277174 - DNA, 22 bp, Homo sapiens
catttcaatacagtttgtaaat

SEQ ID NO: 9277175 - DNA, 22 bp, Homo sapiens
catttcaatgccttcaacatag

SEQ ID NO: 9277176 - DNA, 22 bp, Homo sapiens
catttcaatacagtttgtaaat

SEQ ID NO: 9277177 - DNA, 22 bp, Homo sapiens
catttcaattatttgctcttct

SEQ ID NO: 9277178 - DNA, 22 bp, Homo sapiens
catttcaatgccttcaacatag

SEQ ID NO: 9277179 - DNA, 22 bp, Homo sapiens
cattgctttgtgcatatttaaa

SEQ ID NO: 9277180 - DNA, 22 bp, Homo sapiens
cattgcttgatagctgaaaatt

SEQ ID NO: 9277181 - DNA, 22 bp, Homo sapiens
cattgcttatctagttcacata

SEQ ID NO: 9277182 - DNA, 19 bp, Homo sapiens
cattcctttgtctgccaaa

SEQ ID NO: 9277183 - DNA, 22 bp, Homo sapiens
cattgcaggagagtaaataaaa

SEQ ID NO: 9277184 - DNA, 22 bp, Homo sapiens
cattgcctcggagcctgttatg

SEQ ID NO: 9277185 - DNA, 22 bp, Homo sapiens
cattgcagtaatctggtgaaat

SEQ ID NO: 9277186 - DNA, 22 bp, Homo sapiens
cattgcagtaatctggtgaaat

SEQ ID NO: 9277187 - DNA, 22 bp, Homo sapiens
aggcaagtgcattagaagagca

SEQ ID NO: 9277188 - DNA, 22 bp, Homo sapiens
aggcaaggtgctcttgctctat

SEQ ID NO: 9277189 - DNA, 22 bp, Homo sapiens
aggcaaggtgctacagacagtg

SEQ ID NO: 9277190 - DNA, 22 bp, Homo sapiens
cattccttaacgtggggagtct

SEQ ID NO: 9277191 - DNA, 22 bp, Homo sapiens
cattccttaacgtggggagtct

SEQ ID NO: 9277192 - DNA, 17 bp, Homo sapiens
aggcaatgactgtggtt

SEQ ID NO: 9277193 - DNA, 22 bp, Homo sapiens
aggcaatcctcttacagatggg

SEQ ID NO: 9277194 - DNA, 17 bp, Homo sapiens
aggcaatgactgtggtt

SEQ ID NO: 9277195 - DNA, 22 bp, Homo sapiens
aggcaatcccctgaggatactt

SEQ ID NO: 9277196 - DNA, 22 bp, Homo sapiens
aggattttgacttattcaggga

SEQ ID NO: 9277197 - DNA, 20 bp, Homo sapiens
aggcaaggtagatgtctgct

SEQ ID NO: 9277198 - DNA, 22 bp, Homo sapiens
aggcaaggtgctacagacagtg

SEQ ID NO: 9277199 - DNA, 22 bp, Homo sapiens
aggcaagggggcgccaccttcc

SEQ ID NO: 9277200 - DNA, 22 bp, Homo sapiens
aggcaagcattgggaacagggc

SEQ ID NO: 9277201 - DNA, 22 bp, Homo sapiens
cagtgtggtgagattccaggtg

SEQ ID NO: 9277202 - DNA, 22 bp, Homo sapiens
cagtgtggtgagattccaggtg

SEQ ID NO: 9277203 - DNA, 21 bp, Homo sapiens
cagtgtggtgaccagggtctc

SEQ ID NO: 9277204 - DNA, 21 bp, Homo sapiens
cagtgtggtgaccagggtctc

SEQ ID NO: 9277205 - DNA, 22 bp, Homo sapiens
cagtgtgtggatcctcccagga

SEQ ID NO: 9277206 - DNA, 22 bp, Homo sapiens
cagtgtggtgtgcacagcttag

SEQ ID NO: 9277207 - DNA, 22 bp, Homo sapiens
cagtgttccctgaacatatgtt

SEQ ID NO: 9277208 - DNA, 22 bp, Homo sapiens
aggagccaggaaacctgctctg

SEQ ID NO: 9277209 - DNA, 22 bp, Homo sapiens
aggagccaggccccatggggct

SEQ ID NO: 9277210 - DNA, 23 bp, Homo sapiens
aggagccaggtgcagcccttgtg

SEQ ID NO: 9277211 - DNA, 22 bp, Homo sapiens
aggagccagattctctcacttt

SEQ ID NO: 9277212 - DNA, 22 bp, Homo sapiens
cagtgtggagggagagagcctg

SEQ ID NO: 9277213 - DNA, 22 bp, Homo sapiens
cagtgtggagggagagagcctg

SEQ ID NO: 9277214 - DNA, 22 bp, Homo sapiens
cagtgtggcttagggaataggc

SEQ ID NO: 9277215 - DNA, 22 bp, Homo sapiens
cagtgtggctgagacagaggct

SEQ ID NO: 9277216 - DNA, 22 bp, Homo sapiens
cagtgtggctgagacagaggct

SEQ ID NO: 9277217 - DNA, 22 bp, Homo sapiens
cagtgtggctgagacagaggct

SEQ ID NO: 9277218 - DNA, 22 bp, Homo sapiens
cagtgtgggtttgggaggagta

SEQ ID NO: 9277219 - DNA, 22 bp, Homo sapiens
cagtgtggcttagggaataggc

SEQ ID NO: 9277220 - DNA, 22 bp, Homo sapiens
cagtgtgggtgaaatacaaagt

SEQ ID NO: 9277221 - DNA, 20 bp, Homo sapiens
cagtccaggctgcagcatct

SEQ ID NO: 9277222 - DNA, 22 bp, Homo sapiens
cagtccagtccaatcctcaatg

SEQ ID NO: 9277223 - DNA, 22 bp, Homo sapiens
cagtccagctcatcagtggcac

SEQ ID NO: 9277224 - DNA, 22 bp, Homo sapiens
cagtccaggcctggaggagcca

SEQ ID NO: 9277225 - DNA, 22 bp, Homo sapiens
cagtccaggcctggaggagcca

SEQ ID NO: 9277226 - DNA, 22 bp, Homo sapiens
cagtccaggcctggaggagcca

SEQ ID NO: 9277227 - DNA, 22 bp, Homo sapiens
cagtccagagcccaccagagga

SEQ ID NO: 9277228 - DNA, 22 bp, Homo sapiens
cagtccagccagtagggtgtgg

SEQ ID NO: 9277229 - DNA, 22 bp, Homo sapiens
cataacatccttgctactttga

SEQ ID NO: 9277230 - DNA, 22 bp, Homo sapiens
cataacatgtacatataaatgc

SEQ ID NO: 9277231 - DNA, 22 bp, Homo sapiens
cataacatgtacatataaatgc

SEQ ID NO: 9277232 - DNA, 22 bp, Homo sapiens
cataacatgtacatataaatgc

SEQ ID NO: 9277233 - DNA, 22 bp, Homo sapiens
cataacattaagcctctatttc

SEQ ID NO: 9277234 - DNA, 22 bp, Homo sapiens
cataacatgtacatataaatgc

SEQ ID NO: 9277235 - DNA, 22 bp, Homo sapiens
cataacatgtacatataaatgc

SEQ ID NO: 9277236 - DNA, 22 bp, Homo sapiens
cataacatgtacatataaatgc

SEQ ID NO: 9277237 - DNA, 22 bp, Homo sapiens
cataacattaagcctctatttc

SEQ ID NO: 9277238 - DNA, 22 bp, Homo sapiens
cataacattattttctgaagat

SEQ ID NO: 9277239 - DNA, 22 bp, Homo sapiens
cagttttatgtcgaatgtatac

SEQ ID NO: 9277240 - DNA, 22 bp, Homo sapiens
cagttttattggttgaaatctg

SEQ ID NO: 9277241 - DNA, 22 bp, Homo sapiens
cataacttggtgttggaaactg

SEQ ID NO: 9277242 - DNA, 22 bp, Homo sapiens
cataactttaaagacagtgtgg

SEQ ID NO: 9277243 - DNA, 22 bp, Homo sapiens
cataacttgctttggagcccgg

SEQ ID NO: 9277244 - DNA, 22 bp, Homo sapiens
cataactgttaagataattttt

SEQ ID NO: 9277245 - DNA, 22 bp, Homo sapiens
cataactggggacacttctcta

SEQ ID NO: 9277246 - DNA, 22 bp, Homo sapiens
cataactgggagatccaagggt

SEQ ID NO: 9277247 - DNA, 22 bp, Homo sapiens
cataactagagtgaaatgttga

SEQ ID NO: 9277248 - DNA, 22 bp, Homo sapiens
aggagctgtcagagtgccagag

SEQ ID NO: 9277249 - DNA, 22 bp, Homo sapiens
aggagctgtcagagtgccagag

SEQ ID NO: 9277250 - DNA, 22 bp, Homo sapiens
aggagctgtgaatgggaggggt

SEQ ID NO: 9277251 - DNA, 22 bp, Homo sapiens
aggagctgtcagagtgccagag

SEQ ID NO: 9277252 - DNA, 22 bp, Homo sapiens
aggagctgggttcctttggtgg

SEQ ID NO: 9277253 - DNA, 23 bp, Homo sapiens
aggaggcctgaaactgaggctga

SEQ ID NO: 9277254 - DNA, 23 bp, Homo sapiens
aggaggcctgaaactgaggctga

SEQ ID NO: 9277255 - DNA, 22 bp, Homo sapiens
aggaggcctctatccagagaga

SEQ ID NO: 9277256 - DNA, 22 bp, Homo sapiens
aggaggccgggattctggagat

SEQ ID NO: 9277257 - DNA, 22 bp, Homo sapiens
aggaggccgctgatgggctccc

SEQ ID NO: 9277258 - DNA, 20 bp, Homo sapiens
aggaggcctgcagatagttc

SEQ ID NO: 9277259 - DNA, 20 bp, Homo sapiens
aggaggcctgcagatagttc

SEQ ID NO: 9277260 - DNA, 22 bp, Homo sapiens
aggaggctctcaggtcctcccc

SEQ ID NO: 9277261 - DNA, 22 bp, Homo sapiens
aggaggctgaactagggtctgg

SEQ ID NO: 9277262 - DNA, 22 bp, Homo sapiens
catacaaatgtgtccaggctct

SEQ ID NO: 9277263 - DNA, 22 bp, Homo sapiens
catacaatcaagttctttatta

SEQ ID NO: 9277264 - DNA, 22 bp, Homo sapiens
catacaatcaagttctttatta

SEQ ID NO: 9277265 - DNA, 22 bp, Homo sapiens
catacagtgtggcatgtagtct

SEQ ID NO: 9277266 - DNA, 22 bp, Homo sapiens
catacagttttccctagatgtg

SEQ ID NO: 9277267 - DNA, 22 bp, Homo sapiens
catacagtcactgtggtaccac

SEQ ID NO: 9277268 - DNA, 22 bp, Homo sapiens
catacagttttccctagatgtg

SEQ ID NO: 9277269 - DNA, 22 bp, Homo sapiens
catacataccactgctgtcttt

SEQ ID NO: 9277270 - DNA, 22 bp, Homo sapiens
catacatactgagtggactgat

SEQ ID NO: 9277271 - DNA, 22 bp, Homo sapiens
catacatatgcatgtgtgtata

SEQ ID NO: 9277272 - DNA, 22 bp, Homo sapiens
catcttcaccagagacaagcaa

SEQ ID NO: 9277273 - DNA, 22 bp, Homo sapiens
catcttacccctgctaatgacc

SEQ ID NO: 9277274 - DNA, 21 bp, Homo sapiens
catcttaggttgtacatatat

SEQ ID NO: 9277275 - DNA, 22 bp, Homo sapiens
catctctgagacctcagctggg

SEQ ID NO: 9277276 - DNA, 22 bp, Homo sapiens
catctctccacggcagctctcg

SEQ ID NO: 9277277 - DNA, 19 bp, Homo sapiens
catctctgcaaggagctgc

SEQ ID NO: 9277278 - DNA, 22 bp, Homo sapiens
catctctgagacctcagctggg

SEQ ID NO: 9277279 - DNA, 19 bp, Homo sapiens
catctctgcaaggagctgc

SEQ ID NO: 9277280 - DNA, 19 bp, Homo sapiens
catctctgcaaggagctgc

SEQ ID NO: 9277281 - DNA, 22 bp, Homo sapiens
catctctggttcagtctctgtg

SEQ ID NO: 9277282 - DNA, 22 bp, Homo sapiens
catctctgtgtccccagagctt

SEQ ID NO: 9277283 - DNA, 22 bp, Homo sapiens
catctctgtgtccccagagctt

SEQ ID NO: 9277284 - DNA, 22 bp, Homo sapiens
catctccaggagttctactcat

SEQ ID NO: 9277285 - DNA, 22 bp, Homo sapiens
catctcctttggtctacttcca

SEQ ID NO: 9277286 - DNA, 22 bp, Homo sapiens
catctctccacggcagctctcg

SEQ ID NO: 9277287 - DNA, 20 bp, Homo sapiens
catctcctgcctccatgttc

SEQ ID NO: 9277288 - DNA, 22 bp, Homo sapiens
catctcctggcagctgttagga

SEQ ID NO: 9277289 - DNA, 22 bp, Homo sapiens
catccaaactctcattatctgt

SEQ ID NO: 9277290 - DNA, 22 bp, Homo sapiens
catacatatgtggatgtcatat

SEQ ID NO: 9277291 - DNA, 22 bp, Homo sapiens
catacatatgtggatgtcatat

SEQ ID NO: 9277292 - DNA, 22 bp, Homo sapiens
catacatatgtggatgtcatat

SEQ ID NO: 9277293 - DNA, 22 bp, Homo sapiens
catctcatcctgccctaaaaca

SEQ ID NO: 9277294 - DNA, 22 bp, Homo sapiens
catctcatcagtgagagtcagc

SEQ ID NO: 9277295 - DNA, 22 bp, Homo sapiens
aggatttgcactggtgtttgag

SEQ ID NO: 9277296 - DNA, 22 bp, Homo sapiens
catgagataatttttctccagt

SEQ ID NO: 9277297 - DNA, 22 bp, Homo sapiens
catgagagacattctgtgtgaa

SEQ ID NO: 9277298 - DNA, 23 bp, Homo sapiens
aggatgtaggatgtatggcagag

SEQ ID NO: 9277299 - DNA, 22 bp, Homo sapiens
aggatgtgagtggacacagtcc

SEQ ID NO: 9277300 - DNA, 22 bp, Homo sapiens
aggatgtgagccagcctggcct

SEQ ID NO: 9277301 - DNA, 22 bp, Homo sapiens
catcttcaggttcatggtcata

SEQ ID NO: 9277302 - DNA, 22 bp, Homo sapiens
catcttcaggtgttttccatca

SEQ ID NO: 9277303 - DNA, 23 bp, Homo sapiens
aggatgggtggcaatagaaagac

SEQ ID NO: 9277304 - DNA, 23 bp, Homo sapiens
aggatgggtggcaatagaaagac

SEQ ID NO: 9277305 - DNA, 23 bp, Homo sapiens
aggatgggtggcaatagaaagac

SEQ ID NO: 9277306 - DNA, 22 bp, Homo sapiens
aggatgggtcagctagagtcca

SEQ ID NO: 9277307 - DNA, 22 bp, Homo sapiens
aggatgggtcagctagagtcca

SEQ ID NO: 9277308 - DNA, 22 bp, Homo sapiens
aggatggggtctgcagcctggt

SEQ ID NO: 9277309 - DNA, 22 bp, Homo sapiens
aggatggggtctgcagcctggt

SEQ ID NO: 9277310 - DNA, 22 bp, Homo sapiens
aggatggggtctgcagcctggt

SEQ ID NO: 9277311 - DNA, 22 bp, Homo sapiens
aggatgggcctgggatatgctt

SEQ ID NO: 9277312 - DNA, 22 bp, Homo sapiens
aggatgggcctgggatatgctt

SEQ ID NO: 9277313 - DNA, 22 bp, Homo sapiens
aggatggggtctgcagcctggt

SEQ ID NO: 9277314 - DNA, 22 bp, Homo sapiens
aggatgggcctgggatatgctt

SEQ ID NO: 9277315 - DNA, 22 bp, Homo sapiens
aggatggcttgcaggaggctgt

SEQ ID NO: 9277316 - DNA, 22 bp, Homo sapiens
cccagacataacagcagagagg

SEQ ID NO: 9277317 - DNA, 22 bp, Homo sapiens
cccagacagtgatttacttaat

SEQ ID NO: 9277318 - DNA, 22 bp, Homo sapiens
cccagaaggtcgaggctgcagt

SEQ ID NO: 9277319 - DNA, 22 bp, Homo sapiens
tgcacagaatcattttcagctg

SEQ ID NO: 9277320 - DNA, 22 bp, Homo sapiens
tgcacacattaaggatacacag

SEQ ID NO: 9277321 - DNA, 22 bp, Homo sapiens
tgcacacatgtttacaagcatc

SEQ ID NO: 9277322 - DNA, 22 bp, Homo sapiens
tgcacacatgtatgtatatgtg

SEQ ID NO: 9277323 - DNA, 22 bp, Homo sapiens
cccagactcatccctgggagct

SEQ ID NO: 9277324 - DNA, 22 bp, Homo sapiens
cccagactcatccctgggagct

SEQ ID NO: 9277325 - DNA, 23 bp, Homo sapiens
tgcaaataacaaggagtttaagg

SEQ ID NO: 9277326 - DNA, 22 bp, Homo sapiens
tgcaaagatttatctttctcca

SEQ ID NO: 9277327 - DNA, 22 bp, Homo sapiens
tgcaaagttgaggaaggcatgg

SEQ ID NO: 9277328 - DNA, 22 bp, Homo sapiens
cccacttcatgggcaggaagga

SEQ ID NO: 9277329 - DNA, 20 bp, Homo sapiens
cccagaagcttaacagagca

SEQ ID NO: 9277330 - DNA, 22 bp, Homo sapiens
cccactgtgttgctgttaatct

SEQ ID NO: 9277331 - DNA, 23 bp, Homo sapiens
ccattcatctcagtcattgcttt

SEQ ID NO: 9277332 - DNA, 22 bp, Homo sapiens
ccatgttgtcaaacttagagta

SEQ ID NO: 9277333 - DNA, 22 bp, Homo sapiens
ccatgttgtatctcttatcggc

SEQ ID NO: 9277334 - DNA, 22 bp, Homo sapiens
ccattccttcatcaaaaggcct

SEQ ID NO: 9277335 - DNA, 19 bp, Homo sapiens
ccattcctctagaatttgg

SEQ ID NO: 9277336 - DNA, 20 bp, Homo sapiens
ccattctgggtgcagtctgg

SEQ ID NO: 9277337 - DNA, 22 bp, Homo sapiens
tgatttcttctaatttccatca

SEQ ID NO: 9277338 - DNA, 23 bp, Homo sapiens
tgattttaaaaagtaagttatca

SEQ ID NO: 9277339 - DNA, 22 bp, Homo sapiens
tgatttcttccttgtcattaga

SEQ ID NO: 9277340 - DNA, 23 bp, Homo sapiens
tgattttaaaaagtaagttatca

SEQ ID NO: 9277341 - DNA, 22 bp, Homo sapiens
tgattttacttagcatgatgtt

SEQ ID NO: 9277342 - DNA, 22 bp, Homo sapiens
tgattttacttagcatgatgtt

SEQ ID NO: 9277343 - DNA, 22 bp, Homo sapiens
tgatttctcttggcaatatgtt

SEQ ID NO: 9277344 - DNA, 21 bp, Homo sapiens
tgatttctgccaagttcacta

SEQ ID NO: 9277345 - DNA, 22 bp, Homo sapiens
tgatttctctccgttatttcag

SEQ ID NO: 9277346 - DNA, 22 bp, Homo sapiens
tgagggcagagcactggggagc

SEQ ID NO: 9277347 - DNA, 22 bp, Homo sapiens
tgagggccgaggagctgtgggt

SEQ ID NO: 9277348 - DNA, 22 bp, Homo sapiens
tgagggccgaggagctgtgggt

SEQ ID NO: 9277349 - DNA, 22 bp, Homo sapiens
tgagggctaaattgtggcaggt

SEQ ID NO: 9277350 - DNA, 22 bp, Homo sapiens
tgagggcaaagtggtgctgagg

SEQ ID NO: 9277351 - DNA, 22 bp, Homo sapiens
tgagggcagagcactggggagc

SEQ ID NO: 9277352 - DNA, 23 bp, Homo sapiens
tgaggctgattgatttttgctca

SEQ ID NO: 9277353 - DNA, 22 bp, Homo sapiens
tgaggctgccttgggaagaggg

SEQ ID NO: 9277354 - DNA, 20 bp, Homo sapiens
tgagggctaaccagactctg

SEQ ID NO: 9277355 - DNA, 22 bp, Homo sapiens
tgagggctgacaggaggacagc

SEQ ID NO: 9277356 - DNA, 22 bp, Homo sapiens
tgagggctgcttccagagctag

SEQ ID NO: 9277357 - DNA, 22 bp, Homo sapiens
tgagggctgcttccagagctag

SEQ ID NO: 9277358 - DNA, 22 bp, Homo sapiens
tgagggctgcttccagagctag

SEQ ID NO: 9277359 - DNA, 22 bp, Homo sapiens
tgagggctgtggaaggctaacc

SEQ ID NO: 9277360 - DNA, 22 bp, Homo sapiens
ccagtgttgcataggatgggga

SEQ ID NO: 9277361 - DNA, 22 bp, Homo sapiens
ccagtgtttacagttgaacaaa

SEQ ID NO: 9277362 - DNA, 22 bp, Homo sapiens
ccagtgttggaggatggcttgc

SEQ ID NO: 9277363 - DNA, 22 bp, Homo sapiens
ccagtgtttaggaataaaatgt

SEQ ID NO: 9277364 - DNA, 22 bp, Homo sapiens
ccagtgttccagagagctgatg

SEQ ID NO: 9277365 - DNA, 22 bp, Homo sapiens
ccagtgttccctcgggttcatg

SEQ ID NO: 9277366 - DNA, 22 bp, Homo sapiens
ccagtgttccatggagtgatta

SEQ ID NO: 9277367 - DNA, 22 bp, Homo sapiens
ccagtgttctggtgttcatttc

SEQ ID NO: 9277368 - DNA, 22 bp, Homo sapiens
ccagtgttgaacagtatttgga

SEQ ID NO: 9277369 - DNA, 22 bp, Homo sapiens
ccagtcctggccagtaacatga

SEQ ID NO: 9277370 - DNA, 22 bp, Homo sapiens
ccagtcctgggagcttgcactg

SEQ ID NO: 9277371 - DNA, 22 bp, Homo sapiens
ccagtcctgtgtgaccctgcac

SEQ ID NO: 9277372 - DNA, 19 bp, Homo sapiens
ccagtctccttgcagcatc

SEQ ID NO: 9277373 - DNA, 22 bp, Homo sapiens
ccagtctcagttcacgttggta

SEQ ID NO: 9277374 - DNA, 20 bp, Homo sapiens
ccagtccctgagcaccaggg

SEQ ID NO: 9277375 - DNA, 20 bp, Homo sapiens
ccagtccctgagcaccaggg

SEQ ID NO: 9277376 - DNA, 22 bp, Homo sapiens
ccagtcctagttctaccttaca

SEQ ID NO: 9277377 - DNA, 22 bp, Homo sapiens
ccagtcctagaagaggagtcga

SEQ ID NO: 9277378 - DNA, 22 bp, Homo sapiens
ccagtcccgcatggtccagaat

SEQ ID NO: 9277379 - DNA, 22 bp, Homo sapiens
ccagtcccatctctgtcgctta

SEQ ID NO: 9277380 - DNA, 22 bp, Homo sapiens
ccagtcccgcatggtccagaat

SEQ ID NO: 9277381 - DNA, 22 bp, Homo sapiens
tgaggcagcaattgtattgtat

SEQ ID NO: 9277382 - DNA, 22 bp, Homo sapiens
tgaggcagcattcttcaagaca

SEQ ID NO: 9277383 - DNA, 22 bp, Homo sapiens
tgaggcagcattcttcaagaca

SEQ ID NO: 9277384 - DNA, 22 bp, Homo sapiens
tgaggcagcattcttcaagaca

SEQ ID NO: 9277385 - DNA, 22 bp, Homo sapiens
tgaggcagcccactttccttag

SEQ ID NO: 9277386 - DNA, 22 bp, Homo sapiens
tgaggtatggtaaggtaaaatc

SEQ ID NO: 9277387 - DNA, 22 bp, Homo sapiens
ccatgtgggattttggtgtctg

SEQ ID NO: 9277388 - DNA, 22 bp, Homo sapiens
ccatgtggtgggaaggagaatg

SEQ ID NO: 9277389 - DNA, 22 bp, Homo sapiens
tgaggtagggaaggctggtatt

SEQ ID NO: 9277390 - DNA, 22 bp, Homo sapiens
tgaggtaggtggtaagagatac

SEQ ID NO: 9277391 - DNA, 22 bp, Homo sapiens
tgaggtaggtaccattatcact

SEQ ID NO: 9277392 - DNA, 22 bp, Homo sapiens
tgaggtagggacttaaaactgt

SEQ ID NO: 9277393 - DNA, 22 bp, Homo sapiens
tgaggtagggagtttgttgttg

SEQ ID NO: 9277394 - DNA, 22 bp, Homo sapiens
tgaggtaggataagacaatgag

SEQ ID NO: 9277395 - DNA, 22 bp, Homo sapiens
tgaggtaggcttgagatgggag

SEQ ID NO: 9277396 - DNA, 22 bp, Homo sapiens
tgaggtaggtgtcgagagaggt

SEQ ID NO: 9277397 - DNA, 22 bp, Homo sapiens
tgaggtaggtgtcgagagaggt

SEQ ID NO: 9277398 - DNA, 22 bp, Homo sapiens
tgaggtaggtggtaagagatac

SEQ ID NO: 9277399 - DNA, 22 bp, Homo sapiens
tgaggtaggtggtgaaaaatga

SEQ ID NO: 9277400 - DNA, 22 bp, Homo sapiens
tgaggtaggtggtggcagccat

SEQ ID NO: 9277401 - DNA, 22 bp, Homo sapiens
tgaggtaggttgaaagatagat

SEQ ID NO: 9277402 - DNA, 22 bp, Homo sapiens
tgaggtagtaaaggtgttagtt

SEQ ID NO: 9277403 - DNA, 22 bp, Homo sapiens
tgaggtagtgattgtagaagtg

SEQ ID NO: 9277404 - DNA, 22 bp, Homo sapiens
tgaggtagtagatttttgtcca

SEQ ID NO: 9277405 - DNA, 22 bp, Homo sapiens
tgaggtagtgcttgtcatgttt

SEQ ID NO: 9277406 - DNA, 22 bp, Homo sapiens
tgaggtagtgtttagtccagtc

SEQ ID NO: 9277407 - DNA, 21 bp, Homo sapiens
tgaggtagtgtttgtcaagtt

SEQ ID NO: 9277408 - DNA, 22 bp, Homo sapiens
tgaggtagtttttcaagtattt

SEQ ID NO: 9277409 - DNA, 22 bp, Homo sapiens
tgaggtagttctaatattaaag

SEQ ID NO: 9277410 - DNA, 22 bp, Homo sapiens
tgaggtagtttgttgtacagta

SEQ ID NO: 9277411 - DNA, 22 bp, Homo sapiens
ccagtgtttccgtcagtacacg

SEQ ID NO: 9277412 - DNA, 22 bp, Homo sapiens
ccagtgtttccccagaagagag

SEQ ID NO: 9277413 - DNA, 22 bp, Homo sapiens
ccagtgttttcatcctcccttg

SEQ ID NO: 9277414 - DNA, 22 bp, Homo sapiens
ccagtgtttgatgggattttca

SEQ ID NO: 9277415 - DNA, 22 bp, Homo sapiens
ccatcctgcattgctattcaga

SEQ ID NO: 9277416 - DNA, 22 bp, Homo sapiens
ccatgcagtgctggagctgatt

SEQ ID NO: 9277417 - DNA, 22 bp, Homo sapiens
ccatcctggccttgctgtccac

SEQ ID NO: 9277418 - DNA, 22 bp, Homo sapiens
ccatcctggcctcgctgtccac

SEQ ID NO: 9277419 - DNA, 22 bp, Homo sapiens
ccatgccagctgctaggtcaca

SEQ ID NO: 9277420 - DNA, 22 bp, Homo sapiens
ccatgctgaccctgtgcaggca

SEQ ID NO: 9277421 - DNA, 22 bp, Homo sapiens
ccatgctctggggaggtcaagc

SEQ ID NO: 9277422 - DNA, 22 bp, Homo sapiens
ccatgctccttaccactcactt

SEQ ID NO: 9277423 - DNA, 22 bp, Homo sapiens
ccatgctgtgacacagtagtta

SEQ ID NO: 9277424 - DNA, 22 bp, Homo sapiens
ccatgcccttgtcatctccagg

SEQ ID NO: 9277425 - DNA, 22 bp, Homo sapiens
ccatgccctaaaggactggcag

SEQ ID NO: 9277426 - DNA, 22 bp, Homo sapiens
ccatgcctcgggaagagtctgt

SEQ ID NO: 9277427 - DNA, 22 bp, Homo sapiens
ccaggggaaacagggagcactc

SEQ ID NO: 9277428 - DNA, 22 bp, Homo sapiens
ccaggggaaacagggagcactc

SEQ ID NO: 9277429 - DNA, 22 bp, Homo sapiens
ccagggctttgccaaagtccag

SEQ ID NO: 9277430 - DNA, 22 bp, Homo sapiens
ccagggctttatctgcctttga

SEQ ID NO: 9277431 - DNA, 19 bp, Homo sapiens
ccagggctttaagttgagg

SEQ ID NO: 9277432 - DNA, 22 bp, Homo sapiens
ccagggcttggtggcttgtatc

SEQ ID NO: 9277433 - DNA, 22 bp, Homo sapiens
ccagggcttcccacgtgccctg

SEQ ID NO: 9277434 - DNA, 22 bp, Homo sapiens
ccagggcttcccacgtgccctg

SEQ ID NO: 9277435 - DNA, 22 bp, Homo sapiens
tgacaatggggcacatggaaag

SEQ ID NO: 9277436 - DNA, 22 bp, Homo sapiens
ccagggcttcagttagtggtga

SEQ ID NO: 9277437 - DNA, 22 bp, Homo sapiens
ccagggctggaccagtgcttgg

SEQ ID NO: 9277438 - DNA, 22 bp, Homo sapiens
tgacaatgacatggacagtgat

SEQ ID NO: 9277439 - DNA, 22 bp, Homo sapiens
tgacaatgacatggacagtgat

SEQ ID NO: 9277440 - DNA, 22 bp, Homo sapiens
tgacaatggatattagttgtgg

SEQ ID NO: 9277441 - DNA, 22 bp, Homo sapiens
tgacaagatcacagtcaagtgt

SEQ ID NO: 9277442 - DNA, 19 bp, Homo sapiens
tgacaagataatagccttg

SEQ ID NO: 9277443 - DNA, 22 bp, Homo sapiens
tgacaagaggcagaatcagctg

SEQ ID NO: 9277444 - DNA, 22 bp, Homo sapiens
tgacataaatctaaaggaaagg

SEQ ID NO: 9277445 - DNA, 22 bp, Homo sapiens
tgacataaaccagtgagcaaaa

SEQ ID NO: 9277446 - DNA, 22 bp, Homo sapiens
tgacagttaaggtatacattca

SEQ ID NO: 9277447 - DNA, 22 bp, Homo sapiens
tgacagttgagcatgtaagaga

SEQ ID NO: 9277448 - DNA, 23 bp, Homo sapiens
tgacagtgtatttgactatatgg

SEQ ID NO: 9277449 - DNA, 22 bp, Homo sapiens
tgacagtgcgggtacatcatag

SEQ ID NO: 9277450 - DNA, 22 bp, Homo sapiens
tgacagtgcgggtacatcatag

SEQ ID NO: 9277451 - DNA, 21 bp, Homo sapiens
ccaggggcaaattgtcgtttc

SEQ ID NO: 9277452 - DNA, 22 bp, Homo sapiens
tgacatcctgagtacataagag

SEQ ID NO: 9277453 - DNA, 22 bp, Homo sapiens
tgacatcattagtaacatagct

SEQ ID NO: 9277454 - DNA, 22 bp, Homo sapiens
tgacatccggccactagactcc

SEQ ID NO: 9277455 - DNA, 22 bp, Homo sapiens
tgagaaaaggttgagatgataa

SEQ ID NO: 9277456 - DNA, 22 bp, Homo sapiens
tgagaaaagtacatggagaagc

SEQ ID NO: 9277457 - DNA, 22 bp, Homo sapiens
tgagaaaagtacatggagaagc

SEQ ID NO: 9277458 - DNA, 22 bp, Homo sapiens
tgacataagttggtagaaagga

SEQ ID NO: 9277459 - DNA, 22 bp, Homo sapiens
tgacataatgctttgaagttgc

SEQ ID NO: 9277460 - DNA, 22 bp, Homo sapiens
tgacataatgctttgaagttgc

SEQ ID NO: 9277461 - DNA, 20 bp, Homo sapiens
tgacatagctcttggggtgc

SEQ ID NO: 9277462 - DNA, 21 bp, Homo sapiens
tgaatgcttcgtcatcctggc

SEQ ID NO: 9277463 - DNA, 22 bp, Homo sapiens
tgaatgatttgggtgcattcag

SEQ ID NO: 9277464 - DNA, 22 bp, Homo sapiens
tgacaagaaagcgtcttctttt

SEQ ID NO: 9277465 - DNA, 22 bp, Homo sapiens
tgacaagaagacctggtaatga

SEQ ID NO: 9277466 - DNA, 22 bp, Homo sapiens
tgaatgagtggattctgagtag

SEQ ID NO: 9277467 - DNA, 22 bp, Homo sapiens
tgaatgatacagaattatgtag

SEQ ID NO: 9277468 - DNA, 22 bp, Homo sapiens
tgaatgatatattgggaataat

SEQ ID NO: 9277469 - DNA, 22 bp, Homo sapiens
tgaatgatatgtgaaaaggaac

SEQ ID NO: 9277470 - DNA, 22 bp, Homo sapiens
tgaatgatctagttttgtagac

SEQ ID NO: 9277471 - DNA, 22 bp, Homo sapiens
tgaatgatctccgattagtcct

SEQ ID NO: 9277472 - DNA, 22 bp, Homo sapiens
tgaatgatgaggggagaataat

SEQ ID NO: 9277473 - DNA, 21 bp, Homo sapiens
tgaatgatctggttgcctttt

SEQ ID NO: 9277474 - DNA, 22 bp, Homo sapiens
tgaatgatgcatttgtttccca

SEQ ID NO: 9277475 - DNA, 22 bp, Homo sapiens
tgaatgatgcagtataatgata

SEQ ID NO: 9277476 - DNA, 21 bp, Homo sapiens
tgaatgatgccccagagttgt

SEQ ID NO: 9277477 - DNA, 23 bp, Homo sapiens
tgaatgatggtgctcctcatctt

SEQ ID NO: 9277478 - DNA, 22 bp, Homo sapiens
tgaatgatggtgtgttcttgcc

SEQ ID NO: 9277479 - DNA, 22 bp, Homo sapiens
tgaatgatttcttaggcaattg

SEQ ID NO: 9277480 - DNA, 23 bp, Homo sapiens
tgaatgattgtactgagctttta

SEQ ID NO: 9277481 - DNA, 22 bp, Homo sapiens
tgaatgattaaaacccggacta

SEQ ID NO: 9277482 - DNA, 22 bp, Homo sapiens
tgaatgatgtataatattgaga

SEQ ID NO: 9277483 - DNA, 22 bp, Homo sapiens
ccaggctggagtgcagtggcac

SEQ ID NO: 9277484 - DNA, 22 bp, Homo sapiens
ccaggctggagtgcagtggcac

SEQ ID NO: 9277485 - DNA, 22 bp, Homo sapiens
ccaggctggagtgcagtggcac

SEQ ID NO: 9277486 - DNA, 22 bp, Homo sapiens
ccaggctggagtgcagtggcac

SEQ ID NO: 9277487 - DNA, 22 bp, Homo sapiens
ccaggctggagtgcaatggtgc

SEQ ID NO: 9277488 - DNA, 22 bp, Homo sapiens
ccaggctggagtgcaatggtgc

SEQ ID NO: 9277489 - DNA, 22 bp, Homo sapiens
ccaggctggagtgcaatggtgc

SEQ ID NO: 9277490 - DNA, 22 bp, Homo sapiens
ccaggctggagtgcagtagtgt

SEQ ID NO: 9277491 - DNA, 22 bp, Homo sapiens
ccaggctggagtgcagtagtgt

SEQ ID NO: 9277492 - DNA, 22 bp, Homo sapiens
ccaggctggattttgcagttca

SEQ ID NO: 9277493 - DNA, 22 bp, Homo sapiens
ccaggctggagtgtagtcgcat

SEQ ID NO: 9277494 - DNA, 22 bp, Homo sapiens
ccaggctggagtgtagtcgcat

SEQ ID NO: 9277495 - DNA, 22 bp, Homo sapiens
ccaggctggattttgcagttca

SEQ ID NO: 9277496 - DNA, 22 bp, Homo sapiens
ccaggctggattttgcagttca

SEQ ID NO: 9277497 - DNA, 20 bp, Homo sapiens
ccaggctggcaaatgggggc

SEQ ID NO: 9277498 - DNA, 20 bp, Homo sapiens
ccaggctggcaaatgggggc

SEQ ID NO: 9277499 - DNA, 20 bp, Homo sapiens
ccaggctggcaaatgggggc

SEQ ID NO: 9277500 - DNA, 22 bp, Homo sapiens
tgaggcagaaaatagcagttca

SEQ ID NO: 9277501 - DNA, 22 bp, Homo sapiens
tgaggcagaaattcctgttttc

SEQ ID NO: 9277502 - DNA, 22 bp, Homo sapiens
tgaggcagaaattcctgttttc

SEQ ID NO: 9277503 - DNA, 22 bp, Homo sapiens
tgaggcagatatttattgggtt

SEQ ID NO: 9277504 - DNA, 22 bp, Homo sapiens
tgaggcagagtaagatacatga

SEQ ID NO: 9277505 - DNA, 22 bp, Homo sapiens
tgaggcagcaattgtattgtat

SEQ ID NO: 9277506 - DNA, 22 bp, Homo sapiens
tgaggcagcaattgattattca

SEQ ID NO: 9277507 - DNA, 22 bp, Homo sapiens
ccaggtgtggggaggactcaca

SEQ ID NO: 9277508 - DNA, 22 bp, Homo sapiens
ccaggtgtgatttggcagtgtc

SEQ ID NO: 9277509 - DNA, 22 bp, Homo sapiens
ccaggtgtgctctgcagtggat

SEQ ID NO: 9277510 - DNA, 22 bp, Homo sapiens
ccaggtgtgccagcagggactg

SEQ ID NO: 9277511 - DNA, 22 bp, Homo sapiens
tgagacagttctgcagctgggt

SEQ ID NO: 9277512 - DNA, 22 bp, Homo sapiens
tgagacagttctgcagctgggt

SEQ ID NO: 9277513 - DNA, 22 bp, Homo sapiens
tgagacagttctgcagctgggt

SEQ ID NO: 9277514 - DNA, 20 bp, Homo sapiens
tgagacccgctgacaagttc

SEQ ID NO: 9277515 - DNA, 22 bp, Homo sapiens
tgagacgaagtcttgctctgtt

SEQ ID NO: 9277516 - DNA, 23 bp, Homo sapiens
tgagaccctaatttagcaagtgt

SEQ ID NO: 9277517 - DNA, 22 bp, Homo sapiens
tgagacgaagtcttgctctgtt

SEQ ID NO: 9277518 - DNA, 22 bp, Homo sapiens
ccaggtgtagcactgctcacag

SEQ ID NO: 9277519 - DNA, 22 bp, Homo sapiens
ccaggtggttcaggtcaccata

SEQ ID NO: 9277520 - DNA, 22 bp, Homo sapiens
ccaggtgtctgtggccagccct

SEQ ID NO: 9277521 - DNA, 22 bp, Homo sapiens
ccaggtgtcatgcgtgtgaccc

SEQ ID NO: 9277522 - DNA, 22 bp, Homo sapiens
ccaggtgtaggacaccaaggga

SEQ ID NO: 9277523 - DNA, 21 bp, Homo sapiens
ccagggtccagctgccatggt

SEQ ID NO: 9277524 - DNA, 22 bp, Homo sapiens
ccagggggcttggtgaggccat

SEQ ID NO: 9277525 - DNA, 22 bp, Homo sapiens
ccaggggctggtgctgagctgg

SEQ ID NO: 9277526 - DNA, 22 bp, Homo sapiens
ccaggggctggtgctgagctgg

SEQ ID NO: 9277527 - DNA, 22 bp, Homo sapiens
ccaggggggcgtagatgctggg

SEQ ID NO: 9277528 - DNA, 22 bp, Homo sapiens
ccaggtggacaaggctttcaca

SEQ ID NO: 9277529 - DNA, 22 bp, Homo sapiens
ccaggtggacggcgagtacagg

SEQ ID NO: 9277530 - DNA, 22 bp, Homo sapiens
ccaggtggacaaggctttcaca

SEQ ID NO: 9277531 - DNA, 22 bp, Homo sapiens
ccaggtggaaggtctgtgctct

SEQ ID NO: 9277532 - DNA, 22 bp, Homo sapiens
ccaggtggaaggtctgtgctct

SEQ ID NO: 9277533 - DNA, 22 bp, Homo sapiens
ccaggtggaaggtctgtgctct

SEQ ID NO: 9277534 - DNA, 19 bp, Homo sapiens
ccaggtggaactgaggtag

SEQ ID NO: 9277535 - DNA, 22 bp, Homo sapiens
ccaggtggaaggtctgtgctct

SEQ ID NO: 9277536 - DNA, 19 bp, Homo sapiens
ccaggtggaactgaggtag

SEQ ID NO: 9277537 - DNA, 22 bp, Homo sapiens
ccaggtgctcttgccagggctg

SEQ ID NO: 9277538 - DNA, 22 bp, Homo sapiens
ccaggggctggtgctgagctgg

SEQ ID NO: 9277539 - DNA, 22 bp, Homo sapiens
ccaggggctggtgctgagctgg

SEQ ID NO: 9277540 - DNA, 22 bp, Homo sapiens
ccaggggctgcagatccatggt

SEQ ID NO: 9277541 - DNA, 22 bp, Homo sapiens
ccaggggctgcagatccatggt

SEQ ID NO: 9277542 - DNA, 22 bp, Homo sapiens
ccaggggctgcagatccatggt

SEQ ID NO: 9277543 - DNA, 22 bp, Homo sapiens
ccaggggctctcagggtgtgtg

SEQ ID NO: 9277544 - DNA, 22 bp, Homo sapiens
ccaggggcctgtgaaggtgccc

SEQ ID NO: 9277545 - DNA, 22 bp, Homo sapiens
tgagaatattgttttagtgagg

SEQ ID NO: 9277546 - DNA, 22 bp, Homo sapiens
tgagaatagcagactggtaact

SEQ ID NO: 9277547 - DNA, 21 bp, Homo sapiens
tgagaagtatgtcttcagcca

SEQ ID NO: 9277548 - DNA, 17 bp, Homo sapiens
tgagaagtaggcatcat

SEQ ID NO: 9277549 - DNA, 22 bp, Homo sapiens
tctggcctcttgggatgctccc

SEQ ID NO: 9277550 - DNA, 22 bp, Homo sapiens
tctggcctatttctgtcagatc

SEQ ID NO: 9277551 - DNA, 22 bp, Homo sapiens
tctggcagctcagttcaggtct

SEQ ID NO: 9277552 - DNA, 22 bp, Homo sapiens
tctggcaggaccatgaagcgta

SEQ ID NO: 9277553 - DNA, 22 bp, Homo sapiens
tctggctcagggctctgaggga

SEQ ID NO: 9277554 - DNA, 22 bp, Homo sapiens
ccaggaccctgcaaaccctgtt

SEQ ID NO: 9277555 - DNA, 22 bp, Homo sapiens
ccaggacctggagctctatgaa

SEQ ID NO: 9277556 - DNA, 19 bp, Homo sapiens
ccaggacctttccagggtc

SEQ ID NO: 9277557 - DNA, 22 bp, Homo sapiens
ccaggacactgcttcacagcag

SEQ ID NO: 9277558 - DNA, 22 bp, Homo sapiens
ccaggacagggagacgggagcc

SEQ ID NO: 9277559 - DNA, 22 bp, Homo sapiens
ccaggagaagcatctgagtgta

SEQ ID NO: 9277560 - DNA, 22 bp, Homo sapiens
ccaggagaataatggcagatta

SEQ ID NO: 9277561 - DNA, 22 bp, Homo sapiens
ccaggagaataatggcagatta

SEQ ID NO: 9277562 - DNA, 22 bp, Homo sapiens
ccaggacttcgaggctacagtg

SEQ ID NO: 9277563 - DNA, 22 bp, Homo sapiens
ccaggactgcagggggcgagga

SEQ ID NO: 9277564 - DNA, 22 bp, Homo sapiens
tctggtcccttttcctgcagtc

SEQ ID NO: 9277565 - DNA, 22 bp, Homo sapiens
tctggtcccttttcctgcagtc

SEQ ID NO: 9277566 - DNA, 22 bp, Homo sapiens
tctggtccccattccaggtggg

SEQ ID NO: 9277567 - DNA, 22 bp, Homo sapiens
tctggtgtcagtattctttgaa

SEQ ID NO: 9277568 - DNA, 22 bp, Homo sapiens
tctggtggtgggccacaagcat

SEQ ID NO: 9277569 - DNA, 19 bp, Homo sapiens
tctggttcatttctgctgt

SEQ ID NO: 9277570 - DNA, 22 bp, Homo sapiens
tctgggagatccaagcagaact

SEQ ID NO: 9277571 - DNA, 22 bp, Homo sapiens
tctgggagcacacgcagtgatc

SEQ ID NO: 9277572 - DNA, 22 bp, Homo sapiens
tctgggagagtcacaggcattg

SEQ ID NO: 9277573 - DNA, 22 bp, Homo sapiens
tctgggagatccaagcagaact

SEQ ID NO: 9277574 - DNA, 22 bp, Homo sapiens
tctggtaacctttatccctcct

SEQ ID NO: 9277575 - DNA, 22 bp, Homo sapiens
tctggtcaagacatcctaacat

SEQ ID NO: 9277576 - DNA, 22 bp, Homo sapiens
tctggggatgaggtccagtgat

SEQ ID NO: 9277577 - DNA, 22 bp, Homo sapiens
ccagctctctgcagaaaggact

SEQ ID NO: 9277578 - DNA, 22 bp, Homo sapiens
ccagctctcagcgggagactca

SEQ ID NO: 9277579 - DNA, 22 bp, Homo sapiens
ccagctctcagcgggagactca

SEQ ID NO: 9277580 - DNA, 22 bp, Homo sapiens
ccagctctcagcgggagactca

SEQ ID NO: 9277581 - DNA, 22 bp, Homo sapiens
tctggaaatggaagtaactatg

SEQ ID NO: 9277582 - DNA, 22 bp, Homo sapiens
tctggaaaagcgataaaccatt

SEQ ID NO: 9277583 - DNA, 22 bp, Homo sapiens
tctggaaataaaattatagttg

SEQ ID NO: 9277584 - DNA, 22 bp, Homo sapiens
tctgctttgctgcctcctgatc

SEQ ID NO: 9277585 - DNA, 22 bp, Homo sapiens
tctgctttcttgcgcagatgtg

SEQ ID NO: 9277586 - DNA, 22 bp, Homo sapiens
tctgctttagaatccagtagct

SEQ ID NO: 9277587 - DNA, 22 bp, Homo sapiens
tctgctttattacactagccaa

SEQ ID NO: 9277588 - DNA, 22 bp, Homo sapiens
tctgctttcaaattcacttagt

SEQ ID NO: 9277589 - DNA, 22 bp, Homo sapiens
tctgctttcaaattcacttagt

SEQ ID NO: 9277590 - DNA, 22 bp, Homo sapiens
tctgctttcttactaaaaatga

SEQ ID NO: 9277591 - DNA, 22 bp, Homo sapiens
tctgctttcttactaaaaatga

SEQ ID NO: 9277592 - DNA, 22 bp, Homo sapiens
tctcagaataaattcctaactt

SEQ ID NO: 9277593 - DNA, 22 bp, Homo sapiens
tctcagaagtgatcaggatgtt

SEQ ID NO: 9277594 - DNA, 22 bp, Homo sapiens
tctcagaagggtggtgctggag

SEQ ID NO: 9277595 - DNA, 22 bp, Homo sapiens
ccagagagagaggtcaatggca

SEQ ID NO: 9277596 - DNA, 22 bp, Homo sapiens
ccagagagaaatggatttgagt

SEQ ID NO: 9277597 - DNA, 22 bp, Homo sapiens
ccagagagaaaatggagggcca

SEQ ID NO: 9277598 - DNA, 22 bp, Homo sapiens
ccagagagaaaatggagggcca

SEQ ID NO: 9277599 - DNA, 22 bp, Homo sapiens
ccagagagaaaatggagggcca

SEQ ID NO: 9277600 - DNA, 22 bp, Homo sapiens
tctcagaattgtgtccactggg

SEQ ID NO: 9277601 - DNA, 22 bp, Homo sapiens
tctcagaatccttgcccaggtg

SEQ ID NO: 9277602 - DNA, 19 bp, Homo sapiens
tctcagaattaagagtgct

SEQ ID NO: 9277603 - DNA, 22 bp, Homo sapiens
tctcagaatccttgcccaggtg

SEQ ID NO: 9277604 - DNA, 22 bp, Homo sapiens
tctcagaatcaggacctacttc

SEQ ID NO: 9277605 - DNA, 22 bp, Homo sapiens
tctcagaataaattcctaactt

SEQ ID NO: 9277606 - DNA, 22 bp, Homo sapiens
tctcagaattgtgtccactggg

SEQ ID NO: 9277607 - DNA, 19 bp, Homo sapiens
tctcagaattggcaatcat

SEQ ID NO: 9277608 - DNA, 18 bp, Homo sapiens
ccagctgcgctgaaccga

SEQ ID NO: 9277609 - DNA, 21 bp, Homo sapiens
ccagctgcctgcactttggac

SEQ ID NO: 9277610 - DNA, 22 bp, Homo sapiens
ccagctgcgggcatcgagagtt

SEQ ID NO: 9277611 - DNA, 22 bp, Homo sapiens
ccagctgcgggcatcgagagtt

SEQ ID NO: 9277612 - DNA, 22 bp, Homo sapiens
ccagctgcccaagaggcatcct

SEQ ID NO: 9277613 - DNA, 22 bp, Homo sapiens
ccagctgcccactatgtgttct

SEQ ID NO: 9277614 - DNA, 21 bp, Homo sapiens
ccagctgcctgcactttggac

SEQ ID NO: 9277615 - DNA, 22 bp, Homo sapiens
ccagctgcgggcatcgagagtt

SEQ ID NO: 9277616 - DNA, 22 bp, Homo sapiens
ccagctgctatcatgccatttc

SEQ ID NO: 9277617 - DNA, 17 bp, Homo sapiens
ccagctgctccctcaga

SEQ ID NO: 9277618 - DNA, 21 bp, Homo sapiens
ccagctgctccttgaggttcc

SEQ ID NO: 9277619 - DNA, 22 bp, Homo sapiens
ccagctgctgtgcagggaggct

SEQ ID NO: 9277620 - DNA, 22 bp, Homo sapiens
ccagctgctgtgaggaccacag

SEQ ID NO: 9277621 - DNA, 22 bp, Homo sapiens
ccagctgctgtgaggaccacag

SEQ ID NO: 9277622 - DNA, 22 bp, Homo sapiens
ccagctgctgtgaggaccacag

SEQ ID NO: 9277623 - DNA, 22 bp, Homo sapiens
ccagctgctctcttctccgcca

SEQ ID NO: 9277624 - DNA, 22 bp, Homo sapiens
ccagctgctgacatgggcaggt

SEQ ID NO: 9277625 - DNA, 22 bp, Homo sapiens
ccagctgctgacatgggcaggt

SEQ ID NO: 9277626 - DNA, 22 bp, Homo sapiens
ccagctgctgacatgggcaggt

SEQ ID NO: 9277627 - DNA, 22 bp, Homo sapiens
ccagctgcaggtgttccagatg

SEQ ID NO: 9277628 - DNA, 22 bp, Homo sapiens
ccagctgcaggtgttccagatg

SEQ ID NO: 9277629 - DNA, 22 bp, Homo sapiens
ccagctgcaggggagcagtgga

SEQ ID NO: 9277630 - DNA, 22 bp, Homo sapiens
ccagctgcccaagaggcatcct

SEQ ID NO: 9277631 - DNA, 22 bp, Homo sapiens
ccagctgcatcctattcactgc

SEQ ID NO: 9277632 - DNA, 22 bp, Homo sapiens
ccagctgaggcagccacacagg

SEQ ID NO: 9277633 - DNA, 22 bp, Homo sapiens
ccagctgaggcagccacacagg

SEQ ID NO: 9277634 - DNA, 20 bp, Homo sapiens
ccagctgagccaaggggaga

SEQ ID NO: 9277635 - DNA, 22 bp, Homo sapiens
ccagctctgccaagcgtcagct

SEQ ID NO: 9277636 - DNA, 22 bp, Homo sapiens
ccagctctgccaagcgtcagct

SEQ ID NO: 9277637 - DNA, 22 bp, Homo sapiens
ccagctgattcggtggtggttg

SEQ ID NO: 9277638 - DNA, 22 bp, Homo sapiens
ccagctgcaggggagcagtgga

SEQ ID NO: 9277639 - DNA, 22 bp, Homo sapiens
ccagctgcaggggagcagtgga

SEQ ID NO: 9277640 - DNA, 22 bp, Homo sapiens
ccagctctctttgaagcataaa

SEQ ID NO: 9277641 - DNA, 22 bp, Homo sapiens
ccagctctctttgaagcataaa

SEQ ID NO: 9277642 - DNA, 22 bp, Homo sapiens
ccagctctctgtcctccccaca

SEQ ID NO: 9277643 - DNA, 22 bp, Homo sapiens
ccagctctctgcagaaaggact

SEQ ID NO: 9277644 - DNA, 22 bp, Homo sapiens
ccagctctgcatgtttcccttg

SEQ ID NO: 9277645 - DNA, 22 bp, Homo sapiens
ccagctctgccaagcgtcagct

SEQ ID NO: 9277646 - DNA, 22 bp, Homo sapiens
ccagctctgccaagcgtcagct

SEQ ID NO: 9277647 - DNA, 22 bp, Homo sapiens
ccagctctgcagggcctggggt

SEQ ID NO: 9277648 - DNA, 22 bp, Homo sapiens
ccagctctgcagggcctggggt

SEQ ID NO: 9277649 - DNA, 22 bp, Homo sapiens
ccagctctgattttgacctcca

SEQ ID NO: 9277650 - DNA, 22 bp, Homo sapiens
ccagctctgattttgacctcca

SEQ ID NO: 9277651 - DNA, 21 bp, Homo sapiens
tcttccctcaggatgtcctgc

SEQ ID NO: 9277652 - DNA, 21 bp, Homo sapiens
tcttccctcaggatgtcctgc

SEQ ID NO: 9277653 - DNA, 19 bp, Homo sapiens
tcttccctggctgtcagtc

SEQ ID NO: 9277654 - DNA, 22 bp, Homo sapiens
tcttcccccgtgctccagtgca

SEQ ID NO: 9277655 - DNA, 22 bp, Homo sapiens
tcttcctatggggctgcaggaa

SEQ ID NO: 9277656 - DNA, 22 bp, Homo sapiens
ccaggccagcaggcacacctgc

SEQ ID NO: 9277657 - DNA, 22 bp, Homo sapiens
ccaggccagcgctggctggagg

SEQ ID NO: 9277658 - DNA, 22 bp, Homo sapiens
tcttcccagctgctgcgatgcc

SEQ ID NO: 9277659 - DNA, 22 bp, Homo sapiens
tcttcccagaggaggtgccagc

SEQ ID NO: 9277660 - DNA, 22 bp, Homo sapiens
tcttcccactgcccatgggcag

SEQ ID NO: 9277661 - DNA, 20 bp, Homo sapiens
tcttccaggtacagtctgca

SEQ ID NO: 9277662 - DNA, 20 bp, Homo sapiens
tcttccaggtacagtctgca

SEQ ID NO: 9277663 - DNA, 22 bp, Homo sapiens
tcttcactgtgaatttgttctt

SEQ ID NO: 9277664 - DNA, 22 bp, Homo sapiens
tcttcagagactctgagcccct

SEQ ID NO: 9277665 - DNA, 22 bp, Homo sapiens
ccaggagtttgaggctgcagtg

SEQ ID NO: 9277666 - DNA, 22 bp, Homo sapiens
ccaggagttggaggttgcagtg

SEQ ID NO: 9277667 - DNA, 22 bp, Homo sapiens
ccaggagttggaggctgcagtg

SEQ ID NO: 9277668 - DNA, 22 bp, Homo sapiens
tcttcaccatcaacagaatgaa

SEQ ID NO: 9277669 - DNA, 22 bp, Homo sapiens
ccaggagtctggatgaggtgtc

SEQ ID NO: 9277670 - DNA, 22 bp, Homo sapiens
ccaggagtgcagggatggtatc

SEQ ID NO: 9277671 - DNA, 22 bp, Homo sapiens
ccaggaggttgaggctgcagtg

SEQ ID NO: 9277672 - DNA, 22 bp, Homo sapiens
ccaggaggttgaggctgcagtg

SEQ ID NO: 9277673 - DNA, 22 bp, Homo sapiens
ccaggaggttgaggctgcagtg

SEQ ID NO: 9277674 - DNA, 22 bp, Homo sapiens
ccaggagacaaagatgactgct

SEQ ID NO: 9277675 - DNA, 22 bp, Homo sapiens
ccaggagacccagggaaggagc

SEQ ID NO: 9277676 - DNA, 22 bp, Homo sapiens
ccaggagaatgggattacccta

SEQ ID NO: 9277677 - DNA, 22 bp, Homo sapiens
ccaggagactgtactgatattt

SEQ ID NO: 9277678 - DNA, 22 bp, Homo sapiens
ccaggagacccagggaaggagc

SEQ ID NO: 9277679 - DNA, 22 bp, Homo sapiens
ccaggaggttgaggctgcagtg

SEQ ID NO: 9277680 - DNA, 22 bp, Homo sapiens
ccaggagggaccgcggcatccc

SEQ ID NO: 9277681 - DNA, 22 bp, Homo sapiens
tctttcttattatgctcaatgt

SEQ ID NO: 9277682 - DNA, 22 bp, Homo sapiens
tctttcttattatgctcaatgt

SEQ ID NO: 9277683 - DNA, 22 bp, Homo sapiens
tctttcttcagccctgtaagat

SEQ ID NO: 9277684 - DNA, 22 bp, Homo sapiens
tctttcttcagccctgtaagat

SEQ ID NO: 9277685 - DNA, 22 bp, Homo sapiens
tctttcttggtattctgagcta

SEQ ID NO: 9277686 - DNA, 22 bp, Homo sapiens
tctttcttgtgggtgccctttt

SEQ ID NO: 9277687 - DNA, 22 bp, Homo sapiens
tctttcttggtataaagcaggg

SEQ ID NO: 9277688 - DNA, 22 bp, Homo sapiens
tctttgaaaagatattcctcct

SEQ ID NO: 9277689 - DNA, 22 bp, Homo sapiens
ccaggcctgcatctgctgcgca

SEQ ID NO: 9277690 - DNA, 22 bp, Homo sapiens
ccaggcccaccttggccactta

SEQ ID NO: 9277691 - DNA, 22 bp, Homo sapiens
ccaggcccagggtactgaccaa

SEQ ID NO: 9277692 - DNA, 22 bp, Homo sapiens
ccaggccccagggctggctttc

SEQ ID NO: 9277693 - DNA, 22 bp, Homo sapiens
tctttcaaatgcttgaattgga

SEQ ID NO: 9277694 - DNA, 22 bp, Homo sapiens
tctttcttattagccattgttc

SEQ ID NO: 9277695 - DNA, 22 bp, Homo sapiens
tctttcttattagccattgttc

SEQ ID NO: 9277696 - DNA, 22 bp, Homo sapiens
ccaggccagggctgcagcgagc

SEQ ID NO: 9277697 - DNA, 22 bp, Homo sapiens
ccaggccagtgtttggtccagg

SEQ ID NO: 9277698 - DNA, 19 bp, Homo sapiens
ccaggccatcccagttccc

SEQ ID NO: 9277699 - DNA, 22 bp, Homo sapiens
ccaggccattcccagagttgct

SEQ ID NO: 9277700 - DNA, 22 bp, Homo sapiens
ccaggctgaatatgttccaggg

SEQ ID NO: 9277701 - DNA, 22 bp, Homo sapiens
ccaggctgaatatgttccaggg

SEQ ID NO: 9277702 - DNA, 23 bp, Homo sapiens
ccaggctctttcacctgctattc

SEQ ID NO: 9277703 - DNA, 23 bp, Homo sapiens
ccaggctctttcacctgctattc

SEQ ID NO: 9277704 - DNA, 22 bp, Homo sapiens
ccaggctctgtgtgggctagag

SEQ ID NO: 9277705 - DNA, 22 bp, Homo sapiens
ccaggctctgttccccgaggag

SEQ ID NO: 9277706 - DNA, 22 bp, Homo sapiens
ccaggcctggacgggtggcctg

SEQ ID NO: 9277707 - DNA, 21 bp, Homo sapiens
ccaggctcctgaggctggtca

SEQ ID NO: 9277708 - DNA, 21 bp, Homo sapiens
ccaggctcctgaggctggtca

SEQ ID NO: 9277709 - DNA, 22 bp, Homo sapiens
ccaggcctggccaggggatgcc

SEQ ID NO: 9277710 - DNA, 22 bp, Homo sapiens
ccaggctctgtctggtcagaag

SEQ ID NO: 9277711 - DNA, 22 bp, Homo sapiens
tctttggggcatctgggagatt

SEQ ID NO: 9277712 - DNA, 19 bp, Homo sapiens
tctttggcttctggatcag

SEQ ID NO: 9277713 - DNA, 22 bp, Homo sapiens
ccaggctgagcatgattggagc

SEQ ID NO: 9277714 - DNA, 22 bp, Homo sapiens
ccaggctgctgttggtgtccgc

SEQ ID NO: 9277715 - DNA, 22 bp, Homo sapiens
ccaggctgctgttggtgtccgc

SEQ ID NO: 9277716 - DNA, 22 bp, Homo sapiens
ccaggctggagtgcaatggcat

SEQ ID NO: 9277717 - DNA, 22 bp, Homo sapiens
ccaggctggagtgcaatggcat

SEQ ID NO: 9277718 - DNA, 22 bp, Homo sapiens
ccaggctggagtgcaatggcgt

SEQ ID NO: 9277719 - DNA, 22 bp, Homo sapiens
ccaggctggagtgcaatggtgc

SEQ ID NO: 9277720 - DNA, 22 bp, Homo sapiens
ccaggctggagtgcaatggcgt

SEQ ID NO: 9277721 - DNA, 22 bp, Homo sapiens
tggctgggagctggaactgggc

SEQ ID NO: 9277722 - DNA, 22 bp, Homo sapiens
tggcttcattctgtagttaaaa

SEQ ID NO: 9277723 - DNA, 22 bp, Homo sapiens
tggcttcattattgtttttcct

SEQ ID NO: 9277724 - DNA, 22 bp, Homo sapiens
tggcttcattcagcatgacagt

SEQ ID NO: 9277725 - DNA, 22 bp, Homo sapiens
tggcttcatggcaagtcttagt

SEQ ID NO: 9277726 - DNA, 22 bp, Homo sapiens
tggcttcagttcctgtgttgtt

SEQ ID NO: 9277727 - DNA, 17 bp, Homo sapiens
tggcttcaggctgagca

SEQ ID NO: 9277728 - DNA, 22 bp, Homo sapiens
tggctgagagaagacggggaag

SEQ ID NO: 9277729 - DNA, 22 bp, Homo sapiens
tggctgagaccttcccaaattc

SEQ ID NO: 9277730 - DNA, 22 bp, Homo sapiens
tggctgagaccttcccaaattc

SEQ ID NO: 9277731 - DNA, 22 bp, Homo sapiens
tggctgagaccatcagggtgta

SEQ ID NO: 9277732 - DNA, 16 bp, Homo sapiens
tggctgagagagggtt

SEQ ID NO: 9277733 - DNA, 22 bp, Homo sapiens
tggctgagagaagacggggaag

SEQ ID NO: 9277734 - DNA, 16 bp, Homo sapiens
tggctgagagagggtt

SEQ ID NO: 9277735 - DNA, 22 bp, Homo sapiens
tggctgctagccagagcttcag

SEQ ID NO: 9277736 - DNA, 22 bp, Homo sapiens
tggctgagaccatcagggtgta

SEQ ID NO: 9277737 - DNA, 22 bp, Homo sapiens
tggctgagaatgggatgatgcc

SEQ ID NO: 9277738 - DNA, 22 bp, Homo sapiens
tggctgagaccatcagggtgta

SEQ ID NO: 9277739 - DNA, 22 bp, Homo sapiens
tggctgagaccatcagggtgta

SEQ ID NO: 9277740 - DNA, 19 bp, Homo sapiens
tggctctgtcgaaggcaca

SEQ ID NO: 9277741 - DNA, 22 bp, Homo sapiens
tggctgagaatgggatgatgcc

SEQ ID NO: 9277742 - DNA, 22 bp, Homo sapiens
tggctgagaatgggatgatgcc

SEQ ID NO: 9277743 - DNA, 22 bp, Homo sapiens
tggctctgtcactgtgagctat

SEQ ID NO: 9277744 - DNA, 17 bp, Homo sapiens
tggctctgtcctcagct

SEQ ID NO: 9277745 - DNA, 17 bp, Homo sapiens
tggctctgtcctcagct

SEQ ID NO: 9277746 - DNA, 20 bp, Homo sapiens
cctctgcctttctagtctga

SEQ ID NO: 9277747 - DNA, 22 bp, Homo sapiens
cctctgctgctgttgagcaccg

SEQ ID NO: 9277748 - DNA, 22 bp, Homo sapiens
tggcttccagtaatcaggattt

SEQ ID NO: 9277749 - DNA, 22 bp, Homo sapiens
tggcttccagaactgagcaaca

SEQ ID NO: 9277750 - DNA, 22 bp, Homo sapiens
tggcttccaaattatccctaga

SEQ ID NO: 9277751 - DNA, 22 bp, Homo sapiens
tggcttccactgtgtgccccct

SEQ ID NO: 9277752 - DNA, 22 bp, Homo sapiens
tggcttccagagctgctccacc

SEQ ID NO: 9277753 - DNA, 22 bp, Homo sapiens
cctctgcctgcacatcatcctg

SEQ ID NO: 9277754 - DNA, 22 bp, Homo sapiens
cctctgcctgcacatcatcctg

SEQ ID NO: 9277755 - DNA, 22 bp, Homo sapiens
cctctgcccttttcctgtatca

SEQ ID NO: 9277756 - DNA, 22 bp, Homo sapiens
cctctgagtcctccctggttgc

SEQ ID NO: 9277757 - DNA, 22 bp, Homo sapiens
tgggaagctgcattttaacaag

SEQ ID NO: 9277758 - DNA, 22 bp, Homo sapiens
tgggaagctgcattttaacaag

SEQ ID NO: 9277759 - DNA, 22 bp, Homo sapiens
tgggaagctactcatgcaggca

SEQ ID NO: 9277760 - DNA, 22 bp, Homo sapiens
tgggaaggacagaacataattg

SEQ ID NO: 9277761 - DNA, 22 bp, Homo sapiens
tgggaaggacgtgtcagtggca

SEQ ID NO: 9277762 - DNA, 22 bp, Homo sapiens
tgggaaggacgtgtcagtggca

SEQ ID NO: 9277763 - DNA, 22 bp, Homo sapiens
tgggaaggcagtcactgtccta

SEQ ID NO: 9277764 - DNA, 19 bp, Homo sapiens
cctctgtgggagtcagtga

SEQ ID NO: 9277765 - DNA, 22 bp, Homo sapiens
tgggcccaggtcctgggagaag

SEQ ID NO: 9277766 - DNA, 22 bp, Homo sapiens
tgggcccaggtcctgggagaag

SEQ ID NO: 9277767 - DNA, 22 bp, Homo sapiens
tgggcccaggtcctgggagaag

SEQ ID NO: 9277768 - DNA, 22 bp, Homo sapiens
tgggcccatcattgctgtgggc

SEQ ID NO: 9277769 - DNA, 22 bp, Homo sapiens
tgggccctgacttcaagcatcc

SEQ ID NO: 9277770 - DNA, 22 bp, Homo sapiens
tgggccctgcccttgtctgtcc

SEQ ID NO: 9277771 - DNA, 22 bp, Homo sapiens
tgggccctgcccttgtctgtcc

SEQ ID NO: 9277772 - DNA, 23 bp, Homo sapiens
tgggccctggagtcgccagtctg

SEQ ID NO: 9277773 - DNA, 22 bp, Homo sapiens
tgggctcctcgtcactcgctgt

SEQ ID NO: 9277774 - DNA, 22 bp, Homo sapiens
tgggctccttgggagcaagtga

SEQ ID NO: 9277775 - DNA, 22 bp, Homo sapiens
tgggctgctgttacaggggctg

SEQ ID NO: 9277776 - DNA, 22 bp, Homo sapiens
tgggctgctgtctgcacatgct

SEQ ID NO: 9277777 - DNA, 22 bp, Homo sapiens
cctgagctgaactaagcagttt

SEQ ID NO: 9277778 - DNA, 22 bp, Homo sapiens
cctgagctctgcactttttaga

SEQ ID NO: 9277779 - DNA, 22 bp, Homo sapiens
cctgagctgcggggcagtgctc

SEQ ID NO: 9277780 - DNA, 22 bp, Homo sapiens
cctgagctgactctcctttcag

SEQ ID NO: 9277781 - DNA, 22 bp, Homo sapiens
cctgagctggaagagcttgtgc

SEQ ID NO: 9277782 - DNA, 22 bp, Homo sapiens
cctgagctgcggggcagtgctc

SEQ ID NO: 9277783 - DNA, 22 bp, Homo sapiens
cctgagctggaagagcttgtgc

SEQ ID NO: 9277784 - DNA, 22 bp, Homo sapiens
cctgagctggaagagcttgtgc

SEQ ID NO: 9277785 - DNA, 22 bp, Homo sapiens
tggggaggaagtcagatttcag

SEQ ID NO: 9277786 - DNA, 22 bp, Homo sapiens
tgggctggagcttgttgcttcc

SEQ ID NO: 9277787 - DNA, 22 bp, Homo sapiens
tgggctggcccaccacacctcg

SEQ ID NO: 9277788 - DNA, 22 bp, Homo sapiens
tgggctggagcttgttgcttcc

SEQ ID NO: 9277789 - DNA, 21 bp, Homo sapiens
cctgagcctgtttatccagaa

SEQ ID NO: 9277790 - DNA, 22 bp, Homo sapiens
cctgagctagggaaggaagacc

SEQ ID NO: 9277791 - DNA, 22 bp, Homo sapiens
cctgagcctggctcatgcactc

SEQ ID NO: 9277792 - DNA, 22 bp, Homo sapiens
tgggctggcccaccacacctcg

SEQ ID NO: 9277793 - DNA, 22 bp, Homo sapiens
tgggctggcccaccacacctcg

SEQ ID NO: 9277794 - DNA, 22 bp, Homo sapiens
cctgagcctgagtggtgcaggg

SEQ ID NO: 9277795 - DNA, 22 bp, Homo sapiens
cctgagcctgcagccgagcaga

SEQ ID NO: 9277796 - DNA, 22 bp, Homo sapiens
tgggccatttttggaagactgg

SEQ ID NO: 9277797 - DNA, 22 bp, Homo sapiens
tgggccagtttctcattgaaat

SEQ ID NO: 9277798 - DNA, 22 bp, Homo sapiens
tgggccagtttctcattgaaat

SEQ ID NO: 9277799 - DNA, 22 bp, Homo sapiens
cctgagcatcagcgcctcctta

SEQ ID NO: 9277800 - DNA, 22 bp, Homo sapiens
cctgagcatcagcgcctcctta

SEQ ID NO: 9277801 - DNA, 19 bp, Homo sapiens
cctgagattcctccttttc

SEQ ID NO: 9277802 - DNA, 23 bp, Homo sapiens
cctgagatctgtaagggaccttg

SEQ ID NO: 9277803 - DNA, 21 bp, Homo sapiens
cctgagatctggagtggcttt

SEQ ID NO: 9277804 - DNA, 22 bp, Homo sapiens
cctgagagagaagcgacctggt

SEQ ID NO: 9277805 - DNA, 21 bp, Homo sapiens
cctgagatctggagtggcttt

SEQ ID NO: 9277806 - DNA, 22 bp, Homo sapiens
cctgagaccaagttgcagccat

SEQ ID NO: 9277807 - DNA, 22 bp, Homo sapiens
cctgagaccaagttgcagccat

SEQ ID NO: 9277808 - DNA, 18 bp, Homo sapiens
tgggagtgggagtggata

SEQ ID NO: 9277809 - DNA, 19 bp, Homo sapiens
tgggagtggggaaggtcct

SEQ ID NO: 9277810 - DNA, 18 bp, Homo sapiens
tgggagtgggagtggata

SEQ ID NO: 9277811 - DNA, 22 bp, Homo sapiens
tgggagtgttcttggcttgctt

SEQ ID NO: 9277812 - DNA, 19 bp, Homo sapiens
tgggagtggggaaggtcct

SEQ ID NO: 9277813 - DNA, 22 bp, Homo sapiens
tgggagtggggcatagaaggta

SEQ ID NO: 9277814 - DNA, 22 bp, Homo sapiens
cctcttctaggacgtccttgtg

SEQ ID NO: 9277815 - DNA, 22 bp, Homo sapiens
cctcttctcaactccagccaga

SEQ ID NO: 9277816 - DNA, 22 bp, Homo sapiens
cctcttctaggtttcagcctgc

SEQ ID NO: 9277817 - DNA, 17 bp, Homo sapiens
cctcttcctctcagctg

SEQ ID NO: 9277818 - DNA, 22 bp, Homo sapiens
cctcttcctcaccatctacaac

SEQ ID NO: 9277819 - DNA, 22 bp, Homo sapiens
tggcctgggcatgaagcatcgt

SEQ ID NO: 9277820 - DNA, 22 bp, Homo sapiens
tggcctggctgccctgtctgga

SEQ ID NO: 9277821 - DNA, 22 bp, Homo sapiens
tggcctggctgccctgtctgga

SEQ ID NO: 9277822 - DNA, 22 bp, Homo sapiens
tggcctggctgccctgtctgga

SEQ ID NO: 9277823 - DNA, 22 bp, Homo sapiens
tggcctgggcctgccggtgcaa

SEQ ID NO: 9277824 - DNA, 22 bp, Homo sapiens
tggcctgggccggcagatatac

SEQ ID NO: 9277825 - DNA, 22 bp, Homo sapiens
tggcctgggcctgccggtgcaa

SEQ ID NO: 9277826 - DNA, 22 bp, Homo sapiens
tggcctgggcctgccggtgcaa

SEQ ID NO: 9277827 - DNA, 22 bp, Homo sapiens
tggcctggggaagaccatgggc

SEQ ID NO: 9277828 - DNA, 22 bp, Homo sapiens
tggcctggggaagaccatgggc

SEQ ID NO: 9277829 - DNA, 22 bp, Homo sapiens
tggcctggggacctgtgagacc

SEQ ID NO: 9277830 - DNA, 22 bp, Homo sapiens
tggcctggggacctgtgagacc

SEQ ID NO: 9277831 - DNA, 21 bp, Homo sapiens
tggctctgggtaggagagtgc

SEQ ID NO: 9277832 - DNA, 22 bp, Homo sapiens
tggctctggtgcgggctcctgc

SEQ ID NO: 9277833 - DNA, 22 bp, Homo sapiens
tggcctggctcacagtgagatt

SEQ ID NO: 9277834 - DNA, 22 bp, Homo sapiens
tggcctggctgccctgtctgga

SEQ ID NO: 9277835 - DNA, 22 bp, Homo sapiens
tggcctggctgccctgtctgga

SEQ ID NO: 9277836 - DNA, 23 bp, Homo sapiens
cctcatgaaggtctgcttcctgg

SEQ ID NO: 9277837 - DNA, 22 bp, Homo sapiens
cctcagggactccatgctgcag

SEQ ID NO: 9277838 - DNA, 22 bp, Homo sapiens
cctcaggctctgggtgcctacc

SEQ ID NO: 9277839 - DNA, 22 bp, Homo sapiens
cctcaggctgctcacacttgtc

SEQ ID NO: 9277840 - DNA, 22 bp, Homo sapiens
cctcaggctgctcacacttgtc

SEQ ID NO: 9277841 - DNA, 22 bp, Homo sapiens
cctcaggctagctactgtccct

SEQ ID NO: 9277842 - DNA, 22 bp, Homo sapiens
cctcaggcctctgcctcattgg

SEQ ID NO: 9277843 - DNA, 22 bp, Homo sapiens
cctcaggcttcgtcttccaccc

SEQ ID NO: 9277844 - DNA, 22 bp, Homo sapiens
cctcaggcttctagttcagtga

SEQ ID NO: 9277845 - DNA, 22 bp, Homo sapiens
cctcaggcttctagttcagtga

SEQ ID NO: 9277846 - DNA, 22 bp, Homo sapiens
cctcaggcttgtgagccttcag

SEQ ID NO: 9277847 - DNA, 20 bp, Homo sapiens
tggcccagcacgacgaggac

SEQ ID NO: 9277848 - DNA, 17 bp, Homo sapiens
cctcagcttctttcctc

SEQ ID NO: 9277849 - DNA, 22 bp, Homo sapiens
cctcagaggttttcattctgta

SEQ ID NO: 9277850 - DNA, 21 bp, Homo sapiens
cccttcttgggtcaaagtata

SEQ ID NO: 9277851 - DNA, 22 bp, Homo sapiens
tggcagaggagaattaagatta

SEQ ID NO: 9277852 - DNA, 22 bp, Homo sapiens
tggcagaggagaattaagatta

SEQ ID NO: 9277853 - DNA, 19 bp, Homo sapiens
tggcagaggacaaggactt

SEQ ID NO: 9277854 - DNA, 19 bp, Homo sapiens
tggcagaggacaaggactt

SEQ ID NO: 9277855 - DNA, 21 bp, Homo sapiens
cccttctgctccagctttgcc

SEQ ID NO: 9277856 - DNA, 19 bp, Homo sapiens
tggcagaggacaaggactt

SEQ ID NO: 9277857 - DNA, 19 bp, Homo sapiens
tggcagaggacaaggactt

SEQ ID NO: 9277858 - DNA, 22 bp, Homo sapiens
cccttcctcctcgcctgtcaga

SEQ ID NO: 9277859 - DNA, 22 bp, Homo sapiens
cccttcctcctcgcctgtcaga

SEQ ID NO: 9277860 - DNA, 22 bp, Homo sapiens
cccttcctggagtaccctctgt

SEQ ID NO: 9277861 - DNA, 22 bp, Homo sapiens
cccttcctgggtgtcccggagt

SEQ ID NO: 9277862 - DNA, 22 bp, Homo sapiens
cccttcctcctcgcctgtcaga

SEQ ID NO: 9277863 - DNA, 22 bp, Homo sapiens
ccctgcaggggacctgcagcct

SEQ ID NO: 9277864 - DNA, 22 bp, Homo sapiens
ccctgcaggggacctgcagcct

SEQ ID NO: 9277865 - DNA, 22 bp, Homo sapiens
ccctgcagggaggattctgaag

SEQ ID NO: 9277866 - DNA, 22 bp, Homo sapiens
ccctgtgggccatgtgtctaca

SEQ ID NO: 9277867 - DNA, 23 bp, Homo sapiens
ccctgcagtcagggtgagatggt

SEQ ID NO: 9277868 - DNA, 22 bp, Homo sapiens
ccctgcaggggacctgcagcct

SEQ ID NO: 9277869 - DNA, 22 bp, Homo sapiens
ccctgcaggggacctgcagcct

SEQ ID NO: 9277870 - DNA, 22 bp, Homo sapiens
ccctgcaggctcagactggagt

SEQ ID NO: 9277871 - DNA, 21 bp, Homo sapiens
ccctgcaggccagggctgagc

SEQ ID NO: 9277872 - DNA, 22 bp, Homo sapiens
tggagcagggcatcactgtgcg

SEQ ID NO: 9277873 - DNA, 22 bp, Homo sapiens
tggagcagggcatcactgtgcg

SEQ ID NO: 9277874 - DNA, 22 bp, Homo sapiens
tggagcaggccggaagtggctt

SEQ ID NO: 9277875 - DNA, 22 bp, Homo sapiens
tggagcaggccggaagtggctt

SEQ ID NO: 9277876 - DNA, 22 bp, Homo sapiens
ccctgcagccttgcatgccttc

SEQ ID NO: 9277877 - DNA, 22 bp, Homo sapiens
ccctgcagccttgcatgccttc

SEQ ID NO: 9277878 - DNA, 22 bp, Homo sapiens
ccctgcagccttgcatgccttc

SEQ ID NO: 9277879 - DNA, 18 bp, Homo sapiens
tggagcaggtaggcatga

SEQ ID NO: 9277880 - DNA, 18 bp, Homo sapiens
tggagcaggtaggcatga

SEQ ID NO: 9277881 - DNA, 18 bp, Homo sapiens
cctaagctccagccccag

SEQ ID NO: 9277882 - DNA, 22 bp, Homo sapiens
tggcagaggtaattcaaatccc

SEQ ID NO: 9277883 - DNA, 22 bp, Homo sapiens
tggcagaggctctgtgatgttg

SEQ ID NO: 9277884 - DNA, 22 bp, Homo sapiens
tggcagaggtaattcaaatccc

SEQ ID NO: 9277885 - DNA, 22 bp, Homo sapiens
tggcagaggagaattaagatta

SEQ ID NO: 9277886 - DNA, 22 bp, Homo sapiens
tggcagaggagaattaagatta

SEQ ID NO: 9277887 - DNA, 22 bp, Homo sapiens
tggcagaggaggctcagattga

SEQ ID NO: 9277888 - DNA, 22 bp, Homo sapiens
tggcagaggaggctcagattga

SEQ ID NO: 9277889 - DNA, 19 bp, Homo sapiens
tggcagaggcagtttgtac

SEQ ID NO: 9277890 - DNA, 22 bp, Homo sapiens
tggcagaggctctgtgatgttg

SEQ ID NO: 9277891 - DNA, 19 bp, Homo sapiens
cctagagggaaggcaggac

SEQ ID NO: 9277892 - DNA, 23 bp, Homo sapiens
cctagattcaaagcttataattc

SEQ ID NO: 9277893 - DNA, 22 bp, Homo sapiens
cctagcagggaagcagtgagga

SEQ ID NO: 9277894 - DNA, 22 bp, Homo sapiens
cctagccccagatatctcacac

SEQ ID NO: 9277895 - DNA, 22 bp, Homo sapiens
cctagaggctgcaaggagaggc

SEQ ID NO: 9277896 - DNA, 22 bp, Homo sapiens
cctagagctctgctttatctaa

SEQ ID NO: 9277897 - DNA, 22 bp, Homo sapiens
cctagactagaggcagggagcc

SEQ ID NO: 9277898 - DNA, 22 bp, Homo sapiens
tggcagggtgggcttcagcccc

SEQ ID NO: 9277899 - DNA, 22 bp, Homo sapiens
tggcagggttggccaccttacc

SEQ ID NO: 9277900 - DNA, 22 bp, Homo sapiens
cctcagaatagtcctcagatca

SEQ ID NO: 9277901 - DNA, 22 bp, Homo sapiens
cctcagaaggacaagagacaaa

SEQ ID NO: 9277902 - DNA, 22 bp, Homo sapiens
tggcaggtagtcagaggcgaca

SEQ ID NO: 9277903 - DNA, 22 bp, Homo sapiens
tggcaggtagagttctgagatg

SEQ ID NO: 9277904 - DNA, 18 bp, Homo sapiens
tggcaggtagactcaggt

SEQ ID NO: 9277905 - DNA, 22 bp, Homo sapiens
cccgcaggggcagccctcatcc

SEQ ID NO: 9277906 - DNA, 22 bp, Homo sapiens
cccgactagctgggattacagg

SEQ ID NO: 9277907 - DNA, 22 bp, Homo sapiens
cccgagcctcggtttcttttct

SEQ ID NO: 9277908 - DNA, 22 bp, Homo sapiens
ccccttctctgcaagcctgctc

SEQ ID NO: 9277909 - DNA, 23 bp, Homo sapiens
cccctctggtggctcagctcctg

SEQ ID NO: 9277910 - DNA, 22 bp, Homo sapiens
tgctggctttttggtccttgct

SEQ ID NO: 9277911 - DNA, 22 bp, Homo sapiens
tgctgggatatagcttctaggg

SEQ ID NO: 9277912 - DNA, 22 bp, Homo sapiens
tgctgggattacagtcatgagc

SEQ ID NO: 9277913 - DNA, 22 bp, Homo sapiens
tgctggctttgcgagatgcatt

SEQ ID NO: 9277914 - DNA, 22 bp, Homo sapiens
cccattcatcctcgcttccttc

SEQ ID NO: 9277915 - DNA, 22 bp, Homo sapiens
cccattcatcctcgcttccttc

SEQ ID NO: 9277916 - DNA, 22 bp, Homo sapiens
cccattccctttactgttgcat

SEQ ID NO: 9277917 - DNA, 22 bp, Homo sapiens
cccagttgttgccggctctgga

SEQ ID NO: 9277918 - DNA, 22 bp, Homo sapiens
cccattcatcctcgcttccttc

SEQ ID NO: 9277919 - DNA, 22 bp, Homo sapiens
cccaggtctatgccagctctga

SEQ ID NO: 9277920 - DNA, 22 bp, Homo sapiens
cccaggtctatgccagctctga

SEQ ID NO: 9277921 - DNA, 22 bp, Homo sapiens
cccaggtcgtcagcagtgtggt

SEQ ID NO: 9277922 - DNA, 22 bp, Homo sapiens
cccaggtccccacctgtctgct

SEQ ID NO: 9277923 - DNA, 23 bp, Homo sapiens
cccaggtcaaaattcacaggcct

SEQ ID NO: 9277924 - DNA, 22 bp, Homo sapiens
cccatttgtatagagccttata

SEQ ID NO: 9277925 - DNA, 22 bp, Homo sapiens
cccatttgtccaaagtataaaa

SEQ ID NO: 9277926 - DNA, 22 bp, Homo sapiens
cccattttgcttatgctgctgt

SEQ ID NO: 9277927 - DNA, 22 bp, Homo sapiens
ccccaaagcctcagcctgcctg

SEQ ID NO: 9277928 - DNA, 22 bp, Homo sapiens
ccccaaagctgagttcccgcct

SEQ ID NO: 9277929 - DNA, 19 bp, Homo sapiens
ccccaaagtttagatgttg

SEQ ID NO: 9277930 - DNA, 22 bp, Homo sapiens
ccccaaagtgttggataattga

SEQ ID NO: 9277931 - DNA, 22 bp, Homo sapiens
ccccacagcttgtggagagaat

SEQ ID NO: 9277932 - DNA, 22 bp, Homo sapiens
ccccaaggtgctcactgtctgg

SEQ ID NO: 9277933 - DNA, 22 bp, Homo sapiens
ccccacaactcatgttgaaact

SEQ ID NO: 9277934 - DNA, 22 bp, Homo sapiens
ccccaccaccaaggctcagttt

SEQ ID NO: 9277935 - DNA, 22 bp, Homo sapiens
ccccaccatgtagaaactgaga

SEQ ID NO: 9277936 - DNA, 22 bp, Homo sapiens
ccctcctctccctaagagtcac

SEQ ID NO: 9277937 - DNA, 22 bp, Homo sapiens
tggaatgtggtatcagtagaaa

SEQ ID NO: 9277938 - DNA, 22 bp, Homo sapiens
tggaatgtgttctattttacag

SEQ ID NO: 9277939 - DNA, 22 bp, Homo sapiens
ccctcgccgcagctgcttcccg

SEQ ID NO: 9277940 - DNA, 22 bp, Homo sapiens
ccctcgctctaggcagccctgt

SEQ ID NO: 9277941 - DNA, 22 bp, Homo sapiens
tggaatggaaacaaactgagga

SEQ ID NO: 9277942 - DNA, 22 bp, Homo sapiens
tggaatggaaacaaactgagga

SEQ ID NO: 9277943 - DNA, 22 bp, Homo sapiens
tggaatggggactttgggacat

SEQ ID NO: 9277944 - DNA, 22 bp, Homo sapiens
tggaatgtcagctacaagaggg

SEQ ID NO: 9277945 - DNA, 22 bp, Homo sapiens
tggaatgtgctagggctgtggc

SEQ ID NO: 9277946 - DNA, 22 bp, Homo sapiens
tgctgtggttcccagagtggat

SEQ ID NO: 9277947 - DNA, 22 bp, Homo sapiens
tgctgtggattcagagatgaaa

SEQ ID NO: 9277948 - DNA, 22 bp, Homo sapiens
tgctgtgtaaaaggtgattgaa

SEQ ID NO: 9277949 - DNA, 22 bp, Homo sapiens
tgctgtgggcagtacataagct

SEQ ID NO: 9277950 - DNA, 22 bp, Homo sapiens
tgctgtggttcccagagtggat

SEQ ID NO: 9277951 - DNA, 22 bp, Homo sapiens
tgctgtggattcagagatgaaa

SEQ ID NO: 9277952 - DNA, 22 bp, Homo sapiens
tgctgtgctggcggcagaggcc

SEQ ID NO: 9277953 - DNA, 18 bp, Homo sapiens
cccggctaatttttggta

SEQ ID NO: 9277954 - DNA, 18 bp, Homo sapiens
cccggctaatttttggta

SEQ ID NO: 9277955 - DNA, 22 bp, Homo sapiens
tggaatggaaacaaactgagga

SEQ ID NO: 9277956 - DNA, 22 bp, Homo sapiens
tggaatggaaacaaactgagga

SEQ ID NO: 9277957 - DNA, 22 bp, Homo sapiens
tggaatggaaacaaactgagga

SEQ ID NO: 9277958 - DNA, 22 bp, Homo sapiens
tggaatggaaacaaactgagga

SEQ ID NO: 9277959 - DNA, 22 bp, Homo sapiens
tggaatggaaacaaactgagga

SEQ ID NO: 9277960 - DNA, 22 bp, Homo sapiens
tggaagggagctggaatttgga

SEQ ID NO: 9277961 - DNA, 22 bp, Homo sapiens
tgctgtgttcaccaatatgtgt

SEQ ID NO: 9277962 - DNA, 22 bp, Homo sapiens
tgctgtgttaaatacaagcatg

SEQ ID NO: 9277963 - DNA, 22 bp, Homo sapiens
tggagcaagctggagagaacat

SEQ ID NO: 9277964 - DNA, 22 bp, Homo sapiens
tggagcaggcatctttctctct

SEQ ID NO: 9277965 - DNA, 16 bp, Homo sapiens
tggagcaggcaggatg

SEQ ID NO: 9277966 - DNA, 22 bp, Homo sapiens
tggagcaggactgctgccctca

SEQ ID NO: 9277967 - DNA, 22 bp, Homo sapiens
tggagcaggacggggagtggta

SEQ ID NO: 9277968 - DNA, 22 bp, Homo sapiens
ccctgagcccatagttgacatt

SEQ ID NO: 9277969 - DNA, 22 bp, Homo sapiens
ccctgagccacacagagcaggt

SEQ ID NO: 9277970 - DNA, 22 bp, Homo sapiens
ccctgagccgcctgccgtgtcc

SEQ ID NO: 9277971 - DNA, 22 bp, Homo sapiens
ccctgagccgctgctccaacct

SEQ ID NO: 9277972 - DNA, 22 bp, Homo sapiens
ccctgagcaacaaactgaatac

SEQ ID NO: 9277973 - DNA, 22 bp, Homo sapiens
ccctgagatgcctcaccctagt

SEQ ID NO: 9277974 - DNA, 22 bp, Homo sapiens
ccctgagagtgagtgccacctt

SEQ ID NO: 9277975 - DNA, 20 bp, Homo sapiens
ccctgagacaaaggaggggc

SEQ ID NO: 9277976 - DNA, 20 bp, Homo sapiens
ccctgagacaaaggaggggc

SEQ ID NO: 9277977 - DNA, 20 bp, Homo sapiens
ccctgagacaaaggaggggc

SEQ ID NO: 9277978 - DNA, 20 bp, Homo sapiens
ccctgagaccagagagcagc

SEQ ID NO: 9277979 - DNA, 22 bp, Homo sapiens
ccctgacagatggcaggggagc

SEQ ID NO: 9277980 - DNA, 22 bp, Homo sapiens
ccctgacccaaaactgtcagaa

SEQ ID NO: 9277981 - DNA, 22 bp, Homo sapiens
ccctctctcaggctgacagcct

SEQ ID NO: 9277982 - DNA, 19 bp, Homo sapiens
ccctcttgcacaaagcaaa

SEQ ID NO: 9277983 - DNA, 22 bp, Homo sapiens
cccagggtccctgctctctgtg

SEQ ID NO: 9277984 - DNA, 22 bp, Homo sapiens
cccagggttgcctgcctctgct

SEQ ID NO: 9277985 - DNA, 23 bp, Homo sapiens
cccaggtagccctctagagcctg

SEQ ID NO: 9277986 - DNA, 20 bp, Homo sapiens
cccaggggttgtggtgagga

SEQ ID NO: 9277987 - DNA, 22 bp, Homo sapiens
cccaggggttctgagcagcagc

SEQ ID NO: 9277988 - DNA, 22 bp, Homo sapiens
cccaggggttctagaccagctt

SEQ ID NO: 9277989 - DNA, 22 bp, Homo sapiens
cccaggggttcaaggctgcagt

SEQ ID NO: 9277990 - DNA, 22 bp, Homo sapiens
cccaggggttcaaggctgcagt

SEQ ID NO: 9277991 - DNA, 22 bp, Homo sapiens
cccagggacagatgggcagcta

SEQ ID NO: 9277992 - DNA, 22 bp, Homo sapiens
cccagggacagatgggcagcta

SEQ ID NO: 9277993 - DNA, 22 bp, Homo sapiens
cccagggacagctaggtggggc

SEQ ID NO: 9277994 - DNA, 17 bp, Homo sapiens
cccagggaccactgctt

SEQ ID NO: 9277995 - DNA, 22 bp, Homo sapiens
cccagggacagatgggcagcta

SEQ ID NO: 9277996 - DNA, 17 bp, Homo sapiens
cccagggaccactgctt

SEQ ID NO: 9277997 - DNA, 22 bp, Homo sapiens
tgcctgtgtggtctgcgcatta

SEQ ID NO: 9277998 - DNA, 22 bp, Homo sapiens
tgccttcaccaggccttcagcc

SEQ ID NO: 9277999 - DNA, 22 bp, Homo sapiens
cccagggccctggacagctaca

SEQ ID NO: 9278000 - DNA, 22 bp, Homo sapiens
cccagggattataaaggtgaaa

SEQ ID NO: 9278001 - DNA, 22 bp, Homo sapiens
tgcctgttattgttggcttagt

SEQ ID NO: 9278002 - DNA, 22 bp, Homo sapiens
tgcctgttgcccacctgataaa

SEQ ID NO: 9278003 - DNA, 22 bp, Homo sapiens
tgcctgttgcccacctgataaa

SEQ ID NO: 9278004 - DNA, 22 bp, Homo sapiens
cccaggctggtcctgaactcct

SEQ ID NO: 9278005 - DNA, 22 bp, Homo sapiens
cccaggctggtcctgaactcct

SEQ ID NO: 9278006 - DNA, 22 bp, Homo sapiens
cccaggctggggctcctccagc

SEQ ID NO: 9278007 - DNA, 21 bp, Homo sapiens
cccagggaagccgcagtcacc

SEQ ID NO: 9278008 - DNA, 22 bp, Homo sapiens
cccagggaatgactctggcctt

SEQ ID NO: 9278009 - DNA, 22 bp, Homo sapiens
cccagggaagggctacctgagg

SEQ ID NO: 9278010 - DNA, 22 bp, Homo sapiens
cccagggaaggcagatggagga

SEQ ID NO: 9278011 - DNA, 23 bp, Homo sapiens
cccagggacacgatgacacctcc

SEQ ID NO: 9278012 - DNA, 22 bp, Homo sapiens
cccagggaatgactctggcctt

SEQ ID NO: 9278013 - DNA, 23 bp, Homo sapiens
cccagggacacgatgacacctcc

SEQ ID NO: 9278014 - DNA, 22 bp, Homo sapiens
cccaggctgggaacgattctag

SEQ ID NO: 9278015 - DNA, 22 bp, Homo sapiens
cccaggctgggaacgattctag

SEQ ID NO: 9278016 - DNA, 22 bp, Homo sapiens
cccaggctggggctcctccagc

SEQ ID NO: 9278017 - DNA, 22 bp, Homo sapiens
cccaggctggcctccgcagtgc

SEQ ID NO: 9278018 - DNA, 22 bp, Homo sapiens
cccaggctggcactgctgaagt

SEQ ID NO: 9278019 - DNA, 22 bp, Homo sapiens
cccaggctggcctccgcagtgc

SEQ ID NO: 9278020 - DNA, 22 bp, Homo sapiens
cccaggctggatttcggtggca

SEQ ID NO: 9278021 - DNA, 22 bp, Homo sapiens
cccaggctggatttcggtggca

SEQ ID NO: 9278022 - DNA, 22 bp, Homo sapiens
cccaggctggagtgtaatggtg

SEQ ID NO: 9278023 - DNA, 22 bp, Homo sapiens
cccaggctggagtgtaatggtg

SEQ ID NO: 9278024 - DNA, 22 bp, Homo sapiens
cccaggctggcactgctgaagt

SEQ ID NO: 9278025 - DNA, 22 bp, Homo sapiens
cccaggctggcactgctgaagt

SEQ ID NO: 9278026 - DNA, 22 bp, Homo sapiens
cccaggctggcactgctgaagt

SEQ ID NO: 9278027 - DNA, 22 bp, Homo sapiens
cccaggctggatttcggtggca

SEQ ID NO: 9278028 - DNA, 22 bp, Homo sapiens
cccaggctggatttcggtggca

SEQ ID NO: 9278029 - DNA, 22 bp, Homo sapiens
tgccctggtgaagtgctctcct

SEQ ID NO: 9278030 - DNA, 22 bp, Homo sapiens
tgccctggtgaagtgctctcct

SEQ ID NO: 9278031 - DNA, 22 bp, Homo sapiens
cccaggctggagggcagtgtca

SEQ ID NO: 9278032 - DNA, 22 bp, Homo sapiens
cccaggctggaattccaggcct

SEQ ID NO: 9278033 - DNA, 22 bp, Homo sapiens
cccaggctggagggcagtgtca

SEQ ID NO: 9278034 - DNA, 22 bp, Homo sapiens
cccaggctggaattccaggcct

SEQ ID NO: 9278035 - DNA, 22 bp, Homo sapiens
cccaggctgagttagaggtgtc

SEQ ID NO: 9278036 - DNA, 22 bp, Homo sapiens
cccaggctgagttagaggtgtc

SEQ ID NO: 9278037 - DNA, 22 bp, Homo sapiens
cccaggctggagtgcaatggtg

SEQ ID NO: 9278038 - DNA, 22 bp, Homo sapiens
cccaggctggagtgcaatggtg

SEQ ID NO: 9278039 - DNA, 22 bp, Homo sapiens
cccaggctggagtgcaatggtg

SEQ ID NO: 9278040 - DNA, 22 bp, Homo sapiens
cccaggctggagtgcagtggcg

SEQ ID NO: 9278041 - DNA, 22 bp, Homo sapiens
cccaggctggagtgcagtggcg

SEQ ID NO: 9278042 - DNA, 22 bp, Homo sapiens
cccaggctggagtgcagtggcg

SEQ ID NO: 9278043 - DNA, 22 bp, Homo sapiens
cccaggctggagtgcaatggca

SEQ ID NO: 9278044 - DNA, 22 bp, Homo sapiens
cccaggctggagtgcaatggca

SEQ ID NO: 9278045 - DNA, 22 bp, Homo sapiens
cccaggctggagtgcaatggtg

SEQ ID NO: 9278046 - DNA, 22 bp, Homo sapiens
cccaggctggagtgcaatggca

SEQ ID NO: 9278047 - DNA, 22 bp, Homo sapiens
cccaggctggagtgcaatggca

SEQ ID NO: 9278048 - DNA, 22 bp, Homo sapiens
cccaggctggagggcagtgtca

SEQ ID NO: 9278049 - DNA, 22 bp, Homo sapiens
cccaggctggagggcagtgtca

SEQ ID NO: 9278050 - DNA, 22 bp, Homo sapiens
tgccaggctaagtggaggactt

SEQ ID NO: 9278051 - DNA, 22 bp, Homo sapiens
tgccagtctcaccctgggtcct

SEQ ID NO: 9278052 - DNA, 22 bp, Homo sapiens
tgccagtgcttgtgtctgagca

SEQ ID NO: 9278053 - DNA, 22 bp, Homo sapiens
tgccagtgggtgtgcagagact

SEQ ID NO: 9278054 - DNA, 22 bp, Homo sapiens
cccaggagagaggccagttggc

SEQ ID NO: 9278055 - DNA, 22 bp, Homo sapiens
cccaggagagaggccagttggc

SEQ ID NO: 9278056 - DNA, 22 bp, Homo sapiens
cccaggagagaggccagttggc

SEQ ID NO: 9278057 - DNA, 22 bp, Homo sapiens
cccaggagagagacttgaatct

SEQ ID NO: 9278058 - DNA, 22 bp, Homo sapiens
cccaggagagaggggataaagc

SEQ ID NO: 9278059 - DNA, 22 bp, Homo sapiens
cccaggagagaggggataaagc

SEQ ID NO: 9278060 - DNA, 22 bp, Homo sapiens
cccaggagagggaaccaaatgt

SEQ ID NO: 9278061 - DNA, 22 bp, Homo sapiens
cccaggagagggaaccaaatgt

SEQ ID NO: 9278062 - DNA, 22 bp, Homo sapiens
cccaggagacctgtgaaaggac

SEQ ID NO: 9278063 - DNA, 22 bp, Homo sapiens
cccaggagacctagatctgttt

SEQ ID NO: 9278064 - DNA, 22 bp, Homo sapiens
cccaggagacctagatctgttt

SEQ ID NO: 9278065 - DNA, 22 bp, Homo sapiens
cccaggagacctagatctgttt

SEQ ID NO: 9278066 - DNA, 22 bp, Homo sapiens
cccaggagactgagctgtaacc

SEQ ID NO: 9278067 - DNA, 22 bp, Homo sapiens
cccaggagactgagctgtaacc

SEQ ID NO: 9278068 - DNA, 22 bp, Homo sapiens
cccaggagacctgtgaaaggac

SEQ ID NO: 9278069 - DNA, 22 bp, Homo sapiens
cccaggagagagacttgaatct

SEQ ID NO: 9278070 - DNA, 22 bp, Homo sapiens
cccaggagagagacttgaatct

SEQ ID NO: 9278071 - DNA, 22 bp, Homo sapiens
cccaggagacatatagaaggac

SEQ ID NO: 9278072 - DNA, 22 bp, Homo sapiens
cccaggagacatatagaaggac

SEQ ID NO: 9278073 - DNA, 22 bp, Homo sapiens
tgccagctccgaggagctgcag

SEQ ID NO: 9278074 - DNA, 22 bp, Homo sapiens
tgccagctcccttttctcctcc

SEQ ID NO: 9278075 - DNA, 22 bp, Homo sapiens
tgccacagaggtgaagcccact

SEQ ID NO: 9278076 - DNA, 22 bp, Homo sapiens
tgcacagagagatgagacacgt

SEQ ID NO: 9278077 - DNA, 21 bp, Homo sapiens
tgccagctgctgcatctgtct

SEQ ID NO: 9278078 - DNA, 22 bp, Homo sapiens
tgccagcttttgactatcttag

SEQ ID NO: 9278079 - DNA, 22 bp, Homo sapiens
tgccagcttttgactatcttag

SEQ ID NO: 9278080 - DNA, 22 bp, Homo sapiens
tgcccagctgtcaaagtagata

SEQ ID NO: 9278081 - DNA, 23 bp, Homo sapiens
cccaggctacaaattatgctctg

SEQ ID NO: 9278082 - DNA, 22 bp, Homo sapiens
tgccagttgggaaaacagacat

SEQ ID NO: 9278083 - DNA, 22 bp, Homo sapiens
tgccagtgtggaactaggaaga

SEQ ID NO: 9278084 - DNA, 22 bp, Homo sapiens
tgccagtgtggaactaggaaga

SEQ ID NO: 9278085 - DNA, 22 bp, Homo sapiens
tgccagtgggtgtgcagagact

SEQ ID NO: 9278086 - DNA, 22 bp, Homo sapiens
tgccatattgcaaagtgtctgc

SEQ ID NO: 9278087 - DNA, 22 bp, Homo sapiens
tgccatagcaatggtaagctga

SEQ ID NO: 9278088 - DNA, 22 bp, Homo sapiens
tgcccagccaatttgttatgtt

SEQ ID NO: 9278089 - DNA, 22 bp, Homo sapiens
tgcccagccagtttatggtaat

SEQ ID NO: 9278090 - DNA, 22 bp, Homo sapiens
cccaggctagaaaggccaacaa

SEQ ID NO: 9278091 - DNA, 19 bp, Homo sapiens
cccaggctacatggagagg

SEQ ID NO: 9278092 - DNA, 19 bp, Homo sapiens
cccaggctacatggagagg

SEQ ID NO: 9278093 - DNA, 22 bp, Homo sapiens
cccaggctagtatgatatcagt

SEQ ID NO: 9278094 - DNA, 22 bp, Homo sapiens
cccaggctagtatgatatcagt

SEQ ID NO: 9278095 - DNA, 22 bp, Homo sapiens
cccaggctagaaaggccaacaa

SEQ ID NO: 9278096 - DNA, 22 bp, Homo sapiens
cccaggctcagactggcttgtt

SEQ ID NO: 9278097 - DNA, 22 bp, Homo sapiens
cccaggctcccaggtgggacaa

SEQ ID NO: 9278098 - DNA, 22 bp, Homo sapiens
cccaggctcagactggcttgtt

SEQ ID NO: 9278099 - DNA, 22 bp, Homo sapiens
cccaggctcactgtccgcttcc

SEQ ID NO: 9278100 - DNA, 22 bp, Homo sapiens
cccaggctcagactggcttgtt

SEQ ID NO: 9278101 - DNA, 22 bp, Homo sapiens
cccaggctcactgtccgcttcc

SEQ ID NO: 9278102 - DNA, 22 bp, Homo sapiens
tgccctggggagcccagccagg

SEQ ID NO: 9278103 - DNA, 21 bp, Homo sapiens
tgccctggggctcttccctca

SEQ ID NO: 9278104 - DNA, 21 bp, Homo sapiens
tgccctggggctcttccctca

SEQ ID NO: 9278105 - DNA, 22 bp, Homo sapiens
tgccctggggtctggagcagca

SEQ ID NO: 9278106 - DNA, 22 bp, Homo sapiens
tgccctgggagttggagctgct

SEQ ID NO: 9278107 - DNA, 22 bp, Homo sapiens
cccaggctcccaggtgggacaa

SEQ ID NO: 9278108 - DNA, 22 bp, Homo sapiens
cccaggctcccaggtgggacaa

SEQ ID NO: 9278109 - DNA, 22 bp, Homo sapiens
cccaggctcccaggtgggacaa

SEQ ID NO: 9278110 - DNA, 22 bp, Homo sapiens
cccaggctcccaggtgggacaa

SEQ ID NO: 9278111 - DNA, 22 bp, Homo sapiens
cagttataagactaagctattc

SEQ ID NO: 9278112 - DNA, 22 bp, Homo sapiens
cagttctggaggctccacatct

SEQ ID NO: 9278113 - DNA, 22 bp, Homo sapiens
cagttctggagtttcattcttt

SEQ ID NO: 9278114 - DNA, 20 bp, Homo sapiens
cagttgaaataatttgtttg

SEQ ID NO: 9278115 - DNA, 22 bp, Homo sapiens
cagttgaaaagattttattctg

SEQ ID NO: 9278116 - DNA, 22 bp, Homo sapiens
tcaatagcaatcaagccttcca

SEQ ID NO: 9278117 - DNA, 22 bp, Homo sapiens
tcaatagattaggtattagatt

SEQ ID NO: 9278118 - DNA, 22 bp, Homo sapiens
tcaatagagccttctttcaggt

SEQ ID NO: 9278119 - DNA, 22 bp, Homo sapiens
tcaatatagcagtgtacttgag

SEQ ID NO: 9278120 - DNA, 22 bp, Homo sapiens
tcaatattcttctttagtagga

SEQ ID NO: 9278121 - DNA, 22 bp, Homo sapiens
tcaatgaaagagcatgcatttt

SEQ ID NO: 9278122 - DNA, 22 bp, Homo sapiens
tcaatgaaagagcatgcatttt

SEQ ID NO: 9278123 - DNA, 22 bp, Homo sapiens
tcagagatcttcaggatgggac

SEQ ID NO: 9278124 - DNA, 22 bp, Homo sapiens
tcagagaggttggtgataagaa

SEQ ID NO: 9278125 - DNA, 22 bp, Homo sapiens
tcagagagtgcaaaatatagct

SEQ ID NO: 9278126 - DNA, 17 bp, Homo sapiens
cagttggagacaagtcc

SEQ ID NO: 9278127 - DNA, 22 bp, Homo sapiens
cagttgctggatgtgcagctct

SEQ ID NO: 9278128 - DNA, 22 bp, Homo sapiens
cagttgcagaggcagagtgcta

SEQ ID NO: 9278129 - DNA, 22 bp, Homo sapiens
tcagaggagccaaagttctgag

SEQ ID NO: 9278130 - DNA, 22 bp, Homo sapiens
tcagaggagatggttaccaggg

SEQ ID NO: 9278131 - DNA, 22 bp, Homo sapiens
tcagaggagcaaaagaggggat

SEQ ID NO: 9278132 - DNA, 22 bp, Homo sapiens
tcagaggaggcatttaaacaga

SEQ ID NO: 9278133 - DNA, 22 bp, Homo sapiens
tcagaggaggcatttaaacaga

SEQ ID NO: 9278134 - DNA, 22 bp, Homo sapiens
tcagaggagggactcagaccca

SEQ ID NO: 9278135 - DNA, 22 bp, Homo sapiens
tcagaggatcatgtccctactc

SEQ ID NO: 9278136 - DNA, 23 bp, Homo sapiens
tcagaggatcatcaaacgttttc

SEQ ID NO: 9278137 - DNA, 22 bp, Homo sapiens
tcagaggatagaaatacttatt

SEQ ID NO: 9278138 - DNA, 22 bp, Homo sapiens
tcagaggatgctgttctttaat

SEQ ID NO: 9278139 - DNA, 22 bp, Homo sapiens
tcagatagtgataatagcatgt

SEQ ID NO: 9278140 - DNA, 23 bp, Homo sapiens
cataaaatattagtatggtagca

SEQ ID NO: 9278141 - DNA, 23 bp, Homo sapiens
cataaaatattagtatggtagca

SEQ ID NO: 9278142 - DNA, 23 bp, Homo sapiens
cataaaatattagtatggtagca

SEQ ID NO: 9278143 - DNA, 22 bp, Homo sapiens
cataaaatggcttgttctttaa

SEQ ID NO: 9278144 - DNA, 22 bp, Homo sapiens
cataaaagccacctatttaaag

SEQ ID NO: 9278145 - DNA, 22 bp, Homo sapiens
cagtttttcaaaattacatgat

SEQ ID NO: 9278146 - DNA, 22 bp, Homo sapiens
cagtttttgccattaagagtaa

SEQ ID NO: 9278147 - DNA, 22 bp, Homo sapiens
cagtttttcaaaattacatgat

SEQ ID NO: 9278148 - DNA, 17 bp, Homo sapiens
cataaaacagttctatt

SEQ ID NO: 9278149 - DNA, 22 bp, Homo sapiens
cagtttttgccattaagagtaa

SEQ ID NO: 9278150 - DNA, 22 bp, Homo sapiens
cagttttcttgttatatttggg

SEQ ID NO: 9278151 - DNA, 22 bp, Homo sapiens
cagtttttagattagttggtgg

SEQ ID NO: 9278152 - DNA, 22 bp, Homo sapiens
cagttttccatgactcagagag

SEQ ID NO: 9278153 - DNA, 22 bp, Homo sapiens
cagttttctatggtagaagcat

SEQ ID NO: 9278154 - DNA, 18 bp, Homo sapiens
cataattttctttcttta

SEQ ID NO: 9278155 - DNA, 22 bp, Homo sapiens
cataattttccatggtttgcta

SEQ ID NO: 9278156 - DNA, 22 bp, Homo sapiens
cataatttgtggtagtggggga

SEQ ID NO: 9278157 - DNA, 22 bp, Homo sapiens
cataatttgatatgcttgatgg

SEQ ID NO: 9278158 - DNA, 22 bp, Homo sapiens
cataatttgatatgcttgatgg

SEQ ID NO: 9278159 - DNA, 22 bp, Homo sapiens
cataatttctaccagggccata

SEQ ID NO: 9278160 - DNA, 22 bp, Homo sapiens
cataatttctgtatcagcacca

SEQ ID NO: 9278161 - DNA, 22 bp, Homo sapiens
tcaggccaggagatcagattga

SEQ ID NO: 9278162 - DNA, 18 bp, Homo sapiens
cataattttctttcttta

SEQ ID NO: 9278163 - DNA, 22 bp, Homo sapiens
cataattactgatatgctgatt

SEQ ID NO: 9278164 - DNA, 22 bp, Homo sapiens
cataattactgatatgctgatt

SEQ ID NO: 9278165 - DNA, 22 bp, Homo sapiens
cataattaggcagttgatcatt

SEQ ID NO: 9278166 - DNA, 22 bp, Homo sapiens
cataattagagaattcatgtta

SEQ ID NO: 9278167 - DNA, 22 bp, Homo sapiens
cataattaaattctgggcaaga

SEQ ID NO: 9278168 - DNA, 22 bp, Homo sapiens
cataattaaattctgggcaaga

SEQ ID NO: 9278169 - DNA, 22 bp, Homo sapiens
cataattaggcagttgatcatt

SEQ ID NO: 9278170 - DNA, 22 bp, Homo sapiens
cataattagagaattcatgtta

SEQ ID NO: 9278171 - DNA, 22 bp, Homo sapiens
cataattagtcatgttatgcat

SEQ ID NO: 9278172 - DNA, 22 bp, Homo sapiens
cataattaggcagttgatcatt

SEQ ID NO: 9278173 - DNA, 22 bp, Homo sapiens
cataattaggcagttgatcatt

SEQ ID NO: 9278174 - DNA, 22 bp, Homo sapiens
cataattataaacgcaagttca

SEQ ID NO: 9278175 - DNA, 22 bp, Homo sapiens
cataattagtcatgttatgcat

SEQ ID NO: 9278176 - DNA, 22 bp, Homo sapiens
cataattataaacgcaagttca

SEQ ID NO: 9278177 - DNA, 22 bp, Homo sapiens
cataattagtcatgttatgcat

SEQ ID NO: 9278178 - DNA, 22 bp, Homo sapiens
cataatttcactgtcgtatggc

SEQ ID NO: 9278179 - DNA, 22 bp, Homo sapiens
cataatttcccaagagattgaa

SEQ ID NO: 9278180 - DNA, 22 bp, Homo sapiens
cataatttcccaagagattgaa

SEQ ID NO: 9278181 - DNA, 22 bp, Homo sapiens
tcagcaggtggtgggcaggtga

SEQ ID NO: 9278182 - DNA, 22 bp, Homo sapiens
cataatatctccgattacttgc

SEQ ID NO: 9278183 - DNA, 22 bp, Homo sapiens
cataatatctccgattacttgc

SEQ ID NO: 9278184 - DNA, 22 bp, Homo sapiens
cataatatctccgattacttgc

SEQ ID NO: 9278185 - DNA, 22 bp, Homo sapiens
cataacatccttgctactttga

SEQ ID NO: 9278186 - DNA, 22 bp, Homo sapiens
cataatatctccgattacttgc

SEQ ID NO: 9278187 - DNA, 22 bp, Homo sapiens
cataatcagatgtgtacataag

SEQ ID NO: 9278188 - DNA, 22 bp, Homo sapiens
catagaaatcaggtgagaatct

SEQ ID NO: 9278189 - DNA, 22 bp, Homo sapiens
catagaaagtattatggaattt

SEQ ID NO: 9278190 - DNA, 22 bp, Homo sapiens
catagaaactgagacaaggatt

SEQ ID NO: 9278191 - DNA, 22 bp, Homo sapiens
catagaaactgagacaaggatt

SEQ ID NO: 9278192 - DNA, 22 bp, Homo sapiens
catagaaactgagacaaggatt

SEQ ID NO: 9278193 - DNA, 22 bp, Homo sapiens
tcaggcccttctcccaggactc

SEQ ID NO: 9278194 - DNA, 22 bp, Homo sapiens
tcaggctgcctatcagactgtg

SEQ ID NO: 9278195 - DNA, 22 bp, Homo sapiens
tcaggctgcctatcagactgtg

SEQ ID NO: 9278196 - DNA, 22 bp, Homo sapiens
catagaatatgtgtgattgtta

SEQ ID NO: 9278197 - DNA, 17 bp, Homo sapiens
tcaggctgtgcctggta

SEQ ID NO: 9278198 - DNA, 17 bp, Homo sapiens
tcaggctgtgcctggta

SEQ ID NO: 9278199 - DNA, 17 bp, Homo sapiens
tcaggctgtgcctggta

SEQ ID NO: 9278200 - DNA, 21 bp, Homo sapiens
tcaggctgtctgctggttcca

SEQ ID NO: 9278201 - DNA, 22 bp, Homo sapiens
tcaggctgtatatcttgcactc

SEQ ID NO: 9278202 - DNA, 22 bp, Homo sapiens
tcaggctgtgggcactggccat

SEQ ID NO: 9278203 - DNA, 22 bp, Homo sapiens
tcaggctgtgggcactggccat

SEQ ID NO: 9278204 - DNA, 22 bp, Homo sapiens
tcaggctgtgggcactggccat

SEQ ID NO: 9278205 - DNA, 22 bp, Homo sapiens
tcaggctgtggctttgaccgca

SEQ ID NO: 9278206 - DNA, 22 bp, Homo sapiens
tcaggctgtggcttcagttctt

SEQ ID NO: 9278207 - DNA, 22 bp, Homo sapiens
tcagggagaggtgagagcctgt

SEQ ID NO: 9278208 - DNA, 22 bp, Homo sapiens
tcagggagagtgacccatccac

SEQ ID NO: 9278209 - DNA, 22 bp, Homo sapiens
tcaggctgtgtctttaaacaat

SEQ ID NO: 9278210 - DNA, 22 bp, Homo sapiens
tcaggctgtgggcactggccat

SEQ ID NO: 9278211 - DNA, 19 bp, Homo sapiens
catctggatgattctcctg

SEQ ID NO: 9278212 - DNA, 22 bp, Homo sapiens
catctgctgttccttggactca

SEQ ID NO: 9278213 - DNA, 22 bp, Homo sapiens
catctgtaaagtaggaatattg

SEQ ID NO: 9278214 - DNA, 22 bp, Homo sapiens
catctgtagctccatgacaatt

SEQ ID NO: 9278215 - DNA, 22 bp, Homo sapiens
catctgtaggtgacacatgagt

SEQ ID NO: 9278216 - DNA, 22 bp, Homo sapiens
catctgaatttgccttagtttc

SEQ ID NO: 9278217 - DNA, 22 bp, Homo sapiens
catctgaagtgaattgcttttt

SEQ ID NO: 9278218 - DNA, 22 bp, Homo sapiens
catctgaaatctgcctacaagc

SEQ ID NO: 9278219 - DNA, 22 bp, Homo sapiens
catctgcctaagtggccctgtt

SEQ ID NO: 9278220 - DNA, 22 bp, Homo sapiens
catgaacaccaggcatgaacaa

SEQ ID NO: 9278221 - DNA, 22 bp, Homo sapiens
catgaacaaattctgtttgagg

SEQ ID NO: 9278222 - DNA, 22 bp, Homo sapiens
catgaacaatttgctcactgat

SEQ ID NO: 9278223 - DNA, 21 bp, Homo sapiens
catgaacatgcttatcctcag

SEQ ID NO: 9278224 - DNA, 22 bp, Homo sapiens
catgaacagctaacattttggg

SEQ ID NO: 9278225 - DNA, 22 bp, Homo sapiens
catgaacattcagaaatacagc

SEQ ID NO: 9278226 - DNA, 22 bp, Homo sapiens
catcttaaaatgtgtcataact

SEQ ID NO: 9278227 - DNA, 22 bp, Homo sapiens
catcttaaattaaagcttaagg

SEQ ID NO: 9278228 - DNA, 22 bp, Homo sapiens
tcagggagggacctgaggctgg

SEQ ID NO: 9278229 - DNA, 22 bp, Homo sapiens
tcagggagatttggggactcaa

SEQ ID NO: 9278230 - DNA, 22 bp, Homo sapiens
tcagtcattgtccttaaaacac

SEQ ID NO: 9278231 - DNA, 22 bp, Homo sapiens
tcagtccactaagacccttgtt

SEQ ID NO: 9278232 - DNA, 22 bp, Homo sapiens
tcagtcccaaggtcctgaggtg

SEQ ID NO: 9278233 - DNA, 20 bp, Homo sapiens
tcagtgctcaggcaccaggt

SEQ ID NO: 9278234 - DNA, 22 bp, Homo sapiens
tcagtgctaaaagagctggtgt

SEQ ID NO: 9278235 - DNA, 22 bp, Homo sapiens
tcagtgctaaaagagctggtgt

SEQ ID NO: 9278236 - DNA, 22 bp, Homo sapiens
tcagtgctgccatggcagggcc

SEQ ID NO: 9278237 - DNA, 22 bp, Homo sapiens
tcagtgctgagtagcgtgcacc

SEQ ID NO: 9278238 - DNA, 22 bp, Homo sapiens
catgcaggttatatgtgcttct

SEQ ID NO: 9278239 - DNA, 22 bp, Homo sapiens
catgcagtattcaggacagttc

SEQ ID NO: 9278240 - DNA, 22 bp, Homo sapiens
catgcagtattcaggacagttc

SEQ ID NO: 9278241 - DNA, 22 bp, Homo sapiens
catgcagtcaataaacatgtgt

SEQ ID NO: 9278242 - DNA, 22 bp, Homo sapiens
catgcagtgaaattgatatcca

SEQ ID NO: 9278243 - DNA, 22 bp, Homo sapiens
catgcagtgactcagacacagg

SEQ ID NO: 9278244 - DNA, 22 bp, Homo sapiens
catgcagtctggagccttctgt

SEQ ID NO: 9278245 - DNA, 22 bp, Homo sapiens
catgcagtgactcagacacagg

SEQ ID NO: 9278246 - DNA, 22 bp, Homo sapiens
catgcagtgactcagacacagg

SEQ ID NO: 9278247 - DNA, 22 bp, Homo sapiens
catgcagtgatgcactgcatca

SEQ ID NO: 9278248 - DNA, 22 bp, Homo sapiens
catgcagggagcagaggagaca

SEQ ID NO: 9278249 - DNA, 22 bp, Homo sapiens
catgcagggactagagaacagg

SEQ ID NO: 9278250 - DNA, 22 bp, Homo sapiens
catgcagtttctctatgcgtag

SEQ ID NO: 9278251 - DNA, 22 bp, Homo sapiens
catgcagttgaagcacagagag

SEQ ID NO: 9278252 - DNA, 22 bp, Homo sapiens
catgcagttgaagcacagagag

SEQ ID NO: 9278253 - DNA, 22 bp, Homo sapiens
catgcagtgcctctggattctt

SEQ ID NO: 9278254 - DNA, 22 bp, Homo sapiens
catgcagtggtaaaaagtcagg

SEQ ID NO: 9278255 - DNA, 22 bp, Homo sapiens
catgcagtgctttgcgccgggc

SEQ ID NO: 9278256 - DNA, 22 bp, Homo sapiens
catgcagtgtgtatctacttaa

SEQ ID NO: 9278257 - DNA, 22 bp, Homo sapiens
catgcagtggtaaaaagtcagg

SEQ ID NO: 9278258 - DNA, 22 bp, Homo sapiens
catgcagttgaagcacagagag

SEQ ID NO: 9278259 - DNA, 22 bp, Homo sapiens
catgcacacacagttctaatta

SEQ ID NO: 9278260 - DNA, 22 bp, Homo sapiens
catgagaaccaggtctgtgttt

SEQ ID NO: 9278261 - DNA, 22 bp, Homo sapiens
catgacatctgcttagtatgaa

SEQ ID NO: 9278262 - DNA, 22 bp, Homo sapiens
catgaatttatattattagtga

SEQ ID NO: 9278263 - DNA, 22 bp, Homo sapiens
catgacaatatgttctttcatt

SEQ ID NO: 9278264 - DNA, 22 bp, Homo sapiens
catgacacccaggcatagcacc

SEQ ID NO: 9278265 - DNA, 22 bp, Homo sapiens
catgaatatacatcctgatggc

SEQ ID NO: 9278266 - DNA, 22 bp, Homo sapiens
catgaatatttagtatttactt

SEQ ID NO: 9278267 - DNA, 22 bp, Homo sapiens
catgaatatttagtatttactt

SEQ ID NO: 9278268 - DNA, 22 bp, Homo sapiens
catgaatatacatcctgatggc

SEQ ID NO: 9278269 - DNA, 22 bp, Homo sapiens
catggcagctttgggaggagga

SEQ ID NO: 9278270 - DNA, 22 bp, Homo sapiens
catgcatgtttactacagtgac

SEQ ID NO: 9278271 - DNA, 22 bp, Homo sapiens
catgcattcagaatctctcaca

SEQ ID NO: 9278272 - DNA, 22 bp, Homo sapiens
catgcattcagaatctctcaca

SEQ ID NO: 9278273 - DNA, 22 bp, Homo sapiens
catggcagagcctgcaggtggg

SEQ ID NO: 9278274 - DNA, 22 bp, Homo sapiens
catggaaggcaaaagacacaga

SEQ ID NO: 9278275 - DNA, 22 bp, Homo sapiens
catggaactgtataaaggcact

SEQ ID NO: 9278276 - DNA, 22 bp, Homo sapiens
catgcatttggagttttcaagt

SEQ ID NO: 9278277 - DNA, 22 bp, Homo sapiens
catggccaaggatgctcaacca

SEQ ID NO: 9278278 - DNA, 22 bp, Homo sapiens
catggccacatctagctgcaag

SEQ ID NO: 9278279 - DNA, 20 bp, Homo sapiens
tccagctgggaacagctgat

SEQ ID NO: 9278280 - DNA, 22 bp, Homo sapiens
catggcaggatctgggcccaca

SEQ ID NO: 9278281 - DNA, 22 bp, Homo sapiens
catggcattgcataacggggct

SEQ ID NO: 9278282 - DNA, 22 bp, Homo sapiens
catgggcagttggcagggctca

SEQ ID NO: 9278283 - DNA, 22 bp, Homo sapiens
catgggcagttggcagggctca

SEQ ID NO: 9278284 - DNA, 22 bp, Homo sapiens
catgggccatggtgaagccagg

SEQ ID NO: 9278285 - DNA, 22 bp, Homo sapiens
tccatcaccacagaggacagag

SEQ ID NO: 9278286 - DNA, 22 bp, Homo sapiens
catgggctctctgagctccagg

SEQ ID NO: 9278287 - DNA, 22 bp, Homo sapiens
tccattttagaagaaaatccac

SEQ ID NO: 9278288 - DNA, 22 bp, Homo sapiens
tccattttgtaggtatgctaca

SEQ ID NO: 9278289 - DNA, 22 bp, Homo sapiens
tccattttcatctcatgtataa

SEQ ID NO: 9278290 - DNA, 22 bp, Homo sapiens
tccattttctaagtatcactta

SEQ ID NO: 9278291 - DNA, 22 bp, Homo sapiens
tccaggagaccagatgtaggcc

SEQ ID NO: 9278292 - DNA, 17 bp, Homo sapiens
tccaggagaggcaatgg

SEQ ID NO: 9278293 - DNA, 23 bp, Homo sapiens
tccaggagaattccagggcccgg

SEQ ID NO: 9278294 - DNA, 22 bp, Homo sapiens
tccaggagaggcctgaccaggt

SEQ ID NO: 9278295 - DNA, 22 bp, Homo sapiens
tccaggagatacactgcaccag

SEQ ID NO: 9278296 - DNA, 22 bp, Homo sapiens
tccaggagaggtgtggggactg

SEQ ID NO: 9278297 - DNA, 22 bp, Homo sapiens
catgggaggtctgcaaggtgct

SEQ ID NO: 9278298 - DNA, 22 bp, Homo sapiens
catgggcaccttaaaatgaggc

SEQ ID NO: 9278299 - DNA, 22 bp, Homo sapiens
tccaggagcatccaggtgaagc

SEQ ID NO: 9278300 - DNA, 22 bp, Homo sapiens
catgggaggcctgctgctggtg

SEQ ID NO: 9278301 - DNA, 19 bp, Homo sapiens
tccaggagcaaagccagtt

SEQ ID NO: 9278302 - DNA, 22 bp, Homo sapiens
cattctgggtctggctcaggga

SEQ ID NO: 9278303 - DNA, 17 bp, Homo sapiens
cattctgtaatctttct

SEQ ID NO: 9278304 - DNA, 22 bp, Homo sapiens
cattcttatatttactcattca

SEQ ID NO: 9278305 - DNA, 22 bp, Homo sapiens
cattcttacacaatattttaat

SEQ ID NO: 9278306 - DNA, 22 bp, Homo sapiens
cattcttacacaatattttaat

SEQ ID NO: 9278307 - DNA, 22 bp, Homo sapiens
cattcttatatttactcattca

SEQ ID NO: 9278308 - DNA, 22 bp, Homo sapiens
cattctctctacttgttttcaa

SEQ ID NO: 9278309 - DNA, 22 bp, Homo sapiens
cattctctgatcttcacatacc

SEQ ID NO: 9278310 - DNA, 22 bp, Homo sapiens
cattctctgatcttcacatacc

SEQ ID NO: 9278311 - DNA, 22 bp, Homo sapiens
cattctctgatcttcacatacc

SEQ ID NO: 9278312 - DNA, 22 bp, Homo sapiens
cattacatggtccaggatatat

SEQ ID NO: 9278313 - DNA, 22 bp, Homo sapiens
cattacatttcaaaatgtttcc

SEQ ID NO: 9278314 - DNA, 22 bp, Homo sapiens
cattacttctcatgcttcatgc

SEQ ID NO: 9278315 - DNA, 22 bp, Homo sapiens
cattacatggtccaggatatat

SEQ ID NO: 9278316 - DNA, 22 bp, Homo sapiens
cattacatctttgatgcagtat

SEQ ID NO: 9278317 - DNA, 22 bp, Homo sapiens
tcccaaagaactgaatagtaat

SEQ ID NO: 9278318 - DNA, 22 bp, Homo sapiens
cattagctcagatacctctgag

SEQ ID NO: 9278319 - DNA, 22 bp, Homo sapiens
cattaggtatttaagcacacag

SEQ ID NO: 9278320 - DNA, 22 bp, Homo sapiens
cattagcaggcactaagaaggt

SEQ ID NO: 9278321 - DNA, 22 bp, Homo sapiens
cattagcaggcactaagaaggt

SEQ ID NO: 9278322 - DNA, 22 bp, Homo sapiens
cattagcagtcattactgtgct

SEQ ID NO: 9278323 - DNA, 22 bp, Homo sapiens
cattcatttatgaaatatctat

SEQ ID NO: 9278324 - DNA, 22 bp, Homo sapiens
cattcatttgcccagtaagtca

SEQ ID NO: 9278325 - DNA, 22 bp, Homo sapiens
cattctcaatagtagatgagta

SEQ ID NO: 9278326 - DNA, 22 bp, Homo sapiens
cattctcaatagtagatgagta

SEQ ID NO: 9278327 - DNA, 18 bp, Homo sapiens
cattgtacaatgctttat

SEQ ID NO: 9278328 - DNA, 22 bp, Homo sapiens
cattgtcacccaaagctcatag

SEQ ID NO: 9278329 - DNA, 22 bp, Homo sapiens
cattgtcacccaaagctcatag

SEQ ID NO: 9278330 - DNA, 22 bp, Homo sapiens
cattgtattgaggatacttaag

SEQ ID NO: 9278331 - DNA, 22 bp, Homo sapiens
cattgtcattctatgctattca

SEQ ID NO: 9278332 - DNA, 22 bp, Homo sapiens
cattgtcacccaaagctcatag

SEQ ID NO: 9278333 - DNA, 22 bp, Homo sapiens
cattgtcacccaaagctcatag

SEQ ID NO: 9278334 - DNA, 22 bp, Homo sapiens
cattgttatagcattacacacc

SEQ ID NO: 9278335 - DNA, 22 bp, Homo sapiens
cattgttcaacactgacttgca

SEQ ID NO: 9278336 - DNA, 22 bp, Homo sapiens
cattgttaattggtatcttaca

SEQ ID NO: 9278337 - DNA, 22 bp, Homo sapiens
cattgttaccatcttttaccta

SEQ ID NO: 9278338 - DNA, 22 bp, Homo sapiens
cattgtttgtaaaattccagta

SEQ ID NO: 9278339 - DNA, 22 bp, Homo sapiens
catttaaaggttgtgggtaaaa

SEQ ID NO: 9278340 - DNA, 22 bp, Homo sapiens
cattgttttgagaacaacctga

SEQ ID NO: 9278341 - DNA, 22 bp, Homo sapiens
catttaaaggttgtgggtaaaa

SEQ ID NO: 9278342 - DNA, 22 bp, Homo sapiens
catttacaatgtacaggttgtg

SEQ ID NO: 9278343 - DNA, 22 bp, Homo sapiens
catttacacacagaggtgtgct

SEQ ID NO: 9278344 - DNA, 22 bp, Homo sapiens
catttaatagatgctgtttcag

SEQ ID NO: 9278345 - DNA, 22 bp, Homo sapiens
catttacacttctaaccacaag

SEQ ID NO: 9278346 - DNA, 20 bp, Homo sapiens
tccctcctgcagatagagaa

SEQ ID NO: 9278347 - DNA, 22 bp, Homo sapiens
tccctcctggtgatgatgcaaa

SEQ ID NO: 9278348 - DNA, 22 bp, Homo sapiens
tccctcctggccgtcaccgctg

SEQ ID NO: 9278349 - DNA, 18 bp, Homo sapiens
tccctcctgcctgcttcc

SEQ ID NO: 9278350 - DNA, 22 bp, Homo sapiens
tccctgctttcttgtgagggga

SEQ ID NO: 9278351 - DNA, 22 bp, Homo sapiens
catttattgagtggccacagtg

SEQ ID NO: 9278352 - DNA, 20 bp, Homo sapiens
tccctggggccctacttcct

SEQ ID NO: 9278353 - DNA, 22 bp, Homo sapiens
tccctggggtatcgctgaggca

SEQ ID NO: 9278354 - DNA, 22 bp, Homo sapiens
tccctgggtcattctctggcac

SEQ ID NO: 9278355 - DNA, 20 bp, Homo sapiens
tcctaactataaagtggctc

SEQ ID NO: 9278356 - DNA, 22 bp, Homo sapiens
tcctaactaatttgtagcaaaa

SEQ ID NO: 9278357 - DNA, 23 bp, Homo sapiens
tcctaactcaattcaggggtgtc

SEQ ID NO: 9278358 - DNA, 22 bp, Homo sapiens
tcctaactgccctgggcaaggt

SEQ ID NO: 9278359 - DNA, 18 bp, Homo sapiens
tcctaacttagatactcc

SEQ ID NO: 9278360 - DNA, 16 bp, Homo sapiens
tcctaactggcagttc

SEQ ID NO: 9278361 - DNA, 22 bp, Homo sapiens
tcctaactccactagccttggg

SEQ ID NO: 9278362 - DNA, 23 bp, Homo sapiens
tcctaactgattctgcagtctct

SEQ ID NO: 9278363 - DNA, 22 bp, Homo sapiens
tccctgggtcctgcttgctctc

SEQ ID NO: 9278364 - DNA, 22 bp, Homo sapiens
tccctgggttacctttcaaggt

SEQ ID NO: 9278365 - DNA, 22 bp, Homo sapiens
tccctgggttcccgtggaagtg

SEQ ID NO: 9278366 - DNA, 22 bp, Homo sapiens
tccctgggtcctgcttgctctc

SEQ ID NO: 9278367 - DNA, 22 bp, Homo sapiens
tccctcctttatcaaaaagaga

SEQ ID NO: 9278368 - DNA, 22 bp, Homo sapiens
tccctctccctattgcctggag

SEQ ID NO: 9278369 - DNA, 22 bp, Homo sapiens
tccctctccctattgcctggag

SEQ ID NO: 9278370 - DNA, 22 bp, Homo sapiens
tccctctctagcctgttcagta

SEQ ID NO: 9278371 - DNA, 22 bp, Homo sapiens
tccctctccctattgcctggag

SEQ ID NO: 9278372 - DNA, 22 bp, Homo sapiens
tccctctccctattgcctggag

SEQ ID NO: 9278373 - DNA, 22 bp, Homo sapiens
tccctctcttgggcgtggctca

SEQ ID NO: 9278374 - DNA, 22 bp, Homo sapiens
catttattagttagttcgatgt

SEQ ID NO: 9278375 - DNA, 22 bp, Homo sapiens
tccctctctggctggggtgcgg

SEQ ID NO: 9278376 - DNA, 22 bp, Homo sapiens
tccctctctggctggggtgcgg

SEQ ID NO: 9278377 - DNA, 22 bp, Homo sapiens
tccctctctagcctgttcagta

SEQ ID NO: 9278378 - DNA, 22 bp, Homo sapiens
catttattcagctcagtcggtt

SEQ ID NO: 9278379 - DNA, 22 bp, Homo sapiens
catttattctcagatccttgtc

SEQ ID NO: 9278380 - DNA, 22 bp, Homo sapiens
catttattctcagatccttgtc

SEQ ID NO: 9278381 - DNA, 22 bp, Homo sapiens
catttattctcagatccttgtc

SEQ ID NO: 9278382 - DNA, 22 bp, Homo sapiens
catttattcatgatctgtagct

SEQ ID NO: 9278383 - DNA, 22 bp, Homo sapiens
catttattcatgatctgtagct

SEQ ID NO: 9278384 - DNA, 22 bp, Homo sapiens
catttattcatttgctagggct

SEQ ID NO: 9278385 - DNA, 17 bp, Homo sapiens
tccttcagtgcctctgc

SEQ ID NO: 9278386 - DNA, 17 bp, Homo sapiens
tccttcagtgcctctgc

SEQ ID NO: 9278387 - DNA, 22 bp, Homo sapiens
tccttcagtgtcccgctcaggt

SEQ ID NO: 9278388 - DNA, 22 bp, Homo sapiens
tccttcagttaaagatctcaca

SEQ ID NO: 9278389 - DNA, 22 bp, Homo sapiens
tccttaaaggactagaagtcaa

SEQ ID NO: 9278390 - DNA, 21 bp, Homo sapiens
tccttcagtctagatgattgt

SEQ ID NO: 9278391 - DNA, 22 bp, Homo sapiens
tccttcagtcttctgagccata

SEQ ID NO: 9278392 - DNA, 21 bp, Homo sapiens
tccttcagttctgcactttct

SEQ ID NO: 9278393 - DNA, 22 bp, Homo sapiens
tccttcagttatcacagtactg

SEQ ID NO: 9278394 - DNA, 22 bp, Homo sapiens
tccttcagttcaattagtccgt

SEQ ID NO: 9278395 - DNA, 19 bp, Homo sapiens
tcctggggaggggcatggc

SEQ ID NO: 9278396 - DNA, 19 bp, Homo sapiens
tcctggggaggggcatggc

SEQ ID NO: 9278397 - DNA, 22 bp, Homo sapiens
tcctgggcttgctcctccagct

SEQ ID NO: 9278398 - DNA, 22 bp, Homo sapiens
tcctgggcttgctcctccagct

SEQ ID NO: 9278399 - DNA, 22 bp, Homo sapiens
tcctgggcttgctcctccagct

SEQ ID NO: 9278400 - DNA, 22 bp, Homo sapiens
tcctgggcttgctcctccagct

SEQ ID NO: 9278401 - DNA, 22 bp, Homo sapiens
tcctgggcttcacagactctgt

SEQ ID NO: 9278402 - DNA, 22 bp, Homo sapiens
tcctgggcttcacagactctgt

SEQ ID NO: 9278403 - DNA, 22 bp, Homo sapiens
ccactgctaacttgctgcagct

SEQ ID NO: 9278404 - DNA, 22 bp, Homo sapiens
tcctttatgtgagttgtttccc

SEQ ID NO: 9278405 - DNA, 22 bp, Homo sapiens
tcctttatctgctcagaaagta

SEQ ID NO: 9278406 - DNA, 22 bp, Homo sapiens
tcctttatcaaggagccttaga

SEQ ID NO: 9278407 - DNA, 22 bp, Homo sapiens
tcctttatctgctcagaaagta

SEQ ID NO: 9278408 - DNA, 22 bp, Homo sapiens
tccttgtaacgttgggctgggg

SEQ ID NO: 9278409 - DNA, 22 bp, Homo sapiens
tccttgggtcagtgagtgaggt

SEQ ID NO: 9278410 - DNA, 22 bp, Homo sapiens
tccttcctgcaggccaagtcct

SEQ ID NO: 9278411 - DNA, 22 bp, Homo sapiens
tccttcctgcaggccaagtcct

SEQ ID NO: 9278412 - DNA, 21 bp, Homo sapiens
tctaagaacatgattctccct

SEQ ID NO: 9278413 - DNA, 22 bp, Homo sapiens
tctaagaaatcagatgatgagg

SEQ ID NO: 9278414 - DNA, 22 bp, Homo sapiens
ccacttgaaacttagtggcata

SEQ ID NO: 9278415 - DNA, 22 bp, Homo sapiens
tctaagccaggactgagagacg

SEQ ID NO: 9278416 - DNA, 22 bp, Homo sapiens
tctaagacactgtactttcagt

SEQ ID NO: 9278417 - DNA, 22 bp, Homo sapiens
ccactgtcttttccaggctgaa

SEQ ID NO: 9278418 - DNA, 22 bp, Homo sapiens
ccactgtctgtgacatcagaaa

SEQ ID NO: 9278419 - DNA, 22 bp, Homo sapiens
ccactgtcttttccaggctgaa

SEQ ID NO: 9278420 - DNA, 22 bp, Homo sapiens
ccactgtctgcaggcctcagca

SEQ ID NO: 9278421 - DNA, 22 bp, Homo sapiens
ccactgtcagaggggctgtgcc

SEQ ID NO: 9278422 - DNA, 22 bp, Homo sapiens
ccactgtaaccattatcaccat

SEQ ID NO: 9278423 - DNA, 22 bp, Homo sapiens
ccactgggggctgctcccaggt

SEQ ID NO: 9278424 - DNA, 22 bp, Homo sapiens
ccactgtaagtttgaaaataac

SEQ ID NO: 9278425 - DNA, 22 bp, Homo sapiens
ccactgtataagcaaaatgaaa

SEQ ID NO: 9278426 - DNA, 22 bp, Homo sapiens
tctaaggagcgctccagaaaaa

SEQ ID NO: 9278427 - DNA, 21 bp, Homo sapiens
tctaagccttgcagatgggtt

SEQ ID NO: 9278428 - DNA, 22 bp, Homo sapiens
tctaagcctgtgtcctctgcag

SEQ ID NO: 9278429 - DNA, 22 bp, Homo sapiens
tctaatcctatggtggggaggg

SEQ ID NO: 9278430 - DNA, 22 bp, Homo sapiens
tctaatctacaaaaggaaattc

SEQ ID NO: 9278431 - DNA, 22 bp, Homo sapiens
tctaatccttgctacctgggtg

SEQ ID NO: 9278432 - DNA, 22 bp, Homo sapiens
tcctggctccagcagctcttcc

SEQ ID NO: 9278433 - DNA, 22 bp, Homo sapiens
tcctgggactctttatcagaga

SEQ ID NO: 9278434 - DNA, 22 bp, Homo sapiens
tcctgggactctttatcagaga

SEQ ID NO: 9278435 - DNA, 22 bp, Homo sapiens
ccacagaacctcagctttgagc

SEQ ID NO: 9278436 - DNA, 22 bp, Homo sapiens
ccacagaaagttgtctagagta

SEQ ID NO: 9278437 - DNA, 22 bp, Homo sapiens
tcctgggagagtgggactgtat

SEQ ID NO: 9278438 - DNA, 22 bp, Homo sapiens
tcctgggagagtgggactgtat

SEQ ID NO: 9278439 - DNA, 22 bp, Homo sapiens
tcctgggagagtttgattcatt

SEQ ID NO: 9278440 - DNA, 22 bp, Homo sapiens
tcctgggagacccagctgtgga

SEQ ID NO: 9278441 - DNA, 22 bp, Homo sapiens
tcctgggagacccagctgtgga

SEQ ID NO: 9278442 - DNA, 22 bp, Homo sapiens
tcctgggagcccttgctccacc

SEQ ID NO: 9278443 - DNA, 22 bp, Homo sapiens
tcctgggagcccttgctccacc

SEQ ID NO: 9278444 - DNA, 22 bp, Homo sapiens
tcctgggcttaagtgatcctcc

SEQ ID NO: 9278445 - DNA, 22 bp, Homo sapiens
tcctgggcttaagtgatcctcc

SEQ ID NO: 9278446 - DNA, 22 bp, Homo sapiens
tcctgggagcatggtgccgtga

SEQ ID NO: 9278447 - DNA, 22 bp, Homo sapiens
tcctgggagcatggtgccgtga

SEQ ID NO: 9278448 - DNA, 22 bp, Homo sapiens
tcctgggagcccttgctccacc

SEQ ID NO: 9278449 - DNA, 22 bp, Homo sapiens
tcctgggagcacatggtcctgc

SEQ ID NO: 9278450 - DNA, 22 bp, Homo sapiens
tcctgggagagtttgattcatt

SEQ ID NO: 9278451 - DNA, 22 bp, Homo sapiens
ccacagaaagcctgggaagtgg

SEQ ID NO: 9278452 - DNA, 22 bp, Homo sapiens
ccacagaaaataaagcacgatt

SEQ ID NO: 9278453 - DNA, 22 bp, Homo sapiens
ccacactgaacctcagtgtctt

SEQ ID NO: 9278454 - DNA, 22 bp, Homo sapiens
ccacacagtcagtttccaagaa

SEQ ID NO: 9278455 - DNA, 19 bp, Homo sapiens
ccacacagtgtgcaattta

SEQ ID NO: 9278456 - DNA, 22 bp, Homo sapiens
ccaaggctggagtgcagtggcg

SEQ ID NO: 9278457 - DNA, 22 bp, Homo sapiens
ccaaggctggagggcttatgta

SEQ ID NO: 9278458 - DNA, 22 bp, Homo sapiens
ccaaggctgtggggctgtgcag

SEQ ID NO: 9278459 - DNA, 22 bp, Homo sapiens
ccaaggctgtcattcagtagct

SEQ ID NO: 9278460 - DNA, 22 bp, Homo sapiens
ccaaggctcctcagctggtctt

SEQ ID NO: 9278461 - DNA, 22 bp, Homo sapiens
tcctggaggacagaggcatctc

SEQ ID NO: 9278462 - DNA, 22 bp, Homo sapiens
tcctggaggacagaggcatctc

SEQ ID NO: 9278463 - DNA, 22 bp, Homo sapiens
ccaaggcttcctgacctacatg

SEQ ID NO: 9278464 - DNA, 22 bp, Homo sapiens
ccaaggcttcccagagatgctc

SEQ ID NO: 9278465 - DNA, 22 bp, Homo sapiens
ccaaggcttcccagagatgctc

SEQ ID NO: 9278466 - DNA, 22 bp, Homo sapiens
ccaaggcttcccagagatgctc

SEQ ID NO: 9278467 - DNA, 22 bp, Homo sapiens
ccaaggcaacgttggtgtcagg

SEQ ID NO: 9278468 - DNA, 22 bp, Homo sapiens
ccaaggcagaagatggctcttg

SEQ ID NO: 9278469 - DNA, 22 bp, Homo sapiens
ccaaggcacactctgcaaggtt

SEQ ID NO: 9278470 - DNA, 22 bp, Homo sapiens
ccaaggcatatggctgaaacca

SEQ ID NO: 9278471 - DNA, 22 bp, Homo sapiens
ccaagaggttgaggctgcagtg

SEQ ID NO: 9278472 - DNA, 22 bp, Homo sapiens
ccaagaggttgtgaggcaggca

SEQ ID NO: 9278473 - DNA, 22 bp, Homo sapiens
tcctacaatgcacagaatagcc

SEQ ID NO: 9278474 - DNA, 20 bp, Homo sapiens
tcctaataacctgaagaaat

SEQ ID NO: 9278475 - DNA, 22 bp, Homo sapiens
tcctacatcagctctcagtagc

SEQ ID NO: 9278476 - DNA, 22 bp, Homo sapiens
tcctagaactccaggacagtcc

SEQ ID NO: 9278477 - DNA, 22 bp, Homo sapiens
tcctagaacagcccacctggaa

SEQ ID NO: 9278478 - DNA, 22 bp, Homo sapiens
caggtcagaggcgcagccccca

SEQ ID NO: 9278479 - DNA, 22 bp, Homo sapiens
caggtcagaggtagatgagatg

SEQ ID NO: 9278480 - DNA, 22 bp, Homo sapiens
caggtaggtatggtgcagtctt

SEQ ID NO: 9278481 - DNA, 22 bp, Homo sapiens
caggtaggggagagctccaaca

SEQ ID NO: 9278482 - DNA, 22 bp, Homo sapiens
caggtagggatatgatggtgat

SEQ ID NO: 9278483 - DNA, 22 bp, Homo sapiens
caggtacactcccttgtgctga

SEQ ID NO: 9278484 - DNA, 22 bp, Homo sapiens
cagggtttctgttgagaagtcc

SEQ ID NO: 9278485 - DNA, 22 bp, Homo sapiens
caggtaaagcttcaaatcactt

SEQ ID NO: 9278486 - DNA, 22 bp, Homo sapiens
caggtaagaccgtttaggcagt

SEQ ID NO: 9278487 - DNA, 22 bp, Homo sapiens
caggtaggatggaagggctcaa

SEQ ID NO: 9278488 - DNA, 22 bp, Homo sapiens
caggtaggaggctccctagtcc

SEQ ID NO: 9278489 - DNA, 22 bp, Homo sapiens
caggtaggcagccggtctctgg

SEQ ID NO: 9278490 - DNA, 22 bp, Homo sapiens
caggtaggatggaagggctcaa

SEQ ID NO: 9278491 - DNA, 17 bp, Homo sapiens
caggtacattgctactg

SEQ ID NO: 9278492 - DNA, 22 bp, Homo sapiens
caggtccaactatttatctgtg

SEQ ID NO: 9278493 - DNA, 22 bp, Homo sapiens
caggtccaagagatcctcctac

SEQ ID NO: 9278494 - DNA, 18 bp, Homo sapiens
caggtcagcctggcctca

SEQ ID NO: 9278495 - DNA, 22 bp, Homo sapiens
caggtcagcacttggaggtgca

SEQ ID NO: 9278496 - DNA, 18 bp, Homo sapiens
caggtcagcctggcctca

SEQ ID NO: 9278497 - DNA, 22 bp, Homo sapiens
caggtgaagaggataaaaagtt

SEQ ID NO: 9278498 - DNA, 22 bp, Homo sapiens
caggtgaagaggataaaaagtt

SEQ ID NO: 9278499 - DNA, 22 bp, Homo sapiens
caggtgaatcacttgagtccag

SEQ ID NO: 9278500 - DNA, 22 bp, Homo sapiens
caggtgcctcaggatgagacaa

SEQ ID NO: 9278501 - DNA, 22 bp, Homo sapiens
caggtgccgggaatgcagcaat

SEQ ID NO: 9278502 - DNA, 22 bp, Homo sapiens
caggtgcccagctcctgctgtg

SEQ ID NO: 9278503 - DNA, 22 bp, Homo sapiens
caggtgctgcgtggcggagctg

SEQ ID NO: 9278504 - DNA, 22 bp, Homo sapiens
caggtgctctgctgcaggtaag

SEQ ID NO: 9278505 - DNA, 22 bp, Homo sapiens
tattatcattggtaatatggtc

SEQ ID NO: 9278506 - DNA, 20 bp, Homo sapiens
tattatgacctgtgttctgg

SEQ ID NO: 9278507 - DNA, 22 bp, Homo sapiens
tattatgagccaggtgctgtct

SEQ ID NO: 9278508 - DNA, 22 bp, Homo sapiens
tattatgaggcttagggatgac

SEQ ID NO: 9278509 - DNA, 22 bp, Homo sapiens
tattatgaggggcagagggcat

SEQ ID NO: 9278510 - DNA, 22 bp, Homo sapiens
tattatgaggactggtgtaagg

SEQ ID NO: 9278511 - DNA, 22 bp, Homo sapiens
tattatgattcggacgtggcag

SEQ ID NO: 9278512 - DNA, 22 bp, Homo sapiens
tattatgatcccagccctggag

SEQ ID NO: 9278513 - DNA, 22 bp, Homo sapiens
tattatgatcgtgactcaagga

SEQ ID NO: 9278514 - DNA, 22 bp, Homo sapiens
tattatgaggtatttggacttt

SEQ ID NO: 9278515 - DNA, 22 bp, Homo sapiens
tattatcattaactgttgaatt

SEQ ID NO: 9278516 - DNA, 22 bp, Homo sapiens
tattatcatgttaattagtggg

SEQ ID NO: 9278517 - DNA, 22 bp, Homo sapiens
tattatcagagctatttggaat

SEQ ID NO: 9278518 - DNA, 22 bp, Homo sapiens
tattatatttagtaatgtggag

SEQ ID NO: 9278519 - DNA, 22 bp, Homo sapiens
tattagttgcaaaacattgact

SEQ ID NO: 9278520 - DNA, 22 bp, Homo sapiens
tattatggcagcattcagtatg

SEQ ID NO: 9278521 - DNA, 22 bp, Homo sapiens
tattatggttgtaggttaacaa

SEQ ID NO: 9278522 - DNA, 22 bp, Homo sapiens
tattatggggggaacatcactc

SEQ ID NO: 9278523 - DNA, 22 bp, Homo sapiens
caggtgggtacatcacagagac

SEQ ID NO: 9278524 - DNA, 18 bp, Homo sapiens
caggtgggtctcctgccc

SEQ ID NO: 9278525 - DNA, 18 bp, Homo sapiens
caggtgggtctcctgccc

SEQ ID NO: 9278526 - DNA, 18 bp, Homo sapiens
caggtgggtctcctgccc

SEQ ID NO: 9278527 - DNA, 23 bp, Homo sapiens
caggtggctccacgaggggtggg

SEQ ID NO: 9278528 - DNA, 23 bp, Homo sapiens
caggtggctccacgaggggtggg

SEQ ID NO: 9278529 - DNA, 19 bp, Homo sapiens
caggtggcgctctacaggg

SEQ ID NO: 9278530 - DNA, 19 bp, Homo sapiens
caggtggcgctctacaggg

SEQ ID NO: 9278531 - DNA, 22 bp, Homo sapiens
tattaaatgttatttgggttgt

SEQ ID NO: 9278532 - DNA, 22 bp, Homo sapiens
caggtggatctctaaggactga

SEQ ID NO: 9278533 - DNA, 22 bp, Homo sapiens
caggtggagctgactgagggca

SEQ ID NO: 9278534 - DNA, 22 bp, Homo sapiens
caggtggcagaggtctctggaa

SEQ ID NO: 9278535 - DNA, 22 bp, Homo sapiens
caggtggcagaggtctctggaa

SEQ ID NO: 9278536 - DNA, 22 bp, Homo sapiens
caggtggcagtgcctgcattct

SEQ ID NO: 9278537 - DNA, 22 bp, Homo sapiens
caggtggccagtactcaaggat

SEQ ID NO: 9278538 - DNA, 22 bp, Homo sapiens
caggtggccagtactcaaggat

SEQ ID NO: 9278539 - DNA, 22 bp, Homo sapiens
cagtcaaacttataggcacatt

SEQ ID NO: 9278540 - DNA, 22 bp, Homo sapiens
cagtcaacagagagcccgtcag

SEQ ID NO: 9278541 - DNA, 22 bp, Homo sapiens
cagtcacacaagtggacttggg

SEQ ID NO: 9278542 - DNA, 17 bp, Homo sapiens
cagtcacaggtcttttc

SEQ ID NO: 9278543 - DNA, 22 bp, Homo sapiens
cagtcacaagcgtacctaattt

SEQ ID NO: 9278544 - DNA, 22 bp, Homo sapiens
cagtcacataggtatacacata

SEQ ID NO: 9278545 - DNA, 22 bp, Homo sapiens
cagtcacataggtatacacata

SEQ ID NO: 9278546 - DNA, 22 bp, Homo sapiens
cagtcacattgccctgcattta

SEQ ID NO: 9278547 - DNA, 22 bp, Homo sapiens
cagtcaccaccaggtggcagta

SEQ ID NO: 9278548 - DNA, 22 bp, Homo sapiens
cagtcacatttcgacataacta

SEQ ID NO: 9278549 - DNA, 22 bp, Homo sapiens
cagtcactggaatagctgagga

SEQ ID NO: 9278550 - DNA, 22 bp, Homo sapiens
caggtgggtgtatgaatgcaaa

SEQ ID NO: 9278551 - DNA, 19 bp, Homo sapiens
caggtggtaatctgagcct

SEQ ID NO: 9278552 - DNA, 22 bp, Homo sapiens
cagtatatgctctttcatcaaa

SEQ ID NO: 9278553 - DNA, 22 bp, Homo sapiens
cagtatctccacatgtaaagtg

SEQ ID NO: 9278554 - DNA, 22 bp, Homo sapiens
cagtatctccacatgtaaagtg

SEQ ID NO: 9278555 - DNA, 19 bp, Homo sapiens
cagtatcattgcacatagt

SEQ ID NO: 9278556 - DNA, 22 bp, Homo sapiens
cagtattttccttgttaactta

SEQ ID NO: 9278557 - DNA, 22 bp, Homo sapiens
cagtattttcaggatttggaag

SEQ ID NO: 9278558 - DNA, 22 bp, Homo sapiens
cagtcaggctgcgcttctctga

SEQ ID NO: 9278559 - DNA, 22 bp, Homo sapiens
cagtcaggctgcgcttctctga

SEQ ID NO: 9278560 - DNA, 22 bp, Homo sapiens
cagtcaggaatgcctccttcct

SEQ ID NO: 9278561 - DNA, 22 bp, Homo sapiens
cagtcacttacaaaaatataat

SEQ ID NO: 9278562 - DNA, 22 bp, Homo sapiens
cagtccaacctgccccttgggc

SEQ ID NO: 9278563 - DNA, 22 bp, Homo sapiens
cagtcattttatttgaaaatta

SEQ ID NO: 9278564 - DNA, 22 bp, Homo sapiens
cagtcagggacaccagctagga

SEQ ID NO: 9278565 - DNA, 22 bp, Homo sapiens
cagtcagggacaccagctagga

SEQ ID NO: 9278566 - DNA, 22 bp, Homo sapiens
cagtcagggacaccagctagga

SEQ ID NO: 9278567 - DNA, 22 bp, Homo sapiens
cagtcaggggtgggatcaaggc

SEQ ID NO: 9278568 - DNA, 22 bp, Homo sapiens
tattttacagactactttagat

SEQ ID NO: 9278569 - DNA, 22 bp, Homo sapiens
tattttaaagtgaagggtcttg

SEQ ID NO: 9278570 - DNA, 22 bp, Homo sapiens
tattttaaagactgccagccta

SEQ ID NO: 9278571 - DNA, 22 bp, Homo sapiens
tattttatctgccagagtggag

SEQ ID NO: 9278572 - DNA, 22 bp, Homo sapiens
tattttcaccatgtatccctgt

SEQ ID NO: 9278573 - DNA, 22 bp, Homo sapiens
tattttatctgccagagtggag

SEQ ID NO: 9278574 - DNA, 22 bp, Homo sapiens
tattttatctgccagagtggag

SEQ ID NO: 9278575 - DNA, 22 bp, Homo sapiens
tcaaaaatgttttatattggta

SEQ ID NO: 9278576 - DNA, 22 bp, Homo sapiens
tcaaaacactattacctttaat

SEQ ID NO: 9278577 - DNA, 19 bp, Homo sapiens
tcaaaacacaaatggttga

SEQ ID NO: 9278578 - DNA, 22 bp, Homo sapiens
tcaaaacaatcattggatgtgc

SEQ ID NO: 9278579 - DNA, 22 bp, Homo sapiens
tcaaaacaacactcaggtgtaa

SEQ ID NO: 9278580 - DNA, 22 bp, Homo sapiens
tcaagcaagtgtttggtgtaaa

SEQ ID NO: 9278581 - DNA, 22 bp, Homo sapiens
tcaagcaagttgcatattgcta

SEQ ID NO: 9278582 - DNA, 22 bp, Homo sapiens
tcaagcaaagatacaaatggaa

SEQ ID NO: 9278583 - DNA, 22 bp, Homo sapiens
tcaagcaaagtttagctggtta

SEQ ID NO: 9278584 - DNA, 22 bp, Homo sapiens
tcaacaaatacttaaagcagag

SEQ ID NO: 9278585 - DNA, 22 bp, Homo sapiens
tcaaaacactattacctttaat

SEQ ID NO: 9278586 - DNA, 22 bp, Homo sapiens
tcaagcagggtagcaagctggt

SEQ ID NO: 9278587 - DNA, 22 bp, Homo sapiens
tcaagcagcttttacagaagag

SEQ ID NO: 9278588 - DNA, 22 bp, Homo sapiens
cagggccattggcgtggctgtc

SEQ ID NO: 9278589 - DNA, 22 bp, Homo sapiens
cagggccattggcgtggctgtc

SEQ ID NO: 9278590 - DNA, 22 bp, Homo sapiens
tagcttaaggagtaccagatca

SEQ ID NO: 9278591 - DNA, 22 bp, Homo sapiens
tagcttaacagcaaaactgttg

SEQ ID NO: 9278592 - DNA, 22 bp, Homo sapiens
cagggccagttctcgcagcagt

SEQ ID NO: 9278593 - DNA, 22 bp, Homo sapiens
cagggccatatcttgtgcacca

SEQ ID NO: 9278594 - DNA, 22 bp, Homo sapiens
cagggccatgaggcacagggtc

SEQ ID NO: 9278595 - DNA, 22 bp, Homo sapiens
cagggccatgaggcacagggtc

SEQ ID NO: 9278596 - DNA, 22 bp, Homo sapiens
cagggagccccaattccatgcc

SEQ ID NO: 9278597 - DNA, 22 bp, Homo sapiens
cagggccactgcatgaggttca

SEQ ID NO: 9278598 - DNA, 22 bp, Homo sapiens
cagggccactgtagatgaggag

SEQ ID NO: 9278599 - DNA, 22 bp, Homo sapiens
cagggccaggctgatggcctgg

SEQ ID NO: 9278600 - DNA, 22 bp, Homo sapiens
cagggccagggctatggtgaag

SEQ ID NO: 9278601 - DNA, 22 bp, Homo sapiens
cagggccagttctcgcagcagt

SEQ ID NO: 9278602 - DNA, 22 bp, Homo sapiens
cagggagcaggctctgtccatc

SEQ ID NO: 9278603 - DNA, 22 bp, Homo sapiens
cagggagcagcccctagaagta

SEQ ID NO: 9278604 - DNA, 22 bp, Homo sapiens
cagggagcactgcgagcggcag

SEQ ID NO: 9278605 - DNA, 22 bp, Homo sapiens
cagggagcagcatgggcaaagg

SEQ ID NO: 9278606 - DNA, 22 bp, Homo sapiens
tagatttcgctgcatctcaatc

SEQ ID NO: 9278607 - DNA, 22 bp, Homo sapiens
tagatttcgctgcatctcaatc

SEQ ID NO: 9278608 - DNA, 22 bp, Homo sapiens
tagatttcaggagacaaaatgg

SEQ ID NO: 9278609 - DNA, 22 bp, Homo sapiens
taggccaaatgacttgatgttt

SEQ ID NO: 9278610 - DNA, 22 bp, Homo sapiens
taggccaacgtggaagggtcca

SEQ ID NO: 9278611 - DNA, 22 bp, Homo sapiens
taggccaaggacagtaaggaca

SEQ ID NO: 9278612 - DNA, 22 bp, Homo sapiens
taggagggccctgaaaatggca

SEQ ID NO: 9278613 - DNA, 22 bp, Homo sapiens
taggcagggattagggttgatt

SEQ ID NO: 9278614 - DNA, 22 bp, Homo sapiens
taggcaggtgtgcactgcccac

SEQ ID NO: 9278615 - DNA, 22 bp, Homo sapiens
tagcttccctagctaaagaggt

SEQ ID NO: 9278616 - DNA, 21 bp, Homo sapiens
tagcttccagctcaagctgag

SEQ ID NO: 9278617 - DNA, 21 bp, Homo sapiens
tagcttccagctcaagctgag

SEQ ID NO: 9278618 - DNA, 22 bp, Homo sapiens
tagcttccctgctggatcataa

SEQ ID NO: 9278619 - DNA, 22 bp, Homo sapiens
tagcttatcccacagtgcccag

SEQ ID NO: 9278620 - DNA, 22 bp, Homo sapiens
tagcttcatgcttcaccacgct

SEQ ID NO: 9278621 - DNA, 22 bp, Homo sapiens
tagcttcagtggccctagacac

SEQ ID NO: 9278622 - DNA, 19 bp, Homo sapiens
tagcttcacgtggtctaga

SEQ ID NO: 9278623 - DNA, 22 bp, Homo sapiens
tagcttgactattctatgatgt

SEQ ID NO: 9278624 - DNA, 22 bp, Homo sapiens
tagctttaaaaatcatcaaagc

SEQ ID NO: 9278625 - DNA, 18 bp, Homo sapiens
taggaggatactgagatg

SEQ ID NO: 9278626 - DNA, 22 bp, Homo sapiens
taggccacaaataagatcctgt

SEQ ID NO: 9278627 - DNA, 22 bp, Homo sapiens
taggccacagagaggagatttc

SEQ ID NO: 9278628 - DNA, 21 bp, Homo sapiens
taggccacatgggttggagat

SEQ ID NO: 9278629 - DNA, 22 bp, Homo sapiens
taggccaccagggttccattta

SEQ ID NO: 9278630 - DNA, 22 bp, Homo sapiens
taggccacagatgagacataag

SEQ ID NO: 9278631 - DNA, 22 bp, Homo sapiens
taggccactctcctttgtctca

SEQ ID NO: 9278632 - DNA, 22 bp, Homo sapiens
taggccactctcctttgtctca

SEQ ID NO: 9278633 - DNA, 22 bp, Homo sapiens
taggccacgaaggagatgatag

SEQ ID NO: 9278634 - DNA, 22 bp, Homo sapiens
taggccacgaaggagatgatag

SEQ ID NO: 9278635 - DNA, 22 bp, Homo sapiens
taggccacggaaagcaggttgc

SEQ ID NO: 9278636 - DNA, 22 bp, Homo sapiens
cagggcccagtccctgctgtca

SEQ ID NO: 9278637 - DNA, 22 bp, Homo sapiens
cagggcccatggctcaggtagg

SEQ ID NO: 9278638 - DNA, 22 bp, Homo sapiens
cagggccccagggatgtctgct

SEQ ID NO: 9278639 - DNA, 23 bp, Homo sapiens
cagggccctgctcaatttctcca

SEQ ID NO: 9278640 - DNA, 22 bp, Homo sapiens
cagggcctcatcctcagagatt

SEQ ID NO: 9278641 - DNA, 22 bp, Homo sapiens
cagggtagacagtaggtgtctg

SEQ ID NO: 9278642 - DNA, 22 bp, Homo sapiens
cagggtagggcaagggaacctg

SEQ ID NO: 9278643 - DNA, 22 bp, Homo sapiens
caggggtgtttttggccaggag

SEQ ID NO: 9278644 - DNA, 22 bp, Homo sapiens
cagggtacagagttttctaaac

SEQ ID NO: 9278645 - DNA, 22 bp, Homo sapiens
cagggtccggctgcctggctgt

SEQ ID NO: 9278646 - DNA, 22 bp, Homo sapiens
cagggtctgatggtcctcactt

SEQ ID NO: 9278647 - DNA, 22 bp, Homo sapiens
cagggtcatggcacctgcacgg

SEQ ID NO: 9278648 - DNA, 22 bp, Homo sapiens
cagggggctcaaaggagagtgc

SEQ ID NO: 9278649 - DNA, 22 bp, Homo sapiens
cagggggctcaaaggagagtgc

SEQ ID NO: 9278650 - DNA, 22 bp, Homo sapiens
cagggggctcaaaggagagtgc

SEQ ID NO: 9278651 - DNA, 22 bp, Homo sapiens
cagggggctgtggctgtccagt

SEQ ID NO: 9278652 - DNA, 22 bp, Homo sapiens
caggggctgtttgcctcaggcc

SEQ ID NO: 9278653 - DNA, 22 bp, Homo sapiens
caggggctgtttgcctcaggcc

SEQ ID NO: 9278654 - DNA, 22 bp, Homo sapiens
caggggcctgtcctggcttctg

SEQ ID NO: 9278655 - DNA, 22 bp, Homo sapiens
caggggcttttcctctataagg

SEQ ID NO: 9278656 - DNA, 22 bp, Homo sapiens
caggggcttaagtgacagaagg

SEQ ID NO: 9278657 - DNA, 22 bp, Homo sapiens
caggggcctgtcctggcttctg

SEQ ID NO: 9278658 - DNA, 22 bp, Homo sapiens
cagggctgtggaaaactggtgc

SEQ ID NO: 9278659 - DNA, 22 bp, Homo sapiens
cagggctgtggaaaactggtgc

SEQ ID NO: 9278660 - DNA, 22 bp, Homo sapiens
cagggctgtggctttgtgctgt

SEQ ID NO: 9278661 - DNA, 22 bp, Homo sapiens
cagggctgtgcccatcttcccc

SEQ ID NO: 9278662 - DNA, 22 bp, Homo sapiens
cagggctgtgcccatcttcccc

SEQ ID NO: 9278663 - DNA, 17 bp, Homo sapiens
cagggctgtctgcctag

SEQ ID NO: 9278664 - DNA, 17 bp, Homo sapiens
cagggctgtctgcctag

SEQ ID NO: 9278665 - DNA, 22 bp, Homo sapiens
taggctgggctgagctggacgg

SEQ ID NO: 9278666 - DNA, 22 bp, Homo sapiens
cagggctgagaatttagagaca

SEQ ID NO: 9278667 - DNA, 22 bp, Homo sapiens
cagggctgagaatttagagaca

SEQ ID NO: 9278668 - DNA, 22 bp, Homo sapiens
cagggctgaagaaattcaaaag

SEQ ID NO: 9278669 - DNA, 22 bp, Homo sapiens
cagggctgaagaaattcaaaag

SEQ ID NO: 9278670 - DNA, 22 bp, Homo sapiens
taggctgggctgagctggacgg

SEQ ID NO: 9278671 - DNA, 18 bp, Homo sapiens
taggctgggggctgtagt

SEQ ID NO: 9278672 - DNA, 22 bp, Homo sapiens
taggctgggggtaggaattgag

SEQ ID NO: 9278673 - DNA, 22 bp, Homo sapiens
cagggctgaactgagcttgtga

SEQ ID NO: 9278674 - DNA, 22 bp, Homo sapiens
cagggctgaaatcaaggtgtag

SEQ ID NO: 9278675 - DNA, 22 bp, Homo sapiens
cagggctgaaatcaaggtgtag

SEQ ID NO: 9278676 - DNA, 22 bp, Homo sapiens
cagggctggatttcatttctag

SEQ ID NO: 9278677 - DNA, 22 bp, Homo sapiens
cagggctggatttcatttctag

SEQ ID NO: 9278678 - DNA, 22 bp, Homo sapiens
tagggaaaagacttcactgttt

SEQ ID NO: 9278679 - DNA, 22 bp, Homo sapiens
tagggaaatatagatttagggc

SEQ ID NO: 9278680 - DNA, 23 bp, Homo sapiens
cagggctggtagggaagagcgtg

SEQ ID NO: 9278681 - DNA, 23 bp, Homo sapiens
cagggctggtagggaagagcgtg

SEQ ID NO: 9278682 - DNA, 22 bp, Homo sapiens
tagggaaaagacttcactgttt

SEQ ID NO: 9278683 - DNA, 22 bp, Homo sapiens
cagggctggtttgtcgaagaaa

SEQ ID NO: 9278684 - DNA, 22 bp, Homo sapiens
cagggctggtttgtcgaagaaa

SEQ ID NO: 9278685 - DNA, 23 bp, Homo sapiens
cagggctggtagggaagagcgtg

SEQ ID NO: 9278686 - DNA, 22 bp, Homo sapiens
cagggctggtttgtcgaagaaa

SEQ ID NO: 9278687 - DNA, 22 bp, Homo sapiens
cagggctgtaaattagtgctga

SEQ ID NO: 9278688 - DNA, 22 bp, Homo sapiens
cagggctgtctccaaaggcccc

SEQ ID NO: 9278689 - DNA, 22 bp, Homo sapiens
cagggctgtctccaaaggcccc

SEQ ID NO: 9278690 - DNA, 22 bp, Homo sapiens
caggcagagttagtgatttagg

SEQ ID NO: 9278691 - DNA, 22 bp, Homo sapiens
caggcagatatgttcgctttaa

SEQ ID NO: 9278692 - DNA, 22 bp, Homo sapiens
caggcagagttagagcaactgg

SEQ ID NO: 9278693 - DNA, 22 bp, Homo sapiens
caggcagagttagagcaactgg

SEQ ID NO: 9278694 - DNA, 22 bp, Homo sapiens
caggcaccccaggtgagcactg

SEQ ID NO: 9278695 - DNA, 22 bp, Homo sapiens
caggcacccagcccagtcgcac

SEQ ID NO: 9278696 - DNA, 22 bp, Homo sapiens
caggcacccagcccagtcgcac

SEQ ID NO: 9278697 - DNA, 22 bp, Homo sapiens
caggcaccccaggtgagcactg

SEQ ID NO: 9278698 - DNA, 22 bp, Homo sapiens
caggcaccacactaggggctga

SEQ ID NO: 9278699 - DNA, 22 bp, Homo sapiens
caggcaccccaggtgagcactg

SEQ ID NO: 9278700 - DNA, 22 bp, Homo sapiens
caggcacctcacgtgggtccca

SEQ ID NO: 9278701 - DNA, 22 bp, Homo sapiens
caggcacctgtgtgtctcaggg

SEQ ID NO: 9278702 - DNA, 22 bp, Homo sapiens
caggcacctcacgtgggtccca

SEQ ID NO: 9278703 - DNA, 22 bp, Homo sapiens
caggcacctgtgtgtctcaggg

SEQ ID NO: 9278704 - DNA, 22 bp, Homo sapiens
taataattaacagtgatgggtc

SEQ ID NO: 9278705 - DNA, 22 bp, Homo sapiens
caggcagcagccactctggtat

SEQ ID NO: 9278706 - DNA, 22 bp, Homo sapiens
caggcagatttgctgccctcca

SEQ ID NO: 9278707 - DNA, 22 bp, Homo sapiens
caggcagatgctgacaagagtt

SEQ ID NO: 9278708 - DNA, 22 bp, Homo sapiens
caggcagatttgctgccctcca

SEQ ID NO: 9278709 - DNA, 22 bp, Homo sapiens
caggcagatttgctgccctcca

SEQ ID NO: 9278710 - DNA, 22 bp, Homo sapiens
taatacacactctcattcctaa

SEQ ID NO: 9278711 - DNA, 22 bp, Homo sapiens
taataattggcaatgttgagca

SEQ ID NO: 9278712 - DNA, 22 bp, Homo sapiens
taataattttaaagaaggctag

SEQ ID NO: 9278713 - DNA, 21 bp, Homo sapiens
taataattccactacagagta

SEQ ID NO: 9278714 - DNA, 21 bp, Homo sapiens
taataattccactacagagta

SEQ ID NO: 9278715 - DNA, 22 bp, Homo sapiens
gtgcttctcttcacacccaact

SEQ ID NO: 9278716 - DNA, 22 bp, Homo sapiens
gtgcttctctgctctacccggc

SEQ ID NO: 9278717 - DNA, 22 bp, Homo sapiens
gtgcttctcttcacacccaact

SEQ ID NO: 9278718 - DNA, 22 bp, Homo sapiens
gtgcttctccgttctgcagcac

SEQ ID NO: 9278719 - DNA, 22 bp, Homo sapiens
gtgcttcctctgccaacactct

SEQ ID NO: 9278720 - DNA, 22 bp, Homo sapiens
cagctcagacgcaggtcgagca

SEQ ID NO: 9278721 - DNA, 22 bp, Homo sapiens
cagctcagacgcaggtcgagca

SEQ ID NO: 9278722 - DNA, 22 bp, Homo sapiens
cagctcagacgcaggtcgagca

SEQ ID NO: 9278723 - DNA, 22 bp, Homo sapiens
cagctcaagtttcccaggtcag

SEQ ID NO: 9278724 - DNA, 22 bp, Homo sapiens
cagctcaagtttcccaggtcag

SEQ ID NO: 9278725 - DNA, 22 bp, Homo sapiens
cagctatttatctttcatgata

SEQ ID NO: 9278726 - DNA, 22 bp, Homo sapiens
cagctattggtccacaggtatg

SEQ ID NO: 9278727 - DNA, 22 bp, Homo sapiens
cagctatttgtaggaaaactgt

SEQ ID NO: 9278728 - DNA, 22 bp, Homo sapiens
cagctattttctcattaaggat

SEQ ID NO: 9278729 - DNA, 22 bp, Homo sapiens
cagctattggcaagaagtggtg

SEQ ID NO: 9278730 - DNA, 22 bp, Homo sapiens
cagctattgataaatgttgggg

SEQ ID NO: 9278731 - DNA, 22 bp, Homo sapiens
cagctattggtccacaggtatg

SEQ ID NO: 9278732 - DNA, 23 bp, Homo sapiens
cagctcagagtgtgtcctgtttc

SEQ ID NO: 9278733 - DNA, 23 bp, Homo sapiens
cagctcagcacataggaggtact

SEQ ID NO: 9278734 - DNA, 22 bp, Homo sapiens
caggcaccaatagggatcgtgg

SEQ ID NO: 9278735 - DNA, 22 bp, Homo sapiens
taagtcctattccaggtctctc

SEQ ID NO: 9278736 - DNA, 22 bp, Homo sapiens
taagtccataatggcagtaaat

SEQ ID NO: 9278737 - DNA, 22 bp, Homo sapiens
taagtccacctcattcttcagc

SEQ ID NO: 9278738 - DNA, 22 bp, Homo sapiens
taagtccagtgttctctctgtg

SEQ ID NO: 9278739 - DNA, 22 bp, Homo sapiens
taagtccaagggtatgagttgg

SEQ ID NO: 9278740 - DNA, 22 bp, Homo sapiens
taagtccacaggagttgtgttc

SEQ ID NO: 9278741 - DNA, 22 bp, Homo sapiens
taagtccacaggctgacagcgg

SEQ ID NO: 9278742 - DNA, 22 bp, Homo sapiens
taatgtaaagaagatgtaggaa

SEQ ID NO: 9278743 - DNA, 22 bp, Homo sapiens
taatgtataacaaatactcatc

SEQ ID NO: 9278744 - DNA, 22 bp, Homo sapiens
taatgtaggggtgtaacacaca

SEQ ID NO: 9278745 - DNA, 22 bp, Homo sapiens
taatgtacaagaggctagggtg

SEQ ID NO: 9278746 - DNA, 22 bp, Homo sapiens
taatgtataacaaatactcatc

SEQ ID NO: 9278747 - DNA, 22 bp, Homo sapiens
taatgtataacaaatactcatc

SEQ ID NO: 9278748 - DNA, 22 bp, Homo sapiens
taatgtcaaggtcattctagag

SEQ ID NO: 9278749 - DNA, 20 bp, Homo sapiens
taatgtcaaagtcacaaggt

SEQ ID NO: 9278750 - DNA, 22 bp, Homo sapiens
taatcatatgggtaatccaatg

SEQ ID NO: 9278751 - DNA, 22 bp, Homo sapiens
taatatgtgttactgacttttt

SEQ ID NO: 9278752 - DNA, 22 bp, Homo sapiens
taatacagatacaaaggaggac

SEQ ID NO: 9278753 - DNA, 22 bp, Homo sapiens
taatatctggcattcaaacatg

SEQ ID NO: 9278754 - DNA, 22 bp, Homo sapiens
taatatctacttcatagagttt

SEQ ID NO: 9278755 - DNA, 22 bp, Homo sapiens
taatcacaattcagatgtctta

SEQ ID NO: 9278756 - DNA, 22 bp, Homo sapiens
taatcacagaaacagactgttt

SEQ ID NO: 9278757 - DNA, 22 bp, Homo sapiens
taatgttacactgcatggttca

SEQ ID NO: 9278758 - DNA, 22 bp, Homo sapiens
taatgtgtgtcatcagtagagt

SEQ ID NO: 9278759 - DNA, 22 bp, Homo sapiens
taatgtctttaagagcattggg

SEQ ID NO: 9278760 - DNA, 22 bp, Homo sapiens
taatgtctagatcagacctcga

SEQ ID NO: 9278761 - DNA, 22 bp, Homo sapiens
taatgtctgtgtttcagtgcag

SEQ ID NO: 9278762 - DNA, 22 bp, Homo sapiens
caggcatgcttctgtctgggca

SEQ ID NO: 9278763 - DNA, 22 bp, Homo sapiens
caggcatggaaaagcccagagg

SEQ ID NO: 9278764 - DNA, 22 bp, Homo sapiens
caggcatggagaggcagagact

SEQ ID NO: 9278765 - DNA, 22 bp, Homo sapiens
caggcatttcgcaaaggctgag

SEQ ID NO: 9278766 - DNA, 22 bp, Homo sapiens
tacaaaaaattgatactgacga

SEQ ID NO: 9278767 - DNA, 22 bp, Homo sapiens
caggcatttcgcaaaggctgag

SEQ ID NO: 9278768 - DNA, 22 bp, Homo sapiens
tacaaaacagtgctctggtcct

SEQ ID NO: 9278769 - DNA, 22 bp, Homo sapiens
tacaaaacagtgctctggtcct

SEQ ID NO: 9278770 - DNA, 22 bp, Homo sapiens
tacaaaacagtgctctggtcct

SEQ ID NO: 9278771 - DNA, 20 bp, Homo sapiens
tacaaacctccacactggtg

SEQ ID NO: 9278772 - DNA, 22 bp, Homo sapiens
caggccagggttgagaagagaa

SEQ ID NO: 9278773 - DNA, 22 bp, Homo sapiens
caggccagtgtgcttcccaggc

SEQ ID NO: 9278774 - DNA, 19 bp, Homo sapiens
caggccagtgtcagggggc

SEQ ID NO: 9278775 - DNA, 22 bp, Homo sapiens
tagaaacaaagacctgggtgct

SEQ ID NO: 9278776 - DNA, 22 bp, Homo sapiens
tagaaacaaagacctgggtgct

SEQ ID NO: 9278777 - DNA, 22 bp, Homo sapiens
tagaaacaaaatctgatgactc

SEQ ID NO: 9278778 - DNA, 22 bp, Homo sapiens
tagaaaatgttccactgccatt

SEQ ID NO: 9278779 - DNA, 22 bp, Homo sapiens
tagaaaatagggcctgtggagc

SEQ ID NO: 9278780 - DNA, 22 bp, Homo sapiens
caggctgggactgacccctgct

SEQ ID NO: 9278781 - DNA, 22 bp, Homo sapiens
caggctgggcagcctccccggc

SEQ ID NO: 9278782 - DNA, 22 bp, Homo sapiens
caggctgggaacgccacccgct

SEQ ID NO: 9278783 - DNA, 22 bp, Homo sapiens
caggctgggaacgccacccgct

SEQ ID NO: 9278784 - DNA, 22 bp, Homo sapiens
caggctgggactgacccctgct

SEQ ID NO: 9278785 - DNA, 22 bp, Homo sapiens
caggctggcaatgcgtcaagca

SEQ ID NO: 9278786 - DNA, 22 bp, Homo sapiens
caggctgggaacgccacccgct

SEQ ID NO: 9278787 - DNA, 22 bp, Homo sapiens
caggctgccgtggggtccaggc

SEQ ID NO: 9278788 - DNA, 22 bp, Homo sapiens
caggctgccgtggggtccaggc

SEQ ID NO: 9278789 - DNA, 22 bp, Homo sapiens
caggctgccgtgaagcaggcct

SEQ ID NO: 9278790 - DNA, 22 bp, Homo sapiens
caggctggagttcagtggtgtg

SEQ ID NO: 9278791 - DNA, 22 bp, Homo sapiens
caggctggagttcagtggtgtg

SEQ ID NO: 9278792 - DNA, 22 bp, Homo sapiens
caggctggagttcagtggtgtg

SEQ ID NO: 9278793 - DNA, 22 bp, Homo sapiens
caggctggagttcagtggtgtg

SEQ ID NO: 9278794 - DNA, 22 bp, Homo sapiens
caggctggcaatgcgtcaagca

SEQ ID NO: 9278795 - DNA, 22 bp, Homo sapiens
caggctgccaaggctggggagg

SEQ ID NO: 9278796 - DNA, 22 bp, Homo sapiens
caggctgccaaggctggggagg

SEQ ID NO: 9278797 - DNA, 22 bp, Homo sapiens
caggctgcagtgcagtggctat

SEQ ID NO: 9278798 - DNA, 22 bp, Homo sapiens
caggctgcagtgcagtggctat

SEQ ID NO: 9278799 - DNA, 22 bp, Homo sapiens
caggctgccgtgaagcaggcct

SEQ ID NO: 9278800 - DNA, 22 bp, Homo sapiens
caggctgccgtgaagcaggcct

SEQ ID NO: 9278801 - DNA, 22 bp, Homo sapiens
cagggacaatggcagagcctga

SEQ ID NO: 9278802 - DNA, 20 bp, Homo sapiens
cagggacagcagtgggtttt

SEQ ID NO: 9278803 - DNA, 22 bp, Homo sapiens
tagattcattttagcaaaagtt

SEQ ID NO: 9278804 - DNA, 22 bp, Homo sapiens
tagattcagatatttaggacaa

SEQ ID NO: 9278805 - DNA, 22 bp, Homo sapiens
tagatacacacacagtcatgtg

SEQ ID NO: 9278806 - DNA, 22 bp, Homo sapiens
cagggacagccttggggtggcg

SEQ ID NO: 9278807 - DNA, 22 bp, Homo sapiens
tagattcagatatttaggacaa

SEQ ID NO: 9278808 - DNA, 22 bp, Homo sapiens
caggctttttctgctgtcctct

SEQ ID NO: 9278809 - DNA, 22 bp, Homo sapiens
cagggaaagtcccaccccacac

SEQ ID NO: 9278810 - DNA, 22 bp, Homo sapiens
cagggaaactaggaaataagct

SEQ ID NO: 9278811 - DNA, 22 bp, Homo sapiens
caggcttggttggggcgaggga

SEQ ID NO: 9278812 - DNA, 22 bp, Homo sapiens
caggctttactttctctctgaa

SEQ ID NO: 9278813 - DNA, 22 bp, Homo sapiens
caggcttgggagcagagccact

SEQ ID NO: 9278814 - DNA, 22 bp, Homo sapiens
caggctgtctgaatggaggccc

SEQ ID NO: 9278815 - DNA, 22 bp, Homo sapiens
tactttaaaaactgataattca

SEQ ID NO: 9278816 - DNA, 22 bp, Homo sapiens
tactttaaaaactgataattca

SEQ ID NO: 9278817 - DNA, 22 bp, Homo sapiens
tacttgttatcatcttttcctt

SEQ ID NO: 9278818 - DNA, 22 bp, Homo sapiens
tactttacagtattagataatt

SEQ ID NO: 9278819 - DNA, 22 bp, Homo sapiens
tactttatattgtggctggcca

SEQ ID NO: 9278820 - DNA, 22 bp, Homo sapiens
tactttatattgtggctggcca

SEQ ID NO: 9278821 - DNA, 22 bp, Homo sapiens
tactttaaaaactgataattca

SEQ ID NO: 9278822 - DNA, 22 bp, Homo sapiens
tactttacagtattagataatt

SEQ ID NO: 9278823 - DNA, 22 bp, Homo sapiens
tactttaatatatgtgaagttc

SEQ ID NO: 9278824 - DNA, 22 bp, Homo sapiens
tactttatcagcgtcaaaggta

SEQ ID NO: 9278825 - DNA, 22 bp, Homo sapiens
tactttatcagcgtcaaaggta

SEQ ID NO: 9278826 - DNA, 22 bp, Homo sapiens
tactttattcaggaaggctggt

SEQ ID NO: 9278827 - DNA, 22 bp, Homo sapiens
tactttattcaggaaggctggt

SEQ ID NO: 9278828 - DNA, 18 bp, Homo sapiens
tactttattccccctcca

SEQ ID NO: 9278829 - DNA, 22 bp, Homo sapiens
tactttattgtaaatgctgatg

SEQ ID NO: 9278830 - DNA, 18 bp, Homo sapiens
tactttattccccctcca

SEQ ID NO: 9278831 - DNA, 22 bp, Homo sapiens
caggctaaagctttgagcatgt

SEQ ID NO: 9278832 - DNA, 22 bp, Homo sapiens
caggcgagggccctgaggagcc

SEQ ID NO: 9278833 - DNA, 22 bp, Homo sapiens
tacatttataaggcttctctgt

SEQ ID NO: 9278834 - DNA, 22 bp, Homo sapiens
tacatttataaggcttctctgt

SEQ ID NO: 9278835 - DNA, 22 bp, Homo sapiens
tacattgttttttcttgccatc

SEQ ID NO: 9278836 - DNA, 23 bp, Homo sapiens
tacattgtggatggagtcctggg

SEQ ID NO: 9278837 - DNA, 22 bp, Homo sapiens
tacattgtgttaaaacagaaga

SEQ ID NO: 9278838 - DNA, 22 bp, Homo sapiens
tacattgttcatgcatgagaaa

SEQ ID NO: 9278839 - DNA, 22 bp, Homo sapiens
tacattgtgatgtttcaataca

SEQ ID NO: 9278840 - DNA, 18 bp, Homo sapiens
caggcctcttgatcttcc

SEQ ID NO: 9278841 - DNA, 22 bp, Homo sapiens
caggcctgaccctgagcttcac

SEQ ID NO: 9278842 - DNA, 22 bp, Homo sapiens
caggcctgagacatctgagata

SEQ ID NO: 9278843 - DNA, 22 bp, Homo sapiens
caggcctgagacatctgagata

SEQ ID NO: 9278844 - DNA, 22 bp, Homo sapiens
caggcctgagacatctgagata

SEQ ID NO: 9278845 - DNA, 22 bp, Homo sapiens
caggcctgaccctgagcttcac

SEQ ID NO: 9278846 - DNA, 22 bp, Homo sapiens
tacatgtttggtaaatgatggc

SEQ ID NO: 9278847 - DNA, 22 bp, Homo sapiens
tacattgctagaaatgtatttt

SEQ ID NO: 9278848 - DNA, 22 bp, Homo sapiens
tacattgctcattatattgctt

SEQ ID NO: 9278849 - DNA, 22 bp, Homo sapiens
tacattgattcaggatataggc

SEQ ID NO: 9278850 - DNA, 22 bp, Homo sapiens
tacattgctttctaatacatct

SEQ ID NO: 9278851 - DNA, 22 bp, Homo sapiens
caggcccagggagggagaccaa

SEQ ID NO: 9278852 - DNA, 22 bp, Homo sapiens
caggcctcgaggagacagctac

SEQ ID NO: 9278853 - DNA, 22 bp, Homo sapiens
caggcctctatggtcagctgag

SEQ ID NO: 9278854 - DNA, 22 bp, Homo sapiens
caggcctctatggtcagctgag

SEQ ID NO: 9278855 - DNA, 22 bp, Homo sapiens
caggcctctccttagtctggca

SEQ ID NO: 9278856 - DNA, 20 bp, Homo sapiens
caggcctctgggggccctgg

SEQ ID NO: 9278857 - DNA, 22 bp, Homo sapiens
cgtcacttcttagtctattttc

SEQ ID NO: 9278858 - DNA, 22 bp, Homo sapiens
ttcatccatatgcagagagctt

SEQ ID NO: 9278859 - DNA, 22 bp, Homo sapiens
ttcatcttgatggcttcctaat

SEQ ID NO: 9278860 - DNA, 22 bp, Homo sapiens
ttcatgaaacttaactgttggg

SEQ ID NO: 9278861 - DNA, 20 bp, Homo sapiens
cggtgcagacagcccctcgt

SEQ ID NO: 9278862 - DNA, 22 bp, Homo sapiens
cggtctcccgtgtgtgtgcgct

SEQ ID NO: 9278863 - DNA, 19 bp, Homo sapiens
cgtacctgacacagaacag

SEQ ID NO: 9278864 - DNA, 22 bp, Homo sapiens
cgtaggatactcagtgctcatt

SEQ ID NO: 9278865 - DNA, 22 bp, Homo sapiens
ctaaagaagctagcaatctata

SEQ ID NO: 9278866 - DNA, 22 bp, Homo sapiens
ctaaagagagttcaagactcct

SEQ ID NO: 9278867 - DNA, 22 bp, Homo sapiens
ctaaagataaggaaagtatcct

SEQ ID NO: 9278868 - DNA, 22 bp, Homo sapiens
ctaaataatccctctggtctta

SEQ ID NO: 9278869 - DNA, 22 bp, Homo sapiens
ctaaataatccctctggtctta

SEQ ID NO: 9278870 - DNA, 17 bp, Homo sapiens
ctaaatacttgcgtttc

SEQ ID NO: 9278871 - DNA, 22 bp, Homo sapiens
ttcatgaatgttccatgtgagt

SEQ ID NO: 9278872 - DNA, 22 bp, Homo sapiens
ttcatgaagggtgaatatagtc

SEQ ID NO: 9278873 - DNA, 22 bp, Homo sapiens
ttcagagtcagggatctcagag

SEQ ID NO: 9278874 - DNA, 22 bp, Homo sapiens
ttcagagttagacgaaaagcaa

SEQ ID NO: 9278875 - DNA, 22 bp, Homo sapiens
ttcagaggttagagcagtggga

SEQ ID NO: 9278876 - DNA, 22 bp, Homo sapiens
ttcagagggttttagggtcaga

SEQ ID NO: 9278877 - DNA, 22 bp, Homo sapiens
ttcacagaagaggtcacatttc

SEQ ID NO: 9278878 - DNA, 22 bp, Homo sapiens
ttcagaaagtgaatcttgttat

SEQ ID NO: 9278879 - DNA, 22 bp, Homo sapiens
ttcagagggacattcaagggaa

SEQ ID NO: 9278880 - DNA, 22 bp, Homo sapiens
ttcagattttttaataggtaat

SEQ ID NO: 9278881 - DNA, 22 bp, Homo sapiens
ttcagcaaacacgatgcttgtt

SEQ ID NO: 9278882 - DNA, 22 bp, Homo sapiens
ttcaggctatagaccaatttgg

SEQ ID NO: 9278883 - DNA, 22 bp, Homo sapiens
ttcagggacttagtgtcagttt

SEQ ID NO: 9278884 - DNA, 22 bp, Homo sapiens
ttcagggagagcgggacgggtg

SEQ ID NO: 9278885 - DNA, 22 bp, Homo sapiens
ttcagggagagcgggacgggtg

SEQ ID NO: 9278886 - DNA, 22 bp, Homo sapiens
cgccaggcttggtagctcatgc

SEQ ID NO: 9278887 - DNA, 22 bp, Homo sapiens
cgccaggcttggtagctcatgc

SEQ ID NO: 9278888 - DNA, 22 bp, Homo sapiens
cgcatccagggcgcaggatctg

SEQ ID NO: 9278889 - DNA, 22 bp, Homo sapiens
cgcccagctgaaatctccaggc

SEQ ID NO: 9278890 - DNA, 22 bp, Homo sapiens
ttaggagtccagatgtcttggg

SEQ ID NO: 9278891 - DNA, 22 bp, Homo sapiens
ttaggatttgaaaaggggcaga

SEQ ID NO: 9278892 - DNA, 22 bp, Homo sapiens
ttaggcatgcaagattaagctc

SEQ ID NO: 9278893 - DNA, 22 bp, Homo sapiens
ttaggctgttcttgtgttgtta

SEQ ID NO: 9278894 - DNA, 22 bp, Homo sapiens
ttaggctgttcttgtgttgtta

SEQ ID NO: 9278895 - DNA, 22 bp, Homo sapiens
ttaggaggtctatggacatcct

SEQ ID NO: 9278896 - DNA, 22 bp, Homo sapiens
cctttctctttgctgatcatgt

SEQ ID NO: 9278897 - DNA, 22 bp, Homo sapiens
cctttctctggcagcaggacag

SEQ ID NO: 9278898 - DNA, 22 bp, Homo sapiens
cctttctcttggataccgattg

SEQ ID NO: 9278899 - DNA, 17 bp, Homo sapiens
cctttctctttcatctc

SEQ ID NO: 9278900 - DNA, 22 bp, Homo sapiens
cctttctctatcgacccatcgc

SEQ ID NO: 9278901 - DNA, 16 bp, Homo sapiens
cctttctctgccttcc

SEQ ID NO: 9278902 - DNA, 16 bp, Homo sapiens
cctttctctgccttcc

SEQ ID NO: 9278903 - DNA, 22 bp, Homo sapiens
cctttctcattttaagcattag

SEQ ID NO: 9278904 - DNA, 22 bp, Homo sapiens
cctttctacagatgcctcttgc

SEQ ID NO: 9278905 - DNA, 22 bp, Homo sapiens
cctttctaagatactgcaactt

SEQ ID NO: 9278906 - DNA, 22 bp, Homo sapiens
cgccctccacacagcccctggc

SEQ ID NO: 9278907 - DNA, 22 bp, Homo sapiens
cgccctccacacagcccctggc

SEQ ID NO: 9278908 - DNA, 22 bp, Homo sapiens
ttcaagtctggagatctggaac

SEQ ID NO: 9278909 - DNA, 22 bp, Homo sapiens
ttcaaatttggtatgcaagcca

SEQ ID NO: 9278910 - DNA, 22 bp, Homo sapiens
cgcccaggctggagtgcagtga

SEQ ID NO: 9278911 - DNA, 22 bp, Homo sapiens
cgcccaggctggagtgcagtga

SEQ ID NO: 9278912 - DNA, 22 bp, Homo sapiens
cgcccaggctggagagcagtgg

SEQ ID NO: 9278913 - DNA, 22 bp, Homo sapiens
cgcccaggctggagagcagtgg

SEQ ID NO: 9278914 - DNA, 22 bp, Homo sapiens
cgcccagggcaggaggccgctc

SEQ ID NO: 9278915 - DNA, 22 bp, Homo sapiens
cgcccaggctggagtgcagtgg

SEQ ID NO: 9278916 - DNA, 22 bp, Homo sapiens
cgcccaggctggagtgcagtgg

SEQ ID NO: 9278917 - DNA, 22 bp, Homo sapiens
cgccccagatgcaagacaaaga

SEQ ID NO: 9278918 - DNA, 22 bp, Homo sapiens
ttcaagtttgtatttctgtatt

SEQ ID NO: 9278919 - DNA, 22 bp, Homo sapiens
ttcacacagcaactgtatgaat

SEQ ID NO: 9278920 - DNA, 22 bp, Homo sapiens
ttcacacagcaactgtatgaat

SEQ ID NO: 9278921 - DNA, 22 bp, Homo sapiens
ttcacacagaatctgaggagct

SEQ ID NO: 9278922 - DNA, 22 bp, Homo sapiens
ttcacaatttcccttcatcagg

SEQ ID NO: 9278923 - DNA, 22 bp, Homo sapiens
ttcacaatttcccttcatcagg

SEQ ID NO: 9278924 - DNA, 22 bp, Homo sapiens
ttcaagtttttaaaggcagtta

SEQ ID NO: 9278925 - DNA, 22 bp, Homo sapiens
ctatggtgatagaaatcagaat

SEQ ID NO: 9278926 - DNA, 22 bp, Homo sapiens
ctatgagaagaaaacaagatta

SEQ ID NO: 9278927 - DNA, 23 bp, Homo sapiens
ctatggaataccaatgattctca

SEQ ID NO: 9278928 - DNA, 23 bp, Homo sapiens
ctatggaataccaatgattctca

SEQ ID NO: 9278929 - DNA, 23 bp, Homo sapiens
ctatggaataccaatgattctca

SEQ ID NO: 9278930 - DNA, 22 bp, Homo sapiens
ctatggaaactcaacatttgtt

SEQ ID NO: 9278931 - DNA, 22 bp, Homo sapiens
ctatggaaactcaacatttgtt

SEQ ID NO: 9278932 - DNA, 22 bp, Homo sapiens
ctatggaaacctaatcaggaga

SEQ ID NO: 9278933 - DNA, 22 bp, Homo sapiens
ctatggaaacctaatcaggaga

SEQ ID NO: 9278934 - DNA, 22 bp, Homo sapiens
ctatggaagggatgcaaagaaa

SEQ ID NO: 9278935 - DNA, 22 bp, Homo sapiens
ctatgttctcggcactatggat

SEQ ID NO: 9278936 - DNA, 22 bp, Homo sapiens
ctattacaatctgctactatga

SEQ ID NO: 9278937 - DNA, 22 bp, Homo sapiens
ctattaaatactcttcaaattg

SEQ ID NO: 9278938 - DNA, 22 bp, Homo sapiens
ctagccagactcaagggccacc

SEQ ID NO: 9278939 - DNA, 22 bp, Homo sapiens
ctagccagatgattcccaaata

SEQ ID NO: 9278940 - DNA, 22 bp, Homo sapiens
ctagcaggtcaaaccagctgat

SEQ ID NO: 9278941 - DNA, 22 bp, Homo sapiens
ctagcaggtcaaaccagctgat

SEQ ID NO: 9278942 - DNA, 22 bp, Homo sapiens
ctagccagatttaaagagagac

SEQ ID NO: 9278943 - DNA, 22 bp, Homo sapiens
ttctctggatgtttctcagtca

SEQ ID NO: 9278944 - DNA, 22 bp, Homo sapiens
ttctctggccatagctggctag

SEQ ID NO: 9278945 - DNA, 22 bp, Homo sapiens
ttctctggcctgaggcgaggcc

SEQ ID NO: 9278946 - DNA, 22 bp, Homo sapiens
ttctctggcctgaggcgaggcc

SEQ ID NO: 9278947 - DNA, 22 bp, Homo sapiens
ttctctggcgcgctgtgctatg

SEQ ID NO: 9278948 - DNA, 22 bp, Homo sapiens
ttctctggcgcgctgtgctatg

SEQ ID NO: 9278949 - DNA, 22 bp, Homo sapiens
ttctctggcggtgtgttttcct

SEQ ID NO: 9278950 - DNA, 21 bp, Homo sapiens
ttctctggcttctgtagctgg

SEQ ID NO: 9278951 - DNA, 22 bp, Homo sapiens
ctagcacagcccattcagtcta

SEQ ID NO: 9278952 - DNA, 22 bp, Homo sapiens
ctcacacacgaagcccttggcc

SEQ ID NO: 9278953 - DNA, 22 bp, Homo sapiens
ctcacacacgaagcccttggcc

SEQ ID NO: 9278954 - DNA, 22 bp, Homo sapiens
ctcacagagcctctgtgtcttc

SEQ ID NO: 9278955 - DNA, 22 bp, Homo sapiens
ctcacagatacggctattcctg

SEQ ID NO: 9278956 - DNA, 22 bp, Homo sapiens
ctcacagctgcttcaggatcca

SEQ ID NO: 9278957 - DNA, 22 bp, Homo sapiens
ctcacagcagctctgcgagata

SEQ ID NO: 9278958 - DNA, 22 bp, Homo sapiens
ctcaaaatccataaaatcaggt

SEQ ID NO: 9278959 - DNA, 22 bp, Homo sapiens
ctcaaaagacttaaacataaga

SEQ ID NO: 9278960 - DNA, 22 bp, Homo sapiens
ctatttttctgtaccctaattt

SEQ ID NO: 9278961 - DNA, 22 bp, Homo sapiens
ctattatttcctcatctataaa

SEQ ID NO: 9278962 - DNA, 22 bp, Homo sapiens
ctattattatgttaactggact

SEQ ID NO: 9278963 - DNA, 19 bp, Homo sapiens
ctattagcttgggcatcat

SEQ ID NO: 9278964 - DNA, 22 bp, Homo sapiens
ctattagaaagcatcttctata

SEQ ID NO: 9278965 - DNA, 22 bp, Homo sapiens
ttctctggagagtatcttctta

SEQ ID NO: 9278966 - DNA, 22 bp, Homo sapiens
ttctctggagggctgcccggcc

SEQ ID NO: 9278967 - DNA, 20 bp, Homo sapiens
ttctctggatagccagatgt

SEQ ID NO: 9278968 - DNA, 21 bp, Homo sapiens
ttctctggataggccagtcct

SEQ ID NO: 9278969 - DNA, 22 bp, Homo sapiens
ttctctggatgtttctcagtca

SEQ ID NO: 9278970 - DNA, 22 bp, Homo sapiens
ctagaaaaatactttattgtga

SEQ ID NO: 9278971 - DNA, 22 bp, Homo sapiens
ttctcctttgtaattctcatcc

SEQ ID NO: 9278972 - DNA, 22 bp, Homo sapiens
ttctccttttccagttcccagt

SEQ ID NO: 9278973 - DNA, 21 bp, Homo sapiens
ctacttaagtaggggattagg

SEQ ID NO: 9278974 - DNA, 21 bp, Homo sapiens
ctacttaagtaggggattagg

SEQ ID NO: 9278975 - DNA, 21 bp, Homo sapiens
ctacttaagtaggggattagg

SEQ ID NO: 9278976 - DNA, 22 bp, Homo sapiens
ctacttctgtgatgaaactaca

SEQ ID NO: 9278977 - DNA, 22 bp, Homo sapiens
ctacttgttcactgtaggtcgc

SEQ ID NO: 9278978 - DNA, 20 bp, Homo sapiens
ctactttaggcactgagaat

SEQ ID NO: 9278979 - DNA, 19 bp, Homo sapiens
ctactttataatatgcctc

SEQ ID NO: 9278980 - DNA, 22 bp, Homo sapiens
ctactttaacaattcgcaagaa

SEQ ID NO: 9278981 - DNA, 22 bp, Homo sapiens
ctactttaacatggaggcactt

SEQ ID NO: 9278982 - DNA, 22 bp, Homo sapiens
ctactttaattttctgcagaga

SEQ ID NO: 9278983 - DNA, 22 bp, Homo sapiens
ctactttacctccatcagactg

SEQ ID NO: 9278984 - DNA, 22 bp, Homo sapiens
ctacccttaagtttctgtgggg

SEQ ID NO: 9278985 - DNA, 22 bp, Homo sapiens
ctacccttaagtttctgtgggg

SEQ ID NO: 9278986 - DNA, 22 bp, Homo sapiens
ctacctgaaaaggttgtggtga

SEQ ID NO: 9278987 - DNA, 22 bp, Homo sapiens
ctaccttcaagttcctccctct

SEQ ID NO: 9278988 - DNA, 21 bp, Homo sapiens
ctaccctcactcccattcctc

SEQ ID NO: 9278989 - DNA, 22 bp, Homo sapiens
ctacccaggcttagagggctgg

SEQ ID NO: 9278990 - DNA, 22 bp, Homo sapiens
ctacccaggctggagtgcagta

SEQ ID NO: 9278991 - DNA, 22 bp, Homo sapiens
ctacatttcatccagggagagc

SEQ ID NO: 9278992 - DNA, 22 bp, Homo sapiens
ttcctgggctttcccctctggt

SEQ ID NO: 9278993 - DNA, 22 bp, Homo sapiens
ttcctgggctgcagagagcacc

SEQ ID NO: 9278994 - DNA, 22 bp, Homo sapiens
ttcctgggctgcagagagcacc

SEQ ID NO: 9278995 - DNA, 22 bp, Homo sapiens
ttcctgggctgcagagagcacc

SEQ ID NO: 9278996 - DNA, 22 bp, Homo sapiens
ttcctgggctctggctggccta

SEQ ID NO: 9278997 - DNA, 22 bp, Homo sapiens
ctactgagtccttcagctgcca

SEQ ID NO: 9278998 - DNA, 22 bp, Homo sapiens
ctactgaattagactgcatttt

SEQ ID NO: 9278999 - DNA, 22 bp, Homo sapiens
ctactgaaactcagaaattcaa

SEQ ID NO: 9279000 - DNA, 22 bp, Homo sapiens
ctactgaagataactggctctt

SEQ ID NO: 9279001 - DNA, 22 bp, Homo sapiens
ctactctgtggtgtatttgcat

SEQ ID NO: 9279002 - DNA, 22 bp, Homo sapiens
ctactctgaattgaagtgatat

SEQ ID NO: 9279003 - DNA, 22 bp, Homo sapiens
ctactgtccataaagtataact

SEQ ID NO: 9279004 - DNA, 22 bp, Homo sapiens
ctactgccattgtctctgccat

SEQ ID NO: 9279005 - DNA, 22 bp, Homo sapiens
ctacagagttcacaggatttta

SEQ ID NO: 9279006 - DNA, 22 bp, Homo sapiens
ctacagctggccttggaaaact

SEQ ID NO: 9279007 - DNA, 22 bp, Homo sapiens
ctacaggtcaagcagtagctct

SEQ ID NO: 9279008 - DNA, 22 bp, Homo sapiens
ctacaggtatgtgcatgacatc

SEQ ID NO: 9279009 - DNA, 23 bp, Homo sapiens
ctacaggttaattttcagtggaa

SEQ ID NO: 9279010 - DNA, 22 bp, Homo sapiens
ctacagtagagaggatgtagaa

SEQ ID NO: 9279011 - DNA, 22 bp, Homo sapiens
ctacaggaaggatcttgctcaa

SEQ ID NO: 9279012 - DNA, 22 bp, Homo sapiens
ctacaggctcagggagccctct

SEQ ID NO: 9279013 - DNA, 22 bp, Homo sapiens
ctacaggctcagggagccctct

SEQ ID NO: 9279014 - DNA, 22 bp, Homo sapiens
ttcctgggcaggacgagagtct

SEQ ID NO: 9279015 - DNA, 22 bp, Homo sapiens
ttcctgggccttaaatcttttg

SEQ ID NO: 9279016 - DNA, 22 bp, Homo sapiens
ttcctgggctgcagagagcacc

SEQ ID NO: 9279017 - DNA, 22 bp, Homo sapiens
ttcctgggaggctgtgtacttg

SEQ ID NO: 9279018 - DNA, 22 bp, Homo sapiens
ttcctgggattattgtcaagca

SEQ ID NO: 9279019 - DNA, 22 bp, Homo sapiens
ctacagtctggcaggaatgtta

SEQ ID NO: 9279020 - DNA, 22 bp, Homo sapiens
ttcctgggagctagccacatct

SEQ ID NO: 9279021 - DNA, 22 bp, Homo sapiens
ttcctgggactggagcagccca

SEQ ID NO: 9279022 - DNA, 22 bp, Homo sapiens
ctacagagtatctaaagaggta

SEQ ID NO: 9279023 - DNA, 22 bp, Homo sapiens
ttccaggactcgttctggctca

SEQ ID NO: 9279024 - DNA, 22 bp, Homo sapiens
tggggcagccacatagacaaca

SEQ ID NO: 9279025 - DNA, 22 bp, Homo sapiens
tggggcagccacatagacaaca

SEQ ID NO: 9279026 - DNA, 22 bp, Homo sapiens
tggggcagctccatctattcca

SEQ ID NO: 9279027 - DNA, 22 bp, Homo sapiens
tggggcagctccatctattcca

SEQ ID NO: 9279028 - DNA, 22 bp, Homo sapiens
tggggcagggatgggaaactat

SEQ ID NO: 9279029 - DNA, 22 bp, Homo sapiens
tggggcagggatgggaaactat

SEQ ID NO: 9279030 - DNA, 22 bp, Homo sapiens
tggggcagttaataaacattct

SEQ ID NO: 9279031 - DNA, 22 bp, Homo sapiens
tggggcagtggcttttcaccct

SEQ ID NO: 9279032 - DNA, 23 bp, Homo sapiens
tggggccaagtgaggaagggtct

SEQ ID NO: 9279033 - DNA, 22 bp, Homo sapiens
tggggccacacatctctttcta

SEQ ID NO: 9279034 - DNA, 22 bp, Homo sapiens
tggggctgtccttagtctgaga

SEQ ID NO: 9279035 - DNA, 22 bp, Homo sapiens
tggggccaagaaggtctcatgt

SEQ ID NO: 9279036 - DNA, 22 bp, Homo sapiens
cctgggaggctgaggctgcagt

SEQ ID NO: 9279037 - DNA, 21 bp, Homo sapiens
tgggggagaattggttgcttt

SEQ ID NO: 9279038 - DNA, 22 bp, Homo sapiens
tgggggaagagcttgttaaagt

SEQ ID NO: 9279039 - DNA, 22 bp, Homo sapiens
tgggggaactgttgcgcgcggg

SEQ ID NO: 9279040 - DNA, 21 bp, Homo sapiens
tgggggagaattggttgcttt

SEQ ID NO: 9279041 - DNA, 22 bp, Homo sapiens
tgggggactgcactggcgtcag

SEQ ID NO: 9279042 - DNA, 21 bp, Homo sapiens
tgggggagaattggttgcttt

SEQ ID NO: 9279043 - DNA, 22 bp, Homo sapiens
cctgggagtggcactcacagca

SEQ ID NO: 9279044 - DNA, 22 bp, Homo sapiens
cctgggagtggcactcacagca

SEQ ID NO: 9279045 - DNA, 19 bp, Homo sapiens
cctgggagtcagctgaagg

SEQ ID NO: 9279046 - DNA, 22 bp, Homo sapiens
cctgggagtgtgccatctctgt

SEQ ID NO: 9279047 - DNA, 22 bp, Homo sapiens
cctgggatgaaagcagcccact

SEQ ID NO: 9279048 - DNA, 22 bp, Homo sapiens
cctgggagtgtgccatctctgt

SEQ ID NO: 9279049 - DNA, 22 bp, Homo sapiens
cctgggagtgtcagacttgctt

SEQ ID NO: 9279050 - DNA, 22 bp, Homo sapiens
cctgggatttgcgccagacctt

SEQ ID NO: 9279051 - DNA, 22 bp, Homo sapiens
cctgggcaaatgccagagacaa

SEQ ID NO: 9279052 - DNA, 22 bp, Homo sapiens
cctgggatttcctgagcactct

SEQ ID NO: 9279053 - DNA, 22 bp, Homo sapiens
cctgggatttgcgccagacctt

SEQ ID NO: 9279054 - DNA, 22 bp, Homo sapiens
cctgggatttgcgccagacctt

SEQ ID NO: 9279055 - DNA, 22 bp, Homo sapiens
cctgggatttcctgagcactct

SEQ ID NO: 9279056 - DNA, 22 bp, Homo sapiens
cctgggcaacatagggagaccc

SEQ ID NO: 9279057 - DNA, 22 bp, Homo sapiens
cctgggcaacatagggagaccc

SEQ ID NO: 9279058 - DNA, 22 bp, Homo sapiens
cctgggcaaatgccagagacaa

SEQ ID NO: 9279059 - DNA, 22 bp, Homo sapiens
cctgggcaaattatgttactca

SEQ ID NO: 9279060 - DNA, 22 bp, Homo sapiens
cctgggcaacatagtgagacct

SEQ ID NO: 9279061 - DNA, 22 bp, Homo sapiens
cctgggcaacatagtgagacct

SEQ ID NO: 9279062 - DNA, 22 bp, Homo sapiens
cctgggcaacatagtgagaccc

SEQ ID NO: 9279063 - DNA, 22 bp, Homo sapiens
cctgggcaacatagtgagacct

SEQ ID NO: 9279064 - DNA, 22 bp, Homo sapiens
cctgggcaacatagtgagaccc

SEQ ID NO: 9279065 - DNA, 22 bp, Homo sapiens
cctgggcaacatagtgagaccc

SEQ ID NO: 9279066 - DNA, 22 bp, Homo sapiens
cctgggcaacatagggagaccc

SEQ ID NO: 9279067 - DNA, 22 bp, Homo sapiens
cctgggcaacatagtgagaccc

SEQ ID NO: 9279068 - DNA, 22 bp, Homo sapiens
cctgggcaacatagggagaccc

SEQ ID NO: 9279069 - DNA, 22 bp, Homo sapiens
cctgggcaatatagtgaggccc

SEQ ID NO: 9279070 - DNA, 22 bp, Homo sapiens
cctgggcaacatagtgagacct

SEQ ID NO: 9279071 - DNA, 22 bp, Homo sapiens
cctgggcaatatagtgaggccc

SEQ ID NO: 9279072 - DNA, 22 bp, Homo sapiens
tgtgggtcctcctgtgtgcccg

SEQ ID NO: 9279073 - DNA, 22 bp, Homo sapiens
tgtgtctgaactagttgctctc

SEQ ID NO: 9279074 - DNA, 22 bp, Homo sapiens
tgtgtctgaacatgctttgtaa

SEQ ID NO: 9279075 - DNA, 22 bp, Homo sapiens
tgtgtctccatagccagctagc

SEQ ID NO: 9279076 - DNA, 22 bp, Homo sapiens
tgtgtctctcctggaagcacgt

SEQ ID NO: 9279077 - DNA, 19 bp, Homo sapiens
tgtgtctctgtgtagcctg

SEQ ID NO: 9279078 - DNA, 22 bp, Homo sapiens
cctgggcttacgacctctgact

SEQ ID NO: 9279079 - DNA, 22 bp, Homo sapiens
cctgggctgttgcatcatcctt

SEQ ID NO: 9279080 - DNA, 22 bp, Homo sapiens
cctgggctgttgcatcatcctt

SEQ ID NO: 9279081 - DNA, 22 bp, Homo sapiens
cctgggctgggcgtctcatggg

SEQ ID NO: 9279082 - DNA, 22 bp, Homo sapiens
cctgggctgtacctgtgcgcgg

SEQ ID NO: 9279083 - DNA, 22 bp, Homo sapiens
tgttacaagtcttgaggtactt

SEQ ID NO: 9279084 - DNA, 22 bp, Homo sapiens
tgttacaaatgcggagtttgtg

SEQ ID NO: 9279085 - DNA, 22 bp, Homo sapiens
tgttaatttctttagaagtgga

SEQ ID NO: 9279086 - DNA, 22 bp, Homo sapiens
tgttaatggctgaagacatcct

SEQ ID NO: 9279087 - DNA, 22 bp, Homo sapiens
tgtgttctgaaggagaagagtg

SEQ ID NO: 9279088 - DNA, 22 bp, Homo sapiens
tgtgttctcctacagataagga

SEQ ID NO: 9279089 - DNA, 22 bp, Homo sapiens
tgtgttctgaaggagaagagtg

SEQ ID NO: 9279090 - DNA, 18 bp, Homo sapiens
tgttaaggatccagtagt

SEQ ID NO: 9279091 - DNA, 22 bp, Homo sapiens
tgttaaggggatatagcagggc

SEQ ID NO: 9279092 - DNA, 22 bp, Homo sapiens
tgttaaggtcctgacttctgca

SEQ ID NO: 9279093 - DNA, 22 bp, Homo sapiens
tgttaagggtaaacagcagtaa

SEQ ID NO: 9279094 - DNA, 22 bp, Homo sapiens
tgttaatatactaaaatccact

SEQ ID NO: 9279095 - DNA, 23 bp, Homo sapiens
tgttaatacatctgccactcatt

SEQ ID NO: 9279096 - DNA, 22 bp, Homo sapiens
cctgggctctatcctgacccag

SEQ ID NO: 9279097 - DNA, 22 bp, Homo sapiens
cctgggctctgaggagggagtc

SEQ ID NO: 9279098 - DNA, 22 bp, Homo sapiens
cctgggctctgaggagggagtc

SEQ ID NO: 9279099 - DNA, 22 bp, Homo sapiens
cctgggctcaagtgatcctcct

SEQ ID NO: 9279100 - DNA, 22 bp, Homo sapiens
tgtgtctgcccttagtacatct

SEQ ID NO: 9279101 - DNA, 16 bp, Homo sapiens
cctgggctctgttgga

SEQ ID NO: 9279102 - DNA, 22 bp, Homo sapiens
cctgggctctgtcagaattggg

SEQ ID NO: 9279103 - DNA, 22 bp, Homo sapiens
cctgggctggagtacagcagtg

SEQ ID NO: 9279104 - DNA, 22 bp, Homo sapiens
cctgggctggagtacagcagtg

SEQ ID NO: 9279105 - DNA, 22 bp, Homo sapiens
cctgggctggagtacagcagtg

SEQ ID NO: 9279106 - DNA, 22 bp, Homo sapiens
cctgggctgcatgatggcattt

SEQ ID NO: 9279107 - DNA, 22 bp, Homo sapiens
cctgggtgtcatgggcagctgg

SEQ ID NO: 9279108 - DNA, 22 bp, Homo sapiens
cctggtgcttaccagagctttt

SEQ ID NO: 9279109 - DNA, 22 bp, Homo sapiens
cctggtgcttaccagagctttt

SEQ ID NO: 9279110 - DNA, 22 bp, Homo sapiens
cctggtggagaggggcggagcg

SEQ ID NO: 9279111 - DNA, 22 bp, Homo sapiens
cctggtggcttctgggtggacg

SEQ ID NO: 9279112 - DNA, 22 bp, Homo sapiens
tgtttacttcatcgagtacttc

SEQ ID NO: 9279113 - DNA, 22 bp, Homo sapiens
tgtttacttgaggtggaaacaa

SEQ ID NO: 9279114 - DNA, 22 bp, Homo sapiens
cctggtgtggctgtcacagagg

SEQ ID NO: 9279115 - DNA, 22 bp, Homo sapiens
cctggtgttgtgaagtagccgt

SEQ ID NO: 9279116 - DNA, 22 bp, Homo sapiens
tgttcattattcttcatctgcc

SEQ ID NO: 9279117 - DNA, 22 bp, Homo sapiens
tgttcattcaacatgtcatcta

SEQ ID NO: 9279118 - DNA, 22 bp, Homo sapiens
tgttcattctgtatatgctgta

SEQ ID NO: 9279119 - DNA, 22 bp, Homo sapiens
tgttcattttgaagtacttcaa

SEQ ID NO: 9279120 - DNA, 22 bp, Homo sapiens
tgttacacagcagaatagcaag

SEQ ID NO: 9279121 - DNA, 22 bp, Homo sapiens
tgttacaatattatcaactgag

SEQ ID NO: 9279122 - DNA, 22 bp, Homo sapiens
tgttcatagctatcattgtgtc

SEQ ID NO: 9279123 - DNA, 22 bp, Homo sapiens
cctgtgtggccaggctggagtc

SEQ ID NO: 9279124 - DNA, 22 bp, Homo sapiens
cctgtgtggccaggctggagtc

SEQ ID NO: 9279125 - DNA, 19 bp, Homo sapiens
cctgtgtggggtagagatc

SEQ ID NO: 9279126 - DNA, 19 bp, Homo sapiens
cctgtgtggggtagagatc

SEQ ID NO: 9279127 - DNA, 20 bp, Homo sapiens
cctgtgtggccagctgaggc

SEQ ID NO: 9279128 - DNA, 20 bp, Homo sapiens
cctgtgtggccagctgaggc

SEQ ID NO: 9279129 - DNA, 20 bp, Homo sapiens
cctgtgtggtttgcactaca

SEQ ID NO: 9279130 - DNA, 22 bp, Homo sapiens
cctgtgtggtagccagcggtgc

SEQ ID NO: 9279131 - DNA, 19 bp, Homo sapiens
cctgtgtggggtagagatc

SEQ ID NO: 9279132 - DNA, 21 bp, Homo sapiens
cctgtgtgtctgactgggcta

SEQ ID NO: 9279133 - DNA, 22 bp, Homo sapiens
cctgtgtgtaggccaggggagt

SEQ ID NO: 9279134 - DNA, 22 bp, Homo sapiens
cctgtgtgtaggccaggggagt

SEQ ID NO: 9279135 - DNA, 22 bp, Homo sapiens
cctgtgtgtaggccaggggagt

SEQ ID NO: 9279136 - DNA, 22 bp, Homo sapiens
cctgtgtcttccccactggtgt

SEQ ID NO: 9279137 - DNA, 22 bp, Homo sapiens
cctgtgtgaaggttaggcaggt

SEQ ID NO: 9279138 - DNA, 22 bp, Homo sapiens
cctgtgtgattggaagctgaga

SEQ ID NO: 9279139 - DNA, 22 bp, Homo sapiens
cctgtgtgcacacgaggccatg

SEQ ID NO: 9279140 - DNA, 22 bp, Homo sapiens
cctgtgtgcacacgaggccatg

SEQ ID NO: 9279141 - DNA, 22 bp, Homo sapiens
cctgtgtgctgatgacgacaga

SEQ ID NO: 9279142 - DNA, 23 bp, Homo sapiens
cctgtgtgcccttaattcacagc

SEQ ID NO: 9279143 - DNA, 22 bp, Homo sapiens
cctgtgtgctgatgacgacaga

SEQ ID NO: 9279144 - DNA, 22 bp, Homo sapiens
cctgtgtggaaaccgcatgacg

SEQ ID NO: 9279145 - DNA, 22 bp, Homo sapiens
ccttcctggctgtccgcctgat

SEQ ID NO: 9279146 - DNA, 22 bp, Homo sapiens
ccttcctggagcccatgcagat

SEQ ID NO: 9279147 - DNA, 19 bp, Homo sapiens
ccttcctccccagggccat

SEQ ID NO: 9279148 - DNA, 22 bp, Homo sapiens
ccttcctcatccatttctcttg

SEQ ID NO: 9279149 - DNA, 17 bp, Homo sapiens
ccttcctcatctccttc

SEQ ID NO: 9279150 - DNA, 17 bp, Homo sapiens
ccttcctcatctccttc

SEQ ID NO: 9279151 - DNA, 22 bp, Homo sapiens
ccttcccaggctagaccaacat

SEQ ID NO: 9279152 - DNA, 22 bp, Homo sapiens
ccttcagtcccatgtttctctt

SEQ ID NO: 9279153 - DNA, 19 bp, Homo sapiens
ccttccccttcagcctctg

SEQ ID NO: 9279154 - DNA, 19 bp, Homo sapiens
ccttccccttcagcctctg

SEQ ID NO: 9279155 - DNA, 22 bp, Homo sapiens
ccttccccaggtgctcactgtc

SEQ ID NO: 9279156 - DNA, 22 bp, Homo sapiens
ttagaaaaatgttcagtagttt

SEQ ID NO: 9279157 - DNA, 22 bp, Homo sapiens
cctttacagtatggttgtatca

SEQ ID NO: 9279158 - DNA, 22 bp, Homo sapiens
ttagaatttctgctcactttga

SEQ ID NO: 9279159 - DNA, 22 bp, Homo sapiens
ttagaattattgtttccttcta

SEQ ID NO: 9279160 - DNA, 22 bp, Homo sapiens
ttagaagttcaggtctgtaatc

SEQ ID NO: 9279161 - DNA, 22 bp, Homo sapiens
ttagaatcaggtgttataatca

SEQ ID NO: 9279162 - DNA, 22 bp, Homo sapiens
ttagaatctaacattcttatct

SEQ ID NO: 9279163 - DNA, 22 bp, Homo sapiens
ttagaatctttagagtctcact

SEQ ID NO: 9279164 - DNA, 21 bp, Homo sapiens
ttacttttgcaccaacctaat

SEQ ID NO: 9279165 - DNA, 23 bp, Homo sapiens
ttacttttgcaccaacctaatat

SEQ ID NO: 9279166 - DNA, 23 bp, Homo sapiens
ttacttttgcaccaacctaatat

SEQ ID NO: 9279167 - DNA, 21 bp, Homo sapiens
ttacttttgcagcaacctaat

SEQ ID NO: 9279168 - DNA, 22 bp, Homo sapiens
ccttccttgagaagcaattcct

SEQ ID NO: 9279169 - DNA, 22 bp, Homo sapiens
ccttccttcaagcacacatcta

SEQ ID NO: 9279170 - DNA, 22 bp, Homo sapiens
ccttccttgagaagcaattcct

SEQ ID NO: 9279171 - DNA, 22 bp, Homo sapiens
ccttcctttcagggctatgcct

SEQ ID NO: 9279172 - DNA, 22 bp, Homo sapiens
ccttcctttgcaggtcaggtca

SEQ ID NO: 9279173 - DNA, 22 bp, Homo sapiens
ccttcgagatttaaacactgat

SEQ ID NO: 9279174 - DNA, 22 bp, Homo sapiens
ccttcctttgcatcatttctag

SEQ ID NO: 9279175 - DNA, 21 bp, Homo sapiens
ttactaaacaaaacatgcagg

SEQ ID NO: 9279176 - DNA, 22 bp, Homo sapiens
ttaaatagctcttgtagaagaa

SEQ ID NO: 9279177 - DNA, 22 bp, Homo sapiens
ttaaagttcattaaatgagcca

SEQ ID NO: 9279178 - DNA, 22 bp, Homo sapiens
ttaaagtttcagaaacttggtc

SEQ ID NO: 9279179 - DNA, 22 bp, Homo sapiens
ttaaagtttgcctatgtgttgt

SEQ ID NO: 9279180 - DNA, 22 bp, Homo sapiens
ttaaagtctatgtactacactt

SEQ ID NO: 9279181 - DNA, 22 bp, Homo sapiens
ttaaagtatagaggacaaaaac

SEQ ID NO: 9279182 - DNA, 21 bp, Homo sapiens
cctgtggtctggagggagcac

SEQ ID NO: 9279183 - DNA, 21 bp, Homo sapiens
cctgtggtctggagggagcac

SEQ ID NO: 9279184 - DNA, 22 bp, Homo sapiens
cctgtggtttacatgacagtta

SEQ ID NO: 9279185 - DNA, 22 bp, Homo sapiens
cctgtggtttactctgtggcta

SEQ ID NO: 9279186 - DNA, 22 bp, Homo sapiens
cctgtgtcagcccctgcctcca

SEQ ID NO: 9279187 - DNA, 21 bp, Homo sapiens
cctgtgccagtctatgtgttc

SEQ ID NO: 9279188 - DNA, 22 bp, Homo sapiens
cctgtgccttaaccctttaggc

SEQ ID NO: 9279189 - DNA, 22 bp, Homo sapiens
cctgtgcctgcctgtgagttct

SEQ ID NO: 9279190 - DNA, 19 bp, Homo sapiens
cctgtgctaggagctgacc

SEQ ID NO: 9279191 - DNA, 19 bp, Homo sapiens
cctgtgctaggagctgacc

SEQ ID NO: 9279192 - DNA, 22 bp, Homo sapiens
ttaaagctgagccctcagaagc

SEQ ID NO: 9279193 - DNA, 22 bp, Homo sapiens
ttaaagctggcgttacagtttg

SEQ ID NO: 9279194 - DNA, 22 bp, Homo sapiens
cctgtgcttcagctggaggagg

SEQ ID NO: 9279195 - DNA, 21 bp, Homo sapiens
ttaaagctatggtagtgggct

SEQ ID NO: 9279196 - DNA, 19 bp, Homo sapiens
cctgtctgtcttcagctag

SEQ ID NO: 9279197 - DNA, 19 bp, Homo sapiens
cctgtctgtcttcagctag

SEQ ID NO: 9279198 - DNA, 22 bp, Homo sapiens
cctgtctgtcctttgcattctt

SEQ ID NO: 9279199 - DNA, 22 bp, Homo sapiens
cctgtctgtcctttgcattctt

SEQ ID NO: 9279200 - DNA, 22 bp, Homo sapiens
cctgtctgtcctttgcattctt

SEQ ID NO: 9279201 - DNA, 19 bp, Homo sapiens
cctgtctgtcttcagctag

SEQ ID NO: 9279202 - DNA, 23 bp, Homo sapiens
cctgtctgtgctgggtggacaca

SEQ ID NO: 9279203 - DNA, 22 bp, Homo sapiens
cctgtctgtttcattccttgtt

SEQ ID NO: 9279204 - DNA, 22 bp, Homo sapiens
cctgtctgtttgcccattcttg

SEQ ID NO: 9279205 - DNA, 22 bp, Homo sapiens
cctgtctgtttgcccattcttg

SEQ ID NO: 9279206 - DNA, 22 bp, Homo sapiens
cctgtgccatcctgagcatccc

SEQ ID NO: 9279207 - DNA, 22 bp, Homo sapiens
cctgtctggaacatggcctgtt

SEQ ID NO: 9279208 - DNA, 22 bp, Homo sapiens
cctgtctggaacatggcctgtt

SEQ ID NO: 9279209 - DNA, 20 bp, Homo sapiens
cctgtctggagacaaagaga

SEQ ID NO: 9279210 - DNA, 22 bp, Homo sapiens
cctgtctggccaccagggcgat

SEQ ID NO: 9279211 - DNA, 22 bp, Homo sapiens
cctgtctggccttccacggggg

SEQ ID NO: 9279212 - DNA, 22 bp, Homo sapiens
cctgtctgggcttgagtattta

SEQ ID NO: 9279213 - DNA, 22 bp, Homo sapiens
cctgtctggccttccacggggg

SEQ ID NO: 9279214 - DNA, 22 bp, Homo sapiens
cctgtctggggactccctgggt

SEQ ID NO: 9279215 - DNA, 22 bp, Homo sapiens
cctgtctgtcctctcatgagcc

SEQ ID NO: 9279216 - DNA, 22 bp, Homo sapiens
cctgtctgtcctttgcattctt

SEQ ID NO: 9279217 - DNA, 22 bp, Homo sapiens
cctgtctgtattggtttgctat

SEQ ID NO: 9279218 - DNA, 22 bp, Homo sapiens
cctgtctgtcctctcatgagcc

SEQ ID NO: 9279219 - DNA, 22 bp, Homo sapiens
cctgtctgtattattcaccact

SEQ ID NO: 9279220 - DNA, 22 bp, Homo sapiens
cctgtctgtatcggttcagagt

SEQ ID NO: 9279221 - DNA, 18 bp, Homo sapiens
cctgtctggggtccccac

SEQ ID NO: 9279222 - DNA, 22 bp, Homo sapiens
cctgtctggggactccctgggt

SEQ ID NO: 9279223 - DNA, 18 bp, Homo sapiens
cctgtctggggtccccac

SEQ ID NO: 9279224 - DNA, 22 bp, Homo sapiens
cctgtctgcatgatccctgcca

SEQ ID NO: 9279225 - DNA, 22 bp, Homo sapiens
cctgtctgcatgatccctgcca

SEQ ID NO: 9279226 - DNA, 22 bp, Homo sapiens
cctgtctgcatgatccctgcca

SEQ ID NO: 9279227 - DNA, 22 bp, Homo sapiens
cctgtctgcatgatccctgcca

SEQ ID NO: 9279228 - DNA, 22 bp, Homo sapiens
cctgtctgcatgatccctgcca

SEQ ID NO: 9279229 - DNA, 22 bp, Homo sapiens
cctgtctgcagatatctcaggt

SEQ ID NO: 9279230 - DNA, 22 bp, Homo sapiens
cctgtctgcaggaaattaccag

SEQ ID NO: 9279231 - DNA, 20 bp, Homo sapiens
cctgtctgcaatggaggtca

SEQ ID NO: 9279232 - DNA, 22 bp, Homo sapiens
cctgtctgcagatatctcaggt

SEQ ID NO: 9279233 - DNA, 22 bp, Homo sapiens
cctgtctgcagatatctcaggt

SEQ ID NO: 9279234 - DNA, 22 bp, Homo sapiens
cctgtctgaatcatgatttcct

SEQ ID NO: 9279235 - DNA, 22 bp, Homo sapiens
cctgtctgaatcatgatttcct

SEQ ID NO: 9279236 - DNA, 22 bp, Homo sapiens
cctgtctgaatcatgatttcct

SEQ ID NO: 9279237 - DNA, 22 bp, Homo sapiens
cctgtctctttcaatctgagag

SEQ ID NO: 9279238 - DNA, 22 bp, Homo sapiens
cctgtctctttcaatctgagag

SEQ ID NO: 9279239 - DNA, 22 bp, Homo sapiens
cctgtcagatgaagtaattgtg

SEQ ID NO: 9279240 - DNA, 22 bp, Homo sapiens
tgtttagatctcattcttccca

SEQ ID NO: 9279241 - DNA, 21 bp, Homo sapiens
ctgaggcatgcaggcctgggc

SEQ ID NO: 9279242 - DNA, 22 bp, Homo sapiens
ctgaggcatgggaagttgggtg

SEQ ID NO: 9279243 - DNA, 22 bp, Homo sapiens
ctgaggcatgggaagttgggtg

SEQ ID NO: 9279244 - DNA, 22 bp, Homo sapiens
ctgaggcatgttacaggacata

SEQ ID NO: 9279245 - DNA, 22 bp, Homo sapiens
ctgaggcatgttacaggacata

SEQ ID NO: 9279246 - DNA, 22 bp, Homo sapiens
ctgaggcatgttacaggacata

SEQ ID NO: 9279247 - DNA, 22 bp, Homo sapiens
ctgaggccagaacccgaccctg

SEQ ID NO: 9279248 - DNA, 18 bp, Homo sapiens
ctgaggccaactacactg

SEQ ID NO: 9279249 - DNA, 22 bp, Homo sapiens
ctgaggccagagtgggcctctt

SEQ ID NO: 9279250 - DNA, 22 bp, Homo sapiens
ctgaggccagctgcagagctct

SEQ ID NO: 9279251 - DNA, 22 bp, Homo sapiens
ctgaggcccctcttgtgagcat

SEQ ID NO: 9279252 - DNA, 22 bp, Homo sapiens
ctgaggcccctcttgtgagcat

SEQ ID NO: 9279253 - DNA, 22 bp, Homo sapiens
ctgaggcccctctcttgagctt

SEQ ID NO: 9279254 - DNA, 22 bp, Homo sapiens
ctgaggcccctctcttgagctt

SEQ ID NO: 9279255 - DNA, 19 bp, Homo sapiens
ctgaggcccatgtaccatg

SEQ ID NO: 9279256 - DNA, 19 bp, Homo sapiens
ctgaggcccatgtaccatg

SEQ ID NO: 9279257 - DNA, 18 bp, Homo sapiens
ctgaggcccagagagggc

SEQ ID NO: 9279258 - DNA, 17 bp, Homo sapiens
ctgaggcccagggccca

SEQ ID NO: 9279259 - DNA, 17 bp, Homo sapiens
ctgaggcccagggccca

SEQ ID NO: 9279260 - DNA, 22 bp, Homo sapiens
ctgaggccagctgcagagctct

SEQ ID NO: 9279261 - DNA, 22 bp, Homo sapiens
ctgaggccagctgcagagctct

SEQ ID NO: 9279262 - DNA, 22 bp, Homo sapiens
ctgaggccagctgcagagctct

SEQ ID NO: 9279263 - DNA, 22 bp, Homo sapiens
ctgcacagtgggtggggcgtca

SEQ ID NO: 9279264 - DNA, 22 bp, Homo sapiens
ctgcacagtggacagtgaagat

SEQ ID NO: 9279265 - DNA, 22 bp, Homo sapiens
ctgcacaggggatgagggcagt

SEQ ID NO: 9279266 - DNA, 22 bp, Homo sapiens
ctgcacagggatatggggagct

SEQ ID NO: 9279267 - DNA, 22 bp, Homo sapiens
ctgcacagcctgtctgggggcc

SEQ ID NO: 9279268 - DNA, 22 bp, Homo sapiens
ctgcacagctgggcaagatata

SEQ ID NO: 9279269 - DNA, 22 bp, Homo sapiens
ctgcacagctggccagggagag

SEQ ID NO: 9279270 - DNA, 22 bp, Homo sapiens
ctgcacagctggccagggagag

SEQ ID NO: 9279271 - DNA, 22 bp, Homo sapiens
ctgcacagagcggcagttctta

SEQ ID NO: 9279272 - DNA, 22 bp, Homo sapiens
ctgcacagaggtcggtctgcca

SEQ ID NO: 9279273 - DNA, 22 bp, Homo sapiens
ctgcacagagcagggcagacac

SEQ ID NO: 9279274 - DNA, 22 bp, Homo sapiens
ctgcacagagcagggcagacac

SEQ ID NO: 9279275 - DNA, 22 bp, Homo sapiens
ctgcacagagcagggcagacac

SEQ ID NO: 9279276 - DNA, 22 bp, Homo sapiens
ctgaggccggagcactgaagag

SEQ ID NO: 9279277 - DNA, 22 bp, Homo sapiens
ctgaggccggagcactgaagag

SEQ ID NO: 9279278 - DNA, 22 bp, Homo sapiens
ctgcaaaagtcattgtggtttt

SEQ ID NO: 9279279 - DNA, 22 bp, Homo sapiens
ctgcaaaattgttctttgctcc

SEQ ID NO: 9279280 - DNA, 22 bp, Homo sapiens
ctgcacagtttgatttcttgct

SEQ ID NO: 9279281 - DNA, 22 bp, Homo sapiens
ctgcacagtttgatttcttgct

SEQ ID NO: 9279282 - DNA, 22 bp, Homo sapiens
ctgcactgaagaaaggagctct

SEQ ID NO: 9279283 - DNA, 22 bp, Homo sapiens
ctgcaccgtgtctcgggctgcc

SEQ ID NO: 9279284 - DNA, 22 bp, Homo sapiens
ctgcaggcatctaactgtgggc

SEQ ID NO: 9279285 - DNA, 22 bp, Homo sapiens
ctgcaggcatctaactgtgggc

SEQ ID NO: 9279286 - DNA, 22 bp, Homo sapiens
ctgcagggagcagatggcgtgt

SEQ ID NO: 9279287 - DNA, 22 bp, Homo sapiens
ctgcaggcccccttcctggagt

SEQ ID NO: 9279288 - DNA, 22 bp, Homo sapiens
ctgcagggccatgggttctata

SEQ ID NO: 9279289 - DNA, 22 bp, Homo sapiens
ctgcagggcccaaggtcaacgg

SEQ ID NO: 9279290 - DNA, 22 bp, Homo sapiens
ctgcagggcccgcctgagccct

SEQ ID NO: 9279291 - DNA, 22 bp, Homo sapiens
ctgcagggcccgcctgagccct

SEQ ID NO: 9279292 - DNA, 22 bp, Homo sapiens
ctgcaggggcagtccacttcct

SEQ ID NO: 9279293 - DNA, 22 bp, Homo sapiens
ctgcaggggcctcgagcacagg

SEQ ID NO: 9279294 - DNA, 22 bp, Homo sapiens
ctgcaggggcagtccacttcct

SEQ ID NO: 9279295 - DNA, 22 bp, Homo sapiens
ctgcaggggaccaaagtctgac

SEQ ID NO: 9279296 - DNA, 22 bp, Homo sapiens
ctgcagggcttaccttgctctg

SEQ ID NO: 9279297 - DNA, 22 bp, Homo sapiens
ctgcagggcagggcctcctggc

SEQ ID NO: 9279298 - DNA, 22 bp, Homo sapiens
ctgcagggcattgtaactcttt

SEQ ID NO: 9279299 - DNA, 22 bp, Homo sapiens
ctgcagggcagggcctcctggc

SEQ ID NO: 9279300 - DNA, 22 bp, Homo sapiens
ctgcagggcagggcctcctggc

SEQ ID NO: 9279301 - DNA, 22 bp, Homo sapiens
ctgcagggattgcttctgtata

SEQ ID NO: 9279302 - DNA, 19 bp, Homo sapiens
ctgcagggatgtgcagagt

SEQ ID NO: 9279303 - DNA, 22 bp, Homo sapiens
ctgcagggatgtgaggcccgtt

SEQ ID NO: 9279304 - DNA, 19 bp, Homo sapiens
ctgcagggatgtgcagagt

SEQ ID NO: 9279305 - DNA, 20 bp, Homo sapiens
ctgagcccccagcctgcagg

SEQ ID NO: 9279306 - DNA, 22 bp, Homo sapiens
ctgagcccctctgacctcagag

SEQ ID NO: 9279307 - DNA, 22 bp, Homo sapiens
ctgagcccaggcgggagctgag

SEQ ID NO: 9279308 - DNA, 22 bp, Homo sapiens
ctgagccccatctgaggtgccc

SEQ ID NO: 9279309 - DNA, 22 bp, Homo sapiens
ctgagcccattgggtgctgtta

SEQ ID NO: 9279310 - DNA, 22 bp, Homo sapiens
ctgaggcagagggcagaccaga

SEQ ID NO: 9279311 - DNA, 22 bp, Homo sapiens
ctgaggcagagggcagaccaga

SEQ ID NO: 9279312 - DNA, 22 bp, Homo sapiens
ctgagcccttgcttatgcttcc

SEQ ID NO: 9279313 - DNA, 22 bp, Homo sapiens
ctgagccatgagcctgcgccca

SEQ ID NO: 9279314 - DNA, 22 bp, Homo sapiens
ctgagccatgagcctgcgccca

SEQ ID NO: 9279315 - DNA, 22 bp, Homo sapiens
ctgagccataagggaggctggg

SEQ ID NO: 9279316 - DNA, 22 bp, Homo sapiens
ctgagccataagggaggctggg

SEQ ID NO: 9279317 - DNA, 22 bp, Homo sapiens
ctgagccatccataccagctta

SEQ ID NO: 9279318 - DNA, 22 bp, Homo sapiens
ctgagccatccataccagctta

SEQ ID NO: 9279319 - DNA, 22 bp, Homo sapiens
ctgagccatccataccagctta

SEQ ID NO: 9279320 - DNA, 22 bp, Homo sapiens
ctgagccagtagtcagggacaa

SEQ ID NO: 9279321 - DNA, 22 bp, Homo sapiens
ctgagccagtagtcagggacaa

SEQ ID NO: 9279322 - DNA, 22 bp, Homo sapiens
ctgagccataagggaggctggg

SEQ ID NO: 9279323 - DNA, 22 bp, Homo sapiens
ctgagccataagggaggctggg

SEQ ID NO: 9279324 - DNA, 22 bp, Homo sapiens
ctgagccagtagtcagggacaa

SEQ ID NO: 9279325 - DNA, 22 bp, Homo sapiens
ctgactcccaagctagtgctct

SEQ ID NO: 9279326 - DNA, 23 bp, Homo sapiens
ctgactcatcccaccacctcctc

SEQ ID NO: 9279327 - DNA, 22 bp, Homo sapiens
ctgactcagcagctgatgatcc

SEQ ID NO: 9279328 - DNA, 22 bp, Homo sapiens
ctgagccaaccacagcaggagc

SEQ ID NO: 9279329 - DNA, 22 bp, Homo sapiens
ctgactctcctcaagcataaat

SEQ ID NO: 9279330 - DNA, 22 bp, Homo sapiens
ctgactccctccccaaagctgg

SEQ ID NO: 9279331 - DNA, 22 bp, Homo sapiens
ctgactccctgattctgggttt

SEQ ID NO: 9279332 - DNA, 22 bp, Homo sapiens
ctgactccttaccatatgcttt

SEQ ID NO: 9279333 - DNA, 22 bp, Homo sapiens
ctgacagattagatgtgcatat

SEQ ID NO: 9279334 - DNA, 22 bp, Homo sapiens
ctgaatcatggtcattagttta

SEQ ID NO: 9279335 - DNA, 22 bp, Homo sapiens
ctgacaggttggtagctttgga

SEQ ID NO: 9279336 - DNA, 22 bp, Homo sapiens
ctgacagtcttgccaagtttct

SEQ ID NO: 9279337 - DNA, 22 bp, Homo sapiens
ctgacagtgtacactgacagct

SEQ ID NO: 9279338 - DNA, 22 bp, Homo sapiens
ctgacagtttttgctgtattgt

SEQ ID NO: 9279339 - DNA, 22 bp, Homo sapiens
ctgacatttactgagcacttac

SEQ ID NO: 9279340 - DNA, 22 bp, Homo sapiens
ctgacatttactgagcacttac

SEQ ID NO: 9279341 - DNA, 18 bp, Homo sapiens
ctctttctttggcacaaa

SEQ ID NO: 9279342 - DNA, 22 bp, Homo sapiens
ctctttctggaaggcagagtgg

SEQ ID NO: 9279343 - DNA, 22 bp, Homo sapiens
ctctttctgattcgctgggacc

SEQ ID NO: 9279344 - DNA, 22 bp, Homo sapiens
ctctttggatagaattacaaag

SEQ ID NO: 9279345 - DNA, 22 bp, Homo sapiens
ctctttcctcagccacagtcta

SEQ ID NO: 9279346 - DNA, 22 bp, Homo sapiens
ctctttctcattgtcagcagaa

SEQ ID NO: 9279347 - DNA, 22 bp, Homo sapiens
ctctttctcgccgcccgcagtc

SEQ ID NO: 9279348 - DNA, 22 bp, Homo sapiens
ctctttctgattcgctgggacc

SEQ ID NO: 9279349 - DNA, 22 bp, Homo sapiens
ctctttagtttgaaatccacat

SEQ ID NO: 9279350 - DNA, 22 bp, Homo sapiens
ctctttagtggtgatgatgcta

SEQ ID NO: 9279351 - DNA, 21 bp, Homo sapiens
ctctttatatagtaaagatat

SEQ ID NO: 9279352 - DNA, 22 bp, Homo sapiens
ctctttcagttctgatagtctc

SEQ ID NO: 9279353 - DNA, 20 bp, Homo sapiens
tttgctatgcatatctgacc

SEQ ID NO: 9279354 - DNA, 22 bp, Homo sapiens
tttgctataaaagggtcacacg

SEQ ID NO: 9279355 - DNA, 22 bp, Homo sapiens
tttgctataaaagggtcacacg

SEQ ID NO: 9279356 - DNA, 22 bp, Homo sapiens
tttgctatttttctgtgcagct

SEQ ID NO: 9279357 - DNA, 22 bp, Homo sapiens
tttgctattgtgaatagtgcca

SEQ ID NO: 9279358 - DNA, 22 bp, Homo sapiens
tttgcctctcagagtctacaca

SEQ ID NO: 9279359 - DNA, 21 bp, Homo sapiens
tttgccttcacgaagcatcct

SEQ ID NO: 9279360 - DNA, 22 bp, Homo sapiens
tttgccttctctgaacctattt

SEQ ID NO: 9279361 - DNA, 22 bp, Homo sapiens
ctctggaagaatacacttagaa

SEQ ID NO: 9279362 - DNA, 22 bp, Homo sapiens
ctctgcttttatgtgccggcgc

SEQ ID NO: 9279363 - DNA, 22 bp, Homo sapiens
ctctgctttttagggagcctag

SEQ ID NO: 9279364 - DNA, 20 bp, Homo sapiens
ctctgctttaggagagtcag

SEQ ID NO: 9279365 - DNA, 20 bp, Homo sapiens
ctctgctttaggagagtcag

SEQ ID NO: 9279366 - DNA, 20 bp, Homo sapiens
ctctgctttccacctttcag

SEQ ID NO: 9279367 - DNA, 22 bp, Homo sapiens
tttgctcttatgaacaaggtgg

SEQ ID NO: 9279368 - DNA, 22 bp, Homo sapiens
tttgggaaatagtagaaaatgt

SEQ ID NO: 9279369 - DNA, 22 bp, Homo sapiens
tttgggaagaggaatctctgga

SEQ ID NO: 9279370 - DNA, 22 bp, Homo sapiens
tttgggaagaagttgcaaattt

SEQ ID NO: 9279371 - DNA, 22 bp, Homo sapiens
tttgggcaattcagtgggacct

SEQ ID NO: 9279372 - DNA, 22 bp, Homo sapiens
tttgggaattgtagctgtcttg

SEQ ID NO: 9279373 - DNA, 22 bp, Homo sapiens
ctctgcccacgtcttgcccaga

SEQ ID NO: 9279374 - DNA, 22 bp, Homo sapiens
ctctgccagtttctggcctcag

SEQ ID NO: 9279375 - DNA, 22 bp, Homo sapiens
ctctgccatcttggagctcaag

SEQ ID NO: 9279376 - DNA, 22 bp, Homo sapiens
tttccttgttcatttgccctat

SEQ ID NO: 9279377 - DNA, 22 bp, Homo sapiens
tttccttgttattatttgtcct

SEQ ID NO: 9279378 - DNA, 22 bp, Homo sapiens
tttccttgttattatttgtcct

SEQ ID NO: 9279379 - DNA, 22 bp, Homo sapiens
tttccttgttattatttgtcct

SEQ ID NO: 9279380 - DNA, 20 bp, Homo sapiens
tttcctttcattttagtacc

SEQ ID NO: 9279381 - DNA, 20 bp, Homo sapiens
tttcctttcattttagtacc

SEQ ID NO: 9279382 - DNA, 22 bp, Homo sapiens
ctctgccaccatgcttcctgac

SEQ ID NO: 9279383 - DNA, 19 bp, Homo sapiens
ctctgcctccctcctgggt

SEQ ID NO: 9279384 - DNA, 19 bp, Homo sapiens
ctctgcctccctcctgggt

SEQ ID NO: 9279385 - DNA, 19 bp, Homo sapiens
ctctgcctccctcctgggt

SEQ ID NO: 9279386 - DNA, 19 bp, Homo sapiens
ctctgcctccctcctgggt

SEQ ID NO: 9279387 - DNA, 22 bp, Homo sapiens
ctctgccctcgcacatctgcca

SEQ ID NO: 9279388 - DNA, 22 bp, Homo sapiens
tttgcattttagatttaggcct

SEQ ID NO: 9279389 - DNA, 22 bp, Homo sapiens
ctctgcccgcggatgccacgtc

SEQ ID NO: 9279390 - DNA, 22 bp, Homo sapiens
ctctgcccgcggatgccacgtc

SEQ ID NO: 9279391 - DNA, 22 bp, Homo sapiens
ttttcaggtgcagtaatcatat

SEQ ID NO: 9279392 - DNA, 22 bp, Homo sapiens
ttttcaggctgatttgtgttag

SEQ ID NO: 9279393 - DNA, 22 bp, Homo sapiens
ttttcagaggcctaagaggttt

SEQ ID NO: 9279394 - DNA, 22 bp, Homo sapiens
ttttcagtggtatctttgtaaa

SEQ ID NO: 9279395 - DNA, 22 bp, Homo sapiens
ttttcagttactgtttatgtga

SEQ ID NO: 9279396 - DNA, 22 bp, Homo sapiens
ctctttaaagtaaaatttgtct

SEQ ID NO: 9279397 - DNA, 22 bp, Homo sapiens
ctctttaactcccattctgtcc

SEQ ID NO: 9279398 - DNA, 22 bp, Homo sapiens
ctctttaagctcctaacagcca

SEQ ID NO: 9279399 - DNA, 20 bp, Homo sapiens
ctctttacatgtctcttcct

SEQ ID NO: 9279400 - DNA, 22 bp, Homo sapiens
ctctttactgctactacaaaga

SEQ ID NO: 9279401 - DNA, 22 bp, Homo sapiens
ctctttagtctgtgtggagaag

SEQ ID NO: 9279402 - DNA, 22 bp, Homo sapiens
ctctttagtcacagggcttcat

SEQ ID NO: 9279403 - DNA, 21 bp, Homo sapiens
ctcttcagtggtgagctcttc

SEQ ID NO: 9279404 - DNA, 22 bp, Homo sapiens
ctcttcattagttcctgtccca

SEQ ID NO: 9279405 - DNA, 22 bp, Homo sapiens
ctcttcaaaagtctaatcctta

SEQ ID NO: 9279406 - DNA, 22 bp, Homo sapiens
ctcttattttatggcatttgtg

SEQ ID NO: 9279407 - DNA, 22 bp, Homo sapiens
ctcttattcctacagtaacagg

SEQ ID NO: 9279408 - DNA, 22 bp, Homo sapiens
ctcttattcctacagtaacagg

SEQ ID NO: 9279409 - DNA, 22 bp, Homo sapiens
ctctgtttctcagcctatttcc

SEQ ID NO: 9279410 - DNA, 22 bp, Homo sapiens
ctcttagtttatctttgacaaa

SEQ ID NO: 9279411 - DNA, 23 bp, Homo sapiens
ttttagtgactcctttatctgcc

SEQ ID NO: 9279412 - DNA, 22 bp, Homo sapiens
tttgtacagtgatgttgtatgc

SEQ ID NO: 9279413 - DNA, 22 bp, Homo sapiens
tttgtacactgtctactatgaa

SEQ ID NO: 9279414 - DNA, 22 bp, Homo sapiens
tttgtacactgtctactatgaa

SEQ ID NO: 9279415 - DNA, 22 bp, Homo sapiens
tttgtacactgtctactatgaa

SEQ ID NO: 9279416 - DNA, 22 bp, Homo sapiens
tttgtacacaggatgttataat

SEQ ID NO: 9279417 - DNA, 22 bp, Homo sapiens
tttgtacacctacctaatacag

SEQ ID NO: 9279418 - DNA, 22 bp, Homo sapiens
tttgttctgaaaactcaagtcc

SEQ ID NO: 9279419 - DNA, 22 bp, Homo sapiens
tttgttctgaaaactcaagtcc

SEQ ID NO: 9279420 - DNA, 22 bp, Homo sapiens
ttttaagaactgttctgtgctt

SEQ ID NO: 9279421 - DNA, 22 bp, Homo sapiens
ttttaagatgctagtatttcag

SEQ ID NO: 9279422 - DNA, 22 bp, Homo sapiens
ttttaagatgctagtatttcag

SEQ ID NO: 9279423 - DNA, 22 bp, Homo sapiens
ttttaagaggaggctgtttgaa

SEQ ID NO: 9279424 - DNA, 22 bp, Homo sapiens
tttgtacatatataaaatctgt

SEQ ID NO: 9279425 - DNA, 22 bp, Homo sapiens
ttttagaatcaggttgtctggg

SEQ ID NO: 9279426 - DNA, 22 bp, Homo sapiens
ttttagattataagtctaattc

SEQ ID NO: 9279427 - DNA, 22 bp, Homo sapiens
ttttagattgggaaatgtaaag

SEQ ID NO: 9279428 - DNA, 22 bp, Homo sapiens
ttttagcactaagtgatatgct

SEQ ID NO: 9279429 - DNA, 22 bp, Homo sapiens
ttttagcacactttctttagcg

SEQ ID NO: 9279430 - DNA, 22 bp, Homo sapiens
ttttagattgggaaatgtaaag

SEQ ID NO: 9279431 - DNA, 20 bp, Homo sapiens
ttttagcacttgttatggtg

SEQ ID NO: 9279432 - DNA, 22 bp, Homo sapiens
ttttaagttaatataattgagg

SEQ ID NO: 9279433 - DNA, 22 bp, Homo sapiens
ttttaagttaatataattgagg

SEQ ID NO: 9279434 - DNA, 19 bp, Homo sapiens
ttttaagtgccctttcttc

SEQ ID NO: 9279435 - DNA, 19 bp, Homo sapiens
ttttaagtcctctctattc

SEQ ID NO: 9279436 - DNA, 22 bp, Homo sapiens
ttttaagttggattgctaagta

SEQ ID NO: 9279437 - DNA, 22 bp, Homo sapiens
ttttaatactgctattgtagga

SEQ ID NO: 9279438 - DNA, 22 bp, Homo sapiens
ttttaatactgctattgtagga

SEQ ID NO: 9279439 - DNA, 22 bp, Homo sapiens
ttgtacaaataggaacctctga

SEQ ID NO: 9279440 - DNA, 22 bp, Homo sapiens
ttgtacaaaggatttggaagag

SEQ ID NO: 9279441 - DNA, 22 bp, Homo sapiens
ttgtacaaagatttcacagctc

SEQ ID NO: 9279442 - DNA, 22 bp, Homo sapiens
ttggtcagcactgatgtttcag

SEQ ID NO: 9279443 - DNA, 22 bp, Homo sapiens
ttgtacaacacatattctacag

SEQ ID NO: 9279444 - DNA, 22 bp, Homo sapiens
ttgtacaaatgcatattcctgg

SEQ ID NO: 9279445 - DNA, 22 bp, Homo sapiens
ttgtacaaatgcatattcctgg

SEQ ID NO: 9279446 - DNA, 22 bp, Homo sapiens
ctccagattcctgctggcagaa

SEQ ID NO: 9279447 - DNA, 22 bp, Homo sapiens
ttgtacaagtattatgtgaaca

SEQ ID NO: 9279448 - DNA, 22 bp, Homo sapiens
ctccagattccgtttattcagg

SEQ ID NO: 9279449 - DNA, 22 bp, Homo sapiens
ctccacagcccctccagtggca

SEQ ID NO: 9279450 - DNA, 22 bp, Homo sapiens
ctccacagctcaggctcagagt

SEQ ID NO: 9279451 - DNA, 22 bp, Homo sapiens
ctccacagcccctccagtggca

SEQ ID NO: 9279452 - DNA, 19 bp, Homo sapiens
ctccacagggattgtgatt

SEQ ID NO: 9279453 - DNA, 22 bp, Homo sapiens
ctccaacgaggctggggtacaa

SEQ ID NO: 9279454 - DNA, 22 bp, Homo sapiens
ctccaacgaggctggggtacaa

SEQ ID NO: 9279455 - DNA, 20 bp, Homo sapiens
ctccaaggcttgcaggaggc

SEQ ID NO: 9279456 - DNA, 22 bp, Homo sapiens
ttgaaagttatctagattctga

SEQ ID NO: 9279457 - DNA, 22 bp, Homo sapiens
ttgaaagttaggatttagctgg

SEQ ID NO: 9279458 - DNA, 22 bp, Homo sapiens
ttgaaagtcacaatggcattaa

SEQ ID NO: 9279459 - DNA, 22 bp, Homo sapiens
ttgaaatactgcattgttcagt

SEQ ID NO: 9279460 - DNA, 22 bp, Homo sapiens
ttgaaatactgcattgttcagt

SEQ ID NO: 9279461 - DNA, 22 bp, Homo sapiens
ctcatctgtatatagtgaatga

SEQ ID NO: 9279462 - DNA, 22 bp, Homo sapiens
ctccaaaggataaaagcagagt

SEQ ID NO: 9279463 - DNA, 22 bp, Homo sapiens
ctcatttatgtaatgattaagg

SEQ ID NO: 9279464 - DNA, 22 bp, Homo sapiens
ttcttttcccaatattttgctg

SEQ ID NO: 9279465 - DNA, 22 bp, Homo sapiens
ttcttttcctgtggctcatcca

SEQ ID NO: 9279466 - DNA, 22 bp, Homo sapiens
ttcttttcctacacagcgattt

SEQ ID NO: 9279467 - DNA, 22 bp, Homo sapiens
ttcttttcctacacagcgattt

SEQ ID NO: 9279468 - DNA, 23 bp, Homo sapiens
ttgaaaggtagctggcagctaga

SEQ ID NO: 9279469 - DNA, 23 bp, Homo sapiens
ttgaaaggtagctggcagctaga

SEQ ID NO: 9279470 - DNA, 22 bp, Homo sapiens
ttgaaaggtgctgtgtgctgat

SEQ ID NO: 9279471 - DNA, 22 bp, Homo sapiens
ttgaaaggtgctgtgtgctgat

SEQ ID NO: 9279472 - DNA, 22 bp, Homo sapiens
ttgaaaggtgaacatgatgcac

SEQ ID NO: 9279473 - DNA, 22 bp, Homo sapiens
ttgaaaggtgacattgttagag

SEQ ID NO: 9279474 - DNA, 22 bp, Homo sapiens
ttctttcttagcaatctatggt

SEQ ID NO: 9279475 - DNA, 22 bp, Homo sapiens
ttctttcttagcaatctatggt

SEQ ID NO: 9279476 - DNA, 22 bp, Homo sapiens
ttcttttagtcattcagggaag

SEQ ID NO: 9279477 - DNA, 22 bp, Homo sapiens
ttcttttacattaagatttcag

SEQ ID NO: 9279478 - DNA, 22 bp, Homo sapiens
ttcttttacattaagatttcag

SEQ ID NO: 9279479 - DNA, 22 bp, Homo sapiens
ttcttttacattaagatttcag

SEQ ID NO: 9279480 - DNA, 22 bp, Homo sapiens
ttgtggggcaacagcaggtgaa

SEQ ID NO: 9279481 - DNA, 22 bp, Homo sapiens
ttgtggggaggatttgatgaga

SEQ ID NO: 9279482 - DNA, 22 bp, Homo sapiens
ttgtgggcttgcctggctcttg

SEQ ID NO: 9279483 - DNA, 22 bp, Homo sapiens
ttgtgaaatcgtgtttggaagc

SEQ ID NO: 9279484 - DNA, 22 bp, Homo sapiens
ttgtgaaaagccgcaagtatag

SEQ ID NO: 9279485 - DNA, 22 bp, Homo sapiens
ttgtgtaaatgtctgtctttct

SEQ ID NO: 9279486 - DNA, 22 bp, Homo sapiens
ttgtgtaatgaagttatcatgt

SEQ ID NO: 9279487 - DNA, 22 bp, Homo sapiens
ctccatggggaaatgaaggtgg

SEQ ID NO: 9279488 - DNA, 22 bp, Homo sapiens
ctccatggaaccggggctgctt

SEQ ID NO: 9279489 - DNA, 22 bp, Homo sapiens
ctccagccagagtgcctctgtt

SEQ ID NO: 9279490 - DNA, 22 bp, Homo sapiens
ctccagcagaaagggcgagtgg

SEQ ID NO: 9279491 - DNA, 22 bp, Homo sapiens
ctccagccagagtgcctctgtt

SEQ ID NO: 9279492 - DNA, 22 bp, Homo sapiens
ctccagcctcagatgacggtac

SEQ ID NO: 9279493 - DNA, 22 bp, Homo sapiens
ttgtctgtccaggcaccccaag

SEQ ID NO: 9279494 - DNA, 22 bp, Homo sapiens
ttgtcttttgtgggaaatatgg

SEQ ID NO: 9279495 - DNA, 22 bp, Homo sapiens
ttgtcttttgtgggaaatatgg

SEQ ID NO: 9279496 - DNA, 19 bp, Homo sapiens
ttgtcttagctgcataaga

SEQ ID NO: 9279497 - DNA, 22 bp, Homo sapiens
ttgtcttaaatggatggacaat

SEQ ID NO: 9279498 - DNA, 22 bp, Homo sapiens
ttgtctgtcccagcttgtgcat

SEQ ID NO: 9279499 - DNA, 22 bp, Homo sapiens
ttgtctgtgaaatggaaatagt

SEQ ID NO: 9279500 - DNA, 23 bp, Homo sapiens
ttgtctgtgcttttccagttgct

SEQ ID NO: 9279501 - DNA, 22 bp, Homo sapiens
ctcccagccttcgccagtctga

SEQ ID NO: 9279502 - DNA, 22 bp, Homo sapiens
ctcccagccttcgccagtctga

SEQ ID NO: 9279503 - DNA, 22 bp, Homo sapiens
ctcccagattcctgctgtggga

SEQ ID NO: 9279504 - DNA, 22 bp, Homo sapiens
ctcccagagaccaagctgagaa

SEQ ID NO: 9279505 - DNA, 22 bp, Homo sapiens
ctcccagacatgtgcctccttg

SEQ ID NO: 9279506 - DNA, 22 bp, Homo sapiens
ctcccactcctggctcaccaca

SEQ ID NO: 9279507 - DNA, 22 bp, Homo sapiens
ctcccactcctggctcaccaca

SEQ ID NO: 9279508 - DNA, 22 bp, Homo sapiens
ctcccagaaaattctcagacaa

SEQ ID NO: 9279509 - DNA, 22 bp, Homo sapiens
ctcccaaggggtaagggagctg

SEQ ID NO: 9279510 - DNA, 22 bp, Homo sapiens
tttaatatccagtggatacaaa

SEQ ID NO: 9279511 - DNA, 22 bp, Homo sapiens
tttaatagggcccaatgagact

SEQ ID NO: 9279512 - DNA, 22 bp, Homo sapiens
tttaatatccagtggatacaaa

SEQ ID NO: 9279513 - DNA, 22 bp, Homo sapiens
tttaatatccagtggatacaaa

SEQ ID NO: 9279514 - DNA, 22 bp, Homo sapiens
tttaatatttctttcctgaagc

SEQ ID NO: 9279515 - DNA, 22 bp, Homo sapiens
ctcccaggcacagggaggagcc

SEQ ID NO: 9279516 - DNA, 22 bp, Homo sapiens
ctcccaggcacagggaggagcc

SEQ ID NO: 9279517 - DNA, 22 bp, Homo sapiens
ctcccaggcagggctgcccact

SEQ ID NO: 9279518 - DNA, 22 bp, Homo sapiens
ctcccaggccatgctctagcca

SEQ ID NO: 9279519 - DNA, 17 bp, Homo sapiens
ctcctggccacccctct

SEQ ID NO: 9279520 - DNA, 22 bp, Homo sapiens
ctcctggcagttccccttgtca

SEQ ID NO: 9279521 - DNA, 22 bp, Homo sapiens
ctcctggccacgttcttgctgg

SEQ ID NO: 9279522 - DNA, 22 bp, Homo sapiens
ctcctggccccagatcccaatc

SEQ ID NO: 9279523 - DNA, 22 bp, Homo sapiens
ctcctggcaggctgagtgaaat

SEQ ID NO: 9279524 - DNA, 22 bp, Homo sapiens
ctcctggcactgtcttgaccca

SEQ ID NO: 9279525 - DNA, 17 bp, Homo sapiens
ctcctggcagcctcagg

SEQ ID NO: 9279526 - DNA, 22 bp, Homo sapiens
ctcctggcactcagtgtggaag

SEQ ID NO: 9279527 - DNA, 22 bp, Homo sapiens
tttatttaaagtcgtgtgttaa

SEQ ID NO: 9279528 - DNA, 22 bp, Homo sapiens
tttatttaaagtcgtgtgttaa

SEQ ID NO: 9279529 - DNA, 22 bp, Homo sapiens
ctcctccagtgggtccctcagg

SEQ ID NO: 9279530 - DNA, 18 bp, Homo sapiens
ctcctccacagcccctgc

SEQ ID NO: 9279531 - DNA, 22 bp, Homo sapiens
ctcctccagctctccctggggg

SEQ ID NO: 9279532 - DNA, 22 bp, Homo sapiens
tttattccatgtgtctatgacc

SEQ ID NO: 9279533 - DNA, 22 bp, Homo sapiens
tttattgttatcatgggtgagt

SEQ ID NO: 9279534 - DNA, 22 bp, Homo sapiens
tttattgttgggtcttaagctg

SEQ ID NO: 9279535 - DNA, 22 bp, Homo sapiens
tttattgttgttagtcataagt

SEQ ID NO: 9279536 - DNA, 22 bp, Homo sapiens
tttattgttgttagtcataagt

SEQ ID NO: 9279537 - DNA, 22 bp, Homo sapiens
tttattgttgttagtcataagt

SEQ ID NO: 9279538 - DNA, 22 bp, Homo sapiens
tttattgttgggtcttaagctg

SEQ ID NO: 9279539 - DNA, 22 bp, Homo sapiens
tttattgttgttagtcataagt

SEQ ID NO: 9279540 - DNA, 22 bp, Homo sapiens
tttattgttgttagtcataagt

SEQ ID NO: 9279541 - DNA, 22 bp, Homo sapiens
tttattgtttagaagggggctg

SEQ ID NO: 9279542 - DNA, 22 bp, Homo sapiens
tttagtgcctgggccagttcca

SEQ ID NO: 9279543 - DNA, 22 bp, Homo sapiens
ctcctccacagagtccttgcca

SEQ ID NO: 9279544 - DNA, 22 bp, Homo sapiens
tttagtgagtgtgaatcaaatg

SEQ ID NO: 9279545 - DNA, 22 bp, Homo sapiens
tttagtgattcatttagaaaaa

SEQ ID NO: 9279546 - DNA, 22 bp, Homo sapiens
tttagtgataagaattatgaaa

SEQ ID NO: 9279547 - DNA, 22 bp, Homo sapiens
tttagtagaaatatttgggcct

SEQ ID NO: 9279548 - DNA, 18 bp, Homo sapiens
ctcccctgttttccctgc

SEQ ID NO: 9279549 - DNA, 22 bp, Homo sapiens
ctcccgtggatgttcttcagtc

SEQ ID NO: 9279550 - DNA, 22 bp, Homo sapiens
tttagactaattcctaaagggc

SEQ ID NO: 9279551 - DNA, 23 bp, Homo sapiens
ctccccagtgtcctcatgcatct

SEQ ID NO: 9279552 - DNA, 22 bp, Homo sapiens
tttaatctattccctaaacacc

SEQ ID NO: 9279553 - DNA, 23 bp, Homo sapiens
ctccccagtgtcctcatgcatct

SEQ ID NO: 9279554 - DNA, 23 bp, Homo sapiens
ctccccagtgtcctcatgcatct

SEQ ID NO: 9279555 - DNA, 22 bp, Homo sapiens
ctccccatggcaacagttatgg

SEQ ID NO: 9279556 - DNA, 22 bp, Homo sapiens
ctccccattatgcagtcattat

SEQ ID NO: 9279557 - DNA, 22 bp, Homo sapiens
ctccccattgtgacctcatcca

SEQ ID NO: 9279558 - DNA, 22 bp, Homo sapiens
ctcccctccttaggtcttctag

SEQ ID NO: 9279559 - DNA, 22 bp, Homo sapiens
ctcctggccctgagctcccagg

SEQ ID NO: 9279560 - DNA, 22 bp, Homo sapiens
ctcctggccctgagctcccagg

SEQ ID NO: 9279561 - DNA, 22 bp, Homo sapiens
tttcaattaggatgtttccatg

SEQ ID NO: 9279562 - DNA, 22 bp, Homo sapiens
tttcaatgtaacatttccaggc

SEQ ID NO: 9279563 - DNA, 22 bp, Homo sapiens
tttcaattccaccaaagcgccc

SEQ ID NO: 9279564 - DNA, 22 bp, Homo sapiens
tttcaattgactttggaagaaa

SEQ ID NO: 9279565 - DNA, 22 bp, Homo sapiens
tttcaattccaccaaagcgccc

SEQ ID NO: 9279566 - DNA, 22 bp, Homo sapiens
tttcaattaggatgtttccatg

SEQ ID NO: 9279567 - DNA, 22 bp, Homo sapiens
tttcaatttccaggctagaatt

SEQ ID NO: 9279568 - DNA, 22 bp, Homo sapiens
tttcaattgactttggaagaaa

SEQ ID NO: 9279569 - DNA, 22 bp, Homo sapiens
tttcaatttccaggctagaatt

SEQ ID NO: 9279570 - DNA, 21 bp, Homo sapiens
tttcaatttgccttgagtcat

SEQ ID NO: 9279571 - DNA, 22 bp, Homo sapiens
tttcaatttccaggctagaatt

SEQ ID NO: 9279572 - DNA, 21 bp, Homo sapiens
tttcaatttgccttgagtcat

SEQ ID NO: 9279573 - DNA, 21 bp, Homo sapiens
tttcaatttgccttgagtcat

SEQ ID NO: 9279574 - DNA, 22 bp, Homo sapiens
tttcacaaactgaggagacaat

SEQ ID NO: 9279575 - DNA, 21 bp, Homo sapiens
tttcacaaaagtatgtgacaa

SEQ ID NO: 9279576 - DNA, 22 bp, Homo sapiens
tttcacatagaaagtgatttac

SEQ ID NO: 9279577 - DNA, 22 bp, Homo sapiens
tttcacataaatattatgccta

SEQ ID NO: 9279578 - DNA, 22 bp, Homo sapiens
tttcctaatcccaatgacattt

SEQ ID NO: 9279579 - DNA, 22 bp, Homo sapiens
tttcctacccttccaggcagag

SEQ ID NO: 9279580 - DNA, 20 bp, Homo sapiens
tttcctaagtggtttgctga

SEQ ID NO: 9279581 - DNA, 22 bp, Homo sapiens
tttcctaatcccaatgacattt

SEQ ID NO: 9279582 - DNA, 22 bp, Homo sapiens
tttcctaaggtagtgataattt

SEQ ID NO: 9279583 - DNA, 22 bp, Homo sapiens
tttcctaagggatgcggctcaa

SEQ ID NO: 9279584 - DNA, 20 bp, Homo sapiens
tttccactgtaatgtatgat

SEQ ID NO: 9279585 - DNA, 20 bp, Homo sapiens
tttccactgtaatgtatgat

SEQ ID NO: 9279586 - DNA, 22 bp, Homo sapiens
tttcctaacacaatgcatgaga

SEQ ID NO: 9279587 - DNA, 22 bp, Homo sapiens
tttcctaaggctcattttaaaa

SEQ ID NO: 9279588 - DNA, 22 bp, Homo sapiens
tttcctaacacaatgcatgaga

SEQ ID NO: 9279589 - DNA, 22 bp, Homo sapiens
tttcctaactcatcggatgtac

SEQ ID NO: 9279590 - DNA, 22 bp, Homo sapiens
tttcctaagatagatacttcag

SEQ ID NO: 9279591 - DNA, 22 bp, Homo sapiens
tttcctaagatagatacttcag

SEQ ID NO: 9279592 - DNA, 22 bp, Homo sapiens
tttccttgggtctcttagtggc

SEQ ID NO: 9279593 - DNA, 22 bp, Homo sapiens
tttccttgcctcctgtccttct

SEQ ID NO: 9279594 - DNA, 22 bp, Homo sapiens
tttccttgcctcctgtccttct

SEQ ID NO: 9279595 - DNA, 18 bp, Homo sapiens
tttccttgtatgaacata

SEQ ID NO: 9279596 - DNA, 22 bp, Homo sapiens
tttccttgttattatttgtcct

SEQ ID NO: 9279597 - DNA, 22 bp, Homo sapiens
ctctctggaagggggagctgat

SEQ ID NO: 9279598 - DNA, 22 bp, Homo sapiens
ctctctgagtggctgtactttc

SEQ ID NO: 9279599 - DNA, 20 bp, Homo sapiens
ctctctctccattcccaggg

SEQ ID NO: 9279600 - DNA, 22 bp, Homo sapiens
ctctctcttgtgttgctgcaga

SEQ ID NO: 9279601 - DNA, 22 bp, Homo sapiens
ctctccaggctgggacaggacc

SEQ ID NO: 9279602 - DNA, 22 bp, Homo sapiens
tttcctcaactgtcaaatgggg

SEQ ID NO: 9279603 - DNA, 22 bp, Homo sapiens
tttcctcaactgtcaaatgggg

SEQ ID NO: 9279604 - DNA, 22 bp, Homo sapiens
ctctccaggggtagatgccttc

SEQ ID NO: 9279605 - DNA, 22 bp, Homo sapiens
ctctccaggggtagatgccttc

SEQ ID NO: 9279606 - DNA, 21 bp, Homo sapiens
ctctccaggtaggataaatgt

SEQ ID NO: 9279607 - DNA, 22 bp, Homo sapiens
ctctccagggcatgagttccac

SEQ ID NO: 9279608 - DNA, 22 bp, Homo sapiens
ctctccagtcatattctcagtc

SEQ ID NO: 9279609 - DNA, 22 bp, Homo sapiens
ctctccagtcaggaactctgac

SEQ ID NO: 9279610 - DNA, 22 bp, Homo sapiens
gacagggtacgggctaggcaca

SEQ ID NO: 9279611 - DNA, 22 bp, Homo sapiens
gacagggtccaaaggcagggga

SEQ ID NO: 9279612 - DNA, 22 bp, Homo sapiens
gacagggtccaaaggcagggga

SEQ ID NO: 9279613 - DNA, 22 bp, Homo sapiens
gacagggtccaaaggcagggga

SEQ ID NO: 9279614 - DNA, 22 bp, Homo sapiens
gacaggtaccggtcagactacg

SEQ ID NO: 9279615 - DNA, 22 bp, Homo sapiens
gacaggtgaaacagcaaggtaa

SEQ ID NO: 9279616 - DNA, 21 bp, Homo sapiens
gacaggtgattcagagcaggg

SEQ ID NO: 9279617 - DNA, 22 bp, Homo sapiens
gacaggtgggttctcgtatctg

SEQ ID NO: 9279618 - DNA, 22 bp, Homo sapiens
gacaggtgctaagggacctggc

SEQ ID NO: 9279619 - DNA, 22 bp, Homo sapiens
gacaggtgctaagggacctggc

SEQ ID NO: 9279620 - DNA, 22 bp, Homo sapiens
gacaggtggggaaactaaggta

SEQ ID NO: 9279621 - DNA, 22 bp, Homo sapiens
gacaggtggggaaactaaggta

SEQ ID NO: 9279622 - DNA, 22 bp, Homo sapiens
gaccctggtgggcactggcacc

SEQ ID NO: 9279623 - DNA, 22 bp, Homo sapiens
gaccctgtttctacaaataatt

SEQ ID NO: 9279624 - DNA, 22 bp, Homo sapiens
gaccctggctggagctggcctg

SEQ ID NO: 9279625 - DNA, 22 bp, Homo sapiens
gaccctggctggagctggcctg

SEQ ID NO: 9279626 - DNA, 22 bp, Homo sapiens
gacctcagctgtggggatgctg

SEQ ID NO: 9279627 - DNA, 22 bp, Homo sapiens
gaccctgtttctacaaataatt

SEQ ID NO: 9279628 - DNA, 22 bp, Homo sapiens
gacccttagaatgtgatcttat

SEQ ID NO: 9279629 - DNA, 22 bp, Homo sapiens
gaccctggcaggtagcctcaca

SEQ ID NO: 9279630 - DNA, 22 bp, Homo sapiens
gaccctggctgccgcggtctgg

SEQ ID NO: 9279631 - DNA, 22 bp, Homo sapiens
gacagtcccccagcagcaaacc

SEQ ID NO: 9279632 - DNA, 22 bp, Homo sapiens
gacccagtgactcgtctctgtg

SEQ ID NO: 9279633 - DNA, 22 bp, Homo sapiens
gacagtatccaggtggtgaaga

SEQ ID NO: 9279634 - DNA, 22 bp, Homo sapiens
gacaggcttcatcctcagagtt

SEQ ID NO: 9279635 - DNA, 22 bp, Homo sapiens
gacaggcttagggagggtgctc

SEQ ID NO: 9279636 - DNA, 22 bp, Homo sapiens
gacaggcttcatcctcagagtt

SEQ ID NO: 9279637 - DNA, 22 bp, Homo sapiens
gacaggcttcatgatggcagga

SEQ ID NO: 9279638 - DNA, 17 bp, Homo sapiens
gacaggctcagtgacga

SEQ ID NO: 9279639 - DNA, 22 bp, Homo sapiens
gacaggcttagggagggtgctc

SEQ ID NO: 9279640 - DNA, 22 bp, Homo sapiens
gacaggctgtgatggccgggag

SEQ ID NO: 9279641 - DNA, 22 bp, Homo sapiens
gacagggaaacattgaagtgtc

SEQ ID NO: 9279642 - DNA, 22 bp, Homo sapiens
gacaggctttgagtcccagaac

SEQ ID NO: 9279643 - DNA, 22 bp, Homo sapiens
gacaggcttcctaagtgccaga

SEQ ID NO: 9279644 - DNA, 22 bp, Homo sapiens
gacaggcttcctaagtgccaga

SEQ ID NO: 9279645 - DNA, 22 bp, Homo sapiens
gacaggcttccactatgttgcc

SEQ ID NO: 9279646 - DNA, 22 bp, Homo sapiens
gacaggcttcatgatggcagga

SEQ ID NO: 9279647 - DNA, 22 bp, Homo sapiens
gacaggcttcctaagtgccaga

SEQ ID NO: 9279648 - DNA, 22 bp, Homo sapiens
gacaggcttcctaagtgccaga

SEQ ID NO: 9279649 - DNA, 23 bp, Homo sapiens
gacagggctgacttggcagctgc

SEQ ID NO: 9279650 - DNA, 22 bp, Homo sapiens
gacagggacacagccagtgagg

SEQ ID NO: 9279651 - DNA, 22 bp, Homo sapiens
gacagggctgtgggaggagcag

SEQ ID NO: 9279652 - DNA, 21 bp, Homo sapiens
gacaggggaagaagcaaggag

SEQ ID NO: 9279653 - DNA, 22 bp, Homo sapiens
gacaggggtccctctgggctgt

SEQ ID NO: 9279654 - DNA, 22 bp, Homo sapiens
gacaggggctttgcatgcttta

SEQ ID NO: 9279655 - DNA, 21 bp, Homo sapiens
gacaggggccatgggtttcta

SEQ ID NO: 9279656 - DNA, 21 bp, Homo sapiens
gacaggggaagaagcaaggag

SEQ ID NO: 9279657 - DNA, 22 bp, Homo sapiens
gacacagaccaccaggccctgg

SEQ ID NO: 9279658 - DNA, 22 bp, Homo sapiens
gacacagagataggcctgtgtt

SEQ ID NO: 9279659 - DNA, 22 bp, Homo sapiens
gacaggcctagattcactgctg

SEQ ID NO: 9279660 - DNA, 17 bp, Homo sapiens
gacaggctcagtgacga

SEQ ID NO: 9279661 - DNA, 22 bp, Homo sapiens
gacaggcccgagtagctgatga

SEQ ID NO: 9279662 - DNA, 22 bp, Homo sapiens
gacacagagataggcctgtgtt

SEQ ID NO: 9279663 - DNA, 22 bp, Homo sapiens
gacaggccagacaggagactga

SEQ ID NO: 9279664 - DNA, 22 bp, Homo sapiens
gacaggccaggggctgaggtgg

SEQ ID NO: 9279665 - DNA, 22 bp, Homo sapiens
gacacagaaggtcacatgttca

SEQ ID NO: 9279666 - DNA, 22 bp, Homo sapiens
gacaataaaatgatcttacagt

SEQ ID NO: 9279667 - DNA, 22 bp, Homo sapiens
gacaagtgctgatttatctccc

SEQ ID NO: 9279668 - DNA, 16 bp, Homo sapiens
gacaagtggaggggcc

SEQ ID NO: 9279669 - DNA, 22 bp, Homo sapiens
gaatacatgtgtgtatagaggt

SEQ ID NO: 9279670 - DNA, 22 bp, Homo sapiens
gaatacattggaaatcagaata

SEQ ID NO: 9279671 - DNA, 22 bp, Homo sapiens
gaatacattggaaatcagaata

SEQ ID NO: 9279672 - DNA, 22 bp, Homo sapiens
gaatacattggaaatcagaata

SEQ ID NO: 9279673 - DNA, 22 bp, Homo sapiens
gaatacttttgttaggaaaacg

SEQ ID NO: 9279674 - DNA, 18 bp, Homo sapiens
gaatactgagagcacaaa

SEQ ID NO: 9279675 - DNA, 22 bp, Homo sapiens
gaatatattattcagcttttca

SEQ ID NO: 9279676 - DNA, 22 bp, Homo sapiens
gaatatattggtgaaaatagtt

SEQ ID NO: 9279677 - DNA, 22 bp, Homo sapiens
gaatatattggtgaaaatagtt

SEQ ID NO: 9279678 - DNA, 22 bp, Homo sapiens
gaatacttttgttaggaaaacg

SEQ ID NO: 9279679 - DNA, 22 bp, Homo sapiens
gaatagatcctcatttattgat

SEQ ID NO: 9279680 - DNA, 22 bp, Homo sapiens
gaatagataagtgactatttgg

SEQ ID NO: 9279681 - DNA, 22 bp, Homo sapiens
gaatagatgaaagtgtctctta

SEQ ID NO: 9279682 - DNA, 22 bp, Homo sapiens
gaatatcccgctatgcaaagta

SEQ ID NO: 9279683 - DNA, 22 bp, Homo sapiens
gaatatatttctcttaccttta

SEQ ID NO: 9279684 - DNA, 22 bp, Homo sapiens
gaatatatttctcttaccttta

SEQ ID NO: 9279685 - DNA, 22 bp, Homo sapiens
gaatatcccgctatgcaaagta

SEQ ID NO: 9279686 - DNA, 22 bp, Homo sapiens
gacaactgagcagaggaaatga

SEQ ID NO: 9279687 - DNA, 22 bp, Homo sapiens
gaatatctgtctggttgaggaa

SEQ ID NO: 9279688 - DNA, 22 bp, Homo sapiens
gaatatcttgtacatctaagta

SEQ ID NO: 9279689 - DNA, 22 bp, Homo sapiens
gacaagattaaccatagttaag

SEQ ID NO: 9279690 - DNA, 22 bp, Homo sapiens
gacaagatgagcagctcagtgt

SEQ ID NO: 9279691 - DNA, 22 bp, Homo sapiens
gacaagataatgaagtgcaatt

SEQ ID NO: 9279692 - DNA, 22 bp, Homo sapiens
gacaagatttagagtctgctaa

SEQ ID NO: 9279693 - DNA, 22 bp, Homo sapiens
gacaactgccccattttaaatg

SEQ ID NO: 9279694 - DNA, 22 bp, Homo sapiens
gaatacatgatacatgaactgc

SEQ ID NO: 9279695 - DNA, 22 bp, Homo sapiens
gaatacaagcctgccacctgga

SEQ ID NO: 9279696 - DNA, 22 bp, Homo sapiens
gaatacacgaaggcaagagtcc

SEQ ID NO: 9279697 - DNA, 22 bp, Homo sapiens
gaagtttatttcaatctattca

SEQ ID NO: 9279698 - DNA, 22 bp, Homo sapiens
gaagtttagagtgttgtaattt

SEQ ID NO: 9279699 - DNA, 22 bp, Homo sapiens
gaagtttaggttcttatgttta

SEQ ID NO: 9279700 - DNA, 22 bp, Homo sapiens
gaagttttagtcaaaatgtaga

SEQ ID NO: 9279701 - DNA, 22 bp, Homo sapiens
gaagtttttgtagagacagggt

SEQ ID NO: 9279702 - DNA, 22 bp, Homo sapiens
gaagttttctgaggctgtagct

SEQ ID NO: 9279703 - DNA, 22 bp, Homo sapiens
gaataacattggaaccctgaag

SEQ ID NO: 9279704 - DNA, 22 bp, Homo sapiens
gaataacagcaagtttgcaggc

SEQ ID NO: 9279705 - DNA, 22 bp, Homo sapiens
gaataacattttttcctttaca

SEQ ID NO: 9279706 - DNA, 22 bp, Homo sapiens
gaagcttaattatgaccagctg

SEQ ID NO: 9279707 - DNA, 22 bp, Homo sapiens
gaagcttcgtggctcttcaaat

SEQ ID NO: 9279708 - DNA, 22 bp, Homo sapiens
gaaggaaaacagatctgcctga

SEQ ID NO: 9279709 - DNA, 22 bp, Homo sapiens
gaaggaaaaatactctgtaagg

SEQ ID NO: 9279710 - DNA, 22 bp, Homo sapiens
gaagtttagaagtgacaggttt

SEQ ID NO: 9279711 - DNA, 22 bp, Homo sapiens
gaagttgatagagtacatgatt

SEQ ID NO: 9279712 - DNA, 18 bp, Homo sapiens
ctttcagtaatttcagcc

SEQ ID NO: 9279713 - DNA, 22 bp, Homo sapiens
ctttcagggcaacacttctttt

SEQ ID NO: 9279714 - DNA, 22 bp, Homo sapiens
ctttcagaagaggacctttcca

SEQ ID NO: 9279715 - DNA, 22 bp, Homo sapiens
ctttcacaagatttgagatgct

SEQ ID NO: 9279716 - DNA, 22 bp, Homo sapiens
ctttccaactctagtgaaattt

SEQ ID NO: 9279717 - DNA, 22 bp, Homo sapiens
ctttcatttgataagaatgcca

SEQ ID NO: 9279718 - DNA, 23 bp, Homo sapiens
ctttcattgtggtttcacagagc

SEQ ID NO: 9279719 - DNA, 22 bp, Homo sapiens
ctttcattcttagatattagtg

SEQ ID NO: 9279720 - DNA, 22 bp, Homo sapiens
ctttcattcttagatattagtg

SEQ ID NO: 9279721 - DNA, 22 bp, Homo sapiens
ctttcattcttagatattagtg

SEQ ID NO: 9279722 - DNA, 20 bp, Homo sapiens
gaaatcagttaatgatggtt

SEQ ID NO: 9279723 - DNA, 22 bp, Homo sapiens
gaaatcaaggctacattcaggt

SEQ ID NO: 9279724 - DNA, 22 bp, Homo sapiens
gaaatatttctcttgagcccct

SEQ ID NO: 9279725 - DNA, 22 bp, Homo sapiens
gaaatatttctcttgagcccct

SEQ ID NO: 9279726 - DNA, 22 bp, Homo sapiens
gaaatatttctcttgagcccct

SEQ ID NO: 9279727 - DNA, 22 bp, Homo sapiens
gaaatatttctcttgagcccct

SEQ ID NO: 9279728 - DNA, 17 bp, Homo sapiens
gaacagtgtaagacact

SEQ ID NO: 9279729 - DNA, 22 bp, Homo sapiens
gaacatttggatttgtaaattt

SEQ ID NO: 9279730 - DNA, 22 bp, Homo sapiens
gaacagtgccagcacacaataa

SEQ ID NO: 9279731 - DNA, 20 bp, Homo sapiens
gaacagtcttctgagccaca

SEQ ID NO: 9279732 - DNA, 22 bp, Homo sapiens
gaacagtatttccaggaatccc

SEQ ID NO: 9279733 - DNA, 22 bp, Homo sapiens
gaacagctgctagagatctgtg

SEQ ID NO: 9279734 - DNA, 22 bp, Homo sapiens
gaacagctgctagagatctgtg

SEQ ID NO: 9279735 - DNA, 22 bp, Homo sapiens
gaacagcttcttgggagctggg

SEQ ID NO: 9279736 - DNA, 22 bp, Homo sapiens
gaacagctataatcatctgtcc

SEQ ID NO: 9279737 - DNA, 22 bp, Homo sapiens
gaacagctctgaagcagtaaat

SEQ ID NO: 9279738 - DNA, 22 bp, Homo sapiens
gaacagcttcttgggagctggg

SEQ ID NO: 9279739 - DNA, 21 bp, Homo sapiens
gaacaggaaaagctggcttca

SEQ ID NO: 9279740 - DNA, 22 bp, Homo sapiens
gaacaggcataagcatttgcat

SEQ ID NO: 9279741 - DNA, 22 bp, Homo sapiens
gaaatgattttagtttatcatg

SEQ ID NO: 9279742 - DNA, 22 bp, Homo sapiens
gaaatgattttagtttatcatg

SEQ ID NO: 9279743 - DNA, 22 bp, Homo sapiens
gaaatgtactttaaagccatcc

SEQ ID NO: 9279744 - DNA, 20 bp, Homo sapiens
gaaatgtacacattaccaca

SEQ ID NO: 9279745 - DNA, 22 bp, Homo sapiens
gaacagcagcttcctgggaatt

SEQ ID NO: 9279746 - DNA, 22 bp, Homo sapiens
gaaatgcatggatcttggcaga

SEQ ID NO: 9279747 - DNA, 22 bp, Homo sapiens
gaagatgggaatgatgagtggg

SEQ ID NO: 9279748 - DNA, 22 bp, Homo sapiens
gaagatacacagagctgtcttt

SEQ ID NO: 9279749 - DNA, 22 bp, Homo sapiens
gaagataattcctacttataac

SEQ ID NO: 9279750 - DNA, 22 bp, Homo sapiens
gaagataattcctacttataac

SEQ ID NO: 9279751 - DNA, 22 bp, Homo sapiens
gaagaggtagcattggcaggtg

SEQ ID NO: 9279752 - DNA, 22 bp, Homo sapiens
gaagataactttaaaaagtggc

SEQ ID NO: 9279753 - DNA, 22 bp, Homo sapiens
gaagaggtagcattggcaggtg

SEQ ID NO: 9279754 - DNA, 22 bp, Homo sapiens
gaagataactttaaaaagtggc

SEQ ID NO: 9279755 - DNA, 22 bp, Homo sapiens
gaagataactttaaaaagtggc

SEQ ID NO: 9279756 - DNA, 22 bp, Homo sapiens
gaagaggttcaacgtggtcatc

SEQ ID NO: 9279757 - DNA, 22 bp, Homo sapiens
gaagagtggttatccctgctgt

SEQ ID NO: 9279758 - DNA, 22 bp, Homo sapiens
gaagatttataaggaccttatt

SEQ ID NO: 9279759 - DNA, 22 bp, Homo sapiens
gaagatttataggagcctatta

SEQ ID NO: 9279760 - DNA, 22 bp, Homo sapiens
gaagattgaaggctgggaatta

SEQ ID NO: 9279761 - DNA, 22 bp, Homo sapiens
gaagattacctgagaccacttg

SEQ ID NO: 9279762 - DNA, 22 bp, Homo sapiens
gaagattaaatggctcccatat

SEQ ID NO: 9279763 - DNA, 22 bp, Homo sapiens
gaagattaatgagaaacctgct

SEQ ID NO: 9279764 - DNA, 22 bp, Homo sapiens
gaagattaaatgaagtgacctg

SEQ ID NO: 9279765 - DNA, 20 bp, Homo sapiens
gaagatgggtagaggcacag

SEQ ID NO: 9279766 - DNA, 22 bp, Homo sapiens
gaagatgtgggaactgctgaaa

SEQ ID NO: 9279767 - DNA, 22 bp, Homo sapiens
gaagatgtgcaatacaaagaaa

SEQ ID NO: 9279768 - DNA, 22 bp, Homo sapiens
gaagccctatcctctcctggga

SEQ ID NO: 9279769 - DNA, 22 bp, Homo sapiens
gaagccccaaaccctcgccatc

SEQ ID NO: 9279770 - DNA, 22 bp, Homo sapiens
gaagcccatttgtacagcacat

SEQ ID NO: 9279771 - DNA, 22 bp, Homo sapiens
gaagccagtactgtgctctgca

SEQ ID NO: 9279772 - DNA, 22 bp, Homo sapiens
gaagccaggggcctgacaggca

SEQ ID NO: 9279773 - DNA, 22 bp, Homo sapiens
gaagccagtgtttgaagaattt

SEQ ID NO: 9279774 - DNA, 22 bp, Homo sapiens
gaagcccagcaaactgtgatca

SEQ ID NO: 9279775 - DNA, 22 bp, Homo sapiens
gaagatttggattccatgtcac

SEQ ID NO: 9279776 - DNA, 22 bp, Homo sapiens
gaagatttggattccatgtcac

SEQ ID NO: 9279777 - DNA, 22 bp, Homo sapiens
gaagattttctcctttaaatga

SEQ ID NO: 9279778 - DNA, 22 bp, Homo sapiens
gaagccagcagtggagaaagga

SEQ ID NO: 9279779 - DNA, 22 bp, Homo sapiens
gaagccagccttgtctgcctct

SEQ ID NO: 9279780 - DNA, 22 bp, Homo sapiens
gaagccaggggcctgacaggca

SEQ ID NO: 9279781 - DNA, 22 bp, Homo sapiens
gaagacattaagtctatgtcac

SEQ ID NO: 9279782 - DNA, 22 bp, Homo sapiens
gaagacatcatggagaggatag

SEQ ID NO: 9279783 - DNA, 22 bp, Homo sapiens
gaagacagaaacctgtttggct

SEQ ID NO: 9279784 - DNA, 21 bp, Homo sapiens
gaacatttgggttgtttctac

SEQ ID NO: 9279785 - DNA, 21 bp, Homo sapiens
gaacatttgggttgtttctac

SEQ ID NO: 9279786 - DNA, 22 bp, Homo sapiens
gaaccacaagattcaaaggggt

SEQ ID NO: 9279787 - DNA, 22 bp, Homo sapiens
gaaccacaagattcaaaggggt

SEQ ID NO: 9279788 - DNA, 22 bp, Homo sapiens
gaaccacaatgtgaagaaggag

SEQ ID NO: 9279789 - DNA, 22 bp, Homo sapiens
gaaccatgagaaattgctattt

SEQ ID NO: 9279790 - DNA, 22 bp, Homo sapiens
gaagacaattctgggtggagga

SEQ ID NO: 9279791 - DNA, 22 bp, Homo sapiens
gaagagctgcacactggggact

SEQ ID NO: 9279792 - DNA, 22 bp, Homo sapiens
gaagagctgcacactggggact

SEQ ID NO: 9279793 - DNA, 22 bp, Homo sapiens
gaagagctgcagtttcctgggc

SEQ ID NO: 9279794 - DNA, 22 bp, Homo sapiens
gaagagctatgtccagggagca

SEQ ID NO: 9279795 - DNA, 22 bp, Homo sapiens
gaagagctccaaaaacagtgag

SEQ ID NO: 9279796 - DNA, 22 bp, Homo sapiens
gaagagctccaaaaacagtgag

SEQ ID NO: 9279797 - DNA, 22 bp, Homo sapiens
gaagagctgtcagaaaagctaa

SEQ ID NO: 9279798 - DNA, 22 bp, Homo sapiens
gaagaggatgacaggagccggt

SEQ ID NO: 9279799 - DNA, 22 bp, Homo sapiens
gaagaggactgtggcatcctag

SEQ ID NO: 9279800 - DNA, 22 bp, Homo sapiens
gaagaggactgtggcatcctag

SEQ ID NO: 9279801 - DNA, 22 bp, Homo sapiens
gaagaggactgtggcatcctag

SEQ ID NO: 9279802 - DNA, 22 bp, Homo sapiens
gaagaggatgacaggagccggt

SEQ ID NO: 9279803 - DNA, 22 bp, Homo sapiens
gaagaggcaattgaataagcta

SEQ ID NO: 9279804 - DNA, 22 bp, Homo sapiens
gaagaggcaattgaataagcta

SEQ ID NO: 9279805 - DNA, 22 bp, Homo sapiens
gaagaggctttcctagggcaag

SEQ ID NO: 9279806 - DNA, 20 bp, Homo sapiens
gaggaaaagctgccaggcct

SEQ ID NO: 9279807 - DNA, 22 bp, Homo sapiens
gaggaaaataacaactaagggc

SEQ ID NO: 9279808 - DNA, 22 bp, Homo sapiens
gaggaaaataacaactaagggc

SEQ ID NO: 9279809 - DNA, 22 bp, Homo sapiens
gaggaaaataacaactaagggc

SEQ ID NO: 9279810 - DNA, 22 bp, Homo sapiens
gaggaaaatattcagggaggtt

SEQ ID NO: 9279811 - DNA, 22 bp, Homo sapiens
gaggaaaatattcagggaggtt

SEQ ID NO: 9279812 - DNA, 22 bp, Homo sapiens
gaggaaaatattcagggaggtt

SEQ ID NO: 9279813 - DNA, 22 bp, Homo sapiens
gaggaaaataacaactaagggc

SEQ ID NO: 9279814 - DNA, 22 bp, Homo sapiens
gaggagccctgttccccaggcc

SEQ ID NO: 9279815 - DNA, 22 bp, Homo sapiens
gaggaaaatattcagggaggtt

SEQ ID NO: 9279816 - DNA, 22 bp, Homo sapiens
gaggaaaatgcaacaggaatgc

SEQ ID NO: 9279817 - DNA, 22 bp, Homo sapiens
gaggagcttgaggctaggagcc

SEQ ID NO: 9279818 - DNA, 22 bp, Homo sapiens
gaggaggctaagtgggctctgg

SEQ ID NO: 9279819 - DNA, 22 bp, Homo sapiens
gaggaggctaagtgggctctgg

SEQ ID NO: 9279820 - DNA, 22 bp, Homo sapiens
gaggaggaagttctctgtaggc

SEQ ID NO: 9279821 - DNA, 22 bp, Homo sapiens
gaggaggaagttctctgtaggc

SEQ ID NO: 9279822 - DNA, 22 bp, Homo sapiens
gaggaggaggaagtggaaccca

SEQ ID NO: 9279823 - DNA, 19 bp, Homo sapiens
gaggaggaaaactagtgta

SEQ ID NO: 9279824 - DNA, 22 bp, Homo sapiens
gaggaggaagttctctgtaggc

SEQ ID NO: 9279825 - DNA, 22 bp, Homo sapiens
gaggaggaagttctctgtaggc

SEQ ID NO: 9279826 - DNA, 22 bp, Homo sapiens
gaggccagctagtccaggaagt

SEQ ID NO: 9279827 - DNA, 22 bp, Homo sapiens
gaggccagctagtccaggaagt

SEQ ID NO: 9279828 - DNA, 22 bp, Homo sapiens
gaggccagcgcgcagcactttt

SEQ ID NO: 9279829 - DNA, 22 bp, Homo sapiens
gaggccagctacccaagggtca

SEQ ID NO: 9279830 - DNA, 22 bp, Homo sapiens
gaggcagaggaaggtggtctct

SEQ ID NO: 9279831 - DNA, 22 bp, Homo sapiens
gaggccagcgcgcagcactttt

SEQ ID NO: 9279832 - DNA, 22 bp, Homo sapiens
gaggccagcgcgcagcactttt

SEQ ID NO: 9279833 - DNA, 22 bp, Homo sapiens
gaggccagcccctcttgaaggc

SEQ ID NO: 9279834 - DNA, 22 bp, Homo sapiens
gaggcagaagttgcagtgagca

SEQ ID NO: 9279835 - DNA, 22 bp, Homo sapiens
gaggcactgctgggcccctgta

SEQ ID NO: 9279836 - DNA, 22 bp, Homo sapiens
gaggcagagactccaccttcag

SEQ ID NO: 9279837 - DNA, 22 bp, Homo sapiens
gaggcagagaccttcaggacct

SEQ ID NO: 9279838 - DNA, 22 bp, Homo sapiens
gaggcagagactccaccttcag

SEQ ID NO: 9279839 - DNA, 22 bp, Homo sapiens
gaggcagaggaaggtggtctct

SEQ ID NO: 9279840 - DNA, 22 bp, Homo sapiens
gaggcaccagacatggcctcat

SEQ ID NO: 9279841 - DNA, 22 bp, Homo sapiens
gaggcaccagccccgctagcct

SEQ ID NO: 9279842 - DNA, 22 bp, Homo sapiens
gaggcacatcacttggtgcatt

SEQ ID NO: 9279843 - DNA, 22 bp, Homo sapiens
gaggcactgagagtgggggatg

SEQ ID NO: 9279844 - DNA, 22 bp, Homo sapiens
gaggcacctcgcgggaggaggc

SEQ ID NO: 9279845 - DNA, 22 bp, Homo sapiens
gaggcactgaatacttgagggt

SEQ ID NO: 9279846 - DNA, 22 bp, Homo sapiens
gaggcactctcgacaagggtgg

SEQ ID NO: 9279847 - DNA, 22 bp, Homo sapiens
gagctctgttctcgtcctgctg

SEQ ID NO: 9279848 - DNA, 22 bp, Homo sapiens
gagctctgtgtggcttgggtgg

SEQ ID NO: 9279849 - DNA, 22 bp, Homo sapiens
gagctagagtttgtagggtaga

SEQ ID NO: 9279850 - DNA, 22 bp, Homo sapiens
gagctactgaaatattgatttt

SEQ ID NO: 9279851 - DNA, 22 bp, Homo sapiens
gagctaggggtagtcaggagac

SEQ ID NO: 9279852 - DNA, 22 bp, Homo sapiens
gagctaggggtagtcaggagac

SEQ ID NO: 9279853 - DNA, 22 bp, Homo sapiens
gagctaggggtagtcaggagac

SEQ ID NO: 9279854 - DNA, 22 bp, Homo sapiens
gagcgggaggaacggctcgggc

SEQ ID NO: 9279855 - DNA, 22 bp, Homo sapiens
gagcctggagctggaacgaagc

SEQ ID NO: 9279856 - DNA, 22 bp, Homo sapiens
gagcctggattgaagtgggtgg

SEQ ID NO: 9279857 - DNA, 22 bp, Homo sapiens
gagcctggattgaagtgggtgg

SEQ ID NO: 9279858 - DNA, 22 bp, Homo sapiens
gagcctggacatctcaggccca

SEQ ID NO: 9279859 - DNA, 22 bp, Homo sapiens
gagcctggacatctcaggccca

SEQ ID NO: 9279860 - DNA, 22 bp, Homo sapiens
gagcctggagctggaacgaagc

SEQ ID NO: 9279861 - DNA, 22 bp, Homo sapiens
gagcctggacatctcaggccca

SEQ ID NO: 9279862 - DNA, 22 bp, Homo sapiens
gagcctcctcctggtgtgccga

SEQ ID NO: 9279863 - DNA, 22 bp, Homo sapiens
gagcctgatgaaacaggcagac

SEQ ID NO: 9279864 - DNA, 22 bp, Homo sapiens
gagcctcgtggcggccactgcg

SEQ ID NO: 9279865 - DNA, 22 bp, Homo sapiens
gagcctcgtggcggccactgcg

SEQ ID NO: 9279866 - DNA, 18 bp, Homo sapiens
gagctgagaagaggatgc

SEQ ID NO: 9279867 - DNA, 18 bp, Homo sapiens
gagctgagaagaggatgc

SEQ ID NO: 9279868 - DNA, 22 bp, Homo sapiens
gagctgaattgaagcaaggagc

SEQ ID NO: 9279869 - DNA, 22 bp, Homo sapiens
gagctgtgttcatgaggagaaa

SEQ ID NO: 9279870 - DNA, 19 bp, Homo sapiens
gagctgagagtagcactgg

SEQ ID NO: 9279871 - DNA, 22 bp, Homo sapiens
gagctgagacacactttggcaa

SEQ ID NO: 9279872 - DNA, 22 bp, Homo sapiens
gagctgagaagcagcgcttgat

SEQ ID NO: 9279873 - DNA, 22 bp, Homo sapiens
gagctgagaagcagcgcttgat

SEQ ID NO: 9279874 - DNA, 22 bp, Homo sapiens
gagctgaaatatgaagccaatt

SEQ ID NO: 9279875 - DNA, 22 bp, Homo sapiens
gagcttccatggacgccatctg

SEQ ID NO: 9279876 - DNA, 22 bp, Homo sapiens
gagcttccctctgcagtccctg

SEQ ID NO: 9279877 - DNA, 22 bp, Homo sapiens
gagcttccagagacatcagagt

SEQ ID NO: 9279878 - DNA, 22 bp, Homo sapiens
gagcttccatccttactgtgtg

SEQ ID NO: 9279879 - DNA, 22 bp, Homo sapiens
gagcttcacgggggacagcatt

SEQ ID NO: 9279880 - DNA, 22 bp, Homo sapiens
gagcttcagagaccacttaact

SEQ ID NO: 9279881 - DNA, 22 bp, Homo sapiens
gagcttcagaatttaacagact

SEQ ID NO: 9279882 - DNA, 22 bp, Homo sapiens
gagcttaggccagggacaggga

SEQ ID NO: 9279883 - DNA, 20 bp, Homo sapiens
gagcttcaactcagcaaaca

SEQ ID NO: 9279884 - DNA, 22 bp, Homo sapiens
gagcttcctttttctgcatgac

SEQ ID NO: 9279885 - DNA, 22 bp, Homo sapiens
gagcttcctgcaggtcactgtg

SEQ ID NO: 9279886 - DNA, 22 bp, Homo sapiens
gagcttcctcagcctttctcac

SEQ ID NO: 9279887 - DNA, 22 bp, Homo sapiens
gagcttccctctgcagtccctg

SEQ ID NO: 9279888 - DNA, 22 bp, Homo sapiens
gagcttcttgtttcttcatctg

SEQ ID NO: 9279889 - DNA, 22 bp, Homo sapiens
gagcttctcaacagttatctct

SEQ ID NO: 9279890 - DNA, 22 bp, Homo sapiens
gagcttttcccgtctttctcgt

SEQ ID NO: 9279891 - DNA, 22 bp, Homo sapiens
gagccagaaaagctgcctgact

SEQ ID NO: 9279892 - DNA, 22 bp, Homo sapiens
gagccagagatccaggatggct

SEQ ID NO: 9279893 - DNA, 22 bp, Homo sapiens
gagccaggggtcagctccgagg

SEQ ID NO: 9279894 - DNA, 22 bp, Homo sapiens
gagccaggggtcagctccgagg

SEQ ID NO: 9279895 - DNA, 22 bp, Homo sapiens
gagccaggggtcagctccgagg

SEQ ID NO: 9279896 - DNA, 22 bp, Homo sapiens
gagccaatctttgggctcttgg

SEQ ID NO: 9279897 - DNA, 22 bp, Homo sapiens
gagccaccttcaactcaggaat

SEQ ID NO: 9279898 - DNA, 22 bp, Homo sapiens
gagccacagtggtggcccacgt

SEQ ID NO: 9279899 - DNA, 22 bp, Homo sapiens
gagcagctgtccccaaagcttc

SEQ ID NO: 9279900 - DNA, 18 bp, Homo sapiens
gagcagaggctcaactgg

SEQ ID NO: 9279901 - DNA, 22 bp, Homo sapiens
gagcagatgtgtgccaggatgc

SEQ ID NO: 9279902 - DNA, 22 bp, Homo sapiens
gagcagcaggtggggctggctt

SEQ ID NO: 9279903 - DNA, 22 bp, Homo sapiens
gagatggagtctttttctgtca

SEQ ID NO: 9279904 - DNA, 22 bp, Homo sapiens
gagatggagtctttttctgtca

SEQ ID NO: 9279905 - DNA, 22 bp, Homo sapiens
gagatggagtctttttctgtca

SEQ ID NO: 9279906 - DNA, 21 bp, Homo sapiens
gagatgctttttattcaaccc

SEQ ID NO: 9279907 - DNA, 22 bp, Homo sapiens
gagatgcttttggtccaagagt

SEQ ID NO: 9279908 - DNA, 22 bp, Homo sapiens
gagatgcttgtctgtcttatca

SEQ ID NO: 9279909 - DNA, 20 bp, Homo sapiens
gagatggacagatgaagggg

SEQ ID NO: 9279910 - DNA, 22 bp, Homo sapiens
gagattggcctggcttgccaac

SEQ ID NO: 9279911 - DNA, 22 bp, Homo sapiens
gagattctgtagtcaggcatct

SEQ ID NO: 9279912 - DNA, 22 bp, Homo sapiens
gagattctgtagtcaggcatct

SEQ ID NO: 9279913 - DNA, 22 bp, Homo sapiens
gagattctgtagtcaggcatct

SEQ ID NO: 9279914 - DNA, 22 bp, Homo sapiens
gagattctttccagaactttga

SEQ ID NO: 9279915 - DNA, 22 bp, Homo sapiens
gagattagagttgtttcattgt

SEQ ID NO: 9279916 - DNA, 22 bp, Homo sapiens
gacctcagtgaatggtcatgta

SEQ ID NO: 9279917 - DNA, 22 bp, Homo sapiens
gacctcatgatccacctgcctt

SEQ ID NO: 9279918 - DNA, 22 bp, Homo sapiens
gacctcatgatccacctgcctt

SEQ ID NO: 9279919 - DNA, 22 bp, Homo sapiens
gacctcatgatccacctgcctt

SEQ ID NO: 9279920 - DNA, 22 bp, Homo sapiens
gacctcagctgtggggatgctg

SEQ ID NO: 9279921 - DNA, 22 bp, Homo sapiens
gacctcaggcttctgtaattaa

SEQ ID NO: 9279922 - DNA, 17 bp, Homo sapiens
gacctcaggtgatctgc

SEQ ID NO: 9279923 - DNA, 22 bp, Homo sapiens
gacctcaggtttgtaatggaca

SEQ ID NO: 9279924 - DNA, 22 bp, Homo sapiens
gacctcatgatccacctgcctt

SEQ ID NO: 9279925 - DNA, 22 bp, Homo sapiens
gacctcatgatccacctgcctt

SEQ ID NO: 9279926 - DNA, 22 bp, Homo sapiens
gacctccagcggccctgcagag

SEQ ID NO: 9279927 - DNA, 22 bp, Homo sapiens
gacctccgtgtacacctcccag

SEQ ID NO: 9279928 - DNA, 22 bp, Homo sapiens
gacctcgtgatccgccctcctt

SEQ ID NO: 9279929 - DNA, 22 bp, Homo sapiens
gacctcgtgatccgccctcctt

SEQ ID NO: 9279930 - DNA, 22 bp, Homo sapiens
gacctcgtgatccgcccgcttt

SEQ ID NO: 9279931 - DNA, 22 bp, Homo sapiens
gacctcgtgatctgccagcctt

SEQ ID NO: 9279932 - DNA, 22 bp, Homo sapiens
gagaaggagtagctgacctggg

SEQ ID NO: 9279933 - DNA, 22 bp, Homo sapiens
gagaaggatgaggaaatggtat

SEQ ID NO: 9279934 - DNA, 22 bp, Homo sapiens
gagaaggatgaggaaatggtat

SEQ ID NO: 9279935 - DNA, 22 bp, Homo sapiens
gagaaggatgtggctcatagct

SEQ ID NO: 9279936 - DNA, 22 bp, Homo sapiens
gagaaggaggcgaagcgtgtgc

SEQ ID NO: 9279937 - DNA, 22 bp, Homo sapiens
gagaaggagctcaaatatggct

SEQ ID NO: 9279938 - DNA, 22 bp, Homo sapiens
gacctcttgcaccctggctctt

SEQ ID NO: 9279939 - DNA, 22 bp, Homo sapiens
gacctcgtgatctgccggcctt

SEQ ID NO: 9279940 - DNA, 22 bp, Homo sapiens
gagaaggactacacatctggcc

SEQ ID NO: 9279941 - DNA, 22 bp, Homo sapiens
gagaaggactacacatctggcc

SEQ ID NO: 9279942 - DNA, 22 bp, Homo sapiens
gagaaggctgatccttggagtt

SEQ ID NO: 9279943 - DNA, 22 bp, Homo sapiens
gagaaggatgtggctcatagct

SEQ ID NO: 9279944 - DNA, 22 bp, Homo sapiens
gagaaggctggtcttaagtcga

SEQ ID NO: 9279945 - DNA, 22 bp, Homo sapiens
gagaaggctgatccttggagtt

SEQ ID NO: 9279946 - DNA, 22 bp, Homo sapiens
gagaagggatatgccactctcg

SEQ ID NO: 9279947 - DNA, 22 bp, Homo sapiens
gagaagggcttgggagtcaaca

SEQ ID NO: 9279948 - DNA, 22 bp, Homo sapiens
gagaattttctagtagtttcat

SEQ ID NO: 9279949 - DNA, 22 bp, Homo sapiens
gagaatttcccagtctgtgctg

SEQ ID NO: 9279950 - DNA, 22 bp, Homo sapiens
gagaatttgctggcttcattgt

SEQ ID NO: 9279951 - DNA, 22 bp, Homo sapiens
gagaatttgctggcttcattgt

SEQ ID NO: 9279952 - DNA, 22 bp, Homo sapiens
gagaattttctagtagtttcat

SEQ ID NO: 9279953 - DNA, 22 bp, Homo sapiens
gagaatttcccagtctgtgctg

SEQ ID NO: 9279954 - DNA, 21 bp, Homo sapiens
gagaatctgttttcttgtctt

SEQ ID NO: 9279955 - DNA, 22 bp, Homo sapiens
gagaagggggctcgagtgtcct

SEQ ID NO: 9279956 - DNA, 22 bp, Homo sapiens
gagaagggggctcgagtgtcct

SEQ ID NO: 9279957 - DNA, 22 bp, Homo sapiens
gagaagggggctcgagtgtcct

SEQ ID NO: 9279958 - DNA, 22 bp, Homo sapiens
gagaagggggctcgagtgtcct

SEQ ID NO: 9279959 - DNA, 22 bp, Homo sapiens
gagaggcatggaacagattctt

SEQ ID NO: 9279960 - DNA, 22 bp, Homo sapiens
gagacaaaagttggagtgcaag

SEQ ID NO: 9279961 - DNA, 22 bp, Homo sapiens
gagaggccatggggtgggatgc

SEQ ID NO: 9279962 - DNA, 22 bp, Homo sapiens
gagaggcctgagaggctgcgga

SEQ ID NO: 9279963 - DNA, 22 bp, Homo sapiens
gagaggctcagggacttgctga

SEQ ID NO: 9279964 - DNA, 22 bp, Homo sapiens
gagaggctatgaggttctgtgt

SEQ ID NO: 9279965 - DNA, 22 bp, Homo sapiens
gagaggccatggggtgggatgc

SEQ ID NO: 9279966 - DNA, 18 bp, Homo sapiens
gagaggcccggctgtgcc

SEQ ID NO: 9279967 - DNA, 22 bp, Homo sapiens
gagaggctggtaaagtctgaac

SEQ ID NO: 9279968 - DNA, 22 bp, Homo sapiens
gagaggctgggttggagatcga

SEQ ID NO: 9279969 - DNA, 22 bp, Homo sapiens
gagaggctgtgtgccattgttg

SEQ ID NO: 9279970 - DNA, 22 bp, Homo sapiens
gagaggcttaagggctgtgaag

SEQ ID NO: 9279971 - DNA, 22 bp, Homo sapiens
gagaggcttgtgtgaagaacaa

SEQ ID NO: 9279972 - DNA, 22 bp, Homo sapiens
gagagggagccagccaggaacc

SEQ ID NO: 9279973 - DNA, 22 bp, Homo sapiens
gagatgaagaggcccttggagt

SEQ ID NO: 9279974 - DNA, 22 bp, Homo sapiens
gagatgcagaaccctcaggagc

SEQ ID NO: 9279975 - DNA, 22 bp, Homo sapiens
gagatgctgcctgatttattca

SEQ ID NO: 9279976 - DNA, 22 bp, Homo sapiens
ctgggtctgggcctcctggagt

SEQ ID NO: 9279977 - DNA, 22 bp, Homo sapiens
ctgggtctggtgtcaggcgacg

SEQ ID NO: 9279978 - DNA, 22 bp, Homo sapiens
ctgggtctcttaccatgtgact

SEQ ID NO: 9279979 - DNA, 22 bp, Homo sapiens
ctgggtctcttaccatgtgact

SEQ ID NO: 9279980 - DNA, 22 bp, Homo sapiens
ctgggtctggaggccaagggtg

SEQ ID NO: 9279981 - DNA, 22 bp, Homo sapiens
ctgggtctggccacaggaagta

SEQ ID NO: 9279982 - DNA, 22 bp, Homo sapiens
ctgggtctcttaccatgtgact

SEQ ID NO: 9279983 - DNA, 22 bp, Homo sapiens
ctgggtctccggcagcctcggg

SEQ ID NO: 9279984 - DNA, 22 bp, Homo sapiens
ctggggctgcagcgatcttcat

SEQ ID NO: 9279985 - DNA, 22 bp, Homo sapiens
ctggggctgcagcgatcttcat

SEQ ID NO: 9279986 - DNA, 22 bp, Homo sapiens
ctggggctgcagcgatcttcat

SEQ ID NO: 9279987 - DNA, 22 bp, Homo sapiens
ctggggctgcggacgggagccc

SEQ ID NO: 9279988 - DNA, 22 bp, Homo sapiens
ctggggctgcggacgggagccc

SEQ ID NO: 9279989 - DNA, 22 bp, Homo sapiens
ctggggctgcggtggaggagcc

SEQ ID NO: 9279990 - DNA, 22 bp, Homo sapiens
ctggggctgcggtggaggagcc

SEQ ID NO: 9279991 - DNA, 22 bp, Homo sapiens
ctggggctgcggtggaggagcc

SEQ ID NO: 9279992 - DNA, 22 bp, Homo sapiens
ctggggtgtgctcagagcaggg

SEQ ID NO: 9279993 - DNA, 22 bp, Homo sapiens
ctggggccagtgaggaggcttt

SEQ ID NO: 9279994 - DNA, 22 bp, Homo sapiens
ctggggcccatcgagggctgag

SEQ ID NO: 9279995 - DNA, 22 bp, Homo sapiens
ctggggcccatcgagggctgag

SEQ ID NO: 9279996 - DNA, 22 bp, Homo sapiens
ctggggcccatcgagggctgag

SEQ ID NO: 9279997 - DNA, 20 bp, Homo sapiens
ctggggaggaggatgtgttc

SEQ ID NO: 9279998 - DNA, 22 bp, Homo sapiens
ctggggccacaacggcgcacgc

SEQ ID NO: 9279999 - DNA, 22 bp, Homo sapiens
ctggggctcactccagccctgg

SEQ ID NO: 9280000 - DNA, 22 bp, Homo sapiens
ctggggctcactccagccctgg

SEQ ID NO: 9280001 - DNA, 22 bp, Homo sapiens
ctggggcccgagccttgggcca

SEQ ID NO: 9280002 - DNA, 22 bp, Homo sapiens
ctggggctcactttggtcaggc

SEQ ID NO: 9280003 - DNA, 22 bp, Homo sapiens
ctggggctcactttggtcaggc

SEQ ID NO: 9280004 - DNA, 22 bp, Homo sapiens
ctggggctcactttggtcaggc

SEQ ID NO: 9280005 - DNA, 22 bp, Homo sapiens
ctggggctcactttggtcaggc

SEQ ID NO: 9280006 - DNA, 22 bp, Homo sapiens
ctggggctgcagcgatcttcat

SEQ ID NO: 9280007 - DNA, 22 bp, Homo sapiens
ctggggctctctggaatgcttg

SEQ ID NO: 9280008 - DNA, 23 bp, Homo sapiens
ctggggctcattgcagtagccat

SEQ ID NO: 9280009 - DNA, 20 bp, Homo sapiens
ctggggaggaggatgtgttc

SEQ ID NO: 9280010 - DNA, 20 bp, Homo sapiens
ctggggaggaggatgtgttc

SEQ ID NO: 9280011 - DNA, 20 bp, Homo sapiens
ctggggagctgctcccacga

SEQ ID NO: 9280012 - DNA, 22 bp, Homo sapiens
ctgggctggagtgcaatggcgc

SEQ ID NO: 9280013 - DNA, 22 bp, Homo sapiens
ctgggctgcttgctgaaggggt

SEQ ID NO: 9280014 - DNA, 23 bp, Homo sapiens
ctgggctgcttgagtccctggct

SEQ ID NO: 9280015 - DNA, 23 bp, Homo sapiens
ctgggctgcttgagtccctggct

SEQ ID NO: 9280016 - DNA, 22 bp, Homo sapiens
ctgggctgcttgctgaaggggt

SEQ ID NO: 9280017 - DNA, 22 bp, Homo sapiens
ctgggctgctgtccactagggt

SEQ ID NO: 9280018 - DNA, 22 bp, Homo sapiens
ctgggctgcggttctctgaagc

SEQ ID NO: 9280019 - DNA, 22 bp, Homo sapiens
ctgggctgccaggtaggcacac

SEQ ID NO: 9280020 - DNA, 20 bp, Homo sapiens
ctgggctgcccagctatggg

SEQ ID NO: 9280021 - DNA, 20 bp, Homo sapiens
ctgggctgcccagctatggg

SEQ ID NO: 9280022 - DNA, 22 bp, Homo sapiens
ctgggctgcaggagtggggcaa

SEQ ID NO: 9280023 - DNA, 22 bp, Homo sapiens
ctgggctgcaggagtggggcaa

SEQ ID NO: 9280024 - DNA, 22 bp, Homo sapiens
ctgggctgcagcgggagcgacg

SEQ ID NO: 9280025 - DNA, 22 bp, Homo sapiens
ctgggctgcaggagtggggcaa

SEQ ID NO: 9280026 - DNA, 22 bp, Homo sapiens
ctgggctgcagttcctggtcct

SEQ ID NO: 9280027 - DNA, 22 bp, Homo sapiens
ctgggctgcatcaaagaggcat

SEQ ID NO: 9280028 - DNA, 22 bp, Homo sapiens
ctgggctgcatcaaagaggcat

SEQ ID NO: 9280029 - DNA, 22 bp, Homo sapiens
ctgggccagatccagcctcaca

SEQ ID NO: 9280030 - DNA, 22 bp, Homo sapiens
ctgggctctaggaaccattcct

SEQ ID NO: 9280031 - DNA, 22 bp, Homo sapiens
ctgggctctagaaaggaaagaa

SEQ ID NO: 9280032 - DNA, 22 bp, Homo sapiens
ctgggctctaggaaccattcct

SEQ ID NO: 9280033 - DNA, 22 bp, Homo sapiens
ctgggctctgcagttgatgttt

SEQ ID NO: 9280034 - DNA, 22 bp, Homo sapiens
ctgggccagaccttgtggtctt

SEQ ID NO: 9280035 - DNA, 22 bp, Homo sapiens
ctgggaggcaccgcgtcgtgct

SEQ ID NO: 9280036 - DNA, 22 bp, Homo sapiens
ctgggaggcaccgcgtcgtgct

SEQ ID NO: 9280037 - DNA, 22 bp, Homo sapiens
ctgggaggcaccgcgtcgtgct

SEQ ID NO: 9280038 - DNA, 22 bp, Homo sapiens
ctgggaggattcattgaggtga

SEQ ID NO: 9280039 - DNA, 22 bp, Homo sapiens
ctgggaagaaattgtgggaggc

SEQ ID NO: 9280040 - DNA, 22 bp, Homo sapiens
ctgggaagaaattgtgggaggc

SEQ ID NO: 9280041 - DNA, 22 bp, Homo sapiens
ctggctttggtcccctgtgcct

SEQ ID NO: 9280042 - DNA, 22 bp, Homo sapiens
ctggctttgtatagttccctga

SEQ ID NO: 9280043 - DNA, 22 bp, Homo sapiens
ctggcttttcaaactgttcagt

SEQ ID NO: 9280044 - DNA, 22 bp, Homo sapiens
ctggcttttagtgtgaagactt

SEQ ID NO: 9280045 - DNA, 22 bp, Homo sapiens
ctgggaaatggcttcgagctca

SEQ ID NO: 9280046 - DNA, 22 bp, Homo sapiens
ctggctttgaggatcccctctt

SEQ ID NO: 9280047 - DNA, 22 bp, Homo sapiens
ctggctttgctggactgggagt

SEQ ID NO: 9280048 - DNA, 22 bp, Homo sapiens
ctggctttgaaggtctttccta

SEQ ID NO: 9280049 - DNA, 18 bp, Homo sapiens
ctggctttcttatccatc

SEQ ID NO: 9280050 - DNA, 22 bp, Homo sapiens
ctggctttgaaatgcatttcag

SEQ ID NO: 9280051 - DNA, 22 bp, Homo sapiens
ctggctttctgaacatcagtga

SEQ ID NO: 9280052 - DNA, 22 bp, Homo sapiens
ctggctttctgcaaatctccat

SEQ ID NO: 9280053 - DNA, 22 bp, Homo sapiens
ctggctttccttgtctgcatcc

SEQ ID NO: 9280054 - DNA, 22 bp, Homo sapiens
ctggctttaggttggagagctg

SEQ ID NO: 9280055 - DNA, 22 bp, Homo sapiens
ctggctttcattcattcaggcc

SEQ ID NO: 9280056 - DNA, 22 bp, Homo sapiens
ctggctttaatgtcatctttct

SEQ ID NO: 9280057 - DNA, 22 bp, Homo sapiens
ctggctttacctcactggggct

SEQ ID NO: 9280058 - DNA, 22 bp, Homo sapiens
ctggcttgggtctacctgcctt

SEQ ID NO: 9280059 - DNA, 22 bp, Homo sapiens
ctggcttgttttaagaatacaa

SEQ ID NO: 9280060 - DNA, 22 bp, Homo sapiens
ctgggcatttttctctgttaca

SEQ ID NO: 9280061 - DNA, 23 bp, Homo sapiens
ctgggcatggagcttcagaggct

SEQ ID NO: 9280062 - DNA, 23 bp, Homo sapiens
ctgggcatggagcttcagaggct

SEQ ID NO: 9280063 - DNA, 22 bp, Homo sapiens
ctgggcagtttattcagttctg

SEQ ID NO: 9280064 - DNA, 22 bp, Homo sapiens
ctgggcatatacgtgcaagtca

SEQ ID NO: 9280065 - DNA, 22 bp, Homo sapiens
ctgggccacatcagatgaagac

SEQ ID NO: 9280066 - DNA, 22 bp, Homo sapiens
ctgggccactccagatgcccac

SEQ ID NO: 9280067 - DNA, 22 bp, Homo sapiens
ctgggccacttcctcaggggaa

SEQ ID NO: 9280068 - DNA, 22 bp, Homo sapiens
ctgggccacaagcctgtgtgat

SEQ ID NO: 9280069 - DNA, 22 bp, Homo sapiens
ctgggccacatcagatgaagac

SEQ ID NO: 9280070 - DNA, 22 bp, Homo sapiens
ctgggcaggagaggtggttgga

SEQ ID NO: 9280071 - DNA, 22 bp, Homo sapiens
ctgggaggcggagcttgcagtg

SEQ ID NO: 9280072 - DNA, 22 bp, Homo sapiens
ctgggaggcggagcttgcagtg

SEQ ID NO: 9280073 - DNA, 22 bp, Homo sapiens
ctgggaggcagtctctctagaa

SEQ ID NO: 9280074 - DNA, 22 bp, Homo sapiens
ctgggaggcagtctctctagaa

SEQ ID NO: 9280075 - DNA, 22 bp, Homo sapiens
ctgggaggcagtctctctagaa

SEQ ID NO: 9280076 - DNA, 22 bp, Homo sapiens
ctgggaggcccacgttgggaag

SEQ ID NO: 9280077 - DNA, 22 bp, Homo sapiens
ctgggaggcccacgttgggaag

SEQ ID NO: 9280078 - DNA, 22 bp, Homo sapiens
ctgggaggcagaggttgcagtg

SEQ ID NO: 9280079 - DNA, 22 bp, Homo sapiens
ctgggaggcagaggttgtagtg

SEQ ID NO: 9280080 - DNA, 22 bp, Homo sapiens
ctgggaggcagaggttgtagtg

SEQ ID NO: 9280081 - DNA, 22 bp, Homo sapiens
ctgggaggcagtctctctagaa

SEQ ID NO: 9280082 - DNA, 22 bp, Homo sapiens
ctgggaggcactattcaggagg

SEQ ID NO: 9280083 - DNA, 22 bp, Homo sapiens
ctgggaggcactattcaggagg

SEQ ID NO: 9280084 - DNA, 22 bp, Homo sapiens
ctgggaggcagaggttgcagtg

SEQ ID NO: 9280085 - DNA, 22 bp, Homo sapiens
ctgccactttcacccagtgctc

SEQ ID NO: 9280086 - DNA, 22 bp, Homo sapiens
ctgccacttactaggcatggtg

SEQ ID NO: 9280087 - DNA, 22 bp, Homo sapiens
ctgccactagctttcacatctt

SEQ ID NO: 9280088 - DNA, 22 bp, Homo sapiens
ctgcatccatgttgctgcaaag

SEQ ID NO: 9280089 - DNA, 22 bp, Homo sapiens
ctgcatccatgttgctgcaaag

SEQ ID NO: 9280090 - DNA, 22 bp, Homo sapiens
ctgccaaggctggggaggacaa

SEQ ID NO: 9280091 - DNA, 22 bp, Homo sapiens
ctggcagcttcaggacactcgg

SEQ ID NO: 9280092 - DNA, 22 bp, Homo sapiens
ctggcagcttcaggacactcgg

SEQ ID NO: 9280093 - DNA, 22 bp, Homo sapiens
ctggcagcttcctttgcatctg

SEQ ID NO: 9280094 - DNA, 19 bp, Homo sapiens
ctggcagcctgtctgtgtc

SEQ ID NO: 9280095 - DNA, 22 bp, Homo sapiens
ctgccagctcaaagcgcagcta

SEQ ID NO: 9280096 - DNA, 22 bp, Homo sapiens
ctgccagctcaccggctcagac

SEQ ID NO: 9280097 - DNA, 22 bp, Homo sapiens
ctgccagcagaggccagcgctg

SEQ ID NO: 9280098 - DNA, 22 bp, Homo sapiens
ctgccagcactgcctcctgagg

SEQ ID NO: 9280099 - DNA, 22 bp, Homo sapiens
ctggcaggcagacttctgcaag

SEQ ID NO: 9280100 - DNA, 22 bp, Homo sapiens
ctggccagatgttacgtccaat

SEQ ID NO: 9280101 - DNA, 22 bp, Homo sapiens
ctggccagatgttacgtccaat

SEQ ID NO: 9280102 - DNA, 22 bp, Homo sapiens
ctggccagcatggctgaagtac

SEQ ID NO: 9280103 - DNA, 22 bp, Homo sapiens
ctggccagcatggctgaagtac

SEQ ID NO: 9280104 - DNA, 22 bp, Homo sapiens
ctggccagcatttttgctttag

SEQ ID NO: 9280105 - DNA, 22 bp, Homo sapiens
ctggccagcatttttgctttag

SEQ ID NO: 9280106 - DNA, 22 bp, Homo sapiens
ctggccagagttggagggtgtg

SEQ ID NO: 9280107 - DNA, 22 bp, Homo sapiens
ctggccagagttggagggtgtg

SEQ ID NO: 9280108 - DNA, 22 bp, Homo sapiens
ctggccagcctcccaggtaccc

SEQ ID NO: 9280109 - DNA, 22 bp, Homo sapiens
ctggccagcctcccaggtaccc

SEQ ID NO: 9280110 - DNA, 22 bp, Homo sapiens
ctggccagcctcccaggtaccc

SEQ ID NO: 9280111 - DNA, 22 bp, Homo sapiens
ctggccagcctgtcgatgccct

SEQ ID NO: 9280112 - DNA, 22 bp, Homo sapiens
ctggccaggaggtaaccagatg

SEQ ID NO: 9280113 - DNA, 22 bp, Homo sapiens
ctggccagctgacagcagggct

SEQ ID NO: 9280114 - DNA, 22 bp, Homo sapiens
ctggccagctgacagcagggct

SEQ ID NO: 9280115 - DNA, 22 bp, Homo sapiens
ctggccagctgacagcagggct

SEQ ID NO: 9280116 - DNA, 22 bp, Homo sapiens
ctggctgcgctagtccagaaga

SEQ ID NO: 9280117 - DNA, 22 bp, Homo sapiens
ctggctgcgtctgctctgacag

SEQ ID NO: 9280118 - DNA, 22 bp, Homo sapiens
ctggctgcgtctgctctgacag

SEQ ID NO: 9280119 - DNA, 22 bp, Homo sapiens
ctggctgcttgtagactcgact

SEQ ID NO: 9280120 - DNA, 22 bp, Homo sapiens
ctggctgcagtagcaagagact

SEQ ID NO: 9280121 - DNA, 22 bp, Homo sapiens
ctggctcagtgccttcagaagt

SEQ ID NO: 9280122 - DNA, 22 bp, Homo sapiens
ctggctcagtgccttcagaagt

SEQ ID NO: 9280123 - DNA, 22 bp, Homo sapiens
ctggctcagttcttggttttca

SEQ ID NO: 9280124 - DNA, 22 bp, Homo sapiens
ctggctcagttcttggttttca

SEQ ID NO: 9280125 - DNA, 22 bp, Homo sapiens
ctggctcatagagcagctccaa

SEQ ID NO: 9280126 - DNA, 22 bp, Homo sapiens
ctggctcatagagcagctccaa

SEQ ID NO: 9280127 - DNA, 22 bp, Homo sapiens
ctggctcatccaggtgttgctc

SEQ ID NO: 9280128 - DNA, 22 bp, Homo sapiens
ctggctcatccaggtgttgctc

SEQ ID NO: 9280129 - DNA, 22 bp, Homo sapiens
ctggctcatgtgatgagggcaa

SEQ ID NO: 9280130 - DNA, 22 bp, Homo sapiens
ctggctcatgtgatgagggcaa

SEQ ID NO: 9280131 - DNA, 22 bp, Homo sapiens
ctggctcattttagcatcaggt

SEQ ID NO: 9280132 - DNA, 23 bp, Homo sapiens
ctggctcatcctggttgcagtgg

SEQ ID NO: 9280133 - DNA, 23 bp, Homo sapiens
ctggctcatcctggttgcagtgg

SEQ ID NO: 9280134 - DNA, 23 bp, Homo sapiens
ctggctcatcctggttgcagtgg

SEQ ID NO: 9280135 - DNA, 22 bp, Homo sapiens
ctggctcatccaggtgttgctc

SEQ ID NO: 9280136 - DNA, 22 bp, Homo sapiens
ctggctcttgcgactcagcttg

SEQ ID NO: 9280137 - DNA, 22 bp, Homo sapiens
ctggctcttgcgactcagcttg

SEQ ID NO: 9280138 - DNA, 22 bp, Homo sapiens
ctggctcattttagcatcaggt

SEQ ID NO: 9280139 - DNA, 19 bp, Homo sapiens
ctggccaggccaggggccc

SEQ ID NO: 9280140 - DNA, 19 bp, Homo sapiens
ctggccaggccaggggccc

SEQ ID NO: 9280141 - DNA, 19 bp, Homo sapiens
ctggccaggccaggggccc

SEQ ID NO: 9280142 - DNA, 22 bp, Homo sapiens
ctggccaggccccttgcagggc

SEQ ID NO: 9280143 - DNA, 22 bp, Homo sapiens
ctggcccaggtggtcgttgagg

SEQ ID NO: 9280144 - DNA, 22 bp, Homo sapiens
ctggccaggccccttgcagggc

SEQ ID NO: 9280145 - DNA, 22 bp, Homo sapiens
ctggcccagtctcagagtgtca

SEQ ID NO: 9280146 - DNA, 22 bp, Homo sapiens
ctggcccagtctcagagtgtca

SEQ ID NO: 9280147 - DNA, 22 bp, Homo sapiens
ctggccctcggagtccagctgc

SEQ ID NO: 9280148 - DNA, 22 bp, Homo sapiens
ctggccctgtggaggcaggaac

SEQ ID NO: 9280149 - DNA, 22 bp, Homo sapiens
ctggccctgtggaggcaggaac

SEQ ID NO: 9280150 - DNA, 22 bp, Homo sapiens
ctggctcagacagctgtgcagt

SEQ ID NO: 9280151 - DNA, 22 bp, Homo sapiens
ctggctcagacagctgtgcagt

SEQ ID NO: 9280152 - DNA, 22 bp, Homo sapiens
ctggctcactagccctgccctg

SEQ ID NO: 9280153 - DNA, 22 bp, Homo sapiens
ctggctcactagccctgccctg

SEQ ID NO: 9280154 - DNA, 22 bp, Homo sapiens
ctggctcaggaaagttgctgct

SEQ ID NO: 9280155 - DNA, 22 bp, Homo sapiens
ctggctcaggaaagttgctgct

SEQ ID NO: 9280156 - DNA, 22 bp, Homo sapiens
ctggctcaggaaagttgctgct

SEQ ID NO: 9280157 - DNA, 22 bp, Homo sapiens
ctggctcagggtggtctgggtc

SEQ ID NO: 9280158 - DNA, 22 bp, Homo sapiens
ctggctcagggtggtctgggtc

SEQ ID NO: 9280159 - DNA, 22 bp, Homo sapiens
ctggctcacctccgctccagca

SEQ ID NO: 9280160 - DNA, 22 bp, Homo sapiens
ctggctcacctccgctccagca

SEQ ID NO: 9280161 - DNA, 22 bp, Homo sapiens
ctggctcactagccctgccctg

SEQ ID NO: 9280162 - DNA, 22 bp, Homo sapiens
ctggctcactagccctgccctg

SEQ ID NO: 9280163 - DNA, 22 bp, Homo sapiens
ctggcctgtgggctgtctccgg

SEQ ID NO: 9280164 - DNA, 22 bp, Homo sapiens
cttgatctacatagtgaaaccc

SEQ ID NO: 9280165 - DNA, 22 bp, Homo sapiens
cttgatctacatagtgaaaccc

SEQ ID NO: 9280166 - DNA, 22 bp, Homo sapiens
cttgatttattacccactatat

SEQ ID NO: 9280167 - DNA, 23 bp, Homo sapiens
cttgcaggaagcagatggcacac

SEQ ID NO: 9280168 - DNA, 22 bp, Homo sapiens
cttgcagatgtgactaaattaa

SEQ ID NO: 9280169 - DNA, 22 bp, Homo sapiens
cttgcagaggctgttccagatg

SEQ ID NO: 9280170 - DNA, 22 bp, Homo sapiens
cttgcagtgtggccttgaagag

SEQ ID NO: 9280171 - DNA, 22 bp, Homo sapiens
cttgcagggctgatgggaagtg

SEQ ID NO: 9280172 - DNA, 22 bp, Homo sapiens
cttgcaggcagggcctcctgga

SEQ ID NO: 9280173 - DNA, 22 bp, Homo sapiens
cttcctggctcggtgcctcacc

SEQ ID NO: 9280174 - DNA, 22 bp, Homo sapiens
cttcctgggacacctaactcta

SEQ ID NO: 9280175 - DNA, 22 bp, Homo sapiens
cttcctggctcggtgcctcacc

SEQ ID NO: 9280176 - DNA, 22 bp, Homo sapiens
cttcctggccattgccatggca

SEQ ID NO: 9280177 - DNA, 22 bp, Homo sapiens
cttcctggcatgggtctcatga

SEQ ID NO: 9280178 - DNA, 22 bp, Homo sapiens
cttcctggcatgggtctcatga

SEQ ID NO: 9280179 - DNA, 22 bp, Homo sapiens
cttgacactgtcactcaggcca

SEQ ID NO: 9280180 - DNA, 22 bp, Homo sapiens
cttcctggatgaagcccagcat

SEQ ID NO: 9280181 - DNA, 22 bp, Homo sapiens
cttcctggatgagcaggctgat

SEQ ID NO: 9280182 - DNA, 22 bp, Homo sapiens
cttcctgcaggacagccatctg

SEQ ID NO: 9280183 - DNA, 22 bp, Homo sapiens
cttcctgcatggagtctgaatg

SEQ ID NO: 9280184 - DNA, 22 bp, Homo sapiens
cttcctgcaacacctgtgttgc

SEQ ID NO: 9280185 - DNA, 18 bp, Homo sapiens
cttcctgactagctctgg

SEQ ID NO: 9280186 - DNA, 22 bp, Homo sapiens
cttcctgaggtgctgagcacag

SEQ ID NO: 9280187 - DNA, 22 bp, Homo sapiens
cttcctgcattgtgccagagtt

SEQ ID NO: 9280188 - DNA, 22 bp, Homo sapiens
cttgtccagatgtttgttaggt

SEQ ID NO: 9280189 - DNA, 22 bp, Homo sapiens
cttgtctgggcagcttgggagt

SEQ ID NO: 9280190 - DNA, 21 bp, Homo sapiens
cttgtctgcagtgtttatagc

SEQ ID NO: 9280191 - DNA, 22 bp, Homo sapiens
cttgtctgctataaaaatccag

SEQ ID NO: 9280192 - DNA, 22 bp, Homo sapiens
cttgtcctttacttgagactca

SEQ ID NO: 9280193 - DNA, 23 bp, Homo sapiens
cttgtctaattcatggtgaaggc

SEQ ID NO: 9280194 - DNA, 22 bp, Homo sapiens
cttgtctgataatggggccaac

SEQ ID NO: 9280195 - DNA, 22 bp, Homo sapiens
ctttatgtccaccagactgcaa

SEQ ID NO: 9280196 - DNA, 22 bp, Homo sapiens
ctttatgtccttgaagagttgt

SEQ ID NO: 9280197 - DNA, 16 bp, Homo sapiens
cttgtctgttgctcat

SEQ ID NO: 9280198 - DNA, 22 bp, Homo sapiens
cttgtctgtgtcggataaaact

SEQ ID NO: 9280199 - DNA, 22 bp, Homo sapiens
cttgtcttgcacacggttgcca

SEQ ID NO: 9280200 - DNA, 22 bp, Homo sapiens
cttgtattgcaaactggccagg

SEQ ID NO: 9280201 - DNA, 22 bp, Homo sapiens
cttgtattgctgttttgcatct

SEQ ID NO: 9280202 - DNA, 22 bp, Homo sapiens
cttgtattctgcctaaccttca

SEQ ID NO: 9280203 - DNA, 22 bp, Homo sapiens
cttgtattcttccacttaagat

SEQ ID NO: 9280204 - DNA, 22 bp, Homo sapiens
cttgtattcccctatctctaaa

SEQ ID NO: 9280205 - DNA, 22 bp, Homo sapiens
cttgtattcccctatctctaaa

SEQ ID NO: 9280206 - DNA, 22 bp, Homo sapiens
cttgtattcagcatcttaacta

SEQ ID NO: 9280207 - DNA, 22 bp, Homo sapiens
cttgtattcagagtggacatga

SEQ ID NO: 9280208 - DNA, 23 bp, Homo sapiens
cttgtattcactcatttgggaac

SEQ ID NO: 9280209 - DNA, 22 bp, Homo sapiens
cttgtatacagtgtacacattg

SEQ ID NO: 9280210 - DNA, 22 bp, Homo sapiens
cttgtatagggaaagataaatc

SEQ ID NO: 9280211 - DNA, 22 bp, Homo sapiens
cttgtattaagcttagagaggc

SEQ ID NO: 9280212 - DNA, 22 bp, Homo sapiens
cttgtattaggaagaatgcttt

SEQ ID NO: 9280213 - DNA, 22 bp, Homo sapiens
cttgtacatagagaagaagcct

SEQ ID NO: 9280214 - DNA, 22 bp, Homo sapiens
cttgggtgtgaccttggcattg

SEQ ID NO: 9280215 - DNA, 22 bp, Homo sapiens
cttgtacaggaatccatggtat

SEQ ID NO: 9280216 - DNA, 22 bp, Homo sapiens
cttgtagaattgaaatggtctc

SEQ ID NO: 9280217 - DNA, 22 bp, Homo sapiens
cttgtagaattgaaatggtctc

SEQ ID NO: 9280218 - DNA, 22 bp, Homo sapiens
cttgtacattgatttctgcatt

SEQ ID NO: 9280219 - DNA, 22 bp, Homo sapiens
cttgtatacagtgtacacattg

SEQ ID NO: 9280220 - DNA, 22 bp, Homo sapiens
cttgtagacccctggactcacg

SEQ ID NO: 9280221 - DNA, 20 bp, Homo sapiens
cttgccagttccctggcaga

SEQ ID NO: 9280222 - DNA, 22 bp, Homo sapiens
cttgccagtgttgcagaagctc

SEQ ID NO: 9280223 - DNA, 22 bp, Homo sapiens
cttgggtataaaacttggctat

SEQ ID NO: 9280224 - DNA, 22 bp, Homo sapiens
cttgggtgctggaggctgccgc

SEQ ID NO: 9280225 - DNA, 22 bp, Homo sapiens
cttgggtgctcagggaaagctt

SEQ ID NO: 9280226 - DNA, 22 bp, Homo sapiens
cttgccagtgttgcagaagctc

SEQ ID NO: 9280227 - DNA, 22 bp, Homo sapiens
cttgccagggactcagtcaggg

SEQ ID NO: 9280228 - DNA, 22 bp, Homo sapiens
cttgccagcacttggccagctg

SEQ ID NO: 9280229 - DNA, 22 bp, Homo sapiens
cttgcagtttaggtcctctgtg

SEQ ID NO: 9280230 - DNA, 22 bp, Homo sapiens
cttcagtgaatgttgagtaagg

SEQ ID NO: 9280231 - DNA, 22 bp, Homo sapiens
cttcagtgatataggcttctcc

SEQ ID NO: 9280232 - DNA, 22 bp, Homo sapiens
cttcagggtgacgcaggctgca

SEQ ID NO: 9280233 - DNA, 22 bp, Homo sapiens
cttcagtatcctccacatgtta

SEQ ID NO: 9280234 - DNA, 22 bp, Homo sapiens
cttcagcctcgttactcctgcg

SEQ ID NO: 9280235 - DNA, 22 bp, Homo sapiens
cttcagcctcatctcagcccgt

SEQ ID NO: 9280236 - DNA, 22 bp, Homo sapiens
cttcagctgtggtctccaaggc

SEQ ID NO: 9280237 - DNA, 22 bp, Homo sapiens
cttcaggattaatttggggcct

SEQ ID NO: 9280238 - DNA, 20 bp, Homo sapiens
cttcaggacccatcctcccc

SEQ ID NO: 9280239 - DNA, 22 bp, Homo sapiens
cttccgtgtcagttccaggtgg

SEQ ID NO: 9280240 - DNA, 22 bp, Homo sapiens
cttcctaaaagcttcaagagaa

SEQ ID NO: 9280241 - DNA, 22 bp, Homo sapiens
cttcctaaaagcttcaagagaa

SEQ ID NO: 9280242 - DNA, 22 bp, Homo sapiens
cttcctctgcggcgccgggcgc

SEQ ID NO: 9280243 - DNA, 22 bp, Homo sapiens
cttcctctgcctcccgtgctca

SEQ ID NO: 9280244 - DNA, 22 bp, Homo sapiens
cttcctctgcctcccgtgctca

SEQ ID NO: 9280245 - DNA, 23 bp, Homo sapiens
cttcagtgtgggactgcagcgtg

SEQ ID NO: 9280246 - DNA, 22 bp, Homo sapiens
cttcctctgtgtcctgggcttg

SEQ ID NO: 9280247 - DNA, 16 bp, Homo sapiens
cttcctcttcactggc

SEQ ID NO: 9280248 - DNA, 22 bp, Homo sapiens
cttcctctgtgtcctgggcttc

SEQ ID NO: 9280249 - DNA, 22 bp, Homo sapiens
cttcctctgtggccagagtgta

SEQ ID NO: 9280250 - DNA, 22 bp, Homo sapiens
cttcctctgtggccagagtgta

SEQ ID NO: 9280251 - DNA, 22 bp, Homo sapiens
cttcctgaacaatgccatcaat

SEQ ID NO: 9280252 - DNA, 22 bp, Homo sapiens
cttcctgaagaggttggtcagg

SEQ ID NO: 9280253 - DNA, 22 bp, Homo sapiens
cttcctgaggtgctgagcacag

SEQ ID NO: 9280254 - DNA, 22 bp, Homo sapiens
cttcctgagcaaggaactatag

SEQ ID NO: 9280255 - DNA, 22 bp, Homo sapiens
cttattttaagtcagtttgggt

SEQ ID NO: 9280256 - DNA, 22 bp, Homo sapiens
cttattttaagtcagtttgggt

SEQ ID NO: 9280257 - DNA, 22 bp, Homo sapiens
cttattttaagtcagtttgggt

SEQ ID NO: 9280258 - DNA, 22 bp, Homo sapiens
cttattttgctgatgacccagg

SEQ ID NO: 9280259 - DNA, 22 bp, Homo sapiens
cttatttctccatccagagtca

SEQ ID NO: 9280260 - DNA, 22 bp, Homo sapiens
cttatttctccatccagagtca

SEQ ID NO: 9280261 - DNA, 19 bp, Homo sapiens
cttatttctggttttgggt

SEQ ID NO: 9280262 - DNA, 22 bp, Homo sapiens
cttatttatgtctgtctctaat

SEQ ID NO: 9280263 - DNA, 22 bp, Homo sapiens
cttatttcagccctgggcaccc

SEQ ID NO: 9280264 - DNA, 22 bp, Homo sapiens
cttatttcctgacatggaaaga

SEQ ID NO: 9280265 - DNA, 22 bp, Homo sapiens
cttatttcagccctgggcaccc

SEQ ID NO: 9280266 - DNA, 22 bp, Homo sapiens
cttattttgctgatgacccagg

SEQ ID NO: 9280267 - DNA, 22 bp, Homo sapiens
cttattttgctgatgacccagg

SEQ ID NO: 9280268 - DNA, 22 bp, Homo sapiens
cttattttgctgatgacccagg

SEQ ID NO: 9280269 - DNA, 22 bp, Homo sapiens
cttattttgctgatgacccagg

SEQ ID NO: 9280270 - DNA, 22 bp, Homo sapiens
cttcaaaagccagaagcctgcg

SEQ ID NO: 9280271 - DNA, 22 bp, Homo sapiens
cttcagcatctttttcttgggg

SEQ ID NO: 9280272 - DNA, 22 bp, Homo sapiens
cttcagccctgagtgccagcag

SEQ ID NO: 9280273 - DNA, 22 bp, Homo sapiens
cttcagaagaaaagcagtgtgt

SEQ ID NO: 9280274 - DNA, 22 bp, Homo sapiens
ctgttggcctttcatcagtaat

SEQ ID NO: 9280275 - DNA, 22 bp, Homo sapiens
cttatcagattatctgggctgt

SEQ ID NO: 9280276 - DNA, 22 bp, Homo sapiens
cttatcatatcatacatggcta

SEQ ID NO: 9280277 - DNA, 22 bp, Homo sapiens
cttattgaaagcccctgtgcct

SEQ ID NO: 9280278 - DNA, 22 bp, Homo sapiens
cttattgcaggactaagaacac

SEQ ID NO: 9280279 - DNA, 22 bp, Homo sapiens
cttattgaaagcccctgtgcct

SEQ ID NO: 9280280 - DNA, 21 bp, Homo sapiens
cttattgctgcacaatgattt

SEQ ID NO: 9280281 - DNA, 18 bp, Homo sapiens
cttattgtttaaatggcc

SEQ ID NO: 9280282 - DNA, 22 bp, Homo sapiens
cttattgttcctggaccctgag

SEQ ID NO: 9280283 - DNA, 22 bp, Homo sapiens
cttattgttcagatagagatga

SEQ ID NO: 9280284 - DNA, 22 bp, Homo sapiens
cttattgtgattcctgcctctt

SEQ ID NO: 9280285 - DNA, 22 bp, Homo sapiens
cttattgtgataccatgcagta

SEQ ID NO: 9280286 - DNA, 22 bp, Homo sapiens
cttattgtgtctttgaataagt

SEQ ID NO: 9280287 - DNA, 22 bp, Homo sapiens
cttattgtgtgtattttctagt

SEQ ID NO: 9280288 - DNA, 22 bp, Homo sapiens
cttattgtcttacagtaataga

SEQ ID NO: 9280289 - DNA, 22 bp, Homo sapiens
cttattgtcctgactcatggcc

SEQ ID NO: 9280290 - DNA, 22 bp, Homo sapiens
cttattgtgaggtattgagatt

SEQ ID NO: 9280291 - DNA, 22 bp, Homo sapiens
cttattgtgagatgcgataatt

SEQ ID NO: 9280292 - DNA, 22 bp, Homo sapiens
ctgtgtctgaataactctgtgt

SEQ ID NO: 9280293 - DNA, 22 bp, Homo sapiens
ctgtgtctctccttacaagact

SEQ ID NO: 9280294 - DNA, 22 bp, Homo sapiens
ctgtgtctcatccgcctctggc

SEQ ID NO: 9280295 - DNA, 22 bp, Homo sapiens
ctgtgtcttcaatgtactggga

SEQ ID NO: 9280296 - DNA, 22 bp, Homo sapiens
ctgtgtctgtggaatagcgaat

SEQ ID NO: 9280297 - DNA, 22 bp, Homo sapiens
ctgttaagtgtagataatgtgg

SEQ ID NO: 9280298 - DNA, 22 bp, Homo sapiens
ctgttaatggaggactacagga

SEQ ID NO: 9280299 - DNA, 22 bp, Homo sapiens
ctgtgtcttctgcttacagtct

SEQ ID NO: 9280300 - DNA, 22 bp, Homo sapiens
ctgttaagcaacatgagtaagt

SEQ ID NO: 9280301 - DNA, 18 bp, Homo sapiens
ctgttgagatgtggctga

SEQ ID NO: 9280302 - DNA, 22 bp, Homo sapiens
ctgttctgctgcataaaaactt

SEQ ID NO: 9280303 - DNA, 22 bp, Homo sapiens
ctgttgcagaggggcggagagg

SEQ ID NO: 9280304 - DNA, 22 bp, Homo sapiens
ctgttgctccagggaacacaga

SEQ ID NO: 9280305 - DNA, 21 bp, Homo sapiens
ctgttcactgtgctgtgcaaa

SEQ ID NO: 9280306 - DNA, 22 bp, Homo sapiens
ctgttctatcattaaaagctat

SEQ ID NO: 9280307 - DNA, 20 bp, Homo sapiens
ctgttcctgtcccatgaagc

SEQ ID NO: 9280308 - DNA, 22 bp, Homo sapiens
ctgttctctggcggtggctgtt

SEQ ID NO: 9280309 - DNA, 20 bp, Homo sapiens
ctgttcctgtcccatgaagc

SEQ ID NO: 9280310 - DNA, 20 bp, Homo sapiens
ctgtggctcatgcatctgcc

SEQ ID NO: 9280311 - DNA, 20 bp, Homo sapiens
ctgtggctcatgcatctgcc

SEQ ID NO: 9280312 - DNA, 22 bp, Homo sapiens
ctgtggctgcagccttggtcct

SEQ ID NO: 9280313 - DNA, 22 bp, Homo sapiens
ctgtggctgcagccttggtcct

SEQ ID NO: 9280314 - DNA, 22 bp, Homo sapiens
ctgtggtgggccctgggcttca

SEQ ID NO: 9280315 - DNA, 22 bp, Homo sapiens
ctgtgtacccacgtgggcaccc

SEQ ID NO: 9280316 - DNA, 22 bp, Homo sapiens
ctgtgtagcctcatgtgggctt

SEQ ID NO: 9280317 - DNA, 22 bp, Homo sapiens
ctgtgtcctgtctcctaaggtg

SEQ ID NO: 9280318 - DNA, 22 bp, Homo sapiens
ctgtgtctaatcaggtcagtca

SEQ ID NO: 9280319 - DNA, 22 bp, Homo sapiens
ctgtgtagtcaggtggtcccac

SEQ ID NO: 9280320 - DNA, 22 bp, Homo sapiens
ctgtgtcctcccgctgcaccca

SEQ ID NO: 9280321 - DNA, 22 bp, Homo sapiens
ctgtgtcctgcgtcaagccaat

SEQ ID NO: 9280322 - DNA, 22 bp, Homo sapiens
ctgtccctgagcaactcctgtt

SEQ ID NO: 9280323 - DNA, 22 bp, Homo sapiens
ctgtcctgaaagggagattggg

SEQ ID NO: 9280324 - DNA, 22 bp, Homo sapiens
ctgtcctgaagttttcatgaga

SEQ ID NO: 9280325 - DNA, 22 bp, Homo sapiens
ctgtcctgaagttttcatgaga

SEQ ID NO: 9280326 - DNA, 22 bp, Homo sapiens
ctgtccctgagcaactcctgtt

SEQ ID NO: 9280327 - DNA, 22 bp, Homo sapiens
ctgggtctgtgcccagggacct

SEQ ID NO: 9280328 - DNA, 22 bp, Homo sapiens
ctgggtgaatttgaaggaaagg

SEQ ID NO: 9280329 - DNA, 22 bp, Homo sapiens
ctgggtgacagagtgagatggt

SEQ ID NO: 9280330 - DNA, 22 bp, Homo sapiens
ctgggtgagttgatgaaggaga

SEQ ID NO: 9280331 - DNA, 22 bp, Homo sapiens
ctgggtgagtataggaaaggga

SEQ ID NO: 9280332 - DNA, 22 bp, Homo sapiens
ctgggtgattcctgtccaggca

SEQ ID NO: 9280333 - DNA, 22 bp, Homo sapiens
ctgggtgagttgatgaaggaga

SEQ ID NO: 9280334 - DNA, 22 bp, Homo sapiens
ctgtcctggccgcccttgtgag

SEQ ID NO: 9280335 - DNA, 22 bp, Homo sapiens
ctgtcctggagggcataggacg

SEQ ID NO: 9280336 - DNA, 22 bp, Homo sapiens
ctgtcctggagggcataggacg

SEQ ID NO: 9280337 - DNA, 21 bp, Homo sapiens
ctgtcctggtctagaggcaca

SEQ ID NO: 9280338 - DNA, 22 bp, Homo sapiens
ctgtcctgtagctccatcagtc

SEQ ID NO: 9280339 - DNA, 22 bp, Homo sapiens
ctgtcctgtagctccatcagtc

SEQ ID NO: 9280340 - DNA, 22 bp, Homo sapiens
ctgtcctgtagctccatcagtc

SEQ ID NO: 9280341 - DNA, 22 bp, Homo sapiens
ctgtcctgcccaccctgcaggg

SEQ ID NO: 9280342 - DNA, 22 bp, Homo sapiens
ctgtcctgcccaccctgcaggg

SEQ ID NO: 9280343 - DNA, 22 bp, Homo sapiens
ctgtcctgccagtcctggactc

SEQ ID NO: 9280344 - DNA, 22 bp, Homo sapiens
ctgtcctgatggtgccactggt

SEQ ID NO: 9280345 - DNA, 22 bp, Homo sapiens
ctgtcctgatggtgccactggt

SEQ ID NO: 9280346 - DNA, 22 bp, Homo sapiens
ctgtgcccacctggctctgagg

SEQ ID NO: 9280347 - DNA, 22 bp, Homo sapiens
ctgtgcccagctccctgactgc

SEQ ID NO: 9280348 - DNA, 22 bp, Homo sapiens
ctgtgcccacctggctctgagg

SEQ ID NO: 9280349 - DNA, 22 bp, Homo sapiens
ctgtgcccaggctggagtgcag

SEQ ID NO: 9280350 - DNA, 22 bp, Homo sapiens
ctgtgccaggcccagctgactt

SEQ ID NO: 9280351 - DNA, 22 bp, Homo sapiens
ctgtgccaggcccagctgactt

SEQ ID NO: 9280352 - DNA, 22 bp, Homo sapiens
ctgtggctcatatctgtaatct

SEQ ID NO: 9280353 - DNA, 22 bp, Homo sapiens
ctgtggccagtcccacacctcc

SEQ ID NO: 9280354 - DNA, 22 bp, Homo sapiens
ctgtggccagagcgccgttgac

SEQ ID NO: 9280355 - DNA, 17 bp, Homo sapiens
ctgtggccacctggatg

SEQ ID NO: 9280356 - DNA, 22 bp, Homo sapiens
ctgtgcccataatctggtattt

SEQ ID NO: 9280357 - DNA, 22 bp, Homo sapiens
ctgtgccctctttgctggcctt

SEQ ID NO: 9280358 - DNA, 22 bp, Homo sapiens
ctgtgccctctttgctggcctt

SEQ ID NO: 9280359 - DNA, 19 bp, Homo sapiens
ctgtgccctatgacttgta

SEQ ID NO: 9280360 - DNA, 23 bp, Homo sapiens
ctgtgcccggggctccacctgat

SEQ ID NO: 9280361 - DNA, 22 bp, Homo sapiens
ctgtgagggccagagtcagggc

SEQ ID NO: 9280362 - DNA, 22 bp, Homo sapiens
ctgtgagggccagagtcagggc

SEQ ID NO: 9280363 - DNA, 22 bp, Homo sapiens
ctgtgcagtaggtcagggctgg

SEQ ID NO: 9280364 - DNA, 22 bp, Homo sapiens
ctgtgagtgaccctggtcagca

SEQ ID NO: 9280365 - DNA, 22 bp, Homo sapiens
ctgtgcagtggcagcgtgtggg

SEQ ID NO: 9280366 - DNA, 19 bp, Homo sapiens
ctgtgagtcttgtggcctc

SEQ ID NO: 9280367 - DNA, 22 bp, Homo sapiens
ctgtgcagtggcagcgtgtggg

SEQ ID NO: 9280368 - DNA, 22 bp, Homo sapiens
ctgtgccactgccccaggcctc

SEQ ID NO: 9280369 - DNA, 22 bp, Homo sapiens
ctgtgccagcctgtcccaggag

SEQ ID NO: 9280370 - DNA, 22 bp, Homo sapiens
ctgtgcattgtcttgtctgtag

SEQ ID NO: 9280371 - DNA, 22 bp, Homo sapiens
ctgtgcattgttgagtgtttag

SEQ ID NO: 9280372 - DNA, 22 bp, Homo sapiens
gccaccagtgggggcctgggca

SEQ ID NO: 9280373 - DNA, 18 bp, Homo sapiens
gccagccctccaacctcc

SEQ ID NO: 9280374 - DNA, 22 bp, Homo sapiens
gccagcctgtgggggctctgtg

SEQ ID NO: 9280375 - DNA, 21 bp, Homo sapiens
gccagcctgtttacctgtggt

SEQ ID NO: 9280376 - DNA, 22 bp, Homo sapiens
gccagcctgtgcttggccaggc

SEQ ID NO: 9280377 - DNA, 23 bp, Homo sapiens
gccagccttgctctcctgcagcc

SEQ ID NO: 9280378 - DNA, 23 bp, Homo sapiens
gccagccttgctctcctgcagcc

SEQ ID NO: 9280379 - DNA, 22 bp, Homo sapiens
gccagccttctgtggcctgcaa

SEQ ID NO: 9280380 - DNA, 22 bp, Homo sapiens
gccagctcagtgccaggcccct

SEQ ID NO: 9280381 - DNA, 22 bp, Homo sapiens
gccagctcagtttcaaagtagg

SEQ ID NO: 9280382 - DNA, 22 bp, Homo sapiens
gccagctcagatgcaggaagga

SEQ ID NO: 9280383 - DNA, 22 bp, Homo sapiens
gccagctcagatgcaggaagga

SEQ ID NO: 9280384 - DNA, 22 bp, Homo sapiens
gccagctcttgatgggtgggta

SEQ ID NO: 9280385 - DNA, 22 bp, Homo sapiens
gccagctcttgatgggtgggta

SEQ ID NO: 9280386 - DNA, 22 bp, Homo sapiens
gccagctctgtggctgtacttg

SEQ ID NO: 9280387 - DNA, 22 bp, Homo sapiens
gccagctctgtggctgtacttg

SEQ ID NO: 9280388 - DNA, 22 bp, Homo sapiens
gccagctctgtggctgtacttg

SEQ ID NO: 9280389 - DNA, 22 bp, Homo sapiens
gccagctctcattgtataggct

SEQ ID NO: 9280390 - DNA, 22 bp, Homo sapiens
gccagctccgcaggatggcgcg

SEQ ID NO: 9280391 - DNA, 22 bp, Homo sapiens
gccagctcccaagtgagcccct

SEQ ID NO: 9280392 - DNA, 22 bp, Homo sapiens
gccagctccgcaggatggcgcg

SEQ ID NO: 9280393 - DNA, 22 bp, Homo sapiens
gccagctcccaagtgagcccct

SEQ ID NO: 9280394 - DNA, 22 bp, Homo sapiens
gccagggcaggggagcatctgc

SEQ ID NO: 9280395 - DNA, 22 bp, Homo sapiens
gccagggcaggggagcatctgc

SEQ ID NO: 9280396 - DNA, 22 bp, Homo sapiens
gccagggcaggggagcatctgc

SEQ ID NO: 9280397 - DNA, 22 bp, Homo sapiens
gccagggctcgcggtccctcgt

SEQ ID NO: 9280398 - DNA, 22 bp, Homo sapiens
gccagggctcgcggtccctcgt

SEQ ID NO: 9280399 - DNA, 22 bp, Homo sapiens
gccagggctcgcggtccctcgt

SEQ ID NO: 9280400 - DNA, 22 bp, Homo sapiens
gccagggctgtgcaggtttgtt

SEQ ID NO: 9280401 - DNA, 22 bp, Homo sapiens
gccagggctgtgcaggtttgtt

SEQ ID NO: 9280402 - DNA, 22 bp, Homo sapiens
gccaggcagatatgtgagctta

SEQ ID NO: 9280403 - DNA, 22 bp, Homo sapiens
gccaggcagatatgtgagctta

SEQ ID NO: 9280404 - DNA, 22 bp, Homo sapiens
gccaggcagcagcgaggatggt

SEQ ID NO: 9280405 - DNA, 22 bp, Homo sapiens
gccaggcagagccccgtgcagc

SEQ ID NO: 9280406 - DNA, 22 bp, Homo sapiens
gccaggcagatatgtgagctta

SEQ ID NO: 9280407 - DNA, 22 bp, Homo sapiens
gccaggcagcagcgaggatggt

SEQ ID NO: 9280408 - DNA, 22 bp, Homo sapiens
gccaggcagccaccctctgcga

SEQ ID NO: 9280409 - DNA, 22 bp, Homo sapiens
gccaggcagctgggagggtgcc

SEQ ID NO: 9280410 - DNA, 18 bp, Homo sapiens
gccaggcagggtggggaa

SEQ ID NO: 9280411 - DNA, 22 bp, Homo sapiens
gcagtggcatgatgtgggctca

SEQ ID NO: 9280412 - DNA, 22 bp, Homo sapiens
gcagtggcagctgagggggtat

SEQ ID NO: 9280413 - DNA, 22 bp, Homo sapiens
gcagtggcatgatgtgggctca

SEQ ID NO: 9280414 - DNA, 22 bp, Homo sapiens
gcagtggcagctgagggggtat

SEQ ID NO: 9280415 - DNA, 17 bp, Homo sapiens
gcagtggaggggtagtt

SEQ ID NO: 9280416 - DNA, 23 bp, Homo sapiens
gcagtggaatgtctctgtttgga

SEQ ID NO: 9280417 - DNA, 22 bp, Homo sapiens
gcagtggatccaatggtatctt

SEQ ID NO: 9280418 - DNA, 22 bp, Homo sapiens
gcagtggatggccagcaggggc

SEQ ID NO: 9280419 - DNA, 22 bp, Homo sapiens
gcagtggatccaatggtatctt

SEQ ID NO: 9280420 - DNA, 22 bp, Homo sapiens
gcagtggcaccgctggctctgg

SEQ ID NO: 9280421 - DNA, 22 bp, Homo sapiens
gcaggggagtggcaggcccgga

SEQ ID NO: 9280422 - DNA, 22 bp, Homo sapiens
gcaggggagtggatgatggatt

SEQ ID NO: 9280423 - DNA, 22 bp, Homo sapiens
gcagtggaagcctctttaagca

SEQ ID NO: 9280424 - DNA, 22 bp, Homo sapiens
gcagtggaagcctctttaagca

SEQ ID NO: 9280425 - DNA, 22 bp, Homo sapiens
gcagtgctttagtctgtccttt

SEQ ID NO: 9280426 - DNA, 22 bp, Homo sapiens
gcagtgaagccagatctgaaat

SEQ ID NO: 9280427 - DNA, 22 bp, Homo sapiens
gcagtgaatctggcaagaattt

SEQ ID NO: 9280428 - DNA, 22 bp, Homo sapiens
gcagtgaatttaacactcagat

SEQ ID NO: 9280429 - DNA, 22 bp, Homo sapiens
gcagtggccacatggaggagga

SEQ ID NO: 9280430 - DNA, 22 bp, Homo sapiens
gcagtggccacatggaggagga

SEQ ID NO: 9280431 - DNA, 22 bp, Homo sapiens
gcagtggctaagctcgcatgca

SEQ ID NO: 9280432 - DNA, 22 bp, Homo sapiens
gcagtggcccagcttgcaggct

SEQ ID NO: 9280433 - DNA, 22 bp, Homo sapiens
gcagtggctaggagtctggcgt

SEQ ID NO: 9280434 - DNA, 22 bp, Homo sapiens
gcagtggctaagctcgcatgca

SEQ ID NO: 9280435 - DNA, 22 bp, Homo sapiens
gcatgcaggagagaaagacggc

SEQ ID NO: 9280436 - DNA, 22 bp, Homo sapiens
gcatgcaggataggttgagctc

SEQ ID NO: 9280437 - DNA, 22 bp, Homo sapiens
gcatgcacacactttctcacta

SEQ ID NO: 9280438 - DNA, 22 bp, Homo sapiens
gcatgcacagtttttcacctca

SEQ ID NO: 9280439 - DNA, 22 bp, Homo sapiens
gcatgcacgggcacatatgcta

SEQ ID NO: 9280440 - DNA, 22 bp, Homo sapiens
gcatgcacacctgtgcacattt

SEQ ID NO: 9280441 - DNA, 22 bp, Homo sapiens
gcagtgggagcttaggcagtgc

SEQ ID NO: 9280442 - DNA, 22 bp, Homo sapiens
gccacaggcttaggagggaggt

SEQ ID NO: 9280443 - DNA, 22 bp, Homo sapiens
gccacaggcttaggagggaggt

SEQ ID NO: 9280444 - DNA, 20 bp, Homo sapiens
gccacagttttctcactgca

SEQ ID NO: 9280445 - DNA, 22 bp, Homo sapiens
gccaccagcagaaaaggggcca

SEQ ID NO: 9280446 - DNA, 22 bp, Homo sapiens
gccacatgcaattgcagcacgt

SEQ ID NO: 9280447 - DNA, 22 bp, Homo sapiens
gccacatgtcatgtgctcagta

SEQ ID NO: 9280448 - DNA, 22 bp, Homo sapiens
gccaccaggagcccagtccaaa

SEQ ID NO: 9280449 - DNA, 22 bp, Homo sapiens
gccaccagccccatgcgctgtg

SEQ ID NO: 9280450 - DNA, 22 bp, Homo sapiens
gccaccaggagcccagtccaaa

SEQ ID NO: 9280451 - DNA, 22 bp, Homo sapiens
gccaccaggagcccagtccaaa

SEQ ID NO: 9280452 - DNA, 22 bp, Homo sapiens
gccaccagggggctccagtgag

SEQ ID NO: 9280453 - DNA, 22 bp, Homo sapiens
gccaccagggggctccagtgag

SEQ ID NO: 9280454 - DNA, 22 bp, Homo sapiens
gccaccagggggctccagtgag

SEQ ID NO: 9280455 - DNA, 22 bp, Homo sapiens
gccaccagggggctccagtgag

SEQ ID NO: 9280456 - DNA, 22 bp, Homo sapiens
gccaccagtgggggcctgggca

SEQ ID NO: 9280457 - DNA, 22 bp, Homo sapiens
gccaccagtgggggcctgggca

SEQ ID NO: 9280458 - DNA, 22 bp, Homo sapiens
gccaccagggggtgcaaggtcc

SEQ ID NO: 9280459 - DNA, 22 bp, Homo sapiens
gccaccagggggtgcaaggtcc

SEQ ID NO: 9280460 - DNA, 22 bp, Homo sapiens
gccaccaggttagatccagcct

SEQ ID NO: 9280461 - DNA, 22 bp, Homo sapiens
gcatgcagtaaaattcagcaac

SEQ ID NO: 9280462 - DNA, 22 bp, Homo sapiens
gcatgctgcaccagagcctctc

SEQ ID NO: 9280463 - DNA, 22 bp, Homo sapiens
gcatgctgcagggaatgcttgt

SEQ ID NO: 9280464 - DNA, 22 bp, Homo sapiens
gcatgctgcaccagagcctctc

SEQ ID NO: 9280465 - DNA, 22 bp, Homo sapiens
gcatgctgagcccacgcctggg

SEQ ID NO: 9280466 - DNA, 22 bp, Homo sapiens
gcccagcctccaagctccaagg

SEQ ID NO: 9280467 - DNA, 22 bp, Homo sapiens
gcccagctccattcttggtgag

SEQ ID NO: 9280468 - DNA, 22 bp, Homo sapiens
gcccagctcctctgcagaccct

SEQ ID NO: 9280469 - DNA, 22 bp, Homo sapiens
gcccagctcctctgcagaccct

SEQ ID NO: 9280470 - DNA, 22 bp, Homo sapiens
gcccagctgagaagcgcggggc

SEQ ID NO: 9280471 - DNA, 22 bp, Homo sapiens
gcccagctgcaccctggtgggt

SEQ ID NO: 9280472 - DNA, 22 bp, Homo sapiens
gcccagcacctctctcagggtt

SEQ ID NO: 9280473 - DNA, 22 bp, Homo sapiens
gcccagcagatctcagtgtctc

SEQ ID NO: 9280474 - DNA, 22 bp, Homo sapiens
gcccagcagatctcagtgtctc

SEQ ID NO: 9280475 - DNA, 22 bp, Homo sapiens
gcccagcagatctcagtgtctc

SEQ ID NO: 9280476 - DNA, 22 bp, Homo sapiens
gcccagccctgaggtcacagct

SEQ ID NO: 9280477 - DNA, 22 bp, Homo sapiens
gccagggttgccaatgggggca

SEQ ID NO: 9280478 - DNA, 22 bp, Homo sapiens
gcccagcacattgctgaggacc

SEQ ID NO: 9280479 - DNA, 22 bp, Homo sapiens
gccagggtgagggctgagaggt

SEQ ID NO: 9280480 - DNA, 22 bp, Homo sapiens
gccagggttcgaatccgtatgg

SEQ ID NO: 9280481 - DNA, 22 bp, Homo sapiens
gccagggttcgaatccgtatgg

SEQ ID NO: 9280482 - DNA, 22 bp, Homo sapiens
gccagggtgtgcagggacagga

SEQ ID NO: 9280483 - DNA, 22 bp, Homo sapiens
gccagggggtcagcaggcactt

SEQ ID NO: 9280484 - DNA, 22 bp, Homo sapiens
gccagggggtcagcaggcactt

SEQ ID NO: 9280485 - DNA, 22 bp, Homo sapiens
gccaggggacgcggagcgacga

SEQ ID NO: 9280486 - DNA, 22 bp, Homo sapiens
gccaggggacgcggagcgacga

SEQ ID NO: 9280487 - DNA, 22 bp, Homo sapiens
gccccactgtggaacctaagtc

SEQ ID NO: 9280488 - DNA, 22 bp, Homo sapiens
gcccatggtcagggaggcaggg

SEQ ID NO: 9280489 - DNA, 22 bp, Homo sapiens
gcccaggagaggccagggctga

SEQ ID NO: 9280490 - DNA, 22 bp, Homo sapiens
gcccaggagcctggagatgtgt

SEQ ID NO: 9280491 - DNA, 22 bp, Homo sapiens
gcccaggagcctggagatgtgt

SEQ ID NO: 9280492 - DNA, 16 bp, Homo sapiens
gcccaggacgggaggc

SEQ ID NO: 9280493 - DNA, 22 bp, Homo sapiens
gcccaggactcagggtgtcgcg

SEQ ID NO: 9280494 - DNA, 22 bp, Homo sapiens
gcccaggactcagggtgtcgcg

SEQ ID NO: 9280495 - DNA, 22 bp, Homo sapiens
gcccaggagaggccagggctga

SEQ ID NO: 9280496 - DNA, 22 bp, Homo sapiens
gcccatggcagaactgtgagca

SEQ ID NO: 9280497 - DNA, 22 bp, Homo sapiens
gcccagctttttgaggcaggca

SEQ ID NO: 9280498 - DNA, 22 bp, Homo sapiens
gcccaggaaagatagggcctca

SEQ ID NO: 9280499 - DNA, 22 bp, Homo sapiens
gcccaggaaagatagggcctca

SEQ ID NO: 9280500 - DNA, 22 bp, Homo sapiens
gcccaggaaataaaagtgggct

SEQ ID NO: 9280501 - DNA, 22 bp, Homo sapiens
gcccaggaaatgccccgtggtg

SEQ ID NO: 9280502 - DNA, 22 bp, Homo sapiens
gcccaggaaataaaagtgggct

SEQ ID NO: 9280503 - DNA, 22 bp, Homo sapiens
gcccagctggcttccagcacat

SEQ ID NO: 9280504 - DNA, 22 bp, Homo sapiens
gcccagctgtctggcagggatg

SEQ ID NO: 9280505 - DNA, 22 bp, Homo sapiens
gcccagctgtctggcagggatg

SEQ ID NO: 9280506 - DNA, 22 bp, Homo sapiens
gcccagcttttcacttccacac

SEQ ID NO: 9280507 - DNA, 22 bp, Homo sapiens
gcccagctttttgaggcaggca

SEQ ID NO: 9280508 - DNA, 17 bp, Homo sapiens
gcccaggaaggacggcc

SEQ ID NO: 9280509 - DNA, 22 bp, Homo sapiens
gcccaggaagtgactcagatgt

SEQ ID NO: 9280510 - DNA, 22 bp, Homo sapiens
gcccaggaagccaccgggaagt

SEQ ID NO: 9280511 - DNA, 17 bp, Homo sapiens
gcccaggaaggacggcc

SEQ ID NO: 9280512 - DNA, 22 bp, Homo sapiens
gcccaggaagccaccgggaagt

SEQ ID NO: 9280513 - DNA, 22 bp, Homo sapiens
gcccaggaaatgccccgtggtg

SEQ ID NO: 9280514 - DNA, 22 bp, Homo sapiens
gcccaggaagttgaggctgccg

SEQ ID NO: 9280515 - DNA, 22 bp, Homo sapiens
gcccaggaagttgaggctgccg

SEQ ID NO: 9280516 - DNA, 22 bp, Homo sapiens
gcccaggaagtgactcagatgt

SEQ ID NO: 9280517 - DNA, 22 bp, Homo sapiens
gcccaggaagttgaggctgccg

SEQ ID NO: 9280518 - DNA, 20 bp, Homo sapiens
gcccaggaatttgcatttct

SEQ ID NO: 9280519 - DNA, 20 bp, Homo sapiens
gcccaggaatttgcatttct

SEQ ID NO: 9280520 - DNA, 16 bp, Homo sapiens
gcccaggacgggaggc

SEQ ID NO: 9280521 - DNA, 20 bp, Homo sapiens
gcccaggaatttgcatttct

SEQ ID NO: 9280522 - DNA, 22 bp, Homo sapiens
gccctgtgccagtcacgctgtg

SEQ ID NO: 9280523 - DNA, 22 bp, Homo sapiens
gccctgtgcgactctagaggtt

SEQ ID NO: 9280524 - DNA, 22 bp, Homo sapiens
gccctgggattgggtggaggct

SEQ ID NO: 9280525 - DNA, 22 bp, Homo sapiens
gccccagctctgccacaactag

SEQ ID NO: 9280526 - DNA, 22 bp, Homo sapiens
gccccagccaaggtgacacgaa

SEQ ID NO: 9280527 - DNA, 22 bp, Homo sapiens
gccccagccaaggtgacacgaa

SEQ ID NO: 9280528 - DNA, 22 bp, Homo sapiens
gccccagccaaggtgacacgaa

SEQ ID NO: 9280529 - DNA, 22 bp, Homo sapiens
gccccagaaagttcaaggcaca

SEQ ID NO: 9280530 - DNA, 22 bp, Homo sapiens
gccccagcctcccgagtagctg

SEQ ID NO: 9280531 - DNA, 22 bp, Homo sapiens
gccccagccctgtggaccatgg

SEQ ID NO: 9280532 - DNA, 22 bp, Homo sapiens
gcctccggagtcacagtgtctt

SEQ ID NO: 9280533 - DNA, 22 bp, Homo sapiens
gcctccggagtcacagtgtctt

SEQ ID NO: 9280534 - DNA, 22 bp, Homo sapiens
gcctccggagttgcagtgtctt

SEQ ID NO: 9280535 - DNA, 22 bp, Homo sapiens
gcctccggagttgcagtgtctt

SEQ ID NO: 9280536 - DNA, 22 bp, Homo sapiens
gccctgtgtatcccctgtgctt

SEQ ID NO: 9280537 - DNA, 22 bp, Homo sapiens
gcctcctaccacaccctcagtc

SEQ ID NO: 9280538 - DNA, 22 bp, Homo sapiens
gcctcctgacttacactgagct

SEQ ID NO: 9280539 - DNA, 22 bp, Homo sapiens
gcctcctggggtgccatcatct

SEQ ID NO: 9280540 - DNA, 22 bp, Homo sapiens
gcctcctggcctttgctcctca

SEQ ID NO: 9280541 - DNA, 22 bp, Homo sapiens
gcctcctggcctttgctcctca

SEQ ID NO: 9280542 - DNA, 22 bp, Homo sapiens
gcctcctggttgcttctccaac

SEQ ID NO: 9280543 - DNA, 22 bp, Homo sapiens
gcctctgggctctgcccctggc

SEQ ID NO: 9280544 - DNA, 22 bp, Homo sapiens
gcctctgggctctgcccctggc

SEQ ID NO: 9280545 - DNA, 22 bp, Homo sapiens
gcctcctgagaagccacaggct

SEQ ID NO: 9280546 - DNA, 22 bp, Homo sapiens
gcctcctggaagtcacatgttt

SEQ ID NO: 9280547 - DNA, 22 bp, Homo sapiens
gcctcctgcccagatgagtgat

SEQ ID NO: 9280548 - DNA, 22 bp, Homo sapiens
gcagccccaggagacgcccagg

SEQ ID NO: 9280549 - DNA, 22 bp, Homo sapiens
gcagcccaggtgtagctctttg

SEQ ID NO: 9280550 - DNA, 18 bp, Homo sapiens
gcagcccctcttccttcc

SEQ ID NO: 9280551 - DNA, 22 bp, Homo sapiens
gcagccctcgctagctctcccc

SEQ ID NO: 9280552 - DNA, 22 bp, Homo sapiens
gcagccctcttggtcactaggc

SEQ ID NO: 9280553 - DNA, 22 bp, Homo sapiens
gcagccctgcagctccacaccg

SEQ ID NO: 9280554 - DNA, 22 bp, Homo sapiens
gcagcccaggctcgctcactgc

SEQ ID NO: 9280555 - DNA, 22 bp, Homo sapiens
gcagcccaggtctctctcactc

SEQ ID NO: 9280556 - DNA, 22 bp, Homo sapiens
gcagatggcagcccaggctggg

SEQ ID NO: 9280557 - DNA, 22 bp, Homo sapiens
gcagatggcagcccaggctggg

SEQ ID NO: 9280558 - DNA, 23 bp, Homo sapiens
gcagatggccccagagtgctgcc

SEQ ID NO: 9280559 - DNA, 23 bp, Homo sapiens
gcagatggccccagagtgctgcc

SEQ ID NO: 9280560 - DNA, 21 bp, Homo sapiens
gcagatgggaagagacgaggc

SEQ ID NO: 9280561 - DNA, 22 bp, Homo sapiens
gcagatggctcagacactgggg

SEQ ID NO: 9280562 - DNA, 21 bp, Homo sapiens
gcagatgggagtcatcaggct

SEQ ID NO: 9280563 - DNA, 22 bp, Homo sapiens
gcagatggtgccatgtcttgtg

SEQ ID NO: 9280564 - DNA, 22 bp, Homo sapiens
gcagatggtggggcaggaaaat

SEQ ID NO: 9280565 - DNA, 22 bp, Homo sapiens
gcagatggtggggcaggaaaat

SEQ ID NO: 9280566 - DNA, 22 bp, Homo sapiens
gcagatggtggggcaggaaaat

SEQ ID NO: 9280567 - DNA, 22 bp, Homo sapiens
gcagatggtggaggcaagaggc

SEQ ID NO: 9280568 - DNA, 22 bp, Homo sapiens
gcagctttttggatgtcagtta

SEQ ID NO: 9280569 - DNA, 22 bp, Homo sapiens
gcagctttgtggagaggcccat

SEQ ID NO: 9280570 - DNA, 22 bp, Homo sapiens
gcaggaagatgagctcaggtaa

SEQ ID NO: 9280571 - DNA, 22 bp, Homo sapiens
gcaggaagatgagctcaggtaa

SEQ ID NO: 9280572 - DNA, 22 bp, Homo sapiens
gcaggaagaggctcgaagcccc

SEQ ID NO: 9280573 - DNA, 22 bp, Homo sapiens
gcaggaagcatagaagaatgcc

SEQ ID NO: 9280574 - DNA, 22 bp, Homo sapiens
gcaggaagcatagaagaatgcc

SEQ ID NO: 9280575 - DNA, 22 bp, Homo sapiens
gcagcctcagggcactcagatg

SEQ ID NO: 9280576 - DNA, 22 bp, Homo sapiens
gcagcctcagggcactcagatg

SEQ ID NO: 9280577 - DNA, 22 bp, Homo sapiens
gcagcctccgcactgcgagtcc

SEQ ID NO: 9280578 - DNA, 22 bp, Homo sapiens
gcagcctccgcactgcgagtcc

SEQ ID NO: 9280579 - DNA, 22 bp, Homo sapiens
gcagcctctgatgatggccgta

SEQ ID NO: 9280580 - DNA, 22 bp, Homo sapiens
gcagctttggaggtggaactct

SEQ ID NO: 9280581 - DNA, 22 bp, Homo sapiens
gcagccctgcaggcagctccag

SEQ ID NO: 9280582 - DNA, 22 bp, Homo sapiens
gcagccctgcaggcagctccag

SEQ ID NO: 9280583 - DNA, 22 bp, Homo sapiens
gcagcctcaaactccccagctc

SEQ ID NO: 9280584 - DNA, 20 bp, Homo sapiens
gcagcctcaacaggcacagc

SEQ ID NO: 9280585 - DNA, 20 bp, Homo sapiens
gcagcctcaacaggcacagc

SEQ ID NO: 9280586 - DNA, 20 bp, Homo sapiens
gcagcctcaacaggcacagc

SEQ ID NO: 9280587 - DNA, 22 bp, Homo sapiens
gcagggctctgctgtagtccta

SEQ ID NO: 9280588 - DNA, 22 bp, Homo sapiens
gcagggctctgctgtagtccta

SEQ ID NO: 9280589 - DNA, 22 bp, Homo sapiens
gcagggctgaaggtcccaggcc

SEQ ID NO: 9280590 - DNA, 22 bp, Homo sapiens
gcagggcttagaaatggtggct

SEQ ID NO: 9280591 - DNA, 22 bp, Homo sapiens
gcagggcttgcagcagctagac

SEQ ID NO: 9280592 - DNA, 22 bp, Homo sapiens
gcagggctttttgaaacatggt

SEQ ID NO: 9280593 - DNA, 22 bp, Homo sapiens
gcaggggagtccactctatgca

SEQ ID NO: 9280594 - DNA, 22 bp, Homo sapiens
gcagggctgtggacactttggt

SEQ ID NO: 9280595 - DNA, 22 bp, Homo sapiens
gcagggctgtggacactttggt

SEQ ID NO: 9280596 - DNA, 22 bp, Homo sapiens
gcagggctgttcaggagggtgg

SEQ ID NO: 9280597 - DNA, 22 bp, Homo sapiens
gcagggctgttcaggagggtgg

SEQ ID NO: 9280598 - DNA, 22 bp, Homo sapiens
gcagggctgttcaggagggtgg

SEQ ID NO: 9280599 - DNA, 22 bp, Homo sapiens
gcagggctgttcaggagggtgg

SEQ ID NO: 9280600 - DNA, 22 bp, Homo sapiens
gcagggctgttcaggagggtgg

SEQ ID NO: 9280601 - DNA, 22 bp, Homo sapiens
gcagggcttagaaatggtggct

SEQ ID NO: 9280602 - DNA, 22 bp, Homo sapiens
gcagggctgggtgggagacaga

SEQ ID NO: 9280603 - DNA, 22 bp, Homo sapiens
gcagggctgtaatttgagcctg

SEQ ID NO: 9280604 - DNA, 22 bp, Homo sapiens
gcagggctgtaatttgagcctg

SEQ ID NO: 9280605 - DNA, 22 bp, Homo sapiens
gcagggctgggtgggagacaga

SEQ ID NO: 9280606 - DNA, 22 bp, Homo sapiens
gcagggctgggtgggagacaga

SEQ ID NO: 9280607 - DNA, 22 bp, Homo sapiens
gcagggctgggtgggagacaga

SEQ ID NO: 9280608 - DNA, 22 bp, Homo sapiens
gcagggctggggctgctcctga

SEQ ID NO: 9280609 - DNA, 22 bp, Homo sapiens
gcagggctgaaggtcccaggcc

SEQ ID NO: 9280610 - DNA, 22 bp, Homo sapiens
gcagggctgggtcctgtctcat

SEQ ID NO: 9280611 - DNA, 22 bp, Homo sapiens
gcagggaagacccggagcagcg

SEQ ID NO: 9280612 - DNA, 22 bp, Homo sapiens
gcaggcagttatttagtagaat

SEQ ID NO: 9280613 - DNA, 22 bp, Homo sapiens
gcaggcagttatttagtagaat

SEQ ID NO: 9280614 - DNA, 19 bp, Homo sapiens
gcaggcagtggcattcgga

SEQ ID NO: 9280615 - DNA, 22 bp, Homo sapiens
gcaggcagtcatctttcatatt

SEQ ID NO: 9280616 - DNA, 19 bp, Homo sapiens
gcaggcagtggcattcgga

SEQ ID NO: 9280617 - DNA, 22 bp, Homo sapiens
gcaggcagtcatctttcatatt

SEQ ID NO: 9280618 - DNA, 22 bp, Homo sapiens
gcagggaagatcttggagctgc

SEQ ID NO: 9280619 - DNA, 22 bp, Homo sapiens
gcagggaagggaaacagagacc

SEQ ID NO: 9280620 - DNA, 22 bp, Homo sapiens
gcagggacaactgtgcacctga

SEQ ID NO: 9280621 - DNA, 22 bp, Homo sapiens
gcaggcagatcacctgtcagga

SEQ ID NO: 9280622 - DNA, 22 bp, Homo sapiens
gcaggcagatcacctgtcagga

SEQ ID NO: 9280623 - DNA, 19 bp, Homo sapiens
gcaggcagctggggtatcc

SEQ ID NO: 9280624 - DNA, 22 bp, Homo sapiens
gcaggcaggtggcatcttgtga

SEQ ID NO: 9280625 - DNA, 22 bp, Homo sapiens
gcaggcaggtggcatcttgtga

SEQ ID NO: 9280626 - DNA, 16 bp, Homo sapiens
gcaggcagatcacatg

SEQ ID NO: 9280627 - DNA, 22 bp, Homo sapiens
gcaggcagatcacctgtcagga

SEQ ID NO: 9280628 - DNA, 22 bp, Homo sapiens
gcaggcagagtcaatttgatcc

SEQ ID NO: 9280629 - DNA, 22 bp, Homo sapiens
gcaaagaaatgtcagtgagagg

SEQ ID NO: 9280630 - DNA, 22 bp, Homo sapiens
gcaaagaatgcagatttgcctc

SEQ ID NO: 9280631 - DNA, 22 bp, Homo sapiens
gcaaactggcaaacctgtctgt

SEQ ID NO: 9280632 - DNA, 22 bp, Homo sapiens
gaggcccagcagcgcaggtctt

SEQ ID NO: 9280633 - DNA, 22 bp, Homo sapiens
gaggcccagcagcgcaggtctt

SEQ ID NO: 9280634 - DNA, 22 bp, Homo sapiens
gcaaactgttggagtagagtct

SEQ ID NO: 9280635 - DNA, 22 bp, Homo sapiens
gcaaagaaagccaaggtctaac

SEQ ID NO: 9280636 - DNA, 22 bp, Homo sapiens
gcaaagaaagccaaggtctaac

SEQ ID NO: 9280637 - DNA, 22 bp, Homo sapiens
gaggcccacagggagtaccaag

SEQ ID NO: 9280638 - DNA, 20 bp, Homo sapiens
gaggcccagagaggtgaagc

SEQ ID NO: 9280639 - DNA, 22 bp, Homo sapiens
gaggccatgaatggatgttcct

SEQ ID NO: 9280640 - DNA, 17 bp, Homo sapiens
gcaaaggtgaggagaga

SEQ ID NO: 9280641 - DNA, 22 bp, Homo sapiens
gcaaaggctagagacacaggga

SEQ ID NO: 9280642 - DNA, 22 bp, Homo sapiens
gcaaaggctagagacacaggga

SEQ ID NO: 9280643 - DNA, 22 bp, Homo sapiens
gcaaaggcttcttttattctcc

SEQ ID NO: 9280644 - DNA, 22 bp, Homo sapiens
gcaaagttcctactttactgga

SEQ ID NO: 9280645 - DNA, 22 bp, Homo sapiens
gcaaatacatgttgagcaccta

SEQ ID NO: 9280646 - DNA, 22 bp, Homo sapiens
gcaaataatatactttgatctc

SEQ ID NO: 9280647 - DNA, 22 bp, Homo sapiens
gcaaagctgggtgtgaatgcac

SEQ ID NO: 9280648 - DNA, 22 bp, Homo sapiens
gcaaagctgggtgtgaatgcac

SEQ ID NO: 9280649 - DNA, 22 bp, Homo sapiens
gcacaggctccggaggagagct

SEQ ID NO: 9280650 - DNA, 22 bp, Homo sapiens
gcacagggctgccaggcggctt

SEQ ID NO: 9280651 - DNA, 22 bp, Homo sapiens
gcacagtcaacacttattcacc

SEQ ID NO: 9280652 - DNA, 22 bp, Homo sapiens
gcacagtgataggcagttgtgc

SEQ ID NO: 9280653 - DNA, 22 bp, Homo sapiens
gcacaggttgcaaaagttcaca

SEQ ID NO: 9280654 - DNA, 22 bp, Homo sapiens
gcacaccctctcaccagcactg

SEQ ID NO: 9280655 - DNA, 19 bp, Homo sapiens
gcacaccctgcaccaccat

SEQ ID NO: 9280656 - DNA, 22 bp, Homo sapiens
gcacactgcggtgatgtgagtc

SEQ ID NO: 9280657 - DNA, 22 bp, Homo sapiens
gcacactgcggtgatgtgagtc

SEQ ID NO: 9280658 - DNA, 22 bp, Homo sapiens
gcacactgtgaatttgcatatg

SEQ ID NO: 9280659 - DNA, 22 bp, Homo sapiens
gcacagaaatgtctacacatgt

SEQ ID NO: 9280660 - DNA, 22 bp, Homo sapiens
gcacaggccatgggaggacagc

SEQ ID NO: 9280661 - DNA, 22 bp, Homo sapiens
gcacacagtagggattcaatga

SEQ ID NO: 9280662 - DNA, 22 bp, Homo sapiens
gcacacagaatcagtgggcata

SEQ ID NO: 9280663 - DNA, 22 bp, Homo sapiens
gcacacagtactatatgctaca

SEQ ID NO: 9280664 - DNA, 22 bp, Homo sapiens
gcacacagtactatatgctaca

SEQ ID NO: 9280665 - DNA, 19 bp, Homo sapiens
gcacacagtagggctggca

SEQ ID NO: 9280666 - DNA, 22 bp, Homo sapiens
gcacacagaacatttggatcct

SEQ ID NO: 9280667 - DNA, 22 bp, Homo sapiens
gcacacagaacatttggatcct

SEQ ID NO: 9280668 - DNA, 22 bp, Homo sapiens
gcacacagaatcagtgggcata

SEQ ID NO: 9280669 - DNA, 22 bp, Homo sapiens
gcacacagtatatgctcattaa

SEQ ID NO: 9280670 - DNA, 22 bp, Homo sapiens
gcacacagtatatgctcattaa

SEQ ID NO: 9280671 - DNA, 19 bp, Homo sapiens
gcacacagtagggctggca

SEQ ID NO: 9280672 - DNA, 22 bp, Homo sapiens
gcacacagtatatgctcattaa

SEQ ID NO: 9280673 - DNA, 22 bp, Homo sapiens
gcacacagtatatgctcattaa

SEQ ID NO: 9280674 - DNA, 19 bp, Homo sapiens
gcacacatacaccctttgg

SEQ ID NO: 9280675 - DNA, 20 bp, Homo sapiens
gcacacatagaaatgcatat

SEQ ID NO: 9280676 - DNA, 22 bp, Homo sapiens
gcacacatgcatgtgtgcatcc

SEQ ID NO: 9280677 - DNA, 22 bp, Homo sapiens
gcacacattctagccttttgtg

SEQ ID NO: 9280678 - DNA, 22 bp, Homo sapiens
gcacacattcggattcttaacc

SEQ ID NO: 9280679 - DNA, 22 bp, Homo sapiens
gcacatacgtcagtggctgtca

SEQ ID NO: 9280680 - DNA, 22 bp, Homo sapiens
gcacatgactttgaggaaacca

SEQ ID NO: 9280681 - DNA, 22 bp, Homo sapiens
gcacagttaaagggtcatgtga

SEQ ID NO: 9280682 - DNA, 21 bp, Homo sapiens
gcacagtgccaggcacacagt

SEQ ID NO: 9280683 - DNA, 22 bp, Homo sapiens
gcagagaaagttttgtcctcag

SEQ ID NO: 9280684 - DNA, 22 bp, Homo sapiens
gcagagaacccagcagattggc

SEQ ID NO: 9280685 - DNA, 22 bp, Homo sapiens
gcagagcaccaaagtgaaagat

SEQ ID NO: 9280686 - DNA, 18 bp, Homo sapiens
gcagagcagaagctcaag

SEQ ID NO: 9280687 - DNA, 22 bp, Homo sapiens
gcagagaagatgcccaggcttc

SEQ ID NO: 9280688 - DNA, 22 bp, Homo sapiens
gcagagattggtgcactgatga

SEQ ID NO: 9280689 - DNA, 22 bp, Homo sapiens
gcagactgcgtgaggcgccgcc

SEQ ID NO: 9280690 - DNA, 22 bp, Homo sapiens
gcagactgcgtgaggcgccgcc

SEQ ID NO: 9280691 - DNA, 21 bp, Homo sapiens
gcagactgccctgctgtcccc

SEQ ID NO: 9280692 - DNA, 22 bp, Homo sapiens
gcagactgtatcaatgtcagta

SEQ ID NO: 9280693 - DNA, 22 bp, Homo sapiens
gcagactggtcttcagccttgg

SEQ ID NO: 9280694 - DNA, 22 bp, Homo sapiens
gcagacatgggatctattcaca

SEQ ID NO: 9280695 - DNA, 22 bp, Homo sapiens
gcagacctcaggacatcattag

SEQ ID NO: 9280696 - DNA, 21 bp, Homo sapiens
gcagactgccctgctgtcccc

SEQ ID NO: 9280697 - DNA, 22 bp, Homo sapiens
gcagaggtcctagccaggagtc

SEQ ID NO: 9280698 - DNA, 22 bp, Homo sapiens
gcagagggtcctgtgccagcag

SEQ ID NO: 9280699 - DNA, 22 bp, Homo sapiens
gcagagggtcctgtgccagcag

SEQ ID NO: 9280700 - DNA, 22 bp, Homo sapiens
gcagatggactgtatgacctga

SEQ ID NO: 9280701 - DNA, 22 bp, Homo sapiens
gcagatggaaagtgcttgaggg

SEQ ID NO: 9280702 - DNA, 22 bp, Homo sapiens
gcagaggtctcttcaaaataat

SEQ ID NO: 9280703 - DNA, 22 bp, Homo sapiens
gcagaggtctagcaccaagaat

SEQ ID NO: 9280704 - DNA, 22 bp, Homo sapiens
gcagaggcagggccctcctcca

SEQ ID NO: 9280705 - DNA, 22 bp, Homo sapiens
gcagaggatagcatatgaacct

SEQ ID NO: 9280706 - DNA, 22 bp, Homo sapiens
gcagaggatcaggctctggaaa

SEQ ID NO: 9280707 - DNA, 22 bp, Homo sapiens
gcagaggatcaggctctggaaa

SEQ ID NO: 9280708 - DNA, 22 bp, Homo sapiens
gcagaggatcaggctctggaaa

SEQ ID NO: 9280709 - DNA, 22 bp, Homo sapiens
gcagagcagcaaatggaaagga

SEQ ID NO: 9280710 - DNA, 22 bp, Homo sapiens
gcagagcagaggtgcaggttgg

SEQ ID NO: 9280711 - DNA, 22 bp, Homo sapiens
gcagaggagtgattatgccgtg

SEQ ID NO: 9280712 - DNA, 22 bp, Homo sapiens
gcagaggatagcatatgaacct

SEQ ID NO: 9280713 - DNA, 22 bp, Homo sapiens
gcagagcagtactctcttgact

SEQ ID NO: 9280714 - DNA, 22 bp, Homo sapiens
gccttggctgatgtgcgaatga

SEQ ID NO: 9280715 - DNA, 22 bp, Homo sapiens
gccttggccttcctaggcctga

SEQ ID NO: 9280716 - DNA, 22 bp, Homo sapiens
gccttggccttcctaggcctga

SEQ ID NO: 9280717 - DNA, 22 bp, Homo sapiens
gccttgctaatttctcctcaac

SEQ ID NO: 9280718 - DNA, 22 bp, Homo sapiens
gccttggactcgggtggactca

SEQ ID NO: 9280719 - DNA, 23 bp, Homo sapiens
gccttggagaagtcactcaggga

SEQ ID NO: 9280720 - DNA, 22 bp, Homo sapiens
gccttggactaccactcccaca

SEQ ID NO: 9280721 - DNA, 20 bp, Homo sapiens
gcctgagctccgcctcctgt

SEQ ID NO: 9280722 - DNA, 20 bp, Homo sapiens
gcctgagctccgcctcctgt

SEQ ID NO: 9280723 - DNA, 22 bp, Homo sapiens
gcctgagccgcctgagcggcgg

SEQ ID NO: 9280724 - DNA, 22 bp, Homo sapiens
gcctgagctactagggagtctg

SEQ ID NO: 9280725 - DNA, 20 bp, Homo sapiens
gcctgagctattgccaggat

SEQ ID NO: 9280726 - DNA, 22 bp, Homo sapiens
gcctctgggttggtgacaggct

SEQ ID NO: 9280727 - DNA, 22 bp, Homo sapiens
gcctctggtccctcatgctgtg

SEQ ID NO: 9280728 - DNA, 22 bp, Homo sapiens
gcctctggtccctcatgctgtg

SEQ ID NO: 9280729 - DNA, 22 bp, Homo sapiens
gcctctggtccctcatgctgtg

SEQ ID NO: 9280730 - DNA, 22 bp, Homo sapiens
gcctctgggggctcagacctgt

SEQ ID NO: 9280731 - DNA, 22 bp, Homo sapiens
gcctgagcaggcgtggaccatg

SEQ ID NO: 9280732 - DNA, 22 bp, Homo sapiens
gcctgagcaggcgtggaccatg

SEQ ID NO: 9280733 - DNA, 22 bp, Homo sapiens
gcctgagcaggcgtggaccatg

SEQ ID NO: 9280734 - DNA, 21 bp, Homo sapiens
gcctgagcatgtcttcaggtc

SEQ ID NO: 9280735 - DNA, 19 bp, Homo sapiens
gcctgagccagccatgcaa

SEQ ID NO: 9280736 - DNA, 22 bp, Homo sapiens
gcctgagcccaggtgtgcagag

SEQ ID NO: 9280737 - DNA, 22 bp, Homo sapiens
gcctgagcccaggtgtgcagag

SEQ ID NO: 9280738 - DNA, 18 bp, Homo sapiens
gcctctgttgcttgcctg

SEQ ID NO: 9280739 - DNA, 22 bp, Homo sapiens
gcctctgtcatagctcatgtga

SEQ ID NO: 9280740 - DNA, 22 bp, Homo sapiens
gcgggtggatcatgaggtcagg

SEQ ID NO: 9280741 - DNA, 22 bp, Homo sapiens
gcgggtggatcatgaggtcagg

SEQ ID NO: 9280742 - DNA, 22 bp, Homo sapiens
gcctttcacagagatttaaaaa

SEQ ID NO: 9280743 - DNA, 22 bp, Homo sapiens
gcctttatgtctgaaaatcagc

SEQ ID NO: 9280744 - DNA, 22 bp, Homo sapiens
gcctttcagtgccttctgttca

SEQ ID NO: 9280745 - DNA, 22 bp, Homo sapiens
gcgtctcaaggcccccaggcca

SEQ ID NO: 9280746 - DNA, 22 bp, Homo sapiens
gcgtctcaaggcccccaggcca

SEQ ID NO: 9280747 - DNA, 22 bp, Homo sapiens
gcgtctcaaggcccccaggcca

SEQ ID NO: 9280748 - DNA, 22 bp, Homo sapiens
gctacaggggtcagtcctttgc

SEQ ID NO: 9280749 - DNA, 22 bp, Homo sapiens
gctacaggtatatagatgaaac

SEQ ID NO: 9280750 - DNA, 22 bp, Homo sapiens
gctacaggggtcagtcctttgc

SEQ ID NO: 9280751 - DNA, 22 bp, Homo sapiens
gctacaggtgacagcctctgca

SEQ ID NO: 9280752 - DNA, 22 bp, Homo sapiens
gctacaggagataaaggcctct

SEQ ID NO: 9280753 - DNA, 22 bp, Homo sapiens
gctacaggagctgtcacatgct

SEQ ID NO: 9280754 - DNA, 22 bp, Homo sapiens
gctacaggagataaaggcctct

SEQ ID NO: 9280755 - DNA, 22 bp, Homo sapiens
gcgtggggcagcccagggcttc

SEQ ID NO: 9280756 - DNA, 22 bp, Homo sapiens
gcgtgggctggactgggatgaa

SEQ ID NO: 9280757 - DNA, 22 bp, Homo sapiens
gcgtgggctggactgggatgaa

SEQ ID NO: 9280758 - DNA, 22 bp, Homo sapiens
gcgtgggctggactgggatgaa

SEQ ID NO: 9280759 - DNA, 22 bp, Homo sapiens
gcgtggcttagagtggggtacc

SEQ ID NO: 9280760 - DNA, 19 bp, Homo sapiens
gctcagagtccccctgcgg

SEQ ID NO: 9280761 - DNA, 19 bp, Homo sapiens
gctcagagtccccctgcgg

SEQ ID NO: 9280762 - DNA, 22 bp, Homo sapiens
gctactgtgaaggagtctttct

SEQ ID NO: 9280763 - DNA, 20 bp, Homo sapiens
gctactgtgggaaaattgtg

SEQ ID NO: 9280764 - DNA, 22 bp, Homo sapiens
gctacagtagataaggacggtc

SEQ ID NO: 9280765 - DNA, 20 bp, Homo sapiens
gctaccagaacaaggccatt

SEQ ID NO: 9280766 - DNA, 22 bp, Homo sapiens
gctccagggacccaagagaaaa

SEQ ID NO: 9280767 - DNA, 22 bp, Homo sapiens
gctccaggaggctcccgcgtct

SEQ ID NO: 9280768 - DNA, 21 bp, Homo sapiens
gctccctggctgtgtgacctg

SEQ ID NO: 9280769 - DNA, 20 bp, Homo sapiens
gctccctggtagaaatgttt

SEQ ID NO: 9280770 - DNA, 22 bp, Homo sapiens
gctccctggtagccatgctctc

SEQ ID NO: 9280771 - DNA, 23 bp, Homo sapiens
gctccctgtgctccaggagatgc

SEQ ID NO: 9280772 - DNA, 22 bp, Homo sapiens
gctccctggtattgctgccact

SEQ ID NO: 9280773 - DNA, 22 bp, Homo sapiens
gctccctggtattgctgccact

SEQ ID NO: 9280774 - DNA, 22 bp, Homo sapiens
gctccctggtagccatgctctc

SEQ ID NO: 9280775 - DNA, 17 bp, Homo sapiens
gctccctgaggacagct

SEQ ID NO: 9280776 - DNA, 17 bp, Homo sapiens
gctccctgaggacagct

SEQ ID NO: 9280777 - DNA, 22 bp, Homo sapiens
gctccctgcactctgcagccct

SEQ ID NO: 9280778 - DNA, 22 bp, Homo sapiens
gctccctgcactctgcagccct

SEQ ID NO: 9280779 - DNA, 22 bp, Homo sapiens
gctccctgcatttcccaccctt

SEQ ID NO: 9280780 - DNA, 22 bp, Homo sapiens
gctccctgcctacacggacctt

SEQ ID NO: 9280781 - DNA, 22 bp, Homo sapiens
gctcccaccaggcagacctacc

SEQ ID NO: 9280782 - DNA, 22 bp, Homo sapiens
gctcccaccgccgctatgggta

SEQ ID NO: 9280783 - DNA, 22 bp, Homo sapiens
gctcccaccgccgctatgggta

SEQ ID NO: 9280784 - DNA, 22 bp, Homo sapiens
gctcccacctccagcctgagtt

SEQ ID NO: 9280785 - DNA, 22 bp, Homo sapiens
gctcccacctttgctatcagta

SEQ ID NO: 9280786 - DNA, 22 bp, Homo sapiens
gctcccaccttaaccttcacat

SEQ ID NO: 9280787 - DNA, 22 bp, Homo sapiens
gctcccacctccagcctgagtt

SEQ ID NO: 9280788 - DNA, 22 bp, Homo sapiens
gctcccactgcagccctgagcc

SEQ ID NO: 9280789 - DNA, 22 bp, Homo sapiens
gctcccacgcaattcttttcag

SEQ ID NO: 9280790 - DNA, 22 bp, Homo sapiens
gctcccagaaccaaggctgggg

SEQ ID NO: 9280791 - DNA, 22 bp, Homo sapiens
gctcccagaaccaaggctgggg

SEQ ID NO: 9280792 - DNA, 22 bp, Homo sapiens
gctcccagactgaccagaggtg

SEQ ID NO: 9280793 - DNA, 22 bp, Homo sapiens
gctccctgaaaagaacaaagtc

SEQ ID NO: 9280794 - DNA, 20 bp, Homo sapiens
gctccaggtcagagaggacg

SEQ ID NO: 9280795 - DNA, 22 bp, Homo sapiens
gctcccacaaccttcttgctcc

SEQ ID NO: 9280796 - DNA, 22 bp, Homo sapiens
gctcccacaaccttcttgctcc

SEQ ID NO: 9280797 - DNA, 22 bp, Homo sapiens
gctcccaactcaggcctcctcc

SEQ ID NO: 9280798 - DNA, 22 bp, Homo sapiens
gctccagtggatacagcagtgg

SEQ ID NO: 9280799 - DNA, 22 bp, Homo sapiens
gctccaggtgtcccaggtaaaa

SEQ ID NO: 9280800 - DNA, 22 bp, Homo sapiens
gctgccctacccgaggcactct

SEQ ID NO: 9280801 - DNA, 18 bp, Homo sapiens
gctgccctagctcccctc

SEQ ID NO: 9280802 - DNA, 18 bp, Homo sapiens
gctgccctagctcccctc

SEQ ID NO: 9280803 - DNA, 22 bp, Homo sapiens
gctgccctgtggtccagcaggt

SEQ ID NO: 9280804 - DNA, 22 bp, Homo sapiens
gctgccctaatatcacatgtta

SEQ ID NO: 9280805 - DNA, 22 bp, Homo sapiens
gctgcccattccactggatggt

SEQ ID NO: 9280806 - DNA, 22 bp, Homo sapiens
gctgcccattgcacgttgtggc

SEQ ID NO: 9280807 - DNA, 22 bp, Homo sapiens
gctgcctcaggcacctcctggc

SEQ ID NO: 9280808 - DNA, 22 bp, Homo sapiens
gctgcctcactccagcccaata

SEQ ID NO: 9280809 - DNA, 22 bp, Homo sapiens
gctgccctgtggtccagcaggt

SEQ ID NO: 9280810 - DNA, 22 bp, Homo sapiens
gctgccctgtggtccagcaggt

SEQ ID NO: 9280811 - DNA, 22 bp, Homo sapiens
gctgcctgtcctgaggagtccg

SEQ ID NO: 9280812 - DNA, 22 bp, Homo sapiens
gctgcctcaggcacctcctggc

SEQ ID NO: 9280813 - DNA, 22 bp, Homo sapiens
gctgcctcaggcacctcctggc

SEQ ID NO: 9280814 - DNA, 22 bp, Homo sapiens
gctgagggctgtaacagcagag

SEQ ID NO: 9280815 - DNA, 22 bp, Homo sapiens
gctgagggctgtaacagcagag

SEQ ID NO: 9280816 - DNA, 22 bp, Homo sapiens
gctgagggcatgtgtggcgact

SEQ ID NO: 9280817 - DNA, 22 bp, Homo sapiens
gctgagggcatgtgtggcgact

SEQ ID NO: 9280818 - DNA, 22 bp, Homo sapiens
gctgcccagttctgctgctgcc

SEQ ID NO: 9280819 - DNA, 22 bp, Homo sapiens
gctgcccagcaggccccagggg

SEQ ID NO: 9280820 - DNA, 22 bp, Homo sapiens
gctgcttcctttcctgctgacc

SEQ ID NO: 9280821 - DNA, 22 bp, Homo sapiens
gctgcttctctgatggagtcca

SEQ ID NO: 9280822 - DNA, 22 bp, Homo sapiens
gctgcttgattaggttgacact

SEQ ID NO: 9280823 - DNA, 22 bp, Homo sapiens
gctgcttcctttcctgctgacc

SEQ ID NO: 9280824 - DNA, 22 bp, Homo sapiens
gctgcttcagggacgtgccagc

SEQ ID NO: 9280825 - DNA, 22 bp, Homo sapiens
gctgctgtgttggccactgctt

SEQ ID NO: 9280826 - DNA, 22 bp, Homo sapiens
gctgctgtgttggccactgctt

SEQ ID NO: 9280827 - DNA, 22 bp, Homo sapiens
gctgctgttcctccagtggatc

SEQ ID NO: 9280828 - DNA, 22 bp, Homo sapiens
gctgctgttcctccagtggatc

SEQ ID NO: 9280829 - DNA, 22 bp, Homo sapiens
gctgctgtgtgggagacaggcg

SEQ ID NO: 9280830 - DNA, 22 bp, Homo sapiens
gctgctgtgttggagagggact

SEQ ID NO: 9280831 - DNA, 22 bp, Homo sapiens
gctgctccagtgttctgtctag

SEQ ID NO: 9280832 - DNA, 22 bp, Homo sapiens
gctgctccgtctgagctctggt

SEQ ID NO: 9280833 - DNA, 21 bp, Homo sapiens
gctgctgtgggccagggaggc

SEQ ID NO: 9280834 - DNA, 21 bp, Homo sapiens
gctgctcgagatccagtgctt

SEQ ID NO: 9280835 - DNA, 22 bp, Homo sapiens
gctgcctgtgtggccactcact

SEQ ID NO: 9280836 - DNA, 22 bp, Homo sapiens
gctgcctgttgaagggtctgtg

SEQ ID NO: 9280837 - DNA, 22 bp, Homo sapiens
gctgcctgtgtggccactcact

SEQ ID NO: 9280838 - DNA, 22 bp, Homo sapiens
gctgcctgtggcccttctgggt

SEQ ID NO: 9280839 - DNA, 22 bp, Homo sapiens
gctgcctgtggcccttctgggt

SEQ ID NO: 9280840 - DNA, 22 bp, Homo sapiens
gctgcctgtcctgaggagtccg

SEQ ID NO: 9280841 - DNA, 20 bp, Homo sapiens
gctgcctgtttctgtaagta

SEQ ID NO: 9280842 - DNA, 20 bp, Homo sapiens
gctgcctgtttctgtaagta

SEQ ID NO: 9280843 - DNA, 20 bp, Homo sapiens
gctgcctgtttctgtaagta

SEQ ID NO: 9280844 - DNA, 22 bp, Homo sapiens
gctgccttatgtctattagtat

SEQ ID NO: 9280845 - DNA, 22 bp, Homo sapiens
gctctgggattaccagccttag

SEQ ID NO: 9280846 - DNA, 20 bp, Homo sapiens
gctctgggagggatgtgatg

SEQ ID NO: 9280847 - DNA, 22 bp, Homo sapiens
gctctgggccatcctggccggg

SEQ ID NO: 9280848 - DNA, 22 bp, Homo sapiens
gctctgggccgggcaccagcct

SEQ ID NO: 9280849 - DNA, 22 bp, Homo sapiens
gctctgggctgccctctggaca

SEQ ID NO: 9280850 - DNA, 22 bp, Homo sapiens
gctctgggctgccctctggaca

SEQ ID NO: 9280851 - DNA, 22 bp, Homo sapiens
gctctggggatgcttctgccgt

SEQ ID NO: 9280852 - DNA, 22 bp, Homo sapiens
gctgaatgaatgtattttaaaa

SEQ ID NO: 9280853 - DNA, 18 bp, Homo sapiens
gctgaatgtctgctttgc

SEQ ID NO: 9280854 - DNA, 23 bp, Homo sapiens
gctgaatgtaatgttctttgggt

SEQ ID NO: 9280855 - DNA, 18 bp, Homo sapiens
gctctggctcacctccag

SEQ ID NO: 9280856 - DNA, 22 bp, Homo sapiens
gctctggctcaaaccaccggct

SEQ ID NO: 9280857 - DNA, 18 bp, Homo sapiens
gctctggctcacctccag

SEQ ID NO: 9280858 - DNA, 22 bp, Homo sapiens
gctctgggaactgactgccttc

SEQ ID NO: 9280859 - DNA, 22 bp, Homo sapiens
gctctggcttggggcactcgtc

SEQ ID NO: 9280860 - DNA, 22 bp, Homo sapiens
gctctgggaactgactgccttc

SEQ ID NO: 9280861 - DNA, 22 bp, Homo sapiens
gctctgggaactgactgccttc

SEQ ID NO: 9280862 - DNA, 22 bp, Homo sapiens
gctccctgttctcagccatgat

SEQ ID NO: 9280863 - DNA, 22 bp, Homo sapiens
gctccgtgggcattgctaggtg

SEQ ID NO: 9280864 - DNA, 22 bp, Homo sapiens
gctccctgttctcagccatgat

SEQ ID NO: 9280865 - DNA, 22 bp, Homo sapiens
gctctggctagttacctcttac

SEQ ID NO: 9280866 - DNA, 22 bp, Homo sapiens
gctcctccctgtgcagacccag

SEQ ID NO: 9280867 - DNA, 22 bp, Homo sapiens
gctcctccaatatggactcctc

SEQ ID NO: 9280868 - DNA, 22 bp, Homo sapiens
gctcctccctgtgcagacccag

SEQ ID NO: 9280869 - DNA, 22 bp, Homo sapiens
gctgaggctcaagtcatgggtc

SEQ ID NO: 9280870 - DNA, 22 bp, Homo sapiens
gctgaggctcaagtcatgggtc

SEQ ID NO: 9280871 - DNA, 22 bp, Homo sapiens
gctgaggcggaaggattgctag

SEQ ID NO: 9280872 - DNA, 22 bp, Homo sapiens
gctgaggcctcagaaggctgag

SEQ ID NO: 9280873 - DNA, 22 bp, Homo sapiens
gctgaggcctcagaaggctgag

SEQ ID NO: 9280874 - DNA, 22 bp, Homo sapiens
gctgaggccccagggtgatggg

SEQ ID NO: 9280875 - DNA, 22 bp, Homo sapiens
gctgaggccccagggtgatggg

SEQ ID NO: 9280876 - DNA, 22 bp, Homo sapiens
gctgaggccagtttaatgagga

SEQ ID NO: 9280877 - DNA, 22 bp, Homo sapiens
gctgaggccccagggtgatggg

SEQ ID NO: 9280878 - DNA, 22 bp, Homo sapiens
gctgagagtgggtgcagtgctt

SEQ ID NO: 9280879 - DNA, 22 bp, Homo sapiens
gctgaggccaggccccaccgga

SEQ ID NO: 9280880 - DNA, 22 bp, Homo sapiens
gctgaggccaggccccaccgga

SEQ ID NO: 9280881 - DNA, 22 bp, Homo sapiens
gctgaggctgggagcagcctgt

SEQ ID NO: 9280882 - DNA, 22 bp, Homo sapiens
gctgaggctgggagcagcctgt

SEQ ID NO: 9280883 - DNA, 22 bp, Homo sapiens
gctgaggctgggagcagcctgt

SEQ ID NO: 9280884 - DNA, 22 bp, Homo sapiens
gctgagggaggctgaactgagt

SEQ ID NO: 9280885 - DNA, 22 bp, Homo sapiens
gctgaggctgggagcagcctgt

SEQ ID NO: 9280886 - DNA, 22 bp, Homo sapiens
gctgaggctcctcgggaggaca

SEQ ID NO: 9280887 - DNA, 22 bp, Homo sapiens
gctgagactggcagcaggaagt

SEQ ID NO: 9280888 - DNA, 22 bp, Homo sapiens
gctgagactggcagcaggaagt

SEQ ID NO: 9280889 - DNA, 22 bp, Homo sapiens
gctgagagatcaaggcaggatt

SEQ ID NO: 9280890 - DNA, 22 bp, Homo sapiens
gctgagagatcaaggcaggatt

SEQ ID NO: 9280891 - DNA, 22 bp, Homo sapiens
gctgagagaaaagtgaggttct

SEQ ID NO: 9280892 - DNA, 22 bp, Homo sapiens
gctgagagatcaaggcaggatt

SEQ ID NO: 9280893 - DNA, 22 bp, Homo sapiens
gctgagagtgagcactggatat

SEQ ID NO: 9280894 - DNA, 22 bp, Homo sapiens
gctgagagtccaggaaaacatc

SEQ ID NO: 9280895 - DNA, 17 bp, Homo sapiens
gctgagaggcagcacag

SEQ ID NO: 9280896 - DNA, 17 bp, Homo sapiens
gctgagaggcagcacag

SEQ ID NO: 9280897 - DNA, 22 bp, Homo sapiens
gctgagaggcagccagaccctc

SEQ ID NO: 9280898 - DNA, 22 bp, Homo sapiens
gctgagagcaaggacaaagcat

SEQ ID NO: 9280899 - DNA, 22 bp, Homo sapiens
gctgagagcaaagcatgtctag

SEQ ID NO: 9280900 - DNA, 22 bp, Homo sapiens
gctgagagcggccagctgggaa

SEQ ID NO: 9280901 - DNA, 22 bp, Homo sapiens
gctggctgtgattttgccaaca

SEQ ID NO: 9280902 - DNA, 21 bp, Homo sapiens
gctggctggctgaccggcctt

SEQ ID NO: 9280903 - DNA, 17 bp, Homo sapiens
gctggcttctccttgct

SEQ ID NO: 9280904 - DNA, 22 bp, Homo sapiens
gctggcttgacagaggcctggg

SEQ ID NO: 9280905 - DNA, 22 bp, Homo sapiens
gctggcttccttctgcagctag

SEQ ID NO: 9280906 - DNA, 22 bp, Homo sapiens
gctggcttgtcccaggacaaag

SEQ ID NO: 9280907 - DNA, 22 bp, Homo sapiens
gctggcttgatagtttctgctt

SEQ ID NO: 9280908 - DNA, 22 bp, Homo sapiens
gctggcttccctacctgcacct

SEQ ID NO: 9280909 - DNA, 22 bp, Homo sapiens
gctggcttccatcagagggtga

SEQ ID NO: 9280910 - DNA, 21 bp, Homo sapiens
gctggcttcctgagggctgag

SEQ ID NO: 9280911 - DNA, 22 bp, Homo sapiens
gctggcttaatagggatgggct

SEQ ID NO: 9280912 - DNA, 22 bp, Homo sapiens
gctggctttgtggtctctcctc

SEQ ID NO: 9280913 - DNA, 22 bp, Homo sapiens
gctggcttttgaagtctagcta

SEQ ID NO: 9280914 - DNA, 22 bp, Homo sapiens
gctggctttgtcaagggcagca

SEQ ID NO: 9280915 - DNA, 22 bp, Homo sapiens
gctggctttgatcttcccatct

SEQ ID NO: 9280916 - DNA, 22 bp, Homo sapiens
gctggctttgcactgggtgcat

SEQ ID NO: 9280917 - DNA, 21 bp, Homo sapiens
gctggctttattctgcgtttg

SEQ ID NO: 9280918 - DNA, 22 bp, Homo sapiens
gctggctttatcgtcagactcc

SEQ ID NO: 9280919 - DNA, 22 bp, Homo sapiens
gctggctttatggggcttgtgg

SEQ ID NO: 9280920 - DNA, 22 bp, Homo sapiens
gctgggcttcacctccagagtt

SEQ ID NO: 9280921 - DNA, 22 bp, Homo sapiens
gctgggcttcacctccagagtt

SEQ ID NO: 9280922 - DNA, 22 bp, Homo sapiens
gctgggcttcacctccagagtt

SEQ ID NO: 9280923 - DNA, 22 bp, Homo sapiens
gctgggcttctcaatgctgcct

SEQ ID NO: 9280924 - DNA, 23 bp, Homo sapiens
gctgggcttactctttcagtgag

SEQ ID NO: 9280925 - DNA, 22 bp, Homo sapiens
gctgggcttcacagagccttta

SEQ ID NO: 9280926 - DNA, 22 bp, Homo sapiens
gctgggctgtagtttgctgacc

SEQ ID NO: 9280927 - DNA, 22 bp, Homo sapiens
gctgggctgtagtttgctgacc

SEQ ID NO: 9280928 - DNA, 22 bp, Homo sapiens
gctgggctggccgccgagatcg

SEQ ID NO: 9280929 - DNA, 22 bp, Homo sapiens
gctggagagataggcatggggt

SEQ ID NO: 9280930 - DNA, 22 bp, Homo sapiens
gctggagagataggcatggggt

SEQ ID NO: 9280931 - DNA, 22 bp, Homo sapiens
gctggagagataggcatggggt

SEQ ID NO: 9280932 - DNA, 22 bp, Homo sapiens
gctggagagataggcatggggt

SEQ ID NO: 9280933 - DNA, 22 bp, Homo sapiens
gctggagaaactgcagctgagg

SEQ ID NO: 9280934 - DNA, 22 bp, Homo sapiens
gctggagaaactgcagctgagg

SEQ ID NO: 9280935 - DNA, 20 bp, Homo sapiens
gctgctttcaaatgacacgt

SEQ ID NO: 9280936 - DNA, 22 bp, Homo sapiens
gctgctttagaattgaaacaga

SEQ ID NO: 9280937 - DNA, 22 bp, Homo sapiens
gctgctttactgaagagatatg

SEQ ID NO: 9280938 - DNA, 22 bp, Homo sapiens
gctgctttagaattgaaacaga

SEQ ID NO: 9280939 - DNA, 23 bp, Homo sapiens
gctggctggcagtaaaggttgtt

SEQ ID NO: 9280940 - DNA, 19 bp, Homo sapiens
gctggggcctgaccagaca

SEQ ID NO: 9280941 - DNA, 22 bp, Homo sapiens
gctggggctgggctgaggaaga

SEQ ID NO: 9280942 - DNA, 22 bp, Homo sapiens
gctggggcctgaacagtcagct

SEQ ID NO: 9280943 - DNA, 22 bp, Homo sapiens
gctggggcctgaacagtcagct

SEQ ID NO: 9280944 - DNA, 19 bp, Homo sapiens
gctggggcctgaccagaca

SEQ ID NO: 9280945 - DNA, 22 bp, Homo sapiens
gctgtgctgattcattccctgc

SEQ ID NO: 9280946 - DNA, 19 bp, Homo sapiens
gctgtgcctctctcctgct

SEQ ID NO: 9280947 - DNA, 20 bp, Homo sapiens
gctgtgcctccagctggtgg

SEQ ID NO: 9280948 - DNA, 22 bp, Homo sapiens
gctggggctgggctgaggaaga

SEQ ID NO: 9280949 - DNA, 22 bp, Homo sapiens
gctggggctgggctgaggaaga

SEQ ID NO: 9280950 - DNA, 22 bp, Homo sapiens
gctgggcttggtttccctgctt

SEQ ID NO: 9280951 - DNA, 22 bp, Homo sapiens
gctggggaggcagcagagaaca

SEQ ID NO: 9280952 - DNA, 22 bp, Homo sapiens
gctgggcttggtttccctgctt

SEQ ID NO: 9280953 - DNA, 22 bp, Homo sapiens
gctgggcttctcaatgctgcct

SEQ ID NO: 9280954 - DNA, 22 bp, Homo sapiens
gctggggcctgaacagtcagct

SEQ ID NO: 9280955 - DNA, 22 bp, Homo sapiens
gctggggcctctgtgaggttaa

SEQ ID NO: 9280956 - DNA, 22 bp, Homo sapiens
gctggggcctctgtgaggttaa

SEQ ID NO: 9280957 - DNA, 22 bp, Homo sapiens
gctgtggctgtacagagaccat

SEQ ID NO: 9280958 - DNA, 22 bp, Homo sapiens
gctgtggctgaccaccaggggg

SEQ ID NO: 9280959 - DNA, 22 bp, Homo sapiens
gctgtggcttgcagctggggct

SEQ ID NO: 9280960 - DNA, 22 bp, Homo sapiens
gctgtggctgaagatgcaggga

SEQ ID NO: 9280961 - DNA, 22 bp, Homo sapiens
gctgtggctgaagatgcaggga

SEQ ID NO: 9280962 - DNA, 22 bp, Homo sapiens
gctgtggctctcacaagcaaat

SEQ ID NO: 9280963 - DNA, 22 bp, Homo sapiens
gctgtggctccaatggtgagcc

SEQ ID NO: 9280964 - DNA, 22 bp, Homo sapiens
gctgtggcggcagcagctggtg

SEQ ID NO: 9280965 - DNA, 22 bp, Homo sapiens
gctgtgtatcagatgccacggg

SEQ ID NO: 9280966 - DNA, 22 bp, Homo sapiens
gctgtgtatcagatgccacggg

SEQ ID NO: 9280967 - DNA, 22 bp, Homo sapiens
gctgtgtcctcacacagccttt

SEQ ID NO: 9280968 - DNA, 22 bp, Homo sapiens
gctgtgtgaaaactgggcctgg

SEQ ID NO: 9280969 - DNA, 22 bp, Homo sapiens
gctgtgtgaaaactgggcctgg

SEQ ID NO: 9280970 - DNA, 21 bp, Homo sapiens
gcttctgtatctagcaggaac

SEQ ID NO: 9280971 - DNA, 22 bp, Homo sapiens
gcttctgtgagtgcagatgctg

SEQ ID NO: 9280972 - DNA, 22 bp, Homo sapiens
gcttctgtggattggctggctt

SEQ ID NO: 9280973 - DNA, 22 bp, Homo sapiens
gcttctgtggattggctggctt

SEQ ID NO: 9280974 - DNA, 22 bp, Homo sapiens
gcttctgtggtgaggtcacctt

SEQ ID NO: 9280975 - DNA, 21 bp, Homo sapiens
gcttctgtatctagcaggaac

SEQ ID NO: 9280976 - DNA, 22 bp, Homo sapiens
gcttctgtatttattgtccttt

SEQ ID NO: 9280977 - DNA, 22 bp, Homo sapiens
gcttctgtcttagctacctccc

SEQ ID NO: 9280978 - DNA, 22 bp, Homo sapiens
gcttctgttaacttatgttccc

SEQ ID NO: 9280979 - DNA, 22 bp, Homo sapiens
gcttctgtggttgtcacgacta

SEQ ID NO: 9280980 - DNA, 22 bp, Homo sapiens
gcttctgtggtgcatctttgct

SEQ ID NO: 9280981 - DNA, 22 bp, Homo sapiens
gcttctgttcaaggatataagg

SEQ ID NO: 9280982 - DNA, 19 bp, Homo sapiens
gcttctgtttgggcttaga

SEQ ID NO: 9280983 - DNA, 19 bp, Homo sapiens
gcttctgtttgggcttaga

SEQ ID NO: 9280984 - DNA, 22 bp, Homo sapiens
gcttgaaaatgactcttgtgaa

SEQ ID NO: 9280985 - DNA, 22 bp, Homo sapiens
gcttgaaaatgactcttgtgaa

SEQ ID NO: 9280986 - DNA, 22 bp, Homo sapiens
gcttgagttttgggacaaagcc

SEQ ID NO: 9280987 - DNA, 23 bp, Homo sapiens
gcttgcctggtgtgtggctgacc

SEQ ID NO: 9280988 - DNA, 22 bp, Homo sapiens
gcttgcctggcatttctggggc

SEQ ID NO: 9280989 - DNA, 22 bp, Homo sapiens
gcttgcctatctggtggtcgtt

SEQ ID NO: 9280990 - DNA, 17 bp, Homo sapiens
gcttgccttgtcttcct

SEQ ID NO: 9280991 - DNA, 18 bp, Homo sapiens
gctttatttcttggggaa

SEQ ID NO: 9280992 - DNA, 20 bp, Homo sapiens
gcttgctttgtctgatgggc

SEQ ID NO: 9280993 - DNA, 22 bp, Homo sapiens
gcttgcttatttgcccttctcc

SEQ ID NO: 9280994 - DNA, 22 bp, Homo sapiens
ggacagtgaatgtggggatgca

SEQ ID NO: 9280995 - DNA, 22 bp, Homo sapiens
ggacaggtgtgaggctggcaca

SEQ ID NO: 9280996 - DNA, 22 bp, Homo sapiens
ggacacagtggaagacagcttg

SEQ ID NO: 9280997 - DNA, 22 bp, Homo sapiens
ggacacagtggaagacagcttg

SEQ ID NO: 9280998 - DNA, 22 bp, Homo sapiens
ggacagggtaagtactagtgtg

SEQ ID NO: 9280999 - DNA, 22 bp, Homo sapiens
ggacacagctgcagccacaccc

SEQ ID NO: 9281000 - DNA, 22 bp, Homo sapiens
ggacacagctgcagccacaccc

SEQ ID NO: 9281001 - DNA, 20 bp, Homo sapiens
ggaccaggtggggcggtggc

SEQ ID NO: 9281002 - DNA, 20 bp, Homo sapiens
ggaccaggtggggcggtggc

SEQ ID NO: 9281003 - DNA, 19 bp, Homo sapiens
ggaccaggtcctgggcagc

SEQ ID NO: 9281004 - DNA, 22 bp, Homo sapiens
ggaccatctctagccagagctt

SEQ ID NO: 9281005 - DNA, 22 bp, Homo sapiens
ggagacagggttgaaccacgca

SEQ ID NO: 9281006 - DNA, 22 bp, Homo sapiens
ggagacagtatggcttgtagct

SEQ ID NO: 9281007 - DNA, 22 bp, Homo sapiens
ggagacagtatggcttgtagct

SEQ ID NO: 9281008 - DNA, 22 bp, Homo sapiens
ggagacagtatggcttgtagct

SEQ ID NO: 9281009 - DNA, 20 bp, Homo sapiens
ggaccagctgtctgaggggc

SEQ ID NO: 9281010 - DNA, 22 bp, Homo sapiens
ggagagagacctccatgcccag

SEQ ID NO: 9281011 - DNA, 22 bp, Homo sapiens
ggagcaggctctgtggtttcca

SEQ ID NO: 9281012 - DNA, 22 bp, Homo sapiens
ggagcagatgtcttcatggcct

SEQ ID NO: 9281013 - DNA, 22 bp, Homo sapiens
ggagcagcactgccacacagag

SEQ ID NO: 9281014 - DNA, 22 bp, Homo sapiens
ggagcatctgaacagggagaag

SEQ ID NO: 9281015 - DNA, 22 bp, Homo sapiens
ggagccagagcactggggagcc

SEQ ID NO: 9281016 - DNA, 22 bp, Homo sapiens
ggagacagtgacttagagactg

SEQ ID NO: 9281017 - DNA, 22 bp, Homo sapiens
ggagacagtgacttagagactg

SEQ ID NO: 9281018 - DNA, 22 bp, Homo sapiens
ggagacagtgacttagagactg

SEQ ID NO: 9281019 - DNA, 22 bp, Homo sapiens
ggagacagtggtagggcctaag

SEQ ID NO: 9281020 - DNA, 22 bp, Homo sapiens
ggagacagtggtagggcctaag

SEQ ID NO: 9281021 - DNA, 22 bp, Homo sapiens
ggagacagtggtagggcctaag

SEQ ID NO: 9281022 - DNA, 19 bp, Homo sapiens
ggagactcagcccatgcct

SEQ ID NO: 9281023 - DNA, 22 bp, Homo sapiens
ggagaccaggtcagagatggtg

SEQ ID NO: 9281024 - DNA, 22 bp, Homo sapiens
ggagaccaggtcagagatggtg

SEQ ID NO: 9281025 - DNA, 22 bp, Homo sapiens
ggagacccaggttaggaagtaa

SEQ ID NO: 9281026 - DNA, 22 bp, Homo sapiens
ggagacttggcttggatgcttc

SEQ ID NO: 9281027 - DNA, 22 bp, Homo sapiens
ggagacttgagtttttgtctta

SEQ ID NO: 9281028 - DNA, 22 bp, Homo sapiens
gctttctgatgagcttaagaaa

SEQ ID NO: 9281029 - DNA, 22 bp, Homo sapiens
gctttctgattgcgaaaacaaa

SEQ ID NO: 9281030 - DNA, 22 bp, Homo sapiens
gctttctgcctgggctccattt

SEQ ID NO: 9281031 - DNA, 22 bp, Homo sapiens
gctttgctggcttgaaatgctg

SEQ ID NO: 9281032 - DNA, 20 bp, Homo sapiens
gctttctatgagatggactg

SEQ ID NO: 9281033 - DNA, 22 bp, Homo sapiens
gctttctcttcactgatgttca

SEQ ID NO: 9281034 - DNA, 22 bp, Homo sapiens
gctttctgaagcagtgtttctc

SEQ ID NO: 9281035 - DNA, 22 bp, Homo sapiens
gctttgcttcctgttctagcct

SEQ ID NO: 9281036 - DNA, 22 bp, Homo sapiens
gctttggaaatatagactcaag

SEQ ID NO: 9281037 - DNA, 22 bp, Homo sapiens
gctttcctggccctgtccctgc

SEQ ID NO: 9281038 - DNA, 17 bp, Homo sapiens
gctttccttgcccctcc

SEQ ID NO: 9281039 - DNA, 22 bp, Homo sapiens
gctttattttgtgagggattac

SEQ ID NO: 9281040 - DNA, 22 bp, Homo sapiens
ggaagaggctgagccaggtccc

SEQ ID NO: 9281041 - DNA, 22 bp, Homo sapiens
ggaagaggctctcattgagggc

SEQ ID NO: 9281042 - DNA, 22 bp, Homo sapiens
ggaagaggctgagccaggtccc

SEQ ID NO: 9281043 - DNA, 22 bp, Homo sapiens
ggaagaggctctcattgagggc

SEQ ID NO: 9281044 - DNA, 22 bp, Homo sapiens
ggaagacagaagcctacagctt

SEQ ID NO: 9281045 - DNA, 22 bp, Homo sapiens
ggaagaagcagggcatttgaat

SEQ ID NO: 9281046 - DNA, 22 bp, Homo sapiens
ggaagcagcctgaagccaaggg

SEQ ID NO: 9281047 - DNA, 22 bp, Homo sapiens
ggaagatgcccaacccagcttt

SEQ ID NO: 9281048 - DNA, 22 bp, Homo sapiens
ggacacagccacttagggtacc

SEQ ID NO: 9281049 - DNA, 18 bp, Homo sapiens
ggacacagataggtacag

SEQ ID NO: 9281050 - DNA, 17 bp, Homo sapiens
ggacacagctcatggct

SEQ ID NO: 9281051 - DNA, 22 bp, Homo sapiens
ggaattctgtagctcttcctct

SEQ ID NO: 9281052 - DNA, 22 bp, Homo sapiens
ggaatgggagctattagtggaa

SEQ ID NO: 9281053 - DNA, 22 bp, Homo sapiens
ggaatgttctggtctggttcat

SEQ ID NO: 9281054 - DNA, 22 bp, Homo sapiens
ggaatgatggtgcctagattat

SEQ ID NO: 9281055 - DNA, 22 bp, Homo sapiens
ggaatctttgaaggattttaag

SEQ ID NO: 9281056 - DNA, 22 bp, Homo sapiens
gggagaagtggaaatctcatta

SEQ ID NO: 9281057 - DNA, 23 bp, Homo sapiens
gggagaatatgaggatgatggtg

SEQ ID NO: 9281058 - DNA, 22 bp, Homo sapiens
gggacatggaggcgcgcaggca

SEQ ID NO: 9281059 - DNA, 22 bp, Homo sapiens
gggaccagaagaaggatggtga

SEQ ID NO: 9281060 - DNA, 22 bp, Homo sapiens
gggacaggctgagacttgagct

SEQ ID NO: 9281061 - DNA, 22 bp, Homo sapiens
gggacatctttctagtcagggt

SEQ ID NO: 9281062 - DNA, 22 bp, Homo sapiens
gggacatctttctagtcagggt

SEQ ID NO: 9281063 - DNA, 22 bp, Homo sapiens
gggacatgaagcatcggaggca

SEQ ID NO: 9281064 - DNA, 22 bp, Homo sapiens
gggacaggctgagacttgagct

SEQ ID NO: 9281065 - DNA, 22 bp, Homo sapiens
gggacaggctgagacttgagct

SEQ ID NO: 9281066 - DNA, 22 bp, Homo sapiens
gggacaggcccctcgctagctt

SEQ ID NO: 9281067 - DNA, 22 bp, Homo sapiens
ggcttggctacaagccatgggc

SEQ ID NO: 9281068 - DNA, 22 bp, Homo sapiens
ggcttgggagcaggcatgtgac

SEQ ID NO: 9281069 - DNA, 22 bp, Homo sapiens
ggctttaaggagtaaaaatgcc

SEQ ID NO: 9281070 - DNA, 22 bp, Homo sapiens
gggacagcagaaagaaggcaag

SEQ ID NO: 9281071 - DNA, 22 bp, Homo sapiens
gggacaggcaaaggtatgcttc

SEQ ID NO: 9281072 - DNA, 22 bp, Homo sapiens
gggagacacgctgcaggcataa

SEQ ID NO: 9281073 - DNA, 22 bp, Homo sapiens
gggagactagtgctatgttttc

SEQ ID NO: 9281074 - DNA, 22 bp, Homo sapiens
gggagacccccaatgccaggtc

SEQ ID NO: 9281075 - DNA, 22 bp, Homo sapiens
gggagacccccaatgccaggtc

SEQ ID NO: 9281076 - DNA, 20 bp, Homo sapiens
gggagacagggccagtgtcc

SEQ ID NO: 9281077 - DNA, 22 bp, Homo sapiens
gggagaggttacccgagcaact

SEQ ID NO: 9281078 - DNA, 22 bp, Homo sapiens
gggagctgtaagggacaggtag

SEQ ID NO: 9281079 - DNA, 17 bp, Homo sapiens
gggagatgaagggatat

SEQ ID NO: 9281080 - DNA, 22 bp, Homo sapiens
gggagagtagctggaaggttct

SEQ ID NO: 9281081 - DNA, 22 bp, Homo sapiens
gggagaggttacccgagcaact

SEQ ID NO: 9281082 - DNA, 22 bp, Homo sapiens
gggcagctgtatctgagcttat

SEQ ID NO: 9281083 - DNA, 22 bp, Homo sapiens
gggcagctgtcttggttctcaa

SEQ ID NO: 9281084 - DNA, 22 bp, Homo sapiens
gggcagctgcccctctctgggc

SEQ ID NO: 9281085 - DNA, 22 bp, Homo sapiens
gggcagctgccaagtgcatcgc

SEQ ID NO: 9281086 - DNA, 22 bp, Homo sapiens
gggcagctgcagggatggtgac

SEQ ID NO: 9281087 - DNA, 22 bp, Homo sapiens
gggcagctgcagggatggtgac

SEQ ID NO: 9281088 - DNA, 22 bp, Homo sapiens
gggcagctgcccctctctgggc

SEQ ID NO: 9281089 - DNA, 22 bp, Homo sapiens
gggcagctgcccctctctgggc

SEQ ID NO: 9281090 - DNA, 22 bp, Homo sapiens
gggcagctgccagaggccatgg

SEQ ID NO: 9281091 - DNA, 22 bp, Homo sapiens
gggcagctgccagaggccatgg

SEQ ID NO: 9281092 - DNA, 22 bp, Homo sapiens
gggcagctgccagaggccatgg

SEQ ID NO: 9281093 - DNA, 22 bp, Homo sapiens
gggcacaggagaaggatctggc

SEQ ID NO: 9281094 - DNA, 22 bp, Homo sapiens
gggcagctctcacagcagccaa

SEQ ID NO: 9281095 - DNA, 22 bp, Homo sapiens
gggcagctctcacagcagccaa

SEQ ID NO: 9281096 - DNA, 22 bp, Homo sapiens
gggcagctctcacagcagccaa

SEQ ID NO: 9281097 - DNA, 22 bp, Homo sapiens
gggcagctctggctgtgggaag

SEQ ID NO: 9281098 - DNA, 22 bp, Homo sapiens
gggcagctctttggtatccttc

SEQ ID NO: 9281099 - DNA, 22 bp, Homo sapiens
gggcatgcctgcgcagtgcatg

SEQ ID NO: 9281100 - DNA, 17 bp, Homo sapiens
gggcagggactcctggg

SEQ ID NO: 9281101 - DNA, 22 bp, Homo sapiens
gggcaggatgcagtttcagaga

SEQ ID NO: 9281102 - DNA, 19 bp, Homo sapiens
gggcatggatgagcttacc

SEQ ID NO: 9281103 - DNA, 23 bp, Homo sapiens
gggcatggagtgtaggtggaagg

SEQ ID NO: 9281104 - DNA, 18 bp, Homo sapiens
gggcatggatgcagcatc

SEQ ID NO: 9281105 - DNA, 18 bp, Homo sapiens
gggcatggatgcagcatc

SEQ ID NO: 9281106 - DNA, 22 bp, Homo sapiens
gggcaggagagaacagtcatgg

SEQ ID NO: 9281107 - DNA, 22 bp, Homo sapiens
gggcaggagagaacagtcatgg

SEQ ID NO: 9281108 - DNA, 22 bp, Homo sapiens
gggcaggaggctaattctgcat

SEQ ID NO: 9281109 - DNA, 22 bp, Homo sapiens
gggcaggagagaacagtcatgg

SEQ ID NO: 9281110 - DNA, 22 bp, Homo sapiens
gggatggggtcgggaccctgct

SEQ ID NO: 9281111 - DNA, 22 bp, Homo sapiens
gggatggtggcttgcatctgta

SEQ ID NO: 9281112 - DNA, 22 bp, Homo sapiens
gggatggggtcgggaccctgct

SEQ ID NO: 9281113 - DNA, 22 bp, Homo sapiens
gggcaaaggcagaaagcggtgt

SEQ ID NO: 9281114 - DNA, 22 bp, Homo sapiens
gggatttgtgggatggccagtg

SEQ ID NO: 9281115 - DNA, 22 bp, Homo sapiens
gggattacagatgtgagccatt

SEQ ID NO: 9281116 - DNA, 19 bp, Homo sapiens
gggcacagcctccccccag

SEQ ID NO: 9281117 - DNA, 22 bp, Homo sapiens
gggcacagcccagtggggtccc

SEQ ID NO: 9281118 - DNA, 22 bp, Homo sapiens
gggcaagcacagcgagcgtgcg

SEQ ID NO: 9281119 - DNA, 22 bp, Homo sapiens
gggcaagcacagcgagcgtgcg

SEQ ID NO: 9281120 - DNA, 22 bp, Homo sapiens
gggaggagcttggagattcact

SEQ ID NO: 9281121 - DNA, 22 bp, Homo sapiens
gggaggagctgagtgtgtgtgc

SEQ ID NO: 9281122 - DNA, 22 bp, Homo sapiens
gggatggggagctggaaagggg

SEQ ID NO: 9281123 - DNA, 22 bp, Homo sapiens
gggatggggagctggaaagggg

SEQ ID NO: 9281124 - DNA, 22 bp, Homo sapiens
gggatggggagctggaaagggg

SEQ ID NO: 9281125 - DNA, 22 bp, Homo sapiens
gggatggggagctggaaagggg

SEQ ID NO: 9281126 - DNA, 22 bp, Homo sapiens
gggaggaaatgtgcagcgaatt

SEQ ID NO: 9281127 - DNA, 22 bp, Homo sapiens
gggaggaaggcttgggtgagta

SEQ ID NO: 9281128 - DNA, 21 bp, Homo sapiens
gggaggaagctgcttctctct

SEQ ID NO: 9281129 - DNA, 22 bp, Homo sapiens
gggaggaaggcttgggtgagta

SEQ ID NO: 9281130 - DNA, 22 bp, Homo sapiens
gggaggaaatgtgcagcgaatt

SEQ ID NO: 9281131 - DNA, 22 bp, Homo sapiens
gggaggaaagagaagtggtcca

SEQ ID NO: 9281132 - DNA, 22 bp, Homo sapiens
gggagcttaagacagttccaat

SEQ ID NO: 9281133 - DNA, 22 bp, Homo sapiens
ggcttctgtcctctggatctgt

SEQ ID NO: 9281134 - DNA, 22 bp, Homo sapiens
ggcttctgaaactgtattgaga

SEQ ID NO: 9281135 - DNA, 22 bp, Homo sapiens
ggcttctgaaatctctgtgcgt

SEQ ID NO: 9281136 - DNA, 22 bp, Homo sapiens
ggcttctgagtgctctgctgtt

SEQ ID NO: 9281137 - DNA, 22 bp, Homo sapiens
ggcttctgaaccaggccctgga

SEQ ID NO: 9281138 - DNA, 22 bp, Homo sapiens
ggcttctgagtgctctgctgtt

SEQ ID NO: 9281139 - DNA, 22 bp, Homo sapiens
ggcttctgagtgctctgctgtt

SEQ ID NO: 9281140 - DNA, 22 bp, Homo sapiens
ggcttctctcttcacatggctt

SEQ ID NO: 9281141 - DNA, 22 bp, Homo sapiens
ggcttctctcttcacatggctt

SEQ ID NO: 9281142 - DNA, 22 bp, Homo sapiens
ggcttctctcccccagctccac

SEQ ID NO: 9281143 - DNA, 22 bp, Homo sapiens
ggcttctctcccccagctccac

SEQ ID NO: 9281144 - DNA, 22 bp, Homo sapiens
ggctgggctgctgggtcagagc

SEQ ID NO: 9281145 - DNA, 22 bp, Homo sapiens
ggctgggctgctgggtcagagc

SEQ ID NO: 9281146 - DNA, 22 bp, Homo sapiens
ggcttctccaggtactgagcat

SEQ ID NO: 9281147 - DNA, 22 bp, Homo sapiens
ggctgggctgctgggtcagagc

SEQ ID NO: 9281148 - DNA, 22 bp, Homo sapiens
ggctgggctccgggagcatgcg

SEQ ID NO: 9281149 - DNA, 22 bp, Homo sapiens
ggctgggctccgggagcatgcg

SEQ ID NO: 9281150 - DNA, 22 bp, Homo sapiens
ggctgggctccgggagcatgcg

SEQ ID NO: 9281151 - DNA, 22 bp, Homo sapiens
ggctgggctccgggagcatgcg

SEQ ID NO: 9281152 - DNA, 22 bp, Homo sapiens
ggctgggcctctccctcagctg

SEQ ID NO: 9281153 - DNA, 22 bp, Homo sapiens
ggctgggcaggtctgcacaggg

SEQ ID NO: 9281154 - DNA, 22 bp, Homo sapiens
ggctgggcaggtctgcacaggg

SEQ ID NO: 9281155 - DNA, 22 bp, Homo sapiens
ggctgggcaggtctgcacaggg

SEQ ID NO: 9281156 - DNA, 22 bp, Homo sapiens
ggctgggcaggtctgcacaggg

SEQ ID NO: 9281157 - DNA, 22 bp, Homo sapiens
ggctgggcaaacaagactcttc

SEQ ID NO: 9281158 - DNA, 22 bp, Homo sapiens
ggctgggaggccgtgctgacct

SEQ ID NO: 9281159 - DNA, 22 bp, Homo sapiens
ggctgggaggccgtgctgacct

SEQ ID NO: 9281160 - DNA, 22 bp, Homo sapiens
ggctgggaggccgtgctgacct

SEQ ID NO: 9281161 - DNA, 22 bp, Homo sapiens
ggctgctggagttgggtctctc

SEQ ID NO: 9281162 - DNA, 22 bp, Homo sapiens
ggctgctggattgtgtatctgt

SEQ ID NO: 9281163 - DNA, 22 bp, Homo sapiens
ggctgctggcattgaggtaggt

SEQ ID NO: 9281164 - DNA, 22 bp, Homo sapiens
ggctgctggcattgaggtaggt

SEQ ID NO: 9281165 - DNA, 22 bp, Homo sapiens
ggctgctgggaatatgccagct

SEQ ID NO: 9281166 - DNA, 22 bp, Homo sapiens
ggctgctgggaatatgccagct

SEQ ID NO: 9281167 - DNA, 22 bp, Homo sapiens
ggctgctgggaatatgccagct

SEQ ID NO: 9281168 - DNA, 22 bp, Homo sapiens
ggctgctggccagcctaggagt

SEQ ID NO: 9281169 - DNA, 22 bp, Homo sapiens
ggctgctggccagcctaggagt

SEQ ID NO: 9281170 - DNA, 22 bp, Homo sapiens
ggctgagcactttaggcaggag

SEQ ID NO: 9281171 - DNA, 22 bp, Homo sapiens
ggctgagcaattttgatgacat

SEQ ID NO: 9281172 - DNA, 22 bp, Homo sapiens
ggctgagagtttcctctggggc

SEQ ID NO: 9281173 - DNA, 22 bp, Homo sapiens
ggctgagcaattttgatgacat

SEQ ID NO: 9281174 - DNA, 22 bp, Homo sapiens
ggctgagcaattttgatgacat

SEQ ID NO: 9281175 - DNA, 22 bp, Homo sapiens
ggctgagagtggatcccaggga

SEQ ID NO: 9281176 - DNA, 22 bp, Homo sapiens
ggctgagaggacgtcgggctca

SEQ ID NO: 9281177 - DNA, 22 bp, Homo sapiens
ggctgagagtggatcccaggga

SEQ ID NO: 9281178 - DNA, 21 bp, Homo sapiens
ggctgagatggcagaatcacc

SEQ ID NO: 9281179 - DNA, 22 bp, Homo sapiens
ggctgagagtttcctctggggc

SEQ ID NO: 9281180 - DNA, 22 bp, Homo sapiens
ggctgctgacaaacatgatcat

SEQ ID NO: 9281181 - DNA, 22 bp, Homo sapiens
ggctgctgacaaacatgatcat

SEQ ID NO: 9281182 - DNA, 22 bp, Homo sapiens
ggctgctgaagtgtggcaatct

SEQ ID NO: 9281183 - DNA, 22 bp, Homo sapiens
ggctgctgacaaacatgatcat

SEQ ID NO: 9281184 - DNA, 22 bp, Homo sapiens
ggctgctgaagtgtggcaatct

SEQ ID NO: 9281185 - DNA, 22 bp, Homo sapiens
ggctgagcactttaggcaggag

SEQ ID NO: 9281186 - DNA, 22 bp, Homo sapiens
ggctgagcactttaggcaggag

SEQ ID NO: 9281187 - DNA, 22 bp, Homo sapiens
ggctgctgacttcatccagctt

SEQ ID NO: 9281188 - DNA, 22 bp, Homo sapiens
ggctgctgagtcacgacagtga

SEQ ID NO: 9281189 - DNA, 22 bp, Homo sapiens
ggctgctgagttggccaggaga

SEQ ID NO: 9281190 - DNA, 22 bp, Homo sapiens
ggctgctgagttggccaggaga

SEQ ID NO: 9281191 - DNA, 22 bp, Homo sapiens
ggctgctgcccacccctgcatg

SEQ ID NO: 9281192 - DNA, 22 bp, Homo sapiens
ggctgctgcccacccctgcatg

SEQ ID NO: 9281193 - DNA, 22 bp, Homo sapiens
ggctgctggaagactgaacaag

SEQ ID NO: 9281194 - DNA, 22 bp, Homo sapiens
ggctgctggaagactgaacaag

SEQ ID NO: 9281195 - DNA, 22 bp, Homo sapiens
ggctgctgctgtgtaggcctgt

SEQ ID NO: 9281196 - DNA, 22 bp, Homo sapiens
ggctctgggaaatggtcttcct

SEQ ID NO: 9281197 - DNA, 22 bp, Homo sapiens
ggctctggcgtccaatggagcg

SEQ ID NO: 9281198 - DNA, 22 bp, Homo sapiens
ggctctggagcacagacgtctg

SEQ ID NO: 9281199 - DNA, 22 bp, Homo sapiens
ggctctggagcacagacgtctg

SEQ ID NO: 9281200 - DNA, 22 bp, Homo sapiens
ggctctggcaaggggaggctac

SEQ ID NO: 9281201 - DNA, 22 bp, Homo sapiens
ggctgagaagacagtggggtgg

SEQ ID NO: 9281202 - DNA, 22 bp, Homo sapiens
ggctgagaaggagtgggtgagg

SEQ ID NO: 9281203 - DNA, 22 bp, Homo sapiens
ggctgagaacaggcccagcctc

SEQ ID NO: 9281204 - DNA, 22 bp, Homo sapiens
ggctgaagtgtagtggctcact

SEQ ID NO: 9281205 - DNA, 22 bp, Homo sapiens
ggctgaaggatgaaagctgcag

SEQ ID NO: 9281206 - DNA, 22 bp, Homo sapiens
ggctgaagtgtagtggctcact

SEQ ID NO: 9281207 - DNA, 22 bp, Homo sapiens
ggctgagactagagtgaggcat

SEQ ID NO: 9281208 - DNA, 23 bp, Homo sapiens
ggctgagactacaggcgcttgcc

SEQ ID NO: 9281209 - DNA, 22 bp, Homo sapiens
ggctgagactagagtgaggcat

SEQ ID NO: 9281210 - DNA, 22 bp, Homo sapiens
ggctgagactagagtgaggcat

SEQ ID NO: 9281211 - DNA, 22 bp, Homo sapiens
ggctgagaaggagtgggtgagg

SEQ ID NO: 9281212 - DNA, 23 bp, Homo sapiens
ggctgagaagtcccatgataggt

SEQ ID NO: 9281213 - DNA, 22 bp, Homo sapiens
ggctgagacaacctgggaccca

SEQ ID NO: 9281214 - DNA, 22 bp, Homo sapiens
ggctctgggccagagttggctt

SEQ ID NO: 9281215 - DNA, 22 bp, Homo sapiens
ggctctgggccagagttggctt

SEQ ID NO: 9281216 - DNA, 22 bp, Homo sapiens
ggctgaaggatgaaagctgcag

SEQ ID NO: 9281217 - DNA, 22 bp, Homo sapiens
ggctgaagaactgggagtctca

SEQ ID NO: 9281218 - DNA, 22 bp, Homo sapiens
ggctccagatgtcccctggcaa

SEQ ID NO: 9281219 - DNA, 22 bp, Homo sapiens
ggctccagatgtcccctggcaa

SEQ ID NO: 9281220 - DNA, 22 bp, Homo sapiens
ggctccagaggccttacctgca

SEQ ID NO: 9281221 - DNA, 16 bp, Homo sapiens
ggctccagaatagcga

SEQ ID NO: 9281222 - DNA, 22 bp, Homo sapiens
ggctccagaaatcatagagcag

SEQ ID NO: 9281223 - DNA, 22 bp, Homo sapiens
ggctccagaaacttcagtccat

SEQ ID NO: 9281224 - DNA, 22 bp, Homo sapiens
ggctccagaaacttcagtccat

SEQ ID NO: 9281225 - DNA, 22 bp, Homo sapiens
ggcgggagcagcagctctgagc

SEQ ID NO: 9281226 - DNA, 22 bp, Homo sapiens
ggcggaggttgcagtaagccga

SEQ ID NO: 9281227 - DNA, 22 bp, Homo sapiens
ggctccagatgtctcctggcaa

SEQ ID NO: 9281228 - DNA, 22 bp, Homo sapiens
ggctccagatgtctcctggcaa

SEQ ID NO: 9281229 - DNA, 22 bp, Homo sapiens
ggctccagccctggctcttcac

SEQ ID NO: 9281230 - DNA, 22 bp, Homo sapiens
ggctccagctaatggtttctat

SEQ ID NO: 9281231 - DNA, 22 bp, Homo sapiens
ggctccaggaacctcctctcct

SEQ ID NO: 9281232 - DNA, 18 bp, Homo sapiens
ggctccaggacctaccca

SEQ ID NO: 9281233 - DNA, 22 bp, Homo sapiens
ggctccaggagggccttggcca

SEQ ID NO: 9281234 - DNA, 22 bp, Homo sapiens
ggctccaggagatgctgggcag

SEQ ID NO: 9281235 - DNA, 22 bp, Homo sapiens
ggctctggaatgtgtagtcagg

SEQ ID NO: 9281236 - DNA, 21 bp, Homo sapiens
ggcctcagccacctggctctg

SEQ ID NO: 9281237 - DNA, 22 bp, Homo sapiens
ggcctcagaggaggtgtgagtc

SEQ ID NO: 9281238 - DNA, 22 bp, Homo sapiens
ggcctcagaggaggtgtgagtc

SEQ ID NO: 9281239 - DNA, 22 bp, Homo sapiens
ggcctcagaggaggtgtgagtc

SEQ ID NO: 9281240 - DNA, 23 bp, Homo sapiens
ggcctcagcgcacagaaactgct

SEQ ID NO: 9281241 - DNA, 18 bp, Homo sapiens
ggcctcagcctggccgga

SEQ ID NO: 9281242 - DNA, 22 bp, Homo sapiens
ggcctcagggtcactctgtaga

SEQ ID NO: 9281243 - DNA, 22 bp, Homo sapiens
ggcctcagggtcactctgtaga

SEQ ID NO: 9281244 - DNA, 19 bp, Homo sapiens
ggccatggcgggggtcaca

SEQ ID NO: 9281245 - DNA, 22 bp, Homo sapiens
ggcctcagaccggagctggcca

SEQ ID NO: 9281246 - DNA, 22 bp, Homo sapiens
ggccatggcgggagccggcgtc

SEQ ID NO: 9281247 - DNA, 22 bp, Homo sapiens
ggcctcagagaaggctgtgcgg

SEQ ID NO: 9281248 - DNA, 22 bp, Homo sapiens
ggcctcagagaaggctgtgcgg

SEQ ID NO: 9281249 - DNA, 22 bp, Homo sapiens
ggccatgctgttgcctgctggt

SEQ ID NO: 9281250 - DNA, 22 bp, Homo sapiens
ggccatggaccccgagctgacc

SEQ ID NO: 9281251 - DNA, 22 bp, Homo sapiens
ggccatggaccccgagctgacc

SEQ ID NO: 9281252 - DNA, 23 bp, Homo sapiens
ggccatggagacttagaatgggc

SEQ ID NO: 9281253 - DNA, 23 bp, Homo sapiens
ggccatggagacttagaatgggc

SEQ ID NO: 9281254 - DNA, 21 bp, Homo sapiens
ggcctctgtcatcctgggaag

SEQ ID NO: 9281255 - DNA, 21 bp, Homo sapiens
ggcctctgtcatcctgggaag

SEQ ID NO: 9281256 - DNA, 22 bp, Homo sapiens
ggcctctggttcacagggagga

SEQ ID NO: 9281257 - DNA, 22 bp, Homo sapiens
ggcctctggttcacagggagga

SEQ ID NO: 9281258 - DNA, 22 bp, Homo sapiens
ggcctctggttcgtggtgacct

SEQ ID NO: 9281259 - DNA, 22 bp, Homo sapiens
ggcctcttagagttaactgctt

SEQ ID NO: 9281260 - DNA, 22 bp, Homo sapiens
ggcctctgtttggagccaggat

SEQ ID NO: 9281261 - DNA, 20 bp, Homo sapiens
ggcctcagtgtccttgtttg

SEQ ID NO: 9281262 - DNA, 20 bp, Homo sapiens
ggcctcagtgtccttgtttg

SEQ ID NO: 9281263 - DNA, 22 bp, Homo sapiens
ggcctcagtgggccgctgcagg

SEQ ID NO: 9281264 - DNA, 23 bp, Homo sapiens
ggcctcagtgatgatgggttaaa

SEQ ID NO: 9281265 - DNA, 22 bp, Homo sapiens
ggcctcagggttgggcccatta

SEQ ID NO: 9281266 - DNA, 22 bp, Homo sapiens
ggcctcagggttgggcccatta

SEQ ID NO: 9281267 - DNA, 22 bp, Homo sapiens
ggcctcagtttcttcaactgta

SEQ ID NO: 9281268 - DNA, 22 bp, Homo sapiens
ggcctcagtttcttcaactgta

SEQ ID NO: 9281269 - DNA, 22 bp, Homo sapiens
ggcctcagtttcttcaactgta

SEQ ID NO: 9281270 - DNA, 22 bp, Homo sapiens
ggcctcagtttctccatgggtt

SEQ ID NO: 9281271 - DNA, 22 bp, Homo sapiens
ggcctcagtttctccatgggtt

SEQ ID NO: 9281272 - DNA, 20 bp, Homo sapiens
ggcctcagtgtccttgtttg

SEQ ID NO: 9281273 - DNA, 20 bp, Homo sapiens
ggccttgggtttcgcctgtt

SEQ ID NO: 9281274 - DNA, 22 bp, Homo sapiens
ggccttggggtggccttgtccc

SEQ ID NO: 9281275 - DNA, 17 bp, Homo sapiens
ggccttggggcctcagt

SEQ ID NO: 9281276 - DNA, 17 bp, Homo sapiens
ggccttgggctgctctt

SEQ ID NO: 9281277 - DNA, 22 bp, Homo sapiens
ggccttgggctggctgcagtat

SEQ ID NO: 9281278 - DNA, 22 bp, Homo sapiens
ggccttggggaggatggtgtcc

SEQ ID NO: 9281279 - DNA, 22 bp, Homo sapiens
ggccttggtgccatggccagtt

SEQ ID NO: 9281280 - DNA, 22 bp, Homo sapiens
ggccttggtgctctgtgttgca

SEQ ID NO: 9281281 - DNA, 22 bp, Homo sapiens
ggccttggttctgtcacagccg

SEQ ID NO: 9281282 - DNA, 22 bp, Homo sapiens
ggcgaggccgggacaggctgga

SEQ ID NO: 9281283 - DNA, 21 bp, Homo sapiens
ggcctgagtataggacaggcc

SEQ ID NO: 9281284 - DNA, 21 bp, Homo sapiens
ggcctgagtataggacaggcc

SEQ ID NO: 9281285 - DNA, 22 bp, Homo sapiens
ggcctgagtcacatcaggagag

SEQ ID NO: 9281286 - DNA, 22 bp, Homo sapiens
ggcctgagtcccacctggctgt

SEQ ID NO: 9281287 - DNA, 22 bp, Homo sapiens
ggcctgagtcccacctggctgt

SEQ ID NO: 9281288 - DNA, 22 bp, Homo sapiens
ggcctgagtcccacctggctgt

SEQ ID NO: 9281289 - DNA, 22 bp, Homo sapiens
ggccttgggatgtggctgcagc

SEQ ID NO: 9281290 - DNA, 22 bp, Homo sapiens
ggccttgggcagacacgtcaca

SEQ ID NO: 9281291 - DNA, 22 bp, Homo sapiens
ggccttgggatgtggctgcagc

SEQ ID NO: 9281292 - DNA, 18 bp, Homo sapiens
ggcctgcagtgaagcaag

SEQ ID NO: 9281293 - DNA, 22 bp, Homo sapiens
ggcctgaatgcctgagtgtggg

SEQ ID NO: 9281294 - DNA, 22 bp, Homo sapiens
ggcctgagaaccatggggccaa

SEQ ID NO: 9281295 - DNA, 22 bp, Homo sapiens
ggcctcttctgctcatactttc

SEQ ID NO: 9281296 - DNA, 22 bp, Homo sapiens
ggcctgaaatagctctgaggtt

SEQ ID NO: 9281297 - DNA, 22 bp, Homo sapiens
ggcctgaaatagctctgaggtt

SEQ ID NO: 9281298 - DNA, 22 bp, Homo sapiens
ggcctgaaataaagtagcagaa

SEQ ID NO: 9281299 - DNA, 22 bp, Homo sapiens
ggcctgagggtgggctctcagt

SEQ ID NO: 9281300 - DNA, 22 bp, Homo sapiens
ggcctgagggtgggctctcagt

SEQ ID NO: 9281301 - DNA, 22 bp, Homo sapiens
ggcctgaggcgtcccagctgtg

SEQ ID NO: 9281302 - DNA, 22 bp, Homo sapiens
ggcctgaggcgtcccagctgtg

SEQ ID NO: 9281303 - DNA, 22 bp, Homo sapiens
ggcctgagaatgtaccagatct

SEQ ID NO: 9281304 - DNA, 22 bp, Homo sapiens
ggcctgagaaccatggggccaa

SEQ ID NO: 9281305 - DNA, 22 bp, Homo sapiens
ggccagtctgggccacggtcgg

SEQ ID NO: 9281306 - DNA, 22 bp, Homo sapiens
ggccagtcccctaatccagggc

SEQ ID NO: 9281307 - DNA, 22 bp, Homo sapiens
ggccagtgtgcaggtcagagat

SEQ ID NO: 9281308 - DNA, 22 bp, Homo sapiens
ggccatgcaggtcagaggtggg

SEQ ID NO: 9281309 - DNA, 22 bp, Homo sapiens
ggccagggcctggggactgtcc

SEQ ID NO: 9281310 - DNA, 22 bp, Homo sapiens
ggccagggcctggggactgtcc

SEQ ID NO: 9281311 - DNA, 19 bp, Homo sapiens
ggccaggctgactgtggtc

SEQ ID NO: 9281312 - DNA, 22 bp, Homo sapiens
ggccagggggcttcagactcca

SEQ ID NO: 9281313 - DNA, 22 bp, Homo sapiens
ggccagggggcttcagactcca

SEQ ID NO: 9281314 - DNA, 22 bp, Homo sapiens
ggccagggggcttcagactcca

SEQ ID NO: 9281315 - DNA, 22 bp, Homo sapiens
ggcatggggtgtatgtggcacg

SEQ ID NO: 9281316 - DNA, 18 bp, Homo sapiens
ggcatgtgagtgctgagg

SEQ ID NO: 9281317 - DNA, 22 bp, Homo sapiens
ggcatgtgcctgaggtcacaca

SEQ ID NO: 9281318 - DNA, 22 bp, Homo sapiens
ggccaaggtggagaaggcactg

SEQ ID NO: 9281319 - DNA, 22 bp, Homo sapiens
ggcattaactctgtttcaattt

SEQ ID NO: 9281320 - DNA, 22 bp, Homo sapiens
ggcatgtgcctgaggtcacaca

SEQ ID NO: 9281321 - DNA, 22 bp, Homo sapiens
ggccacagaacagctacaggac

SEQ ID NO: 9281322 - DNA, 19 bp, Homo sapiens
ggccaggctgactgtggtc

SEQ ID NO: 9281323 - DNA, 21 bp, Homo sapiens
ggccacaagcggaggagccgc

SEQ ID NO: 9281324 - DNA, 22 bp, Homo sapiens
ggccacacagatgactgctttc

SEQ ID NO: 9281325 - DNA, 22 bp, Homo sapiens
ggccaaggtgttctgatatgcc

SEQ ID NO: 9281326 - DNA, 22 bp, Homo sapiens
ggccaattccaggagccggcgg

SEQ ID NO: 9281327 - DNA, 22 bp, Homo sapiens
ggcaggcagaggctgagacagg

SEQ ID NO: 9281328 - DNA, 22 bp, Homo sapiens
ggcaggtggacgtgctaaagct

SEQ ID NO: 9281329 - DNA, 22 bp, Homo sapiens
ggcaggtggcactgctgctccc

SEQ ID NO: 9281330 - DNA, 22 bp, Homo sapiens
ggcaggtgtgagatcgaggcca

SEQ ID NO: 9281331 - DNA, 22 bp, Homo sapiens
ggcaggtgtgagatcgaggcca

SEQ ID NO: 9281332 - DNA, 22 bp, Homo sapiens
ggcagtcacttttgcttgtgcc

SEQ ID NO: 9281333 - DNA, 22 bp, Homo sapiens
ggcagtcatttaatccctgcat

SEQ ID NO: 9281334 - DNA, 22 bp, Homo sapiens
ggcaggtggcactgctgctccc

SEQ ID NO: 9281335 - DNA, 22 bp, Homo sapiens
ggcaggtgggaaccctccccac

SEQ ID NO: 9281336 - DNA, 22 bp, Homo sapiens
ggcatggggtgtatgtggcacg

SEQ ID NO: 9281337 - DNA, 22 bp, Homo sapiens
ggcatgggccgaggtgcctcct

SEQ ID NO: 9281338 - DNA, 22 bp, Homo sapiens
ggcagtgaatgaaacagaggct

SEQ ID NO: 9281339 - DNA, 22 bp, Homo sapiens
ggcagtgaaaaagtatgtttcc

SEQ ID NO: 9281340 - DNA, 22 bp, Homo sapiens
ggcagtgaacagaaatgcagaa

SEQ ID NO: 9281341 - DNA, 22 bp, Homo sapiens
ggcagtgaacagaaatgcagaa

SEQ ID NO: 9281342 - DNA, 22 bp, Homo sapiens
ggcagtgaacagaaatgcagaa

SEQ ID NO: 9281343 - DNA, 22 bp, Homo sapiens
ggcagtgaatctgagagcctgg

SEQ ID NO: 9281344 - DNA, 19 bp, Homo sapiens
ggcagtctcaagcagcaca

SEQ ID NO: 9281345 - DNA, 22 bp, Homo sapiens
ggcagaggtagctggaaccagg

SEQ ID NO: 9281346 - DNA, 22 bp, Homo sapiens
ggcagaggtagctggaaccagg

SEQ ID NO: 9281347 - DNA, 22 bp, Homo sapiens
ggcagaggtagctggaaccagg

SEQ ID NO: 9281348 - DNA, 22 bp, Homo sapiens
ggcagaggtagctggaaccagg

SEQ ID NO: 9281349 - DNA, 20 bp, Homo sapiens
ggcagagggcctgggagaag

SEQ ID NO: 9281350 - DNA, 22 bp, Homo sapiens
ggcagaggtagctggaaccagg

SEQ ID NO: 9281351 - DNA, 22 bp, Homo sapiens
ggcaggaggtgagtggcgggtg

SEQ ID NO: 9281352 - DNA, 22 bp, Homo sapiens
ggcaggaggtgagtggcgggtg

SEQ ID NO: 9281353 - DNA, 22 bp, Homo sapiens
ggcaggagggcggacaatgacc

SEQ ID NO: 9281354 - DNA, 22 bp, Homo sapiens
ggcaggagggcggacaatgacc

SEQ ID NO: 9281355 - DNA, 22 bp, Homo sapiens
ggcaggaggaagagttagcacc

SEQ ID NO: 9281356 - DNA, 22 bp, Homo sapiens
ggcagaggtagctggaaccagg

SEQ ID NO: 9281357 - DNA, 22 bp, Homo sapiens
ggcaggcaaggcagcctggtga

SEQ ID NO: 9281358 - DNA, 22 bp, Homo sapiens
ggcaggcaacggaccactagtc

SEQ ID NO: 9281359 - DNA, 22 bp, Homo sapiens
ggcaggcaacggaccactagtc

SEQ ID NO: 9281360 - DNA, 22 bp, Homo sapiens
ggcaggcactgtgctaggcgct

SEQ ID NO: 9281361 - DNA, 22 bp, Homo sapiens
ggcaggcagaggctgagacagg

SEQ ID NO: 9281362 - DNA, 22 bp, Homo sapiens
ggcagaggagctggaaacatgg

SEQ ID NO: 9281363 - DNA, 22 bp, Homo sapiens
ggcagaggagctggaaacatgg

SEQ ID NO: 9281364 - DNA, 22 bp, Homo sapiens
ggcagaggagctggaaacatgg

SEQ ID NO: 9281365 - DNA, 22 bp, Homo sapiens
ggcagaggagctggaaacatgg

SEQ ID NO: 9281366 - DNA, 22 bp, Homo sapiens
ggcagaggaggggtgaatttgc

SEQ ID NO: 9281367 - DNA, 20 bp, Homo sapiens
ggcagagggcctgggagaag

SEQ ID NO: 9281368 - DNA, 22 bp, Homo sapiens
ggcagaggaggggtgaatttgc

SEQ ID NO: 9281369 - DNA, 22 bp, Homo sapiens
ggcaccaggctgggcataggcc

SEQ ID NO: 9281370 - DNA, 22 bp, Homo sapiens
ggcaccaggctgggcataggcc

SEQ ID NO: 9281371 - DNA, 20 bp, Homo sapiens
ggcaccaggctaggattgga

SEQ ID NO: 9281372 - DNA, 20 bp, Homo sapiens
ggcaccaggctaggattgga

SEQ ID NO: 9281373 - DNA, 23 bp, Homo sapiens
ggcaccaggccatggagcgggag

SEQ ID NO: 9281374 - DNA, 23 bp, Homo sapiens
ggcaccaggccatggagcgggag

SEQ ID NO: 9281375 - DNA, 22 bp, Homo sapiens
ggcaccaggacatgactcccag

SEQ ID NO: 9281376 - DNA, 22 bp, Homo sapiens
ggcaccaggatcagtctgtcat

SEQ ID NO: 9281377 - DNA, 22 bp, Homo sapiens
ggcagaggaaggatgaattcac

SEQ ID NO: 9281378 - DNA, 22 bp, Homo sapiens
ggcagaggaaggatgaattcac

SEQ ID NO: 9281379 - DNA, 22 bp, Homo sapiens
ggcagaggaaggatgaattcac

SEQ ID NO: 9281380 - DNA, 22 bp, Homo sapiens
ggcagaggagctggaaacatgg

SEQ ID NO: 9281381 - DNA, 22 bp, Homo sapiens
ggcacagcgactaccatcgaaa

SEQ ID NO: 9281382 - DNA, 22 bp, Homo sapiens
ggcacagccctctctgtggaca

SEQ ID NO: 9281383 - DNA, 22 bp, Homo sapiens
ggcacagctcaggtcccagctc

SEQ ID NO: 9281384 - DNA, 22 bp, Homo sapiens
ggcacaggaatctgtgaagtgc

SEQ ID NO: 9281385 - DNA, 22 bp, Homo sapiens
ggcaccagcacttgggatggct

SEQ ID NO: 9281386 - DNA, 22 bp, Homo sapiens
ggcaccagcaggcaccgatgcc

SEQ ID NO: 9281387 - DNA, 22 bp, Homo sapiens
ggcaccagccacctatttctag

SEQ ID NO: 9281388 - DNA, 17 bp, Homo sapiens
ggcaccagacggagagt

SEQ ID NO: 9281389 - DNA, 17 bp, Homo sapiens
ggcaccagacggagagt

SEQ ID NO: 9281390 - DNA, 22 bp, Homo sapiens
ggagtccaacgtgcagccagga

SEQ ID NO: 9281391 - DNA, 21 bp, Homo sapiens
ggagtccaaaaattagccatg

SEQ ID NO: 9281392 - DNA, 18 bp, Homo sapiens
ggagtctcaggagaggaa

SEQ ID NO: 9281393 - DNA, 21 bp, Homo sapiens
ggagtctgaggaagaaaactg

SEQ ID NO: 9281394 - DNA, 22 bp, Homo sapiens
ggagtgaggcatttgtagctga

SEQ ID NO: 9281395 - DNA, 22 bp, Homo sapiens
ggagtcaccaagtaggagtctt

SEQ ID NO: 9281396 - DNA, 22 bp, Homo sapiens
ggagtcaccaagtaggagtctt

SEQ ID NO: 9281397 - DNA, 19 bp, Homo sapiens
ggagccagctgtggaaggc

SEQ ID NO: 9281398 - DNA, 23 bp, Homo sapiens
ggagccagcctgtggggagcggg

SEQ ID NO: 9281399 - DNA, 23 bp, Homo sapiens
ggagccagcctgtggggagcggg

SEQ ID NO: 9281400 - DNA, 19 bp, Homo sapiens
ggagccagctgtggaaggc

SEQ ID NO: 9281401 - DNA, 22 bp, Homo sapiens
ggagccagagtctgcagtgtaa

SEQ ID NO: 9281402 - DNA, 22 bp, Homo sapiens
ggagccagagggatgcagttga

SEQ ID NO: 9281403 - DNA, 22 bp, Homo sapiens
ggagccagagtctgcagtgtaa

SEQ ID NO: 9281404 - DNA, 22 bp, Homo sapiens
ggagccagaggctgctgctgtg

SEQ ID NO: 9281405 - DNA, 22 bp, Homo sapiens
ggagccagaggctgctgctgtg

SEQ ID NO: 9281406 - DNA, 22 bp, Homo sapiens
ggcaagaggtccaagaggtctc

SEQ ID NO: 9281407 - DNA, 22 bp, Homo sapiens
ggcaagagtgaggagtgtctct

SEQ ID NO: 9281408 - DNA, 22 bp, Homo sapiens
ggcaagatccaaggggctagga

SEQ ID NO: 9281409 - DNA, 22 bp, Homo sapiens
ggcaagagggcagatggagtgc

SEQ ID NO: 9281410 - DNA, 21 bp, Homo sapiens
ggcaacagatattttgcttag

SEQ ID NO: 9281411 - DNA, 21 bp, Homo sapiens
ggcaagaaacacaatcaagta

SEQ ID NO: 9281412 - DNA, 22 bp, Homo sapiens
ggcaaaggaaaacgtctcagct

SEQ ID NO: 9281413 - DNA, 22 bp, Homo sapiens
ggcaaatttgtcttaagacacc

SEQ ID NO: 9281414 - DNA, 22 bp, Homo sapiens
ggcaacaactggacatagctgg

SEQ ID NO: 9281415 - DNA, 22 bp, Homo sapiens
ggattttagagtacctaagtgt

SEQ ID NO: 9281416 - DNA, 22 bp, Homo sapiens
ggcaaactacatttttgaaata

SEQ ID NO: 9281417 - DNA, 23 bp, Homo sapiens
ggagtgcaatggcgccatctcgg

SEQ ID NO: 9281418 - DNA, 23 bp, Homo sapiens
ggagtgcaatggcgccatctcgg

SEQ ID NO: 9281419 - DNA, 23 bp, Homo sapiens
ggagtgcaatggcgccatctcgg

SEQ ID NO: 9281420 - DNA, 22 bp, Homo sapiens
ggagtgagtggccttgtcactg

SEQ ID NO: 9281421 - DNA, 22 bp, Homo sapiens
ggagtgagtactggagtagctg

SEQ ID NO: 9281422 - DNA, 22 bp, Homo sapiens
gggccaagggtgcgtggcagga

SEQ ID NO: 9281423 - DNA, 22 bp, Homo sapiens
gggccaaggggagctggaaggg

SEQ ID NO: 9281424 - DNA, 22 bp, Homo sapiens
gggccaaggggagctggaaggg

SEQ ID NO: 9281425 - DNA, 22 bp, Homo sapiens
gggccacacagaacctcctggt

SEQ ID NO: 9281426 - DNA, 22 bp, Homo sapiens
gggccacacagaacctcctggt

SEQ ID NO: 9281427 - DNA, 21 bp, Homo sapiens
gggccacaccttctgcagacc

SEQ ID NO: 9281428 - DNA, 22 bp, Homo sapiens
gggcatggtgatgtgcacctgt

SEQ ID NO: 9281429 - DNA, 22 bp, Homo sapiens
gggcatggtgatgtgcacctgt

SEQ ID NO: 9281430 - DNA, 22 bp, Homo sapiens
gggcatggtgctggtgttcatg

SEQ ID NO: 9281431 - DNA, 22 bp, Homo sapiens
gggcatggtgagggatatgaag

SEQ ID NO: 9281432 - DNA, 22 bp, Homo sapiens
gggcatggtgagggatatgaag

SEQ ID NO: 9281433 - DNA, 22 bp, Homo sapiens
gggcatggccaggtgaggggtc

SEQ ID NO: 9281434 - DNA, 22 bp, Homo sapiens
gggcatggccaggtgaggggtc

SEQ ID NO: 9281435 - DNA, 22 bp, Homo sapiens
gggcatggcgtgtgctggattc

SEQ ID NO: 9281436 - DNA, 18 bp, Homo sapiens
gggcatggatgcagcatc

SEQ ID NO: 9281437 - DNA, 22 bp, Homo sapiens
gggctgagagctggaatctgag

SEQ ID NO: 9281438 - DNA, 22 bp, Homo sapiens
gggctgagagctggaatctgag

SEQ ID NO: 9281439 - DNA, 22 bp, Homo sapiens
gggctgagagtgactgttctgt

SEQ ID NO: 9281440 - DNA, 22 bp, Homo sapiens
gggctgagagctggaatctgag

SEQ ID NO: 9281441 - DNA, 22 bp, Homo sapiens
gggctgagagctggaatctgag

SEQ ID NO: 9281442 - DNA, 21 bp, Homo sapiens
gggccacaccttctgcagacc

SEQ ID NO: 9281443 - DNA, 22 bp, Homo sapiens
gggctgagagctggaatctgag

SEQ ID NO: 9281444 - DNA, 22 bp, Homo sapiens
gggctgagattggtgccctgtc

SEQ ID NO: 9281445 - DNA, 22 bp, Homo sapiens
gggctgagagtgactgttctgt

SEQ ID NO: 9281446 - DNA, 22 bp, Homo sapiens
gggctgagagtgactgttctgt

SEQ ID NO: 9281447 - DNA, 22 bp, Homo sapiens
gggctgagagtgactgttctgt

SEQ ID NO: 9281448 - DNA, 22 bp, Homo sapiens
gggctgagcacatactgacagc

SEQ ID NO: 9281449 - DNA, 22 bp, Homo sapiens
gggctgagcacatactgacagc

SEQ ID NO: 9281450 - DNA, 22 bp, Homo sapiens
gggctgagattggtgccctgtc

SEQ ID NO: 9281451 - DNA, 22 bp, Homo sapiens
gggctgagccacagcttttgtt

SEQ ID NO: 9281452 - DNA, 22 bp, Homo sapiens
gggctgagccacagcttttgtt

SEQ ID NO: 9281453 - DNA, 22 bp, Homo sapiens
gggctgagccacagcttttgtt

SEQ ID NO: 9281454 - DNA, 22 bp, Homo sapiens
gggctgagcacatactgacagc

SEQ ID NO: 9281455 - DNA, 22 bp, Homo sapiens
gggctgagcacatactgacagc

SEQ ID NO: 9281456 - DNA, 22 bp, Homo sapiens
gggctgagccatttgaaccttg

SEQ ID NO: 9281457 - DNA, 22 bp, Homo sapiens
gggctgagccacagcttttgtt

SEQ ID NO: 9281458 - DNA, 22 bp, Homo sapiens
gggctgagccatttgaaccttg

SEQ ID NO: 9281459 - DNA, 22 bp, Homo sapiens
gggctgagctaagctgggttga

SEQ ID NO: 9281460 - DNA, 22 bp, Homo sapiens
gggctgagccatttgaaccttg

SEQ ID NO: 9281461 - DNA, 22 bp, Homo sapiens
gggctgagctaagctgggttga

SEQ ID NO: 9281462 - DNA, 22 bp, Homo sapiens
gggctgagctgttctgagttta

SEQ ID NO: 9281463 - DNA, 22 bp, Homo sapiens
gggctgagctaagctgggttga

SEQ ID NO: 9281464 - DNA, 22 bp, Homo sapiens
gggctgaggaacatattttgtt

SEQ ID NO: 9281465 - DNA, 22 bp, Homo sapiens
gggctgagctgttctgagttta

SEQ ID NO: 9281466 - DNA, 22 bp, Homo sapiens
gggctgagctgttctgagttta

SEQ ID NO: 9281467 - DNA, 22 bp, Homo sapiens
gggctgagctgttctgagttta

SEQ ID NO: 9281468 - DNA, 22 bp, Homo sapiens
gggctgaggaacatattttgtt

SEQ ID NO: 9281469 - DNA, 22 bp, Homo sapiens
gggctgaggctaccactggtct

SEQ ID NO: 9281470 - DNA, 22 bp, Homo sapiens
gggctgaggctaccactggtct

SEQ ID NO: 9281471 - DNA, 22 bp, Homo sapiens
gggctgagttcctgcctcactc

SEQ ID NO: 9281472 - DNA, 22 bp, Homo sapiens
gggctgagttcctgcctcactc

SEQ ID NO: 9281473 - DNA, 22 bp, Homo sapiens
gggctgagtgtcccaggccgaa

SEQ ID NO: 9281474 - DNA, 22 bp, Homo sapiens
gggctgagtgtcccaggccgaa

SEQ ID NO: 9281475 - DNA, 22 bp, Homo sapiens
gggctgagttcctgcctcactc

SEQ ID NO: 9281476 - DNA, 22 bp, Homo sapiens
gggctgagtgtcccaggccgaa

SEQ ID NO: 9281477 - DNA, 22 bp, Homo sapiens
gggctgaggctaccactggtct

SEQ ID NO: 9281478 - DNA, 22 bp, Homo sapiens
gggctgaggctaccactggtct

SEQ ID NO: 9281479 - DNA, 22 bp, Homo sapiens
gggctgagggccaattcctact

SEQ ID NO: 9281480 - DNA, 22 bp, Homo sapiens
gggctgagggccaattcctact

SEQ ID NO: 9281481 - DNA, 22 bp, Homo sapiens
gggctgagtgtcccaggccgaa

SEQ ID NO: 9281482 - DNA, 22 bp, Homo sapiens
gggctgagtgggcctcttactt

SEQ ID NO: 9281483 - DNA, 22 bp, Homo sapiens
gggctgagggccaattcctact

SEQ ID NO: 9281484 - DNA, 22 bp, Homo sapiens
gggctgagggccaattcctact

SEQ ID NO: 9281485 - DNA, 22 bp, Homo sapiens
gggctgccaagcctgcctgcct

SEQ ID NO: 9281486 - DNA, 22 bp, Homo sapiens
gggcttgggtattgtgagaggt

SEQ ID NO: 9281487 - DNA, 19 bp, Homo sapiens
gggcttggggctgaagcct

SEQ ID NO: 9281488 - DNA, 22 bp, Homo sapiens
gggcttggctggggccaccaga

SEQ ID NO: 9281489 - DNA, 22 bp, Homo sapiens
gggcttggcacatgggctcagc

SEQ ID NO: 9281490 - DNA, 22 bp, Homo sapiens
gggcttggcacatgggctcagc

SEQ ID NO: 9281491 - DNA, 22 bp, Homo sapiens
gggcttcttgccatggggacgg

SEQ ID NO: 9281492 - DNA, 22 bp, Homo sapiens
ggggccgaccgcggttcaggcc

SEQ ID NO: 9281493 - DNA, 22 bp, Homo sapiens
ggggcggggctctgagaagcat

SEQ ID NO: 9281494 - DNA, 22 bp, Homo sapiens
ggggccgaccgcggttcaggcc

SEQ ID NO: 9281495 - DNA, 22 bp, Homo sapiens
ggggaagaatggcagaaaacat

SEQ ID NO: 9281496 - DNA, 22 bp, Homo sapiens
ggggaagatggccctccatgtg

SEQ ID NO: 9281497 - DNA, 22 bp, Homo sapiens
ggggaagacctggcactacagc

SEQ ID NO: 9281498 - DNA, 22 bp, Homo sapiens
ggggaagagcattgcacggtgt

SEQ ID NO: 9281499 - DNA, 22 bp, Homo sapiens
ggggctgacgggcatgtggctt

SEQ ID NO: 9281500 - DNA, 22 bp, Homo sapiens
ggggctgatggaactcaggcct

SEQ ID NO: 9281501 - DNA, 22 bp, Homo sapiens
ggggctgatggaactcaggcct

SEQ ID NO: 9281502 - DNA, 22 bp, Homo sapiens
ggggctgagaattcagtctcgg

SEQ ID NO: 9281503 - DNA, 22 bp, Homo sapiens
ggggctgagtcagtgggaagag

SEQ ID NO: 9281504 - DNA, 22 bp, Homo sapiens
ggggctggctcactaagagact

SEQ ID NO: 9281505 - DNA, 22 bp, Homo sapiens
ggggctgggatttgaacccagg

SEQ ID NO: 9281506 - DNA, 22 bp, Homo sapiens
gggtaggaaatccagaggtggc

SEQ ID NO: 9281507 - DNA, 22 bp, Homo sapiens
ggggtgtgagtagagctgggga

SEQ ID NO: 9281508 - DNA, 22 bp, Homo sapiens
ggggtggggttactcattgtgc

SEQ ID NO: 9281509 - DNA, 22 bp, Homo sapiens
ggggtggggttactcattgtgc

SEQ ID NO: 9281510 - DNA, 22 bp, Homo sapiens
ggggtggggttactcattgtgc

SEQ ID NO: 9281511 - DNA, 22 bp, Homo sapiens
ggggtgggcgtgcagggacacc

SEQ ID NO: 9281512 - DNA, 22 bp, Homo sapiens
ggggtgggcgtgcagggacacc

SEQ ID NO: 9281513 - DNA, 22 bp, Homo sapiens
ggggtgggcgtgcagggacacc

SEQ ID NO: 9281514 - DNA, 22 bp, Homo sapiens
ggggtgggcgtgcagggacacc

SEQ ID NO: 9281515 - DNA, 22 bp, Homo sapiens
ggggtgggcgtgcagggacacc

SEQ ID NO: 9281516 - DNA, 22 bp, Homo sapiens
ggggctggtggtggtttctcca

SEQ ID NO: 9281517 - DNA, 22 bp, Homo sapiens
ggggctggtggtggtttctcca

SEQ ID NO: 9281518 - DNA, 22 bp, Homo sapiens
gggtggagcttggacaccagta

SEQ ID NO: 9281519 - DNA, 22 bp, Homo sapiens
gggtggagcttggacaccagta

SEQ ID NO: 9281520 - DNA, 22 bp, Homo sapiens
gggtggaggagaacaggcccca

SEQ ID NO: 9281521 - DNA, 22 bp, Homo sapiens
gggtggaggtgggttttgagat

SEQ ID NO: 9281522 - DNA, 22 bp, Homo sapiens
gggtggaggtgggttttgagat

SEQ ID NO: 9281523 - DNA, 22 bp, Homo sapiens
gggtggagtagaaagatgaatt

SEQ ID NO: 9281524 - DNA, 22 bp, Homo sapiens
gggtggagtagaaagatgaatt

SEQ ID NO: 9281525 - DNA, 22 bp, Homo sapiens
gggtggagtgtgaaatctggct

SEQ ID NO: 9281526 - DNA, 22 bp, Homo sapiens
gggtggagtagaaagatgaatt

SEQ ID NO: 9281527 - DNA, 22 bp, Homo sapiens
gggtagggtgacttaggctggc

SEQ ID NO: 9281528 - DNA, 22 bp, Homo sapiens
gggtagggtgacttaggctggc

SEQ ID NO: 9281529 - DNA, 22 bp, Homo sapiens
gggtaggatggtagaagggacc

SEQ ID NO: 9281530 - DNA, 22 bp, Homo sapiens
gggtaggatggtagaagggacc

SEQ ID NO: 9281531 - DNA, 22 bp, Homo sapiens
gggtaggatggtagaagggacc

SEQ ID NO: 9281532 - DNA, 22 bp, Homo sapiens
gggtaggcaaagcaatgacgtt

SEQ ID NO: 9281533 - DNA, 22 bp, Homo sapiens
gggtaggagaggtgtctgtgtg

SEQ ID NO: 9281534 - DNA, 22 bp, Homo sapiens
ggtcactggtctctgcttccat

SEQ ID NO: 9281535 - DNA, 22 bp, Homo sapiens
ggtcactgagctgtaattctgt

SEQ ID NO: 9281536 - DNA, 22 bp, Homo sapiens
ggtcagaaggcagttaaacaaa

SEQ ID NO: 9281537 - DNA, 22 bp, Homo sapiens
ggtcagaacaagggtaaataaa

SEQ ID NO: 9281538 - DNA, 22 bp, Homo sapiens
ggtcagaacaagcaaataatag

SEQ ID NO: 9281539 - DNA, 22 bp, Homo sapiens
ggtcagaagtgcaaaatcagtt

SEQ ID NO: 9281540 - DNA, 22 bp, Homo sapiens
ggtcagagaaaagtagggtgtt

SEQ ID NO: 9281541 - DNA, 22 bp, Homo sapiens
ggtcagaggtcacaagctggca

SEQ ID NO: 9281542 - DNA, 22 bp, Homo sapiens
ggtcagagctggagagataggg

SEQ ID NO: 9281543 - DNA, 22 bp, Homo sapiens
ggtaggggaagacaagtgaaaa

SEQ ID NO: 9281544 - DNA, 22 bp, Homo sapiens
ggtaggggaagacaagtgaaaa

SEQ ID NO: 9281545 - DNA, 22 bp, Homo sapiens
gggtggctcctatgggcatagc

SEQ ID NO: 9281546 - DNA, 22 bp, Homo sapiens
gggtggccttcatagctcaggg

SEQ ID NO: 9281547 - DNA, 22 bp, Homo sapiens
gggtggccttaggcaagtcact

SEQ ID NO: 9281548 - DNA, 21 bp, Homo sapiens
gggtggccgcatgggtgcgtg

SEQ ID NO: 9281549 - DNA, 22 bp, Homo sapiens
gggtggcatagggtgatggctt

SEQ ID NO: 9281550 - DNA, 22 bp, Homo sapiens
gggtggcacaggtgcagagggt

SEQ ID NO: 9281551 - DNA, 20 bp, Homo sapiens
gggtggagttgcggtctgtg

SEQ ID NO: 9281552 - DNA, 22 bp, Homo sapiens
gggtggcaggattggcaggagt

SEQ ID NO: 9281553 - DNA, 22 bp, Homo sapiens
gggtggcacaggtgcagagggt

SEQ ID NO: 9281554 - DNA, 22 bp, Homo sapiens
gggtggcacaggtgcagagggt

SEQ ID NO: 9281555 - DNA, 22 bp, Homo sapiens
gggtggcacaggtgcagagggt

SEQ ID NO: 9281556 - DNA, 22 bp, Homo sapiens
ggtccctggttccctctgagct

SEQ ID NO: 9281557 - DNA, 22 bp, Homo sapiens
ggtccctggaagtccctcttct

SEQ ID NO: 9281558 - DNA, 22 bp, Homo sapiens
ggtccctggggaactaggctgt

SEQ ID NO: 9281559 - DNA, 22 bp, Homo sapiens
ggtcagcagtgcagggcagagc

SEQ ID NO: 9281560 - DNA, 22 bp, Homo sapiens
ggtccttgtgtctctatggccc

SEQ ID NO: 9281561 - DNA, 22 bp, Homo sapiens
ggtcgctgtgtaggttcagcta

SEQ ID NO: 9281562 - DNA, 22 bp, Homo sapiens
ggtcgctgtgtaggttcagcta

SEQ ID NO: 9281563 - DNA, 22 bp, Homo sapiens
ggtcgctgtgtaggttcagcta

SEQ ID NO: 9281564 - DNA, 22 bp, Homo sapiens
ggtctctgagtgaggacctggg

SEQ ID NO: 9281565 - DNA, 22 bp, Homo sapiens
ggtctctgacttagagatggat

SEQ ID NO: 9281566 - DNA, 22 bp, Homo sapiens
ggtctctgacttagagatggat

SEQ ID NO: 9281567 - DNA, 22 bp, Homo sapiens
ggtctctggccttggagattga

SEQ ID NO: 9281568 - DNA, 22 bp, Homo sapiens
ggtctctgtcactgagtggccc

SEQ ID NO: 9281569 - DNA, 22 bp, Homo sapiens
ggtctcctgaggctgccacacc

SEQ ID NO: 9281570 - DNA, 22 bp, Homo sapiens
ggtctcctgaggctgccacacc

SEQ ID NO: 9281571 - DNA, 22 bp, Homo sapiens
ggtctcaggtagggcctaggaa

SEQ ID NO: 9281572 - DNA, 22 bp, Homo sapiens
ggtctcagctggagtccttggt

SEQ ID NO: 9281573 - DNA, 22 bp, Homo sapiens
ggtgtgtgaggagtcacttagt

SEQ ID NO: 9281574 - DNA, 19 bp, Homo sapiens
ggtgtgtgctggggcctgt

SEQ ID NO: 9281575 - DNA, 19 bp, Homo sapiens
ggtgtgtgctggggcctgt

SEQ ID NO: 9281576 - DNA, 22 bp, Homo sapiens
ggtgtgtggttttgatacagtc

SEQ ID NO: 9281577 - DNA, 22 bp, Homo sapiens
ggtgtgtgtggattagcatgcc

SEQ ID NO: 9281578 - DNA, 22 bp, Homo sapiens
ggtgtgtgtggattagcatgcc

SEQ ID NO: 9281579 - DNA, 22 bp, Homo sapiens
ggtttattgaaggccaccccac

SEQ ID NO: 9281580 - DNA, 22 bp, Homo sapiens
ggtttattgttaataagtttga

SEQ ID NO: 9281581 - DNA, 22 bp, Homo sapiens
ggtttattaatgtgaactgtat

SEQ ID NO: 9281582 - DNA, 22 bp, Homo sapiens
ggtgttgggctcactggtcctt

SEQ ID NO: 9281583 - DNA, 22 bp, Homo sapiens
ggtgttgggagagctggttttg

SEQ ID NO: 9281584 - DNA, 22 bp, Homo sapiens
ggtgttggaacatggtgagatt

SEQ ID NO: 9281585 - DNA, 22 bp, Homo sapiens
ggtgtgggtccttgtgcttgct

SEQ ID NO: 9281586 - DNA, 22 bp, Homo sapiens
ggtgtgggtccttgtgcttgct

SEQ ID NO: 9281587 - DNA, 22 bp, Homo sapiens
ggtgtgggggcagctctgatat

SEQ ID NO: 9281588 - DNA, 22 bp, Homo sapiens
ggtgtggggaggttctgcttct

SEQ ID NO: 9281589 - DNA, 22 bp, Homo sapiens
ggtgtgggccctgatgtcagca

SEQ ID NO: 9281590 - DNA, 22 bp, Homo sapiens
ggtgtgggggcaagtttgagat

SEQ ID NO: 9281591 - DNA, 22 bp, Homo sapiens
ggtgtgggaactacaggttttt

SEQ ID NO: 9281592 - DNA, 22 bp, Homo sapiens
ggtgtggatcatctgaggtcag

SEQ ID NO: 9281593 - DNA, 22 bp, Homo sapiens
ggtgtgggccctgatgtcagca

SEQ ID NO: 9281594 - DNA, 22 bp, Homo sapiens
ggtgtgggccctgatgtcagca

SEQ ID NO: 9281595 - DNA, 22 bp, Homo sapiens
ggtgtgggagagattctttcct

SEQ ID NO: 9281596 - DNA, 22 bp, Homo sapiens
ggtggcctcggtggtgcacagg

SEQ ID NO: 9281597 - DNA, 22 bp, Homo sapiens
ggtggcctgaattagctcaggg

SEQ ID NO: 9281598 - DNA, 22 bp, Homo sapiens
ggtggcctgccctgatccctgg

SEQ ID NO: 9281599 - DNA, 22 bp, Homo sapiens
ggtctggataattccagtacct

SEQ ID NO: 9281600 - DNA, 22 bp, Homo sapiens
ggtctggagtagatgagtcatg

SEQ ID NO: 9281601 - DNA, 22 bp, Homo sapiens
ggtctctgtttggggctggcaa

SEQ ID NO: 9281602 - DNA, 22 bp, Homo sapiens
ggtctgaattccagcccctctg

SEQ ID NO: 9281603 - DNA, 22 bp, Homo sapiens
ggtctggaccatggacgccggg

SEQ ID NO: 9281604 - DNA, 22 bp, Homo sapiens
gtcctgggcctgctgaggctga

SEQ ID NO: 9281605 - DNA, 22 bp, Homo sapiens
gtcctgggcccaggggctgcct

SEQ ID NO: 9281606 - DNA, 22 bp, Homo sapiens
gtcctgggcatgcagggctttc

SEQ ID NO: 9281607 - DNA, 22 bp, Homo sapiens
gtcctgggcccaggggctgcct

SEQ ID NO: 9281608 - DNA, 20 bp, Homo sapiens
gtcctgggagccacagcaca

SEQ ID NO: 9281609 - DNA, 17 bp, Homo sapiens
gtcctgggaggagagag

SEQ ID NO: 9281610 - DNA, 17 bp, Homo sapiens
gtcctgggaggagagag

SEQ ID NO: 9281611 - DNA, 17 bp, Homo sapiens
gtcctgggaggagagag

SEQ ID NO: 9281612 - DNA, 22 bp, Homo sapiens
gtcctgggaggggctggtcctg

SEQ ID NO: 9281613 - DNA, 22 bp, Homo sapiens
gtccctgccctcctgggactca

SEQ ID NO: 9281614 - DNA, 22 bp, Homo sapiens
gtccctgcatctgcaggccatg

SEQ ID NO: 9281615 - DNA, 22 bp, Homo sapiens
gtcctgggaactggacagctaa

SEQ ID NO: 9281616 - DNA, 22 bp, Homo sapiens
gtcctgggaactggacagctaa

SEQ ID NO: 9281617 - DNA, 22 bp, Homo sapiens
gtcctgggagatgggaccctga

SEQ ID NO: 9281618 - DNA, 20 bp, Homo sapiens
gtcctgggagccacagcaca

SEQ ID NO: 9281619 - DNA, 20 bp, Homo sapiens
gtcctgggagccacagcaca

SEQ ID NO: 9281620 - DNA, 22 bp, Homo sapiens
gtcctgggaaggaagccaggga

SEQ ID NO: 9281621 - DNA, 22 bp, Homo sapiens
gtcctgggaaggaagccaggga

SEQ ID NO: 9281622 - DNA, 22 bp, Homo sapiens
gtcctgggaaggaagccaggga

SEQ ID NO: 9281623 - DNA, 22 bp, Homo sapiens
gtcctgggaaggaagccaggga

SEQ ID NO: 9281624 - DNA, 22 bp, Homo sapiens
gtccccagctaatctctttgcc

SEQ ID NO: 9281625 - DNA, 22 bp, Homo sapiens
gtcccctcaaaattcatatgtt

SEQ ID NO: 9281626 - DNA, 22 bp, Homo sapiens
gtcccctcagccacccatgggg

SEQ ID NO: 9281627 - DNA, 22 bp, Homo sapiens
gtcccctggcccccagcgtcgg

SEQ ID NO: 9281628 - DNA, 22 bp, Homo sapiens
gtcccctgtccagggccagcca

SEQ ID NO: 9281629 - DNA, 22 bp, Homo sapiens
gtccctagtggaaagacatgat

SEQ ID NO: 9281630 - DNA, 22 bp, Homo sapiens
gtccctcaaggtccagtcatgg

SEQ ID NO: 9281631 - DNA, 22 bp, Homo sapiens
gtccctcacccagatgctccca

SEQ ID NO: 9281632 - DNA, 22 bp, Homo sapiens
gtccctcagtagtgcacagtgg

SEQ ID NO: 9281633 - DNA, 22 bp, Homo sapiens
gtccctcactggaccatatgaa

SEQ ID NO: 9281634 - DNA, 22 bp, Homo sapiens
gtccctctgtgtccctgcagtc

SEQ ID NO: 9281635 - DNA, 22 bp, Homo sapiens
gtccctctgggccatcaggtcc

SEQ ID NO: 9281636 - DNA, 22 bp, Homo sapiens
gtccctctgtgtccctgcagtc

SEQ ID NO: 9281637 - DNA, 22 bp, Homo sapiens
gtccctctgctctagagagcca

SEQ ID NO: 9281638 - DNA, 22 bp, Homo sapiens
gtccctgcatcaccacgggact

SEQ ID NO: 9281639 - DNA, 22 bp, Homo sapiens
gtccctgagcctggcatttccc

SEQ ID NO: 9281640 - DNA, 22 bp, Homo sapiens
gtccctctgtgtccctgcagtc

SEQ ID NO: 9281641 - DNA, 22 bp, Homo sapiens
gtccactgctgtgtgcttcacc

SEQ ID NO: 9281642 - DNA, 22 bp, Homo sapiens
gtccacagctggccagggcctc

SEQ ID NO: 9281643 - DNA, 18 bp, Homo sapiens
gtccacagattcttcact

SEQ ID NO: 9281644 - DNA, 22 bp, Homo sapiens
gtccacataggaacccagcttc

SEQ ID NO: 9281645 - DNA, 22 bp, Homo sapiens
gtccacagctggccagggcctc

SEQ ID NO: 9281646 - DNA, 22 bp, Homo sapiens
gtatttccattagtgtgtgcac

SEQ ID NO: 9281647 - DNA, 22 bp, Homo sapiens
gtatttcatcttgaaaaccagt

SEQ ID NO: 9281648 - DNA, 22 bp, Homo sapiens
gtccaaaagagccagccgggcg

SEQ ID NO: 9281649 - DNA, 22 bp, Homo sapiens
gtccaagagtcaagaagggggc

SEQ ID NO: 9281650 - DNA, 22 bp, Homo sapiens
gtaaaacaagctttatggttcc

SEQ ID NO: 9281651 - DNA, 22 bp, Homo sapiens
gtaaaacatgttttaactagga

SEQ ID NO: 9281652 - DNA, 22 bp, Homo sapiens
gtaaaacatgttttaactagga

SEQ ID NO: 9281653 - DNA, 22 bp, Homo sapiens
ggttttcaaagaggcatttcat

SEQ ID NO: 9281654 - DNA, 22 bp, Homo sapiens
ggttttcaaagaggcatttcat

SEQ ID NO: 9281655 - DNA, 22 bp, Homo sapiens
ggttttcacctccagaatgtgc

SEQ ID NO: 9281656 - DNA, 22 bp, Homo sapiens
ggttttattaactttaacatca

SEQ ID NO: 9281657 - DNA, 22 bp, Homo sapiens
ggttttattaccccttaaacac

SEQ ID NO: 9281658 - DNA, 22 bp, Homo sapiens
ggttttatcctacccacacagc

SEQ ID NO: 9281659 - DNA, 22 bp, Homo sapiens
ggttttatagcagtactatcag

SEQ ID NO: 9281660 - DNA, 22 bp, Homo sapiens
ggtttgcacgatatttccatgg

SEQ ID NO: 9281661 - DNA, 22 bp, Homo sapiens
ggtttgttggggtccaggccca

SEQ ID NO: 9281662 - DNA, 22 bp, Homo sapiens
ggttttaactacagaattgcaa

SEQ ID NO: 9281663 - DNA, 22 bp, Homo sapiens
gtacattttactttgtttgaat

SEQ ID NO: 9281664 - DNA, 22 bp, Homo sapiens
gtacatttctcccaacactaaa

SEQ ID NO: 9281665 - DNA, 22 bp, Homo sapiens
gtacatttctcttgttcttatt

SEQ ID NO: 9281666 - DNA, 22 bp, Homo sapiens
gtacccagtgattccttcttca

SEQ ID NO: 9281667 - DNA, 22 bp, Homo sapiens
gtaccattgtttgaagtactca

SEQ ID NO: 9281668 - DNA, 22 bp, Homo sapiens
gtacccaggcacgccttgctga

SEQ ID NO: 9281669 - DNA, 22 bp, Homo sapiens
gtacattttgaggttaaaacaa

SEQ ID NO: 9281670 - DNA, 22 bp, Homo sapiens
gtacatttctcccaacactaaa

SEQ ID NO: 9281671 - DNA, 22 bp, Homo sapiens
gtacattttgaggttaaaacaa

SEQ ID NO: 9281672 - DNA, 22 bp, Homo sapiens
gtaaaactgcagaacttggagg

SEQ ID NO: 9281673 - DNA, 22 bp, Homo sapiens
gtaaaactgtctaatggtatat

SEQ ID NO: 9281674 - DNA, 22 bp, Homo sapiens
gtaaaactgtctaatggtatat

SEQ ID NO: 9281675 - DNA, 22 bp, Homo sapiens
gtaaaactgtctaatggtatat

SEQ ID NO: 9281676 - DNA, 23 bp, Homo sapiens
gtaaaatacgcagtgcagtgtga

SEQ ID NO: 9281677 - DNA, 22 bp, Homo sapiens
gtacatttaggattcattgaaa

SEQ ID NO: 9281678 - DNA, 22 bp, Homo sapiens
gtacatttaggattcattgaaa

SEQ ID NO: 9281679 - DNA, 22 bp, Homo sapiens
gtacatttatttttgcagcata

SEQ ID NO: 9281680 - DNA, 22 bp, Homo sapiens
gtacatttcagtttccttaaga

SEQ ID NO: 9281681 - DNA, 22 bp, Homo sapiens
gtacatttcatttaaatgatgt

SEQ ID NO: 9281682 - DNA, 22 bp, Homo sapiens
gtattagaagaaattataggta

SEQ ID NO: 9281683 - DNA, 22 bp, Homo sapiens
gtagacagaaagcggaatcata

SEQ ID NO: 9281684 - DNA, 22 bp, Homo sapiens
gtagacaagcacaggactcaga

SEQ ID NO: 9281685 - DNA, 22 bp, Homo sapiens
gtattagcaagagttgtgattt

SEQ ID NO: 9281686 - DNA, 22 bp, Homo sapiens
gtattagctgccttggagctaa

SEQ ID NO: 9281687 - DNA, 22 bp, Homo sapiens
gtattagctgttagctacatca

SEQ ID NO: 9281688 - DNA, 22 bp, Homo sapiens
gtattattctcagctttgggat

SEQ ID NO: 9281689 - DNA, 22 bp, Homo sapiens
gtagaattacctctctatgtcc

SEQ ID NO: 9281690 - DNA, 22 bp, Homo sapiens
gtagaattttaataatggagat

SEQ ID NO: 9281691 - DNA, 22 bp, Homo sapiens
gtagaactcccagtggtattgt

SEQ ID NO: 9281692 - DNA, 22 bp, Homo sapiens
gtagaactaggacttcaggtat

SEQ ID NO: 9281693 - DNA, 20 bp, Homo sapiens
gtagaaccatgtgtgctggg

SEQ ID NO: 9281694 - DNA, 23 bp, Homo sapiens
gtatttcagcattctcagttaaa

SEQ ID NO: 9281695 - DNA, 22 bp, Homo sapiens
gtattgcattttgaatgcatgg

SEQ ID NO: 9281696 - DNA, 22 bp, Homo sapiens
gtattgcattttaatatgtgca

SEQ ID NO: 9281697 - DNA, 21 bp, Homo sapiens
gtattgcagagttatgtgctc

SEQ ID NO: 9281698 - DNA, 22 bp, Homo sapiens
gtattgcatagacctgggatga

SEQ ID NO: 9281699 - DNA, 22 bp, Homo sapiens
gtattgcattgtttcaagctgt

SEQ ID NO: 9281700 - DNA, 22 bp, Homo sapiens
gtattgcaattactcttcttct

SEQ ID NO: 9281701 - DNA, 22 bp, Homo sapiens
gtattctgggccgattacaaaa

SEQ ID NO: 9281702 - DNA, 22 bp, Homo sapiens
gtattctcaggtggttcctcga

SEQ ID NO: 9281703 - DNA, 22 bp, Homo sapiens
gtcctgggcggagggctgctgt

SEQ ID NO: 9281704 - DNA, 22 bp, Homo sapiens
gtcctgggcctgctgaggctga

SEQ ID NO: 9281705 - DNA, 22 bp, Homo sapiens
gtcctggggaatacagaagccg

SEQ ID NO: 9281706 - DNA, 22 bp, Homo sapiens
gtcctggggaatacagaagccg

SEQ ID NO: 9281707 - DNA, 22 bp, Homo sapiens
gtcctggggatacagaagtgaa

SEQ ID NO: 9281708 - DNA, 22 bp, Homo sapiens
gtcctggggatacagaagtgaa

SEQ ID NO: 9281709 - DNA, 22 bp, Homo sapiens
gtcctggggatacagaagtgaa

SEQ ID NO: 9281710 - DNA, 22 bp, Homo sapiens
gtcctggggatacagaagtgaa

SEQ ID NO: 9281711 - DNA, 22 bp, Homo sapiens
gtcctggggatacagaagtgaa

SEQ ID NO: 9281712 - DNA, 22 bp, Homo sapiens
gtcctggggattatagagtgtt

SEQ ID NO: 9281713 - DNA, 22 bp, Homo sapiens
gtcctggggattatagagtgtt

SEQ ID NO: 9281714 - DNA, 22 bp, Homo sapiens
gtcctggggattatagagtgtt

SEQ ID NO: 9281715 - DNA, 22 bp, Homo sapiens
gtcctggggattatagagtgtt

SEQ ID NO: 9281716 - DNA, 22 bp, Homo sapiens
gtctgccccacaggctcagttg

SEQ ID NO: 9281717 - DNA, 22 bp, Homo sapiens
gtcctgggtccccgcaggtcag

SEQ ID NO: 9281718 - DNA, 22 bp, Homo sapiens
gtcctgggggcagctgtgtcca

SEQ ID NO: 9281719 - DNA, 22 bp, Homo sapiens
gtctgcccatctccgggcgggg

SEQ ID NO: 9281720 - DNA, 22 bp, Homo sapiens
gtcctgggggcagctgtgtcca

SEQ ID NO: 9281721 - DNA, 22 bp, Homo sapiens
gtcctgggggcagctgtgtcca

SEQ ID NO: 9281722 - DNA, 22 bp, Homo sapiens
gtcctgggggcagctgtgtcca

SEQ ID NO: 9281723 - DNA, 22 bp, Homo sapiens
gtctgccctcacgccagctggg

SEQ ID NO: 9281724 - DNA, 22 bp, Homo sapiens
gtctgccctcacgccagctggg

SEQ ID NO: 9281725 - DNA, 22 bp, Homo sapiens
gtctgccctcacatgcactctt

SEQ ID NO: 9281726 - DNA, 22 bp, Homo sapiens
gtctgcccggccttcctccacc

SEQ ID NO: 9281727 - DNA, 22 bp, Homo sapiens
gtctgcccttcctctccacgat

SEQ ID NO: 9281728 - DNA, 22 bp, Homo sapiens
gtctggaggaaaaggttaaatg

SEQ ID NO: 9281729 - DNA, 22 bp, Homo sapiens
gtctggaggaggaagaaggcac

SEQ ID NO: 9281730 - DNA, 22 bp, Homo sapiens
gtctggaggagggctctgcggc

SEQ ID NO: 9281731 - DNA, 22 bp, Homo sapiens
gtctggaggcactttctcatga

SEQ ID NO: 9281732 - DNA, 22 bp, Homo sapiens
gtctgctggtgcctggcctgcg

SEQ ID NO: 9281733 - DNA, 22 bp, Homo sapiens
gtctgctgcagtcgtggctcta

SEQ ID NO: 9281734 - DNA, 22 bp, Homo sapiens
gtctgctgcagagcatggcttt

SEQ ID NO: 9281735 - DNA, 22 bp, Homo sapiens
gtctgcccttggctcagccata

SEQ ID NO: 9281736 - DNA, 22 bp, Homo sapiens
gtgaaggactagcatggagggc

SEQ ID NO: 9281737 - DNA, 22 bp, Homo sapiens
gtgaaggactgaatgaaaatgt

SEQ ID NO: 9281738 - DNA, 22 bp, Homo sapiens
gtgaaggactagcatggagggc

SEQ ID NO: 9281739 - DNA, 22 bp, Homo sapiens
gtgaaggaggggccacagatat

SEQ ID NO: 9281740 - DNA, 22 bp, Homo sapiens
gtgaaggaggggccacagatat

SEQ ID NO: 9281741 - DNA, 22 bp, Homo sapiens
gtgaaggagttatcagtggtta

SEQ ID NO: 9281742 - DNA, 22 bp, Homo sapiens
gtgaccatcatctcagctagtt

SEQ ID NO: 9281743 - DNA, 22 bp, Homo sapiens
gtgaaggagttatcagtggtta

SEQ ID NO: 9281744 - DNA, 22 bp, Homo sapiens
gtgaagcagttgcgtgggttcc

SEQ ID NO: 9281745 - DNA, 22 bp, Homo sapiens
gtgaagcagttgcgtgggttcc

SEQ ID NO: 9281746 - DNA, 22 bp, Homo sapiens
gtgaagcatatgcttctctgcc

SEQ ID NO: 9281747 - DNA, 22 bp, Homo sapiens
gtgaagcataactgaaggattt

SEQ ID NO: 9281748 - DNA, 22 bp, Homo sapiens
gtgaagcagggaaggaaaggat

SEQ ID NO: 9281749 - DNA, 22 bp, Homo sapiens
gtgaagcagagtgtggaagcaa

SEQ ID NO: 9281750 - DNA, 22 bp, Homo sapiens
gtgaagcacgctgccgcactgg

SEQ ID NO: 9281751 - DNA, 22 bp, Homo sapiens
gtgaagcacatgggcgttgggt

SEQ ID NO: 9281752 - DNA, 22 bp, Homo sapiens
gtgaagacttggagaagttaag

SEQ ID NO: 9281753 - DNA, 21 bp, Homo sapiens
gtgaagactttgcctttaaga

SEQ ID NO: 9281754 - DNA, 22 bp, Homo sapiens
gtgaagaaggcaatacaaagaa

SEQ ID NO: 9281755 - DNA, 22 bp, Homo sapiens
gtgaagaccagggaacgctggc

SEQ ID NO: 9281756 - DNA, 22 bp, Homo sapiens
gtgaagaccagggaacgctggc

SEQ ID NO: 9281757 - DNA, 22 bp, Homo sapiens
gtgaagaccagggaacgctggc

SEQ ID NO: 9281758 - DNA, 22 bp, Homo sapiens
gtgaacttccagatgataaaca

SEQ ID NO: 9281759 - DNA, 18 bp, Homo sapiens
gtctggaggtcaggagct

SEQ ID NO: 9281760 - DNA, 22 bp, Homo sapiens
gtctggaggcccgtcagcccta

SEQ ID NO: 9281761 - DNA, 22 bp, Homo sapiens
gtctggagggaagagatgtcag

SEQ ID NO: 9281762 - DNA, 22 bp, Homo sapiens
gtctggaggggagatttgggtt

SEQ ID NO: 9281763 - DNA, 22 bp, Homo sapiens
gtctggagtggggcctgagaat

SEQ ID NO: 9281764 - DNA, 22 bp, Homo sapiens
gtgaaaataaggctggttcttg

SEQ ID NO: 9281765 - DNA, 22 bp, Homo sapiens
gtgaaactgctttgtaaactgt

SEQ ID NO: 9281766 - DNA, 22 bp, Homo sapiens
gtgaaacttcacattttgatag

SEQ ID NO: 9281767 - DNA, 22 bp, Homo sapiens
gtgaaatatttaacgtccaggt

SEQ ID NO: 9281768 - DNA, 22 bp, Homo sapiens
gtgaaatgaatctggaaatatt

SEQ ID NO: 9281769 - DNA, 22 bp, Homo sapiens
gtgaaatattttgtttatgtca

SEQ ID NO: 9281770 - DNA, 22 bp, Homo sapiens
gtgaaatattttgtttatgtca

SEQ ID NO: 9281771 - DNA, 22 bp, Homo sapiens
gtgaacaggagaaagtgatgga

SEQ ID NO: 9281772 - DNA, 22 bp, Homo sapiens
gtgaacaaggagactacaactt

SEQ ID NO: 9281773 - DNA, 22 bp, Homo sapiens
gtgaacagactgttctctacag

SEQ ID NO: 9281774 - DNA, 22 bp, Homo sapiens
gtgaacaaaatagcacatatta

SEQ ID NO: 9281775 - DNA, 22 bp, Homo sapiens
gtgaacatcagattacatgaga

SEQ ID NO: 9281776 - DNA, 22 bp, Homo sapiens
gtgaactattgggtatcataaa

SEQ ID NO: 9281777 - DNA, 22 bp, Homo sapiens
gtgaactaaggattcaaacttc

SEQ ID NO: 9281778 - DNA, 22 bp, Homo sapiens
gtgctaggattacaggcatggg

SEQ ID NO: 9281779 - DNA, 22 bp, Homo sapiens
gtgccacatggtccatgtatca

SEQ ID NO: 9281780 - DNA, 22 bp, Homo sapiens
gtgccacatggcctaatagaga

SEQ ID NO: 9281781 - DNA, 20 bp, Homo sapiens
gtgcatttcacctgtactgt

SEQ ID NO: 9281782 - DNA, 22 bp, Homo sapiens
gtgcatttgtgcatgcacatgt

SEQ ID NO: 9281783 - DNA, 22 bp, Homo sapiens
gtgcatttggtgactctcaccc

SEQ ID NO: 9281784 - DNA, 22 bp, Homo sapiens
gtgcagtggcagatcctagctc

SEQ ID NO: 9281785 - DNA, 19 bp, Homo sapiens
gtgcagttcagagttcaat

SEQ ID NO: 9281786 - DNA, 22 bp, Homo sapiens
gtgcagttcccaaggtcacaca

SEQ ID NO: 9281787 - DNA, 19 bp, Homo sapiens
gtgcagttcagagttcaat

SEQ ID NO: 9281788 - DNA, 22 bp, Homo sapiens
gtgcagttcccaaggtcacaca

SEQ ID NO: 9281789 - DNA, 22 bp, Homo sapiens
gtgcagttgatagttttagtga

SEQ ID NO: 9281790 - DNA, 22 bp, Homo sapiens
gtgcagttgtggacatgacaac

SEQ ID NO: 9281791 - DNA, 22 bp, Homo sapiens
gtgcagttgagacaataggctg

SEQ ID NO: 9281792 - DNA, 22 bp, Homo sapiens
gtgcagttgaagcatggggaga

SEQ ID NO: 9281793 - DNA, 22 bp, Homo sapiens
gtgcagttcttgtaacatgctg

SEQ ID NO: 9281794 - DNA, 22 bp, Homo sapiens
gtgcatatggttacagcaccgc

SEQ ID NO: 9281795 - DNA, 22 bp, Homo sapiens
gtgcatatatgtgcagcatcaa

SEQ ID NO: 9281796 - DNA, 22 bp, Homo sapiens
gtgcatatatgcacatatgtgt

SEQ ID NO: 9281797 - DNA, 22 bp, Homo sapiens
gtgcatatatatgggagggagc

SEQ ID NO: 9281798 - DNA, 22 bp, Homo sapiens
gtgcatttatatttgcctttgg

SEQ ID NO: 9281799 - DNA, 22 bp, Homo sapiens
gtgcatatgtgtgtatacaaac

SEQ ID NO: 9281800 - DNA, 22 bp, Homo sapiens
gtgcatatatgtgcagcatcaa

SEQ ID NO: 9281801 - DNA, 22 bp, Homo sapiens
gtgcatatgtacctgtgatcat

SEQ ID NO: 9281802 - DNA, 22 bp, Homo sapiens
gtgcagatcctgattgcagttc

SEQ ID NO: 9281803 - DNA, 22 bp, Homo sapiens
gtgcagatcctgattgcagttc

SEQ ID NO: 9281804 - DNA, 22 bp, Homo sapiens
gtgcagattcccgggcctctcc

SEQ ID NO: 9281805 - DNA, 22 bp, Homo sapiens
gtgcagtgagcagtgcagcacc

SEQ ID NO: 9281806 - DNA, 22 bp, Homo sapiens
gtgcaggtggttggcccagccg

SEQ ID NO: 9281807 - DNA, 22 bp, Homo sapiens
gtgcagtgaccctggagagctg

SEQ ID NO: 9281808 - DNA, 22 bp, Homo sapiens
gtgcagtgagcagtgcagcacc

SEQ ID NO: 9281809 - DNA, 22 bp, Homo sapiens
gtgcagtgagcagtgcagcacc

SEQ ID NO: 9281810 - DNA, 22 bp, Homo sapiens
gtgcagtggcagatcctagctc

SEQ ID NO: 9281811 - DNA, 22 bp, Homo sapiens
gtgcagtgaccctggagagctg

SEQ ID NO: 9281812 - DNA, 22 bp, Homo sapiens
gtgcagtgaccctggagagctg

SEQ ID NO: 9281813 - DNA, 22 bp, Homo sapiens
gtgcagtccctcctcccaaggc

SEQ ID NO: 9281814 - DNA, 22 bp, Homo sapiens
gtgcagtgaccctggagagctg

SEQ ID NO: 9281815 - DNA, 22 bp, Homo sapiens
gtgcagtgaaaaaagaatgtcc

SEQ ID NO: 9281816 - DNA, 18 bp, Homo sapiens
gtgcagattgcggagccc

SEQ ID NO: 9281817 - DNA, 22 bp, Homo sapiens
gtgcagggtagcgacggcagga

SEQ ID NO: 9281818 - DNA, 22 bp, Homo sapiens
gtgcaggtggatttgggctcaa

SEQ ID NO: 9281819 - DNA, 22 bp, Homo sapiens
gtgcaggtggcttctagcttct

SEQ ID NO: 9281820 - DNA, 22 bp, Homo sapiens
gtgcagagaaatgagaagtcga

SEQ ID NO: 9281821 - DNA, 22 bp, Homo sapiens
gtgcagagaaatgagaagtcga

SEQ ID NO: 9281822 - DNA, 22 bp, Homo sapiens
gtgcagagaaatgagaagtcga

SEQ ID NO: 9281823 - DNA, 22 bp, Homo sapiens
gtgcagagcaagggctgagggc

SEQ ID NO: 9281824 - DNA, 22 bp, Homo sapiens
gtgcagagaggtggagggactt

SEQ ID NO: 9281825 - DNA, 22 bp, Homo sapiens
gtgcaccagtcacatgggcaga

SEQ ID NO: 9281826 - DNA, 22 bp, Homo sapiens
gtgcacatcgtgcaggtttgtt

SEQ ID NO: 9281827 - DNA, 22 bp, Homo sapiens
gtgcacatcgtgcaggtttgtt

SEQ ID NO: 9281828 - DNA, 22 bp, Homo sapiens
gtgagcaggatttcatggtgta

SEQ ID NO: 9281829 - DNA, 22 bp, Homo sapiens
gtgagacaagatttgtaggcag

SEQ ID NO: 9281830 - DNA, 22 bp, Homo sapiens
gtgagaataccagcagtgagaa

SEQ ID NO: 9281831 - DNA, 22 bp, Homo sapiens
gtgagaagataagtattgcaaa

SEQ ID NO: 9281832 - DNA, 22 bp, Homo sapiens
gtgagcagctcagggtggtctc

SEQ ID NO: 9281833 - DNA, 22 bp, Homo sapiens
gtgagcaggataggggctccct

SEQ ID NO: 9281834 - DNA, 23 bp, Homo sapiens
gtgagcagcccactaggaatgcc

SEQ ID NO: 9281835 - DNA, 22 bp, Homo sapiens
gtgagcagcctcacctgagggt

SEQ ID NO: 9281836 - DNA, 22 bp, Homo sapiens
gtgagacacgtgtgtgacctgg

SEQ ID NO: 9281837 - DNA, 23 bp, Homo sapiens
gtgagcagcccactaggaatgcc

SEQ ID NO: 9281838 - DNA, 22 bp, Homo sapiens
gtgagagaaattggagggaatg

SEQ ID NO: 9281839 - DNA, 22 bp, Homo sapiens
gttttcatgtctattgggcata

SEQ ID NO: 9281840 - DNA, 22 bp, Homo sapiens
gtttccatggctctgttaatgg

SEQ ID NO: 9281841 - DNA, 22 bp, Homo sapiens
gtttccaggctttggtatggtt

SEQ ID NO: 9281842 - DNA, 22 bp, Homo sapiens
gtttccaggcactttttctgct

SEQ ID NO: 9281843 - DNA, 22 bp, Homo sapiens
gtttccagagtgagggcacttg

SEQ ID NO: 9281844 - DNA, 22 bp, Homo sapiens
gtttccagcctagagatggtga

SEQ ID NO: 9281845 - DNA, 22 bp, Homo sapiens
gtttccacttgagaggactcct

SEQ ID NO: 9281846 - DNA, 22 bp, Homo sapiens
gtttccacttatatggtaccta

SEQ ID NO: 9281847 - DNA, 22 bp, Homo sapiens
gtttccacgtctcagttccaaa

SEQ ID NO: 9281848 - DNA, 18 bp, Homo sapiens
gttttgaattgtcttaca

SEQ ID NO: 9281849 - DNA, 22 bp, Homo sapiens
gttttgcagagtgcaataaatc

SEQ ID NO: 9281850 - DNA, 22 bp, Homo sapiens
gttttgctcatttggtccaagg

SEQ ID NO: 9281851 - DNA, 22 bp, Homo sapiens
gttttgcagagtgcaataaatc

SEQ ID NO: 9281852 - DNA, 19 bp, Homo sapiens
gttttgcaggcagagggga

SEQ ID NO: 9281853 - DNA, 22 bp, Homo sapiens
gttttgtgaggcacccacaggt

SEQ ID NO: 9281854 - DNA, 22 bp, Homo sapiens
gttttgttcttgtccagggaaa

SEQ ID NO: 9281855 - DNA, 22 bp, Homo sapiens
gttttgttgctgcagagctcaa

SEQ ID NO: 9281856 - DNA, 22 bp, Homo sapiens
gttttgttcatgaacattgggt

SEQ ID NO: 9281857 - DNA, 22 bp, Homo sapiens
gttttgttgctgcagagctcaa

SEQ ID NO: 9281858 - DNA, 21 bp, Homo sapiens
gttttctttgatagagggaag

SEQ ID NO: 9281859 - DNA, 22 bp, Homo sapiens
gttttctttgaatgcttctaga

SEQ ID NO: 9281860 - DNA, 22 bp, Homo sapiens
gttttctttgaatgcttctaga

SEQ ID NO: 9281861 - DNA, 21 bp, Homo sapiens
gttttctttgatagagggaag

SEQ ID NO: 9281862 - DNA, 21 bp, Homo sapiens
gttttctttgatagagggaag

SEQ ID NO: 9281863 - DNA, 22 bp, Homo sapiens
gttttgaaatgaaagaaccaag

SEQ ID NO: 9281864 - DNA, 22 bp, Homo sapiens
gttttcttcctgcaattggcat

SEQ ID NO: 9281865 - DNA, 22 bp, Homo sapiens
gttttcttcctgcaattggcat

SEQ ID NO: 9281866 - DNA, 22 bp, Homo sapiens
gttttctttgaatgcttctaga

SEQ ID NO: 9281867 - DNA, 22 bp, Homo sapiens
gttttcattactgctgtgattt

SEQ ID NO: 9281868 - DNA, 22 bp, Homo sapiens
gttttcattactgctgtgattt

SEQ ID NO: 9281869 - DNA, 22 bp, Homo sapiens
taaaatgatctctcatgttctt

SEQ ID NO: 9281870 - DNA, 22 bp, Homo sapiens
taaaatgatctctcatgttctt

SEQ ID NO: 9281871 - DNA, 22 bp, Homo sapiens
taaaatgatctctcatgttctt

SEQ ID NO: 9281872 - DNA, 22 bp, Homo sapiens
taaaagttttagttgtacataa

SEQ ID NO: 9281873 - DNA, 22 bp, Homo sapiens
taaaatagaggatgtcatgcta

SEQ ID NO: 9281874 - DNA, 22 bp, Homo sapiens
taaaatagaggatgtcatgcta

SEQ ID NO: 9281875 - DNA, 22 bp, Homo sapiens
gtttttatatcctgtggagtgt

SEQ ID NO: 9281876 - DNA, 22 bp, Homo sapiens
gtttttatatcctgtggagtgt

SEQ ID NO: 9281877 - DNA, 22 bp, Homo sapiens
gttttgttttgagtcaactcca

SEQ ID NO: 9281878 - DNA, 22 bp, Homo sapiens
gttttgttttgagtcaactcca

SEQ ID NO: 9281879 - DNA, 19 bp, Homo sapiens
gttttgtttgcagaactta

SEQ ID NO: 9281880 - DNA, 22 bp, Homo sapiens
gttttgttttgagtcaactcca

SEQ ID NO: 9281881 - DNA, 22 bp, Homo sapiens
gtttttatctaatagcagttat

SEQ ID NO: 9281882 - DNA, 22 bp, Homo sapiens
gtttttatctaatagcagttat

SEQ ID NO: 9281883 - DNA, 22 bp, Homo sapiens
gtttttatctaatagcagttat

SEQ ID NO: 9281884 - DNA, 22 bp, Homo sapiens
gtttttattgtgtaaatgtggg

SEQ ID NO: 9281885 - DNA, 22 bp, Homo sapiens
gtttttattgtgtaaatgtggg

SEQ ID NO: 9281886 - DNA, 22 bp, Homo sapiens
taaaatgtgtttctgtatggtt

SEQ ID NO: 9281887 - DNA, 22 bp, Homo sapiens
taaaatttgtccctgagtgttg

SEQ ID NO: 9281888 - DNA, 22 bp, Homo sapiens
taaaatttgtccctgagtgttg

SEQ ID NO: 9281889 - DNA, 22 bp, Homo sapiens
taaacaagctggactgataagt

SEQ ID NO: 9281890 - DNA, 22 bp, Homo sapiens
taaaatttgtccctgagtgttg

SEQ ID NO: 9281891 - DNA, 22 bp, Homo sapiens
taaaatttgtccctgagtgttg

SEQ ID NO: 9281892 - DNA, 22 bp, Homo sapiens
taaagggtaggttttactgtaa

SEQ ID NO: 9281893 - DNA, 22 bp, Homo sapiens
taaacactgccttggtgggtca

SEQ ID NO: 9281894 - DNA, 22 bp, Homo sapiens
taaacaagaaacattttctgtt

SEQ ID NO: 9281895 - DNA, 22 bp, Homo sapiens
taaacaagctggactgataagt

SEQ ID NO: 9281896 - DNA, 22 bp, Homo sapiens
taaacaagggttactgagcatg

SEQ ID NO: 9281897 - DNA, 22 bp, Homo sapiens
taaacactcacttcatagccat

SEQ ID NO: 9281898 - DNA, 22 bp, Homo sapiens
taaaggtttattcaacaaaata

SEQ ID NO: 9281899 - DNA, 22 bp, Homo sapiens
taaaggttgaaaactgactgcc

SEQ ID NO: 9281900 - DNA, 22 bp, Homo sapiens
taaaggttattgcactggagtt

SEQ ID NO: 9281901 - DNA, 22 bp, Homo sapiens
taaaggtagtgtgacatattgt

SEQ ID NO: 9281902 - DNA, 22 bp, Homo sapiens
taaaggttataaaggttagggg

SEQ ID NO: 9281903 - DNA, 22 bp, Homo sapiens
taaaggttagtagcagggaaac

SEQ ID NO: 9281904 - DNA, 22 bp, Homo sapiens
taaaggtatgtcttaatcaaac

SEQ ID NO: 9281905 - DNA, 23 bp, Homo sapiens
taaattacctttccagtgcaggg

SEQ ID NO: 9281906 - DNA, 22 bp, Homo sapiens
taaattaaagattggagaagga

SEQ ID NO: 9281907 - DNA, 20 bp, Homo sapiens
taaattagccttgaagatta

SEQ ID NO: 9281908 - DNA, 22 bp, Homo sapiens
taaattatggctggcagagcag

SEQ ID NO: 9281909 - DNA, 22 bp, Homo sapiens
taaattatggctggcagagcag

SEQ ID NO: 9281910 - DNA, 22 bp, Homo sapiens
taaattatggctggcagagcag

SEQ ID NO: 9281911 - DNA, 22 bp, Homo sapiens
taaattatggctggcagagcag

SEQ ID NO: 9281912 - DNA, 22 bp, Homo sapiens
taaattatgttccatgtccttt

SEQ ID NO: 9281913 - DNA, 22 bp, Homo sapiens
taaatttacccaaggaacatgt

SEQ ID NO: 9281914 - DNA, 22 bp, Homo sapiens
taaattgttttctagaagttgt

SEQ ID NO: 9281915 - DNA, 23 bp, Homo sapiens
taaattgatggtatgggttaagc

SEQ ID NO: 9281916 - DNA, 22 bp, Homo sapiens
taaattgagattattagggtaa

SEQ ID NO: 9281917 - DNA, 22 bp, Homo sapiens
taaattgagattattagggtaa

SEQ ID NO: 9281918 - DNA, 23 bp, Homo sapiens
taaattgatggtatgggttaagc

SEQ ID NO: 9281919 - DNA, 22 bp, Homo sapiens
taaattgatcgtttgggatgaa

SEQ ID NO: 9281920 - DNA, 22 bp, Homo sapiens
taaattgatcgtttgggatgaa

SEQ ID NO: 9281921 - DNA, 22 bp, Homo sapiens
taaattcagtgagtaatttctg

SEQ ID NO: 9281922 - DNA, 22 bp, Homo sapiens
taaattgaaaatctacagaaca

SEQ ID NO: 9281923 - DNA, 22 bp, Homo sapiens
taacattacggacatctgtcag

SEQ ID NO: 9281924 - DNA, 23 bp, Homo sapiens
taaatttcttgattcttatgtga

SEQ ID NO: 9281925 - DNA, 23 bp, Homo sapiens
taaatttcttgattcttatgtga

SEQ ID NO: 9281926 - DNA, 22 bp, Homo sapiens
taaccatattttccattaagtt

SEQ ID NO: 9281927 - DNA, 22 bp, Homo sapiens
taaccagacagaaacagctaga

SEQ ID NO: 9281928 - DNA, 22 bp, Homo sapiens
taacctacatgagaactttaaa

SEQ ID NO: 9281929 - DNA, 22 bp, Homo sapiens
taactacaagggcggtctctgt

SEQ ID NO: 9281930 - DNA, 22 bp, Homo sapiens
taactacatttcactgcaatta

SEQ ID NO: 9281931 - DNA, 22 bp, Homo sapiens
taactagaatggctattttgag

SEQ ID NO: 9281932 - DNA, 22 bp, Homo sapiens
taactgaacagcctaattcttt

SEQ ID NO: 9281933 - DNA, 22 bp, Homo sapiens
taactgatgttcccttactgta

SEQ ID NO: 9281934 - DNA, 20 bp, Homo sapiens
taactgatcattttcaccag

SEQ ID NO: 9281935 - DNA, 22 bp, Homo sapiens
taactcactccaaaaaggcatt

SEQ ID NO: 9281936 - DNA, 22 bp, Homo sapiens
taactaggattacaagcgtgcg

SEQ ID NO: 9281937 - DNA, 22 bp, Homo sapiens
gtgtgccagacatgatgctatg

SEQ ID NO: 9281938 - DNA, 22 bp, Homo sapiens
gtgtgccaggaactggctgctg

SEQ ID NO: 9281939 - DNA, 22 bp, Homo sapiens
gtgtgccaccagtcaaggtgaa

SEQ ID NO: 9281940 - DNA, 22 bp, Homo sapiens
gtgtgccaccagtcaaggtgaa

SEQ ID NO: 9281941 - DNA, 22 bp, Homo sapiens
gtgtgcatgtggaagcatgtat

SEQ ID NO: 9281942 - DNA, 22 bp, Homo sapiens
gtgtgccaacaaaagacagtgc

SEQ ID NO: 9281943 - DNA, 23 bp, Homo sapiens
gtgtgccaagcactgtgccagga

SEQ ID NO: 9281944 - DNA, 21 bp, Homo sapiens
gtgctctgggcagcagagggc

SEQ ID NO: 9281945 - DNA, 22 bp, Homo sapiens
gtgctctggctggtctcccggt

SEQ ID NO: 9281946 - DNA, 22 bp, Homo sapiens
gtgctctgtggattgagttgaa

SEQ ID NO: 9281947 - DNA, 22 bp, Homo sapiens
gtgtgcagtgagcaaaagatct

SEQ ID NO: 9281948 - DNA, 18 bp, Homo sapiens
gtgtgcagttgcaggggt

SEQ ID NO: 9281949 - DNA, 22 bp, Homo sapiens
gtgctcactgtgagacgtcctg

SEQ ID NO: 9281950 - DNA, 22 bp, Homo sapiens
gtgctccctccttcctcaagga

SEQ ID NO: 9281951 - DNA, 22 bp, Homo sapiens
gtgctccaggtcgctcagagag

SEQ ID NO: 9281952 - DNA, 22 bp, Homo sapiens
gtgctccaacattagtgtgctt

SEQ ID NO: 9281953 - DNA, 22 bp, Homo sapiens
gtgctctcctggctgccctgac

SEQ ID NO: 9281954 - DNA, 22 bp, Homo sapiens
gtgctctccagccccacgtgga

SEQ ID NO: 9281955 - DNA, 23 bp, Homo sapiens
gtgctctgcggtctgctagtctg

SEQ ID NO: 9281956 - DNA, 22 bp, Homo sapiens
gtgctctgcctggggtcatggc

SEQ ID NO: 9281957 - DNA, 22 bp, Homo sapiens
gtgctctgagtttgcatgtcag

SEQ ID NO: 9281958 - DNA, 22 bp, Homo sapiens
gtgctctgatctgtctgacatc

SEQ ID NO: 9281959 - DNA, 22 bp, Homo sapiens
gtgctctcctggctgccctgac

SEQ ID NO: 9281960 - DNA, 22 bp, Homo sapiens
gtgctctgagtttgcatgtcag

SEQ ID NO: 9281961 - DNA, 22 bp, Homo sapiens
gttacaaaggaagcttcactgc

SEQ ID NO: 9281962 - DNA, 22 bp, Homo sapiens
gttacaaaggaagcttcactgc

SEQ ID NO: 9281963 - DNA, 22 bp, Homo sapiens
gttacaaagcacttcaagtgaa

SEQ ID NO: 9281964 - DNA, 22 bp, Homo sapiens
gttacaaagcacttcaagtgaa

SEQ ID NO: 9281965 - DNA, 22 bp, Homo sapiens
gttacaaactcaggtgccaaaa

SEQ ID NO: 9281966 - DNA, 18 bp, Homo sapiens
gttaattttgaagttcat

SEQ ID NO: 9281967 - DNA, 22 bp, Homo sapiens
gttaatttagtagagtccagat

SEQ ID NO: 9281968 - DNA, 22 bp, Homo sapiens
gttaatttgcagctttcgagct

SEQ ID NO: 9281969 - DNA, 22 bp, Homo sapiens
gttacaaactcaggtgccaaaa

SEQ ID NO: 9281970 - DNA, 22 bp, Homo sapiens
gttacaaactcaggtgccaaaa

SEQ ID NO: 9281971 - DNA, 22 bp, Homo sapiens
gttaaggatcttgagatgagga

SEQ ID NO: 9281972 - DNA, 22 bp, Homo sapiens
gttaataaaggtatagaatcag

SEQ ID NO: 9281973 - DNA, 22 bp, Homo sapiens
gttaataaaggtatagaatcag

SEQ ID NO: 9281974 - DNA, 22 bp, Homo sapiens
gttaataaaggtatagaatcag

SEQ ID NO: 9281975 - DNA, 22 bp, Homo sapiens
gttaatgttatctgaagacagt

SEQ ID NO: 9281976 - DNA, 22 bp, Homo sapiens
gttaatttagtagagtccagat

SEQ ID NO: 9281977 - DNA, 22 bp, Homo sapiens
gttaatgtgtctgacacaatgg

SEQ ID NO: 9281978 - DNA, 22 bp, Homo sapiens
gttaatgcctacatattaagca

SEQ ID NO: 9281979 - DNA, 22 bp, Homo sapiens
gttaatgccattaggaaattta

SEQ ID NO: 9281980 - DNA, 22 bp, Homo sapiens
gtgtgggaatggcggtcgtgca

SEQ ID NO: 9281981 - DNA, 22 bp, Homo sapiens
gttaagaacttgttgaaggtct

SEQ ID NO: 9281982 - DNA, 22 bp, Homo sapiens
gttaactttttacagaaatgaa

SEQ ID NO: 9281983 - DNA, 22 bp, Homo sapiens
gttaagaagctagagatgaaca

SEQ ID NO: 9281984 - DNA, 22 bp, Homo sapiens
gttaagaagctagagatgaaca

SEQ ID NO: 9281985 - DNA, 22 bp, Homo sapiens
gttaagcctgaatcacattaat

SEQ ID NO: 9281986 - DNA, 22 bp, Homo sapiens
gtgtggcctcaacgggatgcaa

SEQ ID NO: 9281987 - DNA, 22 bp, Homo sapiens
gtgtgcctcccattagggtgta

SEQ ID NO: 9281988 - DNA, 22 bp, Homo sapiens
gtgtggctgattgacatggtca

SEQ ID NO: 9281989 - DNA, 22 bp, Homo sapiens
gttcatcactcagagacctccc

SEQ ID NO: 9281990 - DNA, 22 bp, Homo sapiens
gttcataatttgaaggaatagg

SEQ ID NO: 9281991 - DNA, 22 bp, Homo sapiens
gttgagtgggttaggatgctga

SEQ ID NO: 9281992 - DNA, 22 bp, Homo sapiens
gttgaggtgatgccagccctgc

SEQ ID NO: 9281993 - DNA, 22 bp, Homo sapiens
gttgaggtgatgccagccctgc

SEQ ID NO: 9281994 - DNA, 22 bp, Homo sapiens
gttgaggtgatgccagccctgc

SEQ ID NO: 9281995 - DNA, 22 bp, Homo sapiens
gttgaggagcaagcatgtgtct

SEQ ID NO: 9281996 - DNA, 22 bp, Homo sapiens
gttgaggaggcactcactgtca

SEQ ID NO: 9281997 - DNA, 22 bp, Homo sapiens
gttgaggaggttcagggtggtt

SEQ ID NO: 9281998 - DNA, 22 bp, Homo sapiens
gttcattcatcaaatatttact

SEQ ID NO: 9281999 - DNA, 20 bp, Homo sapiens
gttcatgtctcaaatagaaa

SEQ ID NO: 9282000 - DNA, 22 bp, Homo sapiens
gttacaaaggactgggggccac

SEQ ID NO: 9282001 - DNA, 22 bp, Homo sapiens
gttacaaaggactgggggccac

SEQ ID NO: 9282002 - DNA, 22 bp, Homo sapiens
gttcagatggagaaggaaaact

SEQ ID NO: 9282003 - DNA, 22 bp, Homo sapiens
gttcagatttcatgagtaattg

SEQ ID NO: 9282004 - DNA, 22 bp, Homo sapiens
gttcagcaagtactcagtccac

SEQ ID NO: 9282005 - DNA, 22 bp, Homo sapiens
gttcagcaagaatgtttctatt

SEQ ID NO: 9282006 - DNA, 22 bp, Homo sapiens
gttcagcacaggtgctcagaca

SEQ ID NO: 9282007 - DNA, 22 bp, Homo sapiens
gttcagcagcagtgattttgtg

SEQ ID NO: 9282008 - DNA, 22 bp, Homo sapiens
gttgcctaggctggagtgcagt

SEQ ID NO: 9282009 - DNA, 22 bp, Homo sapiens
gttgagtgggttaggatgctga

SEQ ID NO: 9282010 - DNA, 22 bp, Homo sapiens
gttggggtaccttgaggctggg

SEQ ID NO: 9282011 - DNA, 22 bp, Homo sapiens
gttgctcaggcaggagtacagt

SEQ ID NO: 9282012 - DNA, 22 bp, Homo sapiens
gttgctcaggcaggagtacagt

SEQ ID NO: 9282013 - DNA, 22 bp, Homo sapiens
gttgctcaggcaggagtacagt

SEQ ID NO: 9282014 - DNA, 22 bp, Homo sapiens
gttgccttctatgattctcagt

SEQ ID NO: 9282015 - DNA, 18 bp, Homo sapiens
gtttcatgcatgtgaaac

SEQ ID NO: 9282016 - DNA, 22 bp, Homo sapiens
gttggtgatgccacacatattt

SEQ ID NO: 9282017 - DNA, 22 bp, Homo sapiens
gttggtgagtttctgatcacaa

SEQ ID NO: 9282018 - DNA, 22 bp, Homo sapiens
gttggttagatttcctcacttt

SEQ ID NO: 9282019 - DNA, 22 bp, Homo sapiens
tacagaaaaacttggaggcttt

SEQ ID NO: 9282020 - DNA, 22 bp, Homo sapiens
tacactgaaagagaggattgaa

SEQ ID NO: 9282021 - DNA, 22 bp, Homo sapiens
tacagaaaaacatctggagccg

SEQ ID NO: 9282022 - DNA, 22 bp, Homo sapiens
tacagaaagacctctcgggaaa

SEQ ID NO: 9282023 - DNA, 22 bp, Homo sapiens
tacacttttctggttactcttg

SEQ ID NO: 9282024 - DNA, 22 bp, Homo sapiens
tacactttttactacagattct

SEQ ID NO: 9282025 - DNA, 22 bp, Homo sapiens
tacaacagtaatcaaggttttt

SEQ ID NO: 9282026 - DNA, 22 bp, Homo sapiens
tacactattttactgatacaaa

SEQ ID NO: 9282027 - DNA, 20 bp, Homo sapiens
tacaacaagtagagacatac

SEQ ID NO: 9282028 - DNA, 20 bp, Homo sapiens
tacaaattttccatgtttcc

SEQ ID NO: 9282029 - DNA, 20 bp, Homo sapiens
tacaaattttccatgtttcc

SEQ ID NO: 9282030 - DNA, 22 bp, Homo sapiens
tacaacaatttccacattagaa

SEQ ID NO: 9282031 - DNA, 22 bp, Homo sapiens
tacaacagacaggaataagatt

SEQ ID NO: 9282032 - DNA, 22 bp, Homo sapiens
tacaacagacaggaataagatt

SEQ ID NO: 9282033 - DNA, 22 bp, Homo sapiens
tacaaagtgaaataattctgag

SEQ ID NO: 9282034 - DNA, 22 bp, Homo sapiens
tacaaagtgggaaacgaaggtt

SEQ ID NO: 9282035 - DNA, 22 bp, Homo sapiens
tacaaagtttgagaatgctttc

SEQ ID NO: 9282036 - DNA, 22 bp, Homo sapiens
tacagagtggtgagatcttttg

SEQ ID NO: 9282037 - DNA, 22 bp, Homo sapiens
tacagaaatcacatcgctttga

SEQ ID NO: 9282038 - DNA, 22 bp, Homo sapiens
tacagaaatactggggggttct

SEQ ID NO: 9282039 - DNA, 22 bp, Homo sapiens
tacagaagctgagacactgaga

SEQ ID NO: 9282040 - DNA, 22 bp, Homo sapiens
tacagaaattgccaccagctct

SEQ ID NO: 9282041 - DNA, 22 bp, Homo sapiens
tacagatatagagatttataga

SEQ ID NO: 9282042 - DNA, 22 bp, Homo sapiens
tacagattttgtgaagaagtgt

SEQ ID NO: 9282043 - DNA, 22 bp, Homo sapiens
tacatctcatctgtgctctccg

SEQ ID NO: 9282044 - DNA, 22 bp, Homo sapiens
tacattcccccaattaccaatg

SEQ ID NO: 9282045 - DNA, 22 bp, Homo sapiens
tacatgaacaaaatagcagaaa

SEQ ID NO: 9282046 - DNA, 22 bp, Homo sapiens
tacatcattttggagatgagca

SEQ ID NO: 9282047 - DNA, 22 bp, Homo sapiens
tacatccaaatgaattagaatt

SEQ ID NO: 9282048 - DNA, 22 bp, Homo sapiens
tacatcccagccagcagaatca

SEQ ID NO: 9282049 - DNA, 22 bp, Homo sapiens
tacatagtattcacattgtttt

SEQ ID NO: 9282050 - DNA, 22 bp, Homo sapiens
tacatagcaaggaaatgacaga

SEQ ID NO: 9282051 - DNA, 22 bp, Homo sapiens
tacatatactgagtgatttgct

SEQ ID NO: 9282052 - DNA, 22 bp, Homo sapiens
tacatagttccatttacaggaa

SEQ ID NO: 9282053 - DNA, 22 bp, Homo sapiens
tacatatagacagttactctag

SEQ ID NO: 9282054 - DNA, 22 bp, Homo sapiens
tacatatagacagttactctag

SEQ ID NO: 9282055 - DNA, 22 bp, Homo sapiens
tacatatactgagtgatttgct

SEQ ID NO: 9282056 - DNA, 22 bp, Homo sapiens
tacatatactgagtgatttgct

SEQ ID NO: 9282057 - DNA, 22 bp, Homo sapiens
tacatcatggcttcatgctgca

SEQ ID NO: 9282058 - DNA, 22 bp, Homo sapiens
tacatatagacagttactctag

SEQ ID NO: 9282059 - DNA, 22 bp, Homo sapiens
tacatatagacagttactctag

SEQ ID NO: 9282060 - DNA, 22 bp, Homo sapiens
tacattgacttggattgttaga

SEQ ID NO: 9282061 - DNA, 22 bp, Homo sapiens
tacatttgctttgattttcagc

SEQ ID NO: 9282062 - DNA, 22 bp, Homo sapiens
tacatttgctttgattttcagc

SEQ ID NO: 9282063 - DNA, 22 bp, Homo sapiens
tacattgaggcagtagctggag

SEQ ID NO: 9282064 - DNA, 23 bp, Homo sapiens
tacattctgtatttttatagagt

SEQ ID NO: 9282065 - DNA, 22 bp, Homo sapiens
tacattctggtggagaaagtaa

SEQ ID NO: 9282066 - DNA, 22 bp, Homo sapiens
tacattgaaagtcatttaatcc

SEQ ID NO: 9282067 - DNA, 22 bp, Homo sapiens
tacattctactttttcactccc

SEQ ID NO: 9282068 - DNA, 22 bp, Homo sapiens
tacattctatatctgttacatc

SEQ ID NO: 9282069 - DNA, 22 bp, Homo sapiens
tacattctatatctgttacatc

SEQ ID NO: 9282070 - DNA, 22 bp, Homo sapiens
tacattctggaaaggcacagac

SEQ ID NO: 9282071 - DNA, 22 bp, Homo sapiens
tacattctcttcccattgtctc

SEQ ID NO: 9282072 - DNA, 22 bp, Homo sapiens
tacattctgaaataaatggttt

SEQ ID NO: 9282073 - DNA, 22 bp, Homo sapiens
tacaggcactgaaatgcttatt

SEQ ID NO: 9282074 - DNA, 22 bp, Homo sapiens
tacaggatatcacttcatttct

SEQ ID NO: 9282075 - DNA, 19 bp, Homo sapiens
tacaggatcctcatacagt

SEQ ID NO: 9282076 - DNA, 19 bp, Homo sapiens
tacaggcagtttctacaat

SEQ ID NO: 9282077 - DNA, 22 bp, Homo sapiens
tacaggcatgtagcatggtgat

SEQ ID NO: 9282078 - DNA, 22 bp, Homo sapiens
tacagtaagatgaaatagcaat

SEQ ID NO: 9282079 - DNA, 22 bp, Homo sapiens
tacagtaagatgaaatagcaat

SEQ ID NO: 9282080 - DNA, 22 bp, Homo sapiens
tacagggacatggaacaggctc

SEQ ID NO: 9282081 - DNA, 22 bp, Homo sapiens
tacatacattacctcatttagt

SEQ ID NO: 9282082 - DNA, 22 bp, Homo sapiens
tacatacatggtggaatggtta

SEQ ID NO: 9282083 - DNA, 22 bp, Homo sapiens
tacatacatggtggaatggtta

SEQ ID NO: 9282084 - DNA, 22 bp, Homo sapiens
tacatactccataatgacagca

SEQ ID NO: 9282085 - DNA, 22 bp, Homo sapiens
tacatacattacctcatttagt

SEQ ID NO: 9282086 - DNA, 22 bp, Homo sapiens
tacatacattacctcatttagt

SEQ ID NO: 9282087 - DNA, 22 bp, Homo sapiens
tacatacattacctcatttagt

SEQ ID NO: 9282088 - DNA, 22 bp, Homo sapiens
tacatagagggtaatagcatca

SEQ ID NO: 9282089 - DNA, 22 bp, Homo sapiens
tacatagaacatgtttaatgtc

SEQ ID NO: 9282090 - DNA, 22 bp, Homo sapiens
tacagtaataaaatgagctaca

SEQ ID NO: 9282091 - DNA, 22 bp, Homo sapiens
tacagtagaatcttatagccca

SEQ ID NO: 9282092 - DNA, 22 bp, Homo sapiens
tacagtagacaatgttagtatg

SEQ ID NO: 9282093 - DNA, 22 bp, Homo sapiens
tacagtagaatttttagtaact

SEQ ID NO: 9282094 - DNA, 22 bp, Homo sapiens
tacagtagacaatgttagtatg

SEQ ID NO: 9282095 - DNA, 22 bp, Homo sapiens
taatagaatagtggaaacattg

SEQ ID NO: 9282096 - DNA, 22 bp, Homo sapiens
taatacttaccttgcagagtct

SEQ ID NO: 9282097 - DNA, 22 bp, Homo sapiens
taatacttgtcataaaggcatt

SEQ ID NO: 9282098 - DNA, 22 bp, Homo sapiens
taatacttgctttggatgtatg

SEQ ID NO: 9282099 - DNA, 22 bp, Homo sapiens
taatacttttgccttgtattca

SEQ ID NO: 9282100 - DNA, 22 bp, Homo sapiens
taatactttgaatgagagctaa

SEQ ID NO: 9282101 - DNA, 22 bp, Homo sapiens
taatacttaccttgcagagtct

SEQ ID NO: 9282102 - DNA, 22 bp, Homo sapiens
taatagaatagtggaaacattg

SEQ ID NO: 9282103 - DNA, 22 bp, Homo sapiens
taatagctgtgggaaataaaag

SEQ ID NO: 9282104 - DNA, 22 bp, Homo sapiens
taatgtttccagtctatgatgg

SEQ ID NO: 9282105 - DNA, 22 bp, Homo sapiens
taattatagccgctattttgct

SEQ ID NO: 9282106 - DNA, 22 bp, Homo sapiens
taattatagcattggagtggcc

SEQ ID NO: 9282107 - DNA, 22 bp, Homo sapiens
taattatacaaaaaggcatgca

SEQ ID NO: 9282108 - DNA, 22 bp, Homo sapiens
taattataacatgctttctggc

SEQ ID NO: 9282109 - DNA, 22 bp, Homo sapiens
taattataacagttacatctta

SEQ ID NO: 9282110 - DNA, 22 bp, Homo sapiens
taattatacaaaaaggcatgca

SEQ ID NO: 9282111 - DNA, 22 bp, Homo sapiens
taattataacagttacatctta

SEQ ID NO: 9282112 - DNA, 22 bp, Homo sapiens
taattataacagttacatctta

SEQ ID NO: 9282113 - DNA, 23 bp, Homo sapiens
taattagatgttgattcctgaga

SEQ ID NO: 9282114 - DNA, 22 bp, Homo sapiens
taattataaactgcagtaggta

SEQ ID NO: 9282115 - DNA, 22 bp, Homo sapiens
taattacagaggtttgccagtt

SEQ ID NO: 9282116 - DNA, 22 bp, Homo sapiens
taattacaggtccaaaacaatc

SEQ ID NO: 9282117 - DNA, 22 bp, Homo sapiens
taattacaggtccaaaacaatc

SEQ ID NO: 9282118 - DNA, 22 bp, Homo sapiens
taattacaaagcaagcacaggg

SEQ ID NO: 9282119 - DNA, 22 bp, Homo sapiens
tacaaagaggcagctccatttt

SEQ ID NO: 9282120 - DNA, 22 bp, Homo sapiens
tacaaagagtttggtctctaga

SEQ ID NO: 9282121 - DNA, 22 bp, Homo sapiens
tacaaagagtttggtctctaga

SEQ ID NO: 9282122 - DNA, 22 bp, Homo sapiens
tacaaagaggtaattgcatata

SEQ ID NO: 9282123 - DNA, 22 bp, Homo sapiens
tacaaagaggtaattgcatata

SEQ ID NO: 9282124 - DNA, 22 bp, Homo sapiens
tacaaagaggtaattgcatata

SEQ ID NO: 9282125 - DNA, 22 bp, Homo sapiens
tacaaagaggtaattgcatata

SEQ ID NO: 9282126 - DNA, 22 bp, Homo sapiens
tacaaagaggcagctccatttt

SEQ ID NO: 9282127 - DNA, 22 bp, Homo sapiens
taattatagccgctattttgct

SEQ ID NO: 9282128 - DNA, 22 bp, Homo sapiens
taattatagccgctattttgct

SEQ ID NO: 9282129 - DNA, 22 bp, Homo sapiens
taattatagccgctattttgct

SEQ ID NO: 9282130 - DNA, 22 bp, Homo sapiens
tacaaaaaattgatactgacga

SEQ ID NO: 9282131 - DNA, 22 bp, Homo sapiens
tacaaagtaatgtataatatcg

SEQ ID NO: 9282132 - DNA, 22 bp, Homo sapiens
tacaaagtagaaattcagtaaa

SEQ ID NO: 9282133 - DNA, 22 bp, Homo sapiens
tacaaagtcacattgaaatgaa

SEQ ID NO: 9282134 - DNA, 22 bp, Homo sapiens
tacaaaggaggtgcatagaaca

SEQ ID NO: 9282135 - DNA, 22 bp, Homo sapiens
tacaaaggagtagagaaggctt

SEQ ID NO: 9282136 - DNA, 22 bp, Homo sapiens
tacaaagggggaagagattctg

SEQ ID NO: 9282137 - DNA, 22 bp, Homo sapiens
tacaaaggcttaaagagatttc

SEQ ID NO: 9282138 - DNA, 22 bp, Homo sapiens
tacaaagatagtgttagagtaa

SEQ ID NO: 9282139 - DNA, 22 bp, Homo sapiens
tacaaagatagtgttagagtaa

SEQ ID NO: 9282140 - DNA, 22 bp, Homo sapiens
tacaaagataaaatctcaccat

SEQ ID NO: 9282141 - DNA, 22 bp, Homo sapiens
tacaaagataaaatctcaccat

SEQ ID NO: 9282142 - DNA, 22 bp, Homo sapiens
tacaaagctgtatagcctggtc

SEQ ID NO: 9282143 - DNA, 22 bp, Homo sapiens
tacaaagcttgtactgtgtgac

SEQ ID NO: 9282144 - DNA, 22 bp, Homo sapiens
tacaaaggagactctgtattta

SEQ ID NO: 9282145 - DNA, 22 bp, Homo sapiens
taagtacatttgggaccacctg

SEQ ID NO: 9282146 - DNA, 22 bp, Homo sapiens
taagtacaaatgtatacataag

SEQ ID NO: 9282147 - DNA, 22 bp, Homo sapiens
taaggtttgtggggagcaaaag

SEQ ID NO: 9282148 - DNA, 22 bp, Homo sapiens
taaggtttggctgtctcttggt

SEQ ID NO: 9282149 - DNA, 22 bp, Homo sapiens
taaggttttgagaccagaacgt

SEQ ID NO: 9282150 - DNA, 22 bp, Homo sapiens
taagtaaatttataatgtgatt

SEQ ID NO: 9282151 - DNA, 22 bp, Homo sapiens
taagtaaaacattcaagaagtc

SEQ ID NO: 9282152 - DNA, 22 bp, Homo sapiens
taagtaaatttataatgtgatt

SEQ ID NO: 9282153 - DNA, 22 bp, Homo sapiens
taagtgaatattttcttctgta

SEQ ID NO: 9282154 - DNA, 22 bp, Homo sapiens
taatacatcattcatctaagga

SEQ ID NO: 9282155 - DNA, 22 bp, Homo sapiens
taatacatcattcatctaagga

SEQ ID NO: 9282156 - DNA, 22 bp, Homo sapiens
taatactgaaagggaaatgtcc

SEQ ID NO: 9282157 - DNA, 21 bp, Homo sapiens
taatactgaaagtgacatctg

SEQ ID NO: 9282158 - DNA, 22 bp, Homo sapiens
taataatagcagtagctgccac

SEQ ID NO: 9282159 - DNA, 22 bp, Homo sapiens
taataagcgtagaaggtatatc

SEQ ID NO: 9282160 - DNA, 22 bp, Homo sapiens
taataagcgtagaaggtatatc

SEQ ID NO: 9282161 - DNA, 19 bp, Homo sapiens
taataagcaatatggaagt

SEQ ID NO: 9282162 - DNA, 22 bp, Homo sapiens
taagtgtctctcgaattatgct

SEQ ID NO: 9282163 - DNA, 22 bp, Homo sapiens
taagtgttgatctgagtgctaa

SEQ ID NO: 9282164 - DNA, 22 bp, Homo sapiens
taaggtttaacgccctgtctcg

SEQ ID NO: 9282165 - DNA, 19 bp, Homo sapiens
taaggtttaccagcaaaat

SEQ ID NO: 9282166 - DNA, 22 bp, Homo sapiens
taaggtttctagtttctaaact

SEQ ID NO: 9282167 - DNA, 22 bp, Homo sapiens
taaggtttgcttatcttcgcct

SEQ ID NO: 9282168 - DNA, 22 bp, Homo sapiens
taaggtttgaagaagactgagc

SEQ ID NO: 9282169 - DNA, 22 bp, Homo sapiens
taaggtttcttcagatactagt

SEQ ID NO: 9282170 - DNA, 22 bp, Homo sapiens
taagggttcagaatgcagtggt

SEQ ID NO: 9282171 - DNA, 22 bp, Homo sapiens
taagggttcagaatgcagtggt

SEQ ID NO: 9282172 - DNA, 22 bp, Homo sapiens
taaggccaccgttatagaacca

SEQ ID NO: 9282173 - DNA, 22 bp, Homo sapiens
taaggccaattacatatgttca

SEQ ID NO: 9282174 - DNA, 22 bp, Homo sapiens
taactggcttaaattttatcaa

SEQ ID NO: 9282175 - DNA, 22 bp, Homo sapiens
taaggcaagagcagggtctttg

SEQ ID NO: 9282176 - DNA, 22 bp, Homo sapiens
taaggcaggactggatagctat

SEQ ID NO: 9282177 - DNA, 22 bp, Homo sapiens
taaggcagtgagaagaaacagg

SEQ ID NO: 9282178 - DNA, 22 bp, Homo sapiens
tatccatagtttatagatcaag

SEQ ID NO: 9282179 - DNA, 22 bp, Homo sapiens
tatccatgcctttgtgccttag

SEQ ID NO: 9282180 - DNA, 22 bp, Homo sapiens
tatccaaagtggcatattatag

SEQ ID NO: 9282181 - DNA, 22 bp, Homo sapiens
tatccaattcaccattgatggg

SEQ ID NO: 9282182 - DNA, 22 bp, Homo sapiens
tatatgacagtatcattttaaa

SEQ ID NO: 9282183 - DNA, 22 bp, Homo sapiens
tatagcatatacagataagctg

SEQ ID NO: 9282184 - DNA, 22 bp, Homo sapiens
tataggaaaggagtggtcacaa

SEQ ID NO: 9282185 - DNA, 22 bp, Homo sapiens
tataggaaacatacgtgactag

SEQ ID NO: 9282186 - DNA, 22 bp, Homo sapiens
tataggaaggcagattttagct

SEQ ID NO: 9282187 - DNA, 22 bp, Homo sapiens
tataggaaataggtcttctgtg

SEQ ID NO: 9282188 - DNA, 22 bp, Homo sapiens
tataggaaatttatctcctggg

SEQ ID NO: 9282189 - DNA, 22 bp, Homo sapiens
tataggaagtaattgttgcctg

SEQ ID NO: 9282190 - DNA, 21 bp, Homo sapiens
tatagtgtggatatgctgatg

SEQ ID NO: 9282191 - DNA, 22 bp, Homo sapiens
tatagtacatggaatcttcata

SEQ ID NO: 9282192 - DNA, 22 bp, Homo sapiens
tatagtgtgtgagagagtgaaa

SEQ ID NO: 9282193 - DNA, 22 bp, Homo sapiens
tatagtacacttaggtacttca

SEQ ID NO: 9282194 - DNA, 22 bp, Homo sapiens
tatagtaaaattttcatttatg

SEQ ID NO: 9282195 - DNA, 22 bp, Homo sapiens
tataggtgaataaatgagttta

SEQ ID NO: 9282196 - DNA, 22 bp, Homo sapiens
tatctaaggtatatgaggaatc

SEQ ID NO: 9282197 - DNA, 22 bp, Homo sapiens
tatctacaggtgtcaggtaaga

SEQ ID NO: 9282198 - DNA, 22 bp, Homo sapiens
tatctacaggtgtcaggtaaga

SEQ ID NO: 9282199 - DNA, 20 bp, Homo sapiens
tatctaaatgcttacattac

SEQ ID NO: 9282200 - DNA, 22 bp, Homo sapiens
tatctaaaggatttaatttagt

SEQ ID NO: 9282201 - DNA, 22 bp, Homo sapiens
tatctaaaggatttaatttagt

SEQ ID NO: 9282202 - DNA, 23 bp, Homo sapiens
tatcctaaaggcaacaggaagtc

SEQ ID NO: 9282203 - DNA, 19 bp, Homo sapiens
tatgacaagtactagttct

SEQ ID NO: 9282204 - DNA, 22 bp, Homo sapiens
tatctactcctctttcagatgc

SEQ ID NO: 9282205 - DNA, 22 bp, Homo sapiens
tatctacattcttgtatcttct

SEQ ID NO: 9282206 - DNA, 21 bp, Homo sapiens
tatctactggtgtctttcaga

SEQ ID NO: 9282207 - DNA, 23 bp, Homo sapiens
tatctactttgcaattcagtacc

SEQ ID NO: 9282208 - DNA, 22 bp, Homo sapiens
tatctacagttaatatgtcatc

SEQ ID NO: 9282209 - DNA, 22 bp, Homo sapiens
tatctacatgtaggtatgtatg

SEQ ID NO: 9282210 - DNA, 21 bp, Homo sapiens
tatctacagtgtccattcagt

SEQ ID NO: 9282211 - DNA, 21 bp, Homo sapiens
tatctacagtgtccattcagt

SEQ ID NO: 9282212 - DNA, 22 bp, Homo sapiens
tatgacagtgaaaaaaatcaga

SEQ ID NO: 9282213 - DNA, 22 bp, Homo sapiens
tatgaccataagattactgtta

SEQ ID NO: 9282214 - DNA, 22 bp, Homo sapiens
tatgacattgctttttagaact

SEQ ID NO: 9282215 - DNA, 22 bp, Homo sapiens
tatgagaaaataaatatctgtt

SEQ ID NO: 9282216 - DNA, 22 bp, Homo sapiens
tatgagaaaggagaatgacttt

SEQ ID NO: 9282217 - DNA, 22 bp, Homo sapiens
tatgagaacaagaacaatctcc

SEQ ID NO: 9282218 - DNA, 22 bp, Homo sapiens
tatgagaataatctggtaaata

SEQ ID NO: 9282219 - DNA, 22 bp, Homo sapiens
taggtgtctgctcttatttaac

SEQ ID NO: 9282220 - DNA, 22 bp, Homo sapiens
taggtctgtaaatgagagagac

SEQ ID NO: 9282221 - DNA, 22 bp, Homo sapiens
taggggtgaggccaggcatcag

SEQ ID NO: 9282222 - DNA, 22 bp, Homo sapiens
taggggtgggatccaggaatta

SEQ ID NO: 9282223 - DNA, 22 bp, Homo sapiens
taggggtggagctaagagtccc

SEQ ID NO: 9282224 - DNA, 21 bp, Homo sapiens
taggtatttctatcatgtctc

SEQ ID NO: 9282225 - DNA, 22 bp, Homo sapiens
taggggtgtttcgagagaggtt

SEQ ID NO: 9282226 - DNA, 22 bp, Homo sapiens
tataaattaatgtgcccatgag

SEQ ID NO: 9282227 - DNA, 22 bp, Homo sapiens
tataaatgccaggactttagat

SEQ ID NO: 9282228 - DNA, 22 bp, Homo sapiens
tataaatgccaggactttagat

SEQ ID NO: 9282229 - DNA, 22 bp, Homo sapiens
tataaatgcacttttgaaatat

SEQ ID NO: 9282230 - DNA, 22 bp, Homo sapiens
tataaatgcacttttgaaatat

SEQ ID NO: 9282231 - DNA, 22 bp, Homo sapiens
tataaatgcacttttgaaatat

SEQ ID NO: 9282232 - DNA, 22 bp, Homo sapiens
tataaatctttgttcctagaat

SEQ ID NO: 9282233 - DNA, 22 bp, Homo sapiens
tataattagtaaatggcagatt

SEQ ID NO: 9282234 - DNA, 22 bp, Homo sapiens
tataaccttttctttatcctcc

SEQ ID NO: 9282235 - DNA, 20 bp, Homo sapiens
tataaattcagagctttggt

SEQ ID NO: 9282236 - DNA, 22 bp, Homo sapiens
tataaattattaggctgctaaa

SEQ ID NO: 9282237 - DNA, 22 bp, Homo sapiens
tatacacatcctccaaagatag

SEQ ID NO: 9282238 - DNA, 17 bp, Homo sapiens
tatacacagacagactg

SEQ ID NO: 9282239 - DNA, 22 bp, Homo sapiens
tatacacatttttacctatagt

SEQ ID NO: 9282240 - DNA, 22 bp, Homo sapiens
tatacacatgtgtgtattcata

SEQ ID NO: 9282241 - DNA, 22 bp, Homo sapiens
tatacacacctccaaagcagga

SEQ ID NO: 9282242 - DNA, 22 bp, Homo sapiens
tatacacaaggtgtgcatttgt

SEQ ID NO: 9282243 - DNA, 22 bp, Homo sapiens
tatacaatggctgaatcatcca

SEQ ID NO: 9282244 - DNA, 22 bp, Homo sapiens
tatacacaaacaaggggttaag

SEQ ID NO: 9282245 - DNA, 22 bp, Homo sapiens
tatacaatgagtacattctggg

SEQ ID NO: 9282246 - DNA, 22 bp, Homo sapiens
tatacaatggctgaatcatcca

SEQ ID NO: 9282247 - DNA, 22 bp, Homo sapiens
tatacaatggctgaatcatcca

SEQ ID NO: 9282248 - DNA, 22 bp, Homo sapiens
tatacaatggctgaatcatcca

SEQ ID NO: 9282249 - DNA, 22 bp, Homo sapiens
tataattttagaagagatggaa

SEQ ID NO: 9282250 - DNA, 22 bp, Homo sapiens
tataattttagaagagatggaa

SEQ ID NO: 9282251 - DNA, 22 bp, Homo sapiens
tataatttttctgtggccagtt

SEQ ID NO: 9282252 - DNA, 22 bp, Homo sapiens
tataatttttctgtggccagtt

SEQ ID NO: 9282253 - DNA, 22 bp, Homo sapiens
tatacaatgagtacattctggg

SEQ ID NO: 9282254 - DNA, 22 bp, Homo sapiens
tatacaagtaatgctgaatgat

SEQ ID NO: 9282255 - DNA, 22 bp, Homo sapiens
tataatttggggaaagtggtgt

SEQ ID NO: 9282256 - DNA, 22 bp, Homo sapiens
tataattttaagtggtaaatta

SEQ ID NO: 9282257 - DNA, 22 bp, Homo sapiens
tataattttaagtggtaaatta

SEQ ID NO: 9282258 - DNA, 22 bp, Homo sapiens
tataatttatcatgtcacagtt

SEQ ID NO: 9282259 - DNA, 22 bp, Homo sapiens
tataatttatcatgtcacagtt

SEQ ID NO: 9282260 - DNA, 22 bp, Homo sapiens
tataatttggggaaagtggtgt

SEQ ID NO: 9282261 - DNA, 22 bp, Homo sapiens
tataatttggggaaagtggtgt

SEQ ID NO: 9282262 - DNA, 22 bp, Homo sapiens
tataatttatcatgtcacagtt

SEQ ID NO: 9282263 - DNA, 22 bp, Homo sapiens
tatgaggtaggtattatactta

SEQ ID NO: 9282264 - DNA, 22 bp, Homo sapiens
tatgaggcacttcattagctgg

SEQ ID NO: 9282265 - DNA, 22 bp, Homo sapiens
tatgagataatagatgtgtaaa

SEQ ID NO: 9282266 - DNA, 22 bp, Homo sapiens
tatgtacaagcacacatgtgac

SEQ ID NO: 9282267 - DNA, 22 bp, Homo sapiens
tatgtacaagcacacatgtgac

SEQ ID NO: 9282268 - DNA, 22 bp, Homo sapiens
tatgtacaatcagcagttcata

SEQ ID NO: 9282269 - DNA, 22 bp, Homo sapiens
tatgtacaatcagcagttcata

SEQ ID NO: 9282270 - DNA, 22 bp, Homo sapiens
tatgtacaatcagcagttcata

SEQ ID NO: 9282271 - DNA, 22 bp, Homo sapiens
tatgtacacacacatgcatgta

SEQ ID NO: 9282272 - DNA, 22 bp, Homo sapiens
tatgtacacacacatgcatgta

SEQ ID NO: 9282273 - DNA, 22 bp, Homo sapiens
tatgtcctgctactctctcatg

SEQ ID NO: 9282274 - DNA, 22 bp, Homo sapiens
tatgtacatacatgtgcatacg

SEQ ID NO: 9282275 - DNA, 22 bp, Homo sapiens
tatgtacataacatgaaatgca

SEQ ID NO: 9282276 - DNA, 22 bp, Homo sapiens
tatgtacagtccttaacttaaa

SEQ ID NO: 9282277 - DNA, 22 bp, Homo sapiens
tatgtacagtccttaacttaaa

SEQ ID NO: 9282278 - DNA, 22 bp, Homo sapiens
tatgtacataacatgaaatgca

SEQ ID NO: 9282279 - DNA, 22 bp, Homo sapiens
tatgtacagtccttaacttaaa

SEQ ID NO: 9282280 - DNA, 22 bp, Homo sapiens
tatgtacaccaaggattgaaaa

SEQ ID NO: 9282281 - DNA, 22 bp, Homo sapiens
tattagaaaggctattgcatag

SEQ ID NO: 9282282 - DNA, 22 bp, Homo sapiens
tattagaggaaccaaggtggag

SEQ ID NO: 9282283 - DNA, 22 bp, Homo sapiens
tattactgaggttttatggagt

SEQ ID NO: 9282284 - DNA, 22 bp, Homo sapiens
tattactgaggttttatggagt

SEQ ID NO: 9282285 - DNA, 22 bp, Homo sapiens
tattagcagttgtatgtgtctg

SEQ ID NO: 9282286 - DNA, 17 bp, Homo sapiens
tattagctagcttccag

SEQ ID NO: 9282287 - DNA, 22 bp, Homo sapiens
tattagctcatgatttcggtgg

SEQ ID NO: 9282288 - DNA, 21 bp, Homo sapiens
tattagcttctggtgctgttt

SEQ ID NO: 9282289 - DNA, 22 bp, Homo sapiens
tattagctgtgtaactctggtt

SEQ ID NO: 9282290 - DNA, 22 bp, Homo sapiens
tattagctccagtactgttgcc

SEQ ID NO: 9282291 - DNA, 22 bp, Homo sapiens
tattagcaacagagctcttgtt

SEQ ID NO: 9282292 - DNA, 22 bp, Homo sapiens
tatgtgaatacagcagtggatg

SEQ ID NO: 9282293 - DNA, 22 bp, Homo sapiens
tatgtgaatacagcagtggatg

SEQ ID NO: 9282294 - DNA, 22 bp, Homo sapiens
tatgtgacaaaagtaaactgca

SEQ ID NO: 9282295 - DNA, 22 bp, Homo sapiens
tatgtctttagtatcttttgga

SEQ ID NO: 9282296 - DNA, 22 bp, Homo sapiens
tatgtcttaatccttccttagg

SEQ ID NO: 9282297 - DNA, 22 bp, Homo sapiens
tatgtcttaatccttccttagg

SEQ ID NO: 9282298 - DNA, 22 bp, Homo sapiens
tatgtcttgtgtttgctaatct

SEQ ID NO: 9282299 - DNA, 22 bp, Homo sapiens
tatgtcttcgtcacctatctca

SEQ ID NO: 9282300 - DNA, 22 bp, Homo sapiens
tatgtgcaaattaattgctaga

SEQ ID NO: 9282301 - DNA, 22 bp, Homo sapiens
tatgtgacatatctcagtttga

SEQ ID NO: 9282302 - DNA, 22 bp, Homo sapiens
tatgtgacttgacaaagcttcc

SEQ ID NO: 9282303 - DNA, 22 bp, Homo sapiens
tattctacagtgttagtgttag

SEQ ID NO: 9282304 - DNA, 22 bp, Homo sapiens
tattcctggtgttggctgggtc

SEQ ID NO: 9282305 - DNA, 22 bp, Homo sapiens
tattcattatgaccaaatctag

SEQ ID NO: 9282306 - DNA, 22 bp, Homo sapiens
tattcatgagataggcagtttt

SEQ ID NO: 9282307 - DNA, 22 bp, Homo sapiens
tattcaaagtaccttcattgcc

SEQ ID NO: 9282308 - DNA, 19 bp, Homo sapiens
tattatttgtagcaaggcc

SEQ ID NO: 9282309 - DNA, 22 bp, Homo sapiens
tattagcttctggttttgttct

SEQ ID NO: 9282310 - DNA, 22 bp, Homo sapiens
tattagctttagcctttggatg

SEQ ID NO: 9282311 - DNA, 22 bp, Homo sapiens
tattagcttgtttggcaggatg

SEQ ID NO: 9282312 - DNA, 22 bp, Homo sapiens
tattattatattggatgagact

SEQ ID NO: 9282313 - DNA, 22 bp, Homo sapiens
tattattgactattcagaatgt

SEQ ID NO: 9282314 - DNA, 22 bp, Homo sapiens
tattattgaatcagttctttga

SEQ ID NO: 9282315 - DNA, 22 bp, Homo sapiens
tattattgcaagtatataaagt

SEQ ID NO: 9282316 - DNA, 22 bp, Homo sapiens
tattgaattagaccctaaaatg

SEQ ID NO: 9282317 - DNA, 22 bp, Homo sapiens
tattgaagattttgtggttgct

SEQ ID NO: 9282318 - DNA, 22 bp, Homo sapiens
tattgaagattttgtggttgct

SEQ ID NO: 9282319 - DNA, 22 bp, Homo sapiens
tattgaaattcttcatgtcctc

SEQ ID NO: 9282320 - DNA, 22 bp, Homo sapiens
tattgacaataggcaactgagg

SEQ ID NO: 9282321 - DNA, 22 bp, Homo sapiens
tattgacaatttgtgaaactat

SEQ ID NO: 9282322 - DNA, 22 bp, Homo sapiens
tattcttgtatactacaatctt

SEQ ID NO: 9282323 - DNA, 22 bp, Homo sapiens
tattgaaatgaatgacagtgat

SEQ ID NO: 9282324 - DNA, 22 bp, Homo sapiens
tattcttgtaccttaaatgatt

SEQ ID NO: 9282325 - DNA, 22 bp, Homo sapiens
tattctgtgtgatatgtaaatg

SEQ ID NO: 9282326 - DNA, 22 bp, Homo sapiens
tattctctccccaatcttgctt

SEQ ID NO: 9282327 - DNA, 22 bp, Homo sapiens
tattctctccccaatcttgctt

SEQ ID NO: 9282328 - DNA, 22 bp, Homo sapiens
tattctccccggatcagggcaa

SEQ ID NO: 9282329 - DNA, 22 bp, Homo sapiens
tattctcagtgctataagtaga

SEQ ID NO: 9282330 - DNA, 22 bp, Homo sapiens
tattctcagcaacacacatgga

SEQ ID NO: 9282331 - DNA, 21 bp, Homo sapiens
tatttattaatttgtaaggct

SEQ ID NO: 9282332 - DNA, 22 bp, Homo sapiens
tatttataatctgccaaagaga

SEQ ID NO: 9282333 - DNA, 22 bp, Homo sapiens
tatttataatctgccaaagaga

SEQ ID NO: 9282334 - DNA, 22 bp, Homo sapiens
tattgacagagggtcagaagag

SEQ ID NO: 9282335 - DNA, 22 bp, Homo sapiens
tattgacactttttgtgtagcc

SEQ ID NO: 9282336 - DNA, 22 bp, Homo sapiens
tattgacaggtgcctgcagaca

SEQ ID NO: 9282337 - DNA, 22 bp, Homo sapiens
tattgacagatgcattatgttg

SEQ ID NO: 9282338 - DNA, 22 bp, Homo sapiens
tatttaattagtgattgtagag

SEQ ID NO: 9282339 - DNA, 22 bp, Homo sapiens
tattgacagtgactattggtag

SEQ ID NO: 9282340 - DNA, 22 bp, Homo sapiens
tattgacatttttatagcttga

SEQ ID NO: 9282341 - DNA, 22 bp, Homo sapiens
tattgacagtgactattggtag

SEQ ID NO: 9282342 - DNA, 22 bp, Homo sapiens
tatttctctcacggttgcctgg

SEQ ID NO: 9282343 - DNA, 22 bp, Homo sapiens
tatttctgagaaccaacttacc

SEQ ID NO: 9282344 - DNA, 22 bp, Homo sapiens
tatttctgaatccaaaaggtca

SEQ ID NO: 9282345 - DNA, 19 bp, Homo sapiens
tatttcaaagtgccgtcta

SEQ ID NO: 9282346 - DNA, 22 bp, Homo sapiens
tatttctaagctgtaagtctga

SEQ ID NO: 9282347 - DNA, 22 bp, Homo sapiens
tatttctaagctgtaagtctga

SEQ ID NO: 9282348 - DNA, 22 bp, Homo sapiens
tatttctattccccaggcaagt

SEQ ID NO: 9282349 - DNA, 22 bp, Homo sapiens
tatttattcattcagcaagcat

SEQ ID NO: 9282350 - DNA, 22 bp, Homo sapiens
tatttattcattcagcaagcat

SEQ ID NO: 9282351 - DNA, 22 bp, Homo sapiens
tatttattcattcagcaagcat

SEQ ID NO: 9282352 - DNA, 22 bp, Homo sapiens
tatttattctttgtactgcctt

SEQ ID NO: 9282353 - DNA, 22 bp, Homo sapiens
tatttattggacagtgttgctg

SEQ ID NO: 9282354 - DNA, 22 bp, Homo sapiens
tatttattggacagtgttgctg

SEQ ID NO: 9282355 - DNA, 22 bp, Homo sapiens
tatttattggacagtgttgctg

SEQ ID NO: 9282356 - DNA, 22 bp, Homo sapiens
tatttattctttgtactgcctt

SEQ ID NO: 9282357 - DNA, 22 bp, Homo sapiens
tatttattctttgtactgcctt

SEQ ID NO: 9282358 - DNA, 22 bp, Homo sapiens
tactttttagcacagtgtgtgc

SEQ ID NO: 9282359 - DNA, 22 bp, Homo sapiens
tacttttagcctatttgattct

SEQ ID NO: 9282360 - DNA, 22 bp, Homo sapiens
tacttttagcctatttgattct

SEQ ID NO: 9282361 - DNA, 22 bp, Homo sapiens
tacttttatgtgatgaaatctg

SEQ ID NO: 9282362 - DNA, 22 bp, Homo sapiens
tacttttatgtgatgaaatctg

SEQ ID NO: 9282363 - DNA, 22 bp, Homo sapiens
tagaaaagaattttatttgata

SEQ ID NO: 9282364 - DNA, 19 bp, Homo sapiens
tactttttcaggacagagt

SEQ ID NO: 9282365 - DNA, 22 bp, Homo sapiens
tactttttgtctctttgaatgt

SEQ ID NO: 9282366 - DNA, 22 bp, Homo sapiens
tactttttgtctctttgaatgt

SEQ ID NO: 9282367 - DNA, 22 bp, Homo sapiens
tactttttgtctctttgaatgt

SEQ ID NO: 9282368 - DNA, 22 bp, Homo sapiens
tagaaaactaatacatgcttga

SEQ ID NO: 9282369 - DNA, 22 bp, Homo sapiens
tacttttaaaattcacaggtat

SEQ ID NO: 9282370 - DNA, 22 bp, Homo sapiens
tacttttagcctatttgattct

SEQ ID NO: 9282371 - DNA, 22 bp, Homo sapiens
tactttgtcattctaaccttcc

SEQ ID NO: 9282372 - DNA, 22 bp, Homo sapiens
tactttgtccatttgcaggcag

SEQ ID NO: 9282373 - DNA, 20 bp, Homo sapiens
tactttgatctgataagcaa

SEQ ID NO: 9282374 - DNA, 19 bp, Homo sapiens
tacatttgtgtacacttgt

SEQ ID NO: 9282375 - DNA, 22 bp, Homo sapiens
tacattttctaggggaccaaga

SEQ ID NO: 9282376 - DNA, 22 bp, Homo sapiens
tacattttctaggggaccaaga

SEQ ID NO: 9282377 - DNA, 22 bp, Homo sapiens
taccaaaaccaagccattatct

SEQ ID NO: 9282378 - DNA, 22 bp, Homo sapiens
taccaaaaagtgagccccagag

SEQ ID NO: 9282379 - DNA, 22 bp, Homo sapiens
taccaaaagcttgtttcataca

SEQ ID NO: 9282380 - DNA, 22 bp, Homo sapiens
taccaaaagcttgtttcataca

SEQ ID NO: 9282381 - DNA, 22 bp, Homo sapiens
taccaaagaatattttaaatag

SEQ ID NO: 9282382 - DNA, 22 bp, Homo sapiens
tactttgaccaccatctgatta

SEQ ID NO: 9282383 - DNA, 22 bp, Homo sapiens
tagaaacagaatatgagtgaga

SEQ ID NO: 9282384 - DNA, 22 bp, Homo sapiens
tagaaacagagagatatgcccc

SEQ ID NO: 9282385 - DNA, 22 bp, Homo sapiens
tagaaacagatgtttttgaaga

SEQ ID NO: 9282386 - DNA, 22 bp, Homo sapiens
tagaaacagagcaggtggccca

SEQ ID NO: 9282387 - DNA, 22 bp, Homo sapiens
tagaaacagcatatattagccc

SEQ ID NO: 9282388 - DNA, 22 bp, Homo sapiens
tagaaacatataggatggcagg

SEQ ID NO: 9282389 - DNA, 22 bp, Homo sapiens
tagaaacatataggatggcagg

SEQ ID NO: 9282390 - DNA, 22 bp, Homo sapiens
tagaaacagaaaactgtaatag

SEQ ID NO: 9282391 - DNA, 22 bp, Homo sapiens
tagaaacacagatctggtgtca

SEQ ID NO: 9282392 - DNA, 22 bp, Homo sapiens
tagaaacagaaaactgtaatag

SEQ ID NO: 9282393 - DNA, 22 bp, Homo sapiens
tagaaacaatgacatgcttgta

SEQ ID NO: 9282394 - DNA, 22 bp, Homo sapiens
tagaaacaatgacatgcttgta

SEQ ID NO: 9282395 - DNA, 22 bp, Homo sapiens
tagaaacaagtttctctttggg

SEQ ID NO: 9282396 - DNA, 22 bp, Homo sapiens
tagaaaagccccagctggaggg

SEQ ID NO: 9282397 - DNA, 22 bp, Homo sapiens
tagaaacctcagggaaatcttt

SEQ ID NO: 9282398 - DNA, 22 bp, Homo sapiens
tagaaactagattgatagcgga

SEQ ID NO: 9282399 - DNA, 22 bp, Homo sapiens
tagaaacccatgtttattcagt

SEQ ID NO: 9282400 - DNA, 22 bp, Homo sapiens
tagaaaccatctcactgctcag

SEQ ID NO: 9282401 - DNA, 22 bp, Homo sapiens
tagaaacccaggatttgtattt

SEQ ID NO: 9282402 - DNA, 22 bp, Homo sapiens
tagaaacccatgtttattcagt

SEQ ID NO: 9282403 - DNA, 22 bp, Homo sapiens
tagaaaccctgccttagtagct

SEQ ID NO: 9282404 - DNA, 22 bp, Homo sapiens
tagaaacattcagttgcagtcc

SEQ ID NO: 9282405 - DNA, 22 bp, Homo sapiens
tagaaagaaattcagattggct

SEQ ID NO: 9282406 - DNA, 22 bp, Homo sapiens
tagaaacatatgtttgagacat

SEQ ID NO: 9282407 - DNA, 22 bp, Homo sapiens
tagaaacattcagttgcagtcc

SEQ ID NO: 9282408 - DNA, 22 bp, Homo sapiens
tagaaacatgttctgttctgtt

SEQ ID NO: 9282409 - DNA, 22 bp, Homo sapiens
tagaaacatgagagaaactctt

SEQ ID NO: 9282410 - DNA, 22 bp, Homo sapiens
tagaaatgagccatggtagagc

SEQ ID NO: 9282411 - DNA, 22 bp, Homo sapiens
tagaaatgattggttgagctct

SEQ ID NO: 9282412 - DNA, 22 bp, Homo sapiens
tagaaatgattggttgagctct

SEQ ID NO: 9282413 - DNA, 22 bp, Homo sapiens
tagaaagcttggggtgtttaaa

SEQ ID NO: 9282414 - DNA, 22 bp, Homo sapiens
tagaaaggatattgagatgaat

SEQ ID NO: 9282415 - DNA, 22 bp, Homo sapiens
tagaaaggaagctacttagggg

SEQ ID NO: 9282416 - DNA, 22 bp, Homo sapiens
tagaaagcgttaaatctacaga

SEQ ID NO: 9282417 - DNA, 22 bp, Homo sapiens
tagaaagccctgtgttcactgc

SEQ ID NO: 9282418 - DNA, 22 bp, Homo sapiens
tagaaagctgagtaatacattt

SEQ ID NO: 9282419 - DNA, 22 bp, Homo sapiens
tagaaagcatgcaagtttgatg

SEQ ID NO: 9282420 - DNA, 22 bp, Homo sapiens
tagaaagaaattcagattggct

SEQ ID NO: 9282421 - DNA, 22 bp, Homo sapiens
tagaaagaacttcatgtaaaac

SEQ ID NO: 9282422 - DNA, 22 bp, Homo sapiens
tagaattgggcctaacttccat

SEQ ID NO: 9282423 - DNA, 22 bp, Homo sapiens
tagaatgagaaagtgtagcagg

SEQ ID NO: 9282424 - DNA, 22 bp, Homo sapiens
tagaatgacctcctcttagctt

SEQ ID NO: 9282425 - DNA, 22 bp, Homo sapiens
tagaattatgccttgctgtcca

SEQ ID NO: 9282426 - DNA, 22 bp, Homo sapiens
tagaattatgccttgctgtcca

SEQ ID NO: 9282427 - DNA, 22 bp, Homo sapiens
tagaatgtggaggtaacagact

SEQ ID NO: 9282428 - DNA, 23 bp, Homo sapiens
tagaatgtcattcaatgatatgg

SEQ ID NO: 9282429 - DNA, 22 bp, Homo sapiens
tagaggcagaagaaattgacaa

SEQ ID NO: 9282430 - DNA, 22 bp, Homo sapiens
tagacagatttaaaggaatgga

SEQ ID NO: 9282431 - DNA, 22 bp, Homo sapiens
tagacactttagaagtaagggt

SEQ ID NO: 9282432 - DNA, 22 bp, Homo sapiens
tagacactgtatgagctgggtg

SEQ ID NO: 9282433 - DNA, 23 bp, Homo sapiens
tagacactcctttgtctgtcctt

SEQ ID NO: 9282434 - DNA, 22 bp, Homo sapiens
tagacactagggatttagtact

SEQ ID NO: 9282435 - DNA, 22 bp, Homo sapiens
tagacactagggatttagtact

SEQ ID NO: 9282436 - DNA, 22 bp, Homo sapiens
tagacacatcttcatccacaat

SEQ ID NO: 9282437 - DNA, 22 bp, Homo sapiens
tagaggcattaatgaataaaca

SEQ ID NO: 9282438 - DNA, 22 bp, Homo sapiens
tagaggctcctgtgtgtaggtt

SEQ ID NO: 9282439 - DNA, 22 bp, Homo sapiens
tagaggctcttcattgcagtag

SEQ ID NO: 9282440 - DNA, 22 bp, Homo sapiens
tagaggctactagaggcacctg

SEQ ID NO: 9282441 - DNA, 22 bp, Homo sapiens
tagaggggaaaatgcgtattaa

SEQ ID NO: 9282442 - DNA, 22 bp, Homo sapiens
tagaggctttcagcggtaggtc

SEQ ID NO: 9282443 - DNA, 22 bp, Homo sapiens
tagaggcttctactgctcactt

SEQ ID NO: 9282444 - DNA, 22 bp, Homo sapiens
tagaggctgggaattattttca

SEQ ID NO: 9282445 - DNA, 22 bp, Homo sapiens
taggatttggctttagtcaggt

SEQ ID NO: 9282446 - DNA, 22 bp, Homo sapiens
taggattttttggattctggat

SEQ ID NO: 9282447 - DNA, 22 bp, Homo sapiens
taggcacaaaatgaaaatggca

SEQ ID NO: 9282448 - DNA, 22 bp, Homo sapiens
taggcacaagaccatgcaaagg

SEQ ID NO: 9282449 - DNA, 22 bp, Homo sapiens
tagggacactgctcatgagttc

SEQ ID NO: 9282450 - DNA, 22 bp, Homo sapiens
taggctgggcctgccttccagg

SEQ ID NO: 9282451 - DNA, 22 bp, Homo sapiens
tagggagaaacaccaatttatt

SEQ ID NO: 9282452 - DNA, 22 bp, Homo sapiens
tagggagatgcaagggacggag

SEQ ID NO: 9282453 - DNA, 20 bp, Homo sapiens
tagggagatatgctcttttc

SEQ ID NO: 9282454 - DNA, 22 bp, Homo sapiens
tagggagaggaagcaggccgct

SEQ ID NO: 9282455 - DNA, 22 bp, Homo sapiens
taggctgggagcctgaggctag

SEQ ID NO: 9282456 - DNA, 22 bp, Homo sapiens
taggctgggcattctggccagg

SEQ ID NO: 9282457 - DNA, 22 bp, Homo sapiens
tagggaggctacttcttgtagg

SEQ ID NO: 9282458 - DNA, 22 bp, Homo sapiens
tagggaggagggttttcaaatc

SEQ ID NO: 9282459 - DNA, 22 bp, Homo sapiens
tagggaggctacttcttgtagg

SEQ ID NO: 9282460 - DNA, 22 bp, Homo sapiens
tagggatgatggagcctatgta

SEQ ID NO: 9282461 - DNA, 22 bp, Homo sapiens
tagggatgagccagtgggtagt

SEQ ID NO: 9282462 - DNA, 22 bp, Homo sapiens
tagggatgacgaaaggacagag

SEQ ID NO: 9282463 - DNA, 22 bp, Homo sapiens
tagggcaatatttcccagaaaa

SEQ ID NO: 9282464 - DNA, 22 bp, Homo sapiens
tagggcaatatttcccagaaaa

SEQ ID NO: 9282465 - DNA, 22 bp, Homo sapiens
tagggcagagtccaggatgggc

SEQ ID NO: 9282466 - DNA, 22 bp, Homo sapiens
taggaaaacgtgattttctcac

SEQ ID NO: 9282467 - DNA, 22 bp, Homo sapiens
taggaaaacgtgattttctcac

SEQ ID NO: 9282468 - DNA, 22 bp, Homo sapiens
taggaaaaatacagaattatat

SEQ ID NO: 9282469 - DNA, 22 bp, Homo sapiens
tagctttgtttatcaaggggca

SEQ ID NO: 9282470 - DNA, 22 bp, Homo sapiens
tagctttgtattatcagcattg

SEQ ID NO: 9282471 - DNA, 22 bp, Homo sapiens
tagctttgtcctccaccctcag

SEQ ID NO: 9282472 - DNA, 22 bp, Homo sapiens
tagctttgtgaagtttacagac

SEQ ID NO: 9282473 - DNA, 22 bp, Homo sapiens
tagctttgtgtatgatgtctgt

SEQ ID NO: 9282474 - DNA, 16 bp, Homo sapiens
tagctttgtgttgtgg

SEQ ID NO: 9282475 - DNA, 22 bp, Homo sapiens
tagctttgtgtcctgatttagc

SEQ ID NO: 9282476 - DNA, 22 bp, Homo sapiens
tagctttgttagaatgtcttca

SEQ ID NO: 9282477 - DNA, 22 bp, Homo sapiens
tagctttgccacacatgtagat

SEQ ID NO: 9282478 - DNA, 22 bp, Homo sapiens
tagctttgcaaaggaagtttta

SEQ ID NO: 9282479 - DNA, 22 bp, Homo sapiens
tagctttgccatctgtcacata

SEQ ID NO: 9282480 - DNA, 22 bp, Homo sapiens
tagctttgaacttctgggctca

SEQ ID NO: 9282481 - DNA, 22 bp, Homo sapiens
tagctttgacagttgcaggcag

SEQ ID NO: 9282482 - DNA, 22 bp, Homo sapiens
tagctttgaccaacgactggtc

SEQ ID NO: 9282483 - DNA, 22 bp, Homo sapiens
tagctttgaagttatttaacag

SEQ ID NO: 9282484 - DNA, 22 bp, Homo sapiens
tagctttgggaatgctctcctg

SEQ ID NO: 9282485 - DNA, 22 bp, Homo sapiens
tagctttggattctttggggaa

SEQ ID NO: 9282486 - DNA, 22 bp, Homo sapiens
tagctttgcctgttaatcacaa

SEQ ID NO: 9282487 - DNA, 22 bp, Homo sapiens
tagctttgctggcaagcatgtc

SEQ ID NO: 9282488 - DNA, 22 bp, Homo sapiens
tagctttgcccgtgctggattt

SEQ ID NO: 9282489 - DNA, 22 bp, Homo sapiens
tagctttgcctgaagtaatcag

SEQ ID NO: 9282490 - DNA, 22 bp, Homo sapiens
taggatacaaattctgtaattt

SEQ ID NO: 9282491 - DNA, 22 bp, Homo sapiens
taggatctcaccatagaaggaa

SEQ ID NO: 9282492 - DNA, 22 bp, Homo sapiens
taggatggtcacagagatggac

SEQ ID NO: 9282493 - DNA, 22 bp, Homo sapiens
taggatgtgccaggaaagaaag

SEQ ID NO: 9282494 - DNA, 22 bp, Homo sapiens
taggattccagaacagtgctgc

SEQ ID NO: 9282495 - DNA, 22 bp, Homo sapiens
taggatggtacaaggcaggggt

SEQ ID NO: 9282496 - DNA, 22 bp, Homo sapiens
taggatttaggctttaacatct

SEQ ID NO: 9282497 - DNA, 22 bp, Homo sapiens
taggatggtcacagagatggac

SEQ ID NO: 9282498 - DNA, 22 bp, Homo sapiens
taggatttaataaaagaataga

SEQ ID NO: 9282499 - DNA, 22 bp, Homo sapiens
taggaaacaaagtaatgcaact

SEQ ID NO: 9282500 - DNA, 22 bp, Homo sapiens
taggaaacaaagtggatgaaat

SEQ ID NO: 9282501 - DNA, 22 bp, Homo sapiens
taggaaactaatacagtctgga

SEQ ID NO: 9282502 - DNA, 22 bp, Homo sapiens
tagcccctgcctttgaacctgg

SEQ ID NO: 9282503 - DNA, 22 bp, Homo sapiens
tagcccctgcctttgaacctgg

SEQ ID NO: 9282504 - DNA, 22 bp, Homo sapiens
tagccgcttaattatttggtga

SEQ ID NO: 9282505 - DNA, 22 bp, Homo sapiens
tagcccagcatgagcagagctg

SEQ ID NO: 9282506 - DNA, 22 bp, Homo sapiens
tagcccaggctggagggcagtg

SEQ ID NO: 9282507 - DNA, 22 bp, Homo sapiens
tagcccagctcaaatgaccggt

SEQ ID NO: 9282508 - DNA, 22 bp, Homo sapiens
tagctcctggtgagcctactct

SEQ ID NO: 9282509 - DNA, 22 bp, Homo sapiens
tagccgggtgtggtggaactcc

SEQ ID NO: 9282510 - DNA, 22 bp, Homo sapiens
tagccgggtgttgtgtcatgca

SEQ ID NO: 9282511 - DNA, 22 bp, Homo sapiens
tagccgggtgtggtggaactcc

SEQ ID NO: 9282512 - DNA, 22 bp, Homo sapiens
tagccgggtgttgtgtcatgca

SEQ ID NO: 9282513 - DNA, 22 bp, Homo sapiens
tagctctgaggccatctccggt

SEQ ID NO: 9282514 - DNA, 22 bp, Homo sapiens
tagctctgaggccatctccggt

SEQ ID NO: 9282515 - DNA, 22 bp, Homo sapiens
tagctctgtgctctggatctgt

SEQ ID NO: 9282516 - DNA, 22 bp, Homo sapiens
tagctgaagggcatttaataaa

SEQ ID NO: 9282517 - DNA, 22 bp, Homo sapiens
tagctgaatgccttggattttt

SEQ ID NO: 9282518 - DNA, 22 bp, Homo sapiens
tagctttaatgagttggtaaga

SEQ ID NO: 9282519 - DNA, 22 bp, Homo sapiens
tagcttaaaccaatctgaataa

SEQ ID NO: 9282520 - DNA, 22 bp, Homo sapiens
tagcttaaaatctctagattct

SEQ ID NO: 9282521 - DNA, 22 bp, Homo sapiens
tagaggtgagatattttatttt

SEQ ID NO: 9282522 - DNA, 22 bp, Homo sapiens
tagaggtgagaggaactttgga

SEQ ID NO: 9282523 - DNA, 22 bp, Homo sapiens
tagaggtgagatattttatttt

SEQ ID NO: 9282524 - DNA, 22 bp, Homo sapiens
tagaggtatttttgatggtcat

SEQ ID NO: 9282525 - DNA, 22 bp, Homo sapiens
tagaggtataccaaaaaggcat

SEQ ID NO: 9282526 - DNA, 22 bp, Homo sapiens
tagaggtgacactgagaccata

SEQ ID NO: 9282527 - DNA, 22 bp, Homo sapiens
tagaggtagcaacaggactaga

SEQ ID NO: 9282528 - DNA, 22 bp, Homo sapiens
tagaggtagatggtcagccaat

SEQ ID NO: 9282529 - DNA, 22 bp, Homo sapiens
tagaggtagagttacattagtc

SEQ ID NO: 9282530 - DNA, 22 bp, Homo sapiens
tagaggtactcccctcaaagtt

SEQ ID NO: 9282531 - DNA, 18 bp, Homo sapiens
tagagggggcctgggcat

SEQ ID NO: 9282532 - DNA, 18 bp, Homo sapiens
tagaggggaagaccttta

SEQ ID NO: 9282533 - DNA, 18 bp, Homo sapiens
tagaggggaagaccttta

SEQ ID NO: 9282534 - DNA, 22 bp, Homo sapiens
tagaggggaatctgcctcctct

SEQ ID NO: 9282535 - DNA, 20 bp, Homo sapiens
tagaggggacaatcattgcc

SEQ ID NO: 9282536 - DNA, 22 bp, Homo sapiens
tagcagagaggggacagtggca

SEQ ID NO: 9282537 - DNA, 22 bp, Homo sapiens
tagcagagaggggacagtggca

SEQ ID NO: 9282538 - DNA, 22 bp, Homo sapiens
tagcagaaccagtcagtgagcc

SEQ ID NO: 9282539 - DNA, 22 bp, Homo sapiens
tagcagagtaatactttggagc

SEQ ID NO: 9282540 - DNA, 22 bp, Homo sapiens
tagcagcccagtttctggccaa

SEQ ID NO: 9282541 - DNA, 23 bp, Homo sapiens
tagcagcatttttagcctctgtc

SEQ ID NO: 9282542 - DNA, 22 bp, Homo sapiens
tagcagagcagggatcagagcc

SEQ ID NO: 9282543 - DNA, 22 bp, Homo sapiens
tagcagaggaaaagagaacatt

SEQ ID NO: 9282544 - DNA, 22 bp, Homo sapiens
tagcagaggctgtctgacttaa

SEQ ID NO: 9282545 - DNA, 22 bp, Homo sapiens
tagcagaggctactgctccttg

SEQ ID NO: 9282546 - DNA, 22 bp, Homo sapiens
tcccagggactggatgatgcag

SEQ ID NO: 9282547 - DNA, 22 bp, Homo sapiens
tcccacagtgaagttcatgata

SEQ ID NO: 9282548 - DNA, 22 bp, Homo sapiens
tcccagggactgggctaggctt

SEQ ID NO: 9282549 - DNA, 22 bp, Homo sapiens
tcccacagggcttctctgtaca

SEQ ID NO: 9282550 - DNA, 22 bp, Homo sapiens
tcccagggttacagccagggca

SEQ ID NO: 9282551 - DNA, 22 bp, Homo sapiens
tcccagggttacagccagggca

SEQ ID NO: 9282552 - DNA, 22 bp, Homo sapiens
tcccagggtgcgcctgccctcg

SEQ ID NO: 9282553 - DNA, 22 bp, Homo sapiens
tcccagggtgcgcctgccctcg

SEQ ID NO: 9282554 - DNA, 22 bp, Homo sapiens
tcccagggatcctccgggtcgc

SEQ ID NO: 9282555 - DNA, 22 bp, Homo sapiens
tcccagggatcctccgggtcgc

SEQ ID NO: 9282556 - DNA, 22 bp, Homo sapiens
tcccagggattaggacatggat

SEQ ID NO: 9282557 - DNA, 22 bp, Homo sapiens
tcccagggtgaaatgcagtagg

SEQ ID NO: 9282558 - DNA, 21 bp, Homo sapiens
tcccagggtcttatgggatgt

SEQ ID NO: 9282559 - DNA, 22 bp, Homo sapiens
tcccagggtgaaatgcagtagg

SEQ ID NO: 9282560 - DNA, 22 bp, Homo sapiens
tcccatctccaacatttttctt

SEQ ID NO: 9282561 - DNA, 22 bp, Homo sapiens
tcccatcactagcatctgcacc

SEQ ID NO: 9282562 - DNA, 22 bp, Homo sapiens
tcccaggtgatgctgaggccac

SEQ ID NO: 9282563 - DNA, 20 bp, Homo sapiens
tcccagtcagccagagtgag

SEQ ID NO: 9282564 - DNA, 22 bp, Homo sapiens
tccccagggtccctgcttccat

SEQ ID NO: 9282565 - DNA, 22 bp, Homo sapiens
tccccaggggcatctctctgct

SEQ ID NO: 9282566 - DNA, 22 bp, Homo sapiens
tccccaggggcatctctctgct

SEQ ID NO: 9282567 - DNA, 22 bp, Homo sapiens
tccccagggtccctgcttccat

SEQ ID NO: 9282568 - DNA, 22 bp, Homo sapiens
tccccaggggcctgggcacagt

SEQ ID NO: 9282569 - DNA, 22 bp, Homo sapiens
tccccaggggcctgggcacagt

SEQ ID NO: 9282570 - DNA, 22 bp, Homo sapiens
tccccaggagcaatgattcagt

SEQ ID NO: 9282571 - DNA, 22 bp, Homo sapiens
tccccaggagttttactttgca

SEQ ID NO: 9282572 - DNA, 22 bp, Homo sapiens
tccccagggctgcagagggtgt

SEQ ID NO: 9282573 - DNA, 20 bp, Homo sapiens
tccccagggcatcaggagca

SEQ ID NO: 9282574 - DNA, 20 bp, Homo sapiens
tccccagggcatcaggagca

SEQ ID NO: 9282575 - DNA, 22 bp, Homo sapiens
tccccacctacacactgctcct

SEQ ID NO: 9282576 - DNA, 22 bp, Homo sapiens
tccccaggaatcaggtggttgc

SEQ ID NO: 9282577 - DNA, 22 bp, Homo sapiens
tccccaggaatcaggtggttgc

SEQ ID NO: 9282578 - DNA, 22 bp, Homo sapiens
tccccaggaaggcccttcctgg

SEQ ID NO: 9282579 - DNA, 22 bp, Homo sapiens
tccccaggagcaatgattcagt

SEQ ID NO: 9282580 - DNA, 22 bp, Homo sapiens
tccccaggactaagttgcaatc

SEQ ID NO: 9282581 - DNA, 22 bp, Homo sapiens
tccccaggaaattctgattctt

SEQ ID NO: 9282582 - DNA, 22 bp, Homo sapiens
tccccaggaaggcccttcctgg

SEQ ID NO: 9282583 - DNA, 22 bp, Homo sapiens
tccccaggaaattctgattctt

SEQ ID NO: 9282584 - DNA, 22 bp, Homo sapiens
tccccacacagatacagagtag

SEQ ID NO: 9282585 - DNA, 22 bp, Homo sapiens
tccccacacagatacagagtag

SEQ ID NO: 9282586 - DNA, 23 bp, Homo sapiens
tccagcagagccttccaggaggg

SEQ ID NO: 9282587 - DNA, 22 bp, Homo sapiens
tccagcagaccatcaaggctca

SEQ ID NO: 9282588 - DNA, 23 bp, Homo sapiens
tccagcagccaagaagggtagaa

SEQ ID NO: 9282589 - DNA, 22 bp, Homo sapiens
tccagcagcccgaaggcccatc

SEQ ID NO: 9282590 - DNA, 22 bp, Homo sapiens
tccagcagcctgacttccctct

SEQ ID NO: 9282591 - DNA, 22 bp, Homo sapiens
tccagcagggaattagtagtct

SEQ ID NO: 9282592 - DNA, 22 bp, Homo sapiens
tccagcaggtccgagacaagtt

SEQ ID NO: 9282593 - DNA, 22 bp, Homo sapiens
tccagaggctctgagggagagt

SEQ ID NO: 9282594 - DNA, 22 bp, Homo sapiens
tccagaggctctgagggagagt

SEQ ID NO: 9282595 - DNA, 22 bp, Homo sapiens
tccagaggctccaaagggagat

SEQ ID NO: 9282596 - DNA, 22 bp, Homo sapiens
tccagaggctccaaagggagat

SEQ ID NO: 9282597 - DNA, 22 bp, Homo sapiens
tccagagggcgatggctggggg

SEQ ID NO: 9282598 - DNA, 22 bp, Homo sapiens
tccagagggcgatggctggggg

SEQ ID NO: 9282599 - DNA, 22 bp, Homo sapiens
tccagagggcgatggctggggg

SEQ ID NO: 9282600 - DNA, 22 bp, Homo sapiens
tccagaggggcagccctgtgct

SEQ ID NO: 9282601 - DNA, 22 bp, Homo sapiens
tccagaggtatgtagagagtat

SEQ ID NO: 9282602 - DNA, 22 bp, Homo sapiens
tccagagctgggtctgtgctca

SEQ ID NO: 9282603 - DNA, 22 bp, Homo sapiens
tccagagctctgggcatagctg

SEQ ID NO: 9282604 - DNA, 18 bp, Homo sapiens
tccagagctggtgcttct

SEQ ID NO: 9282605 - DNA, 22 bp, Homo sapiens
tccagaggcaaaaaggtatgga

SEQ ID NO: 9282606 - DNA, 22 bp, Homo sapiens
tccagagctaattcagcagctg

SEQ ID NO: 9282607 - DNA, 22 bp, Homo sapiens
tccagagcctttctgcttgaca

SEQ ID NO: 9282608 - DNA, 22 bp, Homo sapiens
tccagagctacttgctcaactt

SEQ ID NO: 9282609 - DNA, 23 bp, Homo sapiens
tccagagctcatgctctcaacca

SEQ ID NO: 9282610 - DNA, 22 bp, Homo sapiens
tccagagcctatatgttcaact

SEQ ID NO: 9282611 - DNA, 17 bp, Homo sapiens
tccagagcacagagctc

SEQ ID NO: 9282612 - DNA, 17 bp, Homo sapiens
tccagagcacagagctc

SEQ ID NO: 9282613 - DNA, 19 bp, Homo sapiens
tccagaagtccctgagcgg

SEQ ID NO: 9282614 - DNA, 22 bp, Homo sapiens
tcattgagttgcacttttacta

SEQ ID NO: 9282615 - DNA, 22 bp, Homo sapiens
tcattgaatttggttcaatatg

SEQ ID NO: 9282616 - DNA, 22 bp, Homo sapiens
tcattgacagttgtttcaaata

SEQ ID NO: 9282617 - DNA, 19 bp, Homo sapiens
tccagcagtgcttgaaatc

SEQ ID NO: 9282618 - DNA, 22 bp, Homo sapiens
tccagcaggttggtcaggtgca

SEQ ID NO: 9282619 - DNA, 22 bp, Homo sapiens
tccagcaggttggtcaggtgca

SEQ ID NO: 9282620 - DNA, 22 bp, Homo sapiens
tccagcctttctactcactgag

SEQ ID NO: 9282621 - DNA, 22 bp, Homo sapiens
tccagcctttctactcactgag

SEQ ID NO: 9282622 - DNA, 22 bp, Homo sapiens
tccagccaatcagagctgaggc

SEQ ID NO: 9282623 - DNA, 22 bp, Homo sapiens
tccagccaatcagagctgaggc

SEQ ID NO: 9282624 - DNA, 22 bp, Homo sapiens
tccagccaagccttggtagctg

SEQ ID NO: 9282625 - DNA, 22 bp, Homo sapiens
tccagccaagggaggttactag

SEQ ID NO: 9282626 - DNA, 22 bp, Homo sapiens
tccagcattagatgtgaaattg

SEQ ID NO: 9282627 - DNA, 20 bp, Homo sapiens
tccagcatataaactcctct

SEQ ID NO: 9282628 - DNA, 22 bp, Homo sapiens
tccagccaactgcctagggagc

SEQ ID NO: 9282629 - DNA, 23 bp, Homo sapiens
tccagccaaatctggctgacagt

SEQ ID NO: 9282630 - DNA, 22 bp, Homo sapiens
tccagctcaaagtgctcctgtc

SEQ ID NO: 9282631 - DNA, 22 bp, Homo sapiens
tccagctcaaattcagcttcca

SEQ ID NO: 9282632 - DNA, 22 bp, Homo sapiens
tccagctcacagatagcgtggg

SEQ ID NO: 9282633 - DNA, 22 bp, Homo sapiens
tccagctcaaattcagcttcca

SEQ ID NO: 9282634 - DNA, 22 bp, Homo sapiens
tccagctcaaagtgctcctgtc

SEQ ID NO: 9282635 - DNA, 18 bp, Homo sapiens
tccagcgtgctccagggc

SEQ ID NO: 9282636 - DNA, 18 bp, Homo sapiens
tccagctcacagatgggc

SEQ ID NO: 9282637 - DNA, 22 bp, Homo sapiens
tccagctcacagatagcgtggg

SEQ ID NO: 9282638 - DNA, 18 bp, Homo sapiens
tccagctcacagatgggc

SEQ ID NO: 9282639 - DNA, 22 bp, Homo sapiens
tccagctcagatgcagggatca

SEQ ID NO: 9282640 - DNA, 22 bp, Homo sapiens
tccagctcagggttggctcaag

SEQ ID NO: 9282641 - DNA, 22 bp, Homo sapiens
tccagctcagatgcagggatca

SEQ ID NO: 9282642 - DNA, 22 bp, Homo sapiens
tccagctcccactctcactgct

SEQ ID NO: 9282643 - DNA, 22 bp, Homo sapiens
tccagctccacagcctccctgt

SEQ ID NO: 9282644 - DNA, 22 bp, Homo sapiens
tccagctcccactctcactgct

SEQ ID NO: 9282645 - DNA, 20 bp, Homo sapiens
tccagctcagtttttttgtc

SEQ ID NO: 9282646 - DNA, 22 bp, Homo sapiens
tccagctcatctgtctccatta

SEQ ID NO: 9282647 - DNA, 22 bp, Homo sapiens
tccagctccacagcctccctgt

SEQ ID NO: 9282648 - DNA, 22 bp, Homo sapiens
tccagctcatctgtctccatta

SEQ ID NO: 9282649 - DNA, 23 bp, Homo sapiens
tccagctcccttcaatggcactg

SEQ ID NO: 9282650 - DNA, 20 bp, Homo sapiens
tccagctccgtgttcttcct

SEQ ID NO: 9282651 - DNA, 17 bp, Homo sapiens
tccagctcctcattgtt

SEQ ID NO: 9282652 - DNA, 17 bp, Homo sapiens
tccagctcctcattgtt

SEQ ID NO: 9282653 - DNA, 22 bp, Homo sapiens
tccagctcctctacccgatgcg

SEQ ID NO: 9282654 - DNA, 22 bp, Homo sapiens
tccagctcctgagttcactgct

SEQ ID NO: 9282655 - DNA, 22 bp, Homo sapiens
tccagctcctctacccgatgcg

SEQ ID NO: 9282656 - DNA, 22 bp, Homo sapiens
tccagcttgcctggtcttttgg

SEQ ID NO: 9282657 - DNA, 22 bp, Homo sapiens
tccagcttgacaaatgatttta

SEQ ID NO: 9282658 - DNA, 22 bp, Homo sapiens
tccagcttcttgacttggtggt

SEQ ID NO: 9282659 - DNA, 22 bp, Homo sapiens
tccagcttataggtagatttaa

SEQ ID NO: 9282660 - DNA, 19 bp, Homo sapiens
tccaggaggctgccattga

SEQ ID NO: 9282661 - DNA, 22 bp, Homo sapiens
tccagctttgagattttatgga

SEQ ID NO: 9282662 - DNA, 22 bp, Homo sapiens
tccagcttttaccaaatgagca

SEQ ID NO: 9282663 - DNA, 22 bp, Homo sapiens
tccagcttttattggatgagga

SEQ ID NO: 9282664 - DNA, 22 bp, Homo sapiens
tccagctcttcagttctgcaaa

SEQ ID NO: 9282665 - DNA, 21 bp, Homo sapiens
tccagctcttatgttcatgaa

SEQ ID NO: 9282666 - DNA, 22 bp, Homo sapiens
tccagctctggcttggctagct

SEQ ID NO: 9282667 - DNA, 20 bp, Homo sapiens
tccagctgtctttcagagac

SEQ ID NO: 9282668 - DNA, 22 bp, Homo sapiens
tccagctctgcttcacagtctc

SEQ ID NO: 9282669 - DNA, 22 bp, Homo sapiens
tccagctctggcttggctagct

SEQ ID NO: 9282670 - DNA, 22 bp, Homo sapiens
tccagctctgctgtgcgccggt

SEQ ID NO: 9282671 - DNA, 22 bp, Homo sapiens
tccagctctgcttcacagtctc

SEQ ID NO: 9282672 - DNA, 22 bp, Homo sapiens
tccagctctgattctcactagc

SEQ ID NO: 9282673 - DNA, 21 bp, Homo sapiens
tccagctctcatagtgttcca

SEQ ID NO: 9282674 - DNA, 21 bp, Homo sapiens
tccagctctcatagtgttcca

SEQ ID NO: 9282675 - DNA, 18 bp, Homo sapiens
tccagctctgccacttac

SEQ ID NO: 9282676 - DNA, 21 bp, Homo sapiens
tccagctcctgccactcctta

SEQ ID NO: 9282677 - DNA, 21 bp, Homo sapiens
tccagctcctgccactcctta

SEQ ID NO: 9282678 - DNA, 22 bp, Homo sapiens
tccagctctaacatgctgggcc

SEQ ID NO: 9282679 - DNA, 22 bp, Homo sapiens
tccagctctaacatgctgggcc

SEQ ID NO: 9282680 - DNA, 22 bp, Homo sapiens
tccagctctaaggctgatagcc

SEQ ID NO: 9282681 - DNA, 22 bp, Homo sapiens
tccagctctaaggctgatagcc

SEQ ID NO: 9282682 - DNA, 22 bp, Homo sapiens
tccatctggtggcttccttttg

SEQ ID NO: 9282683 - DNA, 22 bp, Homo sapiens
tccatctgtcaaatatcatgct

SEQ ID NO: 9282684 - DNA, 22 bp, Homo sapiens
tccatctgtctttcccatccac

SEQ ID NO: 9282685 - DNA, 22 bp, Homo sapiens
tccatctgcatttggtttctgt

SEQ ID NO: 9282686 - DNA, 22 bp, Homo sapiens
tccatctggagacttcctggtc

SEQ ID NO: 9282687 - DNA, 22 bp, Homo sapiens
tccatctggtgagtgaggagcc

SEQ ID NO: 9282688 - DNA, 22 bp, Homo sapiens
tccatccatgtaggaagatggt

SEQ ID NO: 9282689 - DNA, 22 bp, Homo sapiens
tccatctcacctgcactctgcg

SEQ ID NO: 9282690 - DNA, 20 bp, Homo sapiens
tccatgcaaatacagagttt

SEQ ID NO: 9282691 - DNA, 22 bp, Homo sapiens
tccatgagggacactggatgct

SEQ ID NO: 9282692 - DNA, 22 bp, Homo sapiens
tccatgaggcagggaggctggc

SEQ ID NO: 9282693 - DNA, 22 bp, Homo sapiens
tccatgaggcagggaggctggc

SEQ ID NO: 9282694 - DNA, 22 bp, Homo sapiens
tcccaagtgtcttggaccaggg

SEQ ID NO: 9282695 - DNA, 22 bp, Homo sapiens
tcccaattaacaggtatcaggc

SEQ ID NO: 9282696 - DNA, 22 bp, Homo sapiens
tcccaaggataagagagtctga

SEQ ID NO: 9282697 - DNA, 20 bp, Homo sapiens
tcccaaggatgcctgggtgt

SEQ ID NO: 9282698 - DNA, 20 bp, Homo sapiens
tcccaaggatgcctgggtgt

SEQ ID NO: 9282699 - DNA, 22 bp, Homo sapiens
tcccaaggcacagggcagggac

SEQ ID NO: 9282700 - DNA, 22 bp, Homo sapiens
tcccaaggccaggcatctagaa

SEQ ID NO: 9282701 - DNA, 19 bp, Homo sapiens
tcccaagatttctgtatca

SEQ ID NO: 9282702 - DNA, 22 bp, Homo sapiens
tccatgccaggcagtcgatgca

SEQ ID NO: 9282703 - DNA, 22 bp, Homo sapiens
tcccaagcttagggctctcagt

SEQ ID NO: 9282704 - DNA, 22 bp, Homo sapiens
tccagtttatttttggcagggt

SEQ ID NO: 9282705 - DNA, 22 bp, Homo sapiens
tccagtttcatagctaaggaac

SEQ ID NO: 9282706 - DNA, 22 bp, Homo sapiens
tccatcaccatttctgcgagct

SEQ ID NO: 9282707 - DNA, 22 bp, Homo sapiens
tccatcaggctcgtgggctctc

SEQ ID NO: 9282708 - DNA, 22 bp, Homo sapiens
tccagggctcattccctctgca

SEQ ID NO: 9282709 - DNA, 22 bp, Homo sapiens
tccagggctcattccctctgca

SEQ ID NO: 9282710 - DNA, 22 bp, Homo sapiens
tccagttgcccatctctcttct

SEQ ID NO: 9282711 - DNA, 22 bp, Homo sapiens
tccagtttacagggttgctttt

SEQ ID NO: 9282712 - DNA, 22 bp, Homo sapiens
tccagttgcccatctctcttct

SEQ ID NO: 9282713 - DNA, 22 bp, Homo sapiens
tccagttgtttgtattaactct

SEQ ID NO: 9282714 - DNA, 22 bp, Homo sapiens
tccagggcctgaggttgaagtg

SEQ ID NO: 9282715 - DNA, 22 bp, Homo sapiens
tccagggcctgaggttgaagtg

SEQ ID NO: 9282716 - DNA, 22 bp, Homo sapiens
tccagggccttacctcttcaga

SEQ ID NO: 9282717 - DNA, 22 bp, Homo sapiens
tccagggcgtgtgtgaaggaaa

SEQ ID NO: 9282718 - DNA, 22 bp, Homo sapiens
tccagggcgtgtgtgaaggaaa

SEQ ID NO: 9282719 - DNA, 22 bp, Homo sapiens
tccagggcgtgtgtgaaggaaa

SEQ ID NO: 9282720 - DNA, 20 bp, Homo sapiens
tccagggctagggagctcat

SEQ ID NO: 9282721 - DNA, 20 bp, Homo sapiens
tccagggctagggagctcat

SEQ ID NO: 9282722 - DNA, 20 bp, Homo sapiens
tccagggctagggagctcat

SEQ ID NO: 9282723 - DNA, 22 bp, Homo sapiens
tccagggctacaaggcaccaga

SEQ ID NO: 9282724 - DNA, 22 bp, Homo sapiens
tccagggctacaaggcaccaga

SEQ ID NO: 9282725 - DNA, 22 bp, Homo sapiens
tccagggccatgaagttgcaca

SEQ ID NO: 9282726 - DNA, 22 bp, Homo sapiens
tccagggccatctccatgaggc

SEQ ID NO: 9282727 - DNA, 22 bp, Homo sapiens
tccagggccacagaggatgcta

SEQ ID NO: 9282728 - DNA, 20 bp, Homo sapiens
tccagggccctggctcctct

SEQ ID NO: 9282729 - DNA, 20 bp, Homo sapiens
tccagggccctggctcctct

SEQ ID NO: 9282730 - DNA, 22 bp, Homo sapiens
tccagggccatgaagttgcaca

SEQ ID NO: 9282731 - DNA, 22 bp, Homo sapiens
tccagggccccccagttgcacg

SEQ ID NO: 9282732 - DNA, 22 bp, Homo sapiens
tccagggccccccagttgcacg

SEQ ID NO: 9282733 - DNA, 22 bp, Homo sapiens
tccaggctgcagtcttgccctc

SEQ ID NO: 9282734 - DNA, 22 bp, Homo sapiens
tccaggctgcaaggccacaggg

SEQ ID NO: 9282735 - DNA, 22 bp, Homo sapiens
tccaggctgcagtcttgccctc

SEQ ID NO: 9282736 - DNA, 22 bp, Homo sapiens
tccaggctgccacagtgcaacg

SEQ ID NO: 9282737 - DNA, 22 bp, Homo sapiens
tccaggctggaaatgtcaaact

SEQ ID NO: 9282738 - DNA, 22 bp, Homo sapiens
tccaggctgccacagtgcaacg

SEQ ID NO: 9282739 - DNA, 22 bp, Homo sapiens
tccaggctggaaatgtcaaact

SEQ ID NO: 9282740 - DNA, 22 bp, Homo sapiens
tccagggcagccgcgggtgcgc

SEQ ID NO: 9282741 - DNA, 22 bp, Homo sapiens
tccaggctggaaatgtcaaact

SEQ ID NO: 9282742 - DNA, 22 bp, Homo sapiens
tccagggccacagaggatgcta

SEQ ID NO: 9282743 - DNA, 22 bp, Homo sapiens
tccagggccacagaggatgcta

SEQ ID NO: 9282744 - DNA, 22 bp, Homo sapiens
tccagggcagggtgcgcatggg

SEQ ID NO: 9282745 - DNA, 22 bp, Homo sapiens
tccagggcagggtgcgcatggg

SEQ ID NO: 9282746 - DNA, 22 bp, Homo sapiens
tccaggctcagcacttgctact

SEQ ID NO: 9282747 - DNA, 22 bp, Homo sapiens
tccaggctcctgactttttggg

SEQ ID NO: 9282748 - DNA, 22 bp, Homo sapiens
tccaggctctaggctgctctcc

SEQ ID NO: 9282749 - DNA, 22 bp, Homo sapiens
tccaggctctaggctgctctcc

SEQ ID NO: 9282750 - DNA, 22 bp, Homo sapiens
tccaggctctcaggtgtcagca

SEQ ID NO: 9282751 - DNA, 22 bp, Homo sapiens
tccaggctctcaggtgtcagca

SEQ ID NO: 9282752 - DNA, 22 bp, Homo sapiens
tccaggctaggtttacaggaca

SEQ ID NO: 9282753 - DNA, 22 bp, Homo sapiens
tccaggctaggtttacaggaca

SEQ ID NO: 9282754 - DNA, 22 bp, Homo sapiens
tccaggctcagcacttgctact

SEQ ID NO: 9282755 - DNA, 22 bp, Homo sapiens
tccaggctgcaaggccacaggg

SEQ ID NO: 9282756 - DNA, 21 bp, Homo sapiens
tccaggctgatgatgtcaact

SEQ ID NO: 9282757 - DNA, 21 bp, Homo sapiens
tccaggctgatgatgtcaact

SEQ ID NO: 9282758 - DNA, 19 bp, Homo sapiens
tccaggctgagagtcagct

SEQ ID NO: 9282759 - DNA, 22 bp, Homo sapiens
tccaggctgatccatgaagaat

SEQ ID NO: 9282760 - DNA, 22 bp, Homo sapiens
tccaggctgatccatgaagaat

SEQ ID NO: 9282761 - DNA, 22 bp, Homo sapiens
tccaggctgatccatgaagaat

SEQ ID NO: 9282762 - DNA, 22 bp, Homo sapiens
tccaggctgacgcagctattta

SEQ ID NO: 9282763 - DNA, 22 bp, Homo sapiens
tccaggctgacgcagctattta

SEQ ID NO: 9282764 - DNA, 19 bp, Homo sapiens
tccaggctgagagtcagct

SEQ ID NO: 9282765 - DNA, 22 bp, Homo sapiens
tccaggctctcaggtgtcagca

SEQ ID NO: 9282766 - DNA, 23 bp, Homo sapiens
tccaggctgaaggagcagatttt

SEQ ID NO: 9282767 - DNA, 23 bp, Homo sapiens
tccaggctgaaggagcagatttt

SEQ ID NO: 9282768 - DNA, 22 bp, Homo sapiens
tccaggccacgacctcctggat

SEQ ID NO: 9282769 - DNA, 22 bp, Homo sapiens
tccaggcatggtgtaattttgc

SEQ ID NO: 9282770 - DNA, 22 bp, Homo sapiens
tccaggcatctgtattttttaa

SEQ ID NO: 9282771 - DNA, 22 bp, Homo sapiens
tccaggaggtatgagtggcccc

SEQ ID NO: 9282772 - DNA, 22 bp, Homo sapiens
tccaggaggggtaggcagtatg

SEQ ID NO: 9282773 - DNA, 22 bp, Homo sapiens
tccaggaggtgaggggaccaaa

SEQ ID NO: 9282774 - DNA, 22 bp, Homo sapiens
tccaggaggtatgagtggcccc

SEQ ID NO: 9282775 - DNA, 22 bp, Homo sapiens
tccaggaggttgagactgcagt

SEQ ID NO: 9282776 - DNA, 20 bp, Homo sapiens
tccaggaggttagtgtggct

SEQ ID NO: 9282777 - DNA, 22 bp, Homo sapiens
tccaggaggtttggaggaagca

SEQ ID NO: 9282778 - DNA, 22 bp, Homo sapiens
tccaggagtcctgggagtgatt

SEQ ID NO: 9282779 - DNA, 22 bp, Homo sapiens
tccaggagtgataaggccactg

SEQ ID NO: 9282780 - DNA, 22 bp, Homo sapiens
tccaggagtcctgggtggcccc

SEQ ID NO: 9282781 - DNA, 22 bp, Homo sapiens
tccaggagtgctggttagagta

SEQ ID NO: 9282782 - DNA, 21 bp, Homo sapiens
tccaggagtggctgggcaggg

SEQ ID NO: 9282783 - DNA, 21 bp, Homo sapiens
tccaggagtggctgggcaggg

SEQ ID NO: 9282784 - DNA, 21 bp, Homo sapiens
tccaggagtggctgggcaggg

SEQ ID NO: 9282785 - DNA, 22 bp, Homo sapiens
tccaggagtttgagactgcagt

SEQ ID NO: 9282786 - DNA, 22 bp, Homo sapiens
tccaggcagggcagccatcaag

SEQ ID NO: 9282787 - DNA, 22 bp, Homo sapiens
tccaggcagggcagccatcaag

SEQ ID NO: 9282788 - DNA, 22 bp, Homo sapiens
tccaggcagttttccaggttgt

SEQ ID NO: 9282789 - DNA, 22 bp, Homo sapiens
tcaggaggtttggattcagtta

SEQ ID NO: 9282790 - DNA, 21 bp, Homo sapiens
tcaggaagagccagttcatgc

SEQ ID NO: 9282791 - DNA, 22 bp, Homo sapiens
tcaggaagccggttaaatagat

SEQ ID NO: 9282792 - DNA, 22 bp, Homo sapiens
tcagctctgcactccactgtgg

SEQ ID NO: 9282793 - DNA, 22 bp, Homo sapiens
tcaggaacacaggggcccatgc

SEQ ID NO: 9282794 - DNA, 22 bp, Homo sapiens
tcagctctgcaaggtcacctcc

SEQ ID NO: 9282795 - DNA, 22 bp, Homo sapiens
tcaggaacatttaaccacaggg

SEQ ID NO: 9282796 - DNA, 22 bp, Homo sapiens
tcaggaacataatgtgagtcag

SEQ ID NO: 9282797 - DNA, 22 bp, Homo sapiens
tcaggaaccctggtctcctgct

SEQ ID NO: 9282798 - DNA, 22 bp, Homo sapiens
tcaggaacttctaggaaagctg

SEQ ID NO: 9282799 - DNA, 22 bp, Homo sapiens
tcaggaagaaagaagggagtgt

SEQ ID NO: 9282800 - DNA, 22 bp, Homo sapiens
tcagctcctcagagcctcagtt

SEQ ID NO: 9282801 - DNA, 22 bp, Homo sapiens
tcagctcctcatgcaggggata

SEQ ID NO: 9282802 - DNA, 22 bp, Homo sapiens
tcagctcctcatgcaggggata

SEQ ID NO: 9282803 - DNA, 22 bp, Homo sapiens
tcagctctaagttttatgcaaa

SEQ ID NO: 9282804 - DNA, 22 bp, Homo sapiens
tcagctctacacacacctgtgt

SEQ ID NO: 9282805 - DNA, 22 bp, Homo sapiens
tcagctctaagttttatgcaaa

SEQ ID NO: 9282806 - DNA, 22 bp, Homo sapiens
tcagctctacctgggagctgtc

SEQ ID NO: 9282807 - DNA, 22 bp, Homo sapiens
tcagctctacacacacctgtgt

SEQ ID NO: 9282808 - DNA, 22 bp, Homo sapiens
tcagctctacctgggagctgtc

SEQ ID NO: 9282809 - DNA, 22 bp, Homo sapiens
tcagctctcacagatctcaacc

SEQ ID NO: 9282810 - DNA, 22 bp, Homo sapiens
tcagctctcacagatctcaacc

SEQ ID NO: 9282811 - DNA, 22 bp, Homo sapiens
tcagctctctgggctcgaacct

SEQ ID NO: 9282812 - DNA, 22 bp, Homo sapiens
tcagctctgcaaggtcacctcc

SEQ ID NO: 9282813 - DNA, 22 bp, Homo sapiens
tcagctctctgggctcgaacct

SEQ ID NO: 9282814 - DNA, 22 bp, Homo sapiens
tcagcctggtgattcctctgtc

SEQ ID NO: 9282815 - DNA, 22 bp, Homo sapiens
tcagcctggtgattcctctgtc

SEQ ID NO: 9282816 - DNA, 22 bp, Homo sapiens
tcagcctggcaggatggcctgg

SEQ ID NO: 9282817 - DNA, 22 bp, Homo sapiens
tcagccttgtggccctgctcca

SEQ ID NO: 9282818 - DNA, 18 bp, Homo sapiens
tcagcctgttgtctgcct

SEQ ID NO: 9282819 - DNA, 22 bp, Homo sapiens
tcagctcactctgcttcctggg

SEQ ID NO: 9282820 - DNA, 22 bp, Homo sapiens
tcagcctgctccaagtgctgcc

SEQ ID NO: 9282821 - DNA, 22 bp, Homo sapiens
tcagcctgctccaagtgctgcc

SEQ ID NO: 9282822 - DNA, 22 bp, Homo sapiens
tcagcctgcgtcatggtgacac

SEQ ID NO: 9282823 - DNA, 22 bp, Homo sapiens
tcagcactttttaaagcagcat

SEQ ID NO: 9282824 - DNA, 22 bp, Homo sapiens
tcagcacttttactctctttgc

SEQ ID NO: 9282825 - DNA, 22 bp, Homo sapiens
tcagcactttgaagcagaagga

SEQ ID NO: 9282826 - DNA, 22 bp, Homo sapiens
tcagcactttgaagcagaagga

SEQ ID NO: 9282827 - DNA, 22 bp, Homo sapiens
tcagcacttggatttcagagat

SEQ ID NO: 9282828 - DNA, 22 bp, Homo sapiens
tcaggccacttcacaggtgatt

SEQ ID NO: 9282829 - DNA, 22 bp, Homo sapiens
tcaggccacggctcactgagac

SEQ ID NO: 9282830 - DNA, 22 bp, Homo sapiens
tcaggccagcaccatccctatc

SEQ ID NO: 9282831 - DNA, 22 bp, Homo sapiens
tcaggccaaagaaacagcatga

SEQ ID NO: 9282832 - DNA, 22 bp, Homo sapiens
tcaggccaaggtagacatgact

SEQ ID NO: 9282833 - DNA, 19 bp, Homo sapiens
tcaggcagttattcacaaa

SEQ ID NO: 9282834 - DNA, 19 bp, Homo sapiens
tcaggcagttattcacaaa

SEQ ID NO: 9282835 - DNA, 20 bp, Homo sapiens
tcaggcagtggggaaaggca

SEQ ID NO: 9282836 - DNA, 22 bp, Homo sapiens
tcaggcagtagaattgcttgaa

SEQ ID NO: 9282837 - DNA, 21 bp, Homo sapiens
tcaggcagtgcaaatacatgg

SEQ ID NO: 9282838 - DNA, 22 bp, Homo sapiens
tcaggatgaagtcagaggggtc

SEQ ID NO: 9282839 - DNA, 22 bp, Homo sapiens
tcaggatgacttcaaggaggaa

SEQ ID NO: 9282840 - DNA, 22 bp, Homo sapiens
tcagggaaaggggagagtcatt

SEQ ID NO: 9282841 - DNA, 22 bp, Homo sapiens
tcagggaaatagcagggctgaa

SEQ ID NO: 9282842 - DNA, 22 bp, Homo sapiens
tcagggaaaagtcacactgggt

SEQ ID NO: 9282843 - DNA, 22 bp, Homo sapiens
tcagggaaacctaaggaagcca

SEQ ID NO: 9282844 - DNA, 22 bp, Homo sapiens
tcagggaacctctcctgtttct

SEQ ID NO: 9282845 - DNA, 22 bp, Homo sapiens
tcagggaacaatgttatggctt

SEQ ID NO: 9282846 - DNA, 22 bp, Homo sapiens
tcagggaaatttccatgtgttt

SEQ ID NO: 9282847 - DNA, 22 bp, Homo sapiens
tcagggaaatttccatgtgttt

SEQ ID NO: 9282848 - DNA, 22 bp, Homo sapiens
tcagggaaattcaagggagatt

SEQ ID NO: 9282849 - DNA, 22 bp, Homo sapiens
tcaggctgggctcctctcccca

SEQ ID NO: 9282850 - DNA, 22 bp, Homo sapiens
tcaggctggggtgctaaggtgt

SEQ ID NO: 9282851 - DNA, 22 bp, Homo sapiens
tcaggctggggtgctaaggtgt

SEQ ID NO: 9282852 - DNA, 22 bp, Homo sapiens
tcaggctttttctcaacctctt

SEQ ID NO: 9282853 - DNA, 22 bp, Homo sapiens
tcaggctggagtgcagtggcgc

SEQ ID NO: 9282854 - DNA, 22 bp, Homo sapiens
tcaggctggagtgcagtggcgc

SEQ ID NO: 9282855 - DNA, 22 bp, Homo sapiens
tcaggctgggagacaatcactg

SEQ ID NO: 9282856 - DNA, 22 bp, Homo sapiens
tcaggctgggagacaatcactg

SEQ ID NO: 9282857 - DNA, 18 bp, Homo sapiens
tcaggctgggcctccttc

SEQ ID NO: 9282858 - DNA, 22 bp, Homo sapiens
tcaggctgggctcctctcccca

SEQ ID NO: 9282859 - DNA, 18 bp, Homo sapiens
tcaggctgggcctccttc

SEQ ID NO: 9282860 - DNA, 22 bp, Homo sapiens
tcaggctgaggtcatctgcatc

SEQ ID NO: 9282861 - DNA, 22 bp, Homo sapiens
tcaggctgataggaggaactga

SEQ ID NO: 9282862 - DNA, 22 bp, Homo sapiens
tcaggctgctggccagcaggct

SEQ ID NO: 9282863 - DNA, 22 bp, Homo sapiens
tcaggctgctggccagcaggct

SEQ ID NO: 9282864 - DNA, 22 bp, Homo sapiens
tcaggctgctggccagcaggct

SEQ ID NO: 9282865 - DNA, 22 bp, Homo sapiens
tcaggctggagtgcagtggcgc

SEQ ID NO: 9282866 - DNA, 22 bp, Homo sapiens
tcaggctggagtgcagtggcgc

SEQ ID NO: 9282867 - DNA, 22 bp, Homo sapiens
tcaggctggaatgcagtggggc

SEQ ID NO: 9282868 - DNA, 22 bp, Homo sapiens
tcaggctggaatgcagtggggc

SEQ ID NO: 9282869 - DNA, 22 bp, Homo sapiens
tcaggctggaatgcagtggggc

SEQ ID NO: 9282870 - DNA, 22 bp, Homo sapiens
tcaggctggaatgcagtggggc

SEQ ID NO: 9282871 - DNA, 22 bp, Homo sapiens
tcaggctgctttcatgcttaga

SEQ ID NO: 9282872 - DNA, 22 bp, Homo sapiens
tcaggctgctgtactgtgaatg

SEQ ID NO: 9282873 - DNA, 18 bp, Homo sapiens
tcaggctggaagtttgcc

SEQ ID NO: 9282874 - DNA, 22 bp, Homo sapiens
tcaggctgctttcatgcttaga

SEQ ID NO: 9282875 - DNA, 22 bp, Homo sapiens
tcatggctctaaagacatagat

SEQ ID NO: 9282876 - DNA, 22 bp, Homo sapiens
tcatggcattgttaagggtttt

SEQ ID NO: 9282877 - DNA, 20 bp, Homo sapiens
tcatggcagccacccacagg

SEQ ID NO: 9282878 - DNA, 22 bp, Homo sapiens
tcatggcacttagcacagtcct

SEQ ID NO: 9282879 - DNA, 22 bp, Homo sapiens
tcatggcagccctttactagag

SEQ ID NO: 9282880 - DNA, 22 bp, Homo sapiens
tcatggcacatgccctccaggg

SEQ ID NO: 9282881 - DNA, 21 bp, Homo sapiens
tcatggattttctctgctttt

SEQ ID NO: 9282882 - DNA, 21 bp, Homo sapiens
tcatggattttctctgctttt

SEQ ID NO: 9282883 - DNA, 22 bp, Homo sapiens
tcatggattaaattattaagtt

SEQ ID NO: 9282884 - DNA, 22 bp, Homo sapiens
tcatggatgggcccagctctgt

SEQ ID NO: 9282885 - DNA, 22 bp, Homo sapiens
tcatggattaaattattaagtt

SEQ ID NO: 9282886 - DNA, 22 bp, Homo sapiens
tcatggataaaatattggttaa

SEQ ID NO: 9282887 - DNA, 19 bp, Homo sapiens
tcatggatcaggtagttta

SEQ ID NO: 9282888 - DNA, 22 bp, Homo sapiens
tcatggatgatagcttcattgc

SEQ ID NO: 9282889 - DNA, 22 bp, Homo sapiens
tcatggatgatagcttcattgc

SEQ ID NO: 9282890 - DNA, 22 bp, Homo sapiens
tcatggatggccgggaggtgat

SEQ ID NO: 9282891 - DNA, 22 bp, Homo sapiens
tcatggatgggcccagctctgt

SEQ ID NO: 9282892 - DNA, 22 bp, Homo sapiens
tcatggataaaatattggttaa

SEQ ID NO: 9282893 - DNA, 22 bp, Homo sapiens
tcatggagactttgagcctgtt

SEQ ID NO: 9282894 - DNA, 23 bp, Homo sapiens
tcatggaactgggcaatcttgaa

SEQ ID NO: 9282895 - DNA, 23 bp, Homo sapiens
tcatggaactgggcaatcttgaa

SEQ ID NO: 9282896 - DNA, 19 bp, Homo sapiens
tcatggaagaaatgtgata

SEQ ID NO: 9282897 - DNA, 20 bp, Homo sapiens
tcatggaatctcactctagt

SEQ ID NO: 9282898 - DNA, 22 bp, Homo sapiens
tcatggaatagagcagtggcaa

SEQ ID NO: 9282899 - DNA, 21 bp, Homo sapiens
tcatggaagtaacaaacatat

SEQ ID NO: 9282900 - DNA, 22 bp, Homo sapiens
tcatggaaacagcaatgctaat

SEQ ID NO: 9282901 - DNA, 22 bp, Homo sapiens
tcatggaaacagcaatgctaat

SEQ ID NO: 9282902 - DNA, 22 bp, Homo sapiens
tcatggaaacaatgcggaaaaa

SEQ ID NO: 9282903 - DNA, 22 bp, Homo sapiens
tcatgctttggttgctgtcctt

SEQ ID NO: 9282904 - DNA, 22 bp, Homo sapiens
tcatgctgtgaactgtatacat

SEQ ID NO: 9282905 - DNA, 22 bp, Homo sapiens
tcattacagtgtttatatgtct

SEQ ID NO: 9282906 - DNA, 22 bp, Homo sapiens
tcattacagtgtttatatgtct

SEQ ID NO: 9282907 - DNA, 18 bp, Homo sapiens
tcattagggattgcaaag

SEQ ID NO: 9282908 - DNA, 22 bp, Homo sapiens
tcattacagagatataatctac

SEQ ID NO: 9282909 - DNA, 22 bp, Homo sapiens
tcattacagagatataatctac

SEQ ID NO: 9282910 - DNA, 22 bp, Homo sapiens
tcattacagagatataatctac

SEQ ID NO: 9282911 - DNA, 22 bp, Homo sapiens
tcattattctctttaatgttct

SEQ ID NO: 9282912 - DNA, 22 bp, Homo sapiens
tcattattctctttaatgttct

SEQ ID NO: 9282913 - DNA, 22 bp, Homo sapiens
tcattatcctagtatcttgaat

SEQ ID NO: 9282914 - DNA, 22 bp, Homo sapiens
tcattatcttggctcatttctg

SEQ ID NO: 9282915 - DNA, 22 bp, Homo sapiens
tcattataaacatatgctaaag

SEQ ID NO: 9282916 - DNA, 22 bp, Homo sapiens
tcattatcctagtatcttgaat

SEQ ID NO: 9282917 - DNA, 22 bp, Homo sapiens
tcattcaggttgggcaagtgtc

SEQ ID NO: 9282918 - DNA, 22 bp, Homo sapiens
tcattcagagagaatgttccag

SEQ ID NO: 9282919 - DNA, 18 bp, Homo sapiens
tcattcaaagtctactga

SEQ ID NO: 9282920 - DNA, 23 bp, Homo sapiens
tcattcaaggctggtatctttca

SEQ ID NO: 9282921 - DNA, 22 bp, Homo sapiens
tcattatttgctttagttatgt

SEQ ID NO: 9282922 - DNA, 22 bp, Homo sapiens
tcagtgttcagcggtgtgtgca

SEQ ID NO: 9282923 - DNA, 16 bp, Homo sapiens
tcagtgttccagaata

SEQ ID NO: 9282924 - DNA, 22 bp, Homo sapiens
tcagtgttcagggaccaggtcc

SEQ ID NO: 9282925 - DNA, 22 bp, Homo sapiens
tcagtgttattagatgaggttt

SEQ ID NO: 9282926 - DNA, 22 bp, Homo sapiens
tcagtgttattagatgaggttt

SEQ ID NO: 9282927 - DNA, 22 bp, Homo sapiens
tcagtgttagacaagtttggaa

SEQ ID NO: 9282928 - DNA, 22 bp, Homo sapiens
tcagtgttcgctcagggactcc

SEQ ID NO: 9282929 - DNA, 22 bp, Homo sapiens
tcataggagtagcagtgagagg

SEQ ID NO: 9282930 - DNA, 22 bp, Homo sapiens
tcatataagtttaaaactatct

SEQ ID NO: 9282931 - DNA, 22 bp, Homo sapiens
tcatataactggatattttcaa

SEQ ID NO: 9282932 - DNA, 22 bp, Homo sapiens
tcatagttatggagattaagga

SEQ ID NO: 9282933 - DNA, 22 bp, Homo sapiens
tcatgctagttaagaacacaat

SEQ ID NO: 9282934 - DNA, 22 bp, Homo sapiens
tcatgctatttcgaatgtaata

SEQ ID NO: 9282935 - DNA, 22 bp, Homo sapiens
tcatatttaggcctttaattca

SEQ ID NO: 9282936 - DNA, 22 bp, Homo sapiens
tcatatttaggcctttaattca

SEQ ID NO: 9282937 - DNA, 22 bp, Homo sapiens
tcatatttaggcctttaattca

SEQ ID NO: 9282938 - DNA, 22 bp, Homo sapiens
tcatattagggtaatgataaga

SEQ ID NO: 9282939 - DNA, 22 bp, Homo sapiens
tcatattagggtaatgataaga

SEQ ID NO: 9282940 - DNA, 22 bp, Homo sapiens
tcatattagggtaatgataaga

SEQ ID NO: 9282941 - DNA, 21 bp, Homo sapiens
tcatatttctcttgctattgt

SEQ ID NO: 9282942 - DNA, 21 bp, Homo sapiens
tcatatttctcttgctattgt

SEQ ID NO: 9282943 - DNA, 21 bp, Homo sapiens
tcatatttctcttgctattgt

SEQ ID NO: 9282944 - DNA, 21 bp, Homo sapiens
tcatatttctcttgctattgt

SEQ ID NO: 9282945 - DNA, 22 bp, Homo sapiens
tcatatttatatgttggcacag

SEQ ID NO: 9282946 - DNA, 17 bp, Homo sapiens
tcagggaatgaggttgt

SEQ ID NO: 9282947 - DNA, 22 bp, Homo sapiens
tcagggaataagtagatgagtg

SEQ ID NO: 9282948 - DNA, 22 bp, Homo sapiens
tcagggaagacttcttagagga

SEQ ID NO: 9282949 - DNA, 22 bp, Homo sapiens
tcagggaatgatgcacacagtt

SEQ ID NO: 9282950 - DNA, 22 bp, Homo sapiens
tcagggaccaccactcacccag

SEQ ID NO: 9282951 - DNA, 22 bp, Homo sapiens
tcagggacagggtgctgctgcg

SEQ ID NO: 9282952 - DNA, 22 bp, Homo sapiens
tcaggtggctggttgctggcta

SEQ ID NO: 9282953 - DNA, 22 bp, Homo sapiens
tcagggacccctctgagtggag

SEQ ID NO: 9282954 - DNA, 22 bp, Homo sapiens
tcaggtggccaaatgggagcgc

SEQ ID NO: 9282955 - DNA, 22 bp, Homo sapiens
tcaggtgttagaagaaatttca

SEQ ID NO: 9282956 - DNA, 17 bp, Homo sapiens
tcagtctctgtcctgga

SEQ ID NO: 9282957 - DNA, 22 bp, Homo sapiens
tcagtgcagaatagtgatgcat

SEQ ID NO: 9282958 - DNA, 22 bp, Homo sapiens
tcagtgcacccaattctctcca

SEQ ID NO: 9282959 - DNA, 22 bp, Homo sapiens
tcagtgatttctggggtgaggg

SEQ ID NO: 9282960 - DNA, 22 bp, Homo sapiens
tcagtgatttctggggtgaggg

SEQ ID NO: 9282961 - DNA, 22 bp, Homo sapiens
tcagtgaaccttctgtggcagg

SEQ ID NO: 9282962 - DNA, 22 bp, Homo sapiens
tcagtgaagtaatggtgagaga

SEQ ID NO: 9282963 - DNA, 21 bp, Homo sapiens
tcagtgacaggtgctgacctc

SEQ ID NO: 9282964 - DNA, 22 bp, Homo sapiens
tcagtgaaatgcatattcttcg

SEQ ID NO: 9282965 - DNA, 22 bp, Homo sapiens
tcagtcttttgccctgaggagt

SEQ ID NO: 9282966 - DNA, 22 bp, Homo sapiens
tcagtctttaaaagctcaggaa

SEQ ID NO: 9282967 - DNA, 22 bp, Homo sapiens
tcagtctttcgaattcagccag

SEQ ID NO: 9282968 - DNA, 22 bp, Homo sapiens
tcagtgcagggtgggagagaga

SEQ ID NO: 9282969 - DNA, 22 bp, Homo sapiens
tcagtgtagcagacttgtagcc

SEQ ID NO: 9282970 - DNA, 22 bp, Homo sapiens
tcagtgtaagttatgtagatgt

SEQ ID NO: 9282971 - DNA, 22 bp, Homo sapiens
tcagtgtcacaggatgctatgc

SEQ ID NO: 9282972 - DNA, 22 bp, Homo sapiens
tcagtgttacattatatagaac

SEQ ID NO: 9282973 - DNA, 22 bp, Homo sapiens
tcagtgttagacaagtttggaa

SEQ ID NO: 9282974 - DNA, 22 bp, Homo sapiens
tcagtgttaatcagtggtacct

SEQ ID NO: 9282975 - DNA, 22 bp, Homo sapiens
tcagtgttaatcagtggtacct

SEQ ID NO: 9282976 - DNA, 22 bp, Homo sapiens
tcagtgtgttactttctcctat

SEQ ID NO: 9282977 - DNA, 22 bp, Homo sapiens
tcagtgtccggagcctgagtgc

SEQ ID NO: 9282978 - DNA, 22 bp, Homo sapiens
tcagtgtccttcgttcttgttg

SEQ ID NO: 9282979 - DNA, 22 bp, Homo sapiens
tcaagagttggtcaaatccaaa

SEQ ID NO: 9282980 - DNA, 22 bp, Homo sapiens
tcaagcttgtcataaacagctc

SEQ ID NO: 9282981 - DNA, 22 bp, Homo sapiens
tcaagctggctgttgctatttc

SEQ ID NO: 9282982 - DNA, 22 bp, Homo sapiens
tcaaggaaggtctgttgctcca

SEQ ID NO: 9282983 - DNA, 22 bp, Homo sapiens
tcaaggaaggtctgttgctcca

SEQ ID NO: 9282984 - DNA, 20 bp, Homo sapiens
tcaaggaatgtcattttgtt

SEQ ID NO: 9282985 - DNA, 22 bp, Homo sapiens
tcaaggagacagaaagcaatgg

SEQ ID NO: 9282986 - DNA, 20 bp, Homo sapiens
tcaaggactccctgggaaga

SEQ ID NO: 9282987 - DNA, 18 bp, Homo sapiens
tcaagacatcatgaaata

SEQ ID NO: 9282988 - DNA, 22 bp, Homo sapiens
tcaagagaaggggaaatagact

SEQ ID NO: 9282989 - DNA, 22 bp, Homo sapiens
tcaagagacaggacgtgtttca

SEQ ID NO: 9282990 - DNA, 22 bp, Homo sapiens
tcaagagaagtgctccacagta

SEQ ID NO: 9282991 - DNA, 22 bp, Homo sapiens
tcaagagaagtgctccacagta

SEQ ID NO: 9282992 - DNA, 22 bp, Homo sapiens
tcaagagagtgctgcttggggt

SEQ ID NO: 9282993 - DNA, 22 bp, Homo sapiens
tcaagagattgaataataactg

SEQ ID NO: 9282994 - DNA, 22 bp, Homo sapiens
tcaagagattgaataataactg

SEQ ID NO: 9282995 - DNA, 22 bp, Homo sapiens
tcaagacagatgggtaacttgg

SEQ ID NO: 9282996 - DNA, 21 bp, Homo sapiens
tcaagacagcatatttaagaa

SEQ ID NO: 9282997 - DNA, 22 bp, Homo sapiens
tcaagaatagctgcaaacaggg

SEQ ID NO: 9282998 - DNA, 22 bp, Homo sapiens
tcaagacatattaaatgtgcga

SEQ ID NO: 9282999 - DNA, 22 bp, Homo sapiens
tcaagacatattaaatgtgcga

SEQ ID NO: 9283000 - DNA, 22 bp, Homo sapiens
tcaagacatcactgtgcatttt

SEQ ID NO: 9283001 - DNA, 22 bp, Homo sapiens
tcaagacatcactgtgcatttt

SEQ ID NO: 9283002 - DNA, 22 bp, Homo sapiens
tatttcttgagtggtcagtttc

SEQ ID NO: 9283003 - DNA, 22 bp, Homo sapiens
tcaagaatttttaatgtgactg

SEQ ID NO: 9283004 - DNA, 22 bp, Homo sapiens
tcaagaatttggataagaaatg

SEQ ID NO: 9283005 - DNA, 22 bp, Homo sapiens
tatttcttcgggattcaagcta

SEQ ID NO: 9283006 - DNA, 22 bp, Homo sapiens
tatttctgattgctcatgaggc

SEQ ID NO: 9283007 - DNA, 22 bp, Homo sapiens
tatttctgaggcccaggaagtg

SEQ ID NO: 9283008 - DNA, 22 bp, Homo sapiens
tatttctgggagttcagaaatt

SEQ ID NO: 9283009 - DNA, 20 bp, Homo sapiens
tatttctgggcaaccattta

SEQ ID NO: 9283010 - DNA, 22 bp, Homo sapiens
tatttctgtcagccagatatgg

SEQ ID NO: 9283011 - DNA, 22 bp, Homo sapiens
tatttctgtatgcataaaagga

SEQ ID NO: 9283012 - DNA, 22 bp, Homo sapiens
tatttctgtttatttgtacatc

SEQ ID NO: 9283013 - DNA, 22 bp, Homo sapiens
tatttctgtttatttgtacatc

SEQ ID NO: 9283014 - DNA, 22 bp, Homo sapiens
tcaaggctaaactttcagagta

SEQ ID NO: 9283015 - DNA, 19 bp, Homo sapiens
tcaaggctccctgagggat

SEQ ID NO: 9283016 - DNA, 22 bp, Homo sapiens
tcaaggctattaattctgtgag

SEQ ID NO: 9283017 - DNA, 22 bp, Homo sapiens
tcaagggaggagacacagccct

SEQ ID NO: 9283018 - DNA, 22 bp, Homo sapiens
tcaaggaggtgcttggcttcac

SEQ ID NO: 9283019 - DNA, 22 bp, Homo sapiens
tcaaggcatacatttagaagag

SEQ ID NO: 9283020 - DNA, 19 bp, Homo sapiens
tcaagtcctaggcccacaa

SEQ ID NO: 9283021 - DNA, 22 bp, Homo sapiens
tcaagtatttatttctgctggc

SEQ ID NO: 9283022 - DNA, 22 bp, Homo sapiens
tcaagtaacatgaacacacaga

SEQ ID NO: 9283023 - DNA, 22 bp, Homo sapiens
tcaaggttcaaggctggcttct

SEQ ID NO: 9283024 - DNA, 22 bp, Homo sapiens
tcaaggtgctgtgctgtgctag

SEQ ID NO: 9283025 - DNA, 22 bp, Homo sapiens
tcaataaaattgttttcctatc

SEQ ID NO: 9283026 - DNA, 23 bp, Homo sapiens
tcaataactcgggttaaaataga

SEQ ID NO: 9283027 - DNA, 22 bp, Homo sapiens
tcaagtgtagtggtgtcaggtc

SEQ ID NO: 9283028 - DNA, 22 bp, Homo sapiens
tcaagtcttgatgagacaaacc

SEQ ID NO: 9283029 - DNA, 22 bp, Homo sapiens
tcaagtcttgagggacagcatt

SEQ ID NO: 9283030 - DNA, 22 bp, Homo sapiens
tcaatttcttggtttgataata

SEQ ID NO: 9283031 - DNA, 22 bp, Homo sapiens
tcaattttatgaaacaaagtga

SEQ ID NO: 9283032 - DNA, 22 bp, Homo sapiens
tcaatttcccctattgatagac

SEQ ID NO: 9283033 - DNA, 20 bp, Homo sapiens
tcaatttcaggtagcatagt

SEQ ID NO: 9283034 - DNA, 22 bp, Homo sapiens
tcaatttatgtggctattcatt

SEQ ID NO: 9283035 - DNA, 22 bp, Homo sapiens
tcaataatggcaggataaattt

SEQ ID NO: 9283036 - DNA, 22 bp, Homo sapiens
tcaataaggcaacattaagtta

SEQ ID NO: 9283037 - DNA, 22 bp, Homo sapiens
tcaatttatgtggctattcatt

SEQ ID NO: 9283038 - DNA, 22 bp, Homo sapiens
tcaatttaaggtactactttgg

SEQ ID NO: 9283039 - DNA, 22 bp, Homo sapiens
tcaataatggcaggataaattt

SEQ ID NO: 9283040 - DNA, 22 bp, Homo sapiens
tcaatacagaaaggatattttg

SEQ ID NO: 9283041 - DNA, 22 bp, Homo sapiens
tcacaggctaaatttatgcagg

SEQ ID NO: 9283042 - DNA, 21 bp, Homo sapiens
tcacaggctcagggagagagt

SEQ ID NO: 9283043 - DNA, 21 bp, Homo sapiens
tcacaggctcagggagagagt

SEQ ID NO: 9283044 - DNA, 21 bp, Homo sapiens
tcacaggtcaatgtgtgaagg

SEQ ID NO: 9283045 - DNA, 22 bp, Homo sapiens
tcacagtaaaagcatggaagag

SEQ ID NO: 9283046 - DNA, 22 bp, Homo sapiens
tcacagtactgtgactattgac

SEQ ID NO: 9283047 - DNA, 19 bp, Homo sapiens
tcacaggcatctccccaga

SEQ ID NO: 9283048 - DNA, 22 bp, Homo sapiens
tcacaggagtcataattacagt

SEQ ID NO: 9283049 - DNA, 22 bp, Homo sapiens
tcacaggagtcaaggaatagta

SEQ ID NO: 9283050 - DNA, 22 bp, Homo sapiens
tcacagctccagactgcaactc

SEQ ID NO: 9283051 - DNA, 22 bp, Homo sapiens
tcacagaaggcatcacagaaga

SEQ ID NO: 9283052 - DNA, 22 bp, Homo sapiens
tcacagaacacaaatgccactt

SEQ ID NO: 9283053 - DNA, 22 bp, Homo sapiens
tcacaattcagaaaccaagtag

SEQ ID NO: 9283054 - DNA, 22 bp, Homo sapiens
tcacaatgaaaaacactacata

SEQ ID NO: 9283055 - DNA, 22 bp, Homo sapiens
tcacaatatttatcttccaatt

SEQ ID NO: 9283056 - DNA, 22 bp, Homo sapiens
tcacaaagctttgataagcaga

SEQ ID NO: 9283057 - DNA, 22 bp, Homo sapiens
tcacaaagctttgataagcaga

SEQ ID NO: 9283058 - DNA, 22 bp, Homo sapiens
tcacaaacaatgctttggaatt

SEQ ID NO: 9283059 - DNA, 22 bp, Homo sapiens
tcacaaatagctatattaagga

SEQ ID NO: 9283060 - DNA, 22 bp, Homo sapiens
tcacaagatatttcagtccttt

SEQ ID NO: 9283061 - DNA, 22 bp, Homo sapiens
tcacaagatacagttagaagca

SEQ ID NO: 9283062 - DNA, 22 bp, Homo sapiens
tcactgaactctcatagagaaa

SEQ ID NO: 9283063 - DNA, 22 bp, Homo sapiens
tcactgacgtggggctacttga

SEQ ID NO: 9283064 - DNA, 22 bp, Homo sapiens
tcactgaatacttgtctcatcc

SEQ ID NO: 9283065 - DNA, 22 bp, Homo sapiens
tcactgaagactgggctctaaa

SEQ ID NO: 9283066 - DNA, 21 bp, Homo sapiens
tcactgaagcctaagatgttt

SEQ ID NO: 9283067 - DNA, 21 bp, Homo sapiens
tcactgaagcctaagatgttt

SEQ ID NO: 9283068 - DNA, 22 bp, Homo sapiens
tcactgttaataaatagcaaag

SEQ ID NO: 9283069 - DNA, 22 bp, Homo sapiens
tcactgttagagcaaacgtatg

SEQ ID NO: 9283070 - DNA, 22 bp, Homo sapiens
tcactttgccctgtaccttggg

SEQ ID NO: 9283071 - DNA, 23 bp, Homo sapiens
tcactttgatgtaattgaaaagc

SEQ ID NO: 9283072 - DNA, 22 bp, Homo sapiens
tcactttggaagatagcacatc

SEQ ID NO: 9283073 - DNA, 22 bp, Homo sapiens
tcactttggattatgtaatttc

SEQ ID NO: 9283074 - DNA, 22 bp, Homo sapiens
tcactttgacggccaacttcta

SEQ ID NO: 9283075 - DNA, 22 bp, Homo sapiens
tcactttgacagagaaatgaat

SEQ ID NO: 9283076 - DNA, 22 bp, Homo sapiens
tcactttgatgacattgtagct

SEQ ID NO: 9283077 - DNA, 22 bp, Homo sapiens
tcactttgaattccttgatttt

SEQ ID NO: 9283078 - DNA, 22 bp, Homo sapiens
tcactttagaggaaacattgag

SEQ ID NO: 9283079 - DNA, 22 bp, Homo sapiens
tcactttacctcattcaggcag

SEQ ID NO: 9283080 - DNA, 22 bp, Homo sapiens
tcactttaccaaagtacaggag

SEQ ID NO: 9283081 - DNA, 21 bp, Homo sapiens
tcactagtgccttctgtcatt

SEQ ID NO: 9283082 - DNA, 22 bp, Homo sapiens
tcactagtcgcggggggaggta

SEQ ID NO: 9283083 - DNA, 23 bp, Homo sapiens
tcactagtcaagtgcctttgagt

SEQ ID NO: 9283084 - DNA, 22 bp, Homo sapiens
tcactagtcatcaacttccatt

SEQ ID NO: 9283085 - DNA, 22 bp, Homo sapiens
tcactagtcatcaacttccatt

SEQ ID NO: 9283086 - DNA, 22 bp, Homo sapiens
tcactacaacctccgcctcctg

SEQ ID NO: 9283087 - DNA, 22 bp, Homo sapiens
tcactacaacctccgcctcctg

SEQ ID NO: 9283088 - DNA, 22 bp, Homo sapiens
tcacccagccttggcgggtttg

SEQ ID NO: 9283089 - DNA, 22 bp, Homo sapiens
tcacccagccttggcgggtttg

SEQ ID NO: 9283090 - DNA, 22 bp, Homo sapiens
tcacccagcgggcgcacactcg

SEQ ID NO: 9283091 - DNA, 22 bp, Homo sapiens
tcacccagcgggcgcacactcg

SEQ ID NO: 9283092 - DNA, 22 bp, Homo sapiens
tcacccaggatattgaagtcag

SEQ ID NO: 9283093 - DNA, 19 bp, Homo sapiens
tcacccaggctgctggctc

SEQ ID NO: 9283094 - DNA, 22 bp, Homo sapiens
tcacccaggatattgaagtcag

SEQ ID NO: 9283095 - DNA, 22 bp, Homo sapiens
tcacccaggctggactgcagtg

SEQ ID NO: 9283096 - DNA, 22 bp, Homo sapiens
tcacccaggctggagtgcagtg

SEQ ID NO: 9283097 - DNA, 22 bp, Homo sapiens
tcacccaggctggagtgcagtg

SEQ ID NO: 9283098 - DNA, 22 bp, Homo sapiens
tcacccaggctggactgcagtg

SEQ ID NO: 9283099 - DNA, 22 bp, Homo sapiens
tcacccaggctggagtgcagtg

SEQ ID NO: 9283100 - DNA, 22 bp, Homo sapiens
tcacccaggctggtatgcagtg

SEQ ID NO: 9283101 - DNA, 22 bp, Homo sapiens
tcacccaggctggtatgcagtg

SEQ ID NO: 9283102 - DNA, 22 bp, Homo sapiens
tcacccaggctggagtgtagtg

SEQ ID NO: 9283103 - DNA, 22 bp, Homo sapiens
tcacccaggctggagtgtagtg

SEQ ID NO: 9283104 - DNA, 22 bp, Homo sapiens
tcacattttatctattttaagt

SEQ ID NO: 9283105 - DNA, 22 bp, Homo sapiens
tcacattttatctgagattgac

SEQ ID NO: 9283106 - DNA, 22 bp, Homo sapiens
tcacagtataacctcatatagg

SEQ ID NO: 9283107 - DNA, 22 bp, Homo sapiens
tcacagtataacctcatatagg

SEQ ID NO: 9283108 - DNA, 22 bp, Homo sapiens
tcacagtagttgttctctgttt

SEQ ID NO: 9283109 - DNA, 22 bp, Homo sapiens
tcacattttctactactgtacg

SEQ ID NO: 9283110 - DNA, 22 bp, Homo sapiens
tcacattttcatattctctgag

SEQ ID NO: 9283111 - DNA, 22 bp, Homo sapiens
tcacattttccttggtatctgt

SEQ ID NO: 9283112 - DNA, 22 bp, Homo sapiens
tcacattttcttaggaaactta

SEQ ID NO: 9283113 - DNA, 22 bp, Homo sapiens
tcacattttctactactgtacg

SEQ ID NO: 9283114 - DNA, 22 bp, Homo sapiens
tcacattttctactactgtacg

SEQ ID NO: 9283115 - DNA, 22 bp, Homo sapiens
tcaccactgaacagacctttgg

SEQ ID NO: 9283116 - DNA, 22 bp, Homo sapiens
tcaccactgaggccacgtggct

SEQ ID NO: 9283117 - DNA, 22 bp, Homo sapiens
tcaccaaggcattttcacagca

SEQ ID NO: 9283118 - DNA, 22 bp, Homo sapiens
tcaccaataataacttgagaat

SEQ ID NO: 9283119 - DNA, 22 bp, Homo sapiens
tcacccagcagctgcttctgct

SEQ ID NO: 9283120 - DNA, 22 bp, Homo sapiens
tcaccaggctagagtgcagtgg

SEQ ID NO: 9283121 - DNA, 22 bp, Homo sapiens
tcaccaggattgggctgtaggc

SEQ ID NO: 9283122 - DNA, 22 bp, Homo sapiens
tcaccaggcaactatgtactcc

SEQ ID NO: 9283123 - DNA, 22 bp, Homo sapiens
tcaccaggattcctatcagtag

SEQ ID NO: 9283124 - DNA, 20 bp, Homo sapiens
tcagagaaggagctttcctg

SEQ ID NO: 9283125 - DNA, 22 bp, Homo sapiens
tcagagaaggcaattttatggt

SEQ ID NO: 9283126 - DNA, 22 bp, Homo sapiens
tcagagaaggctgagtcacggc

SEQ ID NO: 9283127 - DNA, 22 bp, Homo sapiens
tcagagaactgcagcccttcct

SEQ ID NO: 9283128 - DNA, 22 bp, Homo sapiens
tcagagaactccacaccttagg

SEQ ID NO: 9283129 - DNA, 22 bp, Homo sapiens
tcagaccatcctgctgttagtg

SEQ ID NO: 9283130 - DNA, 22 bp, Homo sapiens
tcagacctctgaccttgccaaa

SEQ ID NO: 9283131 - DNA, 22 bp, Homo sapiens
tcagacagtttgcagtgtgcct

SEQ ID NO: 9283132 - DNA, 22 bp, Homo sapiens
tcagacagtgtgatcagtctct

SEQ ID NO: 9283133 - DNA, 22 bp, Homo sapiens
tcagacagtgtgatcagtctct

SEQ ID NO: 9283134 - DNA, 22 bp, Homo sapiens
tcagaccatcctgctgttagtg

SEQ ID NO: 9283135 - DNA, 22 bp, Homo sapiens
tcagacagtcatcagagcttgt

SEQ ID NO: 9283136 - DNA, 22 bp, Homo sapiens
tcacttttgatccctatgcagt

SEQ ID NO: 9283137 - DNA, 22 bp, Homo sapiens
tcagaaaagaccacattattct

SEQ ID NO: 9283138 - DNA, 22 bp, Homo sapiens
tcagcaatgtgatactgtgcaa

SEQ ID NO: 9283139 - DNA, 22 bp, Homo sapiens
tcagcaccagttatcctcaggg

SEQ ID NO: 9283140 - DNA, 22 bp, Homo sapiens
tcagcacaggtcttgcaaaaca

SEQ ID NO: 9283141 - DNA, 22 bp, Homo sapiens
tcagcactgaaattcttcacat

SEQ ID NO: 9283142 - DNA, 22 bp, Homo sapiens
tcagcactcgctacctagtaaa

SEQ ID NO: 9283143 - DNA, 22 bp, Homo sapiens
tcagcaccagttatcctcaggg

SEQ ID NO: 9283144 - DNA, 22 bp, Homo sapiens
tcagcactatacattttgaata

SEQ ID NO: 9283145 - DNA, 22 bp, Homo sapiens
tcagcacttactagtggccttt

SEQ ID NO: 9283146 - DNA, 22 bp, Homo sapiens
tcagcactgtgtccagtctccc

SEQ ID NO: 9283147 - DNA, 22 bp, Homo sapiens
tcagcactgtctattagtgaga

SEQ ID NO: 9283148 - DNA, 22 bp, Homo sapiens
tcagcactgtcttttatttgaa

SEQ ID NO: 9283149 - DNA, 22 bp, Homo sapiens
tcagcactggcgctgggcaggt

SEQ ID NO: 9283150 - DNA, 22 bp, Homo sapiens
tcagcactgatgtttcagaaga

SEQ ID NO: 9283151 - DNA, 22 bp, Homo sapiens
tcagcactgatagaagtcaata

SEQ ID NO: 9283152 - DNA, 22 bp, Homo sapiens
tcagcactgaatctggatttgc

SEQ ID NO: 9283153 - DNA, 22 bp, Homo sapiens
tcagcaagtggaccatcctggg

SEQ ID NO: 9283154 - DNA, 22 bp, Homo sapiens
tcagcaagcagggggatgttca

SEQ ID NO: 9283155 - DNA, 22 bp, Homo sapiens
tcagaggaacactgtttcatgc

SEQ ID NO: 9283156 - DNA, 22 bp, Homo sapiens
tcagaggaaaggtcagatggct

SEQ ID NO: 9283157 - DNA, 22 bp, Homo sapiens
tcagaggaaagggaacatagtc

SEQ ID NO: 9283158 - DNA, 22 bp, Homo sapiens
tcagaggaaagggaacatagtc

SEQ ID NO: 9283159 - DNA, 22 bp, Homo sapiens
tcagaggaaaggtcagatggct

SEQ ID NO: 9283160 - DNA, 22 bp, Homo sapiens
tcagagctgcccatgcaagggg

SEQ ID NO: 9283161 - DNA, 22 bp, Homo sapiens
tcagagctgcccatgcaagggg

SEQ ID NO: 9283162 - DNA, 22 bp, Homo sapiens
tcagagctttggagaccaggaa

SEQ ID NO: 9283163 - DNA, 22 bp, Homo sapiens
tcagagctttggagaccaggaa

SEQ ID NO: 9283164 - DNA, 22 bp, Homo sapiens
tcagagcttatctcttgctgga

SEQ ID NO: 9283165 - DNA, 22 bp, Homo sapiens
tcagagctaaggggagagcaaa

SEQ ID NO: 9283166 - DNA, 22 bp, Homo sapiens
tcagagccaatcatggtgcatt

SEQ ID NO: 9283167 - DNA, 22 bp, Homo sapiens
tcagagcactggtgctaccttg

SEQ ID NO: 9283168 - DNA, 22 bp, Homo sapiens
ttctttatgttaatgaatctat

SEQ ID NO: 9283169 - DNA, 22 bp, Homo sapiens
ttctttatgcttctgtttaggc

SEQ ID NO: 9283170 - DNA, 23 bp, Homo sapiens
ttctttcaagaagttcacagtgc

SEQ ID NO: 9283171 - DNA, 22 bp, Homo sapiens
ttctttcactcaagaaggatct

SEQ ID NO: 9283172 - DNA, 22 bp, Homo sapiens
ttctttcagaacacaagtgatt

SEQ ID NO: 9283173 - DNA, 22 bp, Homo sapiens
ttctttcagaacacaagtgatt

SEQ ID NO: 9283174 - DNA, 22 bp, Homo sapiens
ttctttcaatagctggcatatg

SEQ ID NO: 9283175 - DNA, 22 bp, Homo sapiens
ttctttcaatagctggcatatg

SEQ ID NO: 9283176 - DNA, 22 bp, Homo sapiens
ttctttcccagaagatatgttt

SEQ ID NO: 9283177 - DNA, 20 bp, Homo sapiens
ttctttcatctacacgttgt

SEQ ID NO: 9283178 - DNA, 22 bp, Homo sapiens
ttgaagattctttttgttagta

SEQ ID NO: 9283179 - DNA, 22 bp, Homo sapiens
ttgaagatctttgcattgcagg

SEQ ID NO: 9283180 - DNA, 22 bp, Homo sapiens
ttgaagatgctgtctcttccag

SEQ ID NO: 9283181 - DNA, 22 bp, Homo sapiens
ttgaagagtctagattggttat

SEQ ID NO: 9283182 - DNA, 22 bp, Homo sapiens
ttgaagacacagacatatagag

SEQ ID NO: 9283183 - DNA, 22 bp, Homo sapiens
ttgaagacaagggcaggggttc

SEQ ID NO: 9283184 - DNA, 22 bp, Homo sapiens
ttgaagactaatttagataatg

SEQ ID NO: 9283185 - DNA, 22 bp, Homo sapiens
ttgaagacctttagtgctatgt

SEQ ID NO: 9283186 - DNA, 22 bp, Homo sapiens
ttctttccttgcctcagtgaag

SEQ ID NO: 9283187 - DNA, 22 bp, Homo sapiens
ttctttcccttccagcagctcc

SEQ ID NO: 9283188 - DNA, 23 bp, Homo sapiens
ttgaggcaaacatgtaagtagga

SEQ ID NO: 9283189 - DNA, 22 bp, Homo sapiens
ttgaggcacagattttagtggc

SEQ ID NO: 9283190 - DNA, 22 bp, Homo sapiens
ttgaggcacacacaggttgcat

SEQ ID NO: 9283191 - DNA, 22 bp, Homo sapiens
ttgagcccaggaggcctgggtg

SEQ ID NO: 9283192 - DNA, 22 bp, Homo sapiens
ttgagcccaggaggcctgggtg

SEQ ID NO: 9283193 - DNA, 22 bp, Homo sapiens
ttgagcaatgtcactgaggctt

SEQ ID NO: 9283194 - DNA, 22 bp, Homo sapiens
ttgagcaatgctgcaaagagat

SEQ ID NO: 9283195 - DNA, 20 bp, Homo sapiens
ttgagcaatcagtaaaggat

SEQ ID NO: 9283196 - DNA, 22 bp, Homo sapiens
ttgagcacattccctttcatgg

SEQ ID NO: 9283197 - DNA, 22 bp, Homo sapiens
ttgagcacttattggtgttagg

SEQ ID NO: 9283198 - DNA, 19 bp, Homo sapiens
ttgagcagtgcttagcacc

SEQ ID NO: 9283199 - DNA, 22 bp, Homo sapiens
ttgagcaggatggctatgcaca

SEQ ID NO: 9283200 - DNA, 22 bp, Homo sapiens
ttgaagcatttgctatagcatt

SEQ ID NO: 9283201 - DNA, 22 bp, Homo sapiens
ttgaagcatttctttgagcttc

SEQ ID NO: 9283202 - DNA, 22 bp, Homo sapiens
ttgaagcattgtggcttgtatt

SEQ ID NO: 9283203 - DNA, 22 bp, Homo sapiens
ttgaagcatggtacttgttcaa

SEQ ID NO: 9283204 - DNA, 22 bp, Homo sapiens
ttgaagcaggaaaatttctatt

SEQ ID NO: 9283205 - DNA, 22 bp, Homo sapiens
ttgaagcagctcaggaggctta

SEQ ID NO: 9283206 - DNA, 22 bp, Homo sapiens
ttgaagcacaatgtcttttatc

SEQ ID NO: 9283207 - DNA, 22 bp, Homo sapiens
ttgaagcagagaaatacttgaa

SEQ ID NO: 9283208 - DNA, 21 bp, Homo sapiens
ttgaagcaagggtggctctga

SEQ ID NO: 9283209 - DNA, 22 bp, Homo sapiens
ttgaagcaaggcgaatcttgtg

SEQ ID NO: 9283210 - DNA, 22 bp, Homo sapiens
ttgaagcaaattctgtgcagta

SEQ ID NO: 9283211 - DNA, 20 bp, Homo sapiens
ttgaatgaatgtctggctca

SEQ ID NO: 9283212 - DNA, 22 bp, Homo sapiens
ttgaatgaagtccctttttact

SEQ ID NO: 9283213 - DNA, 22 bp, Homo sapiens
ttgaatgatcctatctagcaca

SEQ ID NO: 9283214 - DNA, 22 bp, Homo sapiens
ttgaatgagaagttattgccat

SEQ ID NO: 9283215 - DNA, 22 bp, Homo sapiens
ttgaatgagtgttttactcatg

SEQ ID NO: 9283216 - DNA, 22 bp, Homo sapiens
ttgaatgaggaagagcactggc

SEQ ID NO: 9283217 - DNA, 22 bp, Homo sapiens
ttgaggccaaaaagtcctatga

SEQ ID NO: 9283218 - DNA, 22 bp, Homo sapiens
ttgagtctctgccaaaacacaa

SEQ ID NO: 9283219 - DNA, 22 bp, Homo sapiens
ttgaggccccatggatgagaac

SEQ ID NO: 9283220 - DNA, 22 bp, Homo sapiens
ttgaggcagggcatggtggccc

SEQ ID NO: 9283221 - DNA, 20 bp, Homo sapiens
ttgaggcatgtctagaagta

SEQ ID NO: 9283222 - DNA, 22 bp, Homo sapiens
ttgaggcaggtccgggtccttc

SEQ ID NO: 9283223 - DNA, 22 bp, Homo sapiens
ttgagtgtactttagtcatctg

SEQ ID NO: 9283224 - DNA, 22 bp, Homo sapiens
ttgatcaagtgggaaatagtaa

SEQ ID NO: 9283225 - DNA, 22 bp, Homo sapiens
ttgatgcactatgtaacttaca

SEQ ID NO: 9283226 - DNA, 22 bp, Homo sapiens
ttgatgagaccattgccgcgtc

SEQ ID NO: 9283227 - DNA, 22 bp, Homo sapiens
ttgatgtaaagtgattcatggg

SEQ ID NO: 9283228 - DNA, 22 bp, Homo sapiens
ttgatcttgtgatagttcaact

SEQ ID NO: 9283229 - DNA, 22 bp, Homo sapiens
ttgattactatgtgttgaaagc

SEQ ID NO: 9283230 - DNA, 22 bp, Homo sapiens
ttgattagtgaaacatgcctag

SEQ ID NO: 9283231 - DNA, 22 bp, Homo sapiens
ttgatgttgctcttaacagtat

SEQ ID NO: 9283232 - DNA, 22 bp, Homo sapiens
ttgatgtacagaattgttcaca

SEQ ID NO: 9283233 - DNA, 22 bp, Homo sapiens
ttgattcttctgaatttgcaga

SEQ ID NO: 9283234 - DNA, 22 bp, Homo sapiens
ttgattctggtgactgatggaa

SEQ ID NO: 9283235 - DNA, 22 bp, Homo sapiens
ttgattctgggctcatttcttt

SEQ ID NO: 9283236 - DNA, 22 bp, Homo sapiens
ttgattctatgaggtaagctat

SEQ ID NO: 9283237 - DNA, 23 bp, Homo sapiens
ttgattctccagtatgggctgag

SEQ ID NO: 9283238 - DNA, 22 bp, Homo sapiens
ttgattctgatcctgtctggag

SEQ ID NO: 9283239 - DNA, 22 bp, Homo sapiens
ttgattctgatcctttgctagc

SEQ ID NO: 9283240 - DNA, 22 bp, Homo sapiens
ttgattttaaaatagtgacact

SEQ ID NO: 9283241 - DNA, 21 bp, Homo sapiens
ttgattttaggaagtttgtca

SEQ ID NO: 9283242 - DNA, 21 bp, Homo sapiens
ttgattttaggaagtttgtca

SEQ ID NO: 9283243 - DNA, 22 bp, Homo sapiens
ttgatttatagaatgttcaagc

SEQ ID NO: 9283244 - DNA, 22 bp, Homo sapiens
ttgatttatagaatgttcaagc

SEQ ID NO: 9283245 - DNA, 22 bp, Homo sapiens
ttgatttcaaaatatatgcttg

SEQ ID NO: 9283246 - DNA, 23 bp, Homo sapiens
ttgatttagctgggattgcatgc

SEQ ID NO: 9283247 - DNA, 22 bp, Homo sapiens
ttgatttctattgagttcctgt

SEQ ID NO: 9283248 - DNA, 22 bp, Homo sapiens
ttgatttctattcagatgtaga

SEQ ID NO: 9283249 - DNA, 22 bp, Homo sapiens
ttgattttaaaatagtgacact

SEQ ID NO: 9283250 - DNA, 22 bp, Homo sapiens
ttgcaaatctttgccagaaggc

SEQ ID NO: 9283251 - DNA, 22 bp, Homo sapiens
ttgcaaatgtttcataacagta

SEQ ID NO: 9283252 - DNA, 22 bp, Homo sapiens
ttctttatcagttactcatagg

SEQ ID NO: 9283253 - DNA, 22 bp, Homo sapiens
ttctttatcagttactcatagg

SEQ ID NO: 9283254 - DNA, 22 bp, Homo sapiens
ttcttgctcaatgtctgtttaa

SEQ ID NO: 9283255 - DNA, 22 bp, Homo sapiens
ttctttaaaatagtgagaaaga

SEQ ID NO: 9283256 - DNA, 22 bp, Homo sapiens
ttctttaaaatagtgagaaaga

SEQ ID NO: 9283257 - DNA, 22 bp, Homo sapiens
ttctttaaatgaattctctgta

SEQ ID NO: 9283258 - DNA, 22 bp, Homo sapiens
ttctttaaatgaattctctgta

SEQ ID NO: 9283259 - DNA, 22 bp, Homo sapiens
ttcttgccatatttcagccctt

SEQ ID NO: 9283260 - DNA, 22 bp, Homo sapiens
ttcttgatttcatgcagttaag

SEQ ID NO: 9283261 - DNA, 22 bp, Homo sapiens
ttcttgatgaatgctaagaact

SEQ ID NO: 9283262 - DNA, 22 bp, Homo sapiens
ttcttctttcctataattaatt

SEQ ID NO: 9283263 - DNA, 22 bp, Homo sapiens
ttcttgaaaatagccatgtaca

SEQ ID NO: 9283264 - DNA, 19 bp, Homo sapiens
ttcttgaacatgtttctca

SEQ ID NO: 9283265 - DNA, 22 bp, Homo sapiens
ttcttgaatagggattgataaa

SEQ ID NO: 9283266 - DNA, 22 bp, Homo sapiens
ttcttgaaggggatataaatag

SEQ ID NO: 9283267 - DNA, 22 bp, Homo sapiens
ttcttgaatcactttagagata

SEQ ID NO: 9283268 - DNA, 22 bp, Homo sapiens
ttcttacatctataaagttggg

SEQ ID NO: 9283269 - DNA, 22 bp, Homo sapiens
ttcttacatctataaagttggg

SEQ ID NO: 9283270 - DNA, 22 bp, Homo sapiens
ttcttacatcagtttattttgt

SEQ ID NO: 9283271 - DNA, 22 bp, Homo sapiens
ttcttacatcagtttattttgt

SEQ ID NO: 9283272 - DNA, 22 bp, Homo sapiens
ttcttacatattttcatatggt

SEQ ID NO: 9283273 - DNA, 22 bp, Homo sapiens
ttcttctttatctcagtatcct

SEQ ID NO: 9283274 - DNA, 22 bp, Homo sapiens
ttcttcttgtctgccctcacat

SEQ ID NO: 9283275 - DNA, 22 bp, Homo sapiens
ttcttacagccctattactaaa

SEQ ID NO: 9283276 - DNA, 22 bp, Homo sapiens
ttcttacagccctattactaaa

SEQ ID NO: 9283277 - DNA, 22 bp, Homo sapiens
ttcttacatattttcatatggt

SEQ ID NO: 9283278 - DNA, 22 bp, Homo sapiens
ttcttacatattttcatatggt

SEQ ID NO: 9283279 - DNA, 22 bp, Homo sapiens
ttcttacagccctattactaaa

SEQ ID NO: 9283280 - DNA, 22 bp, Homo sapiens
ttcttacatattttcatatggt

SEQ ID NO: 9283281 - DNA, 22 bp, Homo sapiens
ttcttacagagtttacagagcc

SEQ ID NO: 9283282 - DNA, 22 bp, Homo sapiens
ttcttacagagtttacagagcc

SEQ ID NO: 9283283 - DNA, 22 bp, Homo sapiens
ttcttacagatttggtgaatga

SEQ ID NO: 9283284 - DNA, 22 bp, Homo sapiens
ttcttacagatttggtgaatga

SEQ ID NO: 9283285 - DNA, 22 bp, Homo sapiens
ttcttacagatttggtgaatga

SEQ ID NO: 9283286 - DNA, 22 bp, Homo sapiens
ttcttacagatttggtgaatga

SEQ ID NO: 9283287 - DNA, 22 bp, Homo sapiens
ttctgttacttgcaaccacagg

SEQ ID NO: 9283288 - DNA, 22 bp, Homo sapiens
ttctgtttataatttgcagttg

SEQ ID NO: 9283289 - DNA, 22 bp, Homo sapiens
ttctgtttcctgccttcccatt

SEQ ID NO: 9283290 - DNA, 22 bp, Homo sapiens
ttctgtttataatttgcagttg

SEQ ID NO: 9283291 - DNA, 22 bp, Homo sapiens
ttctgttctttatttaccatat

SEQ ID NO: 9283292 - DNA, 22 bp, Homo sapiens
ttcttacactcttaaaaatcat

SEQ ID NO: 9283293 - DNA, 22 bp, Homo sapiens
ttcttaaaacttatggacaggt

SEQ ID NO: 9283294 - DNA, 22 bp, Homo sapiens
ttcttacaagtattccaggtcc

SEQ ID NO: 9283295 - DNA, 22 bp, Homo sapiens
ttcttacaagtattccaggtcc

SEQ ID NO: 9283296 - DNA, 22 bp, Homo sapiens
ttcttaaaacttatggacaggt

SEQ ID NO: 9283297 - DNA, 22 bp, Homo sapiens
ttctgtttgccatatatagtag

SEQ ID NO: 9283298 - DNA, 22 bp, Homo sapiens
ttctgtttctggggtctctgac

SEQ ID NO: 9283299 - DNA, 22 bp, Homo sapiens
ttctgtttctggggtctctgac

SEQ ID NO: 9283300 - DNA, 22 bp, Homo sapiens
ttctgttttagaaataagtagt

SEQ ID NO: 9283301 - DNA, 22 bp, Homo sapiens
ttctgtttgtgaactggctgag

SEQ ID NO: 9283302 - DNA, 22 bp, Homo sapiens
ttctgttttagaaataagtagt

SEQ ID NO: 9283303 - DNA, 23 bp, Homo sapiens
ttctgggctgtggaagcctcggg

SEQ ID NO: 9283304 - DNA, 22 bp, Homo sapiens
ttctgggcctcctaggacaggc

SEQ ID NO: 9283305 - DNA, 22 bp, Homo sapiens
ttctgggcccactgtagcatcc

SEQ ID NO: 9283306 - DNA, 22 bp, Homo sapiens
ttctggtaccgtgtcagaaacc

SEQ ID NO: 9283307 - DNA, 19 bp, Homo sapiens
ttctggtctggaatcaagg

SEQ ID NO: 9283308 - DNA, 22 bp, Homo sapiens
ttctgggggaatacagctatga

SEQ ID NO: 9283309 - DNA, 22 bp, Homo sapiens
ttctgagagagcctctcatgtt

SEQ ID NO: 9283310 - DNA, 22 bp, Homo sapiens
ttctgacaattcagtaacagca

SEQ ID NO: 9283311 - DNA, 22 bp, Homo sapiens
ttctgacacattactacatgga

SEQ ID NO: 9283312 - DNA, 22 bp, Homo sapiens
ttctgacatatccagtctcagt

SEQ ID NO: 9283313 - DNA, 22 bp, Homo sapiens
ttctgagaatgcttctggaatc

SEQ ID NO: 9283314 - DNA, 22 bp, Homo sapiens
ttctgagaaggctgtggacaca

SEQ ID NO: 9283315 - DNA, 22 bp, Homo sapiens
ttctgacctcaggtgatccgtc

SEQ ID NO: 9283316 - DNA, 22 bp, Homo sapiens
ttctataaatgaatgtgtatat

SEQ ID NO: 9283317 - DNA, 22 bp, Homo sapiens
ttctataagactcatatttctt

SEQ ID NO: 9283318 - DNA, 22 bp, Homo sapiens
ttctcttttagaggctccatga

SEQ ID NO: 9283319 - DNA, 22 bp, Homo sapiens
ttctcttttagaggctccatga

SEQ ID NO: 9283320 - DNA, 22 bp, Homo sapiens
ttctcttttcaccagttgctaa

SEQ ID NO: 9283321 - DNA, 22 bp, Homo sapiens
ttctagtgtccttggacttgct

SEQ ID NO: 9283322 - DNA, 22 bp, Homo sapiens
ttctagttaatgtagcatcttg

SEQ ID NO: 9283323 - DNA, 22 bp, Homo sapiens
ttctagttaatgtagcatcttg

SEQ ID NO: 9283324 - DNA, 22 bp, Homo sapiens
ttctagttgagggagacaaata

SEQ ID NO: 9283325 - DNA, 22 bp, Homo sapiens
ttctagttcttaggaacagaca

SEQ ID NO: 9283326 - DNA, 22 bp, Homo sapiens
ttctagttgagggagacaaata

SEQ ID NO: 9283327 - DNA, 22 bp, Homo sapiens
ttctagttctgaaagcctgaca

SEQ ID NO: 9283328 - DNA, 22 bp, Homo sapiens
ttctagttatagaaaaagcatt

SEQ ID NO: 9283329 - DNA, 22 bp, Homo sapiens
ttctagttttcagtccaccagg

SEQ ID NO: 9283330 - DNA, 20 bp, Homo sapiens
ttctgcttgcaaatatcaag

SEQ ID NO: 9283331 - DNA, 22 bp, Homo sapiens
ttctgcttctgtgtgtcccagg

SEQ ID NO: 9283332 - DNA, 22 bp, Homo sapiens
ttctgcttttattgccagagtt

SEQ ID NO: 9283333 - DNA, 22 bp, Homo sapiens
ttctgcttttctctgtctgagt

SEQ ID NO: 9283334 - DNA, 22 bp, Homo sapiens
ttctgcttttctctgtctgagt

SEQ ID NO: 9283335 - DNA, 22 bp, Homo sapiens
ttctgctcttggctttgctggt

SEQ ID NO: 9283336 - DNA, 22 bp, Homo sapiens
ttctgctgaagtcactgggagc

SEQ ID NO: 9283337 - DNA, 22 bp, Homo sapiens
ttctgctctgacttgcaaggaa

SEQ ID NO: 9283338 - DNA, 22 bp, Homo sapiens
ttctgctcagtagtaagagtgc

SEQ ID NO: 9283339 - DNA, 17 bp, Homo sapiens
ttctgctgtcgtcctct

SEQ ID NO: 9283340 - DNA, 21 bp, Homo sapiens
ttctgctgtgccatgcctctg

SEQ ID NO: 9283341 - DNA, 22 bp, Homo sapiens
ttctgctggtaactatgtttca

SEQ ID NO: 9283342 - DNA, 19 bp, Homo sapiens
ttctgctgttcctaggctg

SEQ ID NO: 9283343 - DNA, 21 bp, Homo sapiens
ttctgctgtgccatgcctctg

SEQ ID NO: 9283344 - DNA, 21 bp, Homo sapiens
ttctgccttcccctagctggg

SEQ ID NO: 9283345 - DNA, 22 bp, Homo sapiens
ttctgccttacgatattttcaa

SEQ ID NO: 9283346 - DNA, 22 bp, Homo sapiens
ttctgccttcagtcctctgact

SEQ ID NO: 9283347 - DNA, 22 bp, Homo sapiens
ttctgccttcagtcctctgact

SEQ ID NO: 9283348 - DNA, 22 bp, Homo sapiens
ttcctgttgtgttagagtcaat

SEQ ID NO: 9283349 - DNA, 22 bp, Homo sapiens
ttccttaatgaatcaggccatt

SEQ ID NO: 9283350 - DNA, 22 bp, Homo sapiens
ttcctgttcaggaaagttgtgt

SEQ ID NO: 9283351 - DNA, 22 bp, Homo sapiens
ttcctgttcaggaaagttgtgt

SEQ ID NO: 9283352 - DNA, 22 bp, Homo sapiens
ttcctgttagccattattagct

SEQ ID NO: 9283353 - DNA, 22 bp, Homo sapiens
ttcctgtgtgttggtggcagaa

SEQ ID NO: 9283354 - DNA, 22 bp, Homo sapiens
ttccttagatccttcaatcacg

SEQ ID NO: 9283355 - DNA, 22 bp, Homo sapiens
ttccttctagagcttgtttagg

SEQ ID NO: 9283356 - DNA, 22 bp, Homo sapiens
ttccttctagcccaagtattgg

SEQ ID NO: 9283357 - DNA, 22 bp, Homo sapiens
ttccttctagagcttgtttagg

SEQ ID NO: 9283358 - DNA, 22 bp, Homo sapiens
ttccttctagagcttgtttagg

SEQ ID NO: 9283359 - DNA, 18 bp, Homo sapiens
ttccttctgatgtatatg

SEQ ID NO: 9283360 - DNA, 22 bp, Homo sapiens
ttccttctgaagcctttgtgtt

SEQ ID NO: 9283361 - DNA, 22 bp, Homo sapiens
ttccttctgaagcctttgtgtt

SEQ ID NO: 9283362 - DNA, 22 bp, Homo sapiens
ttccttctgaagcctttgtgtt

SEQ ID NO: 9283363 - DNA, 22 bp, Homo sapiens
ttccttctcagccctcgaggat

SEQ ID NO: 9283364 - DNA, 22 bp, Homo sapiens
ttccttctcagccctcgaggat

SEQ ID NO: 9283365 - DNA, 22 bp, Homo sapiens
ttccttctattcagctccaaga

SEQ ID NO: 9283366 - DNA, 22 bp, Homo sapiens
ttccttctagcccaagtattgg

SEQ ID NO: 9283367 - DNA, 22 bp, Homo sapiens
ttccttctattcagctccaaga

SEQ ID NO: 9283368 - DNA, 22 bp, Homo sapiens
ttccttctccagaacttctagg

SEQ ID NO: 9283369 - DNA, 22 bp, Homo sapiens
ttccttctccagaacttctagg

SEQ ID NO: 9283370 - DNA, 22 bp, Homo sapiens
ttccttctccagaacttctagg

SEQ ID NO: 9283371 - DNA, 22 bp, Homo sapiens
ttccttctctgtggggaaggca

SEQ ID NO: 9283372 - DNA, 22 bp, Homo sapiens
ttcctgtggccttacatctgtg

SEQ ID NO: 9283373 - DNA, 22 bp, Homo sapiens
ttcctgtggccttacatctgtg

SEQ ID NO: 9283374 - DNA, 22 bp, Homo sapiens
ttcctgtgcttaattctcactg

SEQ ID NO: 9283375 - DNA, 20 bp, Homo sapiens
ttcctgtcctctctttcagg

SEQ ID NO: 9283376 - DNA, 22 bp, Homo sapiens
ttcctgaagtcaaagatctaaa

SEQ ID NO: 9283377 - DNA, 22 bp, Homo sapiens
ttcctgaaaatacagggagaga

SEQ ID NO: 9283378 - DNA, 22 bp, Homo sapiens
ttcctcttccatcttcccaggg

SEQ ID NO: 9283379 - DNA, 22 bp, Homo sapiens
ttcctgaaaatacagggagacc

SEQ ID NO: 9283380 - DNA, 22 bp, Homo sapiens
ttcctgaaaatacagggagaga

SEQ ID NO: 9283381 - DNA, 22 bp, Homo sapiens
ttcctgaaaatacagggagacc

SEQ ID NO: 9283382 - DNA, 22 bp, Homo sapiens
ttctaatcctgactcagctgct

SEQ ID NO: 9283383 - DNA, 22 bp, Homo sapiens
ttctaattgtgtttgcatatct

SEQ ID NO: 9283384 - DNA, 22 bp, Homo sapiens
ttctaattgtgtttgcatatct

SEQ ID NO: 9283385 - DNA, 22 bp, Homo sapiens
ttctaattattcccttgtccca

SEQ ID NO: 9283386 - DNA, 21 bp, Homo sapiens
ttctagaaaagtatgggactg

SEQ ID NO: 9283387 - DNA, 22 bp, Homo sapiens
ttctagggaatgggatgaggat

SEQ ID NO: 9283388 - DNA, 22 bp, Homo sapiens
ttctagcagagggcatctgctg

SEQ ID NO: 9283389 - DNA, 22 bp, Homo sapiens
ttctagaggggagatactagta

SEQ ID NO: 9283390 - DNA, 22 bp, Homo sapiens
ttctagagccagggcagctgca

SEQ ID NO: 9283391 - DNA, 22 bp, Homo sapiens
ttctagatagagtgcaaattat

SEQ ID NO: 9283392 - DNA, 21 bp, Homo sapiens
ttccacagtgagaactgcaag

SEQ ID NO: 9283393 - DNA, 22 bp, Homo sapiens
ttccacagatgtatgaagtggt

SEQ ID NO: 9283394 - DNA, 22 bp, Homo sapiens
ttccacagcccaagctggtggc

SEQ ID NO: 9283395 - DNA, 22 bp, Homo sapiens
ttccacaggactaaatgtcatc

SEQ ID NO: 9283396 - DNA, 22 bp, Homo sapiens
ttccacagtcatcctgggaatt

SEQ ID NO: 9283397 - DNA, 23 bp, Homo sapiens
ttccacaatgaaaataaagcagg

SEQ ID NO: 9283398 - DNA, 22 bp, Homo sapiens
ttcctaatgtctactttagttc

SEQ ID NO: 9283399 - DNA, 22 bp, Homo sapiens
ttcctaatcacgaacattattt

SEQ ID NO: 9283400 - DNA, 22 bp, Homo sapiens
ttcctaatggcaaaacatgttt

SEQ ID NO: 9283401 - DNA, 22 bp, Homo sapiens
ttcctaacacagtgtaagcaag

SEQ ID NO: 9283402 - DNA, 22 bp, Homo sapiens
ttcctaacgccagtattttcat

SEQ ID NO: 9283403 - DNA, 22 bp, Homo sapiens
ttcctaacctctagctgcatat

SEQ ID NO: 9283404 - DNA, 22 bp, Homo sapiens
ttcctaactctggcacctagtc

SEQ ID NO: 9283405 - DNA, 22 bp, Homo sapiens
ttcctaactggcctttatggat

SEQ ID NO: 9283406 - DNA, 22 bp, Homo sapiens
ttccctggcatgagtgtaagat

SEQ ID NO: 9283407 - DNA, 22 bp, Homo sapiens
ttccctggaaagccatgcagtc

SEQ ID NO: 9283408 - DNA, 22 bp, Homo sapiens
ttccctggggaaggtgaccttt

SEQ ID NO: 9283409 - DNA, 22 bp, Homo sapiens
ttcctaacaaggggtattcatc

SEQ ID NO: 9283410 - DNA, 22 bp, Homo sapiens
ttcctaacaagtctatctttga

SEQ ID NO: 9283411 - DNA, 22 bp, Homo sapiens
ttccagagcagttttcagatca

SEQ ID NO: 9283412 - DNA, 22 bp, Homo sapiens
ttccagagaggctcatgttccc

SEQ ID NO: 9283413 - DNA, 22 bp, Homo sapiens
ttcctagctataaagctcttcc

SEQ ID NO: 9283414 - DNA, 22 bp, Homo sapiens
ttcctagaatggttagaaaata

SEQ ID NO: 9283415 - DNA, 22 bp, Homo sapiens
ttcctagggcagagccgctggg

SEQ ID NO: 9283416 - DNA, 22 bp, Homo sapiens
ttcctatgaataaatattgagc

SEQ ID NO: 9283417 - DNA, 19 bp, Homo sapiens
ttcctagtagactgtgtgt

SEQ ID NO: 9283418 - DNA, 22 bp, Homo sapiens
ttcctcacactcccccattcga

SEQ ID NO: 9283419 - DNA, 22 bp, Homo sapiens
ttcctcagccaaggctgggatc

SEQ ID NO: 9283420 - DNA, 22 bp, Homo sapiens
ttcctcagccaaggctgggatc

SEQ ID NO: 9283421 - DNA, 22 bp, Homo sapiens
ttcctcagccagcacttagggg

SEQ ID NO: 9283422 - DNA, 22 bp, Homo sapiens
ttcctcagccagcacttagggg

SEQ ID NO: 9283423 - DNA, 22 bp, Homo sapiens
ttcctcagaccctcattgtgag

SEQ ID NO: 9283424 - DNA, 22 bp, Homo sapiens
ttcctcagaccctcattgtgag

SEQ ID NO: 9283425 - DNA, 22 bp, Homo sapiens
ttcctcagaaaatactgtccaa

SEQ ID NO: 9283426 - DNA, 22 bp, Homo sapiens
ttcctcagagggcgctggggaa

SEQ ID NO: 9283427 - DNA, 22 bp, Homo sapiens
ttcctcagagggcgctggggaa

SEQ ID NO: 9283428 - DNA, 20 bp, Homo sapiens
ttcctcaggagaggatgtta

SEQ ID NO: 9283429 - DNA, 22 bp, Homo sapiens
ttcctcaggctgctttcacata

SEQ ID NO: 9283430 - DNA, 22 bp, Homo sapiens
ttcctcagctggcctgattggg

SEQ ID NO: 9283431 - DNA, 22 bp, Homo sapiens
ttcctcagggcggatgggcagg

SEQ ID NO: 9283432 - DNA, 22 bp, Homo sapiens
ttcctcagttagtgcctgaggc

SEQ ID NO: 9283433 - DNA, 22 bp, Homo sapiens
ttcctcaggcttccctttgtcc

SEQ ID NO: 9283434 - DNA, 22 bp, Homo sapiens
ttcctcaggcttccctttgtcc

SEQ ID NO: 9283435 - DNA, 22 bp, Homo sapiens
ttcctctgtagttgctgatgaa

SEQ ID NO: 9283436 - DNA, 22 bp, Homo sapiens
ttcctctgtatgctttgctgct

SEQ ID NO: 9283437 - DNA, 22 bp, Homo sapiens
ttcctctgtagttgctgatgaa

SEQ ID NO: 9283438 - DNA, 22 bp, Homo sapiens
ttcctccagcctggagcacttc

SEQ ID NO: 9283439 - DNA, 22 bp, Homo sapiens
ttcctcatggggttccttcaga

SEQ ID NO: 9283440 - DNA, 22 bp, Homo sapiens
ttcctccacgtgacaggagcca

SEQ ID NO: 9283441 - DNA, 22 bp, Homo sapiens
ttcctcatctgtgcacctcact

SEQ ID NO: 9283442 - DNA, 22 bp, Homo sapiens
ttcctcatggggttccttcaga

SEQ ID NO: 9283443 - DNA, 22 bp, Homo sapiens
ttcctcatggggttccttcaga

SEQ ID NO: 9283444 - DNA, 22 bp, Homo sapiens
ttagagttgagtttctatgaga

SEQ ID NO: 9283445 - DNA, 22 bp, Homo sapiens
ttagagttcagcatgactttga

SEQ ID NO: 9283446 - DNA, 22 bp, Homo sapiens
ttagagttaggatttgtcttta

SEQ ID NO: 9283447 - DNA, 22 bp, Homo sapiens
ttagaggtgtcaggagcacagg

SEQ ID NO: 9283448 - DNA, 23 bp, Homo sapiens
ttcaaagcttaagctctttccac

SEQ ID NO: 9283449 - DNA, 22 bp, Homo sapiens
ttagataaagtgatgtaggcta

SEQ ID NO: 9283450 - DNA, 22 bp, Homo sapiens
ttagagttttctgttcctctaa

SEQ ID NO: 9283451 - DNA, 22 bp, Homo sapiens
ttcaacaagtagtacacacagt

SEQ ID NO: 9283452 - DNA, 22 bp, Homo sapiens
ttcaacaaggctgtcaaaagtt

SEQ ID NO: 9283453 - DNA, 17 bp, Homo sapiens
ttcaaagcttatcaagg

SEQ ID NO: 9283454 - DNA, 22 bp, Homo sapiens
ttcaacaaactgttcacgaatg

SEQ ID NO: 9283455 - DNA, 21 bp, Homo sapiens
ttcaacaaagggaataagttt

SEQ ID NO: 9283456 - DNA, 22 bp, Homo sapiens
ttcaacacaggaacatgatata

SEQ ID NO: 9283457 - DNA, 22 bp, Homo sapiens
ttcaacaatgcacttgagtata

SEQ ID NO: 9283458 - DNA, 22 bp, Homo sapiens
ttcaacaagtcttttttcactg

SEQ ID NO: 9283459 - DNA, 22 bp, Homo sapiens
ttcaacagcttccaaagtgtgt

SEQ ID NO: 9283460 - DNA, 22 bp, Homo sapiens
ttcaacatcttggagctggaac

SEQ ID NO: 9283461 - DNA, 22 bp, Homo sapiens
ttcaacatgcaaacatgtttgt

SEQ ID NO: 9283462 - DNA, 22 bp, Homo sapiens
ttcaacatgctttatttctaaa

SEQ ID NO: 9283463 - DNA, 22 bp, Homo sapiens
ttcaactgggcggatctgagaa

SEQ ID NO: 9283464 - DNA, 22 bp, Homo sapiens
ttcaacatgttctacataaggg

SEQ ID NO: 9283465 - DNA, 22 bp, Homo sapiens
ttcaacatttgaaatgaatgaa

SEQ ID NO: 9283466 - DNA, 22 bp, Homo sapiens
ttcaacatttgatacaagtcag

SEQ ID NO: 9283467 - DNA, 22 bp, Homo sapiens
ttcaacatttatcagtttatca

SEQ ID NO: 9283468 - DNA, 22 bp, Homo sapiens
ttcacagtgctgcacctggctt

SEQ ID NO: 9283469 - DNA, 22 bp, Homo sapiens
ttcacaggtgagcattaggccg

SEQ ID NO: 9283470 - DNA, 22 bp, Homo sapiens
ttcacagtcacccttctccatg

SEQ ID NO: 9283471 - DNA, 22 bp, Homo sapiens
ttcacaatagctggcatcatct

SEQ ID NO: 9283472 - DNA, 22 bp, Homo sapiens
ttcacaataggagcatgcaaat

SEQ ID NO: 9283473 - DNA, 22 bp, Homo sapiens
ttcacaagtgtgaaggcagagc

SEQ ID NO: 9283474 - DNA, 18 bp, Homo sapiens
ttcacaagggcttggttt

SEQ ID NO: 9283475 - DNA, 22 bp, Homo sapiens
ttcacaagtcattagctgcata

SEQ ID NO: 9283476 - DNA, 22 bp, Homo sapiens
ttcacaaagctggagcatttcc

SEQ ID NO: 9283477 - DNA, 22 bp, Homo sapiens
ttcacaaagctggagcatttcc

SEQ ID NO: 9283478 - DNA, 22 bp, Homo sapiens
ttcaagaagcccaaagactagc

SEQ ID NO: 9283479 - DNA, 22 bp, Homo sapiens
ttcaatgatttttagggatcat

SEQ ID NO: 9283480 - DNA, 22 bp, Homo sapiens
ttcaagaaagagtggctattcc

SEQ ID NO: 9283481 - DNA, 22 bp, Homo sapiens
ttcaatgtctatgtacatttta

SEQ ID NO: 9283482 - DNA, 22 bp, Homo sapiens
ttcaatgcatatagatatagaa

SEQ ID NO: 9283483 - DNA, 22 bp, Homo sapiens
ttcaatttagtgatgttgttgg

SEQ ID NO: 9283484 - DNA, 22 bp, Homo sapiens
ttcaattcaattctaaatatat

SEQ ID NO: 9283485 - DNA, 22 bp, Homo sapiens
ttcaattctgatgaaggcaata

SEQ ID NO: 9283486 - DNA, 22 bp, Homo sapiens
ttcaattctaaactaatattct

SEQ ID NO: 9283487 - DNA, 22 bp, Homo sapiens
ttcaattctaaactaatattct

SEQ ID NO: 9283488 - DNA, 22 bp, Homo sapiens
ttcaatgtggttataataacta

SEQ ID NO: 9283489 - DNA, 22 bp, Homo sapiens
ttcaattttgcagaggaatgca

SEQ ID NO: 9283490 - DNA, 22 bp, Homo sapiens
ttcaattttgcagaggaatgca

SEQ ID NO: 9283491 - DNA, 22 bp, Homo sapiens
ttcaatttgtgctaaggcaccg

SEQ ID NO: 9283492 - DNA, 22 bp, Homo sapiens
ttcacaaaaatgctgaacagtt

SEQ ID NO: 9283493 - DNA, 22 bp, Homo sapiens
ttcaatttagtgatgttgttgg

SEQ ID NO: 9283494 - DNA, 22 bp, Homo sapiens
ttcaatttcataatatctagct

SEQ ID NO: 9283495 - DNA, 22 bp, Homo sapiens
ttcaatttcataatatctagct

SEQ ID NO: 9283496 - DNA, 22 bp, Homo sapiens
ttcacaaacaccagaatggcta

SEQ ID NO: 9283497 - DNA, 22 bp, Homo sapiens
ttcacaaaaatgctgaacagtt

SEQ ID NO: 9283498 - DNA, 22 bp, Homo sapiens
ttcatggcaggagtcagaagct

SEQ ID NO: 9283499 - DNA, 22 bp, Homo sapiens
ttcatggatcatgccttttgtg

SEQ ID NO: 9283500 - DNA, 22 bp, Homo sapiens
ttcatgcttttaccgctgttaa

SEQ ID NO: 9283501 - DNA, 20 bp, Homo sapiens
ttcatgctggaggggctggc

SEQ ID NO: 9283502 - DNA, 23 bp, Homo sapiens
ttcatgtggacctagaggcctgt

SEQ ID NO: 9283503 - DNA, 22 bp, Homo sapiens
ttcatgtgtatggaacattttt

SEQ ID NO: 9283504 - DNA, 20 bp, Homo sapiens
ttcatgggagcaaagaggcc

SEQ ID NO: 9283505 - DNA, 20 bp, Homo sapiens
ttcatggtgtatttctttct

SEQ ID NO: 9283506 - DNA, 22 bp, Homo sapiens
ttcatgtaccgtgtaccaggca

SEQ ID NO: 9283507 - DNA, 22 bp, Homo sapiens
ttcatgtaggctgcaatgcaca

SEQ ID NO: 9283508 - DNA, 22 bp, Homo sapiens
ttcatgtctgccttttcaagtg

SEQ ID NO: 9283509 - DNA, 22 bp, Homo sapiens
ttcacagtggccctctctgagt

SEQ ID NO: 9283510 - DNA, 22 bp, Homo sapiens
ttcacattagccaagagatgga

SEQ ID NO: 9283511 - DNA, 22 bp, Homo sapiens
ttcacagtggctgacaggctgg

SEQ ID NO: 9283512 - DNA, 22 bp, Homo sapiens
ttcacattagtggttctatata

SEQ ID NO: 9283513 - DNA, 22 bp, Homo sapiens
ttcacattataatcagttctgc

SEQ ID NO: 9283514 - DNA, 22 bp, Homo sapiens
ttcacattcagaaaaagcccgt

SEQ ID NO: 9283515 - DNA, 22 bp, Homo sapiens
ttcagtaaggataataaacaga

SEQ ID NO: 9283516 - DNA, 22 bp, Homo sapiens
ttcagtataaaatcaaagtgat

SEQ ID NO: 9283517 - DNA, 22 bp, Homo sapiens
ttcagtatctgcaaaatgggga

SEQ ID NO: 9283518 - DNA, 22 bp, Homo sapiens
ttcagtatgtagaacaagtgtt

SEQ ID NO: 9283519 - DNA, 22 bp, Homo sapiens
ttcagtatgattcctccagtag

SEQ ID NO: 9283520 - DNA, 22 bp, Homo sapiens
ttcagtcccttgcttaaattta

SEQ ID NO: 9283521 - DNA, 22 bp, Homo sapiens
ttcagtatttgaaaccataggc

SEQ ID NO: 9283522 - DNA, 22 bp, Homo sapiens
ttcagtaaaacactgcaatgtc

SEQ ID NO: 9283523 - DNA, 21 bp, Homo sapiens
ttcaggtgagatcatgttgac

SEQ ID NO: 9283524 - DNA, 22 bp, Homo sapiens
ttaaatgagatgttcagatatt

SEQ ID NO: 9283525 - DNA, 22 bp, Homo sapiens
ttaaatgaggctgatgtagatt

SEQ ID NO: 9283526 - DNA, 22 bp, Homo sapiens
ttaaatgaggctgatgtagatt

SEQ ID NO: 9283527 - DNA, 22 bp, Homo sapiens
ttaaatgagatgttcagatatt

SEQ ID NO: 9283528 - DNA, 22 bp, Homo sapiens
ttaaatgaggctgatgtagatt

SEQ ID NO: 9283529 - DNA, 22 bp, Homo sapiens
ttaaatgatgcatatcatttag

SEQ ID NO: 9283530 - DNA, 22 bp, Homo sapiens
ttaaatgatgcatatcatttag

SEQ ID NO: 9283531 - DNA, 22 bp, Homo sapiens
ttaaatgatgcatatcatttag

SEQ ID NO: 9283532 - DNA, 22 bp, Homo sapiens
ttaaatgaacgagatatgcaac

SEQ ID NO: 9283533 - DNA, 22 bp, Homo sapiens
ttaaatctgttctcatgtctgt

SEQ ID NO: 9283534 - DNA, 22 bp, Homo sapiens
ttaaatattttcagcagggtca

SEQ ID NO: 9283535 - DNA, 22 bp, Homo sapiens
ttaaatattttcagcagggtca

SEQ ID NO: 9283536 - DNA, 22 bp, Homo sapiens
ttaaatgacttttattattctc

SEQ ID NO: 9283537 - DNA, 22 bp, Homo sapiens
ttaaatgaacgagatatgcaac

SEQ ID NO: 9283538 - DNA, 22 bp, Homo sapiens
ttaaatgacgggactgggtttt

SEQ ID NO: 9283539 - DNA, 22 bp, Homo sapiens
ttaacaatagagtttcttcagg

SEQ ID NO: 9283540 - DNA, 22 bp, Homo sapiens
ttaacacagggggagacaaagt

SEQ ID NO: 9283541 - DNA, 22 bp, Homo sapiens
ttaacaaagctctgttcctttt

SEQ ID NO: 9283542 - DNA, 22 bp, Homo sapiens
ttaacaaagtaacgggaaaaga

SEQ ID NO: 9283543 - DNA, 22 bp, Homo sapiens
ttaacaaggtgactgcattaaa

SEQ ID NO: 9283544 - DNA, 22 bp, Homo sapiens
ttaacaaatatttcccatgccc

SEQ ID NO: 9283545 - DNA, 22 bp, Homo sapiens
ttaaattaggactctagttctg

SEQ ID NO: 9283546 - DNA, 22 bp, Homo sapiens
ttaacaaaaatatcaggcatca

SEQ ID NO: 9283547 - DNA, 22 bp, Homo sapiens
ttaacaaaaatatcaggcatca

SEQ ID NO: 9283548 - DNA, 22 bp, Homo sapiens
ttaacaaaaatatcaggcatca

SEQ ID NO: 9283549 - DNA, 22 bp, Homo sapiens
ttaacaaaaatatcaggcatca

SEQ ID NO: 9283550 - DNA, 22 bp, Homo sapiens
ttaacaaaaatatcaggcatca

SEQ ID NO: 9283551 - DNA, 22 bp, Homo sapiens
ttaaattaggactctagttctg

SEQ ID NO: 9283552 - DNA, 22 bp, Homo sapiens
ttaaattaggactctagttctg

SEQ ID NO: 9283553 - DNA, 22 bp, Homo sapiens
ttaaattaggactctagttctg

SEQ ID NO: 9283554 - DNA, 22 bp, Homo sapiens
ttaaatgtgatttcatttatgt

SEQ ID NO: 9283555 - DNA, 22 bp, Homo sapiens
ttaaatgtgcctaaacctgtaa

SEQ ID NO: 9283556 - DNA, 22 bp, Homo sapiens
tgttttctgtgtagagatcaca

SEQ ID NO: 9283557 - DNA, 22 bp, Homo sapiens
tgttttctgtgtagagatcaca

SEQ ID NO: 9283558 - DNA, 22 bp, Homo sapiens
tgttttctgggtggaaggtact

SEQ ID NO: 9283559 - DNA, 22 bp, Homo sapiens
tgttttctgggtggaaggtact

SEQ ID NO: 9283560 - DNA, 22 bp, Homo sapiens
tgttttcttcctaattgctcat

SEQ ID NO: 9283561 - DNA, 22 bp, Homo sapiens
tgttttcttcctaattgctcat

SEQ ID NO: 9283562 - DNA, 22 bp, Homo sapiens
tgttttcttctgtaccgtgcca

SEQ ID NO: 9283563 - DNA, 22 bp, Homo sapiens
tgttttcttctgtaccgtgcca

SEQ ID NO: 9283564 - DNA, 17 bp, Homo sapiens
tgttttctgctaccttt

SEQ ID NO: 9283565 - DNA, 17 bp, Homo sapiens
tgttttctgctaccttt

SEQ ID NO: 9283566 - DNA, 22 bp, Homo sapiens
tgttttctgattctcgtgtggt

SEQ ID NO: 9283567 - DNA, 17 bp, Homo sapiens
tgttttctgctaccttt

SEQ ID NO: 9283568 - DNA, 22 bp, Homo sapiens
tgttttctgattctcgtgtggt

SEQ ID NO: 9283569 - DNA, 22 bp, Homo sapiens
tgttttctgatggttaatgagt

SEQ ID NO: 9283570 - DNA, 22 bp, Homo sapiens
tgttttctgatggttaatgagt

SEQ ID NO: 9283571 - DNA, 22 bp, Homo sapiens
tgttttctgatggttaatgagt

SEQ ID NO: 9283572 - DNA, 22 bp, Homo sapiens
tgttttctgatggttaatgagt

SEQ ID NO: 9283573 - DNA, 22 bp, Homo sapiens
tgttttctgatggttaatgagt

SEQ ID NO: 9283574 - DNA, 22 bp, Homo sapiens
tgttttgtgcatttacaacatg

SEQ ID NO: 9283575 - DNA, 22 bp, Homo sapiens
tgttttgtccttttctatatac

SEQ ID NO: 9283576 - DNA, 22 bp, Homo sapiens
tgttttgtctaatctaaattct

SEQ ID NO: 9283577 - DNA, 22 bp, Homo sapiens
tgttttgtttatgagagcacag

SEQ ID NO: 9283578 - DNA, 19 bp, Homo sapiens
tgttttgttaaagcagtcc

SEQ ID NO: 9283579 - DNA, 19 bp, Homo sapiens
tgttttgttaaagcagtcc

SEQ ID NO: 9283580 - DNA, 19 bp, Homo sapiens
tgttttgttaaagcagtcc

SEQ ID NO: 9283581 - DNA, 22 bp, Homo sapiens
tgttttgtagctaatagctatt

SEQ ID NO: 9283582 - DNA, 22 bp, Homo sapiens
tgttttgcttctctgtttccca

SEQ ID NO: 9283583 - DNA, 23 bp, Homo sapiens
tgttttcttgtcctggtataatt

SEQ ID NO: 9283584 - DNA, 23 bp, Homo sapiens
tgttttcttgtcctggtataatt

SEQ ID NO: 9283585 - DNA, 22 bp, Homo sapiens
ttaaatattatgttgtctgcaa

SEQ ID NO: 9283586 - DNA, 22 bp, Homo sapiens
ttaaatattatgttgtctgcaa

SEQ ID NO: 9283587 - DNA, 22 bp, Homo sapiens
ttaaatattatgttgtctgcaa

SEQ ID NO: 9283588 - DNA, 22 bp, Homo sapiens
ttaaatattttcagcagggtca

SEQ ID NO: 9283589 - DNA, 22 bp, Homo sapiens
ttaaatattttcagcagggtca

SEQ ID NO: 9283590 - DNA, 22 bp, Homo sapiens
ttaaatattatgttgtctgcaa

SEQ ID NO: 9283591 - DNA, 22 bp, Homo sapiens
ttaaatattatgttgtctgcaa

SEQ ID NO: 9283592 - DNA, 22 bp, Homo sapiens
ttaaatagtcaaatcagtggca

SEQ ID NO: 9283593 - DNA, 22 bp, Homo sapiens
ttaaatattatgttgtctgcaa

SEQ ID NO: 9283594 - DNA, 22 bp, Homo sapiens
ttaaatattatgttgtctgcaa

SEQ ID NO: 9283595 - DNA, 22 bp, Homo sapiens
ttaaatattatgttgtctgcaa

SEQ ID NO: 9283596 - DNA, 22 bp, Homo sapiens
ttaaatagtaggtctattttgg

SEQ ID NO: 9283597 - DNA, 22 bp, Homo sapiens
ttaaatagtaggtctattttgg

SEQ ID NO: 9283598 - DNA, 22 bp, Homo sapiens
ttaaatagtaggtctattttgg

SEQ ID NO: 9283599 - DNA, 22 bp, Homo sapiens
ttaaagcatgttgcttaacagg

SEQ ID NO: 9283600 - DNA, 22 bp, Homo sapiens
ttaaagcatgctgcttttccat

SEQ ID NO: 9283601 - DNA, 22 bp, Homo sapiens
ttaaagcatcctgtcagtctgt

SEQ ID NO: 9283602 - DNA, 22 bp, Homo sapiens
ttaaagcatcacactattaatt

SEQ ID NO: 9283603 - DNA, 22 bp, Homo sapiens
tgtttttcaaatattgctctgt

SEQ ID NO: 9283604 - DNA, 22 bp, Homo sapiens
tgtttttcaaatattgctctgt

SEQ ID NO: 9283605 - DNA, 22 bp, Homo sapiens
tgttttgtttatgagagcacag

SEQ ID NO: 9283606 - DNA, 22 bp, Homo sapiens
tgtttttaaaatgtcctggtta

SEQ ID NO: 9283607 - DNA, 22 bp, Homo sapiens
tgtttttaaataatgatagaaa

SEQ ID NO: 9283608 - DNA, 22 bp, Homo sapiens
tgtttttaaataatgatagaaa

SEQ ID NO: 9283609 - DNA, 22 bp, Homo sapiens
ttaatttatacataatcacagg

SEQ ID NO: 9283610 - DNA, 22 bp, Homo sapiens
ttaatttatacataatcacagg

SEQ ID NO: 9283611 - DNA, 22 bp, Homo sapiens
ttaatttatacataatcacagg

SEQ ID NO: 9283612 - DNA, 22 bp, Homo sapiens
ttaatttatgtccaaaccagat

SEQ ID NO: 9283613 - DNA, 22 bp, Homo sapiens
ttaattgttggaaatagattat

SEQ ID NO: 9283614 - DNA, 22 bp, Homo sapiens
ttaatttaagaaacggcaggcc

SEQ ID NO: 9283615 - DNA, 22 bp, Homo sapiens
ttaatttaagaaacggcaggcc

SEQ ID NO: 9283616 - DNA, 22 bp, Homo sapiens
ttaatttatacataatcacagg

SEQ ID NO: 9283617 - DNA, 22 bp, Homo sapiens
ttaattgagccagaaagtatct

SEQ ID NO: 9283618 - DNA, 22 bp, Homo sapiens
ttaattctagtttaacacttag

SEQ ID NO: 9283619 - DNA, 22 bp, Homo sapiens
ttaattgatataaagaacttca

SEQ ID NO: 9283620 - DNA, 22 bp, Homo sapiens
ttaattactaagcacaatgcaa

SEQ ID NO: 9283621 - DNA, 22 bp, Homo sapiens
ttaattacaaaacacataggtt

SEQ ID NO: 9283622 - DNA, 22 bp, Homo sapiens
ttaattcagtcaaagaaaccat

SEQ ID NO: 9283623 - DNA, 22 bp, Homo sapiens
ttaattatgcaaaaggccccat

SEQ ID NO: 9283624 - DNA, 22 bp, Homo sapiens
ttaattatgagaaagggaaaag

SEQ ID NO: 9283625 - DNA, 22 bp, Homo sapiens
ttaattatgagaaagggaaaag

SEQ ID NO: 9283626 - DNA, 22 bp, Homo sapiens
ttaattaattagttaagcatgt

SEQ ID NO: 9283627 - DNA, 22 bp, Homo sapiens
ttaataaacaggtgcagctgaa

SEQ ID NO: 9283628 - DNA, 22 bp, Homo sapiens
ttaataaacaggtgcagctgaa

SEQ ID NO: 9283629 - DNA, 22 bp, Homo sapiens
ttaataaacaggtgcagctgaa

SEQ ID NO: 9283630 - DNA, 22 bp, Homo sapiens
ttaataaacaggtgcagctgaa

SEQ ID NO: 9283631 - DNA, 22 bp, Homo sapiens
ttaaggtgctttatttagctct

SEQ ID NO: 9283632 - DNA, 17 bp, Homo sapiens
ttaaggtggatcagcac

SEQ ID NO: 9283633 - DNA, 21 bp, Homo sapiens
ttaaggtcacttctgagccta

SEQ ID NO: 9283634 - DNA, 22 bp, Homo sapiens
ttaagtcaatatcaatctcagc

SEQ ID NO: 9283635 - DNA, 20 bp, Homo sapiens
ttaagaaaagcacatcctgc

SEQ ID NO: 9283636 - DNA, 22 bp, Homo sapiens
ttaagaatgtgccttttggttg

SEQ ID NO: 9283637 - DNA, 22 bp, Homo sapiens
ttaagacacatttctcagacgg

SEQ ID NO: 9283638 - DNA, 21 bp, Homo sapiens
ttaagacacacagattaagga

SEQ ID NO: 9283639 - DNA, 22 bp, Homo sapiens
ttaagaaggtactcaaagatct

SEQ ID NO: 9283640 - DNA, 22 bp, Homo sapiens
ttaagagatttaggaacattat

SEQ ID NO: 9283641 - DNA, 22 bp, Homo sapiens
ttaagagacaggagaatgatgt

SEQ ID NO: 9283642 - DNA, 22 bp, Homo sapiens
ttaagacttttcaaaggcaaac

SEQ ID NO: 9283643 - DNA, 22 bp, Homo sapiens
ttaagagaagagtatctagaac

SEQ ID NO: 9283644 - DNA, 23 bp, Homo sapiens
ttaagactggctgaacttagtag

SEQ ID NO: 9283645 - DNA, 22 bp, Homo sapiens
ttaagactattgtaatagggga

SEQ ID NO: 9283646 - DNA, 22 bp, Homo sapiens
ttaagactaaatgaggtcataa

SEQ ID NO: 9283647 - DNA, 22 bp, Homo sapiens
ttaagacatttttggagattat

SEQ ID NO: 9283648 - DNA, 22 bp, Homo sapiens
ttaagacattcagatatttcta

SEQ ID NO: 9283649 - DNA, 22 bp, Homo sapiens
ttaagacatgtgagcataactt

SEQ ID NO: 9283650 - DNA, 22 bp, Homo sapiens
ttaagacagtgtatttgttttc

SEQ ID NO: 9283651 - DNA, 22 bp, Homo sapiens
ttaacatacatcatgaacaatg

SEQ ID NO: 9283652 - DNA, 22 bp, Homo sapiens
ttaacatacatcatgaacaatg

SEQ ID NO: 9283653 - DNA, 22 bp, Homo sapiens
ttaacaggttatattgtacagg

SEQ ID NO: 9283654 - DNA, 22 bp, Homo sapiens
ttaacactatctgtcataatta

SEQ ID NO: 9283655 - DNA, 22 bp, Homo sapiens
ttaacacttgaactctacatgt

SEQ ID NO: 9283656 - DNA, 22 bp, Homo sapiens
ttaacgaattgtgcataattcc

SEQ ID NO: 9283657 - DNA, 22 bp, Homo sapiens
ttaacatgtcttgacttcatct

SEQ ID NO: 9283658 - DNA, 22 bp, Homo sapiens
ttaacattgtccttagcagatt

SEQ ID NO: 9283659 - DNA, 22 bp, Homo sapiens
ttaatttttatgtatagtgtgt

SEQ ID NO: 9283660 - DNA, 22 bp, Homo sapiens
ttaattttgatgaggttcagtt

SEQ ID NO: 9283661 - DNA, 22 bp, Homo sapiens
ttaattttaacctgtttgtgtc

SEQ ID NO: 9283662 - DNA, 22 bp, Homo sapiens
ttaattttaacctgtttgtgtc

SEQ ID NO: 9283663 - DNA, 22 bp, Homo sapiens
ttaattttctcatctgtgaaat

SEQ ID NO: 9283664 - DNA, 21 bp, Homo sapiens
ttaatttattcatgatagcta

SEQ ID NO: 9283665 - DNA, 21 bp, Homo sapiens
ttaatttattcatgatagcta

SEQ ID NO: 9283666 - DNA, 21 bp, Homo sapiens
ttacacactgcttctagaatg

SEQ ID NO: 9283667 - DNA, 22 bp, Homo sapiens
ttacacagaaacactgttcaga

SEQ ID NO: 9283668 - DNA, 22 bp, Homo sapiens
ttacacagaaacactgttcaga

SEQ ID NO: 9283669 - DNA, 17 bp, Homo sapiens
ttacacaggagagctct

SEQ ID NO: 9283670 - DNA, 17 bp, Homo sapiens
ttacacaggagagctct

SEQ ID NO: 9283671 - DNA, 22 bp, Homo sapiens
ttacacagatggttagtagagg

SEQ ID NO: 9283672 - DNA, 22 bp, Homo sapiens
ttacacagatggttagtagagg

SEQ ID NO: 9283673 - DNA, 18 bp, Homo sapiens
ttacactagccttggttc

SEQ ID NO: 9283674 - DNA, 22 bp, Homo sapiens
ttacactatgaatgagaatata

SEQ ID NO: 9283675 - DNA, 22 bp, Homo sapiens
ttacactaagctacttctatat

SEQ ID NO: 9283676 - DNA, 22 bp, Homo sapiens
ttacacattaacaggcagctaa

SEQ ID NO: 9283677 - DNA, 22 bp, Homo sapiens
ttacacatgctcacttatttgt

SEQ ID NO: 9283678 - DNA, 22 bp, Homo sapiens
ttacacagttggtaggggcaga

SEQ ID NO: 9283679 - DNA, 22 bp, Homo sapiens
ttacacagttggtaggggcaga

SEQ ID NO: 9283680 - DNA, 22 bp, Homo sapiens
ttacacagtggttaagtctggg

SEQ ID NO: 9283681 - DNA, 22 bp, Homo sapiens
ttacacagtgcacaagcagagt

SEQ ID NO: 9283682 - DNA, 22 bp, Homo sapiens
ttacacagtgcacaagcagagt

SEQ ID NO: 9283683 - DNA, 22 bp, Homo sapiens
ttacagtacagaaaataacaga

SEQ ID NO: 9283684 - DNA, 22 bp, Homo sapiens
ttacaggtgtggaaattgagta

SEQ ID NO: 9283685 - DNA, 22 bp, Homo sapiens
ttacaggttaagtgacacttaa

SEQ ID NO: 9283686 - DNA, 22 bp, Homo sapiens
ttacaggtgggaaaactaagct

SEQ ID NO: 9283687 - DNA, 22 bp, Homo sapiens
ttacaggttgtgtattcagtga

SEQ ID NO: 9283688 - DNA, 22 bp, Homo sapiens
ttacaggtgagaaaactgaggc

SEQ ID NO: 9283689 - DNA, 22 bp, Homo sapiens
ttacaggtgggaaaactaagct

SEQ ID NO: 9283690 - DNA, 22 bp, Homo sapiens
ttacaggtggagaagtaaggct

SEQ ID NO: 9283691 - DNA, 22 bp, Homo sapiens
ttacaggtctgtgtcatcatct

SEQ ID NO: 9283692 - DNA, 22 bp, Homo sapiens
ttacaggtcagtttgactgaat

SEQ ID NO: 9283693 - DNA, 21 bp, Homo sapiens
ttacaggtcatccaagtcacc

SEQ ID NO: 9283694 - DNA, 21 bp, Homo sapiens
ttacaggtaacacttcctttc

SEQ ID NO: 9283695 - DNA, 22 bp, Homo sapiens
ttacaggtacttgctgctgaaa

SEQ ID NO: 9283696 - DNA, 22 bp, Homo sapiens
ttacaggtattttattgagcag

SEQ ID NO: 9283697 - DNA, 22 bp, Homo sapiens
ttacacttgaaaacaggattta

SEQ ID NO: 9283698 - DNA, 22 bp, Homo sapiens
ttacatagttaaatagtacagc

SEQ ID NO: 9283699 - DNA, 22 bp, Homo sapiens
ttacagtcaggcatgaattcag

SEQ ID NO: 9283700 - DNA, 22 bp, Homo sapiens
ttacagtctggattaggaaaca

SEQ ID NO: 9283701 - DNA, 17 bp, Homo sapiens
ttacatccttctgaatt

SEQ ID NO: 9283702 - DNA, 22 bp, Homo sapiens
ttacatctaaactgtgaacaat

SEQ ID NO: 9283703 - DNA, 22 bp, Homo sapiens
ttacatcattgagacatacata

SEQ ID NO: 9283704 - DNA, 22 bp, Homo sapiens
ttacatcatgtaactggatata

SEQ ID NO: 9283705 - DNA, 22 bp, Homo sapiens
ttacatcatggagggtattgaa

SEQ ID NO: 9283706 - DNA, 22 bp, Homo sapiens
ttacatcattgagacatacata

SEQ ID NO: 9283707 - DNA, 22 bp, Homo sapiens
ttacattttggggtaaggataa

SEQ ID NO: 9283708 - DNA, 19 bp, Homo sapiens
ttacatctgcaacactggt

SEQ ID NO: 9283709 - DNA, 22 bp, Homo sapiens
ttacatattatccaaaactgct

SEQ ID NO: 9283710 - DNA, 22 bp, Homo sapiens
ttacatattatccaaaactgct

SEQ ID NO: 9283711 - DNA, 22 bp, Homo sapiens
ttacatcatgcttatccctttc

SEQ ID NO: 9283712 - DNA, 22 bp, Homo sapiens
ttacatcagcaagagtgtatgt

SEQ ID NO: 9283713 - DNA, 22 bp, Homo sapiens
ttacatcagaaggaaacagcgt

SEQ ID NO: 9283714 - DNA, 22 bp, Homo sapiens
ttacatcagaatcacccaggaa

SEQ ID NO: 9283715 - DNA, 22 bp, Homo sapiens
ttacatcagaaggaaacagcgt

SEQ ID NO: 9283716 - DNA, 22 bp, Homo sapiens
ttacatcactttacttaataat

SEQ ID NO: 9283717 - DNA, 22 bp, Homo sapiens
ttacatcactttacttaataat

SEQ ID NO: 9283718 - DNA, 20 bp, Homo sapiens
ttactcagttcctgccatgc

SEQ ID NO: 9283719 - DNA, 22 bp, Homo sapiens
ttactcagtctcccatacattg

SEQ ID NO: 9283720 - DNA, 22 bp, Homo sapiens
ttactaggccagttttcacttt

SEQ ID NO: 9283721 - DNA, 22 bp, Homo sapiens
ttactgaaaattcttcaggatt

SEQ ID NO: 9283722 - DNA, 22 bp, Homo sapiens
ttactctgaatgtttctactga

SEQ ID NO: 9283723 - DNA, 22 bp, Homo sapiens
ttacattttggggtaaggataa

SEQ ID NO: 9283724 - DNA, 22 bp, Homo sapiens
ttaccaaatgaaatagagattt

SEQ ID NO: 9283725 - DNA, 22 bp, Homo sapiens
ttactgtagcttgacatatgtc

SEQ ID NO: 9283726 - DNA, 22 bp, Homo sapiens
ttactgtagcttgacatatgtc

SEQ ID NO: 9283727 - DNA, 22 bp, Homo sapiens
ttactgtagaagagaatgattc

SEQ ID NO: 9283728 - DNA, 22 bp, Homo sapiens
ttacttgaaatgtgataagaga

SEQ ID NO: 9283729 - DNA, 22 bp, Homo sapiens
ttacttgaaaggaaattaaggt

SEQ ID NO: 9283730 - DNA, 22 bp, Homo sapiens
ttacttgatgatgtataaagtc

SEQ ID NO: 9283731 - DNA, 22 bp, Homo sapiens
ttacttgatttgaaaatcatag

SEQ ID NO: 9283732 - DNA, 22 bp, Homo sapiens
ttactttaagggtgtcttatta

SEQ ID NO: 9283733 - DNA, 22 bp, Homo sapiens
ttactttaagggtgtcttatta

SEQ ID NO: 9283734 - DNA, 22 bp, Homo sapiens
ttactttaagggtgtcttatta

SEQ ID NO: 9283735 - DNA, 22 bp, Homo sapiens
ttactttagaaatagtcatcaa

SEQ ID NO: 9283736 - DNA, 21 bp, Homo sapiens
ttactttagaaattgcctttt

SEQ ID NO: 9283737 - DNA, 22 bp, Homo sapiens
ttactttagggatgttttgctt

SEQ ID NO: 9283738 - DNA, 22 bp, Homo sapiens
ttactttagatcatactgtgtg

SEQ ID NO: 9283739 - DNA, 22 bp, Homo sapiens
ttactttagatcatactgtgtg

SEQ ID NO: 9283740 - DNA, 22 bp, Homo sapiens
ttactgtttgaaaaatgaatgt

SEQ ID NO: 9283741 - DNA, 22 bp, Homo sapiens
ttactgttggtgtatccatagc

SEQ ID NO: 9283742 - DNA, 22 bp, Homo sapiens
ttactgttcatgttgtacactt

SEQ ID NO: 9283743 - DNA, 22 bp, Homo sapiens
ttacttacagacagtagactct

SEQ ID NO: 9283744 - DNA, 22 bp, Homo sapiens
ttacttaaaaattctaagcccc

SEQ ID NO: 9283745 - DNA, 22 bp, Homo sapiens
ttactgttttggtacctcattg

SEQ ID NO: 9283746 - DNA, 22 bp, Homo sapiens
ttacttgaaaaccaccagtatt

SEQ ID NO: 9283747 - DNA, 19 bp, Homo sapiens
ttacttcaggagtgaaatt

SEQ ID NO: 9283748 - DNA, 22 bp, Homo sapiens
ttagaaagaactttagatatca

SEQ ID NO: 9283749 - DNA, 22 bp, Homo sapiens
ttactttggatggtcaagaaag

SEQ ID NO: 9283750 - DNA, 22 bp, Homo sapiens
ttactttgatgatcaatgagcg

SEQ ID NO: 9283751 - DNA, 22 bp, Homo sapiens
ttactttatgtgatggattagt

SEQ ID NO: 9283752 - DNA, 22 bp, Homo sapiens
ttactttatgtgatggattagt

SEQ ID NO: 9283753 - DNA, 22 bp, Homo sapiens
ttactttagggatgttttgctt

SEQ ID NO: 9283754 - DNA, 22 bp, Homo sapiens
ttactttatagaacactggggg

SEQ ID NO: 9283755 - DNA, 22 bp, Homo sapiens
ttactttatagaacactggggg

SEQ ID NO: 9283756 - DNA, 22 bp, Homo sapiens
ttactttatctcctagattcca

SEQ ID NO: 9283757 - DNA, 22 bp, Homo sapiens
ttagaaagctttccatagtcaa

SEQ ID NO: 9283758 - DNA, 22 bp, Homo sapiens
ttagaaagctttccatagtcaa

SEQ ID NO: 9283759 - DNA, 21 bp, Homo sapiens
ttagaagctaatgcagctggt

SEQ ID NO: 9283760 - DNA, 22 bp, Homo sapiens
ttagagaaaagcttgcttgctt

SEQ ID NO: 9283761 - DNA, 21 bp, Homo sapiens
ttagacttgggtttttcctgg

SEQ ID NO: 9283762 - DNA, 22 bp, Homo sapiens
ttagaggaaagtgactccgatg

SEQ ID NO: 9283763 - DNA, 22 bp, Homo sapiens
ttagaggacaagaggcctggct

SEQ ID NO: 9283764 - DNA, 22 bp, Homo sapiens
ttagagatttgtctgatagtag

SEQ ID NO: 9283765 - DNA, 22 bp, Homo sapiens
ttagagaattccaaatgactac

SEQ ID NO: 9283766 - DNA, 22 bp, Homo sapiens
ttagagagaaccatcaggatct

SEQ ID NO: 9283767 - DNA, 22 bp, Homo sapiens
ttagagatacatttgtagcttg

SEQ ID NO: 9283768 - DNA, 21 bp, Homo sapiens
tgtgttcttctaggtcagcta

SEQ ID NO: 9283769 - DNA, 22 bp, Homo sapiens
tgtgttcttaaaagcagtgata

SEQ ID NO: 9283770 - DNA, 22 bp, Homo sapiens
tgtgttcttaaaagcagtgata

SEQ ID NO: 9283771 - DNA, 22 bp, Homo sapiens
tgtgttctggctgtgacagctg

SEQ ID NO: 9283772 - DNA, 22 bp, Homo sapiens
tgtgttggaaatagggtctttg

SEQ ID NO: 9283773 - DNA, 22 bp, Homo sapiens
tgtgttggctgccggcacagga

SEQ ID NO: 9283774 - DNA, 22 bp, Homo sapiens
tgtgttaattccacaaacattc

SEQ ID NO: 9283775 - DNA, 22 bp, Homo sapiens
tgtgttcaagattagttctagt

SEQ ID NO: 9283776 - DNA, 22 bp, Homo sapiens
tgtgttcaagattagttctagt

SEQ ID NO: 9283777 - DNA, 19 bp, Homo sapiens
tgtgttcaaactccatctc

SEQ ID NO: 9283778 - DNA, 22 bp, Homo sapiens
tgtgttctggaaagctcactga

SEQ ID NO: 9283779 - DNA, 22 bp, Homo sapiens
tgtgtgcacatgatttgaaatg

SEQ ID NO: 9283780 - DNA, 22 bp, Homo sapiens
tgtgttttacaaattctcttaa

SEQ ID NO: 9283781 - DNA, 21 bp, Homo sapiens
tgtgttttaatgatattctgt

SEQ ID NO: 9283782 - DNA, 21 bp, Homo sapiens
tgtgttttaatgatattctgt

SEQ ID NO: 9283783 - DNA, 22 bp, Homo sapiens
tgtgttttacaaattctcttaa

SEQ ID NO: 9283784 - DNA, 22 bp, Homo sapiens
tgtgttttaaatggaaatttga

SEQ ID NO: 9283785 - DNA, 22 bp, Homo sapiens
tgtgtttgttagactaatgtta

SEQ ID NO: 9283786 - DNA, 22 bp, Homo sapiens
tgtgtttcagaaccttctttca

SEQ ID NO: 9283787 - DNA, 22 bp, Homo sapiens
tgtgtttcagaaccttctttca

SEQ ID NO: 9283788 - DNA, 22 bp, Homo sapiens
tgtgtttatagtgtatcttcca

SEQ ID NO: 9283789 - DNA, 22 bp, Homo sapiens
tgtgtttctgagaatcccacct

SEQ ID NO: 9283790 - DNA, 22 bp, Homo sapiens
tgtgtttctctgaggggtccct

SEQ ID NO: 9283791 - DNA, 22 bp, Homo sapiens
tgtgttgtgacattcttggatg

SEQ ID NO: 9283792 - DNA, 22 bp, Homo sapiens
tgtgtttacttctatgcagttt

SEQ ID NO: 9283793 - DNA, 22 bp, Homo sapiens
tgttatttatctgagcatttat

SEQ ID NO: 9283794 - DNA, 22 bp, Homo sapiens
tgttatttatctgagcatttat

SEQ ID NO: 9283795 - DNA, 22 bp, Homo sapiens
tgttatttatttcacctccaga

SEQ ID NO: 9283796 - DNA, 22 bp, Homo sapiens
tgttatttctttgccatatctt

SEQ ID NO: 9283797 - DNA, 22 bp, Homo sapiens
tgttatttctttgccatatctt

SEQ ID NO: 9283798 - DNA, 22 bp, Homo sapiens
tgttattgatatctaatgctct

SEQ ID NO: 9283799 - DNA, 22 bp, Homo sapiens
tgttatgagtcctcatatacta

SEQ ID NO: 9283800 - DNA, 22 bp, Homo sapiens
tgttatgaacttctagaaaaca

SEQ ID NO: 9283801 - DNA, 22 bp, Homo sapiens
tgttatctcagactgagttact

SEQ ID NO: 9283802 - DNA, 22 bp, Homo sapiens
tgttatcctcagctcacctcta

SEQ ID NO: 9283803 - DNA, 22 bp, Homo sapiens
tgttatcctcagctcacctcta

SEQ ID NO: 9283804 - DNA, 22 bp, Homo sapiens
tgttatcacttagacatgctag

SEQ ID NO: 9283805 - DNA, 22 bp, Homo sapiens
tgttcccattttctgcataatc

SEQ ID NO: 9283806 - DNA, 22 bp, Homo sapiens
tgttcagaacaaaggtaaatga

SEQ ID NO: 9283807 - DNA, 22 bp, Homo sapiens
tgttcccattttctgcataatc

SEQ ID NO: 9283808 - DNA, 22 bp, Homo sapiens
tgttcctgaatgcctggctggc

SEQ ID NO: 9283809 - DNA, 22 bp, Homo sapiens
tgttcactggaacacagctgta

SEQ ID NO: 9283810 - DNA, 22 bp, Homo sapiens
tgttcctgaggcatgtgtcaat

SEQ ID NO: 9283811 - DNA, 21 bp, Homo sapiens
tgttcaaacgtacacatttct

SEQ ID NO: 9283812 - DNA, 22 bp, Homo sapiens
tgttcaaatcttttgcttattt

SEQ ID NO: 9283813 - DNA, 22 bp, Homo sapiens
tgttatttgggaaagttgtaca

SEQ ID NO: 9283814 - DNA, 22 bp, Homo sapiens
tgttatttgggaaagttgtaca

SEQ ID NO: 9283815 - DNA, 22 bp, Homo sapiens
tgttatttgggaaagttgtaca

SEQ ID NO: 9283816 - DNA, 22 bp, Homo sapiens
tgttcacatgtacatgaatatt

SEQ ID NO: 9283817 - DNA, 21 bp, Homo sapiens
tgttcacatggagcagaatgt

SEQ ID NO: 9283818 - DNA, 21 bp, Homo sapiens
tgttcacatggagcagaatgt

SEQ ID NO: 9283819 - DNA, 20 bp, Homo sapiens
tgttcacagtagttgctgct

SEQ ID NO: 9283820 - DNA, 22 bp, Homo sapiens
tgtttcatgaaacatgtttagg

SEQ ID NO: 9283821 - DNA, 20 bp, Homo sapiens
tgtttcataagctgtcctat

SEQ ID NO: 9283822 - DNA, 22 bp, Homo sapiens
tgtttcatgtggacatagttgt

SEQ ID NO: 9283823 - DNA, 22 bp, Homo sapiens
tgtttcatgtggacatagttgt

SEQ ID NO: 9283824 - DNA, 22 bp, Homo sapiens
tgtttcatgattgctgtcattt

SEQ ID NO: 9283825 - DNA, 22 bp, Homo sapiens
tgtttcatgaagtctggatatc

SEQ ID NO: 9283826 - DNA, 22 bp, Homo sapiens
tgtttcatgattgctgtcattt

SEQ ID NO: 9283827 - DNA, 22 bp, Homo sapiens
tgtttcattagtactgacaata

SEQ ID NO: 9283828 - DNA, 22 bp, Homo sapiens
tgtttccatggtgacagcagct

SEQ ID NO: 9283829 - DNA, 22 bp, Homo sapiens
tgtttcaagtttgctcaaagga

SEQ ID NO: 9283830 - DNA, 22 bp, Homo sapiens
tgtttcaactgttaagatatgc

SEQ ID NO: 9283831 - DNA, 22 bp, Homo sapiens
tgtttcaactgttaagatatgc

SEQ ID NO: 9283832 - DNA, 22 bp, Homo sapiens
tgtttacatatttggtctcaga

SEQ ID NO: 9283833 - DNA, 22 bp, Homo sapiens
tgtttcctaagtgtctctgaag

SEQ ID NO: 9283834 - DNA, 22 bp, Homo sapiens
tgtttcctaagtgtctctgaag

SEQ ID NO: 9283835 - DNA, 18 bp, Homo sapiens
tgtttcctcctggaggct

SEQ ID NO: 9283836 - DNA, 22 bp, Homo sapiens
tgtttccttctgtctctttgga

SEQ ID NO: 9283837 - DNA, 20 bp, Homo sapiens
tgtttcttttaatgagcggc

SEQ ID NO: 9283838 - DNA, 22 bp, Homo sapiens
tgtttctttgtagatattcttt

SEQ ID NO: 9283839 - DNA, 22 bp, Homo sapiens
tgtttctttgtagatattcttt

SEQ ID NO: 9283840 - DNA, 22 bp, Homo sapiens
tgtttcttgggtgctcacatca

SEQ ID NO: 9283841 - DNA, 22 bp, Homo sapiens
tgttttcacaatgatgtcagat

SEQ ID NO: 9283842 - DNA, 22 bp, Homo sapiens
tgttttcagatgcagggacaca

SEQ ID NO: 9283843 - DNA, 22 bp, Homo sapiens
tgttttcagtcatatagcaggt

SEQ ID NO: 9283844 - DNA, 22 bp, Homo sapiens
tgttttcagatgcagggacaca

SEQ ID NO: 9283845 - DNA, 22 bp, Homo sapiens
tgttttctcttgaaaagcagtc

SEQ ID NO: 9283846 - DNA, 22 bp, Homo sapiens
tgttttcagtcatatagcaggt

SEQ ID NO: 9283847 - DNA, 22 bp, Homo sapiens
tgttttctcttgaaaagcagtc

SEQ ID NO: 9283848 - DNA, 22 bp, Homo sapiens
tgttttctcttgaaaagcagtc

SEQ ID NO: 9283849 - DNA, 22 bp, Homo sapiens
tgtttgagttctagcgcattta

SEQ ID NO: 9283850 - DNA, 17 bp, Homo sapiens
tgttctcttcagaaatc

SEQ ID NO: 9283851 - DNA, 20 bp, Homo sapiens
tgttctgtcgtctttcttca

SEQ ID NO: 9283852 - DNA, 22 bp, Homo sapiens
tgtttaagctgatgaggtatcg

SEQ ID NO: 9283853 - DNA, 22 bp, Homo sapiens
tgttctcactggatgcttcaca

SEQ ID NO: 9283854 - DNA, 21 bp, Homo sapiens
tgttcctgttctctaggatcc

SEQ ID NO: 9283855 - DNA, 22 bp, Homo sapiens
tgttcctgtttctgcgtagttt

SEQ ID NO: 9283856 - DNA, 22 bp, Homo sapiens
tgtttaatgaagatggtttttc

SEQ ID NO: 9283857 - DNA, 22 bp, Homo sapiens
tgtttaataattctatgatagt

SEQ ID NO: 9283858 - DNA, 22 bp, Homo sapiens
tgtttaatttcacaaagttgac

SEQ ID NO: 9283859 - DNA, 22 bp, Homo sapiens
tgtttacaaggagtttatattg

SEQ ID NO: 9283860 - DNA, 22 bp, Homo sapiens
tgtttacacaatagtctctctc

SEQ ID NO: 9283861 - DNA, 22 bp, Homo sapiens
tgtttacaaggagaatttgagg

SEQ ID NO: 9283862 - DNA, 22 bp, Homo sapiens
tgtttacatagtagctgccctg

SEQ ID NO: 9283863 - DNA, 22 bp, Homo sapiens
tgtttacacttcaaggttaagg

SEQ ID NO: 9283864 - DNA, 22 bp, Homo sapiens
tgtttacagaaggcagacttcc

SEQ ID NO: 9283865 - DNA, 22 bp, Homo sapiens
tgtttacagcactgcacactgc

SEQ ID NO: 9283866 - DNA, 22 bp, Homo sapiens
tgtggactttagtaggtgagag

SEQ ID NO: 9283867 - DNA, 22 bp, Homo sapiens
tgtggactgtgctgccacagtg

SEQ ID NO: 9283868 - DNA, 22 bp, Homo sapiens
tgtggactcgcatggctgaggc

SEQ ID NO: 9283869 - DNA, 22 bp, Homo sapiens
tcccctgagacccctcagcact

SEQ ID NO: 9283870 - DNA, 22 bp, Homo sapiens
tcccctctctgcgctcccaggt

SEQ ID NO: 9283871 - DNA, 22 bp, Homo sapiens
tcccctctctgcgctcccaggt

SEQ ID NO: 9283872 - DNA, 22 bp, Homo sapiens
tcccctgcagcgcctgcttcta

SEQ ID NO: 9283873 - DNA, 22 bp, Homo sapiens
tcccctccaactccaactatgg

SEQ ID NO: 9283874 - DNA, 22 bp, Homo sapiens
tcccctccaactccaactatgg

SEQ ID NO: 9283875 - DNA, 23 bp, Homo sapiens
tcccctcaggcagccagtgccct

SEQ ID NO: 9283876 - DNA, 22 bp, Homo sapiens
tcccctcccttccaacagagct

SEQ ID NO: 9283877 - DNA, 22 bp, Homo sapiens
tcccctcctctcctgatatggg

SEQ ID NO: 9283878 - DNA, 22 bp, Homo sapiens
tccccctcattacctcattcaa

SEQ ID NO: 9283879 - DNA, 22 bp, Homo sapiens
tcccccactctaaaggagcctt

SEQ ID NO: 9283880 - DNA, 22 bp, Homo sapiens
tcccccaggctggagtgcagtg

SEQ ID NO: 9283881 - DNA, 22 bp, Homo sapiens
tcccccaggctggagtgcagtg

SEQ ID NO: 9283882 - DNA, 22 bp, Homo sapiens
tccccaggtcctgtcggctcct

SEQ ID NO: 9283883 - DNA, 22 bp, Homo sapiens
tccccaggtcctgtcggctcct

SEQ ID NO: 9283884 - DNA, 22 bp, Homo sapiens
tgtggccaccagagctgctatt

SEQ ID NO: 9283885 - DNA, 22 bp, Homo sapiens
tgtggccaccagagctgctatt

SEQ ID NO: 9283886 - DNA, 22 bp, Homo sapiens
tgtggcattgaataaccttgga

SEQ ID NO: 9283887 - DNA, 22 bp, Homo sapiens
tgtggcagtctcactggagggc

SEQ ID NO: 9283888 - DNA, 22 bp, Homo sapiens
tgtggcatacacatgaggtggt

SEQ ID NO: 9283889 - DNA, 22 bp, Homo sapiens
tgtggcagtctcactggagggc

SEQ ID NO: 9283890 - DNA, 22 bp, Homo sapiens
tgtggcagtaaaattgggcaac

SEQ ID NO: 9283891 - DNA, 18 bp, Homo sapiens
tgtggcaggggtgggaga

SEQ ID NO: 9283892 - DNA, 18 bp, Homo sapiens
tgtggcaggggtgggaga

SEQ ID NO: 9283893 - DNA, 22 bp, Homo sapiens
tgtggcagtataagagctagaa

SEQ ID NO: 9283894 - DNA, 19 bp, Homo sapiens
tgtggccatggttcagctg

SEQ ID NO: 9283895 - DNA, 22 bp, Homo sapiens
tgtggcccagatgagtgtgcta

SEQ ID NO: 9283896 - DNA, 22 bp, Homo sapiens
tgtggccaggcccctgatggtg

SEQ ID NO: 9283897 - DNA, 22 bp, Homo sapiens
tgtggccagcaggtggctgtgt

SEQ ID NO: 9283898 - DNA, 22 bp, Homo sapiens
tgtggcagagagagcttccttg

SEQ ID NO: 9283899 - DNA, 22 bp, Homo sapiens
tgtggcagaggaggcagcgtcc

SEQ ID NO: 9283900 - DNA, 21 bp, Homo sapiens
tgtggcagatgttgggaggca

SEQ ID NO: 9283901 - DNA, 22 bp, Homo sapiens
tgtggaggtttaagtaatggga

SEQ ID NO: 9283902 - DNA, 22 bp, Homo sapiens
tgtggcagaaccagaattcaaa

SEQ ID NO: 9283903 - DNA, 22 bp, Homo sapiens
tgtggcacttctctccttgtaa

SEQ ID NO: 9283904 - DNA, 22 bp, Homo sapiens
tgtggcctctaagctcacgaag

SEQ ID NO: 9283905 - DNA, 22 bp, Homo sapiens
tgtggcctgattttgcatctct

SEQ ID NO: 9283906 - DNA, 22 bp, Homo sapiens
tgtggggaggctgcagtgctgc

SEQ ID NO: 9283907 - DNA, 18 bp, Homo sapiens
tgtggtggagctgccttc

SEQ ID NO: 9283908 - DNA, 22 bp, Homo sapiens
tgtggtctccccagtgccagct

SEQ ID NO: 9283909 - DNA, 22 bp, Homo sapiens
tgtggtcccaaggcaactggaa

SEQ ID NO: 9283910 - DNA, 19 bp, Homo sapiens
tgtggtctctgttctcagg

SEQ ID NO: 9283911 - DNA, 19 bp, Homo sapiens
tgtggggagtcagggggct

SEQ ID NO: 9283912 - DNA, 19 bp, Homo sapiens
tgtggggagtcagggggct

SEQ ID NO: 9283913 - DNA, 22 bp, Homo sapiens
tgtggtagagggcagatgggca

SEQ ID NO: 9283914 - DNA, 22 bp, Homo sapiens
tgtggtagtctcagggcagtat

SEQ ID NO: 9283915 - DNA, 22 bp, Homo sapiens
tgtgtcagcacagtatcaatta

SEQ ID NO: 9283916 - DNA, 22 bp, Homo sapiens
tgtgtcaggagatagcaaaggg

SEQ ID NO: 9283917 - DNA, 22 bp, Homo sapiens
tgtgtaaatggcatctctcagc

SEQ ID NO: 9283918 - DNA, 22 bp, Homo sapiens
tgtgtaaatttatttacataaa

SEQ ID NO: 9283919 - DNA, 22 bp, Homo sapiens
tgtgtaacaatctacacttagg

SEQ ID NO: 9283920 - DNA, 22 bp, Homo sapiens
tgtgtaaatggcatctctcagc

SEQ ID NO: 9283921 - DNA, 22 bp, Homo sapiens
tgtgtaaattatttttaatgat

SEQ ID NO: 9283922 - DNA, 22 bp, Homo sapiens
tgtggtggtaatgagccagatg

SEQ ID NO: 9283923 - DNA, 22 bp, Homo sapiens
tgtggtggtaatgagccagatg

SEQ ID NO: 9283924 - DNA, 22 bp, Homo sapiens
tgtggtggctattctggtctca

SEQ ID NO: 9283925 - DNA, 18 bp, Homo sapiens
tgtggtggagctgccttc

SEQ ID NO: 9283926 - DNA, 22 bp, Homo sapiens
tgtggtggctattctggtctca

SEQ ID NO: 9283927 - DNA, 22 bp, Homo sapiens
tgtggtggggtctggtattcca

SEQ ID NO: 9283928 - DNA, 22 bp, Homo sapiens
tgtgtaaagcttgttccagaaa

SEQ ID NO: 9283929 - DNA, 22 bp, Homo sapiens
tgtgtaaaagattagtttacta

SEQ ID NO: 9283930 - DNA, 22 bp, Homo sapiens
tgtgtgattgcaggagatgtgg

SEQ ID NO: 9283931 - DNA, 22 bp, Homo sapiens
tgtgtgattgcaggagatgtgg

SEQ ID NO: 9283932 - DNA, 22 bp, Homo sapiens
tgtgtgcaagtgacattagaaa

SEQ ID NO: 9283933 - DNA, 22 bp, Homo sapiens
tgtgtgagtaaggctgagagag

SEQ ID NO: 9283934 - DNA, 22 bp, Homo sapiens
tgtgtgaggtggttctgagaag

SEQ ID NO: 9283935 - DNA, 22 bp, Homo sapiens
tgtgtgacccccagtgaagcct

SEQ ID NO: 9283936 - DNA, 22 bp, Homo sapiens
tgtgtgaagcacatgttcaagg

SEQ ID NO: 9283937 - DNA, 22 bp, Homo sapiens
tgtgtgaacatgttttcatttc

SEQ ID NO: 9283938 - DNA, 22 bp, Homo sapiens
tgtgtgaactctctgatgtaca

SEQ ID NO: 9283939 - DNA, 22 bp, Homo sapiens
tgtgtgaagtgattttaagtct

SEQ ID NO: 9283940 - DNA, 22 bp, Homo sapiens
tgtgtgaatctattgaatatat

SEQ ID NO: 9283941 - DNA, 22 bp, Homo sapiens
tgtgtgaatctattgaatatat

SEQ ID NO: 9283942 - DNA, 22 bp, Homo sapiens
tgtgtgaatggattattctatt

SEQ ID NO: 9283943 - DNA, 22 bp, Homo sapiens
tgtgtctgttttgctcaccatt

SEQ ID NO: 9283944 - DNA, 20 bp, Homo sapiens
tgtgtcttcctttctttatg

SEQ ID NO: 9283945 - DNA, 20 bp, Homo sapiens
tgtgtcttcctttctttatg

SEQ ID NO: 9283946 - DNA, 22 bp, Homo sapiens
tgtgtcctttcttaagagtgag

SEQ ID NO: 9283947 - DNA, 22 bp, Homo sapiens
tgtgtccttctgggagtcccag

SEQ ID NO: 9283948 - DNA, 22 bp, Homo sapiens
tgtgtccttatgaaaatactgt

SEQ ID NO: 9283949 - DNA, 22 bp, Homo sapiens
tgtgtccatctgacaggagagg

SEQ ID NO: 9283950 - DNA, 22 bp, Homo sapiens
tgtgtccactgaatgtgtatta

SEQ ID NO: 9283951 - DNA, 22 bp, Homo sapiens
tgtgtccattcaggcactgacc

SEQ ID NO: 9283952 - DNA, 22 bp, Homo sapiens
tgtgtcccttggaacctcagct

SEQ ID NO: 9283953 - DNA, 19 bp, Homo sapiens
ttttccttctcctcttaat

SEQ ID NO: 9283954 - DNA, 22 bp, Homo sapiens
ttttatgaagataattttctga

SEQ ID NO: 9283955 - DNA, 22 bp, Homo sapiens
ttttatcttcattcctatctac

SEQ ID NO: 9283956 - DNA, 22 bp, Homo sapiens
ttttcctttgattcccagatgt

SEQ ID NO: 9283957 - DNA, 22 bp, Homo sapiens
ttttcctttgattcccagatgt

SEQ ID NO: 9283958 - DNA, 22 bp, Homo sapiens
ttttcctttgaaaggtgagggc

SEQ ID NO: 9283959 - DNA, 22 bp, Homo sapiens
ttttcctttgaaaggtgagggc

SEQ ID NO: 9283960 - DNA, 22 bp, Homo sapiens
ttttcctttcatcaggacaaag

SEQ ID NO: 9283961 - DNA, 20 bp, Homo sapiens
ttttccttgttgccgctgct

SEQ ID NO: 9283962 - DNA, 22 bp, Homo sapiens
ttttccttctgatactccattt

SEQ ID NO: 9283963 - DNA, 22 bp, Homo sapiens
ttttccttctgatactccattt

SEQ ID NO: 9283964 - DNA, 20 bp, Homo sapiens
ttttccttctgagtatgttg

SEQ ID NO: 9283965 - DNA, 20 bp, Homo sapiens
ttttccttctgagtatgttg

SEQ ID NO: 9283966 - DNA, 22 bp, Homo sapiens
ttttctaacatctagtaatttg

SEQ ID NO: 9283967 - DNA, 22 bp, Homo sapiens
ttttctaacatctagtaatttg

SEQ ID NO: 9283968 - DNA, 22 bp, Homo sapiens
ttttctaacatctagtaatttg

SEQ ID NO: 9283969 - DNA, 23 bp, Homo sapiens
ttttcctttggacaggctgtatt

SEQ ID NO: 9283970 - DNA, 22 bp, Homo sapiens
ttttcctttggaagatgcatat

SEQ ID NO: 9283971 - DNA, 22 bp, Homo sapiens
ttttcctttggaagatgcatat

SEQ ID NO: 9283972 - DNA, 23 bp, Homo sapiens
ttttcctttggacaggctgtatt

SEQ ID NO: 9283973 - DNA, 23 bp, Homo sapiens
ttttcctttggacaggctgtatt

SEQ ID NO: 9283974 - DNA, 22 bp, Homo sapiens
ttttctattaactcattttgca

SEQ ID NO: 9283975 - DNA, 22 bp, Homo sapiens
ttttctattaactcattttgca

SEQ ID NO: 9283976 - DNA, 22 bp, Homo sapiens
ttttctatctcctagaactgcc

SEQ ID NO: 9283977 - DNA, 22 bp, Homo sapiens
ttttctatctcctagaactgcc

SEQ ID NO: 9283978 - DNA, 22 bp, Homo sapiens
ttttctagggtgctaaatgaac

SEQ ID NO: 9283979 - DNA, 22 bp, Homo sapiens
ttttcttggagtggctgtcctt

SEQ ID NO: 9283980 - DNA, 22 bp, Homo sapiens
ttttctttaatctggtggggtg

SEQ ID NO: 9283981 - DNA, 22 bp, Homo sapiens
ttttggcagattacttaatatg

SEQ ID NO: 9283982 - DNA, 22 bp, Homo sapiens
ttttggccacatccttttgagt

SEQ ID NO: 9283983 - DNA, 22 bp, Homo sapiens
tttttcattgcagcctctctcc

SEQ ID NO: 9283984 - DNA, 22 bp, Homo sapiens
tttttcatgagactagaagtca

SEQ ID NO: 9283985 - DNA, 22 bp, Homo sapiens
tttttcatgagactagaagtca

SEQ ID NO: 9283986 - DNA, 22 bp, Homo sapiens
tttttcctagcgatttgtcagc

SEQ ID NO: 9283987 - DNA, 22 bp, Homo sapiens
tttttcctagcgatttgtcagc

SEQ ID NO: 9283988 - DNA, 20 bp, Homo sapiens
tttttccttctctacaggca

SEQ ID NO: 9283989 - DNA, 22 bp, Homo sapiens
tttttccagggttagatgttta

SEQ ID NO: 9283990 - DNA, 22 bp, Homo sapiens
ttttgcagaatgggaaggtagt

SEQ ID NO: 9283991 - DNA, 22 bp, Homo sapiens
ttttgcagaatgggaaggtagt

SEQ ID NO: 9283992 - DNA, 22 bp, Homo sapiens
ttttgcatctggtgaagaccag

SEQ ID NO: 9283993 - DNA, 22 bp, Homo sapiens
ttttgcatctggtgaagaccag

SEQ ID NO: 9283994 - DNA, 22 bp, Homo sapiens
ttttgatatcatgatgaacaga

SEQ ID NO: 9283995 - DNA, 22 bp, Homo sapiens
ttttgcaaagtacattatcagg

SEQ ID NO: 9283996 - DNA, 22 bp, Homo sapiens
ttttgcctaagaatctctctga

SEQ ID NO: 9283997 - DNA, 22 bp, Homo sapiens
ttttgaaagagtcctgctacag

SEQ ID NO: 9283998 - DNA, 22 bp, Homo sapiens
ttttgaaagccaggtttgtatg

SEQ ID NO: 9283999 - DNA, 22 bp, Homo sapiens
ttttgaaagggtgatttggctt

SEQ ID NO: 9284000 - DNA, 19 bp, Homo sapiens
ttttgaagtatgagacagg

SEQ ID NO: 9284001 - DNA, 22 bp, Homo sapiens
tttttgggtccaggctgtatct

SEQ ID NO: 9284002 - DNA, 22 bp, Homo sapiens
tttttgcaccaacctaatagaa

SEQ ID NO: 9284003 - DNA, 22 bp, Homo sapiens
ttttttgtcttgaagaaatggt

SEQ ID NO: 9284004 - DNA, 22 bp, Homo sapiens
ttttttgtcttgaagaaatggt

SEQ ID NO: 9284005 - DNA, 22 bp, Homo sapiens
ttttttgtagcaagcgcagata

SEQ ID NO: 9284006 - DNA, 22 bp, Homo sapiens
ttttttgtcccagagagcctgg

SEQ ID NO: 9284007 - DNA, 22 bp, Homo sapiens
ttttttgtcccagagagcctgg

SEQ ID NO: 9284008 - DNA, 22 bp, Homo sapiens
tttttgggtccaggctgtatct

SEQ ID NO: 9284009 - DNA, 22 bp, Homo sapiens
tttttccttggatgtgtctctc

SEQ ID NO: 9284010 - DNA, 22 bp, Homo sapiens
tttttgaaggctgatgtgatta

SEQ ID NO: 9284011 - DNA, 22 bp, Homo sapiens
tttttgatactcaagaggggta

SEQ ID NO: 9284012 - DNA, 22 bp, Homo sapiens
tttggacaagttactggtttcc

SEQ ID NO: 9284013 - DNA, 22 bp, Homo sapiens
tttggcaagtgggaaattagta

SEQ ID NO: 9284014 - DNA, 22 bp, Homo sapiens
tttggcagagtcatttcagaaa

SEQ ID NO: 9284015 - DNA, 23 bp, Homo sapiens
tttgtacattgaggaggcagaat

SEQ ID NO: 9284016 - DNA, 22 bp, Homo sapiens
tttgtacatgaatgtgcaccca

SEQ ID NO: 9284017 - DNA, 22 bp, Homo sapiens
tttgtacaattagcagaggcta

SEQ ID NO: 9284018 - DNA, 22 bp, Homo sapiens
tttctttctcgtaaacttagtt

SEQ ID NO: 9284019 - DNA, 22 bp, Homo sapiens
tttctttctcgtaaacttagtt

SEQ ID NO: 9284020 - DNA, 22 bp, Homo sapiens
tttctttcaattctcctaatgc

SEQ ID NO: 9284021 - DNA, 22 bp, Homo sapiens
tttgcaaataaataagtgctcg

SEQ ID NO: 9284022 - DNA, 22 bp, Homo sapiens
tttgatttactggatattctca

SEQ ID NO: 9284023 - DNA, 22 bp, Homo sapiens
tttgattttcagcaatagtggc

SEQ ID NO: 9284024 - DNA, 22 bp, Homo sapiens
tttgattttcagcaatagtggc

SEQ ID NO: 9284025 - DNA, 22 bp, Homo sapiens
tttgcaaatacagaggtcttgc

SEQ ID NO: 9284026 - DNA, 22 bp, Homo sapiens
tttgcaaataccatgaaacttg

SEQ ID NO: 9284027 - DNA, 22 bp, Homo sapiens
tttgcaatttgtgctgcaaatg

SEQ ID NO: 9284028 - DNA, 23 bp, Homo sapiens
tttgcaaattggacacaaccaca

SEQ ID NO: 9284029 - DNA, 22 bp, Homo sapiens
tttgcacacacaataacaaatg

SEQ ID NO: 9284030 - DNA, 22 bp, Homo sapiens
tttgcagatgagaaaactgtgg

SEQ ID NO: 9284031 - DNA, 22 bp, Homo sapiens
tttgcagcaaggagagagcatt

SEQ ID NO: 9284032 - DNA, 22 bp, Homo sapiens
tttgttgtgataatggtctgca

SEQ ID NO: 9284033 - DNA, 22 bp, Homo sapiens
tttgtttacaaaaataagcagt

SEQ ID NO: 9284034 - DNA, 22 bp, Homo sapiens
tttgtttacaaaaataagcagt

SEQ ID NO: 9284035 - DNA, 22 bp, Homo sapiens
tttgttcttgcaacagttatta

SEQ ID NO: 9284036 - DNA, 22 bp, Homo sapiens
tttgttctgcatcacagaaaaa

SEQ ID NO: 9284037 - DNA, 22 bp, Homo sapiens
tttgtcaaagatcagatgcttt

SEQ ID NO: 9284038 - DNA, 22 bp, Homo sapiens
tttgtatttttcccagctagct

SEQ ID NO: 9284039 - DNA, 22 bp, Homo sapiens
tttgtcaatcccttgaaaacct

SEQ ID NO: 9284040 - DNA, 22 bp, Homo sapiens
tttgtcaccagtggctttggta

SEQ ID NO: 9284041 - DNA, 22 bp, Homo sapiens
tttgtcaataactaccaacagg

SEQ ID NO: 9284042 - DNA, 22 bp, Homo sapiens
tttgtcaatcccttgaaaacct

SEQ ID NO: 9284043 - DNA, 22 bp, Homo sapiens
tttgtcaataactaccaacagg

SEQ ID NO: 9284044 - DNA, 22 bp, Homo sapiens
tttgtcagtcatgtctgctttt

SEQ ID NO: 9284045 - DNA, 22 bp, Homo sapiens
tttgttcacctagcaaactttt

SEQ ID NO: 9284046 - DNA, 22 bp, Homo sapiens
tttgttcactgagcaatgatta

SEQ ID NO: 9284047 - DNA, 22 bp, Homo sapiens
tttgtacctgtgggaatacaga

SEQ ID NO: 9284048 - DNA, 22 bp, Homo sapiens
tttgtagcagcatgatttataa

SEQ ID NO: 9284049 - DNA, 22 bp, Homo sapiens
tttgtatgtgataagactattc

SEQ ID NO: 9284050 - DNA, 22 bp, Homo sapiens
tttgtatgaactggtatgtagg

SEQ ID NO: 9284051 - DNA, 22 bp, Homo sapiens
tttgtatgggcagaaattagat

SEQ ID NO: 9284052 - DNA, 22 bp, Homo sapiens
tttgttttcaatgtgtcattca

SEQ ID NO: 9284053 - DNA, 22 bp, Homo sapiens
tttgttttcaatgtgtcattca

SEQ ID NO: 9284054 - DNA, 22 bp, Homo sapiens
tttgttttcaatgtgtcattca

SEQ ID NO: 9284055 - DNA, 22 bp, Homo sapiens
tttgttttctgtaggcctttcc

SEQ ID NO: 9284056 - DNA, 22 bp, Homo sapiens
tttgttttgaactagctcagaa

SEQ ID NO: 9284057 - DNA, 22 bp, Homo sapiens
tttgttttgaactagctcagaa

SEQ ID NO: 9284058 - DNA, 22 bp, Homo sapiens
ttttagaagtgcctatcctatg

SEQ ID NO: 9284059 - DNA, 22 bp, Homo sapiens
ttttagaagttcacttgggttt

SEQ ID NO: 9284060 - DNA, 22 bp, Homo sapiens
tttgttttcaatgtgtcattca

SEQ ID NO: 9284061 - DNA, 22 bp, Homo sapiens
tttgttttcaatgtgtcattca

SEQ ID NO: 9284062 - DNA, 22 bp, Homo sapiens
tttgtttcgcagcctctctctg

SEQ ID NO: 9284063 - DNA, 22 bp, Homo sapiens
ttttatcaatcattaagacatt

SEQ ID NO: 9284064 - DNA, 22 bp, Homo sapiens
ttttatcaatcattaagacatt

SEQ ID NO: 9284065 - DNA, 22 bp, Homo sapiens
ttttatcagcagggataacaag

SEQ ID NO: 9284066 - DNA, 22 bp, Homo sapiens
ttttatcagcagggataacaag

SEQ ID NO: 9284067 - DNA, 22 bp, Homo sapiens
ttttatcagcagggataacaag

SEQ ID NO: 9284068 - DNA, 22 bp, Homo sapiens
ttttatcagcagggataacaag

SEQ ID NO: 9284069 - DNA, 22 bp, Homo sapiens
ttttatcaatcattaagacatt

SEQ ID NO: 9284070 - DNA, 22 bp, Homo sapiens
ttttatcaatcattaagacatt

SEQ ID NO: 9284071 - DNA, 22 bp, Homo sapiens
ttttatcaatcattaagacatt

SEQ ID NO: 9284072 - DNA, 22 bp, Homo sapiens
ttttatcaatcattaagacatt

SEQ ID NO: 9284073 - DNA, 22 bp, Homo sapiens
ttttatatggcacattggttgg

SEQ ID NO: 9284074 - DNA, 22 bp, Homo sapiens
ttttatattgagtgagagttcc

SEQ ID NO: 9284075 - DNA, 20 bp, Homo sapiens
ttttatatgtagggtatatg

SEQ ID NO: 9284076 - DNA, 22 bp, Homo sapiens
ttttatacttaagacagagttt

SEQ ID NO: 9284077 - DNA, 22 bp, Homo sapiens
ttttatacttaagacagagttt

SEQ ID NO: 9284078 - DNA, 22 bp, Homo sapiens
ttttagtttggatttctaaagc

SEQ ID NO: 9284079 - DNA, 22 bp, Homo sapiens
ttttataaagagagtcagttgg

SEQ ID NO: 9284080 - DNA, 22 bp, Homo sapiens
ttttagaagttcatgtgggatt

SEQ ID NO: 9284081 - DNA, 22 bp, Homo sapiens
ttgtcgggcttacgcagggcca

SEQ ID NO: 9284082 - DNA, 22 bp, Homo sapiens
ttgtctgtaaagacggccacca

SEQ ID NO: 9284083 - DNA, 22 bp, Homo sapiens
ttgtgaaatgtttcaaaatagt

SEQ ID NO: 9284084 - DNA, 22 bp, Homo sapiens
ttgtgaatgcttaatatgtttc

SEQ ID NO: 9284085 - DNA, 22 bp, Homo sapiens
ttgtgaatagtgccgctataaa

SEQ ID NO: 9284086 - DNA, 22 bp, Homo sapiens
ttgtgaatagtgccgcaataaa

SEQ ID NO: 9284087 - DNA, 22 bp, Homo sapiens
ttgtctctcattcctgcaactc

SEQ ID NO: 9284088 - DNA, 22 bp, Homo sapiens
ttgtctgagggtttgagagaat

SEQ ID NO: 9284089 - DNA, 22 bp, Homo sapiens
ttgtctgaagtcacacagatgc

SEQ ID NO: 9284090 - DNA, 22 bp, Homo sapiens
ttgtctgaattcttctaggcag

SEQ ID NO: 9284091 - DNA, 22 bp, Homo sapiens
ttgtctgacttctttagttact

SEQ ID NO: 9284092 - DNA, 22 bp, Homo sapiens
ttggtgcaaattcctgtaagag

SEQ ID NO: 9284093 - DNA, 22 bp, Homo sapiens
ttggttaaaatcaaattaatca

SEQ ID NO: 9284094 - DNA, 23 bp, Homo sapiens
ttggtgtcagggaactttggaat

SEQ ID NO: 9284095 - DNA, 22 bp, Homo sapiens
ttggtcctgccccctccaggtc

SEQ ID NO: 9284096 - DNA, 22 bp, Homo sapiens
ttggtcagtcagagaatggagt

SEQ ID NO: 9284097 - DNA, 22 bp, Homo sapiens
ttggggtgttggatggagcaag

SEQ ID NO: 9284098 - DNA, 22 bp, Homo sapiens
ttgcaagatgttaccattgtta

SEQ ID NO: 9284099 - DNA, 22 bp, Homo sapiens
ttgcaagacacttggaagcaca

SEQ ID NO: 9284100 - DNA, 22 bp, Homo sapiens
ttgcaatagccttatttccaaa

SEQ ID NO: 9284101 - DNA, 18 bp, Homo sapiens
ttggggtgaggccaggaa

SEQ ID NO: 9284102 - DNA, 22 bp, Homo sapiens
ttgttagatatttcttagaaga

SEQ ID NO: 9284103 - DNA, 20 bp, Homo sapiens
ttgttagaggaatgccatag

SEQ ID NO: 9284104 - DNA, 20 bp, Homo sapiens
ttgttagaggaatgccatag

SEQ ID NO: 9284105 - DNA, 20 bp, Homo sapiens
ttgttagaggaatgccatag

SEQ ID NO: 9284106 - DNA, 22 bp, Homo sapiens
ttgttacatcttatgtaagtgg

SEQ ID NO: 9284107 - DNA, 22 bp, Homo sapiens
ttgttacagcagtgatttcaga

SEQ ID NO: 9284108 - DNA, 22 bp, Homo sapiens
ttgttacagcagtgatttcaga

SEQ ID NO: 9284109 - DNA, 22 bp, Homo sapiens
ttgttaaaaatagatttccagg

SEQ ID NO: 9284110 - DNA, 22 bp, Homo sapiens
ttgttatcaatgaatcaaaact

SEQ ID NO: 9284111 - DNA, 22 bp, Homo sapiens
ttgttagctgatcttgagtgca

SEQ ID NO: 9284112 - DNA, 22 bp, Homo sapiens
ttgttagcatgcttaatggata

SEQ ID NO: 9284113 - DNA, 22 bp, Homo sapiens
ttgttagtgcaatgtttggtga

SEQ ID NO: 9284114 - DNA, 19 bp, Homo sapiens
ttgtgtgtcagtcagagtt

SEQ ID NO: 9284115 - DNA, 22 bp, Homo sapiens
ttgtgacattgattaaactatg

SEQ ID NO: 9284116 - DNA, 22 bp, Homo sapiens
ttgtgaatggtgccgcaataaa

SEQ ID NO: 9284117 - DNA, 22 bp, Homo sapiens
ttgtgtgtgagccttcaccaca

SEQ ID NO: 9284118 - DNA, 22 bp, Homo sapiens
ttgtgtgtgagccttcaccaca

SEQ ID NO: 9284119 - DNA, 22 bp, Homo sapiens
ttgtgtgtcttcttcactgccc

SEQ ID NO: 9284120 - DNA, 19 bp, Homo sapiens
ttgtgtgtcagtcagagtt

SEQ ID NO: 9284121 - DNA, 22 bp, Homo sapiens
ttgtgtgtgtaactttatgaga

SEQ ID NO: 9284122 - DNA, 22 bp, Homo sapiens
ttgtgtgtgtaactttatgaga

SEQ ID NO: 9284123 - DNA, 22 bp, Homo sapiens
ttgtgtgtgtaactttatgaga

SEQ ID NO: 9284124 - DNA, 22 bp, Homo sapiens
ttgtgtgtttgtagaaaatcca

SEQ ID NO: 9284125 - DNA, 21 bp, Homo sapiens
ttgtgtttccccagtcacttt

SEQ ID NO: 9284126 - DNA, 22 bp, Homo sapiens
ttgtgttaaggtgcatctagtg

SEQ ID NO: 9284127 - DNA, 22 bp, Homo sapiens
ttgtgtttcccttgcatattcc

SEQ ID NO: 9284128 - DNA, 22 bp, Homo sapiens
ttgtgttttcttatggcataaa

SEQ ID NO: 9284129 - DNA, 20 bp, Homo sapiens
ttgtttctgctattttctaa

SEQ ID NO: 9284130 - DNA, 22 bp, Homo sapiens
ttgtttctgagttttcatgtat

SEQ ID NO: 9284131 - DNA, 22 bp, Homo sapiens
ttgtttctctggtcttgagtga

SEQ ID NO: 9284132 - DNA, 20 bp, Homo sapiens
ttgtttctgctattttctaa

SEQ ID NO: 9284133 - DNA, 20 bp, Homo sapiens
ttgtttctgctattttctaa

SEQ ID NO: 9284134 - DNA, 22 bp, Homo sapiens
ttgtttcctttctatacaggat

SEQ ID NO: 9284135 - DNA, 20 bp, Homo sapiens
ttgtttcctggctgttctgc

SEQ ID NO: 9284136 - DNA, 22 bp, Homo sapiens
ttgtttctcctggtgcctgata

SEQ ID NO: 9284137 - DNA, 22 bp, Homo sapiens
ttgtttctccagtctaggaaaa

SEQ ID NO: 9284138 - DNA, 22 bp, Homo sapiens
ttgtttctcctggtgcctgata

SEQ ID NO: 9284139 - DNA, 23 bp, Homo sapiens
ttgtttctttgtattgtctctat

SEQ ID NO: 9284140 - DNA, 22 bp, Homo sapiens
ttgtttgtaaggctcttagaat

SEQ ID NO: 9284141 - DNA, 22 bp, Homo sapiens
ttgtttctttgaagtttctaga

SEQ ID NO: 9284142 - DNA, 17 bp, Homo sapiens
ttgtttcttctctgtgg

SEQ ID NO: 9284143 - DNA, 22 bp, Homo sapiens
ttgttttggagatgagctaaaa

SEQ ID NO: 9284144 - DNA, 22 bp, Homo sapiens
ttgttttcttgtatatagcctc

SEQ ID NO: 9284145 - DNA, 22 bp, Homo sapiens
ttgttttctccactgcatctta

SEQ ID NO: 9284146 - DNA, 22 bp, Homo sapiens
ttgttttcctgggataccaacc

SEQ ID NO: 9284147 - DNA, 22 bp, Homo sapiens
ttgttttctccactgcatctta

SEQ ID NO: 9284148 - DNA, 22 bp, Homo sapiens
ttgttttggaagaacttactct

SEQ ID NO: 9284149 - DNA, 22 bp, Homo sapiens
ttgttttgctaaagggtcatca

SEQ ID NO: 9284150 - DNA, 22 bp, Homo sapiens
ttgttttatctttctacagact

SEQ ID NO: 9284151 - DNA, 22 bp, Homo sapiens
ttgttttatctttctacagact

SEQ ID NO: 9284152 - DNA, 22 bp, Homo sapiens
ttgttttatctttctacagact

SEQ ID NO: 9284153 - DNA, 22 bp, Homo sapiens
ttgttttattctgcaatttccc

SEQ ID NO: 9284154 - DNA, 22 bp, Homo sapiens
ttgttttattctgcaatttccc

SEQ ID NO: 9284155 - DNA, 22 bp, Homo sapiens
ttgttttattctgcaatttccc

SEQ ID NO: 9284156 - DNA, 22 bp, Homo sapiens
ttgttttcacagctttgcccgg

SEQ ID NO: 9284157 - DNA, 22 bp, Homo sapiens
ttgttttcagggtgtcattcac

SEQ ID NO: 9284158 - DNA, 22 bp, Homo sapiens
ttgttttagtaggtacactgag

SEQ ID NO: 9284159 - DNA, 22 bp, Homo sapiens
ttgttttagtaggtacactgag

SEQ ID NO: 9284160 - DNA, 22 bp, Homo sapiens
ttgttttagtaggtacactgag

SEQ ID NO: 9284161 - DNA, 18 bp, Homo sapiens
ttgttttaagactctgtc

SEQ ID NO: 9284162 - DNA, 18 bp, Homo sapiens
ttgttttaagactctgtc

SEQ ID NO: 9284163 - DNA, 22 bp, Homo sapiens
ttgttttaatgagggaggttga

SEQ ID NO: 9284164 - DNA, 22 bp, Homo sapiens
ttgttttaatgagggaggttga

SEQ ID NO: 9284165 - DNA, 22 bp, Homo sapiens
ttgttttaatgagggaggttga

SEQ ID NO: 9284166 - DNA, 22 bp, Homo sapiens
ttgttttaagccagtctgccta

SEQ ID NO: 9284167 - DNA, 22 bp, Homo sapiens
ttgttttaagccagtctgccta

SEQ ID NO: 9284168 - DNA, 22 bp, Homo sapiens
ttgtttgtgctatttaatgtag

SEQ ID NO: 9284169 - DNA, 20 bp, Homo sapiens
ttgttttaaatcctggatga

SEQ ID NO: 9284170 - DNA, 22 bp, Homo sapiens
ttgttttaacgactcagcttgt

SEQ ID NO: 9284171 - DNA, 22 bp, Homo sapiens
ttgttttaacgactcagcttgt

SEQ ID NO: 9284172 - DNA, 22 bp, Homo sapiens
ttgttttaacgactcagcttgt

SEQ ID NO: 9284173 - DNA, 22 bp, Homo sapiens
ttgttttaacctagtgtttatg

SEQ ID NO: 9284174 - DNA, 22 bp, Homo sapiens
ttgttttaacctagtgtttatg

SEQ ID NO: 9284175 - DNA, 22 bp, Homo sapiens
ttgttttaacctagtgtttatg

SEQ ID NO: 9284176 - DNA, 20 bp, Homo sapiens
ttgttttaaatcctggatga

SEQ ID NO: 9284177 - DNA, 22 bp, Homo sapiens
tttattatccagtgttgtcatg

SEQ ID NO: 9284178 - DNA, 22 bp, Homo sapiens
tttattatccagtgttgtcatg

SEQ ID NO: 9284179 - DNA, 22 bp, Homo sapiens
tttattatgatggacaccttcg

SEQ ID NO: 9284180 - DNA, 22 bp, Homo sapiens
tttattatgatggacaccttcg

SEQ ID NO: 9284181 - DNA, 22 bp, Homo sapiens
tttattatgatggacaccttcg

SEQ ID NO: 9284182 - DNA, 22 bp, Homo sapiens
tttattatgtacaggcactata

SEQ ID NO: 9284183 - DNA, 22 bp, Homo sapiens
tttattatgatggacaccttcg

SEQ ID NO: 9284184 - DNA, 22 bp, Homo sapiens
tttattattctgttctctctac

SEQ ID NO: 9284185 - DNA, 22 bp, Homo sapiens
tttattattctgttctctctac

SEQ ID NO: 9284186 - DNA, 22 bp, Homo sapiens
tttattattctctggagaatgt

SEQ ID NO: 9284187 - DNA, 22 bp, Homo sapiens
tttattattctctggagaatgt

SEQ ID NO: 9284188 - DNA, 22 bp, Homo sapiens
tttattattctctggagaatgt

SEQ ID NO: 9284189 - DNA, 22 bp, Homo sapiens
tttattattctctggagaatgt

SEQ ID NO: 9284190 - DNA, 22 bp, Homo sapiens
tttattatgtacaggcactata

SEQ ID NO: 9284191 - DNA, 22 bp, Homo sapiens
tttattatgtacaggcactata

SEQ ID NO: 9284192 - DNA, 22 bp, Homo sapiens
tttattaattagtgacccaatg

SEQ ID NO: 9284193 - DNA, 22 bp, Homo sapiens
tttattagattatcaaagaggt

SEQ ID NO: 9284194 - DNA, 22 bp, Homo sapiens
tttattacaccaggttaactca

SEQ ID NO: 9284195 - DNA, 22 bp, Homo sapiens
tttattatagtggtggggactg

SEQ ID NO: 9284196 - DNA, 22 bp, Homo sapiens
tttattatagtggtggggactg

SEQ ID NO: 9284197 - DNA, 22 bp, Homo sapiens
tttattatccagtgttgtcatg

SEQ ID NO: 9284198 - DNA, 22 bp, Homo sapiens
tttattatagtggtggggactg

SEQ ID NO: 9284199 - DNA, 22 bp, Homo sapiens
tttattatagtggtggggactg

SEQ ID NO: 9284200 - DNA, 22 bp, Homo sapiens
tttattagtgcttgtatcactg

SEQ ID NO: 9284201 - DNA, 22 bp, Homo sapiens
tttatttgtcttgccatttagt

SEQ ID NO: 9284202 - DNA, 22 bp, Homo sapiens
tttatttggcatctctgccaag

SEQ ID NO: 9284203 - DNA, 22 bp, Homo sapiens
tttatttcttagtttgccacag

SEQ ID NO: 9284204 - DNA, 22 bp, Homo sapiens
tttatttggcatccagggagaa

SEQ ID NO: 9284205 - DNA, 22 bp, Homo sapiens
tttatttcttagtttgccacag

SEQ ID NO: 9284206 - DNA, 22 bp, Homo sapiens
tttatttcactctccggatact

SEQ ID NO: 9284207 - DNA, 15 bp, Homo sapiens
tttcaaaatgaggcc

SEQ ID NO: 9284208 - DNA, 22 bp, Homo sapiens
tttcaaaagcgtacgtagtgaa

SEQ ID NO: 9284209 - DNA, 22 bp, Homo sapiens
tttcaaaattttgcagtggtaa

SEQ ID NO: 9284210 - DNA, 22 bp, Homo sapiens
tttcaaaattttgcagtggtaa

SEQ ID NO: 9284211 - DNA, 22 bp, Homo sapiens
tttcaaacatatcttcattact

SEQ ID NO: 9284212 - DNA, 22 bp, Homo sapiens
tttataaaatagactgggtcta

SEQ ID NO: 9284213 - DNA, 22 bp, Homo sapiens
tttataaaatagactgggtcta

SEQ ID NO: 9284214 - DNA, 22 bp, Homo sapiens
tttataaaatagactgggtcta

SEQ ID NO: 9284215 - DNA, 22 bp, Homo sapiens
tttataaacagtaccacggtgc

SEQ ID NO: 9284216 - DNA, 22 bp, Homo sapiens
tttataaacagtaccacggtgc

SEQ ID NO: 9284217 - DNA, 22 bp, Homo sapiens
tttataaccaagttctgcttgt

SEQ ID NO: 9284218 - DNA, 22 bp, Homo sapiens
tttataaacagtaccacggtgc

SEQ ID NO: 9284219 - DNA, 22 bp, Homo sapiens
tttagttttaactgaaagctat

SEQ ID NO: 9284220 - DNA, 22 bp, Homo sapiens
tttagttattgttacagtatga

SEQ ID NO: 9284221 - DNA, 22 bp, Homo sapiens
tttagttattgttacagtatga

SEQ ID NO: 9284222 - DNA, 22 bp, Homo sapiens
tttatagatgtctgtattataa

SEQ ID NO: 9284223 - DNA, 22 bp, Homo sapiens
tttatactccactctgcaagcg

SEQ ID NO: 9284224 - DNA, 22 bp, Homo sapiens
tttatacatggagaatttttgc

SEQ ID NO: 9284225 - DNA, 22 bp, Homo sapiens
tttataattatctctactctta

SEQ ID NO: 9284226 - DNA, 17 bp, Homo sapiens
tttataattggcctctt

SEQ ID NO: 9284227 - DNA, 22 bp, Homo sapiens
tttatacatggagaatttttgc

SEQ ID NO: 9284228 - DNA, 22 bp, Homo sapiens
tttatataacagagactgctat

SEQ ID NO: 9284229 - DNA, 22 bp, Homo sapiens
tttattaagatgcgaatgctga

SEQ ID NO: 9284230 - DNA, 22 bp, Homo sapiens
tttattaatgtagcatccatgg

SEQ ID NO: 9284231 - DNA, 21 bp, Homo sapiens
tttattaacaactgtggacgt

SEQ ID NO: 9284232 - DNA, 22 bp, Homo sapiens
tttattaaaactgttggctctg

SEQ ID NO: 9284233 - DNA, 22 bp, Homo sapiens
tttatgtttgcattttcaaaga

SEQ ID NO: 9284234 - DNA, 22 bp, Homo sapiens
tttaccatctgccacagatatg

SEQ ID NO: 9284235 - DNA, 22 bp, Homo sapiens
tttaccattattaaaattaagt

SEQ ID NO: 9284236 - DNA, 19 bp, Homo sapiens
tttaccttcttgagagcag

SEQ ID NO: 9284237 - DNA, 22 bp, Homo sapiens
tttactaacaccatacatgctg

SEQ ID NO: 9284238 - DNA, 22 bp, Homo sapiens
tttacaacgttcctggtgctaa

SEQ ID NO: 9284239 - DNA, 22 bp, Homo sapiens
tttaccatacatcaaaatattt

SEQ ID NO: 9284240 - DNA, 22 bp, Homo sapiens
tttacaaggcagaactgattaa

SEQ ID NO: 9284241 - DNA, 22 bp, Homo sapiens
tttacaaggcagaactgattaa

SEQ ID NO: 9284242 - DNA, 22 bp, Homo sapiens
tttacaaggcagttattttcct

SEQ ID NO: 9284243 - DNA, 22 bp, Homo sapiens
tttacaaggcagttattttcct

SEQ ID NO: 9284244 - DNA, 22 bp, Homo sapiens
tttagttattgttacagtatga

SEQ ID NO: 9284245 - DNA, 22 bp, Homo sapiens
tttactttctcaagtatatagg

SEQ ID NO: 9284246 - DNA, 22 bp, Homo sapiens
tttactttctcaagtatatagg

SEQ ID NO: 9284247 - DNA, 22 bp, Homo sapiens
tttactttgtgtcaagtcaaga

SEQ ID NO: 9284248 - DNA, 22 bp, Homo sapiens
tttactttgtgtcaagtcaaga

SEQ ID NO: 9284249 - DNA, 22 bp, Homo sapiens
tttacttcatttccagtgagga

SEQ ID NO: 9284250 - DNA, 22 bp, Homo sapiens
tttactcttgctacacaactgt

SEQ ID NO: 9284251 - DNA, 18 bp, Homo sapiens
tttactcataggcctgac

SEQ ID NO: 9284252 - DNA, 22 bp, Homo sapiens
tttactgaactgctagtacagg

SEQ ID NO: 9284253 - DNA, 22 bp, Homo sapiens
tttactgaatttggtatattcc

SEQ ID NO: 9284254 - DNA, 22 bp, Homo sapiens
tttactgagtgacctagaataa

SEQ ID NO: 9284255 - DNA, 21 bp, Homo sapiens
tttactgagcacttactatgt

SEQ ID NO: 9284256 - DNA, 21 bp, Homo sapiens
tttactgagcacttactatgt

SEQ ID NO: 9284257 - DNA, 22 bp, Homo sapiens
tttaattgcatttaaagatgga

SEQ ID NO: 9284258 - DNA, 22 bp, Homo sapiens
tttaatttgaaatgagtaaccc

SEQ ID NO: 9284259 - DNA, 22 bp, Homo sapiens
tttaatttgaaatgagtaaccc

SEQ ID NO: 9284260 - DNA, 22 bp, Homo sapiens
tttaatttgaaatgagtaaccc

SEQ ID NO: 9284261 - DNA, 22 bp, Homo sapiens
tttaattagcaagccagagagc

SEQ ID NO: 9284262 - DNA, 22 bp, Homo sapiens
tttaattctggcataatagctc

SEQ ID NO: 9284263 - DNA, 22 bp, Homo sapiens
tttaattatgttaagccactga

SEQ ID NO: 9284264 - DNA, 22 bp, Homo sapiens
tttaattttcctcttcctggag

SEQ ID NO: 9284265 - DNA, 22 bp, Homo sapiens
tttaattttcctggtaggcctg

SEQ ID NO: 9284266 - DNA, 22 bp, Homo sapiens
tttaattttcctggtaggcctg

SEQ ID NO: 9284267 - DNA, 22 bp, Homo sapiens
tttaattttctgggcccagcag

SEQ ID NO: 9284268 - DNA, 22 bp, Homo sapiens
tttaattttctgggcccagcag

SEQ ID NO: 9284269 - DNA, 22 bp, Homo sapiens
tttaatttgtatttctagaggg

SEQ ID NO: 9284270 - DNA, 22 bp, Homo sapiens
tttaattttcctcttcctggag

SEQ ID NO: 9284271 - DNA, 21 bp, Homo sapiens
tttaatttgcatgtatgacgc

SEQ ID NO: 9284272 - DNA, 21 bp, Homo sapiens
tttaatttgcatgtatgacgc

SEQ ID NO: 9284273 - DNA, 22 bp, Homo sapiens
tttaaacaaataggattgccta

SEQ ID NO: 9284274 - DNA, 22 bp, Homo sapiens
tttaaaatttagacctctccac

SEQ ID NO: 9284275 - DNA, 22 bp, Homo sapiens
tttaaaatttagacctctccac

SEQ ID NO: 9284276 - DNA, 22 bp, Homo sapiens
tttaaaatcagatgggagttgg

SEQ ID NO: 9284277 - DNA, 22 bp, Homo sapiens
tttaaaatcagatgggagttgg

SEQ ID NO: 9284278 - DNA, 22 bp, Homo sapiens
tttaaaatttagacctctccac

SEQ ID NO: 9284279 - DNA, 23 bp, Homo sapiens
ttgtttttagaggtggcatgaga

SEQ ID NO: 9284280 - DNA, 22 bp, Homo sapiens
ttgtttttagagaagccctgaa

SEQ ID NO: 9284281 - DNA, 22 bp, Homo sapiens
ttgtttttaaacatgtgactga

SEQ ID NO: 9284282 - DNA, 22 bp, Homo sapiens
tttaaaatcagatgggagttgg

SEQ ID NO: 9284283 - DNA, 22 bp, Homo sapiens
tttaaaatcagatgggagttgg

SEQ ID NO: 9284284 - DNA, 21 bp, Homo sapiens
tttctgtctctgccactagtt

SEQ ID NO: 9284285 - DNA, 22 bp, Homo sapiens
tttctgtattttgtcataacct

SEQ ID NO: 9284286 - DNA, 22 bp, Homo sapiens
tttctgtcatagttatctttgt

SEQ ID NO: 9284287 - DNA, 19 bp, Homo sapiens
tttctgttagaaggataca

SEQ ID NO: 9284288 - DNA, 19 bp, Homo sapiens
tttctgttagaaggataca

SEQ ID NO: 9284289 - DNA, 22 bp, Homo sapiens
tttctgttaggcatcattttaa

SEQ ID NO: 9284290 - DNA, 22 bp, Homo sapiens
tttctgttaggcatcattttaa

SEQ ID NO: 9284291 - DNA, 23 bp, Homo sapiens
tttctgttgggtatatatccaag

SEQ ID NO: 9284292 - DNA, 22 bp, Homo sapiens
tttcttcccaagcagtttcaga

SEQ ID NO: 9284293 - DNA, 22 bp, Homo sapiens
tttcttccccactgcaggctct

SEQ ID NO: 9284294 - DNA, 22 bp, Homo sapiens
tttcttatgtgcagagtgagta

SEQ ID NO: 9284295 - DNA, 22 bp, Homo sapiens
tttcttctgagatcagggagaa

SEQ ID NO: 9284296 - DNA, 22 bp, Homo sapiens
tttcttctctgattaaggctca

SEQ ID NO: 9284297 - DNA, 22 bp, Homo sapiens
tttcttctctgattaaggctca

SEQ ID NO: 9284298 - DNA, 22 bp, Homo sapiens
tttcttctctaatctcaatgat

SEQ ID NO: 9284299 - DNA, 22 bp, Homo sapiens
tttcttctctaatctcaatgat

SEQ ID NO: 9284300 - DNA, 20 bp, Homo sapiens
tttcttgtacttggagaagg

SEQ ID NO: 9284301 - DNA, 22 bp, Homo sapiens
tttcttgtaagatgtttattaa

SEQ ID NO: 9284302 - DNA, 20 bp, Homo sapiens
tttcttgtacttggagaagg

SEQ ID NO: 9284303 - DNA, 22 bp, Homo sapiens
tttcttctgagatcagggagaa

SEQ ID NO: 9284304 - DNA, 22 bp, Homo sapiens
tttcttgtaagatgtttattaa

SEQ ID NO: 9284305 - DNA, 22 bp, Homo sapiens
tttcttctccatggcaggtcct

SEQ ID NO: 9284306 - DNA, 20 bp, Homo sapiens
tttcttgtcggctgttgctg

SEQ ID NO: 9284307 - DNA, 20 bp, Homo sapiens
tttcttgtcggctgttgctg

SEQ ID NO: 9284308 - DNA, 20 bp, Homo sapiens
tttcttgtcggctgttgctg

SEQ ID NO: 9284309 - DNA, 22 bp, Homo sapiens
tttcttgtctttagtatctggc

SEQ ID NO: 9284310 - DNA, 22 bp, Homo sapiens
tttcttgtctttagtatctggc

SEQ ID NO: 9284311 - DNA, 22 bp, Homo sapiens
tttcttgtttcatggtgtctca

SEQ ID NO: 9284312 - DNA, 22 bp, Homo sapiens
tttcttgtttcatggtgtctca

SEQ ID NO: 9284313 - DNA, 22 bp, Homo sapiens
tttctttaattctcacagcaat

SEQ ID NO: 9284314 - DNA, 22 bp, Homo sapiens
tttctttatcatagcatctttg

SEQ ID NO: 9284315 - DNA, 22 bp, Homo sapiens
tttctttatcatagcatctttg

SEQ ID NO: 9284316 - DNA, 22 bp, Homo sapiens
tttcttctcacccaggacagag

SEQ ID NO: 9284317 - DNA, 22 bp, Homo sapiens
tttcttctcatccctgaaatca

SEQ ID NO: 9284318 - DNA, 22 bp, Homo sapiens
tttcttctcacccaggacagag

SEQ ID NO: 9284319 - DNA, 22 bp, Homo sapiens
tttcttctatgtgtgatatttt

SEQ ID NO: 9284320 - DNA, 22 bp, Homo sapiens
tttcttctatgtgtgatatttt

SEQ ID NO: 9284321 - DNA, 22 bp, Homo sapiens
tttcttctcatccctgaaatca

SEQ ID NO: 9284322 - DNA, 22 bp, Homo sapiens
tttcttctcatccctgaaatca

SEQ ID NO: 9284323 - DNA, 23 bp, Homo sapiens
tttcttctcgaagagggagctta

SEQ ID NO: 9284324 - DNA, 23 bp, Homo sapiens
tttcttctcgaagagggagctta

SEQ ID NO: 9284325 - DNA, 22 bp, Homo sapiens
tttcttctcgacaccttatccc

SEQ ID NO: 9284326 - DNA, 22 bp, Homo sapiens
tttcttctcgacaccttatccc

SEQ ID NO: 9284327 - DNA, 22 bp, Homo sapiens
tttcttctaggactaataagag

SEQ ID NO: 9284328 - DNA, 22 bp, Homo sapiens
tttcttctaggactaataagag

SEQ ID NO: 9284329 - DNA, 22 bp, Homo sapiens
tttcttctaggactaataagag

SEQ ID NO: 9284330 - DNA, 22 bp, Homo sapiens
tttcttctaggactaataagag

SEQ ID NO: 9284331 - DNA, 22 bp, Homo sapiens
tttcttctaagatttcaaacta

SEQ ID NO: 9284332 - DNA, 22 bp, Homo sapiens
tttcttctaagatttcaaacta

SEQ ID NO: 9284333 - DNA, 22 bp, Homo sapiens
tttcttccttaccttactagag

SEQ ID NO: 9284334 - DNA, 22 bp, Homo sapiens
tttcttccttaccttactagag

SEQ ID NO: 9284335 - DNA, 22 bp, Homo sapiens
tttcttcctgctttgtcccatg

SEQ ID NO: 9284336 - DNA, 22 bp, Homo sapiens
tttcttcctgctttgtcccatg

SEQ ID NO: 9284337 - DNA, 22 bp, Homo sapiens
tttcttcctaaatatgatttcc

SEQ ID NO: 9284338 - DNA, 22 bp, Homo sapiens
tttcttcctatgtatcttgctg

SEQ ID NO: 9284339 - DNA, 22 bp, Homo sapiens
tttctgctcgctctcaatcagg

SEQ ID NO: 9284340 - DNA, 22 bp, Homo sapiens
tttctgcttaggactctgtgga

SEQ ID NO: 9284341 - DNA, 22 bp, Homo sapiens
tttctgctttcagagtgagaca

SEQ ID NO: 9284342 - DNA, 17 bp, Homo sapiens
tttctggaatgggcaaa

SEQ ID NO: 9284343 - DNA, 22 bp, Homo sapiens
tttctggaaagcaagatacatt

SEQ ID NO: 9284344 - DNA, 22 bp, Homo sapiens
tttctggcagcgggacaggggt

SEQ ID NO: 9284345 - DNA, 21 bp, Homo sapiens
tttctgggtggctgcatagtg

SEQ ID NO: 9284346 - DNA, 22 bp, Homo sapiens
tttctgggtttatgtcacagct

SEQ ID NO: 9284347 - DNA, 22 bp, Homo sapiens
tttctgtaagtggcaaataatg

SEQ ID NO: 9284348 - DNA, 22 bp, Homo sapiens
tttctgagaaattaaacacttt

SEQ ID NO: 9284349 - DNA, 22 bp, Homo sapiens
tttctgaggaattaatacagaa

SEQ ID NO: 9284350 - DNA, 22 bp, Homo sapiens
tttctgaggaattaatacagaa

SEQ ID NO: 9284351 - DNA, 22 bp, Homo sapiens
tttctgcatctctacagttgtt

SEQ ID NO: 9284352 - DNA, 22 bp, Homo sapiens
tttctgataattttgtgaaatc

SEQ ID NO: 9284353 - DNA, 22 bp, Homo sapiens
tttctgccaggtttctggatga

SEQ ID NO: 9284354 - DNA, 22 bp, Homo sapiens
tttctgcatttacaaaatgagg

SEQ ID NO: 9284355 - DNA, 22 bp, Homo sapiens
tttctgccaaccatttaaactc

SEQ ID NO: 9284356 - DNA, 22 bp, Homo sapiens
tttctgctaatcttttactgag

SEQ ID NO: 9284357 - DNA, 22 bp, Homo sapiens
tttctgccttatctttgctgag

SEQ ID NO: 9284358 - DNA, 22 bp, Homo sapiens
tttctgaaggttaaggaattag

SEQ ID NO: 9284359 - DNA, 22 bp, Homo sapiens
tttctgaagtcttctaacagat

SEQ ID NO: 9284360 - DNA, 22 bp, Homo sapiens
tttctgacctgcaacagtttac

SEQ ID NO: 9284361 - DNA, 22 bp, Homo sapiens
tttctgaatttactcaaggtca

SEQ ID NO: 9284362 - DNA, 22 bp, Homo sapiens
tttctgaattcctaggatgttg

SEQ ID NO: 9284363 - DNA, 22 bp, Homo sapiens
tttctctgttctctaactgtaa

SEQ ID NO: 9284364 - DNA, 22 bp, Homo sapiens
tttctctgtgccatttccataa

SEQ ID NO: 9284365 - DNA, 22 bp, Homo sapiens
tttctcttaatgtctctgtgct

SEQ ID NO: 9284366 - DNA, 22 bp, Homo sapiens
tttctcttaatgtctctgtgct

SEQ ID NO: 9284367 - DNA, 22 bp, Homo sapiens
tttctcttaatgtctctgtgct

SEQ ID NO: 9284368 - DNA, 22 bp, Homo sapiens
tttctctaaatagggaggctta

SEQ ID NO: 9284369 - DNA, 22 bp, Homo sapiens
tttctcggcagagatgatgggc

SEQ ID NO: 9284370 - DNA, 22 bp, Homo sapiens
tttctctaaatagggaggctta

SEQ ID NO: 9284371 - DNA, 22 bp, Homo sapiens
tttctcggcagagatgatgggc

SEQ ID NO: 9284372 - DNA, 22 bp, Homo sapiens
tttctctgtgccatttccataa

SEQ ID NO: 9284373 - DNA, 19 bp, Homo sapiens
tttctctgtgcaccttttc

SEQ ID NO: 9284374 - DNA, 22 bp, Homo sapiens
tttctctgggcactctccaaac

SEQ ID NO: 9284375 - DNA, 17 bp, Homo sapiens
tttctccttccatctca

SEQ ID NO: 9284376 - DNA, 22 bp, Homo sapiens
tttctccttgtgtctcctttga

SEQ ID NO: 9284377 - DNA, 22 bp, Homo sapiens
tttctcctgtgaggtcagaagt

SEQ ID NO: 9284378 - DNA, 22 bp, Homo sapiens
tttctcctgtgtaagccgccca

SEQ ID NO: 9284379 - DNA, 22 bp, Homo sapiens
tttctcctgcccagatgcctgg

SEQ ID NO: 9284380 - DNA, 22 bp, Homo sapiens
tttctcctgctagaacaaggag

SEQ ID NO: 9284381 - DNA, 22 bp, Homo sapiens
tttctcctgtgaggtcagaagt

SEQ ID NO: 9284382 - DNA, 22 bp, Homo sapiens
tttctcctgagttccacgctac

SEQ ID NO: 9284383 - DNA, 22 bp, Homo sapiens
tttctcctctccagagtgcagt

SEQ ID NO: 9284384 - DNA, 22 bp, Homo sapiens
tttctcctctccagagtgcagt

SEQ ID NO: 9284385 - DNA, 22 bp, Homo sapiens
tttctctttgacaggaatcaga

SEQ ID NO: 9284386 - DNA, 22 bp, Homo sapiens
tttctctttcaatctgcagtac

SEQ ID NO: 9284387 - DNA, 22 bp, Homo sapiens
tttctgaaaactgaagtagtgc

SEQ ID NO: 9284388 - DNA, 22 bp, Homo sapiens
tttctctttgacaggaatcaga

SEQ ID NO: 9284389 - DNA, 22 bp, Homo sapiens
tttctctttgacaggaatcaga

SEQ ID NO: 9284390 - DNA, 22 bp, Homo sapiens
tttctctttgacaggaatcaga

SEQ ID NO: 9284391 - DNA, 22 bp, Homo sapiens
tttctctttcaatctgcagtac

SEQ ID NO: 9284392 - DNA, 22 bp, Homo sapiens
tttctctttcaatctgcagtac

SEQ ID NO: 9284393 - DNA, 22 bp, Homo sapiens
tttctcttgcgatatgctacac

SEQ ID NO: 9284394 - DNA, 22 bp, Homo sapiens
tttctgaaatctcttttgagga

SEQ ID NO: 9284395 - DNA, 22 bp, Homo sapiens
tttctgaaatctcttttgagga

SEQ ID NO: 9284396 - DNA, 21 bp, Homo sapiens
tttctgaaggcaacatctatc

SEQ ID NO: 9284397 - DNA, 20 bp, Homo sapiens
tttcaaaggcacctatgaag

SEQ ID NO: 9284398 - DNA, 22 bp, Homo sapiens
tttcaaagggaagttatgaagt

SEQ ID NO: 9284399 - DNA, 22 bp, Homo sapiens
tttcagaggtatgctgcttatc

SEQ ID NO: 9284400 - DNA, 22 bp, Homo sapiens
tttcagagttatgtaagaaaat

SEQ ID NO: 9284401 - DNA, 22 bp, Homo sapiens
tttcagaggtgcttggaatgct

SEQ ID NO: 9284402 - DNA, 22 bp, Homo sapiens
tttcaaagagttgtaaattact

SEQ ID NO: 9284403 - DNA, 23 bp, Homo sapiens
tttcaaagactttcccttagagt

SEQ ID NO: 9284404 - DNA, 22 bp, Homo sapiens
tttcaaagaccattaactatca

SEQ ID NO: 9284405 - DNA, 22 bp, Homo sapiens
tttcaaactttactcttgaatc

SEQ ID NO: 9284406 - DNA, 22 bp, Homo sapiens
tttcaaagacagccatatttgt

SEQ ID NO: 9284407 - DNA, 22 bp, Homo sapiens
tttcagggaagtgttgaaaagg

SEQ ID NO: 9284408 - DNA, 22 bp, Homo sapiens
tttcagtgcacgtagtttattt

SEQ ID NO: 9284409 - DNA, 19 bp, Homo sapiens
tttcaggagctatgcaggg

SEQ ID NO: 9284410 - DNA, 22 bp, Homo sapiens
tttcaggattagtttaagcagg

SEQ ID NO: 9284411 - DNA, 22 bp, Homo sapiens
tttcagatgcaattaattttca

SEQ ID NO: 9284412 - DNA, 22 bp, Homo sapiens
tttcagcactttaggcagcagg

SEQ ID NO: 9284413 - DNA, 22 bp, Homo sapiens
tttcctcttcttcccatgtcat

SEQ ID NO: 9284414 - DNA, 22 bp, Homo sapiens
tttcctcttcttcccatgtcat

SEQ ID NO: 9284415 - DNA, 22 bp, Homo sapiens
tttcctctgggccctgccaccc

SEQ ID NO: 9284416 - DNA, 22 bp, Homo sapiens
tttcctctgggccctgccaccc

SEQ ID NO: 9284417 - DNA, 22 bp, Homo sapiens
tttcctctgtcatgacagctga

SEQ ID NO: 9284418 - DNA, 22 bp, Homo sapiens
tttcctctgctgccattgcccc

SEQ ID NO: 9284419 - DNA, 22 bp, Homo sapiens
tttcctctgctgccattgcccc

SEQ ID NO: 9284420 - DNA, 22 bp, Homo sapiens
tttcattttggttatgccataa

SEQ ID NO: 9284421 - DNA, 22 bp, Homo sapiens
tttcattttggttatgccataa

SEQ ID NO: 9284422 - DNA, 22 bp, Homo sapiens
tttcattttggttatgccataa

SEQ ID NO: 9284423 - DNA, 22 bp, Homo sapiens
tttcattttggttatgccataa

SEQ ID NO: 9284424 - DNA, 22 bp, Homo sapiens
tttcatttcatagaattgtgtt

SEQ ID NO: 9284425 - DNA, 22 bp, Homo sapiens
tttcattgtctacatatgacat

SEQ ID NO: 9284426 - DNA, 22 bp, Homo sapiens
tttcattgtgatgcttttatca

SEQ ID NO: 9284427 - DNA, 22 bp, Homo sapiens
tttcattgtcaataaactgtat

SEQ ID NO: 9284428 - DNA, 22 bp, Homo sapiens
tttctacatttgtaaccagatt

SEQ ID NO: 9284429 - DNA, 22 bp, Homo sapiens
tttctacattcaaaaactacca

SEQ ID NO: 9284430 - DNA, 22 bp, Homo sapiens
tttctaatctttagttacaaaa

SEQ ID NO: 9284431 - DNA, 22 bp, Homo sapiens
tttctaattctaactggcagag

SEQ ID NO: 9284432 - DNA, 22 bp, Homo sapiens
tttctaagtaagattaacttct

SEQ ID NO: 9284433 - DNA, 22 bp, Homo sapiens
tttctaagtatcttgcagtttt

SEQ ID NO: 9284434 - DNA, 22 bp, Homo sapiens
tttctaagtatcttgcagtttt

SEQ ID NO: 9284435 - DNA, 22 bp, Homo sapiens
tttctaagtctgagggagtata

SEQ ID NO: 9284436 - DNA, 22 bp, Homo sapiens
tttctaagtgtgattttagatt

SEQ ID NO: 9284437 - DNA, 22 bp, Homo sapiens
tttcctctttgtgacacagctg

SEQ ID NO: 9284438 - DNA, 22 bp, Homo sapiens
tttcctctttgtaccttgacta

SEQ ID NO: 9284439 - DNA, 22 bp, Homo sapiens
tttcctgagccagagtttcatt

SEQ ID NO: 9284440 - DNA, 22 bp, Homo sapiens
tttcctgcacccgctgatgcca

SEQ ID NO: 9284441 - DNA, 22 bp, Homo sapiens
tttcctgcctggacctctgctt

SEQ ID NO: 9284442 - DNA, 22 bp, Homo sapiens
tttcctggaccaactgagattg

SEQ ID NO: 9284443 - DNA, 22 bp, Homo sapiens
tttcctgttgccatcaagaatg

SEQ ID NO: 9284444 - DNA, 22 bp, Homo sapiens
tttcctgtgcttaacaaatatt

SEQ ID NO: 9284445 - DNA, 22 bp, Homo sapiens
tttccttccaaatgcccgggag

SEQ ID NO: 9284446 - DNA, 22 bp, Homo sapiens
tttccttcatcatctgagagct

SEQ ID NO: 9284447 - DNA, 22 bp, Homo sapiens
tttccttccaggttcctaaggc

SEQ ID NO: 9284448 - DNA, 22 bp, Homo sapiens
tttccttccatgttgggcaaaa

SEQ ID NO: 9284449 - DNA, 22 bp, Homo sapiens
tttccttccctggatgagaagt

SEQ ID NO: 9284450 - DNA, 22 bp, Homo sapiens
tttccttctcagggagcttcaa

SEQ ID NO: 9284451 - DNA, 22 bp, Homo sapiens
tttccttctcagggagcttcaa

SEQ ID NO: 9284452 - DNA, 22 bp, Homo sapiens
tttccttccttgctagcctgag

SEQ ID NO: 9284453 - DNA, 22 bp, Homo sapiens
tttccttctcagggagcttcaa

SEQ ID NO: 9284454 - DNA, 22 bp, Homo sapiens
tttccttccctggatgagaagt

SEQ ID NO: 9284455 - DNA, 22 bp, Homo sapiens
tttccttcctaaggtgaagcaa

SEQ ID NO: 9284456 - DNA, 22 bp, Homo sapiens
tttctcagtgcagtttctacgt

SEQ ID NO: 9284457 - DNA, 21 bp, Homo sapiens
tttctcataaaatactcatta

SEQ ID NO: 9284458 - DNA, 22 bp, Homo sapiens
tttctacttctcctgaatgtct

SEQ ID NO: 9284459 - DNA, 22 bp, Homo sapiens
tttctagaaatagagatagagt

SEQ ID NO: 9284460 - DNA, 22 bp, Homo sapiens
tttctattgtaagtctcctata

SEQ ID NO: 9284461 - DNA, 22 bp, Homo sapiens
tttctattgtaagtctcctata

SEQ ID NO: 9284462 - DNA, 22 bp, Homo sapiens
tttctcctcatgactggttgtg

SEQ ID NO: 9284463 - DNA, 22 bp, Homo sapiens
tttctcctcatgactggttgtg

SEQ ID NO: 9284464 - DNA, 22 bp, Homo sapiens
tttctcctccagagagacacag

SEQ ID NO: 9284465 - DNA, 22 bp, Homo sapiens
tttctcctccagagagacacag

SEQ ID NO: 9284466 - DNA, 22 bp, Homo sapiens
tttctcctctccagagtgcagt

SEQ ID NO: 9284467 - DNA, 22 bp, Homo sapiens
tttctcctcatgactggttgtg

SEQ ID NO: 9284468 - DNA, 22 bp, Homo sapiens
tttctcctaactcaaatttaag

SEQ ID NO: 9284469 - DNA, 22 bp, Homo sapiens
tttctccctttataagactgta

SEQ ID NO: 9284470 - DNA, 22 bp, Homo sapiens
tttctcatggaacatagctcct

SEQ ID NO: 9284471 - DNA, 22 bp, Homo sapiens
tttctcatggacccttcatgat

SEQ ID NO: 9284472 - DNA, 22 bp, Homo sapiens
tttctcatggaacatagctcct

SEQ ID NO: 9284473 - DNA, 23 bp, Homo sapiens
tttctcatccagagagtcagtcc

SEQ ID NO: 9284474 - DNA, 22 bp, Homo sapiens
tttctcatagtcatgcctctta

SEQ ID NO: 9284475 - DNA, 22 bp, Homo sapiens
tttctcatctggaaacagtgct

SEQ ID NO: 9284476 - DNA, 22 bp, Homo sapiens
tttctcatggcccttggctttt

SEQ ID NO: 9284477 - DNA, 22 bp, Homo sapiens
tttctcatggacccttcatgat

SEQ ID NO: 9284478 - DNA, 21 bp, Homo sapiens
tttctccaagtgactgattcc

SEQ ID NO: 9284479 - DNA, 22 bp, Homo sapiens
aggatggggtctgcagcctggt

SEQ ID NO: 9284480 - DNA, 22 bp, Homo sapiens
cattgctgacagatgaagagaa

SEQ ID NO: 9284481 - DNA, 22 bp, Homo sapiens
cattgctgtagtccagatgagg

SEQ ID NO: 9284482 - DNA, 22 bp, Homo sapiens
cattgctgcttccaggcacagg

SEQ ID NO: 9284483 - DNA, 22 bp, Homo sapiens
caggtgggccatgaaaaatgac

SEQ ID NO: 9284484 - DNA, 22 bp, Homo sapiens
cagggcagtaacgggaacatct

SEQ ID NO: 9284485 - DNA, 22 bp, Homo sapiens
cagggcagggagcttagaatga

SEQ ID NO: 9284486 - DNA, 22 bp, Homo sapiens
cagctgttactctgagtaaatg

SEQ ID NO: 9284487 - DNA, 22 bp, Homo sapiens
cagctgttcggggctggcatgt

SEQ ID NO: 9284488 - DNA, 22 bp, Homo sapiens
cagctgttcacatttccaaaac

SEQ ID NO: 9284489 - DNA, 22 bp, Homo sapiens
cagctgttcttgggacagacag

SEQ ID NO: 9284490 - DNA, 22 bp, Homo sapiens
agcttcctgatgcaagagggct

SEQ ID NO: 9284491 - DNA, 22 bp, Homo sapiens
agcttcctgttgagagagggag

SEQ ID NO: 9284492 - DNA, 22 bp, Homo sapiens
agggcagaagtacagacactta

SEQ ID NO: 9284493 - DNA, 22 bp, Homo sapiens
agggcagaccacgtgcaaggat

SEQ ID NO: 9284494 - DNA, 22 bp, Homo sapiens
aggctagaggcttctggcttca

SEQ ID NO: 9284495 - DNA, 22 bp, Homo sapiens
cgggcagtgtggctccagagtc

SEQ ID NO: 9284496 - DNA, 22 bp, Homo sapiens
cctgttgtcatggaataagtta

SEQ ID NO: 9284497 - DNA, 22 bp, Homo sapiens
agtatggaggatggaatttgct

SEQ ID NO: 9284498 - DNA, 22 bp, Homo sapiens
ctcatggagggagtgctcttcc

SEQ ID NO: 9284499 - DNA, 18 bp, Homo sapiens
agtcctggagatcaccaa

SEQ ID NO: 9284500 - DNA, 22 bp, Homo sapiens
ctcctcaaggtctcaggaataa

SEQ ID NO: 9284501 - DNA, 22 bp, Homo sapiens
atatttaactggtcccaatata

SEQ ID NO: 9284502 - DNA, 22 bp, Homo sapiens
atatttaaacagggtaccaata

SEQ ID NO: 9284503 - DNA, 22 bp, Homo sapiens
atattgtactagggttacatgt

SEQ ID NO: 9284504 - DNA, 22 bp, Homo sapiens
atcctgtttgtcactagaaaat

SEQ ID NO: 9284505 - DNA, 22 bp, Homo sapiens
atcctgttgctggctcattttg

SEQ ID NO: 9284506 - DNA, 22 bp, Homo sapiens
atcctgttagcaccttcaaact

SEQ ID NO: 9284507 - DNA, 22 bp, Homo sapiens
atacagtgccccttttcacatg

SEQ ID NO: 9284508 - DNA, 22 bp, Homo sapiens
atacagtgaatacttacagtgt

SEQ ID NO: 9284509 - DNA, 22 bp, Homo sapiens
atacagtgtactatttagcagt

SEQ ID NO: 9284510 - DNA, 22 bp, Homo sapiens
ctgccctttatttcacaaagta

SEQ ID NO: 9284511 - DNA, 22 bp, Homo sapiens
ctgcatcctaacctccatgcag

SEQ ID NO: 9284512 - DNA, 22 bp, Homo sapiens
ctgcatcctggaaatagctaag

SEQ ID NO: 9284513 - DNA, 22 bp, Homo sapiens
ctttctggctgaagtgatgaat

SEQ ID NO: 9284514 - DNA, 22 bp, Homo sapiens
cttcttgtcaatttgccattgt

SEQ ID NO: 9284515 - DNA, 22 bp, Homo sapiens
ctttcttggtcctgaagatggc

SEQ ID NO: 9284516 - DNA, 22 bp, Homo sapiens
atgatgctgtttatcatatact

SEQ ID NO: 9284517 - DNA, 22 bp, Homo sapiens
gactgggacaggacagacatct

SEQ ID NO: 9284518 - DNA, 17 bp, Homo sapiens
gagatgggtggatcacc

SEQ ID NO: 9284519 - DNA, 22 bp, Homo sapiens
gagatggggtcagctgggacat

SEQ ID NO: 9284520 - DNA, 22 bp, Homo sapiens
gagatggggaataggagcaagc

SEQ ID NO: 9284521 - DNA, 18 bp, Homo sapiens
atggtctcatactgggag

SEQ ID NO: 9284522 - DNA, 22 bp, Homo sapiens
attagtgtacatctcacacgca

SEQ ID NO: 9284523 - DNA, 22 bp, Homo sapiens
attagtgttcttatcttctagg

SEQ ID NO: 9284524 - DNA, 22 bp, Homo sapiens
attagtgtctgtgaataattct

SEQ ID NO: 9284525 - DNA, 22 bp, Homo sapiens
gcagtgttaatgcgagtgttca

SEQ ID NO: 9284526 - DNA, 22 bp, Homo sapiens
gcagtgttacctcttcagtggg

SEQ ID NO: 9284527 - DNA, 22 bp, Homo sapiens
gcagtgttaaacaactgctgct

SEQ ID NO: 9284528 - DNA, 22 bp, Homo sapiens
gcagtgttaccttgggctggtt

SEQ ID NO: 9284529 - DNA, 22 bp, Homo sapiens
gcagtgttacttggagtactaa

SEQ ID NO: 9284530 - DNA, 22 bp, Homo sapiens
attccttgggctgccttattat

SEQ ID NO: 9284531 - DNA, 22 bp, Homo sapiens
attccttgggaattattgaatg

SEQ ID NO: 9284532 - DNA, 22 bp, Homo sapiens
attccttggcattctggacttg

SEQ ID NO: 9284533 - DNA, 22 bp, Homo sapiens
attccttgtatatctacatgca

SEQ ID NO: 9284534 - DNA, 22 bp, Homo sapiens
attccttgcacatcagatagtt

SEQ ID NO: 9284535 - DNA, 22 bp, Homo sapiens
attccttgctctcatcaacctt

SEQ ID NO: 9284536 - DNA, 22 bp, Homo sapiens
attccttggaacagatgcgaag

SEQ ID NO: 9284537 - DNA, 22 bp, Homo sapiens
gcaggcctgggagtcatcttgt

SEQ ID NO: 9284538 - DNA, 22 bp, Homo sapiens
caaatgcatgagaaataagagg

SEQ ID NO: 9284539 - DNA, 22 bp, Homo sapiens
gctgacccctacaggttgtgtt

SEQ ID NO: 9284540 - DNA, 22 bp, Homo sapiens
caaagtgctggaattacaggtg

SEQ ID NO: 9284541 - DNA, 22 bp, Homo sapiens
gccaggctggcaaaaggaaacc

SEQ ID NO: 9284542 - DNA, 22 bp, Homo sapiens
gccaggctggggggagatgtct

SEQ ID NO: 9284543 - DNA, 22 bp, Homo sapiens
atttctgttatacctttctcag

SEQ ID NO: 9284544 - DNA, 22 bp, Homo sapiens
cagacctcagtcctcagtagga

SEQ ID NO: 9284545 - DNA, 22 bp, Homo sapiens
ggcttatatattttcacttgcc

SEQ ID NO: 9284546 - DNA, 22 bp, Homo sapiens
ggcttatattgctctattcaca

SEQ ID NO: 9284547 - DNA, 22 bp, Homo sapiens
cagagcctctaaaatttctatc

SEQ ID NO: 9284548 - DNA, 22 bp, Homo sapiens
cagagcctgccacctttctccc

SEQ ID NO: 9284549 - DNA, 22 bp, Homo sapiens
gggctgaggggtatctcatggg

SEQ ID NO: 9284550 - DNA, 22 bp, Homo sapiens
cagcctgccctggaagcccagc

SEQ ID NO: 9284551 - DNA, 22 bp, Homo sapiens
caagccaggaaggatccagcac

SEQ ID NO: 9284552 - DNA, 21 bp, Homo sapiens
caagccagaccaatagcagcc

SEQ ID NO: 9284553 - DNA, 22 bp, Homo sapiens
caagccagtgacagccagggaa

SEQ ID NO: 9284554 - DNA, 22 bp, Homo sapiens
caagtagagttcacttgtcttt

SEQ ID NO: 9284555 - DNA, 22 bp, Homo sapiens
gctttcttatttagaagatttg

SEQ ID NO: 9284556 - DNA, 22 bp, Homo sapiens
gctttcttttcaagaatgtatt

SEQ ID NO: 9284557 - DNA, 22 bp, Homo sapiens
ggaggtggaggttgcaatgagc

SEQ ID NO: 9284558 - DNA, 22 bp, Homo sapiens
cacagtgtgggcatggtgcctg

SEQ ID NO: 9284559 - DNA, 22 bp, Homo sapiens
cacagtgttccagagcagtggt

SEQ ID NO: 9284560 - DNA, 22 bp, Homo sapiens
ggaggtggagctggaagttcca

SEQ ID NO: 9284561 - DNA, 22 bp, Homo sapiens
atagtgtcagaaaatcataaga

SEQ ID NO: 9284562 - DNA, 21 bp, Homo sapiens
agttcacaggaacaagcaggg

SEQ ID NO: 9284563 - DNA, 22 bp, Homo sapiens
agttcacagaatggccagaact

SEQ ID NO: 9284564 - DNA, 22 bp, Homo sapiens
actcagctgatgaagcacaagt

SEQ ID NO: 9284565 - DNA, 22 bp, Homo sapiens
actcagctcaggagctggctgg

SEQ ID NO: 9284566 - DNA, 22 bp, Homo sapiens
actcagcttcctacagctagaa

SEQ ID NO: 9284567 - DNA, 22 bp, Homo sapiens
agtcacttcctgcttgacctga

SEQ ID NO: 9284568 - DNA, 21 bp, Homo sapiens
aggttccagcagccagagaat

SEQ ID NO: 9284569 - DNA, 22 bp, Homo sapiens
aggttccagggattaggatgtg

SEQ ID NO: 9284570 - DNA, 22 bp, Homo sapiens
aggttccaggttcgaatcccat

SEQ ID NO: 9284571 - DNA, 22 bp, Homo sapiens
aggtggggttcagtctcagccg

SEQ ID NO: 9284572 - DNA, 22 bp, Homo sapiens
agttacagtaagccagccagca

SEQ ID NO: 9284573 - DNA, 22 bp, Homo sapiens
agtgtctttcatatcctccatc

SEQ ID NO: 9284574 - DNA, 22 bp, Homo sapiens
agtgtgtactcatatacttcca

SEQ ID NO: 9284575 - DNA, 22 bp, Homo sapiens
acaggatcgccctgttgcccag

SEQ ID NO: 9284576 - DNA, 22 bp, Homo sapiens
acagtgttacttgatagtgtat

SEQ ID NO: 9284577 - DNA, 20 bp, Homo sapiens
acagtgttaggtttttcctt

SEQ ID NO: 9284578 - DNA, 22 bp, Homo sapiens
acagtgttcaaaccactaggct

SEQ ID NO: 9284579 - DNA, 22 bp, Homo sapiens
acagtgttcactaaggttagct

SEQ ID NO: 9284580 - DNA, 22 bp, Homo sapiens
acagtgttatttctgagtaatg

SEQ ID NO: 9284581 - DNA, 20 bp, Homo sapiens
acagtgttagttatcatctc

SEQ ID NO: 9284582 - DNA, 22 bp, Homo sapiens
acagtgttcacttaacaatgga

SEQ ID NO: 9284583 - DNA, 22 bp, Homo sapiens
acagtgttcctttgttgtgact

SEQ ID NO: 9284584 - DNA, 22 bp, Homo sapiens
acagtgttctcttcctgtatag

SEQ ID NO: 9284585 - DNA, 22 bp, Homo sapiens
acagtgttctgaaagttgaggg

SEQ ID NO: 9284586 - DNA, 22 bp, Homo sapiens
acattaacactggtgctggtgt

SEQ ID NO: 9284587 - DNA, 22 bp, Homo sapiens
acattaacaccataagtgtgtt

SEQ ID NO: 9284588 - DNA, 22 bp, Homo sapiens
acattaacaccgtgagtttggt

SEQ ID NO: 9284589 - DNA, 23 bp, Homo sapiens
aggggtggtcagtacccgcagtg

SEQ ID NO: 9284590 - DNA, 22 bp, Homo sapiens
agagctaagaaacagaattgct

SEQ ID NO: 9284591 - DNA, 22 bp, Homo sapiens
atgattgaccatctgctgggct

SEQ ID NO: 9284592 - DNA, 22 bp, Homo sapiens
atgaccagccgagataaacaga

SEQ ID NO: 9284593 - DNA, 22 bp, Homo sapiens
agattctcaacaaagagtagca

SEQ ID NO: 9284594 - DNA, 22 bp, Homo sapiens
agattccttatctgtccaatgg

SEQ ID NO: 9284595 - DNA, 22 bp, Homo sapiens
caaagtgctgggattacaggtg

SEQ ID NO: 9284596 - DNA, 22 bp, Homo sapiens
caaagtgctgggattacaggct

SEQ ID NO: 9284597 - DNA, 22 bp, Homo sapiens
cagagtgagggcctgcacctgc

SEQ ID NO: 9284598 - DNA, 22 bp, Homo sapiens
cagagtgatggcacctgctggg

SEQ ID NO: 9284599 - DNA, 22 bp, Homo sapiens
cagcagaaaatgtgggtgattt

SEQ ID NO: 9284600 - DNA, 22 bp, Homo sapiens
cagcacttggtgccattgagtg

SEQ ID NO: 9284601 - DNA, 22 bp, Homo sapiens
cagcctctgacaccacagtcgt

SEQ ID NO: 9284602 - DNA, 22 bp, Homo sapiens
cagcctcttgcactttgaaggc

SEQ ID NO: 9284603 - DNA, 22 bp, Homo sapiens
cagaaactatgtaagaaagtga

SEQ ID NO: 9284604 - DNA, 22 bp, Homo sapiens
aaatattggtaggatgcttgtt

SEQ ID NO: 9284605 - DNA, 22 bp, Homo sapiens
aaattgctctttaaaagtactg

SEQ ID NO: 9284606 - DNA, 22 bp, Homo sapiens
aaaatactgtggagtgttgaaa

SEQ ID NO: 9284607 - DNA, 22 bp, Homo sapiens
aaaacactgcaaagctgattgg

SEQ ID NO: 9284608 - DNA, 22 bp, Homo sapiens
aaaacactgcaaagctgattgg

SEQ ID NO: 9284609 - DNA, 22 bp, Homo sapiens
aaatacacgtacatgtgtaaaa

SEQ ID NO: 9284610 - DNA, 21 bp, Homo sapiens
acacttcagtttttaaaggga

SEQ ID NO: 9284611 - DNA, 22 bp, Homo sapiens
acacttcaggactctggggcaa

SEQ ID NO: 9284612 - DNA, 22 bp, Homo sapiens
acacttcatagcaaggttggag

SEQ ID NO: 9284613 - DNA, 22 bp, Homo sapiens
acacttcatgcattcttcactc

SEQ ID NO: 9284614 - DNA, 22 bp, Homo sapiens
aatattgagaaccagcatgttt

SEQ ID NO: 9284615 - DNA, 22 bp, Homo sapiens
aatgcacctaccttgattctgc

SEQ ID NO: 9284616 - DNA, 22 bp, Homo sapiens
aacagtgtcaggattacagata

SEQ ID NO: 9284617 - DNA, 22 bp, Homo sapiens
aacagtgtttttcttcagcact

SEQ ID NO: 9284618 - DNA, 19 bp, Homo sapiens
acaaagtgcgtgctctttt

SEQ ID NO: 9284619 - DNA, 22 bp, Homo sapiens
agcaaatacttgaataaaaaga

SEQ ID NO: 9284620 - DNA, 22 bp, Homo sapiens
acagcagatctgtggagcttat

SEQ ID NO: 9284621 - DNA, 22 bp, Homo sapiens
acagcagagtgtgagatagcca

SEQ ID NO: 9284622 - DNA, 23 bp, Homo sapiens
acacttcacccattgtgatagga

SEQ ID NO: 9284623 - DNA, 22 bp, Homo sapiens
acacttcaaatggttggaaaat

SEQ ID NO: 9284624 - DNA, 22 bp, Homo sapiens
acacttcaaagggtgacttgat

SEQ ID NO: 9284625 - DNA, 22 bp, Homo sapiens
aagtagacaataataagacatg

SEQ ID NO: 9284626 - DNA, 22 bp, Homo sapiens
aagtagacttttgcatcaagga

SEQ ID NO: 9284627 - DNA, 22 bp, Homo sapiens
aagtagacagtcatctactttg

SEQ ID NO: 9284628 - DNA, 22 bp, Homo sapiens
acatttcagcgtgcatgacatg

SEQ ID NO: 9284629 - DNA, 22 bp, Homo sapiens
actttgtttccatatttgtagc

SEQ ID NO: 9284630 - DNA, 22 bp, Homo sapiens
tcagcaaggctgcattctcatc

SEQ ID NO: 9284631 - DNA, 22 bp, Homo sapiens
tcagcaagtattttctgaatgc

SEQ ID NO: 9284632 - DNA, 22 bp, Homo sapiens
tcagcactggcgctgggcaggt

SEQ ID NO: 9284633 - DNA, 22 bp, Homo sapiens
tcagcactgtctattagtgaga

SEQ ID NO: 9284634 - DNA, 22 bp, Homo sapiens
tcagcacttactagtggccttt

SEQ ID NO: 9284635 - DNA, 22 bp, Homo sapiens
tcagcactcgctacctagtaaa

SEQ ID NO: 9284636 - DNA, 22 bp, Homo sapiens
tcacaaagtgaagtgtgtcatg

SEQ ID NO: 9284637 - DNA, 22 bp, Homo sapiens
tcaataagtaggatatcaagat

SEQ ID NO: 9284638 - DNA, 22 bp, Homo sapiens
tcaagacatattaaatgtgcga

SEQ ID NO: 9284639 - DNA, 21 bp, Homo sapiens
tcaagacagcatatttaagaa

SEQ ID NO: 9284640 - DNA, 22 bp, Homo sapiens
tcagtgttaatcagtggtacct

SEQ ID NO: 9284641 - DNA, 22 bp, Homo sapiens
tcagtgttagacaagtttggaa

SEQ ID NO: 9284642 - DNA, 22 bp, Homo sapiens
tcagtgttacattatatagaac

SEQ ID NO: 9284643 - DNA, 22 bp, Homo sapiens
tcagtgttcgctcagggactcc

SEQ ID NO: 9284644 - DNA, 22 bp, Homo sapiens
tcagtgttattagatgaggttt

SEQ ID NO: 9284645 - DNA, 22 bp, Homo sapiens
tcagtgttcagggaccaggtcc

SEQ ID NO: 9284646 - DNA, 16 bp, Homo sapiens
tcagtgttccagaata

SEQ ID NO: 9284647 - DNA, 22 bp, Homo sapiens
tcagtgttcagcggtgtgtgca

SEQ ID NO: 9284648 - DNA, 23 bp, Homo sapiens
tcatggaactgggcaatcttgaa

SEQ ID NO: 9284649 - DNA, 22 bp, Homo sapiens
tcagcctgctccaagtgctgcc

SEQ ID NO: 9284650 - DNA, 22 bp, Homo sapiens
tcagctctctgggctcgaacct

SEQ ID NO: 9284651 - DNA, 22 bp, Homo sapiens
tcagctctcacagatctcaacc

SEQ ID NO: 9284652 - DNA, 22 bp, Homo sapiens
tcagctctacctgggagctgtc

SEQ ID NO: 9284653 - DNA, 22 bp, Homo sapiens
tccaggctgcaaggccacaggg

SEQ ID NO: 9284654 - DNA, 22 bp, Homo sapiens
tcccaagtagatgggaatacag

SEQ ID NO: 9284655 - DNA, 22 bp, Homo sapiens
tccagcctttctactcactgag

SEQ ID NO: 9284656 - DNA, 21 bp, Homo sapiens
tccagcctttccctcacttcc

SEQ ID NO: 9284657 - DNA, 22 bp, Homo sapiens
tagaattgggcctaacttccat

SEQ ID NO: 9284658 - DNA, 22 bp, Homo sapiens
tagaaacatgttctgttctgtt

SEQ ID NO: 9284659 - DNA, 22 bp, Homo sapiens
tagaaacattcagttgcagtcc

SEQ ID NO: 9284660 - DNA, 22 bp, Homo sapiens
tagaaacaagtttctctttggg

SEQ ID NO: 9284661 - DNA, 22 bp, Homo sapiens
tagaaacaatgacatgcttgta

SEQ ID NO: 9284662 - DNA, 22 bp, Homo sapiens
tagaaacacagatctggtgtca

SEQ ID NO: 9284663 - DNA, 22 bp, Homo sapiens
tattgaattagaccctaaaatg

SEQ ID NO: 9284664 - DNA, 22 bp, Homo sapiens
tattcatgagataggcagtttt

SEQ ID NO: 9284665 - DNA, 22 bp, Homo sapiens
tatgtacataacatgaaatgca

SEQ ID NO: 9284666 - DNA, 22 bp, Homo sapiens
tatgtcctgctactctctcatg

SEQ ID NO: 9284667 - DNA, 22 bp, Homo sapiens
tacatttgctttgattttcagc

SEQ ID NO: 9284668 - DNA, 22 bp, Homo sapiens
gtttcaggtttaggcacctgga

SEQ ID NO: 9284669 - DNA, 22 bp, Homo sapiens
gttgcctaggctggtcttgaac

SEQ ID NO: 9284670 - DNA, 22 bp, Homo sapiens
gttcagcacaggtgctcagaca

SEQ ID NO: 9284671 - DNA, 22 bp, Homo sapiens
gttcacaaaattctggccagtg

SEQ ID NO: 9284672 - DNA, 22 bp, Homo sapiens
gtgtgggacgggtgagtggcca

SEQ ID NO: 9284673 - DNA, 22 bp, Homo sapiens
gtgtgggaatggcggtcgtgca

SEQ ID NO: 9284674 - DNA, 22 bp, Homo sapiens
gtgtgggaaggctaggatgctg

SEQ ID NO: 9284675 - DNA, 22 bp, Homo sapiens
gtcctggggaatacagaagccg

SEQ ID NO: 9284676 - DNA, 22 bp, Homo sapiens
gtcctgggcctgctgaggctga

SEQ ID NO: 9284677 - DNA, 23 bp, Homo sapiens
gtaaaatacgcagtgcagtgtga

SEQ ID NO: 9284678 - DNA, 22 bp, Homo sapiens
gtccaagtcttccttcccaaac

SEQ ID NO: 9284679 - DNA, 22 bp, Homo sapiens
gtccaagtacatgtgtgtacat

SEQ ID NO: 9284680 - DNA, 22 bp, Homo sapiens
gtatttcatcttgaaaaccagt

SEQ ID NO: 9284681 - DNA, 19 bp, Homo sapiens
gtatttcaggacaagacgt

SEQ ID NO: 9284682 - DNA, 18 bp, Homo sapiens
ggtggcggggatggaggt

SEQ ID NO: 9284683 - DNA, 22 bp, Homo sapiens
ggtgtggatcatctgaggtcag

SEQ ID NO: 9284684 - DNA, 22 bp, Homo sapiens
ggtgtgggccctgatgtcagca

SEQ ID NO: 9284685 - DNA, 22 bp, Homo sapiens
ggtcagcaatttggactgggct

SEQ ID NO: 9284686 - DNA, 22 bp, Homo sapiens
ggtcagcagtgcagggcagagc

SEQ ID NO: 9284687 - DNA, 20 bp, Homo sapiens
gggtggagttgcggtctgtg

SEQ ID NO: 9284688 - DNA, 22 bp, Homo sapiens
gggtagggtgacttaggctggc

SEQ ID NO: 9284689 - DNA, 22 bp, Homo sapiens
ggggtgggcgtgcagggacacc

SEQ ID NO: 9284690 - DNA, 22 bp, Homo sapiens
ggggtggggttactcattgtgc

SEQ ID NO: 9284691 - DNA, 22 bp, Homo sapiens
ggggaagagcattgcacggtgt

SEQ ID NO: 9284692 - DNA, 22 bp, Homo sapiens
ggggaagaggcgtgatggatcc

SEQ ID NO: 9284693 - DNA, 22 bp, Homo sapiens
ggggaagatggccctccatgtg

SEQ ID NO: 9284694 - DNA, 22 bp, Homo sapiens
gggctgaggctaccactggtct

SEQ ID NO: 9284695 - DNA, 22 bp, Homo sapiens
gggctgagctgttctgagttta

SEQ ID NO: 9284696 - DNA, 22 bp, Homo sapiens
gggctgagattggtgccctgtc

SEQ ID NO: 9284697 - DNA, 22 bp, Homo sapiens
ggagtgagtactggagtagctg

SEQ ID NO: 9284698 - DNA, 22 bp, Homo sapiens
ggctgggaggccgtgctgacct

SEQ ID NO: 9284699 - DNA, 22 bp, Homo sapiens
gggatggggagctggaaagggg

SEQ ID NO: 9284700 - DNA, 22 bp, Homo sapiens
gggatggggtcgggaccctgct

SEQ ID NO: 9284701 - DNA, 22 bp, Homo sapiens
gggagagagaaaacgtggcgca

SEQ ID NO: 9284702 - DNA, 22 bp, Homo sapiens
gggagagagagctcatgttgaa

SEQ ID NO: 9284703 - DNA, 20 bp, Homo sapiens
gggagacagggccagtgtcc

SEQ ID NO: 9284704 - DNA, 22 bp, Homo sapiens
gggagacagttcagatagtttc

SEQ ID NO: 9284705 - DNA, 22 bp, Homo sapiens
gggagacacgctgcaggcataa

SEQ ID NO: 9284706 - DNA, 22 bp, Homo sapiens
gggagacacttgctttagaggg

SEQ ID NO: 9284707 - DNA, 19 bp, Homo sapiens
gggagacagctctgggctg

SEQ ID NO: 9284708 - DNA, 22 bp, Homo sapiens
gggagacaaggagaaccaaaga

SEQ ID NO: 9284709 - DNA, 22 bp, Homo sapiens
gggagacaaaggtgaggttctt

SEQ ID NO: 9284710 - DNA, 22 bp, Homo sapiens
gggagacaagaagtagcctgct

SEQ ID NO: 9284711 - DNA, 22 bp, Homo sapiens
ggaagaggctggtagtgcccgt

SEQ ID NO: 9284712 - DNA, 22 bp, Homo sapiens
ggaagcaaaatcatcagtcatt

SEQ ID NO: 9284713 - DNA, 22 bp, Homo sapiens
ggaagcaaattccagaaccaca

SEQ ID NO: 9284714 - DNA, 22 bp, Homo sapiens
ggaagaggaggagccaggcttt

SEQ ID NO: 9284715 - DNA, 22 bp, Homo sapiens
ggaagaggctgagccaggtccc

SEQ ID NO: 9284716 - DNA, 22 bp, Homo sapiens
ggaagaggctgaggccatgctg

SEQ ID NO: 9284717 - DNA, 20 bp, Homo sapiens
gctttctatgagatggactg

SEQ ID NO: 9284718 - DNA, 22 bp, Homo sapiens
ggagacagtggtagggcctaag

SEQ ID NO: 9284719 - DNA, 22 bp, Homo sapiens
ggagacagtgacttagagactg

SEQ ID NO: 9284720 - DNA, 22 bp, Homo sapiens
ggagcaggctctgtggtttcca

SEQ ID NO: 9284721 - DNA, 22 bp, Homo sapiens
ggagacagtatggcttgtagct

SEQ ID NO: 9284722 - DNA, 22 bp, Homo sapiens
ggagacagggttgaaccacgca

SEQ ID NO: 9284723 - DNA, 22 bp, Homo sapiens
gctggggagggcgtcaaggcca

SEQ ID NO: 9284724 - DNA, 22 bp, Homo sapiens
gctggagaaactgcagctgagg

SEQ ID NO: 9284725 - DNA, 23 bp, Homo sapiens
gctcagcctcagcaggcccagga

SEQ ID NO: 9284726 - DNA, 22 bp, Homo sapiens
gctcagccgaacttcagagcag

SEQ ID NO: 9284727 - DNA, 22 bp, Homo sapiens
gcgtctcaaggcccccaggcca

SEQ ID NO: 9284728 - DNA, 22 bp, Homo sapiens
gcggtggggaaaggaggtgctg

SEQ ID NO: 9284729 - DNA, 22 bp, Homo sapiens
gcggtgggggaaaggagcggtt

SEQ ID NO: 9284730 - DNA, 22 bp, Homo sapiens
gccagggttcgaatccgtatgg

SEQ ID NO: 9284731 - DNA, 22 bp, Homo sapiens
gcccagccctgaggtcacagct

SEQ ID NO: 9284732 - DNA, 22 bp, Homo sapiens
cttcctctgaggcttctgagtc

SEQ ID NO: 9284733 - DNA, 22 bp, Homo sapiens
cttgacactgtcactcaggcca

SEQ ID NO: 9284734 - DNA, 22 bp, Homo sapiens
ctggctcactagccctgccctg

SEQ ID NO: 9284735 - DNA, 22 bp, Homo sapiens
ctggctcatagagcagctccaa

SEQ ID NO: 9284736 - DNA, 22 bp, Homo sapiens
gagaggctgtgtgccattgttg

SEQ ID NO: 9284737 - DNA, 22 bp, Homo sapiens
gacctcatgatccacctgcctt

SEQ ID NO: 9284738 - DNA, 22 bp, Homo sapiens
gagattctcgagggcttccagc

SEQ ID NO: 9284739 - DNA, 22 bp, Homo sapiens
gagcagcctgaggagcgtgggc

SEQ ID NO: 9284740 - DNA, 22 bp, Homo sapiens
ctctcctggtgtggaggacagg

SEQ ID NO: 9284741 - DNA, 22 bp, Homo sapiens
tttccttgttattatttgtcct

SEQ ID NO: 9284742 - DNA, 18 bp, Homo sapiens
tttccttgtatgaacata

SEQ ID NO: 9284743 - DNA, 22 bp, Homo sapiens
tttccttgcctcctgtccttct

SEQ ID NO: 9284744 - DNA, 22 bp, Homo sapiens
tttccttgggtctcttagtggc

SEQ ID NO: 9284745 - DNA, 22 bp, Homo sapiens
tttccactgtagagatgttgaa

SEQ ID NO: 9284746 - DNA, 22 bp, Homo sapiens
tttcacaaatgtctttaacttg

SEQ ID NO: 9284747 - DNA, 22 bp, Homo sapiens
ctccaagtcggctgcagctgga

SEQ ID NO: 9284748 - DNA, 22 bp, Homo sapiens
ctcttcaaaagatgtattagaa

SEQ ID NO: 9284749 - DNA, 21 bp, Homo sapiens
ctcttcagtggtgagctcttc

SEQ ID NO: 9284750 - DNA, 22 bp, Homo sapiens
ctcttcagttcacccctaagca

SEQ ID NO: 9284751 - DNA, 22 bp, Homo sapiens
ctcttcagttggtcactattct

SEQ ID NO: 9284752 - DNA, 22 bp, Homo sapiens
ctcttcaacagagcagaaggct

SEQ ID NO: 9284753 - DNA, 22 bp, Homo sapiens
ctcttcaatagattgttgaggg

SEQ ID NO: 9284754 - DNA, 22 bp, Homo sapiens
ctcttcagatatacagtactct

SEQ ID NO: 9284755 - DNA, 22 bp, Homo sapiens
ttttcagttactgtttatgtga

SEQ ID NO: 9284756 - DNA, 22 bp, Homo sapiens
ttttcaggtgcagtaatcatat

SEQ ID NO: 9284757 - DNA, 22 bp, Homo sapiens
tttccttgttcatttgccctat

SEQ ID NO: 9284758 - DNA, 22 bp, Homo sapiens
ctgagcctcctgcttctatttc

SEQ ID NO: 9284759 - DNA, 22 bp, Homo sapiens
ccttcctttcagggctatgcct

SEQ ID NO: 9284760 - DNA, 22 bp, Homo sapiens
ccttccttgagaagcaattcct

SEQ ID NO: 9284761 - DNA, 22 bp, Homo sapiens
ttagaaaaatgttcagtagttt

SEQ ID NO: 9284762 - DNA, 22 bp, Homo sapiens
ccttcctcatccatttctcttg

SEQ ID NO: 9284763 - DNA, 22 bp, Homo sapiens
cctggtttcaggaacataatct

SEQ ID NO: 9284764 - DNA, 22 bp, Homo sapiens
tgtgttctgaaggagaagagtg

SEQ ID NO: 9284765 - DNA, 20 bp, Homo sapiens
ttcctggctctaggaccttg

SEQ ID NO: 9284766 - DNA, 22 bp, Homo sapiens
ttcacaatttcccttcatcagg

SEQ ID NO: 9284767 - DNA, 22 bp, Homo sapiens
ttcagcaaaatatctcagatag

SEQ ID NO: 9284768 - DNA, 22 bp, Homo sapiens
ttcatgaatgttccatgtgagt

SEQ ID NO: 9284769 - DNA, 22 bp, Homo sapiens
caggctgggaacgccacccgct

SEQ ID NO: 9284770 - DNA, 20 bp, Homo sapiens
tacaaacctccacactggtg

SEQ ID NO: 9284771 - DNA, 19 bp, Homo sapiens
taagtatgtactatcttgc

SEQ ID NO: 9284772 - DNA, 22 bp, Homo sapiens
gtgcttcctctgccaacactct

SEQ ID NO: 9284773 - DNA, 22 bp, Homo sapiens
caggtgggtgtatgaatgcaaa

SEQ ID NO: 9284774 - DNA, 22 bp, Homo sapiens
cagggtttcaccatgttagcag

SEQ ID NO: 9284775 - DNA, 22 bp, Homo sapiens
ccaaggctggagtgcagtggcg

SEQ ID NO: 9284776 - DNA, 22 bp, Homo sapiens
ccaaggctgtggggctgtgcag

SEQ ID NO: 9284777 - DNA, 22 bp, Homo sapiens
tcctgtttttgtaatcgactct

SEQ ID NO: 9284778 - DNA, 22 bp, Homo sapiens
tgccatattgcaaagtgtctgc

SEQ ID NO: 9284779 - DNA, 22 bp, Homo sapiens
tgccagcttttgactatcttag

SEQ ID NO: 9284780 - DNA, 19 bp, Homo sapiens
tgccacagataaaaactga

SEQ ID NO: 9284781 - DNA, 22 bp, Homo sapiens
tgccagctcccttttctcctcc

SEQ ID NO: 9284782 - DNA, 22 bp, Homo sapiens
tgcctgttaagggtgtagatat

SEQ ID NO: 9284783 - DNA, 22 bp, Homo sapiens
tgcctgttattgttggcttagt

SEQ ID NO: 9284784 - DNA, 22 bp, Homo sapiens
tggaatggaaacaaactgagga

SEQ ID NO: 9284785 - DNA, 22 bp, Homo sapiens
ccccaaagctgagttcccgcct

SEQ ID NO: 9284786 - DNA, 22 bp, Homo sapiens
cccattccctttactgttgcat

SEQ ID NO: 9284787 - DNA, 18 bp, Homo sapiens
cctagcctccaagctcat

SEQ ID NO: 9284788 - DNA, 21 bp, Homo sapiens
cctagcctcttacccagcttt

SEQ ID NO: 9284789 - DNA, 21 bp, Homo sapiens
cccttcttgggtcaaagtata

SEQ ID NO: 9284790 - DNA, 17 bp, Homo sapiens
cctcagcttctttcctc

SEQ ID NO: 9284791 - DNA, 22 bp, Homo sapiens
tggcctggctcacagtgagatt

SEQ ID NO: 9284792 - DNA, 22 bp, Homo sapiens
cctcttctaggacgtccttgtg

SEQ ID NO: 9284793 - DNA, 22 bp, Homo sapiens
ccaggctgaatatgttccaggg

SEQ ID NO: 9284794 - DNA, 22 bp, Homo sapiens
ccaggcctggaccatgccaggg

SEQ ID NO: 9284795 - DNA, 22 bp, Homo sapiens
ccagctctgcatgtttcccttg

SEQ ID NO: 9284796 - DNA, 22 bp, Homo sapiens
ccagctctctttgaagcataaa

SEQ ID NO: 9284797 - DNA, 22 bp, Homo sapiens
ccagctctctgcagaaaggact

SEQ ID NO: 9284798 - DNA, 22 bp, Homo sapiens
tctgggagcagctcagcagatt

SEQ ID NO: 9284799 - DNA, 22 bp, Homo sapiens
tctggtgtcagtattctttgaa

SEQ ID NO: 9284800 - DNA, 22 bp, Homo sapiens
tctggtagaagaagtgaagctg

SEQ ID NO: 9284801 - DNA, 22 bp, Homo sapiens
ccaggctggattttgcagttca

SEQ ID NO: 9284802 - DNA, 22 bp, Homo sapiens
ccaggctggagtgcagtagtgt

SEQ ID NO: 9284803 - DNA, 21 bp, Homo sapiens
tgaatgcttcgtcatcctggc

SEQ ID NO: 9284804 - DNA, 22 bp, Homo sapiens
ccatgcctggactccactctca

SEQ ID NO: 9284805 - DNA, 22 bp, Homo sapiens
ccatgctgggatgctccaagtg

SEQ ID NO: 9284806 - DNA, 22 bp, Homo sapiens
ccagtgtttgatgggattttca

SEQ ID NO: 9284807 - DNA, 22 bp, Homo sapiens
ccagtgttttcatcctcccttg

SEQ ID NO: 9284808 - DNA, 22 bp, Homo sapiens
ccagtgtttccccagaagagag

SEQ ID NO: 9284809 - DNA, 22 bp, Homo sapiens
ccagtgtttccgtcagtacacg

SEQ ID NO: 9284810 - DNA, 22 bp, Homo sapiens
ccagtgttgaacagtatttgga

SEQ ID NO: 9284811 - DNA, 22 bp, Homo sapiens
ccagtgttctggtgttcatttc

SEQ ID NO: 9284812 - DNA, 22 bp, Homo sapiens
ccagtgttccatggagtgatta

SEQ ID NO: 9284813 - DNA, 22 bp, Homo sapiens
ccagtgttccctcgggttcatg

SEQ ID NO: 9284814 - DNA, 22 bp, Homo sapiens
ccagtgttccagagagctgatg

SEQ ID NO: 9284815 - DNA, 22 bp, Homo sapiens
ccagtgtttaggaataaaatgt

SEQ ID NO: 9284816 - DNA, 22 bp, Homo sapiens
ccagtgttggaggatggcttgc

SEQ ID NO: 9284817 - DNA, 22 bp, Homo sapiens
ccagtgtttacagttgaacaaa

SEQ ID NO: 9284818 - DNA, 22 bp, Homo sapiens
ccagtgttgcataggatgggga

SEQ ID NO: 9284819 - DNA, 20 bp, Homo sapiens
cccagaagcttaacagagca

SEQ ID NO: 9284820 - DNA, 22 bp, Homo sapiens
tttctattgtaagtctcctata

SEQ ID NO: 9284821 - DNA, 22 bp, Homo sapiens
tttcctggttggggacgtggtt

SEQ ID NO: 9284822 - DNA, 22 bp, Homo sapiens
tttcaggattagtttaagcagg

SEQ ID NO: 9284823 - DNA, 19 bp, Homo sapiens
tttcaggagctatgcaggg

SEQ ID NO: 9284824 - DNA, 22 bp, Homo sapiens
tttcagctgctgactagttgta

SEQ ID NO: 9284825 - DNA, 20 bp, Homo sapiens
tttcttgtcggctgttgctg

SEQ ID NO: 9284826 - DNA, 20 bp, Homo sapiens
tttcttgtacttggagaagg

SEQ ID NO: 9284827 - DNA, 22 bp, Homo sapiens
tttatttcttagtttgccacag

SEQ ID NO: 9284828 - DNA, 22 bp, Homo sapiens
ttgtgtttcccttgcatattcc

SEQ ID NO: 9284829 - DNA, 22 bp, Homo sapiens
ttgcaagatgttaccattgtta

SEQ ID NO: 9284830 - DNA, 23 bp, Homo sapiens
ttttcctttggacaggctgtatt

SEQ ID NO: 9284831 - DNA, 18 bp, Homo sapiens
tgtggtggagctgccttc

SEQ ID NO: 9284832 - DNA, 21 bp, Homo sapiens
tgtgttcttctaggtcagcta

SEQ ID NO: 9284833 - DNA, 22 bp, Homo sapiens
ttactggctgggcctgagggct

SEQ ID NO: 9284834 - DNA, 22 bp, Homo sapiens
ttacatcagcaagagtgtatgt

SEQ ID NO: 9284835 - DNA, 22 bp, Homo sapiens
ttacagtattgttaaactcttt

SEQ ID NO: 9284836 - DNA, 22 bp, Homo sapiens
ttaagaatgtgccttttggttg

SEQ ID NO: 9284837 - DNA, 20 bp, Homo sapiens
ttaagaaaagcacatcctgc

SEQ ID NO: 9284838 - DNA, 22 bp, Homo sapiens
ttcatggatcatgccttttgtg

SEQ ID NO: 9284839 - DNA, 22 bp, Homo sapiens
ttcacaaaaatgctgaacagtt

SEQ ID NO: 9284840 - DNA, 22 bp, Homo sapiens
ttcacaaaacactattttctgg

SEQ ID NO: 9284841 - DNA, 22 bp, Homo sapiens
ttcaagaagcccaaagactagc

SEQ ID NO: 9284842 - DNA, 22 bp, Homo sapiens
ttcacaaagctggagcatttcc

SEQ ID NO: 9284843 - DNA, 22 bp, Homo sapiens
ttcacaaagctggttccttctg

SEQ ID NO: 9284844 - DNA, 22 bp, Homo sapiens
ttcaacaaaatatatttttcca

SEQ ID NO: 9284845 - DNA, 22 bp, Homo sapiens
ttcaacaaatatttattgagct

SEQ ID NO: 9284846 - DNA, 22 bp, Homo sapiens
ttcaacaagtatttattgagca

SEQ ID NO: 9284847 - DNA, 22 bp, Homo sapiens
ttgagtctctgccaaaacacaa

SEQ ID NO: 9284848 - DNA, 22 bp, Homo sapiens
ttctttcagaacacaagtgatt

SEQ ID NO: 9284849 - DNA, 22 bp, Homo sapiens
cattaaaatatctcatggtgtt

SEQ ID NO: 9284850 - DNA, 22 bp, Homo sapiens
ccaagctgactgtgctgttgtg

SEQ ID NO: 9284851 - DNA, 22 bp, Homo sapiens
caggtgggagcgaggagctact

SEQ ID NO: 9284852 - DNA, 22 bp, Homo sapiens
caggtgggaccatgatagggca

SEQ ID NO: 9284853 - DNA, 22 bp, Homo sapiens
caggtgagaggcggtcctgcat

SEQ ID NO: 9284854 - DNA, 22 bp, Homo sapiens
cagctctgtaaattccttcatc

SEQ ID NO: 9284855 - DNA, 22 bp, Homo sapiens
aggctcagttctgtggtgagcc

SEQ ID NO: 9284856 - DNA, 22 bp, Homo sapiens
ccagcttttcttatcattataa

SEQ ID NO: 9284857 - DNA, 19 bp, Homo sapiens
ccagcctctcttccacccc

SEQ ID NO: 9284858 - DNA, 22 bp, Homo sapiens
aggcttgacaattttacatgta

SEQ ID NO: 9284859 - DNA, 22 bp, Homo sapiens
aggcttgatttgtcctgcttaa

SEQ ID NO: 9284860 - DNA, 22 bp, Homo sapiens
agggatgatcagggtagaggct

SEQ ID NO: 9284861 - DNA, 22 bp, Homo sapiens
agggatgatttcagtgtctgcc

SEQ ID NO: 9284862 - DNA, 20 bp, Homo sapiens
agggcagagggattacaggc

SEQ ID NO: 9284863 - DNA, 22 bp, Homo sapiens
agggcagaggcggacacggaag

SEQ ID NO: 9284864 - DNA, 22 bp, Homo sapiens
agggcagagattaattaagaca

SEQ ID NO: 9284865 - DNA, 22 bp, Homo sapiens
agtcagcaccccagcggggtca

SEQ ID NO: 9284866 - DNA, 22 bp, Homo sapiens
aggttccaagaaatcatcagtg

SEQ ID NO: 9284867 - DNA, 22 bp, Homo sapiens
agtgcacagcctgctgcagaat

SEQ ID NO: 9284868 - DNA, 22 bp, Homo sapiens
agtggggaagagcatgggccct

SEQ ID NO: 9284869 - DNA, 22 bp, Homo sapiens
agtggggacttatgccagcatt

SEQ ID NO: 9284870 - DNA, 22 bp, Homo sapiens
agtggggaggtccaggccaccc

SEQ ID NO: 9284871 - DNA, 22 bp, Homo sapiens
agtgttcatttattcattcact

SEQ ID NO: 9284872 - DNA, 17 bp, Homo sapiens
ctggggatgtgggactc

SEQ ID NO: 9284873 - DNA, 22 bp, Homo sapiens
cttcataattaccttgtctgcc

SEQ ID NO: 9284874 - DNA, 22 bp, Homo sapiens
cacaaatcattccatcattctt

SEQ ID NO: 9284875 - DNA, 22 bp, Homo sapiens
caaagtgctaggattacaggcg

SEQ ID NO: 9284876 - DNA, 22 bp, Homo sapiens
caaagtcctagaacagtgcttg

SEQ ID NO: 9284877 - DNA, 22 bp, Homo sapiens
caaagtgctaggattacaggcc

SEQ ID NO: 9284878 - DNA, 22 bp, Homo sapiens
cactccctctagttgcattctg

SEQ ID NO: 9284879 - DNA, 19 bp, Homo sapiens
cacttcaatcctttatcaa

SEQ ID NO: 9284880 - DNA, 22 bp, Homo sapiens
cacttcaaggaatatctagaaa

SEQ ID NO: 9284881 - DNA, 22 bp, Homo sapiens
cacttcaattaacttcagcatt

SEQ ID NO: 9284882 - DNA, 22 bp, Homo sapiens
cacttcaatctctgcctccatc

SEQ ID NO: 9284883 - DNA, 22 bp, Homo sapiens
cacttcaaataagctcttctca

SEQ ID NO: 9284884 - DNA, 22 bp, Homo sapiens
cacttcaacagttatttcttag

SEQ ID NO: 9284885 - DNA, 22 bp, Homo sapiens
cacttcaaatatggcttcatga

SEQ ID NO: 9284886 - DNA, 22 bp, Homo sapiens
cacttcaagagcaagggtgcca

SEQ ID NO: 9284887 - DNA, 22 bp, Homo sapiens
cacttcaacctctgagtcctgg

SEQ ID NO: 9284888 - DNA, 22 bp, Homo sapiens
gggttccaaacatagtcttcct

SEQ ID NO: 9284889 - DNA, 22 bp, Homo sapiens
gggtgggatctgtggagcctca

SEQ ID NO: 9284890 - DNA, 22 bp, Homo sapiens
gtcagcagcatgtttaatcaaa

SEQ ID NO: 9284891 - DNA, 21 bp, Homo sapiens
gtcagcagatccagcacttgt

SEQ ID NO: 9284892 - DNA, 17 bp, Homo sapiens
gtcagcagcttgcttgt

SEQ ID NO: 9284893 - DNA, 22 bp, Homo sapiens
cagattcactaatagctggcct

SEQ ID NO: 9284894 - DNA, 22 bp, Homo sapiens
atgagctgggccatccagtgat

SEQ ID NO: 9284895 - DNA, 22 bp, Homo sapiens
ctttgggcaaagggccaattcg

SEQ ID NO: 9284896 - DNA, 22 bp, Homo sapiens
atgtgctgagtgtgtatataca

SEQ ID NO: 9284897 - DNA, 22 bp, Homo sapiens
atgctgggacgtacttgttcat

SEQ ID NO: 9284898 - DNA, 22 bp, Homo sapiens
attataggcttgagccaccgtg

SEQ ID NO: 9284899 - DNA, 22 bp, Homo sapiens
attttgcacactatgcagcttt

SEQ ID NO: 9284900 - DNA, 22 bp, Homo sapiens
attttcagttgaaaaagttggt

SEQ ID NO: 9284901 - DNA, 22 bp, Homo sapiens
atttcaaggctacagaaacctt

SEQ ID NO: 9284902 - DNA, 22 bp, Homo sapiens
aagcacagggactcaggaccgg

SEQ ID NO: 9284903 - DNA, 22 bp, Homo sapiens
aacggctgtggctggcggcagc

SEQ ID NO: 9284904 - DNA, 22 bp, Homo sapiens
aacttaaacccactcatgtaga

SEQ ID NO: 9284905 - DNA, 22 bp, Homo sapiens
aaccaccattctctcctcttcc

SEQ ID NO: 9284906 - DNA, 22 bp, Homo sapiens
aaaatcttgactgtttttagaa

SEQ ID NO: 9284907 - DNA, 22 bp, Homo sapiens
aaacactttagaaagggacttg

SEQ ID NO: 9284908 - DNA, 22 bp, Homo sapiens
aaacaagagtcttgctccacct

SEQ ID NO: 9284909 - DNA, 22 bp, Homo sapiens
aaacctttaccagactagcaag

SEQ ID NO: 9284910 - DNA, 22 bp, Homo sapiens
aagtcacattctgaggtattgg

SEQ ID NO: 9284911 - DNA, 18 bp, Homo sapiens
aagtcacccctgctccct

SEQ ID NO: 9284912 - DNA, 22 bp, Homo sapiens
aatcataattgtatacattcat

SEQ ID NO: 9284913 - DNA, 22 bp, Homo sapiens
acatgtgtggacatgaatctac

SEQ ID NO: 9284914 - DNA, 22 bp, Homo sapiens
acatgtgtctaagaatgaaaga

SEQ ID NO: 9284915 - DNA, 22 bp, Homo sapiens
aagggagaaagaatgagtttag

SEQ ID NO: 9284916 - DNA, 22 bp, Homo sapiens
accatgccagtggcagccagac

SEQ ID NO: 9284917 - DNA, 22 bp, Homo sapiens
aaggtgggcagatcacaaggtc

SEQ ID NO: 9284918 - DNA, 22 bp, Homo sapiens
aaggtggggtcctgtcatctga

SEQ ID NO: 9284919 - DNA, 22 bp, Homo sapiens
aaggcagttcactcacgcagcc

SEQ ID NO: 9284920 - DNA, 22 bp, Homo sapiens
acaattctgatggtttcccagt

SEQ ID NO: 9284921 - DNA, 18 bp, Homo sapiens
acactgcagcagtctgct

SEQ ID NO: 9284922 - DNA, 23 bp, Homo sapiens
agacactgtaaagaattgcagtt

SEQ ID NO: 9284923 - DNA, 22 bp, Homo sapiens
agcaagattgaggcttcctcag

SEQ ID NO: 9284924 - DNA, 22 bp, Homo sapiens
acaatgtttttgttcaaagagt

SEQ ID NO: 9284925 - DNA, 22 bp, Homo sapiens
acaaacagagttgaaaaatagg

SEQ ID NO: 9284926 - DNA, 22 bp, Homo sapiens
aattttcacagtgctgtgagat

SEQ ID NO: 9284927 - DNA, 22 bp, Homo sapiens
agtgttcttcttcaaagctctg

SEQ ID NO: 9284928 - DNA, 22 bp, Homo sapiens
agtgtttaatgccttttccagc

SEQ ID NO: 9284929 - DNA, 22 bp, Homo sapiens
atattcatcgtgtagaaatact

SEQ ID NO: 9284930 - DNA, 22 bp, Homo sapiens
agaaaataaattgatggtggaa

SEQ ID NO: 9284931 - DNA, 22 bp, Homo sapiens
ataatcctgctttttcactatt

SEQ ID NO: 9284932 - DNA, 22 bp, Homo sapiens
actgtcaggatggcagcttgtt

SEQ ID NO: 9284933 - DNA, 22 bp, Homo sapiens
atacatgttgagaaaatatctg

SEQ ID NO: 9284934 - DNA, 21 bp, Homo sapiens
acagttcatgataactccatc

SEQ ID NO: 9284935 - DNA, 22 bp, Homo sapiens
acatttctttctattcagtagc

SEQ ID NO: 9284936 - DNA, 22 bp, Homo sapiens
accaggctccccttggatcctg

SEQ ID NO: 9284937 - DNA, 22 bp, Homo sapiens
accaggctctgccagtgtttac

SEQ ID NO: 9284938 - DNA, 21 bp, Homo sapiens
agggcagattagctgtaagag

SEQ ID NO: 9284939 - DNA, 22 bp, Homo sapiens
agagatgaagggcattccccag

SEQ ID NO: 9284940 - DNA, 22 bp, Homo sapiens
atggggggatgaaggagtccaa

SEQ ID NO: 9284941 - DNA, 22 bp, Homo sapiens
atggggtggagtccgggcagcg

SEQ ID NO: 9284942 - DNA, 18 bp, Homo sapiens
agaattgctgcttcttct

SEQ ID NO: 9284943 - DNA, 22 bp, Homo sapiens
atttcacttagtgtaatgtctt

SEQ ID NO: 9284944 - DNA, 22 bp, Homo sapiens
atttcactcattcatgttactt

SEQ ID NO: 9284945 - DNA, 22 bp, Homo sapiens
atttcactcttaattgcttcct

SEQ ID NO: 9284946 - DNA, 22 bp, Homo sapiens
atttcctgggtctcactccaga

SEQ ID NO: 9284947 - DNA, 22 bp, Homo sapiens
atttcctggtaccaggctttct

SEQ ID NO: 9284948 - DNA, 22 bp, Homo sapiens
cactgctacctctgcctcccgg

SEQ ID NO: 9284949 - DNA, 22 bp, Homo sapiens
cacagtgtttgatttaggggcc

SEQ ID NO: 9284950 - DNA, 22 bp, Homo sapiens
caagcagaaatctagaactcca

SEQ ID NO: 9284951 - DNA, 22 bp, Homo sapiens
caagcactgttaggttgcttgc

SEQ ID NO: 9284952 - DNA, 22 bp, Homo sapiens
agcacatgcacagtgctacact

SEQ ID NO: 9284953 - DNA, 22 bp, Homo sapiens
caaattaccctcaacatctaga

SEQ ID NO: 9284954 - DNA, 22 bp, Homo sapiens
caaatattccaggtacatccct

SEQ ID NO: 9284955 - DNA, 22 bp, Homo sapiens
ggagctgtgttatccattccca

SEQ ID NO: 9284956 - DNA, 22 bp, Homo sapiens
ggacttacataattcagagcct

SEQ ID NO: 9284957 - DNA, 22 bp, Homo sapiens
gctagcctccattttattacta

SEQ ID NO: 9284958 - DNA, 22 bp, Homo sapiens
gcccgcgccagcctctccatct

SEQ ID NO: 9284959 - DNA, 22 bp, Homo sapiens
gcctggagacaaggacaaaggg

SEQ ID NO: 9284960 - DNA, 22 bp, Homo sapiens
gccaggctcagcagtcaacctg

SEQ ID NO: 9284961 - DNA, 22 bp, Homo sapiens
gccaggctcagtagcgattcct

SEQ ID NO: 9284962 - DNA, 22 bp, Homo sapiens
gcagtgtttttcaatgcttcca

SEQ ID NO: 9284963 - DNA, 22 bp, Homo sapiens
gcagtgttttacagaccagcat

SEQ ID NO: 9284964 - DNA, 22 bp, Homo sapiens
gcagtgtttgtgttctcacatg

SEQ ID NO: 9284965 - DNA, 22 bp, Homo sapiens
gcagtgttggcaggatggggct

SEQ ID NO: 9284966 - DNA, 22 bp, Homo sapiens
gcagtgttggtttgctctgcag

SEQ ID NO: 9284967 - DNA, 22 bp, Homo sapiens
gcagtgttgctaggtgcggtga

SEQ ID NO: 9284968 - DNA, 22 bp, Homo sapiens
gcagtgttgtgatccaggtctt

SEQ ID NO: 9284969 - DNA, 22 bp, Homo sapiens
gcagtgttgttaaaagattaga

SEQ ID NO: 9284970 - DNA, 22 bp, Homo sapiens
gcagtgtttcaaatcaaaggca

SEQ ID NO: 9284971 - DNA, 22 bp, Homo sapiens
gcagtgtttacatattagaaac

SEQ ID NO: 9284972 - DNA, 22 bp, Homo sapiens
gcagtgtttcccagagatggaa

SEQ ID NO: 9284973 - DNA, 22 bp, Homo sapiens
gcagtgtttcagtgctttttct

SEQ ID NO: 9284974 - DNA, 22 bp, Homo sapiens
gcagtgtttggatccatagcga

SEQ ID NO: 9284975 - DNA, 23 bp, Homo sapiens
gcagtgtttgcttcatcttatcc

SEQ ID NO: 9284976 - DNA, 22 bp, Homo sapiens
gtctttctatgatgaactgttg

SEQ ID NO: 9284977 - DNA, 22 bp, Homo sapiens
gtacaatagcagttttcccttt

SEQ ID NO: 9284978 - DNA, 22 bp, Homo sapiens
gtagggctcagtaaatactttg

SEQ ID NO: 9284979 - DNA, 22 bp, Homo sapiens
ggtgagggagtggaacgaggtg

SEQ ID NO: 9284980 - DNA, 22 bp, Homo sapiens
gggtggtgtattagagctgcag

SEQ ID NO: 9284981 - DNA, 22 bp, Homo sapiens
ggtggtggagccagctgggagt

SEQ ID NO: 9284982 - DNA, 22 bp, Homo sapiens
ggtggggagtcaggcattcttg

SEQ ID NO: 9284983 - DNA, 22 bp, Homo sapiens
ggtgggtgagccctgggagctg

SEQ ID NO: 9284984 - DNA, 22 bp, Homo sapiens
ggtggggccctggcactggtat

SEQ ID NO: 9284985 - DNA, 22 bp, Homo sapiens
ggtgggcaggcgaggcccaggt

SEQ ID NO: 9284986 - DNA, 22 bp, Homo sapiens
ggtggagagctggatgagaggt

SEQ ID NO: 9284987 - DNA, 22 bp, Homo sapiens
gggctgtgtgcccacttcccat

SEQ ID NO: 9284988 - DNA, 22 bp, Homo sapiens
ggggagaattacatggcgtgga

SEQ ID NO: 9284989 - DNA, 22 bp, Homo sapiens
ggggtggcctgtaggcagcatg

SEQ ID NO: 9284990 - DNA, 22 bp, Homo sapiens
ggggtgggagtgccatccttga

SEQ ID NO: 9284991 - DNA, 22 bp, Homo sapiens
ggggtaggcaggtgatctgatc

SEQ ID NO: 9284992 - DNA, 22 bp, Homo sapiens
gggtgaggccttgctgccatca

SEQ ID NO: 9284993 - DNA, 22 bp, Homo sapiens
gggtgaggcccatttgaggcca

SEQ ID NO: 9284994 - DNA, 22 bp, Homo sapiens
gggtggtggccagcagtgggca

SEQ ID NO: 9284995 - DNA, 22 bp, Homo sapiens
gggtggagagaaagaaacgtga

SEQ ID NO: 9284996 - DNA, 22 bp, Homo sapiens
gggagtggattatgtggaccca

SEQ ID NO: 9284997 - DNA, 22 bp, Homo sapiens
gggagtgggtttggcctaggcc

SEQ ID NO: 9284998 - DNA, 22 bp, Homo sapiens
gggcagagagctggaactcctt

SEQ ID NO: 9284999 - DNA, 22 bp, Homo sapiens
gggagatgactcagtgacctcg

SEQ ID NO: 9285000 - DNA, 22 bp, Homo sapiens
gggaagatagtgttgagggccc

SEQ ID NO: 9285001 - DNA, 22 bp, Homo sapiens
ggctgcaggttggttggcagct

SEQ ID NO: 9285002 - DNA, 22 bp, Homo sapiens
ggccacagcaatgctgtgatgt

SEQ ID NO: 9285003 - DNA, 22 bp, Homo sapiens
ggctcactgcaacttccgcctc

SEQ ID NO: 9285004 - DNA, 18 bp, Homo sapiens
ggcagcctacccacttgt

SEQ ID NO: 9285005 - DNA, 17 bp, Homo sapiens
ggcagcctcaggcgttt

SEQ ID NO: 9285006 - DNA, 18 bp, Homo sapiens
ggcagcctggacatgctc

SEQ ID NO: 9285007 - DNA, 21 bp, Homo sapiens
ggcagcctgacccccagagag

SEQ ID NO: 9285008 - DNA, 19 bp, Homo sapiens
ggcagcctgcacgggctgc

SEQ ID NO: 9285009 - DNA, 22 bp, Homo sapiens
ggcagccttctctcataggtga

SEQ ID NO: 9285010 - DNA, 22 bp, Homo sapiens
ggcagcctggagactttgtgaa

SEQ ID NO: 9285011 - DNA, 22 bp, Homo sapiens
ggcagccttgactagtgactta

SEQ ID NO: 9285012 - DNA, 22 bp, Homo sapiens
ggcagcctcaggttttctttga

SEQ ID NO: 9285013 - DNA, 22 bp, Homo sapiens
ggcagcctccagggcactggtg

SEQ ID NO: 9285014 - DNA, 23 bp, Homo sapiens
ggcagcctctgactctgctttgc

SEQ ID NO: 9285015 - DNA, 21 bp, Homo sapiens
ggcagcctctgtggaagggga

SEQ ID NO: 9285016 - DNA, 22 bp, Homo sapiens
ggcagccttgagggaggcctgg

SEQ ID NO: 9285017 - DNA, 22 bp, Homo sapiens
ggcacctggtaagtgctcagta

SEQ ID NO: 9285018 - DNA, 22 bp, Homo sapiens
ggcacctgtctgctcacagtga

SEQ ID NO: 9285019 - DNA, 22 bp, Homo sapiens
ggcagcactgcagcttgttggg

SEQ ID NO: 9285020 - DNA, 22 bp, Homo sapiens
taccaagtgtattatgctttgt

SEQ ID NO: 9285021 - DNA, 22 bp, Homo sapiens
tacagtgtctggatatcaaagg

SEQ ID NO: 9285022 - DNA, 22 bp, Homo sapiens
tacagtgtgacatttctacaaa

SEQ ID NO: 9285023 - DNA, 22 bp, Homo sapiens
tacagtgtccctttttcagaca

SEQ ID NO: 9285024 - DNA, 22 bp, Homo sapiens
taattcctagaaattattctca

SEQ ID NO: 9285025 - DNA, 21 bp, Homo sapiens
gttcttgcaggatttccttcc

SEQ ID NO: 9285026 - DNA, 21 bp, Homo sapiens
gtgctgggacacagccaggct

SEQ ID NO: 9285027 - DNA, 22 bp, Homo sapiens
tagactagaggatcagcaaggg

SEQ ID NO: 9285028 - DNA, 22 bp, Homo sapiens
tagtttcatctccaccctgccc

SEQ ID NO: 9285029 - DNA, 22 bp, Homo sapiens
tatttgctcaataatagtttta

SEQ ID NO: 9285030 - DNA, 22 bp, Homo sapiens
tatgctttcattcatatgtgag

SEQ ID NO: 9285031 - DNA, 22 bp, Homo sapiens
tatgctttacttttcattgtga

SEQ ID NO: 9285032 - DNA, 22 bp, Homo sapiens
tatgctttggtagagagttgtg

SEQ ID NO: 9285033 - DNA, 22 bp, Homo sapiens
tatgcttttaacctgtaactga

SEQ ID NO: 9285034 - DNA, 20 bp, Homo sapiens
tatgctttttataagattga

SEQ ID NO: 9285035 - DNA, 22 bp, Homo sapiens
tcctcagcaaacacttcactct

SEQ ID NO: 9285036 - DNA, 22 bp, Homo sapiens
tcccaggctaggcctctgcgtt

SEQ ID NO: 9285037 - DNA, 20 bp, Homo sapiens
tcccaggctccaccctagac

SEQ ID NO: 9285038 - DNA, 20 bp, Homo sapiens
tcccaggctgggctccagct

SEQ ID NO: 9285039 - DNA, 22 bp, Homo sapiens
tcccaggctggggccaggtgac

SEQ ID NO: 9285040 - DNA, 22 bp, Homo sapiens
tcagtgttctggatttggggca

SEQ ID NO: 9285041 - DNA, 22 bp, Homo sapiens
tcagtgttcttatttaattagg

SEQ ID NO: 9285042 - DNA, 22 bp, Homo sapiens
tcagtgttgaattttttgcaaa

SEQ ID NO: 9285043 - DNA, 22 bp, Homo sapiens
tcagtgttggcattcagaaatg

SEQ ID NO: 9285044 - DNA, 22 bp, Homo sapiens
tcagtgttggagataattgcac

SEQ ID NO: 9285045 - DNA, 22 bp, Homo sapiens
tcagtgtttaccgtatgttgtt

SEQ ID NO: 9285046 - DNA, 22 bp, Homo sapiens
tcagtgtttattcaatgttatt

SEQ ID NO: 9285047 - DNA, 22 bp, Homo sapiens
tcagtgtttcagtttggaaatg

SEQ ID NO: 9285048 - DNA, 22 bp, Homo sapiens
tcagtgtttattgcggtgtgta

SEQ ID NO: 9285049 - DNA, 22 bp, Homo sapiens
tcagtgtttacatgcatccttg

SEQ ID NO: 9285050 - DNA, 22 bp, Homo sapiens
tcagtgttgtgcacatacaaaa

SEQ ID NO: 9285051 - DNA, 22 bp, Homo sapiens
tcagtgttggctacatctgcct

SEQ ID NO: 9285052 - DNA, 22 bp, Homo sapiens
tcagtgttggtcaagaatcagt

SEQ ID NO: 9285053 - DNA, 22 bp, Homo sapiens
tcagtgtttggtttcagaattg

SEQ ID NO: 9285054 - DNA, 22 bp, Homo sapiens
tcagtgtttgaacccagggtta

SEQ ID NO: 9285055 - DNA, 22 bp, Homo sapiens
tcagtgtttcctgtggtacagc

SEQ ID NO: 9285056 - DNA, 22 bp, Homo sapiens
tcagtgtttcctagagcatata

SEQ ID NO: 9285057 - DNA, 22 bp, Homo sapiens
tcagtgttttaactgtctttta

SEQ ID NO: 9285058 - DNA, 22 bp, Homo sapiens
tcagtgtttgtggcaaatgtta

SEQ ID NO: 9285059 - DNA, 22 bp, Homo sapiens
tcagtgttttccagggtctact

SEQ ID NO: 9285060 - DNA, 22 bp, Homo sapiens
tcagtgtttttaaagcaatata

SEQ ID NO: 9285061 - DNA, 22 bp, Homo sapiens
tcataaattctggtgctgtgag

SEQ ID NO: 9285062 - DNA, 22 bp, Homo sapiens
tcataaattgggttggctgggt

SEQ ID NO: 9285063 - DNA, 22 bp, Homo sapiens
tcatacattcagcagatatttg

SEQ ID NO: 9285064 - DNA, 22 bp, Homo sapiens
tcatttcaatgatactactaag

SEQ ID NO: 9285065 - DNA, 22 bp, Homo sapiens
tcatttacacttcacaaatgga

SEQ ID NO: 9285066 - DNA, 19 bp, Homo sapiens
tccaaggcatggcccagtg

SEQ ID NO: 9285067 - DNA, 22 bp, Homo sapiens
tccaagtccattatggtggtct

SEQ ID NO: 9285068 - DNA, 22 bp, Homo sapiens
tcagctctgcctgtggaggcac

SEQ ID NO: 9285069 - DNA, 22 bp, Homo sapiens
tcagaaacactcttcttctgtc

SEQ ID NO: 9285070 - DNA, 22 bp, Homo sapiens
tcagaaaccagctctctcaatt

SEQ ID NO: 9285071 - DNA, 22 bp, Homo sapiens
tcactgcgcttcagcctgggtg

SEQ ID NO: 9285072 - DNA, 22 bp, Homo sapiens
tcaacagacatttttaagcact

SEQ ID NO: 9285073 - DNA, 22 bp, Homo sapiens
gacagcctggcttaatctgtct

SEQ ID NO: 9285074 - DNA, 22 bp, Homo sapiens
gagaagcaggtttagcagacaa

SEQ ID NO: 9285075 - DNA, 22 bp, Homo sapiens
gagaagcaatcgtgacatctcc

SEQ ID NO: 9285076 - DNA, 22 bp, Homo sapiens
gagaagcaatcagtggccaccc

SEQ ID NO: 9285077 - DNA, 22 bp, Homo sapiens
gagaagcaatcagcagccaccc

SEQ ID NO: 9285078 - DNA, 22 bp, Homo sapiens
gagaagcaatttccaactgtgc

SEQ ID NO: 9285079 - DNA, 22 bp, Homo sapiens
gagcacttcagaattgggcaat

SEQ ID NO: 9285080 - DNA, 22 bp, Homo sapiens
gagcacttaatcctgttattca

SEQ ID NO: 9285081 - DNA, 22 bp, Homo sapiens
gagctcattcattcattgcctg

SEQ ID NO: 9285082 - DNA, 22 bp, Homo sapiens
gagggtgggctcctatctgggt

SEQ ID NO: 9285083 - DNA, 22 bp, Homo sapiens
gagggtgggccagatatgaggg

SEQ ID NO: 9285084 - DNA, 22 bp, Homo sapiens
gagggtggggaatagactgcta

SEQ ID NO: 9285085 - DNA, 22 bp, Homo sapiens
gagggtgggctttgttcctcca

SEQ ID NO: 9285086 - DNA, 22 bp, Homo sapiens
gagggtgggtacaccagccctc

SEQ ID NO: 9285087 - DNA, 22 bp, Homo sapiens
gagggtgggtttcttgcacgtc

SEQ ID NO: 9285088 - DNA, 22 bp, Homo sapiens
gagggtggaagagctgctgaga

SEQ ID NO: 9285089 - DNA, 22 bp, Homo sapiens
gagggtggatcagcctgattgg

SEQ ID NO: 9285090 - DNA, 22 bp, Homo sapiens
gagggtggaaagggtgtacctg

SEQ ID NO: 9285091 - DNA, 22 bp, Homo sapiens
gaggtgagaagggggtcagatg

SEQ ID NO: 9285092 - DNA, 22 bp, Homo sapiens
ctggtaggggtgactgttatcg

SEQ ID NO: 9285093 - DNA, 22 bp, Homo sapiens
cttcacagtaaatccagaagaa

SEQ ID NO: 9285094 - DNA, 22 bp, Homo sapiens
cttgcttgaggtatggaatggg

SEQ ID NO: 9285095 - DNA, 22 bp, Homo sapiens
cttgcttgccatgggcttgggc

SEQ ID NO: 9285096 - DNA, 22 bp, Homo sapiens
gaaatacaggaatgccacacag

SEQ ID NO: 9285097 - DNA, 22 bp, Homo sapiens
gaaatattacagtggaggggat

SEQ ID NO: 9285098 - DNA, 22 bp, Homo sapiens
gaaatattcttgtcttgttttc

SEQ ID NO: 9285099 - DNA, 22 bp, Homo sapiens
gaaatattgtactggagatgtt

SEQ ID NO: 9285100 - DNA, 22 bp, Homo sapiens
gaaatattgggactcagagctt

SEQ ID NO: 9285101 - DNA, 22 bp, Homo sapiens
gaaatatttctcttgagcccct

SEQ ID NO: 9285102 - DNA, 22 bp, Homo sapiens
tttcttggtcttcccgacctgg

SEQ ID NO: 9285103 - DNA, 22 bp, Homo sapiens
tttcttggggctcctgcgccat

SEQ ID NO: 9285104 - DNA, 22 bp, Homo sapiens
tttcttgtaaaagctgtgggaa

SEQ ID NO: 9285105 - DNA, 22 bp, Homo sapiens
ctcttcttatggccgtggctga

SEQ ID NO: 9285106 - DNA, 22 bp, Homo sapiens
ctgctgggtctatgcaagtgga

SEQ ID NO: 9285107 - DNA, 22 bp, Homo sapiens
ctgctgggtttgcctttcacca

SEQ ID NO: 9285108 - DNA, 22 bp, Homo sapiens
ctgctgggatagaagtatctca

SEQ ID NO: 9285109 - DNA, 22 bp, Homo sapiens
cgtggggacccacgtgcagcac

SEQ ID NO: 9285110 - DNA, 22 bp, Homo sapiens
tgtcagcaacccatcactccca

SEQ ID NO: 9285111 - DNA, 22 bp, Homo sapiens
tgtcagcaagacatcagagtga

SEQ ID NO: 9285112 - DNA, 20 bp, Homo sapiens
tgtcagcaattaggagaaaa

SEQ ID NO: 9285113 - DNA, 22 bp, Homo sapiens
tgtcagcacatctgtaatcaca

SEQ ID NO: 9285114 - DNA, 21 bp, Homo sapiens
tgtcagcacgcatgaggccag

SEQ ID NO: 9285115 - DNA, 22 bp, Homo sapiens
tgtcagcagaaatctggtctgc

SEQ ID NO: 9285116 - DNA, 22 bp, Homo sapiens
tgtcagcaccatgggtagtgat

SEQ ID NO: 9285117 - DNA, 22 bp, Homo sapiens
tgtcagcagatctcctgcagcc

SEQ ID NO: 9285118 - DNA, 22 bp, Homo sapiens
tgtcagcagtatctctatctca

SEQ ID NO: 9285119 - DNA, 22 bp, Homo sapiens
tgtcagcagtttttagtggagg

SEQ ID NO: 9285120 - DNA, 22 bp, Homo sapiens
tgtcagcatttaaggagtaagg

SEQ ID NO: 9285121 - DNA, 22 bp, Homo sapiens
tgtcagcatgtcagccaaagat

SEQ ID NO: 9285122 - DNA, 22 bp, Homo sapiens
tgtcagcattgatgaaatgtgg

SEQ ID NO: 9285123 - DNA, 22 bp, Homo sapiens
tgtcagcatcatttgttgaagg

SEQ ID NO: 9285124 - DNA, 22 bp, Homo sapiens
cctgtttggtacaatctgccaa

SEQ ID NO: 9285125 - DNA, 22 bp, Homo sapiens
cctgtttgttacctcgtttgag

SEQ ID NO: 9285126 - DNA, 22 bp, Homo sapiens
ctatacatcccaatttcagaga

SEQ ID NO: 9285127 - DNA, 22 bp, Homo sapiens
ctaaaaatccacactaggtgaa

SEQ ID NO: 9285128 - DNA, 22 bp, Homo sapiens
cgtgggtcgggactccgcctcg

SEQ ID NO: 9285129 - DNA, 22 bp, Homo sapiens
ttctatttccagtccttcagag

SEQ ID NO: 9285130 - DNA, 22 bp, Homo sapiens
ttctatttcttaatcttggctg

SEQ ID NO: 9285131 - DNA, 22 bp, Homo sapiens
ttggaggggccactgcagagct

SEQ ID NO: 9285132 - DNA, 22 bp, Homo sapiens
ccagtgttacggcttgaactat

SEQ ID NO: 9285133 - DNA, 22 bp, Homo sapiens
ccagtgttagagactgatacag

SEQ ID NO: 9285134 - DNA, 22 bp, Homo sapiens
ccagtgttattttagagtgtga

SEQ ID NO: 9285135 - DNA, 22 bp, Homo sapiens
ccagtgttcaatacatatttgt

SEQ ID NO: 9285136 - DNA, 22 bp, Homo sapiens
ccagtgttcagtatgcattaag

SEQ ID NO: 9285137 - DNA, 22 bp, Homo sapiens
ccagtgttcatcaagaaaatgt

SEQ ID NO: 9285138 - DNA, 22 bp, Homo sapiens
ccagtgttcataattttacact

SEQ ID NO: 9285139 - DNA, 22 bp, Homo sapiens
tgaccacagacccaatgactac

SEQ ID NO: 9285140 - DNA, 18 bp, Homo sapiens
cccggctaatttttggta

SEQ ID NO: 9285141 - DNA, 22 bp, Homo sapiens
tgctttcagggatgtctgtgag

SEQ ID NO: 9285142 - DNA, 22 bp, Homo sapiens
tgctttcatgaagtctatagag

SEQ ID NO: 9285143 - DNA, 22 bp, Homo sapiens
tggaggggcaatggagcgcgga

SEQ ID NO: 9285144 - DNA, 22 bp, Homo sapiens
tggaggtgagtgtggtacagca

SEQ ID NO: 9285145 - DNA, 22 bp, Homo sapiens
cagtgtttgtggaattcaggtg

SEQ ID NO: 9285146 - DNA, 22 bp, Homo sapiens
tcagcagatgtggtgaaaagtc

SEQ ID NO: 9285147 - DNA, 22 bp, Homo sapiens
tcagcttttgtcagaaattgta

SEQ ID NO: 9285148 - DNA, 22 bp, Homo sapiens
tactcaaactcactaagacaga

SEQ ID NO: 9285149 - DNA, 22 bp, Homo sapiens
gtgagggataatatgcggggtt

SEQ ID NO: 9285150 - DNA, 22 bp, Homo sapiens
cagggcagaaggcactctactc

SEQ ID NO: 9285151 - DNA, 22 bp, Homo sapiens
catgtgttttgtcatttcaata

SEQ ID NO: 9285152 - DNA, 22 bp, Homo sapiens
catgtgttaatctttctgcaaa

SEQ ID NO: 9285153 - DNA, 22 bp, Homo sapiens
cattgaaatatggaaactgatg

SEQ ID NO: 9285154 - DNA, 22 bp, Homo sapiens
tccctagtcgcatctgtggaga

SEQ ID NO: 9285155 - DNA, 22 bp, Homo sapiens
tcctcagctttggtttactcat

SEQ ID NO: 9285156 - DNA, 22 bp, Homo sapiens
tcctcagcttttatttcacttg

SEQ ID NO: 9285157 - DNA, 22 bp, Homo sapiens
tctccctctttgtctgctttgg

SEQ ID NO: 9285158 - DNA, 22 bp, Homo sapiens
tctcaacagtgaaatgtgtttg

SEQ ID NO: 9285159 - DNA, 22 bp, Homo sapiens
tttatattgtaaaaatggttct

SEQ ID NO: 9285160 - DNA, 22 bp, Homo sapiens
tttcatgcacaaatgagcaagg

SEQ ID NO: 9285161 - DNA, 22 bp, Homo sapiens
tttcatggctaggactagagtg

SEQ ID NO: 9285162 - DNA, 22 bp, Homo sapiens
tttcacaatgcaatcctacttc

SEQ ID NO: 9285163 - DNA, 20 bp, Homo sapiens
tttcacaatgaacatgtctc

SEQ ID NO: 9285164 - DNA, 22 bp, Homo sapiens
tttcaactagcccctaagtcct

SEQ ID NO: 9285165 - DNA, 22 bp, Homo sapiens
ttcaaacagttgcacaacttat

SEQ ID NO: 9285166 - DNA, 22 bp, Homo sapiens
ttcaaacactggcttagccaat

SEQ ID NO: 9285167 - DNA, 22 bp, Homo sapiens
ttcaaacactgttggcactggg

SEQ ID NO: 9285168 - DNA, 22 bp, Homo sapiens
ttcaaacacagacagcagcatg

SEQ ID NO: 9285169 - DNA, 22 bp, Homo sapiens
ttcacagggcagcagctgagcc

SEQ ID NO: 9285170 - DNA, 18 bp, Homo sapiens
ttcagcagcagacacact

SEQ ID NO: 9285171 - DNA, 22 bp, Homo sapiens
ttccaggctgatgggccacagg

SEQ ID NO: 9285172 - DNA, 22 bp, Homo sapiens
ttccttgaccactgcataatga

SEQ ID NO: 9285173 - DNA, 22 bp, Homo sapiens
ttccttgaatgagtcatggaaa

SEQ ID NO: 9285174 - DNA, 22 bp, Homo sapiens
ttccttgaaagtttgaactgac

SEQ ID NO: 9285175 - DNA, 22 bp, Homo sapiens
ttctctcttttgggtaggaggt

SEQ ID NO: 9285176 - DNA, 22 bp, Homo sapiens
ttttcatgtcatgtccttgagg

SEQ ID NO: 9285177 - DNA, 22 bp, Homo sapiens
ttttcagtttgcactgcagtgc

SEQ ID NO: 9285178 - DNA, 22 bp, Homo sapiens
tttgaagagccacagtgaaatt

SEQ ID NO: 9285179 - DNA, 22 bp, Homo sapiens
ggctgggagccccacagagtca

SEQ ID NO: 9285180 - DNA, 22 bp, Homo sapiens
cacagcctcctctggctcacgg

SEQ ID NO: 9285181 - DNA, 21 bp, Homo sapiens
caatggcgagatcttggctca

SEQ ID NO: 9285182 - DNA, 22 bp, Homo sapiens
caatcccatcaccatctgctct

SEQ ID NO: 9285183 - DNA, 22 bp, Homo sapiens
caagtggaatgctcttcctccc

SEQ ID NO: 9285184 - DNA, 20 bp, Homo sapiens
caagttcaccttctcctctc

SEQ ID NO: 9285185 - DNA, 22 bp, Homo sapiens
cagcagaagtccgactccagtc

SEQ ID NO: 9285186 - DNA, 22 bp, Homo sapiens
ggtgggaaggggccagtgtgcg

SEQ ID NO: 9285187 - DNA, 22 bp, Homo sapiens
ggtgggaaggccactgaaggtt

SEQ ID NO: 9285188 - DNA, 22 bp, Homo sapiens
cagcagaagcaacattcaggct

SEQ ID NO: 9285189 - DNA, 22 bp, Homo sapiens
cagcagaacaggcagggaagct

SEQ ID NO: 9285190 - DNA, 22 bp, Homo sapiens
gtctttctatgcatagagcaga

SEQ ID NO: 9285191 - DNA, 22 bp, Homo sapiens
gtctttctgccatgtgaagaga

SEQ ID NO: 9285192 - DNA, 22 bp, Homo sapiens
gtctttctgctgcacggactgc

SEQ ID NO: 9285193 - DNA, 22 bp, Homo sapiens
gtctttggagaggtgccatttc

SEQ ID NO: 9285194 - DNA, 22 bp, Homo sapiens
gtctcaaactcctaggctaaag

SEQ ID NO: 9285195 - DNA, 22 bp, Homo sapiens
gtctcaagggggaactcactgt

SEQ ID NO: 9285196 - DNA, 20 bp, Homo sapiens
gtctcaagtatctcacagtc

SEQ ID NO: 9285197 - DNA, 22 bp, Homo sapiens
atgtaatttatgttatccataa

SEQ ID NO: 9285198 - DNA, 22 bp, Homo sapiens
atgtacaatctatcacaagaag

SEQ ID NO: 9285199 - DNA, 22 bp, Homo sapiens
gagaggctggcagtgccaggtt

SEQ ID NO: 9285200 - DNA, 22 bp, Homo sapiens
gatctcaaagcagtgtgggttg

SEQ ID NO: 9285201 - DNA, 22 bp, Homo sapiens
gaggggggcgccctgcagtgca

SEQ ID NO: 9285202 - DNA, 22 bp, Homo sapiens
atgctttagtgtcaagtttggg

SEQ ID NO: 9285203 - DNA, 22 bp, Homo sapiens
atgcacaagaggctagaaaaga

SEQ ID NO: 9285204 - DNA, 21 bp, Homo sapiens
atcttcaactgattggaggag

SEQ ID NO: 9285205 - DNA, 19 bp, Homo sapiens
atcttcaaagccagcagca

SEQ ID NO: 9285206 - DNA, 22 bp, Homo sapiens
atcttcaactcagagagtgctg

SEQ ID NO: 9285207 - DNA, 22 bp, Homo sapiens
gcagcctgaggccctttctggc

SEQ ID NO: 9285208 - DNA, 22 bp, Homo sapiens
gcagccttctactgaatcctct

SEQ ID NO: 9285209 - DNA, 22 bp, Homo sapiens
gcagcctgttgtaccagcctgt

SEQ ID NO: 9285210 - DNA, 22 bp, Homo sapiens
gcaactgaacatgtgtgtggcc

SEQ ID NO: 9285211 - DNA, 22 bp, Homo sapiens
gcactgggtgggagatctgaat

SEQ ID NO: 9285212 - DNA, 22 bp, Homo sapiens
gcactgggggcagcagtgaggg

SEQ ID NO: 9285213 - DNA, 22 bp, Homo sapiens
gcgtggggtaggtagacatgga

SEQ ID NO: 9285214 - DNA, 22 bp, Homo sapiens
gcccagccacagtcactttcat

SEQ ID NO: 9285215 - DNA, 22 bp, Homo sapiens
gcccagcccctgggtggacgtg

SEQ ID NO: 9285216 - DNA, 19 bp, Homo sapiens
agtagacattttcatgttt

SEQ ID NO: 9285217 - DNA, 22 bp, Homo sapiens
agtaaacatttcagatttattt

SEQ ID NO: 9285218 - DNA, 22 bp, Homo sapiens
agtaaataacagagaaaatggg

SEQ ID NO: 9285219 - DNA, 22 bp, Homo sapiens
agtcagcactcctgaggatcac

SEQ ID NO: 9285220 - DNA, 22 bp, Homo sapiens
agtcagcatatatggagtaagg

SEQ ID NO: 9285221 - DNA, 22 bp, Homo sapiens
agtcacaataccgtgtgtcagt

SEQ ID NO: 9285222 - DNA, 22 bp, Homo sapiens
aggtaaattcagcagtgacatt

SEQ ID NO: 9285223 - DNA, 23 bp, Homo sapiens
agttccagaaaaatgctcaagca

SEQ ID NO: 9285224 - DNA, 17 bp, Homo sapiens
agtgtcagggcccttcc

SEQ ID NO: 9285225 - DNA, 22 bp, Homo sapiens
agtgtctttgacacattcaaag

SEQ ID NO: 9285226 - DNA, 22 bp, Homo sapiens
agtgtctttgtctctcaagcac

SEQ ID NO: 9285227 - DNA, 22 bp, Homo sapiens
agtggggattgtgacatattac

SEQ ID NO: 9285228 - DNA, 23 bp, Homo sapiens
agtctcaagctggagaattacct

SEQ ID NO: 9285229 - DNA, 22 bp, Homo sapiens
agtctcaccgggagcttgggag

SEQ ID NO: 9285230 - DNA, 22 bp, Homo sapiens
agtctcaaactcctaggctcga

SEQ ID NO: 9285231 - DNA, 22 bp, Homo sapiens
agtctcaagcaccgaaagctgt

SEQ ID NO: 9285232 - DNA, 22 bp, Homo sapiens
agtctcaagggatgtctctata

SEQ ID NO: 9285233 - DNA, 22 bp, Homo sapiens
cttccttggcttctggggtgtg

SEQ ID NO: 9285234 - DNA, 22 bp, Homo sapiens
cttccttgtggtccttctcatt

SEQ ID NO: 9285235 - DNA, 22 bp, Homo sapiens
cttcaaggccttccaggttgaa

SEQ ID NO: 9285236 - DNA, 22 bp, Homo sapiens
cttccttgcggcccctgcctag

SEQ ID NO: 9285237 - DNA, 22 bp, Homo sapiens
cttccttgctgtctgctccagg

SEQ ID NO: 9285238 - DNA, 19 bp, Homo sapiens
cttccttgctccccatgtg

SEQ ID NO: 9285239 - DNA, 22 bp, Homo sapiens
cttccttctgaagcatagaagc

SEQ ID NO: 9285240 - DNA, 22 bp, Homo sapiens
cttcaacatacacagagagagg

SEQ ID NO: 9285241 - DNA, 22 bp, Homo sapiens
atcatacagcctttgttagtgt

SEQ ID NO: 9285242 - DNA, 22 bp, Homo sapiens
ctgctgggctcctcatgtgact

SEQ ID NO: 9285243 - DNA, 22 bp, Homo sapiens
ataaaaatgagggcggtagcta

SEQ ID NO: 9285244 - DNA, 22 bp, Homo sapiens
ccagaagaacttaattcaaaac

SEQ ID NO: 9285245 - DNA, 22 bp, Homo sapiens
ccagctctgtaagctgtgaaat

SEQ ID NO: 9285246 - DNA, 22 bp, Homo sapiens
ccaggctgctgttggtgtccgc

SEQ ID NO: 9285247 - DNA, 22 bp, Homo sapiens
ccaggctgggctacaagttgag

SEQ ID NO: 9285248 - DNA, 22 bp, Homo sapiens
ccaaaccatccatctccaggct

SEQ ID NO: 9285249 - DNA, 18 bp, Homo sapiens
aggagacagcctcacctg

SEQ ID NO: 9285250 - DNA, 23 bp, Homo sapiens
aggagacagggaagtgcctggct

SEQ ID NO: 9285251 - DNA, 22 bp, Homo sapiens
agctgggagctgaaggctgatt

SEQ ID NO: 9285252 - DNA, 22 bp, Homo sapiens
agctgggagcagagccacagcc

SEQ ID NO: 9285253 - DNA, 22 bp, Homo sapiens
agctgggaggtgggcagtgaga

SEQ ID NO: 9285254 - DNA, 22 bp, Homo sapiens
acatgaaaagactatctgatta

SEQ ID NO: 9285255 - DNA, 22 bp, Homo sapiens
accaggctgtgaagtgagacta

SEQ ID NO: 9285256 - DNA, 22 bp, Homo sapiens
agtatacatagtgcttcctctt

SEQ ID NO: 9285257 - DNA, 22 bp, Homo sapiens
atcaaaatgctccagtgatggt

SEQ ID NO: 9285258 - DNA, 22 bp, Homo sapiens
acttttcaaatgggaaactcag

SEQ ID NO: 9285259 - DNA, 22 bp, Homo sapiens
atacatatccacaggagataaa

SEQ ID NO: 9285260 - DNA, 22 bp, Homo sapiens
acttccttttgggaaactgttt

SEQ ID NO: 9285261 - DNA, 22 bp, Homo sapiens
agagcagatggagctggaagag

SEQ ID NO: 9285262 - DNA, 22 bp, Homo sapiens
agagattgtgctactcacccaa

SEQ ID NO: 9285263 - DNA, 21 bp, Homo sapiens
agagctggcctgccaggccct

SEQ ID NO: 9285264 - DNA, 22 bp, Homo sapiens
agagctggatggtcaagatggc

SEQ ID NO: 9285265 - DNA, 22 bp, Homo sapiens
agagagcattgaggaaatcttc

SEQ ID NO: 9285266 - DNA, 22 bp, Homo sapiens
atgcatttttgagtatgaatga

SEQ ID NO: 9285267 - DNA, 22 bp, Homo sapiens
attttcagaacattcattcact

SEQ ID NO: 9285268 - DNA, 22 bp, Homo sapiens
caccagctacagactactgtgt

SEQ ID NO: 9285269 - DNA, 19 bp, Homo sapiens
cactgtggtccttcactgc

SEQ ID NO: 9285270 - DNA, 22 bp, Homo sapiens
agcagcctattcttctcttgga

SEQ ID NO: 9285271 - DNA, 22 bp, Homo sapiens
agcagcctcccagggagcagcc

SEQ ID NO: 9285272 - DNA, 22 bp, Homo sapiens
agcagccttgtgactccggggt

SEQ ID NO: 9285273 - DNA, 22 bp, Homo sapiens
agcagccttaggtattgtgatt

SEQ ID NO: 9285274 - DNA, 22 bp, Homo sapiens
agcagccttgcaggggtcgcac

SEQ ID NO: 9285275 - DNA, 22 bp, Homo sapiens
agcagcctggtctctcgccaat

SEQ ID NO: 9285276 - DNA, 22 bp, Homo sapiens
agcagcctctgtagaggtctcc

SEQ ID NO: 9285277 - DNA, 22 bp, Homo sapiens
agcagcctggacttggatgtgg

SEQ ID NO: 9285278 - DNA, 22 bp, Homo sapiens
agcagcctgcagatattggtct

SEQ ID NO: 9285279 - DNA, 22 bp, Homo sapiens
agcagcctttgatcatctggga

SEQ ID NO: 9285280 - DNA, 21 bp, Homo sapiens
agcagccttgtgtgccaggca

SEQ ID NO: 9285281 - DNA, 22 bp, Homo sapiens
agcacctggagggctgggacct

SEQ ID NO: 9285282 - DNA, 22 bp, Homo sapiens
agcacctgggaagctattctca

SEQ ID NO: 9285283 - DNA, 22 bp, Homo sapiens
agcacctggtctcctggcgctg

SEQ ID NO: 9285284 - DNA, 22 bp, Homo sapiens
agcacctgtggctcatgctcgt

SEQ ID NO: 9285285 - DNA, 22 bp, Homo sapiens
cagagcctttgtgtccacattt

SEQ ID NO: 9285286 - DNA, 22 bp, Homo sapiens
agctaagagtggaagctcatct

SEQ ID NO: 9285287 - DNA, 22 bp, Homo sapiens
agcctgggcaacaacacagcga

SEQ ID NO: 9285288 - DNA, 22 bp, Homo sapiens
aagccagtaagtttttgtcatt

SEQ ID NO: 9285289 - DNA, 22 bp, Homo sapiens
aagaattggtttcctctgtcat

SEQ ID NO: 9285290 - DNA, 22 bp, Homo sapiens
aagaaagtgctttgtaaattat

SEQ ID NO: 9285291 - DNA, 22 bp, Homo sapiens
aacacaaagaagctgcaggatc

SEQ ID NO: 9285292 - DNA, 22 bp, Homo sapiens
aactcactttgtggcttctgaa

SEQ ID NO: 9285293 - DNA, 22 bp, Homo sapiens
aaatataatttctgcctcaata

SEQ ID NO: 9285294 - DNA, 22 bp, Homo sapiens
agacactgatgttcagctcaat

SEQ ID NO: 9285295 - DNA, 22 bp, Homo sapiens
agacactgccacttctgttccc

SEQ ID NO: 9285296 - DNA, 22 bp, Homo sapiens
agcagccatttaaaatgaattg

SEQ ID NO: 9285297 - DNA, 22 bp, Homo sapiens
agcagaacattttcagggctgt

SEQ ID NO: 9285298 - DNA, 22 bp, Homo sapiens
agaaaataatttcttggctggt

SEQ ID NO: 9285299 - DNA, 22 bp, Homo sapiens
ggggatggtagaccggtgacgt

SEQ ID NO: 9285300 - DNA, 22 bp, Homo sapiens
ggggatggattccgggtccctg

SEQ ID NO: 9285301 - DNA, 22 bp, Homo sapiens
ggggatggaatgtagtagtgat

SEQ ID NO: 9285302 - DNA, 21 bp, Homo sapiens
gggggaagaggagttgctagt

SEQ ID NO: 9285303 - DNA, 22 bp, Homo sapiens
gggggaaagtggaggttcgtga

SEQ ID NO: 9285304 - DNA, 22 bp, Homo sapiens
gggggaagactgggctagtgat

SEQ ID NO: 9285305 - DNA, 22 bp, Homo sapiens
ggtgcggagactccatgaggcc

SEQ ID NO: 9285306 - DNA, 21 bp, Homo sapiens
ggtagggaaggttcgctggtg

SEQ ID NO: 9285307 - DNA, 22 bp, Homo sapiens
gtcttcaactggactccaggga

SEQ ID NO: 9285308 - DNA, 22 bp, Homo sapiens
gtcttcaacaataactaccact

SEQ ID NO: 9285309 - DNA, 22 bp, Homo sapiens
gtgctgggtgctgcagacaggt

SEQ ID NO: 9285310 - DNA, 22 bp, Homo sapiens
gtgctgggattacaggtgtgag

SEQ ID NO: 9285311 - DNA, 22 bp, Homo sapiens
ggtgggcacattcagtctctgt

SEQ ID NO: 9285312 - DNA, 22 bp, Homo sapiens
ggtgggcagctcttggcaggca

SEQ ID NO: 9285313 - DNA, 22 bp, Homo sapiens
ggagatggtggaagctggtgca

SEQ ID NO: 9285314 - DNA, 22 bp, Homo sapiens
ggatggagatgaccatggtgac

SEQ ID NO: 9285315 - DNA, 22 bp, Homo sapiens
gggaaggtatttagctgctgaa

SEQ ID NO: 9285316 - DNA, 21 bp, Homo sapiens
ggctgggtcatgcagctggcc

SEQ ID NO: 9285317 - DNA, 22 bp, Homo sapiens
ggctgtgagcaggcagaatgct

SEQ ID NO: 9285318 - DNA, 22 bp, Homo sapiens
ggctgtgagtttgtcctccatg

SEQ ID NO: 9285319 - DNA, 22 bp, Homo sapiens
ggcgtttcaccatgttgaccag

SEQ ID NO: 9285320 - DNA, 20 bp, Homo sapiens
ggactacaatttgcagtgtg

SEQ ID NO: 9285321 - DNA, 22 bp, Homo sapiens
ggactgaggacatgtgaggcat

SEQ ID NO: 9285322 - DNA, 22 bp, Homo sapiens
ggagagagatgccgccttgctc

SEQ ID NO: 9285323 - DNA, 22 bp, Homo sapiens
gcttcctagcattagccattgc

SEQ ID NO: 9285324 - DNA, 22 bp, Homo sapiens
gctgggacaacaggtgagcacc

SEQ ID NO: 9285325 - DNA, 22 bp, Homo sapiens
gctgggactgagacagtgacct

SEQ ID NO: 9285326 - DNA, 22 bp, Homo sapiens
gctgtgagtacaaggccctggg

SEQ ID NO: 9285327 - DNA, 22 bp, Homo sapiens
gctgtgataaatgcagatgtca

SEQ ID NO: 9285328 - DNA, 22 bp, Homo sapiens
gcacttcaccactgtcctggtt

SEQ ID NO: 9285329 - DNA, 18 bp, Homo sapiens
gcacttcacccagctagt

SEQ ID NO: 9285330 - DNA, 22 bp, Homo sapiens
gcactgggaagaatgagcctgt

SEQ ID NO: 9285331 - DNA, 22 bp, Homo sapiens
gcaggctgagagtccaagaagg

SEQ ID NO: 9285332 - DNA, 22 bp, Homo sapiens
gcagtcctgtagcgactttttt

SEQ ID NO: 9285333 - DNA, 22 bp, Homo sapiens
gcagtcctcatcctttagcagt

SEQ ID NO: 9285334 - DNA, 22 bp, Homo sapiens
gccagcagtcctgctgtgtgcc

SEQ ID NO: 9285335 - DNA, 22 bp, Homo sapiens
tcagccaggccaggcattcaca

SEQ ID NO: 9285336 - DNA, 22 bp, Homo sapiens
tcaaaatcaaagatacttgaaa

SEQ ID NO: 9285337 - DNA, 22 bp, Homo sapiens
tcacacacataatctaagatta

SEQ ID NO: 9285338 - DNA, 22 bp, Homo sapiens
tcacacacatggatagtatttt

SEQ ID NO: 9285339 - DNA, 23 bp, Homo sapiens
tccagcctcttgctctcacatgc

SEQ ID NO: 9285340 - DNA, 22 bp, Homo sapiens
tccagccttctcaaggctggct

SEQ ID NO: 9285341 - DNA, 22 bp, Homo sapiens
tccacagcacaaagccagtgtg

SEQ ID NO: 9285342 - DNA, 22 bp, Homo sapiens
gtttatatgaacttcataccca

SEQ ID NO: 9285343 - DNA, 22 bp, Homo sapiens
gttccttggaagaacttgaggt

SEQ ID NO: 9285344 - DNA, 22 bp, Homo sapiens
gttccttgggaacaacgctgaa

SEQ ID NO: 9285345 - DNA, 22 bp, Homo sapiens
gttccttgtatttcagacatga

SEQ ID NO: 9285346 - DNA, 22 bp, Homo sapiens
gttccttgtaatttgttaagga

SEQ ID NO: 9285347 - DNA, 18 bp, Homo sapiens
gttcccagatggtgctga

SEQ ID NO: 9285348 - DNA, 22 bp, Homo sapiens
taagaaatttagttatagaatg

SEQ ID NO: 9285349 - DNA, 22 bp, Homo sapiens
tacatgtctacatgcatttttg

SEQ ID NO: 9285350 - DNA, 22 bp, Homo sapiens
tacttcaatttgtatatgtgaa

SEQ ID NO: 9285351 - DNA, 22 bp, Homo sapiens
tacttacttgtcataattctgg

SEQ ID NO: 9285352 - DNA, 22 bp, Homo sapiens
tagtacctctcagctgggatcc

SEQ ID NO: 9285353 - DNA, 22 bp, Homo sapiens
taggttccatgagggaggcaaa

SEQ ID NO: 9285354 - DNA, 22 bp, Homo sapiens
tagtgtttagtacatatgcata

SEQ ID NO: 9285355 - DNA, 22 bp, Homo sapiens
tagttaaagccctaaattgata

SEQ ID NO: 9285356 - DNA, 22 bp, Homo sapiens
tatttcagcaagaagaatgtgg

SEQ ID NO: 9285357 - DNA, 22 bp, Homo sapiens
tatttcactccgagactctatg

SEQ ID NO: 9285358 - DNA, 22 bp, Homo sapiens
tatttcagacactgatcttgca

SEQ ID NO: 9285359 - DNA, 22 bp, Homo sapiens
tatttcacctcacccaggagaa

SEQ ID NO: 9285360 - DNA, 19 bp, Homo sapiens
tatttcaggctcagagtct

SEQ ID NO: 9285361 - DNA, 22 bp, Homo sapiens
tatttcctgcatggtgatgtaa

SEQ ID NO: 9285362 - DNA, 22 bp, Homo sapiens
tatttcctgtggatacttttag

SEQ ID NO: 9285363 - DNA, 22 bp, Homo sapiens
tattttcaccttctctggatat

SEQ ID NO: 9285364 - DNA, 22 bp, Homo sapiens
tattttcattctgtgtgactgt

SEQ ID NO: 9285365 - DNA, 22 bp, Homo sapiens
tattttcatcttgtccttggat

SEQ ID NO: 9285366 - DNA, 22 bp, Homo sapiens
tattgagttacagaaaatactt

SEQ ID NO: 9285367 - DNA, 22 bp, Homo sapiens
tgttgcccaggttctctcctgc

SEQ ID NO: 9285368 - DNA, 22 bp, Homo sapiens
tggttcctacgcacattgaatt

SEQ ID NO: 9285369 - DNA, 22 bp, Homo sapiens
ttatttttaaaagttcacacag

SEQ ID NO: 9285370 - DNA, 20 bp, Homo sapiens
ccttctctggaattgcctcc

SEQ ID NO: 9285371 - DNA, 19 bp, Homo sapiens
ccttgtttggtctttgagc

SEQ ID NO: 9285372 - DNA, 22 bp, Homo sapiens
ttgctgtagctcatttcactct

SEQ ID NO: 9285373 - DNA, 22 bp, Homo sapiens
ttgctgggtcagaagccaggag

SEQ ID NO: 9285374 - DNA, 22 bp, Homo sapiens
ttctccttgaaaagctgcatct

SEQ ID NO: 9285375 - DNA, 22 bp, Homo sapiens
cggctggtgtcgggcacagcaa

SEQ ID NO: 9285376 - DNA, 22 bp, Homo sapiens
ttcctctcctcacatgagtcac

SEQ ID NO: 9285377 - DNA, 22 bp, Homo sapiens
ctcaggctgtgccacctgtgtg

SEQ ID NO: 9285378 - DNA, 22 bp, Homo sapiens
ctccctgcttgtttcccttcag

SEQ ID NO: 9285379 - DNA, 22 bp, Homo sapiens
tttatattacctggaatagctt

SEQ ID NO: 9285380 - DNA, 22 bp, Homo sapiens
ctctcaaatgtaatttgaggtt

SEQ ID NO: 9285381 - DNA, 22 bp, Homo sapiens
ctttctcttcactgtcatgatc

SEQ ID NO: 9285382 - DNA, 22 bp, Homo sapiens
cttccaagttgctctgctgacc

SEQ ID NO: 9285383 - DNA, 22 bp, Homo sapiens
ctgtcagcactctactacagat

SEQ ID NO: 9285384 - DNA, 22 bp, Homo sapiens
ctgggctttgaagccaggctgc

SEQ ID NO: 9285385 - DNA, 22 bp, Homo sapiens
ctgggcttctccccctggcaga

SEQ ID NO: 9285386 - DNA, 19 bp, Homo sapiens
ctgggactcctgatacctt

SEQ ID NO: 9285387 - DNA, 22 bp, Homo sapiens
ctgcttcatatttcatagtgat

SEQ ID NO: 9285388 - DNA, 22 bp, Homo sapiens
ctgggattacaggcacccgtca

SEQ ID NO: 9285389 - DNA, 22 bp, Homo sapiens
gagagggtgcctggaagccagg

SEQ ID NO: 9285390 - DNA, 22 bp, Homo sapiens
gactgagggatagaggtgcttc

SEQ ID NO: 9285391 - DNA, 22 bp, Homo sapiens
tcttctctgtggcctggtggtg

SEQ ID NO: 9285392 - DNA, 22 bp, Homo sapiens
tgaaacaagatccacagacttg

SEQ ID NO: 9285393 - DNA, 22 bp, Homo sapiens
ccagggagtttccaatctgaga

SEQ ID NO: 9285394 - DNA, 19 bp, Homo sapiens
tgaaggtgtatgtgctggg

SEQ ID NO: 9285395 - DNA, 22 bp, Homo sapiens
tgagtccagatgggccagcagg

SEQ ID NO: 9285396 - DNA, 22 bp, Homo sapiens
ccagtgttttccagtttgccca

SEQ ID NO: 9285397 - DNA, 22 bp, Homo sapiens
tgcactttgcaggcatggaaac

SEQ ID NO: 9285398 - DNA, 22 bp, Homo sapiens
tgggtgggagcaccctgtctgg

SEQ ID NO: 9285399 - DNA, 22 bp, Homo sapiens
tggtgggacatctgaggagagg

SEQ ID NO: 9285400 - DNA, 22 bp, Homo sapiens
cctgcctactgagttttatatt

SEQ ID NO: 9285401 - DNA, 22 bp, Homo sapiens
cctgcctatgagacgttttgcc

SEQ ID NO: 9285402 - DNA, 22 bp, Homo sapiens
tggagatgaacatggtgatgtt

SEQ ID NO: 9285403 - DNA, 22 bp, Homo sapiens
tggagacagagatagccaattg

SEQ ID NO: 9285404 - DNA, 22 bp, Homo sapiens
tggagacatgggcgaatctaag

SEQ ID NO: 9285405 - DNA, 18 bp, Homo sapiens
tggagacatagacaatgt

SEQ ID NO: 9285406 - DNA, 22 bp, Homo sapiens
tggagatgcacgagcaggtgga

SEQ ID NO: 9285407 - DNA, 22 bp, Homo sapiens
ccctggcttggcactctccact

SEQ ID NO: 9285408 - DNA, 22 bp, Homo sapiens
tgctgcctggagccttttgttt

SEQ ID NO: 9285409 - DNA, 22 bp, Homo sapiens
tgctgcctggtttcttcttgct

SEQ ID NO: 9285410 - DNA, 22 bp, Homo sapiens
tgcttcctatccacacaatgcc

SEQ ID NO: 9285411 - DNA, 22 bp, Homo sapiens
tgcttcctgaggccgtcttctc

SEQ ID NO: 9285412 - DNA, 22 bp, Homo sapiens
tgcttccttcccgttcttctcc

SEQ ID NO: 9285413 - DNA, 22 bp, Homo sapiens
tgcttccttgagctctccaatc

SEQ ID NO: 9285414 - DNA, 22 bp, Homo sapiens
tgcttccttgatcattcccaaa

SEQ ID NO: 9285415 - DNA, 22 bp, Homo sapiens
catgctttgggtcagaaatgcc

SEQ ID NO: 9285416 - DNA, 22 bp, Homo sapiens
tcctgtttaggctgtggtctgg

SEQ ID NO: 9285417 - DNA, 17 bp, Homo sapiens
tcctgtttatcattgat

SEQ ID NO: 9285418 - DNA, 22 bp, Homo sapiens
tcctgtttccaatttgttgggt

SEQ ID NO: 9285419 - DNA, 22 bp, Homo sapiens
tcctgtttctcctgcaaaatcc

SEQ ID NO: 9285420 - DNA, 22 bp, Homo sapiens
tcctgtttatctgtgtgactcg

SEQ ID NO: 9285421 - DNA, 22 bp, Homo sapiens
tcctgtttcaacccttacactg

SEQ ID NO: 9285422 - DNA, 22 bp, Homo sapiens
caggcctgtctgcacatgaggc

SEQ ID NO: 9285423 - DNA, 22 bp, Homo sapiens
gtggagatcctgagtgcatctg

SEQ ID NO: 9285424 - DNA, 22 bp, Homo sapiens
caggtgggcttgggagaacact

SEQ ID NO: 9285425 - DNA, 22 bp, Homo sapiens
tatgtacatcgttgaattcaaa

SEQ ID NO: 9285426 - DNA, 22 bp, Homo sapiens
tagtgttctaagaacatccatg

SEQ ID NO: 9285427 - DNA, 22 bp, Homo sapiens
ttctttctcagtgggcagatac

SEQ ID NO: 9285428 - DNA, 22 bp, Homo sapiens
ttctcaaagggtggtttgcaaa

SEQ ID NO: 9285429 - DNA, 22 bp, Homo sapiens
ttctcaaagaaagctgtcatta

SEQ ID NO: 9285430 - DNA, 22 bp, Homo sapiens
ttctcactatgtatgtagattg

SEQ ID NO: 9285431 - DNA, 22 bp, Homo sapiens
ttctaaaataagtttatctggt

SEQ ID NO: 9285432 - DNA, 22 bp, Homo sapiens
ttatttaaaagtggtaagattc

SEQ ID NO: 9285433 - DNA, 22 bp, Homo sapiens
ttcagaaatcgagtttcatgtc

SEQ ID NO: 9285434 - DNA, 22 bp, Homo sapiens
ttcagaaatccctcttctaccc

SEQ ID NO: 9285435 - DNA, 22 bp, Homo sapiens
ttccaagaagtcaacaggtagt

SEQ ID NO: 9285436 - DNA, 22 bp, Homo sapiens
ttggaattcaagttgtagctta

SEQ ID NO: 9285437 - DNA, 22 bp, Homo sapiens
ttgcattttggttgtaaatatg

SEQ ID NO: 9285438 - DNA, 22 bp, Homo sapiens
tttccttgcacattggtttcca

SEQ ID NO: 9285439 - DNA, 22 bp, Homo sapiens
tttcacaagtaaagtcctaagt

SEQ ID NO: 9285440 - DNA, 22 bp, Homo sapiens
tttcacaagacagctactgttg

SEQ ID NO: 9285441 - DNA, 22 bp, Homo sapiens
tttaacttagaagagatatcct

SEQ ID NO: 9285442 - DNA, 22 bp, Homo sapiens
ttgtttaaaagaaatcatagaa

SEQ ID NO: 9285443 - DNA, 20 bp, Homo sapiens
tttgagaccagtctgcccaa

SEQ ID NO: 9285444 - DNA, 22 bp, Homo sapiens
tttgggctggtttgccatgccc

SEQ ID NO: 9285445 - DNA, 22 bp, Homo sapiens
tttgggcaggcttttccctaga

SEQ ID NO: 9285446 - DNA, 22 bp, Homo sapiens
atccccaggggcattcaagctt

SEQ ID NO: 9285447 - DNA, 23 bp, Homo sapiens
atatgtcatgcaccagcacttta

SEQ ID NO: 9285448 - DNA, 22 bp, Homo sapiens
atatgcaagcacatagaatact

SEQ ID NO: 9285449 - DNA, 22 bp, Homo sapiens
agttgtcccggtctagccactt

SEQ ID NO: 9285450 - DNA, 22 bp, Homo sapiens
agttgctggtaaatgttatcaa

SEQ ID NO: 9285451 - DNA, 22 bp, Homo sapiens
agttgctgggaaagatttcagt

SEQ ID NO: 9285452 - DNA, 21 bp, Homo sapiens
agttgctgctgctgcaggtga

SEQ ID NO: 9285453 - DNA, 21 bp, Homo sapiens
aggtggggctgcacctctgct

SEQ ID NO: 9285454 - DNA, 21 bp, Homo sapiens
aggtgggagaccatgtaggtc

SEQ ID NO: 9285455 - DNA, 22 bp, Homo sapiens
ctccttctgggcctggcagtgg

SEQ ID NO: 9285456 - DNA, 22 bp, Homo sapiens
agtggtggagagatgaggacac

SEQ ID NO: 9285457 - DNA, 22 bp, Homo sapiens
ctcagcctgtgaagagcagagg

SEQ ID NO: 9285458 - DNA, 20 bp, Homo sapiens
agtcccaacattcagctctg

SEQ ID NO: 9285459 - DNA, 22 bp, Homo sapiens
cgggttcacgccattctcctgc

SEQ ID NO: 9285460 - DNA, 22 bp, Homo sapiens
cggggtgggaatagacctgtct

SEQ ID NO: 9285461 - DNA, 22 bp, Homo sapiens
aggcagcctttagacagtctgc

SEQ ID NO: 9285462 - DNA, 23 bp, Homo sapiens
cctccccaccagactctaacata

SEQ ID NO: 9285463 - DNA, 22 bp, Homo sapiens
ccctgtttatttttggagagaa

SEQ ID NO: 9285464 - DNA, 22 bp, Homo sapiens
ccctgtttaagaaacctgtaaa

SEQ ID NO: 9285465 - DNA, 22 bp, Homo sapiens
ccctgtttggatggggacccag

SEQ ID NO: 9285466 - DNA, 22 bp, Homo sapiens
ccctgttttaagttgatattga

SEQ ID NO: 9285467 - DNA, 22 bp, Homo sapiens
cccagcctctgtttgctcctct

SEQ ID NO: 9285468 - DNA, 22 bp, Homo sapiens
cccagcctctgggctcacccaa

SEQ ID NO: 9285469 - DNA, 22 bp, Homo sapiens
agggagaggttgaaacctcagt

SEQ ID NO: 9285470 - DNA, 22 bp, Homo sapiens
agctgggaagactggaagacag

SEQ ID NO: 9285471 - DNA, 23 bp, Homo sapiens
agctgggaattttctgaagcttt

SEQ ID NO: 9285472 - DNA, 22 bp, Homo sapiens
agctctctgataaattgataaa

SEQ ID NO: 9285473 - DNA, 22 bp, Homo sapiens
aggagacactgagacttcacca

SEQ ID NO: 9285474 - DNA, 22 bp, Homo sapiens
cagtcctgctagtgtgaaaagc

SEQ ID NO: 9285475 - DNA, 22 bp, Homo sapiens
cagtcctggagcccttcttggc

SEQ ID NO: 9285476 - DNA, 21 bp, Homo sapiens
cagtcctgcaaataattcttt

SEQ ID NO: 9285477 - DNA, 22 bp, Homo sapiens
aggcagccagttcaggtttctt

SEQ ID NO: 9285478 - DNA, 21 bp, Homo sapiens
aggcagccagtcatgctccct

SEQ ID NO: 9285479 - DNA, 22 bp, Homo sapiens
gtaaaattctagcatctgaaag

SEQ ID NO: 9285480 - DNA, 22 bp, Homo sapiens
ggttccagagtatttcatttca

SEQ ID NO: 9285481 - DNA, 22 bp, Homo sapiens
ggttccagagtgggctgggaaa

SEQ ID NO: 9285482 - DNA, 23 bp, Homo sapiens
ggttccaggaacacagcctgatg

SEQ ID NO: 9285483 - DNA, 22 bp, Homo sapiens
ggtgggtatagttagggcctct

SEQ ID NO: 9285484 - DNA, 22 bp, Homo sapiens
ggtggggttttaggctgctgca

SEQ ID NO: 9285485 - DNA, 21 bp, Homo sapiens
ggtggggtacctaaggtagct

SEQ ID NO: 9285486 - DNA, 20 bp, Homo sapiens
gggtgggagagtctgagggt

SEQ ID NO: 9285487 - DNA, 22 bp, Homo sapiens
gggtgggactctttggcctgag

SEQ ID NO: 9285488 - DNA, 22 bp, Homo sapiens
cagagcctgctcacgtctctgt

SEQ ID NO: 9285489 - DNA, 20 bp, Homo sapiens
ggggaagaaaaggatgtgat

SEQ ID NO: 9285490 - DNA, 22 bp, Homo sapiens
ggggaagaaatctgggttcttc

SEQ ID NO: 9285491 - DNA, 22 bp, Homo sapiens
gggagggtctgagagctgcacc

SEQ ID NO: 9285492 - DNA, 20 bp, Homo sapiens
gctgccttgtcctgcttggt

SEQ ID NO: 9285493 - DNA, 22 bp, Homo sapiens
gctgccttcccggaatgtcatc

SEQ ID NO: 9285494 - DNA, 22 bp, Homo sapiens
gctgccttccaaagagttttat

SEQ ID NO: 9285495 - DNA, 22 bp, Homo sapiens
gctgccttcccaggcctttgct

SEQ ID NO: 9285496 - DNA, 22 bp, Homo sapiens
cacaccagatggcagcgtggga

SEQ ID NO: 9285497 - DNA, 22 bp, Homo sapiens
cacaccagcatggtctcagtgt

SEQ ID NO: 9285498 - DNA, 22 bp, Homo sapiens
gctgtgctgattcattccctgc

SEQ ID NO: 9285499 - DNA, 22 bp, Homo sapiens
ggatgggtgactttgggcaatg

SEQ ID NO: 9285500 - DNA, 22 bp, Homo sapiens
ggcagagcagccccagggtttg

SEQ ID NO: 9285501 - DNA, 22 bp, Homo sapiens
ggcagagctgcatgagcactca

SEQ ID NO: 9285502 - DNA, 22 bp, Homo sapiens
cacagtgtagactaataataga

SEQ ID NO: 9285503 - DNA, 22 bp, Homo sapiens
cacagtgtgactgaccttcagc

SEQ ID NO: 9285504 - DNA, 22 bp, Homo sapiens
cacagtgtctgtgcttcagtgt

SEQ ID NO: 9285505 - DNA, 22 bp, Homo sapiens
gcctgggagagggatagtgcag

SEQ ID NO: 9285506 - DNA, 22 bp, Homo sapiens
caaacctgagaacatgtgctgt

SEQ ID NO: 9285507 - DNA, 22 bp, Homo sapiens
caaacctgctgctattttatcc

SEQ ID NO: 9285508 - DNA, 22 bp, Homo sapiens
caaacctgtccttttgtctcct

SEQ ID NO: 9285509 - DNA, 22 bp, Homo sapiens
caaaccttgcagaactgggcag

SEQ ID NO: 9285510 - DNA, 23 bp, Homo sapiens
caaacctgtttctctcacctgtc

SEQ ID NO: 9285511 - DNA, 22 bp, Homo sapiens
caaacctgttagaggtcatcgt

SEQ ID NO: 9285512 - DNA, 22 bp, Homo sapiens
gcgcaccacctccaggtggccg

SEQ ID NO: 9285513 - DNA, 22 bp, Homo sapiens
gcctgggagggcagcagtgtgg

SEQ ID NO: 9285514 - DNA, 22 bp, Homo sapiens
attggaaatacagtagaaaaat

SEQ ID NO: 9285515 - DNA, 20 bp, Homo sapiens
attattcatacatgtgtgac

SEQ ID NO: 9285516 - DNA, 22 bp, Homo sapiens
attccttgtttcactgaaaagg

SEQ ID NO: 9285517 - DNA, 22 bp, Homo sapiens
attgaaaaatgactattgctta

SEQ ID NO: 9285518 - DNA, 22 bp, Homo sapiens
attgaagattaaatgcttcctt

SEQ ID NO: 9285519 - DNA, 22 bp, Homo sapiens
attgctggtagtcagtgtccct

SEQ ID NO: 9285520 - DNA, 22 bp, Homo sapiens
attgctggcatcagtgacaata

SEQ ID NO: 9285521 - DNA, 22 bp, Homo sapiens
attctattttttaagaagtagt

SEQ ID NO: 9285522 - DNA, 22 bp, Homo sapiens
attctattaatatttctaggaa

SEQ ID NO: 9285523 - DNA, 22 bp, Homo sapiens
atgaaaacggaccagagctatt

SEQ ID NO: 9285524 - DNA, 20 bp, Homo sapiens
atgcaaactcacaaaatacc

SEQ ID NO: 9285525 - DNA, 22 bp, Homo sapiens
atgagtgtgaagttagctcagt

SEQ ID NO: 9285526 - DNA, 22 bp, Homo sapiens
atgaggtggtcttcagtaggtc

SEQ ID NO: 9285527 - DNA, 22 bp, Homo sapiens
gagctgggcctgcgagtgctgc

SEQ ID NO: 9285528 - DNA, 22 bp, Homo sapiens
atggtcagggcaccctggcccc

SEQ ID NO: 9285529 - DNA, 18 bp, Homo sapiens
atgtacatttgctaaagc

SEQ ID NO: 9285530 - DNA, 18 bp, Homo sapiens
agctcacagatctgtttt

SEQ ID NO: 9285531 - DNA, 22 bp, Homo sapiens
agctcacattctcatcagatgt

SEQ ID NO: 9285532 - DNA, 22 bp, Homo sapiens
cagcagcagtgttctagaatct

SEQ ID NO: 9285533 - DNA, 22 bp, Homo sapiens
agaagacagagtctacattcta

SEQ ID NO: 9285534 - DNA, 22 bp, Homo sapiens
agaagcaaggtctgtcagtata

SEQ ID NO: 9285535 - DNA, 23 bp, Homo sapiens
agaagcaatgctttttttcctct

SEQ ID NO: 9285536 - DNA, 22 bp, Homo sapiens
atgggtggccccgtgtgcagtc

SEQ ID NO: 9285537 - DNA, 22 bp, Homo sapiens
atgggtggagggtgacacggat

SEQ ID NO: 9285538 - DNA, 22 bp, Homo sapiens
atggagttctgccagcgctgct

SEQ ID NO: 9285539 - DNA, 22 bp, Homo sapiens
atttcattgaagttaattcttc

SEQ ID NO: 9285540 - DNA, 22 bp, Homo sapiens
attaaagaaacccagcatgtga

SEQ ID NO: 9285541 - DNA, 22 bp, Homo sapiens
attaaagacagcagatggatgg

SEQ ID NO: 9285542 - DNA, 22 bp, Homo sapiens
actcttcatccctttatcagga

SEQ ID NO: 9285543 - DNA, 22 bp, Homo sapiens
actcttcattcaagtatgcaaa

SEQ ID NO: 9285544 - DNA, 22 bp, Homo sapiens
actcttcagtacaataatatct

SEQ ID NO: 9285545 - DNA, 22 bp, Homo sapiens
actgcaacctccacctcctggg

SEQ ID NO: 9285546 - DNA, 22 bp, Homo sapiens
acctgtttaccctgggctcccc

SEQ ID NO: 9285547 - DNA, 22 bp, Homo sapiens
acctgtttacctgcacctgttt

SEQ ID NO: 9285548 - DNA, 22 bp, Homo sapiens
acctgtttagaaagcttatgag

SEQ ID NO: 9285549 - DNA, 22 bp, Homo sapiens
acctgtttctctctgagttact

SEQ ID NO: 9285550 - DNA, 22 bp, Homo sapiens
acctgtttggaggaggtgttag

SEQ ID NO: 9285551 - DNA, 22 bp, Homo sapiens
acctgtttgtgtccattagtga

SEQ ID NO: 9285552 - DNA, 22 bp, Homo sapiens
acctgtttgtgtttggactgca

SEQ ID NO: 9285553 - DNA, 22 bp, Homo sapiens
acctgtttgttaagaaagcttc

SEQ ID NO: 9285554 - DNA, 22 bp, Homo sapiens
acctgttttagtctttaatcat

SEQ ID NO: 9285555 - DNA, 22 bp, Homo sapiens
acctgttttcagaaaatgcaga

SEQ ID NO: 9285556 - DNA, 22 bp, Homo sapiens
acctgttttcctatctagattg

SEQ ID NO: 9285557 - DNA, 22 bp, Homo sapiens
acctgtggatcagattcttgta

SEQ ID NO: 9285558 - DNA, 22 bp, Homo sapiens
agggtgggctagactcttcccc

SEQ ID NO: 9285559 - DNA, 20 bp, Homo sapiens
agggtggggacgttctgact

SEQ ID NO: 9285560 - DNA, 22 bp, Homo sapiens
agggtggggtgctacatcttta

SEQ ID NO: 9285561 - DNA, 23 bp, Homo sapiens
agtttccacccagggtagaaggg

SEQ ID NO: 9285562 - DNA, 21 bp, Homo sapiens
agtttcctcaactgcagaagg

SEQ ID NO: 9285563 - DNA, 22 bp, Homo sapiens
agtttccaggcaggagctaatt

SEQ ID NO: 9285564 - DNA, 22 bp, Homo sapiens
atccagctttgtctggtcttcg

SEQ ID NO: 9285565 - DNA, 22 bp, Homo sapiens
accattgccccctagtgtctgt

SEQ ID NO: 9285566 - DNA, 22 bp, Homo sapiens
accatgttggccaagctggtct

SEQ ID NO: 9285567 - DNA, 22 bp, Homo sapiens
acatgaaagttattctgagttg

SEQ ID NO: 9285568 - DNA, 22 bp, Homo sapiens
aggccttaccatagctgtagca

SEQ ID NO: 9285569 - DNA, 22 bp, Homo sapiens
aggctagggtaacagatgtggc

SEQ ID NO: 9285570 - DNA, 22 bp, Homo sapiens
acagctctgagatattactatt

SEQ ID NO: 9285571 - DNA, 22 bp, Homo sapiens
acagctctccctcagagaaatg

SEQ ID NO: 9285572 - DNA, 22 bp, Homo sapiens
acagtgttttcttaaggagaaa

SEQ ID NO: 9285573 - DNA, 22 bp, Homo sapiens
acagtgttttgtctggcagggc

SEQ ID NO: 9285574 - DNA, 22 bp, Homo sapiens
acagtgttttatgagaattgtt

SEQ ID NO: 9285575 - DNA, 20 bp, Homo sapiens
acagtgtttttgagtagagc

SEQ ID NO: 9285576 - DNA, 22 bp, Homo sapiens
acagtgttttagaaaagcttga

SEQ ID NO: 9285577 - DNA, 22 bp, Homo sapiens
acagtgttctgctttttaatcc

SEQ ID NO: 9285578 - DNA, 22 bp, Homo sapiens
accaggctgttgggcccagtgt

SEQ ID NO: 9285579 - DNA, 22 bp, Homo sapiens
accaggcttgataccaagaaat

SEQ ID NO: 9285580 - DNA, 22 bp, Homo sapiens
acatttctggagtttctcaaca

SEQ ID NO: 9285581 - DNA, 22 bp, Homo sapiens
acatttcttagcctagttccag

SEQ ID NO: 9285582 - DNA, 19 bp, Homo sapiens
acatatgtggatatacatg

SEQ ID NO: 9285583 - DNA, 22 bp, Homo sapiens
acagtgtttggcaatgcatgca

SEQ ID NO: 9285584 - DNA, 22 bp, Homo sapiens
acagtgtttaagagatggcatt

SEQ ID NO: 9285585 - DNA, 22 bp, Homo sapiens
acagtgtttatgtacagattgt

SEQ ID NO: 9285586 - DNA, 22 bp, Homo sapiens
acagtgtttcacttaaccgttt

SEQ ID NO: 9285587 - DNA, 22 bp, Homo sapiens
acagtgttcttgatattacagt

SEQ ID NO: 9285588 - DNA, 22 bp, Homo sapiens
acagtgttcttggcgctgagtg

SEQ ID NO: 9285589 - DNA, 22 bp, Homo sapiens
acagtgtttaaaaatcagatct

SEQ ID NO: 9285590 - DNA, 22 bp, Homo sapiens
acagtgtttaaaataatatgct

SEQ ID NO: 9285591 - DNA, 22 bp, Homo sapiens
acagtgttgtggctcttaatag

SEQ ID NO: 9285592 - DNA, 22 bp, Homo sapiens
acagtgttgtatttagtttgat

SEQ ID NO: 9285593 - DNA, 22 bp, Homo sapiens
acagtgttgaggtgcttgtttc

SEQ ID NO: 9285594 - DNA, 22 bp, Homo sapiens
agagggggcagcggaccagtga

SEQ ID NO: 9285595 - DNA, 22 bp, Homo sapiens
agagggggtgttccagaagcat

SEQ ID NO: 9285596 - DNA, 23 bp, Homo sapiens
aatgggtgcaactatccatgaca

SEQ ID NO: 9285597 - DNA, 22 bp, Homo sapiens
aattaaaaaaggagagcttgct

SEQ ID NO: 9285598 - DNA, 22 bp, Homo sapiens
acacttcagcagtatgcttggg

SEQ ID NO: 9285599 - DNA, 22 bp, Homo sapiens
acacttcacccctgctcccagt

SEQ ID NO: 9285600 - DNA, 22 bp, Homo sapiens
acactagctaaatgctgattaa

SEQ ID NO: 9285601 - DNA, 22 bp, Homo sapiens
aagcaatagggtaatctactca

SEQ ID NO: 9285602 - DNA, 22 bp, Homo sapiens
acagcagagcaccagggccact

SEQ ID NO: 9285603 - DNA, 22 bp, Homo sapiens
aagcagcttaaattagagcctg

SEQ ID NO: 9285604 - DNA, 22 bp, Homo sapiens
aatttcacagtgaactttgagg

SEQ ID NO: 9285605 - DNA, 21 bp, Homo sapiens
acacaaacctcctcagcctgg

SEQ ID NO: 9285606 - DNA, 22 bp, Homo sapiens
aagagacatgaatactcgaagg

SEQ ID NO: 9285607 - DNA, 22 bp, Homo sapiens
aagagacaagaattccaacgct

SEQ ID NO: 9285608 - DNA, 22 bp, Homo sapiens
aaatcttcctgaaatttgttca

SEQ ID NO: 9285609 - DNA, 22 bp, Homo sapiens
aacacttctcatcactgcaagc

SEQ ID NO: 9285610 - DNA, 22 bp, Homo sapiens
aacacttctgttgataataagc

SEQ ID NO: 9285611 - DNA, 22 bp, Homo sapiens
aacacttcaagcagaaggttgg

SEQ ID NO: 9285612 - DNA, 22 bp, Homo sapiens
aacacttcccatcagagggaca

SEQ ID NO: 9285613 - DNA, 22 bp, Homo sapiens
aacacttcccgaccatatggct

SEQ ID NO: 9285614 - DNA, 22 bp, Homo sapiens
aaaatattttagggccaggaga

SEQ ID NO: 9285615 - DNA, 22 bp, Homo sapiens
aaacagcagctgtttaatttgc

SEQ ID NO: 9285616 - DNA, 22 bp, Homo sapiens
gtcagctaggcagctgtgatgg

SEQ ID NO: 9285617 - DNA, 22 bp, Homo sapiens
gtcctgttggtgaatggctctt

SEQ ID NO: 9285618 - DNA, 21 bp, Homo sapiens
gtcctgttcctgaaccttccc

SEQ ID NO: 9285619 - DNA, 22 bp, Homo sapiens
gtcctgttgtgagctgccttcc

SEQ ID NO: 9285620 - DNA, 22 bp, Homo sapiens
gtaaacattactgtgctgtata

SEQ ID NO: 9285621 - DNA, 22 bp, Homo sapiens
ggtggtggtcccgacttgggag

SEQ ID NO: 9285622 - DNA, 22 bp, Homo sapiens
gggtggggttcaggaatcttca

SEQ ID NO: 9285623 - DNA, 22 bp, Homo sapiens
gggtggggtgtatcggatccta

SEQ ID NO: 9285624 - DNA, 22 bp, Homo sapiens
gggtggggcccaggaaatctat

SEQ ID NO: 9285625 - DNA, 22 bp, Homo sapiens
gggtggggccaggcaatttgca

SEQ ID NO: 9285626 - DNA, 22 bp, Homo sapiens
gtggaggaaaagaagttgggtg

SEQ ID NO: 9285627 - DNA, 22 bp, Homo sapiens
gtgggatgcttaggatcttgcc

SEQ ID NO: 9285628 - DNA, 22 bp, Homo sapiens
gtgggatgcagtggtgagtggc

SEQ ID NO: 9285629 - DNA, 22 bp, Homo sapiens
gtggcattgacatgtaaacagt

SEQ ID NO: 9285630 - DNA, 22 bp, Homo sapiens
gttcaaaattcaaatggtatac

SEQ ID NO: 9285631 - DNA, 18 bp, Homo sapiens
gttcaaggtcaagagaga

SEQ ID NO: 9285632 - DNA, 22 bp, Homo sapiens
gttcaaggaagggaggaaagcc

SEQ ID NO: 9285633 - DNA, 22 bp, Homo sapiens
gttcgcatcttgatcatggact

SEQ ID NO: 9285634 - DNA, 22 bp, Homo sapiens
gttcaagaccagcctggccaac

SEQ ID NO: 9285635 - DNA, 22 bp, Homo sapiens
gtggggtgggctgagttaggcc

SEQ ID NO: 9285636 - DNA, 22 bp, Homo sapiens
gtgggtggagactgggtgcaag

SEQ ID NO: 9285637 - DNA, 22 bp, Homo sapiens
gtggtgtaggtcacagttagga

SEQ ID NO: 9285638 - DNA, 22 bp, Homo sapiens
gtgggcatcaccagggcctcca

SEQ ID NO: 9285639 - DNA, 22 bp, Homo sapiens
gtgggcattggagggggtacag

SEQ ID NO: 9285640 - DNA, 22 bp, Homo sapiens
ggaaggtgctccctggacagag

SEQ ID NO: 9285641 - DNA, 22 bp, Homo sapiens
gcttccttctaccacatcatgc

SEQ ID NO: 9285642 - DNA, 22 bp, Homo sapiens
gcttccttattgttgccatagt

SEQ ID NO: 9285643 - DNA, 22 bp, Homo sapiens
gcttacaggtgaggcagcaaga

SEQ ID NO: 9285644 - DNA, 22 bp, Homo sapiens
gctgggcagtgagtgagtcctt

SEQ ID NO: 9285645 - DNA, 18 bp, Homo sapiens
ggaaggtgctggagtgca

SEQ ID NO: 9285646 - DNA, 22 bp, Homo sapiens
ggagacagcaggaagaaatatc

SEQ ID NO: 9285647 - DNA, 17 bp, Homo sapiens
ggagacagggtctttaa

SEQ ID NO: 9285648 - DNA, 22 bp, Homo sapiens
ggaggtggcagagggacattct

SEQ ID NO: 9285649 - DNA, 22 bp, Homo sapiens
ggaggggtggtcacctggcagg

SEQ ID NO: 9285650 - DNA, 22 bp, Homo sapiens
ggagtgggaacaatgacatggt

SEQ ID NO: 9285651 - DNA, 19 bp, Homo sapiens
ggagtgggtagttagtggt

SEQ ID NO: 9285652 - DNA, 22 bp, Homo sapiens
ggcagacctctccagccccaca

SEQ ID NO: 9285653 - DNA, 22 bp, Homo sapiens
ggcagaggaagctggaagtggg

SEQ ID NO: 9285654 - DNA, 22 bp, Homo sapiens
ggggaagggagtccaagtgtta

SEQ ID NO: 9285655 - DNA, 22 bp, Homo sapiens
gggtgggatggcaggagccgct

SEQ ID NO: 9285656 - DNA, 23 bp, Homo sapiens
gggtgggccaaattaggtagcct

SEQ ID NO: 9285657 - DNA, 22 bp, Homo sapiens
gggtgggccactgagcagcgtg

SEQ ID NO: 9285658 - DNA, 22 bp, Homo sapiens
gggtgggcctgtctggccatgt

SEQ ID NO: 9285659 - DNA, 22 bp, Homo sapiens
gggtgggccccaggtatctgta

SEQ ID NO: 9285660 - DNA, 22 bp, Homo sapiens
gggtgggaacaggatgccagga

SEQ ID NO: 9285661 - DNA, 20 bp, Homo sapiens
ggggggcttcagggcctgtg

SEQ ID NO: 9285662 - DNA, 22 bp, Homo sapiens
gggatggatcttggctgaggct

SEQ ID NO: 9285663 - DNA, 22 bp, Homo sapiens
gggatggacttggggactccag

SEQ ID NO: 9285664 - DNA, 22 bp, Homo sapiens
gggcagaggttcaacttcaaca

SEQ ID NO: 9285665 - DNA, 22 bp, Homo sapiens
ggctgcaggcagaggctgtctg

SEQ ID NO: 9285666 - DNA, 22 bp, Homo sapiens
gggaagagaccgtaccctggcc

SEQ ID NO: 9285667 - DNA, 22 bp, Homo sapiens
ggctcagcacagggctggcatc

SEQ ID NO: 9285668 - DNA, 22 bp, Homo sapiens
gcacttggatatacaaatgaag

SEQ ID NO: 9285669 - DNA, 22 bp, Homo sapiens
gattttcatttgcactctagaa

SEQ ID NO: 9285670 - DNA, 22 bp, Homo sapiens
gattttcatgataaacttgtga

SEQ ID NO: 9285671 - DNA, 22 bp, Homo sapiens
gatttcttgataattcaaatcc

SEQ ID NO: 9285672 - DNA, 22 bp, Homo sapiens
gatttcttggcccactctcaga

SEQ ID NO: 9285673 - DNA, 22 bp, Homo sapiens
gatttctttgtacccacaatcc

SEQ ID NO: 9285674 - DNA, 22 bp, Homo sapiens
gatttcttctctcccaagagga

SEQ ID NO: 9285675 - DNA, 22 bp, Homo sapiens
gcacaaactgcaattacttttg

SEQ ID NO: 9285676 - DNA, 22 bp, Homo sapiens
gatggtggcaagagccaagtct

SEQ ID NO: 9285677 - DNA, 22 bp, Homo sapiens
gcagcctctgcagttcaggagg

SEQ ID NO: 9285678 - DNA, 22 bp, Homo sapiens
gcagctctgtctttcttaaagt

SEQ ID NO: 9285679 - DNA, 22 bp, Homo sapiens
gcaggctgctgagatccttagg

SEQ ID NO: 9285680 - DNA, 22 bp, Homo sapiens
gcaggtggtccccgtggagtgg

SEQ ID NO: 9285681 - DNA, 22 bp, Homo sapiens
gcaggtgggggtcggtgcatct

SEQ ID NO: 9285682 - DNA, 22 bp, Homo sapiens
gcagtgttaggaataaaaatga

SEQ ID NO: 9285683 - DNA, 22 bp, Homo sapiens
gcagtgttacttggtttgcaga

SEQ ID NO: 9285684 - DNA, 22 bp, Homo sapiens
gcagtgttatgttttctataat

SEQ ID NO: 9285685 - DNA, 22 bp, Homo sapiens
gcagtgttccttctactggggc

SEQ ID NO: 9285686 - DNA, 22 bp, Homo sapiens
gcagtgttcagtgaagcaggag

SEQ ID NO: 9285687 - DNA, 22 bp, Homo sapiens
gcagtgttgagccagctggggg

SEQ ID NO: 9285688 - DNA, 22 bp, Homo sapiens
gcagtgttgagtggtggctgaa

SEQ ID NO: 9285689 - DNA, 22 bp, Homo sapiens
gcagtgttgactatggtatgag

SEQ ID NO: 9285690 - DNA, 22 bp, Homo sapiens
gcagtgttcttgttgcttttat

SEQ ID NO: 9285691 - DNA, 22 bp, Homo sapiens
gcagtgttctaaattgggtgtg

SEQ ID NO: 9285692 - DNA, 22 bp, Homo sapiens
gcccttacagggtggtcagcca

SEQ ID NO: 9285693 - DNA, 22 bp, Homo sapiens
gccaggctgctccagggaggcc

SEQ ID NO: 9285694 - DNA, 22 bp, Homo sapiens
gccaggctggtgcaaggatatt

SEQ ID NO: 9285695 - DNA, 22 bp, Homo sapiens
gccaggctgtggggaacttgaa

SEQ ID NO: 9285696 - DNA, 20 bp, Homo sapiens
gcctgtgtcttctctgctgt

SEQ ID NO: 9285697 - DNA, 23 bp, Homo sapiens
gcctgggactggtagtgtgacct

SEQ ID NO: 9285698 - DNA, 22 bp, Homo sapiens
gctcttctcagattgtacactc

SEQ ID NO: 9285699 - DNA, 22 bp, Homo sapiens
gcctgtttccatcaacacatgc

SEQ ID NO: 9285700 - DNA, 22 bp, Homo sapiens
gcctgtttaagtattctgacat

SEQ ID NO: 9285701 - DNA, 22 bp, Homo sapiens
gcctgtttatctatcatgaact

SEQ ID NO: 9285702 - DNA, 22 bp, Homo sapiens
gcctgtttactttgccgcagga

SEQ ID NO: 9285703 - DNA, 22 bp, Homo sapiens
gcctgtttgagaatagtcaggg

SEQ ID NO: 9285704 - DNA, 22 bp, Homo sapiens
gcctgtttgactggtctctgct

SEQ ID NO: 9285705 - DNA, 22 bp, Homo sapiens
gcctgtttctcctccttggccc

SEQ ID NO: 9285706 - DNA, 22 bp, Homo sapiens
gcctgtttccctgacgcttaca

SEQ ID NO: 9285707 - DNA, 22 bp, Homo sapiens
gcctgtttctaatctcatttct

SEQ ID NO: 9285708 - DNA, 22 bp, Homo sapiens
gcctgtttgttatgtcatggta

SEQ ID NO: 9285709 - DNA, 22 bp, Homo sapiens
gcctgtttggctgctgacattg

SEQ ID NO: 9285710 - DNA, 22 bp, Homo sapiens
gcctgtttggaatctgtttaat

SEQ ID NO: 9285711 - DNA, 22 bp, Homo sapiens
gcctgtttggcatcattggttg

SEQ ID NO: 9285712 - DNA, 22 bp, Homo sapiens
gcctgtttgtttgcaaaggagc

SEQ ID NO: 9285713 - DNA, 22 bp, Homo sapiens
gcctgttttagatgcattgatg

SEQ ID NO: 9285714 - DNA, 22 bp, Homo sapiens
gcctgttttcctgctgtggttg

SEQ ID NO: 9285715 - DNA, 22 bp, Homo sapiens
gcctgtttttgcttcgtttaag

SEQ ID NO: 9285716 - DNA, 22 bp, Homo sapiens
gctggcctttgaggaagctgcg

SEQ ID NO: 9285717 - DNA, 22 bp, Homo sapiens
gctggagagtagtaagcagtta

SEQ ID NO: 9285718 - DNA, 22 bp, Homo sapiens
gctggagatgctatgcagaggg

SEQ ID NO: 9285719 - DNA, 22 bp, Homo sapiens
gctgaggatatagcaggaacaa

SEQ ID NO: 9285720 - DNA, 22 bp, Homo sapiens
gagctgggagttatagcatgtt

SEQ ID NO: 9285721 - DNA, 16 bp, Homo sapiens
gaggctggcagatgtc

SEQ ID NO: 9285722 - DNA, 22 bp, Homo sapiens
gaggctggagatattccaatct

SEQ ID NO: 9285723 - DNA, 22 bp, Homo sapiens
gaggtggggttttgttcttgaa

SEQ ID NO: 9285724 - DNA, 22 bp, Homo sapiens
gaggtgggatgtgtgtgctact

SEQ ID NO: 9285725 - DNA, 22 bp, Homo sapiens
gaggtgggagggcagtccctaa

SEQ ID NO: 9285726 - DNA, 22 bp, Homo sapiens
gagtgaggctggaatcatggct

SEQ ID NO: 9285727 - DNA, 22 bp, Homo sapiens
gaaaggtgccccataggcagga

SEQ ID NO: 9285728 - DNA, 22 bp, Homo sapiens
gaaatacaaagccagccatttt

SEQ ID NO: 9285729 - DNA, 22 bp, Homo sapiens
gaagttcaaaagacagatttga

SEQ ID NO: 9285730 - DNA, 22 bp, Homo sapiens
gaagttcaggtgggaattgagc

SEQ ID NO: 9285731 - DNA, 22 bp, Homo sapiens
gaagttcacatagctggcaggt

SEQ ID NO: 9285732 - DNA, 22 bp, Homo sapiens
tgtcatgggtctaaacattgat

SEQ ID NO: 9285733 - DNA, 22 bp, Homo sapiens
tgtcatgggcatttattgaggg

SEQ ID NO: 9285734 - DNA, 22 bp, Homo sapiens
cctggcctcagcctagggctga

SEQ ID NO: 9285735 - DNA, 22 bp, Homo sapiens
tgtctcatctcttaaccccact

SEQ ID NO: 9285736 - DNA, 21 bp, Homo sapiens
tgtctcaatcagaagtcatta

SEQ ID NO: 9285737 - DNA, 21 bp, Homo sapiens
tgtctcaagaaaggcctctcc

SEQ ID NO: 9285738 - DNA, 22 bp, Homo sapiens
tgtgctggggtccagctgagcc

SEQ ID NO: 9285739 - DNA, 22 bp, Homo sapiens
tgtgagcagagacatgaaaagc

SEQ ID NO: 9285740 - DNA, 22 bp, Homo sapiens
cctgggtcctggcagcctcctg

SEQ ID NO: 9285741 - DNA, 22 bp, Homo sapiens
tgctggagagccttggccaagg

SEQ ID NO: 9285742 - DNA, 22 bp, Homo sapiens
tgctggagacatagcaggcagc

SEQ ID NO: 9285743 - DNA, 22 bp, Homo sapiens
cccagcctgtgacagccgtcct

SEQ ID NO: 9285744 - DNA, 22 bp, Homo sapiens
cccagcctggtgcactgtgggg

SEQ ID NO: 9285745 - DNA, 22 bp, Homo sapiens
cccagcctgtctttcccaatga

SEQ ID NO: 9285746 - DNA, 22 bp, Homo sapiens
cccagcctactctgccatagca

SEQ ID NO: 9285747 - DNA, 22 bp, Homo sapiens
tgccacagacaggacagaacag

SEQ ID NO: 9285748 - DNA, 22 bp, Homo sapiens
tgccacagagactttcattgta

SEQ ID NO: 9285749 - DNA, 22 bp, Homo sapiens
ctggagttgggatgtgcctgga

SEQ ID NO: 9285750 - DNA, 23 bp, Homo sapiens
ctgctttcccactccatgctctt

SEQ ID NO: 9285751 - DNA, 22 bp, Homo sapiens
ctgctttcttgttgcatcttaa

SEQ ID NO: 9285752 - DNA, 22 bp, Homo sapiens
ctgattgagaaggaaggggatc

SEQ ID NO: 9285753 - DNA, 22 bp, Homo sapiens
tttaaaaaactagtctgagtct

SEQ ID NO: 9285754 - DNA, 22 bp, Homo sapiens
ttggcattcatgggacaacaaa

SEQ ID NO: 9285755 - DNA, 22 bp, Homo sapiens
ttggcattggagatgcaagaac

SEQ ID NO: 9285756 - DNA, 22 bp, Homo sapiens
ttggcattgaagtttcattggt

SEQ ID NO: 9285757 - DNA, 22 bp, Homo sapiens
tttacatggaatattgtcttgt

SEQ ID NO: 9285758 - DNA, 22 bp, Homo sapiens
ttcctttgggaaatcactaagg

SEQ ID NO: 9285759 - DNA, 22 bp, Homo sapiens
ttctgtatttagtttgaggaca

SEQ ID NO: 9285760 - DNA, 22 bp, Homo sapiens
ctcagcagtaaacgtccggaac

SEQ ID NO: 9285761 - DNA, 22 bp, Homo sapiens
ctcagcagagaccagggaggaa

SEQ ID NO: 9285762 - DNA, 22 bp, Homo sapiens
ttcagaaaggtaaatggatttc

SEQ ID NO: 9285763 - DNA, 22 bp, Homo sapiens
caggcagctgcgacaagagagc

SEQ ID NO: 9285764 - DNA, 22 bp, Homo sapiens
caggcagctctgcttttcctaa

SEQ ID NO: 9285765 - DNA, 22 bp, Homo sapiens
gttcacaagagttacagacaga

SEQ ID NO: 9285766 - DNA, 22 bp, Homo sapiens
gtgtttggtcagacgtccgggg

SEQ ID NO: 9285767 - DNA, 22 bp, Homo sapiens
gttggagtgcagcttgtgcgat

SEQ ID NO: 9285768 - DNA, 22 bp, Homo sapiens
gttctgtctgagcaccacagga

SEQ ID NO: 9285769 - DNA, 22 bp, Homo sapiens
gtgggtggaggcgtcgagggca

SEQ ID NO: 9285770 - DNA, 22 bp, Homo sapiens
gtgggtggatcatgaggtcagg

SEQ ID NO: 9285771 - DNA, 22 bp, Homo sapiens
gtgggtggatcacctgaggtca

SEQ ID NO: 9285772 - DNA, 22 bp, Homo sapiens
gtggggatcactggggacaatc

SEQ ID NO: 9285773 - DNA, 20 bp, Homo sapiens
ccagaagagatgatcatcca

SEQ ID NO: 9285774 - DNA, 16 bp, Homo sapiens
ccacctgcagctctca

SEQ ID NO: 9285775 - DNA, 22 bp, Homo sapiens
ccacagctagggcaatctgatt

SEQ ID NO: 9285776 - DNA, 17 bp, Homo sapiens
tcctgccacctgtcagg

SEQ ID NO: 9285777 - DNA, 22 bp, Homo sapiens
tcctgccacctgcacagctccc

SEQ ID NO: 9285778 - DNA, 22 bp, Homo sapiens
ccaaagtgctggggttacaggc

SEQ ID NO: 9285779 - DNA, 23 bp, Homo sapiens
ccacaaaccatttgtgaaggagc

SEQ ID NO: 9285780 - DNA, 22 bp, Homo sapiens
ccaaagtctgcattttaacatg

SEQ ID NO: 9285781 - DNA, 22 bp, Homo sapiens
ccaaagtcctttctccacctgc

SEQ ID NO: 9285782 - DNA, 22 bp, Homo sapiens
ccagcctggagggcagtggtgg

SEQ ID NO: 9285783 - DNA, 22 bp, Homo sapiens
cagtctccaaatcagtctgaat

SEQ ID NO: 9285784 - DNA, 18 bp, Homo sapiens
cagtcctgtttctacagg

SEQ ID NO: 9285785 - DNA, 22 bp, Homo sapiens
cagtcctgtctttatgacttca

SEQ ID NO: 9285786 - DNA, 22 bp, Homo sapiens
cagtgctgacagggaggaacct

SEQ ID NO: 9285787 - DNA, 22 bp, Homo sapiens
tacatgtgttctgtttcaagtt

SEQ ID NO: 9285788 - DNA, 22 bp, Homo sapiens
tcagctctgttttgagtggaac

SEQ ID NO: 9285789 - DNA, 22 bp, Homo sapiens
tctgcccttggctctcttgttg

SEQ ID NO: 9285790 - DNA, 22 bp, Homo sapiens
tctgttgcaatgtgcatggtga

SEQ ID NO: 9285791 - DNA, 22 bp, Homo sapiens
tcttcaacagtaaacccacttt

SEQ ID NO: 9285792 - DNA, 22 bp, Homo sapiens
tcttctgttttagattgcatac

SEQ ID NO: 9285793 - DNA, 22 bp, Homo sapiens
tcttcctcttctgctgagaagt

SEQ ID NO: 9285794 - DNA, 22 bp, Homo sapiens
tctttctggttatgtatagaga

SEQ ID NO: 9285795 - DNA, 22 bp, Homo sapiens
tctttctgcacttagtggggct

SEQ ID NO: 9285796 - DNA, 22 bp, Homo sapiens
tcttgcttgatacatggaggaa

SEQ ID NO: 9285797 - DNA, 22 bp, Homo sapiens
tcttgaaggggggcagtgttga

SEQ ID NO: 9285798 - DNA, 22 bp, Homo sapiens
tcttggaacttattattgtaga

SEQ ID NO: 9285799 - DNA, 22 bp, Homo sapiens
tcttggaatctccatagagtga

SEQ ID NO: 9285800 - DNA, 18 bp, Homo sapiens
tctcttcttggcagtcaa

SEQ ID NO: 9285801 - DNA, 22 bp, Homo sapiens
tctcttctaattagggtccatg

SEQ ID NO: 9285802 - DNA, 22 bp, Homo sapiens
tctcttctagcttcttgtggtt

SEQ ID NO: 9285803 - DNA, 19 bp, Homo sapiens
tctcttctccctggtttta

SEQ ID NO: 9285804 - DNA, 22 bp, Homo sapiens
tctcttctttggggtgggctca

SEQ ID NO: 9285805 - DNA, 22 bp, Homo sapiens
tctccttgctacccagtatgtc

SEQ ID NO: 9285806 - DNA, 22 bp, Homo sapiens
tctcgctctgtcgcccaggctg

SEQ ID NO: 9285807 - DNA, 22 bp, Homo sapiens
tctcctggatggaccttctctt

SEQ ID NO: 9285808 - DNA, 19 bp, Homo sapiens
tctccaaaaccaatcacta

SEQ ID NO: 9285809 - DNA, 22 bp, Homo sapiens
tctcagggctcagagctcaggc

SEQ ID NO: 9285810 - DNA, 22 bp, Homo sapiens
tctcagctgactgctttcctcg

SEQ ID NO: 9285811 - DNA, 22 bp, Homo sapiens
tctcactttgttgcccagactt

SEQ ID NO: 9285812 - DNA, 22 bp, Homo sapiens
tcctggctctaagtcctgagtg

SEQ ID NO: 9285813 - DNA, 22 bp, Homo sapiens
tcctggctcctggagacctgct

SEQ ID NO: 9285814 - DNA, 17 bp, Homo sapiens
tcctggctctgccactg

SEQ ID NO: 9285815 - DNA, 22 bp, Homo sapiens
tcctgggaagcgccggcctgcg

SEQ ID NO: 9285816 - DNA, 22 bp, Homo sapiens
tcctgggaagagacctgagcat

SEQ ID NO: 9285817 - DNA, 22 bp, Homo sapiens
tcctgggagtaattgagtcatg

SEQ ID NO: 9285818 - DNA, 19 bp, Homo sapiens
tcgtggggaggtgggcagc

SEQ ID NO: 9285819 - DNA, 22 bp, Homo sapiens
tcctttctccgggggactgttg

SEQ ID NO: 9285820 - DNA, 22 bp, Homo sapiens
tcctttgcttctgtcattctcc

SEQ ID NO: 9285821 - DNA, 22 bp, Homo sapiens
tcgaactcatagtcgtagctgt

SEQ ID NO: 9285822 - DNA, 22 bp, Homo sapiens
tccttcaaagctcctagtgagc

SEQ ID NO: 9285823 - DNA, 22 bp, Homo sapiens
tccttcaaaagttgagagagcc

SEQ ID NO: 9285824 - DNA, 22 bp, Homo sapiens
tccttctttccccctagtcatt

SEQ ID NO: 9285825 - DNA, 22 bp, Homo sapiens
tccttctttgacaagtggcaga

SEQ ID NO: 9285826 - DNA, 22 bp, Homo sapiens
tccttggaggtgttcatctgcc

SEQ ID NO: 9285827 - DNA, 22 bp, Homo sapiens
tctcacaagctcaaggattagt

SEQ ID NO: 9285828 - DNA, 21 bp, Homo sapiens
tctcacaatatgatgccagat

SEQ ID NO: 9285829 - DNA, 22 bp, Homo sapiens
tctatttcgcatataagttttg

SEQ ID NO: 9285830 - DNA, 22 bp, Homo sapiens
tctagttctagatccctgagga

SEQ ID NO: 9285831 - DNA, 22 bp, Homo sapiens
tgcagccttgcctcctcccagc

SEQ ID NO: 9285832 - DNA, 18 bp, Homo sapiens
tgcagcctgtagtcttgt

SEQ ID NO: 9285833 - DNA, 22 bp, Homo sapiens
tgcagcctggtggtcactggag

SEQ ID NO: 9285834 - DNA, 22 bp, Homo sapiens
tgcagccttggcaaccagggac

SEQ ID NO: 9285835 - DNA, 22 bp, Homo sapiens
tgcagcctttagaagttcagat

SEQ ID NO: 9285836 - DNA, 22 bp, Homo sapiens
tgcagcctcacgcatccgcatt

SEQ ID NO: 9285837 - DNA, 22 bp, Homo sapiens
tgcagcctggcttcgcgcctcc

SEQ ID NO: 9285838 - DNA, 21 bp, Homo sapiens
tgcagcctctgcccagcagtg

SEQ ID NO: 9285839 - DNA, 22 bp, Homo sapiens
tgcagcctctctgcttcaggaa

SEQ ID NO: 9285840 - DNA, 22 bp, Homo sapiens
tgcagcctagacattctggtca

SEQ ID NO: 9285841 - DNA, 23 bp, Homo sapiens
tgcaacaatgaggaaagctactg

SEQ ID NO: 9285842 - DNA, 22 bp, Homo sapiens
tgatttcaggaatgtcttagca

SEQ ID NO: 9285843 - DNA, 22 bp, Homo sapiens
tgatcccaatctttcctgctcc

SEQ ID NO: 9285844 - DNA, 22 bp, Homo sapiens
tgatcagcatcttcccagctcg

SEQ ID NO: 9285845 - DNA, 22 bp, Homo sapiens
tgagtgtggggaatgtcatgag

SEQ ID NO: 9285846 - DNA, 22 bp, Homo sapiens
tgatttaaaagaaacattgtct

SEQ ID NO: 9285847 - DNA, 22 bp, Homo sapiens
tgccatccaacagttccatctt

SEQ ID NO: 9285848 - DNA, 22 bp, Homo sapiens
tgccatttctttcaatattctt

SEQ ID NO: 9285849 - DNA, 22 bp, Homo sapiens
tgccgtggggctgaggctggag

SEQ ID NO: 9285850 - DNA, 22 bp, Homo sapiens
tgcattcctttgtctgttaaag

SEQ ID NO: 9285851 - DNA, 22 bp, Homo sapiens
tgccacagtttcatggattctg

SEQ ID NO: 9285852 - DNA, 22 bp, Homo sapiens
tgcatgttaagaaaatattgag

SEQ ID NO: 9285853 - DNA, 22 bp, Homo sapiens
tgagatggggagggctgcagaa

SEQ ID NO: 9285854 - DNA, 22 bp, Homo sapiens
tgagatggagtcttgctctgtt

SEQ ID NO: 9285855 - DNA, 22 bp, Homo sapiens
tgagatgaataactcctgctaa

SEQ ID NO: 9285856 - DNA, 22 bp, Homo sapiens
tgagccgtggtctctgagggtg

SEQ ID NO: 9285857 - DNA, 22 bp, Homo sapiens
tgaggctggatgggatgcctcc

SEQ ID NO: 9285858 - DNA, 22 bp, Homo sapiens
tgaggtgggtgtcaggtcagag

SEQ ID NO: 9285859 - DNA, 22 bp, Homo sapiens
tgaagcaatgatagcagaatga

SEQ ID NO: 9285860 - DNA, 22 bp, Homo sapiens
tgaagcaatagagacaagacca

SEQ ID NO: 9285861 - DNA, 22 bp, Homo sapiens
tgaagactcagaagctaagata

SEQ ID NO: 9285862 - DNA, 22 bp, Homo sapiens
tgaagcaagatagaaagctgct

SEQ ID NO: 9285863 - DNA, 22 bp, Homo sapiens
tgaagcaaacgcttctgttcct

SEQ ID NO: 9285864 - DNA, 22 bp, Homo sapiens
tgaaacaaaccagtaattttgt

SEQ ID NO: 9285865 - DNA, 22 bp, Homo sapiens
tgaatgcttggagtcataaaat

SEQ ID NO: 9285866 - DNA, 22 bp, Homo sapiens
tgacaaaccctgcaaatagctc

SEQ ID NO: 9285867 - DNA, 22 bp, Homo sapiens
tgaaggtggaagggtggttctg

SEQ ID NO: 9285868 - DNA, 22 bp, Homo sapiens
tgacagcattactaatacatgt

SEQ ID NO: 9285869 - DNA, 22 bp, Homo sapiens
tgacctattagatttccttgcc

SEQ ID NO: 9285870 - DNA, 22 bp, Homo sapiens
tggcatttagttgcgtattgca

SEQ ID NO: 9285871 - DNA, 22 bp, Homo sapiens
tggcagcattttttccagaaca

SEQ ID NO: 9285872 - DNA, 22 bp, Homo sapiens
tgcttgcaagagatgcaatgac

SEQ ID NO: 9285873 - DNA, 22 bp, Homo sapiens
tgctttaaaccatggatgtgag

SEQ ID NO: 9285874 - DNA, 19 bp, Homo sapiens
tggaaaatggattgaatca

SEQ ID NO: 9285875 - DNA, 22 bp, Homo sapiens
tggagaggagcaccatggccat

SEQ ID NO: 9285876 - DNA, 20 bp, Homo sapiens
tggaggtggtctgctgtcct

SEQ ID NO: 9285877 - DNA, 22 bp, Homo sapiens
tggaggtggcatctgacagctg

SEQ ID NO: 9285878 - DNA, 22 bp, Homo sapiens
tggagggaacaaaggagtccca

SEQ ID NO: 9285879 - DNA, 22 bp, Homo sapiens
tggaggtgtataaggtagcttc

SEQ ID NO: 9285880 - DNA, 19 bp, Homo sapiens
tgctggaggttgacagggt

SEQ ID NO: 9285881 - DNA, 22 bp, Homo sapiens
tgctggagtgagattatgagtt

SEQ ID NO: 9285882 - DNA, 22 bp, Homo sapiens
tgctggaggggcctgaccagga

SEQ ID NO: 9285883 - DNA, 19 bp, Homo sapiens
tgctggagggtagtgagtc

SEQ ID NO: 9285884 - DNA, 23 bp, Homo sapiens
tgctggagtttactcaggccagc

SEQ ID NO: 9285885 - DNA, 22 bp, Homo sapiens
tgctggagcggaggtgagccag

SEQ ID NO: 9285886 - DNA, 22 bp, Homo sapiens
tgctgctttgatgtgtaaatca

SEQ ID NO: 9285887 - DNA, 20 bp, Homo sapiens
tgctgctttgccactagttg

SEQ ID NO: 9285888 - DNA, 22 bp, Homo sapiens
tgctgtgacgcctcaggaatcc

SEQ ID NO: 9285889 - DNA, 22 bp, Homo sapiens
tgctgtgataattcaatgagct

SEQ ID NO: 9285890 - DNA, 22 bp, Homo sapiens
tgctgagcgcatccggcggccg

SEQ ID NO: 9285891 - DNA, 23 bp, Homo sapiens
tggtggggtcttggagacagcac

SEQ ID NO: 9285892 - DNA, 22 bp, Homo sapiens
tggtgggagtgacgttgccttc

SEQ ID NO: 9285893 - DNA, 22 bp, Homo sapiens
tggtgggagtgagggcatgcca

SEQ ID NO: 9285894 - DNA, 22 bp, Homo sapiens
tggtggggattccctccctggc

SEQ ID NO: 9285895 - DNA, 22 bp, Homo sapiens
tggtggggccagacttcagctc

SEQ ID NO: 9285896 - DNA, 22 bp, Homo sapiens
tggtggggctttccttctgctt

SEQ ID NO: 9285897 - DNA, 22 bp, Homo sapiens
tggtcagcttcagagtgttcca

SEQ ID NO: 9285898 - DNA, 22 bp, Homo sapiens
tgtatttctgctttctctagta

SEQ ID NO: 9285899 - DNA, 22 bp, Homo sapiens
tgtattttgagtccaatctcct

SEQ ID NO: 9285900 - DNA, 22 bp, Homo sapiens
tgtatacattctcttgggtttg

SEQ ID NO: 9285901 - DNA, 22 bp, Homo sapiens
tgtcctcaaggagcttcagtct

SEQ ID NO: 9285902 - DNA, 22 bp, Homo sapiens
tgggcatggactgtggagccgc

SEQ ID NO: 9285903 - DNA, 21 bp, Homo sapiens
tggtaggtactggcttcaggc

SEQ ID NO: 9285904 - DNA, 22 bp, Homo sapiens
tgggtgagccacaggagttgtc

SEQ ID NO: 9285905 - DNA, 22 bp, Homo sapiens
tgggtgggagcgccctgtctgg

SEQ ID NO: 9285906 - DNA, 16 bp, Homo sapiens
tgggtgggaggagcgg

SEQ ID NO: 9285907 - DNA, 21 bp, Homo sapiens
tgggtgggcagagtctcttca

SEQ ID NO: 9285908 - DNA, 22 bp, Homo sapiens
tggggtggaacccttctgctgg

SEQ ID NO: 9285909 - DNA, 22 bp, Homo sapiens
tggggtggatagaaagtgatgt

SEQ ID NO: 9285910 - DNA, 22 bp, Homo sapiens
tgggggtgccctatgaggaagc

SEQ ID NO: 9285911 - DNA, 16 bp, Homo sapiens
tggggatggggaagag

SEQ ID NO: 9285912 - DNA, 22 bp, Homo sapiens
tggggatgtaaatgaggtgata

SEQ ID NO: 9285913 - DNA, 22 bp, Homo sapiens
tggggatgtagaaatgaacaac

SEQ ID NO: 9285914 - DNA, 22 bp, Homo sapiens
tggggatgtcatataagaggaa

SEQ ID NO: 9285915 - DNA, 22 bp, Homo sapiens
tggggatgaaacccaggcatct

SEQ ID NO: 9285916 - DNA, 22 bp, Homo sapiens
tgggcttaggtcggaggcggcc

SEQ ID NO: 9285917 - DNA, 22 bp, Homo sapiens
tgggcttggaaagctgctgtgc

SEQ ID NO: 9285918 - DNA, 22 bp, Homo sapiens
tggggaagggcaccctggagac

SEQ ID NO: 9285919 - DNA, 17 bp, Homo sapiens
tggggaagctcagattt

SEQ ID NO: 9285920 - DNA, 16 bp, Homo sapiens
tggggaagctcgtgag

SEQ ID NO: 9285921 - DNA, 22 bp, Homo sapiens
tgtgcagctctagagccaagcc

SEQ ID NO: 9285922 - DNA, 22 bp, Homo sapiens
tgtgcacatatactcatattcc

SEQ ID NO: 9285923 - DNA, 22 bp, Homo sapiens
tgtgcacaggaagctattctct

SEQ ID NO: 9285924 - DNA, 21 bp, Homo sapiens
tgtctttggcctcattcccag

SEQ ID NO: 9285925 - DNA, 22 bp, Homo sapiens
tgtgtacatatctatcctagat

SEQ ID NO: 9285926 - DNA, 22 bp, Homo sapiens
ttaaaatttccccaccatgtat

SEQ ID NO: 9285927 - DNA, 22 bp, Homo sapiens
ttaaacacctgtctagtgtagc

SEQ ID NO: 9285928 - DNA, 22 bp, Homo sapiens
ttaaaaatatgtagggcccgat

SEQ ID NO: 9285929 - DNA, 22 bp, Homo sapiens
tgttgagtatatacctacaagt

SEQ ID NO: 9285930 - DNA, 22 bp, Homo sapiens
ttatttccagtccagaaattta

SEQ ID NO: 9285931 - DNA, 22 bp, Homo sapiens
ttcagcagtgcagacacccagt

SEQ ID NO: 9285932 - DNA, 22 bp, Homo sapiens
ttcaggaaggtcctatagcaga

SEQ ID NO: 9285933 - DNA, 22 bp, Homo sapiens
ttcactcttcggcatctctgta

SEQ ID NO: 9285934 - DNA, 22 bp, Homo sapiens
ttcagcagtcgtccaggaaaag

SEQ ID NO: 9285935 - DNA, 21 bp, Homo sapiens
ttcagcagtcctctagagata

SEQ ID NO: 9285936 - DNA, 22 bp, Homo sapiens
aaacatgatgtcatatatgcca

SEQ ID NO: 9285937 - DNA, 22 bp, Homo sapiens
aaacatgtaagttcagatcacc

SEQ ID NO: 9285938 - DNA, 22 bp, Homo sapiens
aaacagtattatcaatatattt

SEQ ID NO: 9285939 - DNA, 22 bp, Homo sapiens
aaacagtaagttctagtattat

SEQ ID NO: 9285940 - DNA, 22 bp, Homo sapiens
aaacagtactcgatttttgtag

SEQ ID NO: 9285941 - DNA, 22 bp, Homo sapiens
aaacagtagaagtgtattttat

SEQ ID NO: 9285942 - DNA, 22 bp, Homo sapiens
aacataatgtggccaaagtcac

SEQ ID NO: 9285943 - DNA, 22 bp, Homo sapiens
aagaaataagacttctctgtcc

SEQ ID NO: 9285944 - DNA, 22 bp, Homo sapiens
aagaaacaaccactgctctcct

SEQ ID NO: 9285945 - DNA, 22 bp, Homo sapiens
aacacagatcaaaatatttcct

SEQ ID NO: 9285946 - DNA, 22 bp, Homo sapiens
aacagaatcttgggttcttttc

SEQ ID NO: 9285947 - DNA, 22 bp, Homo sapiens
aacatcatcatgaacaactaat

SEQ ID NO: 9285948 - DNA, 22 bp, Homo sapiens
aacatgtgtcttgcatttcttg

SEQ ID NO: 9285949 - DNA, 22 bp, Homo sapiens
acagaattaatgaaaattacaa

SEQ ID NO: 9285950 - DNA, 22 bp, Homo sapiens
aattgatggacagagatgaaga

SEQ ID NO: 9285951 - DNA, 22 bp, Homo sapiens
acaagcagagattaaatgtttt

SEQ ID NO: 9285952 - DNA, 22 bp, Homo sapiens
acatatgcgatcataggatgca

SEQ ID NO: 9285953 - DNA, 22 bp, Homo sapiens
aagcattttgttttaagaatga

SEQ ID NO: 9285954 - DNA, 22 bp, Homo sapiens
accctgatataggtccaagagc

SEQ ID NO: 9285955 - DNA, 22 bp, Homo sapiens
actgagttatgggtatgccttg

SEQ ID NO: 9285956 - DNA, 22 bp, Homo sapiens
atccacttgccactgtatagtt

SEQ ID NO: 9285957 - DNA, 22 bp, Homo sapiens
atccacttggctggttgttcta

SEQ ID NO: 9285958 - DNA, 22 bp, Homo sapiens
agaaacatttagattatatgtc

SEQ ID NO: 9285959 - DNA, 22 bp, Homo sapiens
agaaacatcgcttagtcctcat

SEQ ID NO: 9285960 - DNA, 22 bp, Homo sapiens
agaaacatcctgctttccattt

SEQ ID NO: 9285961 - DNA, 22 bp, Homo sapiens
agaaacagcattagcatcaatt

SEQ ID NO: 9285962 - DNA, 22 bp, Homo sapiens
agaaacatcattgtttggtatt

SEQ ID NO: 9285963 - DNA, 22 bp, Homo sapiens
agaaacatcattggaacacaag

SEQ ID NO: 9285964 - DNA, 20 bp, Homo sapiens
agaaacagcacaattctgtt

SEQ ID NO: 9285965 - DNA, 22 bp, Homo sapiens
agaaacagaagggaaagctttt

SEQ ID NO: 9285966 - DNA, 22 bp, Homo sapiens
atcaccaggcaaaatgtcagag

SEQ ID NO: 9285967 - DNA, 23 bp, Homo sapiens
atcaccagcggaagctgcagacc

SEQ ID NO: 9285968 - DNA, 22 bp, Homo sapiens
agaaacaacttgtttctcttgc

SEQ ID NO: 9285969 - DNA, 22 bp, Homo sapiens
atatataacctggataaggctt

SEQ ID NO: 9285970 - DNA, 22 bp, Homo sapiens
actgtgaatcactactagtaga

SEQ ID NO: 9285971 - DNA, 22 bp, Homo sapiens
agttgcagccttcaggagaccc

SEQ ID NO: 9285972 - DNA, 22 bp, Homo sapiens
accttcaggtgagcacacagat

SEQ ID NO: 9285973 - DNA, 21 bp, Homo sapiens
accttcagtgttctcagctgc

SEQ ID NO: 9285974 - DNA, 22 bp, Homo sapiens
accttcagacatcaactatctc

SEQ ID NO: 9285975 - DNA, 22 bp, Homo sapiens
actaaagtcatcaaagaacttt

SEQ ID NO: 9285976 - DNA, 22 bp, Homo sapiens
actggatggtgtcatgagcagc

SEQ ID NO: 9285977 - DNA, 22 bp, Homo sapiens
atgtttctgaagtttacagata

SEQ ID NO: 9285978 - DNA, 22 bp, Homo sapiens
atggagtttggggtcaaatact

SEQ ID NO: 9285979 - DNA, 19 bp, Homo sapiens
atggaaaatgccagactga

SEQ ID NO: 9285980 - DNA, 22 bp, Homo sapiens
atgtcaaatcagttttatcaga

SEQ ID NO: 9285981 - DNA, 22 bp, Homo sapiens
agaagacagagtctacattcta

SEQ ID NO: 9285982 - DNA, 22 bp, Homo sapiens
agcagttgtagtcatggaaaat

SEQ ID NO: 9285983 - DNA, 22 bp, Homo sapiens
cacagtatgatctaaagtaagt

SEQ ID NO: 9285984 - DNA, 22 bp, Homo sapiens
cacagtattcactgggcagatt

SEQ ID NO: 9285985 - DNA, 22 bp, Homo sapiens
atgtgaaacctgtgagtagagt

SEQ ID NO: 9285986 - DNA, 22 bp, Homo sapiens
atgtgaaaatccaatggcagca

SEQ ID NO: 9285987 - DNA, 22 bp, Homo sapiens
atgtgaaaaatttcttattaca

SEQ ID NO: 9285988 - DNA, 22 bp, Homo sapiens
gagaaatgagtgattcactttt

SEQ ID NO: 9285989 - DNA, 22 bp, Homo sapiens
atgagttcattgcatttgacag

SEQ ID NO: 9285990 - DNA, 22 bp, Homo sapiens
atgcatgatcctgagcaaccca

SEQ ID NO: 9285991 - DNA, 22 bp, Homo sapiens
atgcatttatgtgtgtacattg

SEQ ID NO: 9285992 - DNA, 21 bp, Homo sapiens
attcagagtaattcatcttta

SEQ ID NO: 9285993 - DNA, 22 bp, Homo sapiens
attcagagattgttattcagac

SEQ ID NO: 9285994 - DNA, 22 bp, Homo sapiens
atttctacagtacacatgcatt

SEQ ID NO: 9285995 - DNA, 21 bp, Homo sapiens
atttcagagcacacaagtaaa

SEQ ID NO: 9285996 - DNA, 22 bp, Homo sapiens
atttcagaatgtcctaatttag

SEQ ID NO: 9285997 - DNA, 22 bp, Homo sapiens
caaaacattcagagagctcact

SEQ ID NO: 9285998 - DNA, 17 bp, Homo sapiens
ggaaaagaagagtagga

SEQ ID NO: 9285999 - DNA, 22 bp, Homo sapiens
cagcattgtaagaatgaagacc

SEQ ID NO: 9286000 - DNA, 22 bp, Homo sapiens
cccttcagggttaagtagaggg

SEQ ID NO: 9286001 - DNA, 22 bp, Homo sapiens
catgtgaattccaaagctaggt

SEQ ID NO: 9286002 - DNA, 22 bp, Homo sapiens
catgatgtcacagagaagcaca

SEQ ID NO: 9286003 - DNA, 22 bp, Homo sapiens
tcatgtaaatgtggatgcttcc

SEQ ID NO: 9286004 - DNA, 22 bp, Homo sapiens
tctgagttcataccaggctacc

SEQ ID NO: 9286005 - DNA, 22 bp, Homo sapiens
tctgagtttaggaccaggctga

SEQ ID NO: 9286006 - DNA, 22 bp, Homo sapiens
catttatgatagtaatatgaaa

SEQ ID NO: 9286007 - DNA, 22 bp, Homo sapiens
ccacaagactctgtcagcataa

SEQ ID NO: 9286008 - DNA, 22 bp, Homo sapiens
ccactgatcctgactttggagc

SEQ ID NO: 9286009 - DNA, 22 bp, Homo sapiens
taagcaaataatgcatcaaggg

SEQ ID NO: 9286010 - DNA, 22 bp, Homo sapiens
taacaatacccattctaattac

SEQ ID NO: 9286011 - DNA, 22 bp, Homo sapiens
ttgactttacagttttcttagg

SEQ ID NO: 9286012 - DNA, 22 bp, Homo sapiens
ttgacttttcttggtcacatga

SEQ ID NO: 9286013 - DNA, 22 bp, Homo sapiens
ctcatattgctggtggtctaag

SEQ ID NO: 9286014 - DNA, 22 bp, Homo sapiens
ctgatgctctggatgtagtcaa

SEQ ID NO: 9286015 - DNA, 22 bp, Homo sapiens
ctctttgtagcctttgcatatt

SEQ ID NO: 9286016 - DNA, 22 bp, Homo sapiens
tttgtgaaatgaagtcacaact

SEQ ID NO: 9286017 - DNA, 22 bp, Homo sapiens
tttgtgaacaaacatgaagatg

SEQ ID NO: 9286018 - DNA, 22 bp, Homo sapiens
tttgtgaacactgcgcagaact

SEQ ID NO: 9286019 - DNA, 22 bp, Homo sapiens
tttgtgaagggaacagaagtgt

SEQ ID NO: 9286020 - DNA, 22 bp, Homo sapiens
tttgtgaataggttggcttcca

SEQ ID NO: 9286021 - DNA, 22 bp, Homo sapiens
tgtctttctgcaccacctcaca

SEQ ID NO: 9286022 - DNA, 22 bp, Homo sapiens
tgtattaacattaataaaatgg

SEQ ID NO: 9286023 - DNA, 22 bp, Homo sapiens
gaaatttacaactttctcatgg

SEQ ID NO: 9286024 - DNA, 22 bp, Homo sapiens
cttctttcccaggcatgtttta

SEQ ID NO: 9286025 - DNA, 22 bp, Homo sapiens
gatctttatactgtaataatga

SEQ ID NO: 9286026 - DNA, 22 bp, Homo sapiens
gcagtactttatcacatggaat

SEQ ID NO: 9286027 - DNA, 22 bp, Homo sapiens
gcagtactttaagggatgaagc

SEQ ID NO: 9286028 - DNA, 19 bp, Homo sapiens
ggaaacaggggccagagga

SEQ ID NO: 9286029 - DNA, 22 bp, Homo sapiens
gttctcatagtggaaaataggt

SEQ ID NO: 9286030 - DNA, 22 bp, Homo sapiens
gttgtgaatagtgccgcaataa

SEQ ID NO: 9286031 - DNA, 22 bp, Homo sapiens
gtaaataactggtaattggggt

SEQ ID NO: 9286032 - DNA, 17 bp, Homo sapiens
ttcagcagtgtttctcc

SEQ ID NO: 9286033 - DNA, 22 bp, Homo sapiens
ttacagagctcatttctaaggg

SEQ ID NO: 9286034 - DNA, 22 bp, Homo sapiens
ttaaaccatagtttaacataag

SEQ ID NO: 9286035 - DNA, 22 bp, Homo sapiens
tgtgaaacggagtcagggaagg

SEQ ID NO: 9286036 - DNA, 22 bp, Homo sapiens
tgtgaaaaaagttctagaagga

SEQ ID NO: 9286037 - DNA, 22 bp, Homo sapiens
tgtgaatggacaattaaatcta

SEQ ID NO: 9286038 - DNA, 22 bp, Homo sapiens
tgtgaaagcaagtctagttctc

SEQ ID NO: 9286039 - DNA, 22 bp, Homo sapiens
tgtgaaagagtcttatagtttc

SEQ ID NO: 9286040 - DNA, 22 bp, Homo sapiens
tgtgaaagtcaaattaattgaa

SEQ ID NO: 9286041 - DNA, 22 bp, Homo sapiens
tgtcatttatcttatagtaatc

SEQ ID NO: 9286042 - DNA, 22 bp, Homo sapiens
tgtatgctttccttctttctgg

SEQ ID NO: 9286043 - DNA, 22 bp, Homo sapiens
tgtcaccactggctgaaacacc

SEQ ID NO: 9286044 - DNA, 20 bp, Homo sapiens
tgcctttcctgtttcatctt

SEQ ID NO: 9286045 - DNA, 22 bp, Homo sapiens
tgacatttcttgttgatataaa

SEQ ID NO: 9286046 - DNA, 22 bp, Homo sapiens
tgaaacagtctccagacttgga

SEQ ID NO: 9286047 - DNA, 22 bp, Homo sapiens
tctttgcatgcattttccctta

SEQ ID NO: 9286048 - DNA, 22 bp, Homo sapiens
tgcatgtgtttcccagcaagct

SEQ ID NO: 9286049 - DNA, 22 bp, Homo sapiens
tgcatagaggatccagtgtggt

SEQ ID NO: 9286050 - DNA, 22 bp, Homo sapiens
tgcagttctaagtagacaagtc

SEQ ID NO: 9286051 - DNA, 22 bp, Homo sapiens
tgcattctgacttagttaatat

SEQ ID NO: 9286052 - DNA, 22 bp, Homo sapiens
tgcctgatgcaggagtatcaga

SEQ ID NO: 9286053 - DNA, 22 bp, Homo sapiens
tgatgcattgccgacttactgg

SEQ ID NO: 9286054 - DNA, 22 bp, Homo sapiens
tgatctttttggtcatttgggt

SEQ ID NO: 9286055 - DNA, 22 bp, Homo sapiens
tgatctttggtagtacgataat

SEQ ID NO: 9286056 - DNA, 22 bp, Homo sapiens
tgagttctcatgaaatctagtt

SEQ ID NO: 9286057 - DNA, 18 bp, Homo sapiens
tgcaaatggctgtttgat

SEQ ID NO: 9286058 - DNA, 22 bp, Homo sapiens
tgcaaagatgaaatattaaagg

SEQ ID NO: 9286059 - DNA, 22 bp, Homo sapiens
tgcaaatgcccatttattttct

SEQ ID NO: 9286060 - DNA, 22 bp, Homo sapiens
tgcagattcaaatgaaatgcaa

SEQ ID NO: 9286061 - DNA, 22 bp, Homo sapiens
tctagaaaaccaatattacatg

SEQ ID NO: 9286062 - DNA, 19 bp, Homo sapiens
tccttcagtcagatctggg

SEQ ID NO: 9286063 - DNA, 22 bp, Homo sapiens
tccttcagggggccgcctgcac

SEQ ID NO: 9286064 - DNA, 22 bp, Homo sapiens
tccttcagaaaacctcagtctt

SEQ ID NO: 9286065 - DNA, 22 bp, Homo sapiens
tccttcagattcctgcttctgg

SEQ ID NO: 9286066 - DNA, 22 bp, Homo sapiens
tccttcagaggacggcagccag

SEQ ID NO: 9286067 - DNA, 22 bp, Homo sapiens
tccttcagaggataaggaagaa

SEQ ID NO: 9286068 - DNA, 20 bp, Homo sapiens
tccttcagacgacaagcaag

SEQ ID NO: 9286069 - DNA, 22 bp, Homo sapiens
tccttcagctctctatttagat

SEQ ID NO: 9286070 - DNA, 22 bp, Homo sapiens
tccttcagcttgttagagtgac

SEQ ID NO: 9286071 - DNA, 22 bp, Homo sapiens
tccttcagctactcagtttcca

SEQ ID NO: 9286072 - DNA, 22 bp, Homo sapiens
tccttcagccatgggctctcca

SEQ ID NO: 9286073 - DNA, 22 bp, Homo sapiens
tccttcaggcctcattctcata

SEQ ID NO: 9286074 - DNA, 22 bp, Homo sapiens
tctttaatgtactttctttcac

SEQ ID NO: 9286075 - DNA, 22 bp, Homo sapiens
tctttaatatctgccccagagc

SEQ ID NO: 9286076 - DNA, 22 bp, Homo sapiens
aataacagggttgatttgcaat

SEQ ID NO: 9286077 - DNA, 22 bp, Homo sapiens
aataacagagtcttcaagatag

SEQ ID NO: 9286078 - DNA, 18 bp, Homo sapiens
aagtaacagaagagcaca

SEQ ID NO: 9286079 - DNA, 22 bp, Homo sapiens
acagatgagagacaatgtgcta

SEQ ID NO: 9286080 - DNA, 22 bp, Homo sapiens
acataacaatcataggacatag

SEQ ID NO: 9286081 - DNA, 22 bp, Homo sapiens
agagaaacccttcagtgttttg

SEQ ID NO: 9286082 - DNA, 22 bp, Homo sapiens
aaatcatctctgcatccttagc

SEQ ID NO: 9286083 - DNA, 22 bp, Homo sapiens
aaacatgaatagatattaaaca

SEQ ID NO: 9286084 - DNA, 22 bp, Homo sapiens
aaaccatcagataattcatact

SEQ ID NO: 9286085 - DNA, 22 bp, Homo sapiens
aaaccatggagtaagttcacat

SEQ ID NO: 9286086 - DNA, 22 bp, Homo sapiens
aaacatgagcatctcttcaagc

SEQ ID NO: 9286087 - DNA, 22 bp, Homo sapiens
aaacaaacataggtttgaaagt

SEQ ID NO: 9286088 - DNA, 22 bp, Homo sapiens
aacagtatcttttatcagaaat

SEQ ID NO: 9286089 - DNA, 22 bp, Homo sapiens
aacagtatctacgggaactatt

SEQ ID NO: 9286090 - DNA, 22 bp, Homo sapiens
aacagtattggttgaactcaag

SEQ ID NO: 9286091 - DNA, 22 bp, Homo sapiens
aaagcacattacaagctcagtc

SEQ ID NO: 9286092 - DNA, 22 bp, Homo sapiens
aagcactgtgcctcatatctga

SEQ ID NO: 9286093 - DNA, 22 bp, Homo sapiens
aagatacattttcttcagagaa

SEQ ID NO: 9286094 - DNA, 22 bp, Homo sapiens
aaccagtgaaacaccaggcaag

SEQ ID NO: 9286095 - DNA, 22 bp, Homo sapiens
aatcacattagtgaaacactga

SEQ ID NO: 9286096 - DNA, 19 bp, Homo sapiens
aagttctcagagttcaaag

SEQ ID NO: 9286097 - DNA, 22 bp, Homo sapiens
cagatgtacatgaagggcaatg

SEQ ID NO: 9286098 - DNA, 22 bp, Homo sapiens
agcatgaagacttcagagctag

SEQ ID NO: 9286099 - DNA, 22 bp, Homo sapiens
agcagtaagacttttttctgtg

SEQ ID NO: 9286100 - DNA, 22 bp, Homo sapiens
agaatcaaagagaaatactttg

SEQ ID NO: 9286101 - DNA, 22 bp, Homo sapiens
agaatcaactgaaaattggtga

SEQ ID NO: 9286102 - DNA, 22 bp, Homo sapiens
agacaacatctagtttggtgga

SEQ ID NO: 9286103 - DNA, 22 bp, Homo sapiens
atgaaggatggctggctgccct

SEQ ID NO: 9286104 - DNA, 22 bp, Homo sapiens
agagacaatgccaatgcacacg

SEQ ID NO: 9286105 - DNA, 22 bp, Homo sapiens
agactgtactttctgcagctct

SEQ ID NO: 9286106 - DNA, 22 bp, Homo sapiens
agaaatcatgtcttatttctat

SEQ ID NO: 9286107 - DNA, 22 bp, Homo sapiens
agaaatcaggaacagtaaggag

SEQ ID NO: 9286108 - DNA, 21 bp, Homo sapiens
agaaaaacacgatataagccc

SEQ ID NO: 9286109 - DNA, 22 bp, Homo sapiens
atcccacacccctacaacatat

SEQ ID NO: 9286110 - DNA, 23 bp, Homo sapiens
actagaaaatgactttctccctg

SEQ ID NO: 9286111 - DNA, 22 bp, Homo sapiens
acatgaaaactggttccttcag

SEQ ID NO: 9286112 - DNA, 22 bp, Homo sapiens
aggaagagcattcacatggtag

SEQ ID NO: 9286113 - DNA, 22 bp, Homo sapiens
catcatgccccgctacagtgca

SEQ ID NO: 9286114 - DNA, 22 bp, Homo sapiens
ccatttcattgcctgtaaagtg

SEQ ID NO: 9286115 - DNA, 22 bp, Homo sapiens
agttctcagcttagtatgctgt

SEQ ID NO: 9286116 - DNA, 22 bp, Homo sapiens
agttctcaggtcagctgagtct

SEQ ID NO: 9286117 - DNA, 23 bp, Homo sapiens
agttctcattcatcacggcctat

SEQ ID NO: 9286118 - DNA, 22 bp, Homo sapiens
agttctcaagacaattacctgt

SEQ ID NO: 9286119 - DNA, 23 bp, Homo sapiens
agttctcaaaaccagcttgacaa

SEQ ID NO: 9286120 - DNA, 22 bp, Homo sapiens
atatacttggagactatcattg

SEQ ID NO: 9286121 - DNA, 22 bp, Homo sapiens
atagttttatagatattgtgta

SEQ ID NO: 9286122 - DNA, 22 bp, Homo sapiens
cttaatctcacctgcaaagtcc

SEQ ID NO: 9286123 - DNA, 22 bp, Homo sapiens
atccatgattgcccagaggtgt

SEQ ID NO: 9286124 - DNA, 22 bp, Homo sapiens
atcaagaatgttcattcttcta

SEQ ID NO: 9286125 - DNA, 22 bp, Homo sapiens
atcaagaattgggagctattga

SEQ ID NO: 9286126 - DNA, 22 bp, Homo sapiens
atcacagattgtgaataactat

SEQ ID NO: 9286127 - DNA, 22 bp, Homo sapiens
agtgaaaggttgagaatattct

SEQ ID NO: 9286128 - DNA, 22 bp, Homo sapiens
agtgatgtgggagagtatagct

SEQ ID NO: 9286129 - DNA, 22 bp, Homo sapiens
agtaaacatagaatgttcttcc

SEQ ID NO: 9286130 - DNA, 22 bp, Homo sapiens
agtaaacagtatctttagtgtc

SEQ ID NO: 9286131 - DNA, 22 bp, Homo sapiens
ccttccagtatgttaagatggt

SEQ ID NO: 9286132 - DNA, 22 bp, Homo sapiens
agtaacaagtgccaacgttaga

SEQ ID NO: 9286133 - DNA, 22 bp, Homo sapiens
agtaacagagcatgggttcaga

SEQ ID NO: 9286134 - DNA, 22 bp, Homo sapiens
agtaacagaaggcctgacttaa

SEQ ID NO: 9286135 - DNA, 22 bp, Homo sapiens
attttgaaaagcatttgagtaa

SEQ ID NO: 9286136 - DNA, 22 bp, Homo sapiens
gcaaatgtggcttcctttctag

SEQ ID NO: 9286137 - DNA, 22 bp, Homo sapiens
attgtaaaagtattctaagatt

SEQ ID NO: 9286138 - DNA, 22 bp, Homo sapiens
gaaaacatccagagatagacct

SEQ ID NO: 9286139 - DNA, 22 bp, Homo sapiens
gagttacatggacattctctcc

SEQ ID NO: 9286140 - DNA, 22 bp, Homo sapiens
gagcagtaggagaaccctgagc

SEQ ID NO: 9286141 - DNA, 22 bp, Homo sapiens
atgtaagactttaagaacctaa

SEQ ID NO: 9286142 - DNA, 22 bp, Homo sapiens
cagcagtacttctcagaggtat

SEQ ID NO: 9286143 - DNA, 22 bp, Homo sapiens
cagcagtaattagtgctgcatg

SEQ ID NO: 9286144 - DNA, 22 bp, Homo sapiens
tagaaacaagggagaggattct

SEQ ID NO: 9286145 - DNA, 22 bp, Homo sapiens
catttcaccttagagaattatt

SEQ ID NO: 9286146 - DNA, 21 bp, Homo sapiens
catttcatgattatagaaatg

SEQ ID NO: 9286147 - DNA, 22 bp, Homo sapiens
catttccacttctgaaaactgg

SEQ ID NO: 9286148 - DNA, 22 bp, Homo sapiens
tgagttcttcacattacctacg

SEQ ID NO: 9286149 - DNA, 22 bp, Homo sapiens
gagaaacaggaattgagtcgct

SEQ ID NO: 9286150 - DNA, 22 bp, Homo sapiens
gagaaacactgttagtttatta

SEQ ID NO: 9286151 - DNA, 22 bp, Homo sapiens
gaagggaaggaaagaaccagca

SEQ ID NO: 9286152 - DNA, 22 bp, Homo sapiens
ttctcagtagttagcatttgtg

SEQ ID NO: 9286153 - DNA, 22 bp, Homo sapiens
ttctacatgagaaaatgtattt

SEQ ID NO: 9286154 - DNA, 22 bp, Homo sapiens
ttctacatatatttttctcact

SEQ ID NO: 9286155 - DNA, 18 bp, Homo sapiens
ttatggctgtgaaagagt

SEQ ID NO: 9286156 - DNA, 19 bp, Homo sapiens
cctttgaatcaggacactt

SEQ ID NO: 9286157 - DNA, 22 bp, Homo sapiens
tatttcaacgtatgaaaagctg

SEQ ID NO: 9286158 - DNA, 22 bp, Homo sapiens
tagcagtgccctgtggaataag

SEQ ID NO: 9286159 - DNA, 22 bp, Homo sapiens
tagcatttcactgatcttcact

SEQ ID NO: 9286160 - DNA, 22 bp, Homo sapiens
tagatgttttaactcttggtta

SEQ ID NO: 9286161 - DNA, 22 bp, Homo sapiens
taattttaatagtatgtggcat

SEQ ID NO: 9286162 - DNA, 22 bp, Homo sapiens
taattttaactgtgctgtttgg

SEQ ID NO: 9286163 - DNA, 22 bp, Homo sapiens
taattttacttcctgagcacct

SEQ ID NO: 9286164 - DNA, 22 bp, Homo sapiens
taataacaattgtaggacatga

SEQ ID NO: 9286165 - DNA, 22 bp, Homo sapiens
taatttcaccgttgctagaaat

SEQ ID NO: 9286166 - DNA, 22 bp, Homo sapiens
taactgttgtgcgggtctctgg

SEQ ID NO: 9286167 - DNA, 22 bp, Homo sapiens
tcccttcaataattcaacatta

SEQ ID NO: 9286168 - DNA, 22 bp, Homo sapiens
tcaaacagaggaacaattgttt

SEQ ID NO: 9286169 - DNA, 22 bp, Homo sapiens
tcacagaatttttgcttccagt

SEQ ID NO: 9286170 - DNA, 21 bp, Homo sapiens
tcagagaatggcctactctca

SEQ ID NO: 9286171 - DNA, 22 bp, Homo sapiens
tcagagaatgtccttcttcatt

SEQ ID NO: 9286172 - DNA, 23 bp, Homo sapiens
tcagagaatggtatgcttttcct

SEQ ID NO: 9286173 - DNA, 22 bp, Homo sapiens
tcagagaatccgtaagtcacaa

SEQ ID NO: 9286174 - DNA, 22 bp, Homo sapiens
tcagttacctgacagtggttat

SEQ ID NO: 9286175 - DNA, 21 bp, Homo sapiens
gcagcagtgttctagaatact

SEQ ID NO: 9286176 - DNA, 22 bp, Homo sapiens
gcagcagtggtctgtagaagga

SEQ ID NO: 9286177 - DNA, 22 bp, Homo sapiens
gcagcagtaggaaataacacag

SEQ ID NO: 9286178 - DNA, 19 bp, Homo sapiens
gcagcagtggaaggaaaaa

SEQ ID NO: 9286179 - DNA, 22 bp, Homo sapiens
gcagcagtgcgggcagctacag

SEQ ID NO: 9286180 - DNA, 22 bp, Homo sapiens
ggaaggaaattggggcagttgt

SEQ ID NO: 9286181 - DNA, 22 bp, Homo sapiens
ggaaggaacaaaccctgtgtgg

SEQ ID NO: 9286182 - DNA, 22 bp, Homo sapiens
ggaaggaagaggaccgagctgg

SEQ ID NO: 9286183 - DNA, 23 bp, Homo sapiens
gccttcagctcgggaaggctccc

SEQ ID NO: 9286184 - DNA, 22 bp, Homo sapiens
gccttcagcggccgctcgctgc

SEQ ID NO: 9286185 - DNA, 22 bp, Homo sapiens
gccttcaggagggttccagaca

SEQ ID NO: 9286186 - DNA, 22 bp, Homo sapiens
gccttcagtagtgtcagctgta

SEQ ID NO: 9286187 - DNA, 22 bp, Homo sapiens
gccttcaggtgctgccaggcta

SEQ ID NO: 9286188 - DNA, 22 bp, Homo sapiens
gccttcagtaactgagacggaa

SEQ ID NO: 9286189 - DNA, 22 bp, Homo sapiens
gccttcagtagtatcctcatga

SEQ ID NO: 9286190 - DNA, 22 bp, Homo sapiens
gccttcagccctgactggccag

SEQ ID NO: 9286191 - DNA, 22 bp, Homo sapiens
ttttgtgttgccatgttaagca

SEQ ID NO: 9286192 - DNA, 22 bp, Homo sapiens
ttttgtctaagaactttgcaaa

SEQ ID NO: 9286193 - DNA, 21 bp, Homo sapiens
ttggatgtatttatgttttag

SEQ ID NO: 9286194 - DNA, 22 bp, Homo sapiens
ttgtgatactgagcttggcatt

SEQ ID NO: 9286195 - DNA, 22 bp, Homo sapiens
ttcaagtactgtagatttcagg

SEQ ID NO: 9286196 - DNA, 22 bp, Homo sapiens
ttcaagcagagatatttcaaga

SEQ ID NO: 9286197 - DNA, 22 bp, Homo sapiens
ttctcttgtgccaagttgttgc

SEQ ID NO: 9286198 - DNA, 22 bp, Homo sapiens
ttgaaacagacaagtaaatgtc

SEQ ID NO: 9286199 - DNA, 22 bp, Homo sapiens
agcacattttatttaagaaaat

SEQ ID NO: 9286200 - DNA, 22 bp, Homo sapiens
agcagcaggcttaaggaaaagt

SEQ ID NO: 9286201 - DNA, 22 bp, Homo sapiens
agcagcagggacaaaggaacag

SEQ ID NO: 9286202 - DNA, 22 bp, Homo sapiens
cagcagttatgagtagaatagt

SEQ ID NO: 9286203 - DNA, 22 bp, Homo sapiens
cagagaaagggtgaattccttc

SEQ ID NO: 9286204 - DNA, 22 bp, Homo sapiens
cagagaaaaaatcctgctctca

SEQ ID NO: 9286205 - DNA, 22 bp, Homo sapiens
atttgtttatcgtcgattgtag

SEQ ID NO: 9286206 - DNA, 22 bp, Homo sapiens
atttcactctccctgccactta

SEQ ID NO: 9286207 - DNA, 17 bp, Homo sapiens
atttcacttagcatgag

SEQ ID NO: 9286208 - DNA, 22 bp, Homo sapiens
agacatttggaagatacacata

SEQ ID NO: 9286209 - DNA, 22 bp, Homo sapiens
atggctaaacctgaactggtct

SEQ ID NO: 9286210 - DNA, 22 bp, Homo sapiens
agacattttacattcttccatt

SEQ ID NO: 9286211 - DNA, 22 bp, Homo sapiens
acatcatgagagacttaaattg

SEQ ID NO: 9286212 - DNA, 22 bp, Homo sapiens
acatatttccatgcagcatgtc

SEQ ID NO: 9286213 - DNA, 22 bp, Homo sapiens
acagtatgaatgcagaatgtag

SEQ ID NO: 9286214 - DNA, 22 bp, Homo sapiens
actttcaagaacttctttaatg

SEQ ID NO: 9286215 - DNA, 22 bp, Homo sapiens
agtaaacactgtctttatatat

SEQ ID NO: 9286216 - DNA, 22 bp, Homo sapiens
agtaaacacgtggggtttcttt

SEQ ID NO: 9286217 - DNA, 22 bp, Homo sapiens
acaaacagctaacatatgttaa

SEQ ID NO: 9286218 - DNA, 22 bp, Homo sapiens
agcaagattttccttgaatgtt

SEQ ID NO: 9286219 - DNA, 18 bp, Homo sapiens
agcagtgtggcaagcaga

SEQ ID NO: 9286220 - DNA, 22 bp, Homo sapiens
agccattttggtaatgataaca

SEQ ID NO: 9286221 - DNA, 22 bp, Homo sapiens
agccattttcctgaaatataac

SEQ ID NO: 9286222 - DNA, 22 bp, Homo sapiens
acagtagtctcaggaataggca

SEQ ID NO: 9286223 - DNA, 23 bp, Homo sapiens
aagtaacagggataatagcagtt

SEQ ID NO: 9286224 - DNA, 21 bp, Homo sapiens
aagttgtctcttttggttcct

SEQ ID NO: 9286225 - DNA, 22 bp, Homo sapiens
aaacagtggccaattctggaga

SEQ ID NO: 9286226 - DNA, 22 bp, Homo sapiens
aaacagtgtttttatgatttat

SEQ ID NO: 9286227 - DNA, 21 bp, Homo sapiens
aaactgaccttgcctgagaca

SEQ ID NO: 9286228 - DNA, 22 bp, Homo sapiens
aaacaaacaattagttgtgtgg

SEQ ID NO: 9286229 - DNA, 22 bp, Homo sapiens
aaaagacatctatttcaggcag

SEQ ID NO: 9286230 - DNA, 22 bp, Homo sapiens
aaaaaccattgtcttcagtctc

SEQ ID NO: 9286231 - DNA, 22 bp, Homo sapiens
aaatgtaagtctttgtttctta

SEQ ID NO: 9286232 - DNA, 22 bp, Homo sapiens
aaattttagactcctgggtcta

SEQ ID NO: 9286233 - DNA, 22 bp, Homo sapiens
aacagagtggagccaaactttg

SEQ ID NO: 9286234 - DNA, 22 bp, Homo sapiens
aacagtaaaaatcatttagttg

SEQ ID NO: 9286235 - DNA, 20 bp, Homo sapiens
aacaaactacaaaattatgt

SEQ ID NO: 9286236 - DNA, 22 bp, Homo sapiens
aacaaactcaaatggaagagtg

SEQ ID NO: 9286237 - DNA, 22 bp, Homo sapiens
aaatgtgatactgttcttttta

SEQ ID NO: 9286238 - DNA, 22 bp, Homo sapiens
aacagcatcaccccataacatt

SEQ ID NO: 9286239 - DNA, 22 bp, Homo sapiens
acagaattgatggaaatctcag

SEQ ID NO: 9286240 - DNA, 22 bp, Homo sapiens
acagaatttacacatctctaaa

SEQ ID NO: 9286241 - DNA, 22 bp, Homo sapiens
acagagtaggtgctcagtaaat

SEQ ID NO: 9286242 - DNA, 22 bp, Homo sapiens
aagcatttcaatataatattca

SEQ ID NO: 9286243 - DNA, 22 bp, Homo sapiens
aagcatttatagataagaattt

SEQ ID NO: 9286244 - DNA, 22 bp, Homo sapiens
aagaaatacatggtttttgagt

SEQ ID NO: 9286245 - DNA, 22 bp, Homo sapiens
atttcaacgttagatgtaatag

SEQ ID NO: 9286246 - DNA, 22 bp, Homo sapiens
atttcaacagagtttgaaggca

SEQ ID NO: 9286247 - DNA, 22 bp, Homo sapiens
atttcccaggactagaaatata

SEQ ID NO: 9286248 - DNA, 22 bp, Homo sapiens
atgcagtggcttcagtgtcagt

SEQ ID NO: 9286249 - DNA, 22 bp, Homo sapiens
cagaaacacttgtagagaagtt

SEQ ID NO: 9286250 - DNA, 22 bp, Homo sapiens
cagaaacagacatgacgcagta

SEQ ID NO: 9286251 - DNA, 22 bp, Homo sapiens
cagaaacagagaaatattggct

SEQ ID NO: 9286252 - DNA, 22 bp, Homo sapiens
cagaaacaggcaacgtgtgcac

SEQ ID NO: 9286253 - DNA, 22 bp, Homo sapiens
cacagtgactggcacatagtaa

SEQ ID NO: 9286254 - DNA, 22 bp, Homo sapiens
atccttcaaaaggaatagcagg

SEQ ID NO: 9286255 - DNA, 22 bp, Homo sapiens
cttcagcagcctcttgcataaa

SEQ ID NO: 9286256 - DNA, 22 bp, Homo sapiens
cttcagcaactttggaatgttt

SEQ ID NO: 9286257 - DNA, 22 bp, Homo sapiens
ataatgttgatgattgtctttg

SEQ ID NO: 9286258 - DNA, 22 bp, Homo sapiens
agtaacagggtatttgtgtggg

SEQ ID NO: 9286259 - DNA, 22 bp, Homo sapiens
cccttcagtgctaggctgcctg

SEQ ID NO: 9286260 - DNA, 22 bp, Homo sapiens
catattgtaaaaggttgaatcc

SEQ ID NO: 9286261 - DNA, 22 bp, Homo sapiens
ccacttttgggaacagtgagta

SEQ ID NO: 9286262 - DNA, 22 bp, Homo sapiens
tccccagaggaatatgagattg

SEQ ID NO: 9286263 - DNA, 22 bp, Homo sapiens
tccctaaactctgaactgattc

SEQ ID NO: 9286264 - DNA, 22 bp, Homo sapiens
tagctaatggtgaagattcaga

SEQ ID NO: 9286265 - DNA, 22 bp, Homo sapiens
tagtctttttaataaataatgc

SEQ ID NO: 9286266 - DNA, 22 bp, Homo sapiens
tagtgaaacctgacagatcatg

SEQ ID NO: 9286267 - DNA, 22 bp, Homo sapiens
cagtgccatattgaaagacatt

SEQ ID NO: 9286268 - DNA, 22 bp, Homo sapiens
cagtgccagaggtactagtgga

SEQ ID NO: 9286269 - DNA, 22 bp, Homo sapiens
tgagaaaactcaaagacagatc

SEQ ID NO: 9286270 - DNA, 22 bp, Homo sapiens
tgaaggaatgagtatactgttt

SEQ ID NO: 9286271 - DNA, 22 bp, Homo sapiens
tgaaggaatgagggagtgggtc

SEQ ID NO: 9286272 - DNA, 22 bp, Homo sapiens
tgaaggaaagagggaacatccc

SEQ ID NO: 9286273 - DNA, 22 bp, Homo sapiens
ttgcatagtgctgaggttcggg

SEQ ID NO: 9286274 - DNA, 22 bp, Homo sapiens
ttctatttccagtccttcagag

SEQ ID NO: 9286275 - DNA, 22 bp, Homo sapiens
ctagagaattgtcttgagagtt

SEQ ID NO: 9286276 - DNA, 22 bp, Homo sapiens
ctagagaaacagtgctctgaac

SEQ ID NO: 9286277 - DNA, 22 bp, Homo sapiens
ctagagaaaatgatagcaggaa

SEQ ID NO: 9286278 - DNA, 22 bp, Homo sapiens
ctagagaatcttttaagaagtg

SEQ ID NO: 9286279 - DNA, 22 bp, Homo sapiens
ctagagaacaacattcatatgg

SEQ ID NO: 9286280 - DNA, 22 bp, Homo sapiens
ccttcagaggtgtagattgcgt

SEQ ID NO: 9286281 - DNA, 23 bp, Homo sapiens
ccttcagaagaagtaacaggggc

SEQ ID NO: 9286282 - DNA, 22 bp, Homo sapiens
ccttcagaatgaaattctaatg

SEQ ID NO: 9286283 - DNA, 22 bp, Homo sapiens
gaaatgtaggcataattatttt

SEQ ID NO: 9286284 - DNA, 20 bp, Homo sapiens
gaaatgtatctcttgattct

SEQ ID NO: 9286285 - DNA, 22 bp, Homo sapiens
gaaagacatagttgcaagatgg

SEQ ID NO: 9286286 - DNA, 22 bp, Homo sapiens
gaaattgtcagcttctttcagt

SEQ ID NO: 9286287 - DNA, 22 bp, Homo sapiens
gaaaaatgctccaaatctgtgg

SEQ ID NO: 9286288 - DNA, 22 bp, Homo sapiens
cttgctttatctggtttctcat

SEQ ID NO: 9286289 - DNA, 22 bp, Homo sapiens
ctgtgaatttaaagcacacatc

SEQ ID NO: 9286290 - DNA, 22 bp, Homo sapiens
ctgtgaattgcaacaattgcaa

SEQ ID NO: 9286291 - DNA, 22 bp, Homo sapiens
gagcactgtactcatttgcact

SEQ ID NO: 9286292 - DNA, 22 bp, Homo sapiens
gagcactgatttatttttgtct

SEQ ID NO: 9286293 - DNA, 22 bp, Homo sapiens
gaccttcagtgtgtttctcaca

SEQ ID NO: 9286294 - DNA, 22 bp, Homo sapiens
gaccttcaagcaccatatttat

SEQ ID NO: 9286295 - DNA, 22 bp, Homo sapiens
gaattttattactagtcaactg

SEQ ID NO: 9286296 - DNA, 20 bp, Homo sapiens
gaattttatgaacactacca

SEQ ID NO: 9286297 - DNA, 22 bp, Homo sapiens
gacaaaactgagatcacactgt

SEQ ID NO: 9286298 - DNA, 22 bp, Homo sapiens
gaatggaaactgggagatggcc

SEQ ID NO: 9286299 - DNA, 22 bp, Homo sapiens
tcatttcagccatttttaaatg

SEQ ID NO: 9286300 - DNA, 23 bp, Homo sapiens
tcatttcatccagccttgagagt

SEQ ID NO: 9286301 - DNA, 17 bp, Homo sapiens
tcatttcagtaaatcca

SEQ ID NO: 9286302 - DNA, 22 bp, Homo sapiens
tagcaaatacatgatgtaattt

SEQ ID NO: 9286303 - DNA, 22 bp, Homo sapiens
taacagtattgaagataaacta

SEQ ID NO: 9286304 - DNA, 22 bp, Homo sapiens
taacagtatatttaccaaacct

SEQ ID NO: 9286305 - DNA, 22 bp, Homo sapiens
taacagtatagcctaacatttc

SEQ ID NO: 9286306 - DNA, 21 bp, Homo sapiens
tacatgagtgtatgagcatat

SEQ ID NO: 9286307 - DNA, 22 bp, Homo sapiens
gtgcaggatgttgggaatcagg

SEQ ID NO: 9286308 - DNA, 22 bp, Homo sapiens
tttgaatgagaattattgtcat

SEQ ID NO: 9286309 - DNA, 22 bp, Homo sapiens
tttccctacttgtaactggaaa

SEQ ID NO: 9286310 - DNA, 18 bp, Homo sapiens
tttgctttccttcttcag

SEQ ID NO: 9286311 - DNA, 22 bp, Homo sapiens
ttttctgacctatctacattta

SEQ ID NO: 9286312 - DNA, 20 bp, Homo sapiens
ttctttgttccttacatttg

SEQ ID NO: 9286313 - DNA, 21 bp, Homo sapiens
ttcacagatgggaaaactgag

SEQ ID NO: 9286314 - DNA, 22 bp, Homo sapiens
ttaggaaagggttttctaacag

SEQ ID NO: 9286315 - DNA, 22 bp, Homo sapiens
ttaggaaaagaagacatttcta

SEQ ID NO: 9286316 - DNA, 19 bp, Homo sapiens
ttaggaaaccactttcctt

SEQ ID NO: 9286317 - DNA, 22 bp, Homo sapiens
tttcaactcatgctaaaggaag

SEQ ID NO: 9286318 - DNA, 22 bp, Homo sapiens
tttatctcttttgaccaagatt

SEQ ID NO: 9286319 - DNA, 22 bp, Homo sapiens
ttgtaaatgaccttttctaatt

SEQ ID NO: 9286320 - DNA, 22 bp, Homo sapiens
ttgcagagatcagcaggtttga

SEQ ID NO: 9286321 - DNA, 22 bp, Homo sapiens
aataggaaaatatttaacaaga

SEQ ID NO: 9286322 - DNA, 22 bp, Homo sapiens
acatttcagattcatgaagtga

SEQ ID NO: 9286323 - DNA, 22 bp, Homo sapiens
acagatataaactatagtagtg

SEQ ID NO: 9286324 - DNA, 22 bp, Homo sapiens
acagatatatgattgtgtaaat

SEQ ID NO: 9286325 - DNA, 22 bp, Homo sapiens
acagcagtcagtgaatatttaa

SEQ ID NO: 9286326 - DNA, 22 bp, Homo sapiens
acagcagtgcacagagaaccct

SEQ ID NO: 9286327 - DNA, 22 bp, Homo sapiens
agagaagggggaaagatctcac

SEQ ID NO: 9286328 - DNA, 23 bp, Homo sapiens
aaatgtgagggaaaatctttctg

SEQ ID NO: 9286329 - DNA, 22 bp, Homo sapiens
aaaacacactggaccaatttaa

SEQ ID NO: 9286330 - DNA, 22 bp, Homo sapiens
aaaacacaagaagcagggtaca

SEQ ID NO: 9286331 - DNA, 22 bp, Homo sapiens
aaaacagttataaacagagtca

SEQ ID NO: 9286332 - DNA, 22 bp, Homo sapiens
aaaacagtttaggcatcacagt

SEQ ID NO: 9286333 - DNA, 22 bp, Homo sapiens
aaaaccaagttttccttagtct

SEQ ID NO: 9286334 - DNA, 22 bp, Homo sapiens
aaaacatgtccatacagaaact

SEQ ID NO: 9286335 - DNA, 22 bp, Homo sapiens
aaaatgcatgagaatgtgctcg

SEQ ID NO: 9286336 - DNA, 22 bp, Homo sapiens
aaagcatgctactttatatagg

SEQ ID NO: 9286337 - DNA, 22 bp, Homo sapiens
aacatgaagttttctatagtga

SEQ ID NO: 9286338 - DNA, 23 bp, Homo sapiens
aaatgacatatggtttctgaagg

SEQ ID NO: 9286339 - DNA, 22 bp, Homo sapiens
cagaaacatgtataaagttgta

SEQ ID NO: 9286340 - DNA, 17 bp, Homo sapiens
agcatttgtgttaacag

SEQ ID NO: 9286341 - DNA, 22 bp, Homo sapiens
caagcagaggtttatgtattag

SEQ ID NO: 9286342 - DNA, 22 bp, Homo sapiens
caattttattggtccaaataca

SEQ ID NO: 9286343 - DNA, 22 bp, Homo sapiens
cacagaaatattgtgtcccttg

SEQ ID NO: 9286344 - DNA, 22 bp, Homo sapiens
cagatgaactgtgactgaaaat

SEQ ID NO: 9286345 - DNA, 22 bp, Homo sapiens
attttgtggcagatgcagaacc

SEQ ID NO: 9286346 - DNA, 22 bp, Homo sapiens
attttgtgaaccctcaagcaat

SEQ ID NO: 9286347 - DNA, 22 bp, Homo sapiens
agagaacacgtgcatctgcaat

SEQ ID NO: 9286348 - DNA, 22 bp, Homo sapiens
agagaacagacagatgcaatga

SEQ ID NO: 9286349 - DNA, 22 bp, Homo sapiens
agagaaatttccctgccttctg

SEQ ID NO: 9286350 - DNA, 22 bp, Homo sapiens
atgtagtttggggctagattta

SEQ ID NO: 9286351 - DNA, 22 bp, Homo sapiens
agagaacatattttgtatgatt

SEQ ID NO: 9286352 - DNA, 22 bp, Homo sapiens
agagaacagcctcctagagaaa

SEQ ID NO: 9286353 - DNA, 22 bp, Homo sapiens
agagaacatgacgtaatagtgg

SEQ ID NO: 9286354 - DNA, 22 bp, Homo sapiens
acagcagttactgaaataaagt

SEQ ID NO: 9286355 - DNA, 22 bp, Homo sapiens
acagcagtgggttgccagtggg

SEQ ID NO: 9286356 - DNA, 22 bp, Homo sapiens
agtaacagtaacatcttcctag

SEQ ID NO: 9286357 - DNA, 22 bp, Homo sapiens
agtaacatgagtttttctaatg

SEQ ID NO: 9286358 - DNA, 22 bp, Homo sapiens
atattaaatggattttgggagc

SEQ ID NO: 9286359 - DNA, 20 bp, Homo sapiens
agaaacatttcttgagaact

SEQ ID NO: 9286360 - DNA, 20 bp, Homo sapiens
agaagcatcattctgatgtc

SEQ ID NO: 9286361 - DNA, 22 bp, Homo sapiens
agaaatgtgagccccttatcaa

SEQ ID NO: 9286362 - DNA, 22 bp, Homo sapiens
cagctagtaaatggcaagacta

SEQ ID NO: 9286363 - DNA, 22 bp, Homo sapiens
attgtgaatagtgccgcagtaa

SEQ ID NO: 9286364 - DNA, 22 bp, Homo sapiens
atgtgaaacgcaatgggatcat

SEQ ID NO: 9286365 - DNA, 22 bp, Homo sapiens
atgtgaaatagctggatatgaa

SEQ ID NO: 9286366 - DNA, 20 bp, Homo sapiens
atgtgaaagatcagttgtct

SEQ ID NO: 9286367 - DNA, 22 bp, Homo sapiens
atgtgaaatattaagccgagga

SEQ ID NO: 9286368 - DNA, 21 bp, Homo sapiens
atgtgaaatatcatcagagca

SEQ ID NO: 9286369 - DNA, 22 bp, Homo sapiens
atgtcccttgtctgtgatgtct

SEQ ID NO: 9286370 - DNA, 19 bp, Homo sapiens
gaattttaggacttcagca

SEQ ID NO: 9286371 - DNA, 22 bp, Homo sapiens
gaaggcaagatctcagtggagg

SEQ ID NO: 9286372 - DNA, 22 bp, Homo sapiens
gaaacagtcaactttctttccc

SEQ ID NO: 9286373 - DNA, 22 bp, Homo sapiens
gaaacagtgagaacttttcctg

SEQ ID NO: 9286374 - DNA, 20 bp, Homo sapiens
gaaacattggcagcaactga

SEQ ID NO: 9286375 - DNA, 22 bp, Homo sapiens
ctttcaactacatacaggcgat

SEQ ID NO: 9286376 - DNA, 22 bp, Homo sapiens
ctttcccagagtagttgatgct

SEQ ID NO: 9286377 - DNA, 22 bp, Homo sapiens
ctttcccacgcagtggatgaga

SEQ ID NO: 9286378 - DNA, 22 bp, Homo sapiens
atgaaacagagtacttaatata

SEQ ID NO: 9286379 - DNA, 22 bp, Homo sapiens
atgaaacaagggtattttctct

SEQ ID NO: 9286380 - DNA, 22 bp, Homo sapiens
ataacagtgacctctcagcacc

SEQ ID NO: 9286381 - DNA, 22 bp, Homo sapiens
atacagtaatttgtaactcatc

SEQ ID NO: 9286382 - DNA, 22 bp, Homo sapiens
atacagtagacaatctcatgaa

SEQ ID NO: 9286383 - DNA, 22 bp, Homo sapiens
cttagagatgggttttacttag

SEQ ID NO: 9286384 - DNA, 22 bp, Homo sapiens
atctgagtcaaatatttcattt

SEQ ID NO: 9286385 - DNA, 22 bp, Homo sapiens
atctgagtgttggatttattgt

SEQ ID NO: 9286386 - DNA, 22 bp, Homo sapiens
atattgtgtgtacaagtagtta

SEQ ID NO: 9286387 - DNA, 22 bp, Homo sapiens
atcaacaggtatggatgagatt

SEQ ID NO: 9286388 - DNA, 22 bp, Homo sapiens
ctaagaaatgttgtgaatgcca

SEQ ID NO: 9286389 - DNA, 22 bp, Homo sapiens
aggaatcaggagatgagcacgg

SEQ ID NO: 9286390 - DNA, 22 bp, Homo sapiens
cagtaacatttcaaggtagagg

SEQ ID NO: 9286391 - DNA, 22 bp, Homo sapiens
cagtaacatgtctgttaagaaa

SEQ ID NO: 9286392 - DNA, 22 bp, Homo sapiens
cagtaacatgaagagacatgga

SEQ ID NO: 9286393 - DNA, 22 bp, Homo sapiens
cagtatgtttgggagacatgac

SEQ ID NO: 9286394 - DNA, 22 bp, Homo sapiens
cagtatgagagttgaatcaagg

SEQ ID NO: 9286395 - DNA, 22 bp, Homo sapiens
cagtatgactacaaacagcttt

SEQ ID NO: 9286396 - DNA, 22 bp, Homo sapiens
cagtatgtctactggacaaagt

SEQ ID NO: 9286397 - DNA, 22 bp, Homo sapiens
cagtatgtgatgcaacggaata

SEQ ID NO: 9286398 - DNA, 22 bp, Homo sapiens
aggcaatcctcttacagatggg

SEQ ID NO: 9286399 - DNA, 22 bp, Homo sapiens
catttcaattatttgctcttct

SEQ ID NO: 9286400 - DNA, 22 bp, Homo sapiens
catttcaatacagtttgtaaat

SEQ ID NO: 9286401 - DNA, 22 bp, Homo sapiens
catttctccgccgagatcactg

SEQ ID NO: 9286402 - DNA, 22 bp, Homo sapiens
catttcaaaagaattgccagaa

SEQ ID NO: 9286403 - DNA, 22 bp, Homo sapiens
aggatgtgagtggacacagtcc

SEQ ID NO: 9286404 - DNA, 22 bp, Homo sapiens
tctgctttagaatccagtagct

SEQ ID NO: 9286405 - DNA, 22 bp, Homo sapiens
tccttcagttcaattagtccgt

SEQ ID NO: 9286406 - DNA, 22 bp, Homo sapiens
tccttcagttatcacagtactg

SEQ ID NO: 9286407 - DNA, 21 bp, Homo sapiens
tccttcagttctgcactttct

SEQ ID NO: 9286408 - DNA, 22 bp, Homo sapiens
tccttcagtcttctgagccata

SEQ ID NO: 9286409 - DNA, 21 bp, Homo sapiens
tccttcagtctagatgattgt

SEQ ID NO: 9286410 - DNA, 22 bp, Homo sapiens
tccttcagttaaagatctcaca

SEQ ID NO: 9286411 - DNA, 22 bp, Homo sapiens
tccttcagtgtcccgctcaggt

SEQ ID NO: 9286412 - DNA, 17 bp, Homo sapiens
tccttcagtgcctctgc

SEQ ID NO: 9286413 - DNA, 22 bp, Homo sapiens
catgcagttgaagcacagagag

SEQ ID NO: 9286414 - DNA, 22 bp, Homo sapiens
catgcagtggtaaaaagtcagg

SEQ ID NO: 9286415 - DNA, 22 bp, Homo sapiens
catgcagtgactcagacacagg

SEQ ID NO: 9286416 - DNA, 22 bp, Homo sapiens
catgcagtattcaggacagttc

SEQ ID NO: 9286417 - DNA, 22 bp, Homo sapiens
tcaacaaatacttaaagcagag

SEQ ID NO: 9286418 - DNA, 22 bp, Homo sapiens
tagaaacaaaatctgatgactc

SEQ ID NO: 9286419 - DNA, 22 bp, Homo sapiens
tagaaacaaagacctgggtgct

SEQ ID NO: 9286420 - DNA, 22 bp, Homo sapiens
ttcacagaagaggtcacatttc

SEQ ID NO: 9286421 - DNA, 22 bp, Homo sapiens
ttcagagttagacgaaaagcaa

SEQ ID NO: 9286422 - DNA, 22 bp, Homo sapiens
ttcagagtcagggatctcagag

SEQ ID NO: 9286423 - DNA, 22 bp, Homo sapiens
ctacagagttcacaggatttta

SEQ ID NO: 9286424 - DNA, 22 bp, Homo sapiens
ctcacagagcctctgtgtcttc

SEQ ID NO: 9286425 - DNA, 22 bp, Homo sapiens
ccttcagtcccatgtttctctt

SEQ ID NO: 9286426 - DNA, 22 bp, Homo sapiens
ccttcgagatttaaacactgat

SEQ ID NO: 9286427 - DNA, 19 bp, Homo sapiens
ttttaagtcctctctattc

SEQ ID NO: 9286428 - DNA, 22 bp, Homo sapiens
ttgtcttttgtgggaaatatgg

SEQ ID NO: 9286429 - DNA, 20 bp, Homo sapiens
tttccactgtaatgtatgat

SEQ ID NO: 9286430 - DNA, 21 bp, Homo sapiens
gaacatttgggttgtttctac

SEQ ID NO: 9286431 - DNA, 22 bp, Homo sapiens
gacagtatccaggtggtgaaga

SEQ ID NO: 9286432 - DNA, 22 bp, Homo sapiens
cttcagtatcctccacatgtta

SEQ ID NO: 9286433 - DNA, 22 bp, Homo sapiens
cttcagaagaaaagcagtgtgt

SEQ ID NO: 9286434 - DNA, 22 bp, Homo sapiens
gtagacagaaagcggaatcata

SEQ ID NO: 9286435 - DNA, 22 bp, Homo sapiens
gtgaaggaggggccacagatat

SEQ ID NO: 9286436 - DNA, 22 bp, Homo sapiens
gtgcatttgtgcatgcacatgt

SEQ ID NO: 9286437 - DNA, 23 bp, Homo sapiens
taaatttcttgattcttatgtga

SEQ ID NO: 9286438 - DNA, 22 bp, Homo sapiens
tacagaaatcacatcgctttga

SEQ ID NO: 9286439 - DNA, 22 bp, Homo sapiens
tatgtgaatacagcagtggatg

SEQ ID NO: 9286440 - DNA, 22 bp, Homo sapiens
tagaaacagaaaactgtaatag

SEQ ID NO: 9286441 - DNA, 22 bp, Homo sapiens
tagaaacatataggatggcagg

SEQ ID NO: 9286442 - DNA, 22 bp, Homo sapiens
tagaaacagcatatattagccc

SEQ ID NO: 9286443 - DNA, 22 bp, Homo sapiens
tagaaacagagcaggtggccca

SEQ ID NO: 9286444 - DNA, 22 bp, Homo sapiens
tagaaacagatgtttttgaaga

SEQ ID NO: 9286445 - DNA, 22 bp, Homo sapiens
tagaaacagagagatatgcccc

SEQ ID NO: 9286446 - DNA, 22 bp, Homo sapiens
tagaaacagaatatgagtgaga

SEQ ID NO: 9286447 - DNA, 22 bp, Homo sapiens
tagaaacatgttctgttctgtt

SEQ ID NO: 9286448 - DNA, 22 bp, Homo sapiens
tagaaacatgagagaaactctt

SEQ ID NO: 9286449 - DNA, 22 bp, Homo sapiens
tagaaacatatgtttgagacat

SEQ ID NO: 9286450 - DNA, 22 bp, Homo sapiens
tagaaacattcagttgcagtcc

SEQ ID NO: 9286451 - DNA, 22 bp, Homo sapiens
tactttgaccaccatctgatta

SEQ ID NO: 9286452 - DNA, 22 bp, Homo sapiens
tcatattagggtaatgataaga

SEQ ID NO: 9286453 - DNA, 22 bp, Homo sapiens
tcaattttatgaaacaaagtga

SEQ ID NO: 9286454 - DNA, 22 bp, Homo sapiens
tcaatttcttggtttgataata

SEQ ID NO: 9286455 - DNA, 22 bp, Homo sapiens
tcacaggagtcaaggaatagta

SEQ ID NO: 9286456 - DNA, 22 bp, Homo sapiens
tcagagaactccacaccttagg

SEQ ID NO: 9286457 - DNA, 22 bp, Homo sapiens
tcagagaactgcagcccttcct

SEQ ID NO: 9286458 - DNA, 22 bp, Homo sapiens
tcagagaaggctgagtcacggc

SEQ ID NO: 9286459 - DNA, 20 bp, Homo sapiens
tcagagaaggagctttcctg

SEQ ID NO: 9286460 - DNA, 22 bp, Homo sapiens
ttcaagaaagagtggctattcc

SEQ ID NO: 9286461 - DNA, 22 bp, Homo sapiens
ttcagtaaaacactgcaatgtc

SEQ ID NO: 9286462 - DNA, 22 bp, Homo sapiens
ttccagagaggctcatgttccc

SEQ ID NO: 9286463 - DNA, 22 bp, Homo sapiens
tgttttctgatggttaatgagt

SEQ ID NO: 9286464 - DNA, 22 bp, Homo sapiens
ttaacaaaaatatcaggcatca

SEQ ID NO: 9286465 - DNA, 20 bp, Homo sapiens
tgtgtcttcctttctttatg

SEQ ID NO: 9286466 - DNA, 22 bp, Homo sapiens
tttgttttgaactagctcagaa

SEQ ID NO: 9286467 - DNA, 22 bp, Homo sapiens
tttgttttcaatgtgtcattca

SEQ ID NO: 9286468 - DNA, 22 bp, Homo sapiens
ttgtgaatagtgccgcaataaa

SEQ ID NO: 9286469 - DNA, 22 bp, Homo sapiens
ttgtgaatagtgccgctataaa

SEQ ID NO: 9286470 - DNA, 22 bp, Homo sapiens
ttgtgaaatgtttcaaaatagt

SEQ ID NO: 9286471 - DNA, 22 bp, Homo sapiens
ttgtgaatggtgccgcaataaa

SEQ ID NO: 9286472 - DNA, 22 bp, Homo sapiens
tttaatttgaaatgagtaaccc

SEQ ID NO: 9286473 - DNA, 22 bp, Homo sapiens
tttctattgtaagtctcctata

SEQ ID NO: 9286474 - DNA, 22 bp, Homo sapiens
tttctcctccagagagacacag

SEQ ID NO: 9286475 - DNA, 22 bp, Homo sapiens
aggatgtgagccagcctggcct

SEQ ID NO: 9286476 - DNA, 23 bp, Homo sapiens
aggatgtaggatgtatggcagag

SEQ ID NO: 9286477 - DNA, 22 bp, Homo sapiens
catgagataatttttctccagt

SEQ ID NO: 9286478 - DNA, 22 bp, Homo sapiens
aggatttgcactggtgtttgag

SEQ ID NO: 9286479 - DNA, 22 bp, Homo sapiens
catgagatttgggaggggccag

SEQ ID NO: 9286480 - DNA, 22 bp, Homo sapiens
catctctccacggcagctctcg

SEQ ID NO: 9286481 - DNA, 22 bp, Homo sapiens
catcttcaccagagacaagcaa

SEQ ID NO: 9286482 - DNA, 22 bp, Homo sapiens
aggaggctgaactagggtctgg

SEQ ID NO: 9286483 - DNA, 22 bp, Homo sapiens
aggaggctgaactagggtctgg

SEQ ID NO: 9286484 - DNA, 20 bp, Homo sapiens
aggaggcctgcagatagttc

SEQ ID NO: 9286485 - DNA, 22 bp, Homo sapiens
aggaggcctctatccagagaga

SEQ ID NO: 9286486 - DNA, 23 bp, Homo sapiens
aggaggcctgaaactgaggctga

SEQ ID NO: 9286487 - DNA, 22 bp, Homo sapiens
cataagttgcagagggtgcatt

SEQ ID NO: 9286488 - DNA, 22 bp, Homo sapiens
cataacatgtacatataaatgc

SEQ ID NO: 9286489 - DNA, 21 bp, Homo sapiens
cagtgtggtgaccagggtctc

SEQ ID NO: 9286490 - DNA, 22 bp, Homo sapiens
cagtgtggagggagagagcctg

SEQ ID NO: 9286491 - DNA, 22 bp, Homo sapiens
cagtgtttaatcattgtgaatt

SEQ ID NO: 9286492 - DNA, 22 bp, Homo sapiens
cagtgtgtttcatgtaggtcct

SEQ ID NO: 9286493 - DNA, 22 bp, Homo sapiens
cagtgtgtctcttgtcctggct

SEQ ID NO: 9286494 - DNA, 22 bp, Homo sapiens
catttattggttaggccagcag

SEQ ID NO: 9286495 - DNA, 22 bp, Homo sapiens
catttctcctgggtgataaatt

SEQ ID NO: 9286496 - DNA, 22 bp, Homo sapiens
catttcaatgccttcaacatag

SEQ ID NO: 9286497 - DNA, 22 bp, Homo sapiens
cattggcacctcacaggataga

SEQ ID NO: 9286498 - DNA, 22 bp, Homo sapiens
cattggcacaagtagcttcatc

SEQ ID NO: 9286499 - DNA, 20 bp, Homo sapiens
cattggcattcacagaagct

SEQ ID NO: 9286500 - DNA, 22 bp, Homo sapiens
cattgctttgtgcatatttaaa

SEQ ID NO: 9286501 - DNA, 22 bp, Homo sapiens
aggcaactaggcctctgcctca

SEQ ID NO: 9286502 - DNA, 17 bp, Homo sapiens
aggcaactagttccctc

SEQ ID NO: 9286503 - DNA, 20 bp, Homo sapiens
aggcaactcaagtttttgcc

SEQ ID NO: 9286504 - DNA, 22 bp, Homo sapiens
aggcaactcatcatgaaagact

SEQ ID NO: 9286505 - DNA, 22 bp, Homo sapiens
aggcaactctgaccttatgaag

SEQ ID NO: 9286506 - DNA, 22 bp, Homo sapiens
aggcaactgacagcatatcctg

SEQ ID NO: 9286507 - DNA, 22 bp, Homo sapiens
aggcaactgacagtttctgctt

SEQ ID NO: 9286508 - DNA, 22 bp, Homo sapiens
aggcaactgagaggcccgtgtt

SEQ ID NO: 9286509 - DNA, 22 bp, Homo sapiens
aggcaactggttaagtaaattg

SEQ ID NO: 9286510 - DNA, 22 bp, Homo sapiens
aggcaactgtttgataatgttg

SEQ ID NO: 9286511 - DNA, 22 bp, Homo sapiens
aggcaacttgaccaggctttct

SEQ ID NO: 9286512 - DNA, 22 bp, Homo sapiens
aggcaacttgcatctcggcaag

SEQ ID NO: 9286513 - DNA, 22 bp, Homo sapiens
aggcaacttttggggatgatgg

SEQ ID NO: 9286514 - DNA, 21 bp, Homo sapiens
ccactcatgactccactcacc

SEQ ID NO: 9286515 - DNA, 22 bp, Homo sapiens
ccacccagccagatgcaggaag

SEQ ID NO: 9286516 - DNA, 22 bp, Homo sapiens
ccacgacgagtcatcagggcga

SEQ ID NO: 9286517 - DNA, 22 bp, Homo sapiens
ccacatacaaatggggtgctgt

SEQ ID NO: 9286518 - DNA, 22 bp, Homo sapiens
ccacatacaaatggggtgctgt

SEQ ID NO: 9286519 - DNA, 22 bp, Homo sapiens
ccacatcatggatacagttatg

SEQ ID NO: 9286520 - DNA, 22 bp, Homo sapiens
ccaatgatggtgcccacgatga

SEQ ID NO: 9286521 - DNA, 22 bp, Homo sapiens
ccacagaccttggcttccacct

SEQ ID NO: 9286522 - DNA, 17 bp, Homo sapiens
aggcaggagattggaga

SEQ ID NO: 9286523 - DNA, 22 bp, Homo sapiens
aggcaggaggatcatggatgca

SEQ ID NO: 9286524 - DNA, 22 bp, Homo sapiens
aggacaagctaaaggacttcct

SEQ ID NO: 9286525 - DNA, 22 bp, Homo sapiens
aggacacttaggttattcaact

SEQ ID NO: 9286526 - DNA, 22 bp, Homo sapiens
caggtgggccatgaaaaatgac

SEQ ID NO: 9286527 - DNA, 22 bp, Homo sapiens
caggtggtgcctccaggctggt

SEQ ID NO: 9286528 - DNA, 22 bp, Homo sapiens
caggtggttatgaggaaggtga

SEQ ID NO: 9286529 - DNA, 22 bp, Homo sapiens
caggtggttccatgtttcatga

SEQ ID NO: 9286530 - DNA, 22 bp, Homo sapiens
caggtggtgcctcctcccttcc

SEQ ID NO: 9286531 - DNA, 22 bp, Homo sapiens
caggtgtcaaaatactaagtgg

SEQ ID NO: 9286532 - DNA, 22 bp, Homo sapiens
caggtgtcagcagcactgtact

SEQ ID NO: 9286533 - DNA, 16 bp, Homo sapiens
caggtgtcagtcacct

SEQ ID NO: 9286534 - DNA, 22 bp, Homo sapiens
caggtggttgtttggattctaa

SEQ ID NO: 9286535 - DNA, 22 bp, Homo sapiens
caggtggtttgataggataact

SEQ ID NO: 9286536 - DNA, 22 bp, Homo sapiens
caggtggttgagagctgtaggc

SEQ ID NO: 9286537 - DNA, 22 bp, Homo sapiens
caggtgtctaattctcaccccc

SEQ ID NO: 9286538 - DNA, 22 bp, Homo sapiens
caggtgtcggtcaggcggtttt

SEQ ID NO: 9286539 - DNA, 22 bp, Homo sapiens
cagggcagggccacaccccctg

SEQ ID NO: 9286540 - DNA, 22 bp, Homo sapiens
cagggcagggagcttagaatga

SEQ ID NO: 9286541 - DNA, 22 bp, Homo sapiens
cagggcagggatgttgcggcag

SEQ ID NO: 9286542 - DNA, 22 bp, Homo sapiens
cagggcagtaacgggaacatct

SEQ ID NO: 9286543 - DNA, 22 bp, Homo sapiens
cagggcaggatgctgtgattat

SEQ ID NO: 9286544 - DNA, 22 bp, Homo sapiens
agctttctggttacagtcttca

SEQ ID NO: 9286545 - DNA, 22 bp, Homo sapiens
cagggctggatttcatttctag

SEQ ID NO: 9286546 - DNA, 22 bp, Homo sapiens
agctttggccctggaggttact

SEQ ID NO: 9286547 - DNA, 22 bp, Homo sapiens
agctttgggattcaggcaggaa

SEQ ID NO: 9286548 - DNA, 18 bp, Homo sapiens
cagggctgtggggtcact

SEQ ID NO: 9286549 - DNA, 22 bp, Homo sapiens
caggcagctcaaccttgggagc

SEQ ID NO: 9286550 - DNA, 22 bp, Homo sapiens
caggcagggagctggaaaggat

SEQ ID NO: 9286551 - DNA, 22 bp, Homo sapiens
caggcaggtcagtgaagaagga

SEQ ID NO: 9286552 - DNA, 22 bp, Homo sapiens
caggagaaatgtggctgctacc

SEQ ID NO: 9286553 - DNA, 22 bp, Homo sapiens
caggagaaacataattttctgg

SEQ ID NO: 9286554 - DNA, 22 bp, Homo sapiens
cagctgtccttcctggtgggcg

SEQ ID NO: 9286555 - DNA, 22 bp, Homo sapiens
cagctggtgtccagggaagtgg

SEQ ID NO: 9286556 - DNA, 22 bp, Homo sapiens
cagctggttatcagagaggcct

SEQ ID NO: 9286557 - DNA, 22 bp, Homo sapiens
cagctggttcagtgtctggtga

SEQ ID NO: 9286558 - DNA, 22 bp, Homo sapiens
cagctggtcaactgaatgaaca

SEQ ID NO: 9286559 - DNA, 22 bp, Homo sapiens
cagctgggtttagtggggtgtg

SEQ ID NO: 9286560 - DNA, 22 bp, Homo sapiens
cagctgggtttagtggggtgtg

SEQ ID NO: 9286561 - DNA, 20 bp, Homo sapiens
caggcacactcattcctgct

SEQ ID NO: 9286562 - DNA, 20 bp, Homo sapiens
caggcacactcattcctgct

SEQ ID NO: 9286563 - DNA, 22 bp, Homo sapiens
caggcacacatccgtgagagat

SEQ ID NO: 9286564 - DNA, 22 bp, Homo sapiens
caggcacacagcacatggcctg

SEQ ID NO: 9286565 - DNA, 22 bp, Homo sapiens
caggatggagggagggctgtta

SEQ ID NO: 9286566 - DNA, 22 bp, Homo sapiens
caggatggccccggggctgtgc

SEQ ID NO: 9286567 - DNA, 22 bp, Homo sapiens
aggctcagagatgagtaagcac

SEQ ID NO: 9286568 - DNA, 21 bp, Homo sapiens
aggctcagagatcaaacagta

SEQ ID NO: 9286569 - DNA, 20 bp, Homo sapiens
ccaggcactgtcccatgcag

SEQ ID NO: 9286570 - DNA, 20 bp, Homo sapiens
aggctcagatacccagggaa

SEQ ID NO: 9286571 - DNA, 16 bp, Homo sapiens
aggctcagaggctgga

SEQ ID NO: 9286572 - DNA, 22 bp, Homo sapiens
ccaggaggtggaggttgcggtg

SEQ ID NO: 9286573 - DNA, 22 bp, Homo sapiens
ccaggaggtggcaggacttgcc

SEQ ID NO: 9286574 - DNA, 22 bp, Homo sapiens
ccaggaggtgctggaagaaagc

SEQ ID NO: 9286575 - DNA, 22 bp, Homo sapiens
ccaggaggtgaaacttcaccag

SEQ ID NO: 9286576 - DNA, 22 bp, Homo sapiens
ccaggaggtggagattgcagtg

SEQ ID NO: 9286577 - DNA, 22 bp, Homo sapiens
ccaggagggaggagttcctgag

SEQ ID NO: 9286578 - DNA, 22 bp, Homo sapiens
ccaggaggatcatcctgttttc

SEQ ID NO: 9286579 - DNA, 22 bp, Homo sapiens
ccaggaggatgaggggcataga

SEQ ID NO: 9286580 - DNA, 22 bp, Homo sapiens
ccaggaggtctgagtgtggaca

SEQ ID NO: 9286581 - DNA, 22 bp, Homo sapiens
ccaggagggtggttactcaatc

SEQ ID NO: 9286582 - DNA, 22 bp, Homo sapiens
ccaggaggggtctctgtctccc

SEQ ID NO: 9286583 - DNA, 22 bp, Homo sapiens
aggccctgctttccagagctca

SEQ ID NO: 9286584 - DNA, 22 bp, Homo sapiens
aggccctgcccagtgccacaag

SEQ ID NO: 9286585 - DNA, 22 bp, Homo sapiens
aggcaggtcccctggaaggcac

SEQ ID NO: 9286586 - DNA, 22 bp, Homo sapiens
aggcaggtctgtatctagtctc

SEQ ID NO: 9286587 - DNA, 22 bp, Homo sapiens
aggcaggtgagtcaaaacagac

SEQ ID NO: 9286588 - DNA, 22 bp, Homo sapiens
aggcaggtcacatgcttggcga

SEQ ID NO: 9286589 - DNA, 22 bp, Homo sapiens
aggcaggtagaaggatctttat

SEQ ID NO: 9286590 - DNA, 19 bp, Homo sapiens
aggcaggtgcagaggtccc

SEQ ID NO: 9286591 - DNA, 22 bp, Homo sapiens
aggctctggttcatcatgatgg

SEQ ID NO: 9286592 - DNA, 22 bp, Homo sapiens
aggctctgggaagcagtgagtt

SEQ ID NO: 9286593 - DNA, 20 bp, Homo sapiens
ccaggtggtgcctggagagg

SEQ ID NO: 9286594 - DNA, 22 bp, Homo sapiens
ccaggtggttcaggtcaccata

SEQ ID NO: 9286595 - DNA, 22 bp, Homo sapiens
ccaggtgtgtctggccccgaag

SEQ ID NO: 9286596 - DNA, 22 bp, Homo sapiens
ccaggtgttctttgtccctgtt

SEQ ID NO: 9286597 - DNA, 22 bp, Homo sapiens
ccaggtgttacacgagtgttaa

SEQ ID NO: 9286598 - DNA, 22 bp, Homo sapiens
ccaggtgtttggcctgcatgat

SEQ ID NO: 9286599 - DNA, 18 bp, Homo sapiens
ccaggtggtgacagagat

SEQ ID NO: 9286600 - DNA, 22 bp, Homo sapiens
ccaggtggtgaaagtgggccct

SEQ ID NO: 9286601 - DNA, 22 bp, Homo sapiens
ccaggtggtgcctctgttcgca

SEQ ID NO: 9286602 - DNA, 20 bp, Homo sapiens
ccaggtggtgcctggagagg

SEQ ID NO: 9286603 - DNA, 19 bp, Homo sapiens
aggctctgtaggagagggc

SEQ ID NO: 9286604 - DNA, 22 bp, Homo sapiens
ccagggcacttaggcccagccc

SEQ ID NO: 9286605 - DNA, 22 bp, Homo sapiens
ccagggcagaaaaagagggaat

SEQ ID NO: 9286606 - DNA, 22 bp, Homo sapiens
ccagggcagcagaattggggca

SEQ ID NO: 9286607 - DNA, 22 bp, Homo sapiens
ccagggcagccaacccagatgc

SEQ ID NO: 9286608 - DNA, 22 bp, Homo sapiens
ccagggcagcgcccctccacgc

SEQ ID NO: 9286609 - DNA, 16 bp, Homo sapiens
ccaggtggggctgtga

SEQ ID NO: 9286610 - DNA, 22 bp, Homo sapiens
ccaggtggtgaaagtgggccct

SEQ ID NO: 9286611 - DNA, 22 bp, Homo sapiens
cccacacacatttatgatagga

SEQ ID NO: 9286612 - DNA, 22 bp, Homo sapiens
cccacacactggctgctgccaa

SEQ ID NO: 9286613 - DNA, 22 bp, Homo sapiens
cccacacaaatcatggggagaa

SEQ ID NO: 9286614 - DNA, 22 bp, Homo sapiens
cccacacatttttcacttaccg

SEQ ID NO: 9286615 - DNA, 20 bp, Homo sapiens
cccacacccttcccacttgg

SEQ ID NO: 9286616 - DNA, 18 bp, Homo sapiens
cccacacagcagtagctc

SEQ ID NO: 9286617 - DNA, 20 bp, Homo sapiens
ccagtgggaagtgattaggt

SEQ ID NO: 9286618 - DNA, 22 bp, Homo sapiens
ccagtgggagggagctaggcca

SEQ ID NO: 9286619 - DNA, 22 bp, Homo sapiens
ccagtgggtaggccatggtgag

SEQ ID NO: 9286620 - DNA, 22 bp, Homo sapiens
ccagtgggtgctgggctctgcc

SEQ ID NO: 9286621 - DNA, 22 bp, Homo sapiens
cccaccctgggctacacatcca

SEQ ID NO: 9286622 - DNA, 22 bp, Homo sapiens
cccaccctgggaagctaggcag

SEQ ID NO: 9286623 - DNA, 22 bp, Homo sapiens
agggagctttaccccagatcac

SEQ ID NO: 9286624 - DNA, 22 bp, Homo sapiens
cccaggtggcagaagctgcagt

SEQ ID NO: 9286625 - DNA, 22 bp, Homo sapiens
cccaggtgctgcgtgaagcctc

SEQ ID NO: 9286626 - DNA, 22 bp, Homo sapiens
cccaggtgggcacctcgaggaa

SEQ ID NO: 9286627 - DNA, 22 bp, Homo sapiens
cccaggtgtttgtggcagaggt

SEQ ID NO: 9286628 - DNA, 20 bp, Homo sapiens
cccaggtgtctgaagctctg

SEQ ID NO: 9286629 - DNA, 22 bp, Homo sapiens
agggcatgtgggagaggagcct

SEQ ID NO: 9286630 - DNA, 22 bp, Homo sapiens
agggcatgctggaggagagaca

SEQ ID NO: 9286631 - DNA, 22 bp, Homo sapiens
cccagagtcaagcttaccatta

SEQ ID NO: 9286632 - DNA, 22 bp, Homo sapiens
cccaggcctggtctgggccagt

SEQ ID NO: 9286633 - DNA, 17 bp, Homo sapiens
cccaggccgccgggagc

SEQ ID NO: 9286634 - DNA, 22 bp, Homo sapiens
agggacagtctactgttcactg

SEQ ID NO: 9286635 - DNA, 22 bp, Homo sapiens
agggaatggatgatggcaggtt

SEQ ID NO: 9286636 - DNA, 22 bp, Homo sapiens
agggacagtctactgttcactg

SEQ ID NO: 9286637 - DNA, 22 bp, Homo sapiens
agggacagttacatcatcagac

SEQ ID NO: 9286638 - DNA, 22 bp, Homo sapiens
agggactccctgggccgacacg

SEQ ID NO: 9286639 - DNA, 22 bp, Homo sapiens
cccaggccagaacttggttgct

SEQ ID NO: 9286640 - DNA, 22 bp, Homo sapiens
cctcgacctccccaggctcagg

SEQ ID NO: 9286641 - DNA, 22 bp, Homo sapiens
cctcctggtgggcgcttctggc

SEQ ID NO: 9286642 - DNA, 22 bp, Homo sapiens
aggggctcagttactttggcag

SEQ ID NO: 9286643 - DNA, 22 bp, Homo sapiens
aggggctctgagtgggccagga

SEQ ID NO: 9286644 - DNA, 22 bp, Homo sapiens
cctctgtgggccgggcctgctg

SEQ ID NO: 9286645 - DNA, 22 bp, Homo sapiens
aggggctcctggcctggagagc

SEQ ID NO: 9286646 - DNA, 22 bp, Homo sapiens
aggggctctaaagatcatggaa

SEQ ID NO: 9286647 - DNA, 22 bp, Homo sapiens
cctcttcaggcactcgaaggcc

SEQ ID NO: 9286648 - DNA, 22 bp, Homo sapiens
cctctgtgtgatgcgcaaagta

SEQ ID NO: 9286649 - DNA, 22 bp, Homo sapiens
cctctgtgtgtgcatgcatgcg

SEQ ID NO: 9286650 - DNA, 20 bp, Homo sapiens
cctctgtgtcctgtgtcata

SEQ ID NO: 9286651 - DNA, 20 bp, Homo sapiens
cctctgtgtcctgtgtcata

SEQ ID NO: 9286652 - DNA, 22 bp, Homo sapiens
cctctgtgtcctggtcattgaa

SEQ ID NO: 9286653 - DNA, 22 bp, Homo sapiens
cctctgtgtcctggtcattgaa

SEQ ID NO: 9286654 - DNA, 22 bp, Homo sapiens
cctctgtgtcctggtcattgaa

SEQ ID NO: 9286655 - DNA, 22 bp, Homo sapiens
cctctgtggtctgtctaatgca

SEQ ID NO: 9286656 - DNA, 22 bp, Homo sapiens
agggggtgatcaaggtgcggcg

SEQ ID NO: 9286657 - DNA, 22 bp, Homo sapiens
agggggtgtctctgattgggtt

SEQ ID NO: 9286658 - DNA, 22 bp, Homo sapiens
aggggtagtaggataacaaatt

SEQ ID NO: 9286659 - DNA, 22 bp, Homo sapiens
aggggtagagattgctggtgta

SEQ ID NO: 9286660 - DNA, 22 bp, Homo sapiens
agggcctgtgctgagtagacga

SEQ ID NO: 9286661 - DNA, 22 bp, Homo sapiens
ccctggcagagggggcaggtgc

SEQ ID NO: 9286662 - DNA, 22 bp, Homo sapiens
cctactctgagcgcctccgcat

SEQ ID NO: 9286663 - DNA, 20 bp, Homo sapiens
agggctgagaagggactagc

SEQ ID NO: 9286664 - DNA, 22 bp, Homo sapiens
cgggcaaggcgagactaggccc

SEQ ID NO: 9286665 - DNA, 22 bp, Homo sapiens
cgggcagtgtggctccagagtc

SEQ ID NO: 9286666 - DNA, 22 bp, Homo sapiens
cgaggccagctctaagccctac

SEQ ID NO: 9286667 - DNA, 22 bp, Homo sapiens
cgaggccatgcatgctgaggac

SEQ ID NO: 9286668 - DNA, 22 bp, Homo sapiens
cgcagctgtccatgtgtggggg

SEQ ID NO: 9286669 - DNA, 22 bp, Homo sapiens
cgcaggtgaaagaggctgggca

SEQ ID NO: 9286670 - DNA, 22 bp, Homo sapiens
cgcaggtgaactgttctgcagt

SEQ ID NO: 9286671 - DNA, 22 bp, Homo sapiens
cgcagggccgcgagcgggacca

SEQ ID NO: 9286672 - DNA, 23 bp, Homo sapiens
agtatgggggatcacgtggccct

SEQ ID NO: 9286673 - DNA, 23 bp, Homo sapiens
agtatgaattcattgttttagtt

SEQ ID NO: 9286674 - DNA, 22 bp, Homo sapiens
ctaggtgatccactgctctctt

SEQ ID NO: 9286675 - DNA, 20 bp, Homo sapiens
aggtaggatcggtgtcataa

SEQ ID NO: 9286676 - DNA, 22 bp, Homo sapiens
aggtaggatgggtggagatgat

SEQ ID NO: 9286677 - DNA, 22 bp, Homo sapiens
aggtaggatagataggaagacc

SEQ ID NO: 9286678 - DNA, 21 bp, Homo sapiens
cctgccaggaaactgagtgtc

SEQ ID NO: 9286679 - DNA, 22 bp, Homo sapiens
aggtaggccctgagtgctgttg

SEQ ID NO: 9286680 - DNA, 22 bp, Homo sapiens
aggtagggaagaaggcatgaaa

SEQ ID NO: 9286681 - DNA, 22 bp, Homo sapiens
aggtagggaagaaggcatgaaa

SEQ ID NO: 9286682 - DNA, 22 bp, Homo sapiens
aggtagggctaggctgcgtctg

SEQ ID NO: 9286683 - DNA, 22 bp, Homo sapiens
aggtagggggtttgggaactgc

SEQ ID NO: 9286684 - DNA, 22 bp, Homo sapiens
aggtagggttaatggagatata

SEQ ID NO: 9286685 - DNA, 22 bp, Homo sapiens
cctgcagatgtgggacagctgt

SEQ ID NO: 9286686 - DNA, 22 bp, Homo sapiens
cctgccagatcccctgagctga

SEQ ID NO: 9286687 - DNA, 22 bp, Homo sapiens
cctgccagcatggcttatctcc

SEQ ID NO: 9286688 - DNA, 22 bp, Homo sapiens
cctgccagcccgcgttcatgcc

SEQ ID NO: 9286689 - DNA, 22 bp, Homo sapiens
aggtccctgagtcagcggcgct

SEQ ID NO: 9286690 - DNA, 22 bp, Homo sapiens
cctggaggtggaggttgcagtg

SEQ ID NO: 9286691 - DNA, 21 bp, Homo sapiens
aggtggggctgcacctctgct

SEQ ID NO: 9286692 - DNA, 22 bp, Homo sapiens
aggtggggcccaccaatttgca

SEQ ID NO: 9286693 - DNA, 22 bp, Homo sapiens
aggtggggccaaatgctacagt

SEQ ID NO: 9286694 - DNA, 22 bp, Homo sapiens
aggtggggagtatatgtaattg

SEQ ID NO: 9286695 - DNA, 22 bp, Homo sapiens
ctcctcaaggtctcaggaataa

SEQ ID NO: 9286696 - DNA, 18 bp, Homo sapiens
ctcctggctgatggtgag

SEQ ID NO: 9286697 - DNA, 22 bp, Homo sapiens
ctcctggctcgcccccagctga

SEQ ID NO: 9286698 - DNA, 22 bp, Homo sapiens
ctcctcagactttccttgtccg

SEQ ID NO: 9286699 - DNA, 22 bp, Homo sapiens
ctcctcagaacagccttggctg

SEQ ID NO: 9286700 - DNA, 22 bp, Homo sapiens
ctccctccctacgtgagctcac

SEQ ID NO: 9286701 - DNA, 22 bp, Homo sapiens
ctccctcaggccttagccctgc

SEQ ID NO: 9286702 - DNA, 22 bp, Homo sapiens
ctcccaggttgattctttccct

SEQ ID NO: 9286703 - DNA, 22 bp, Homo sapiens
agtggcagatctctggtctgga

SEQ ID NO: 9286704 - DNA, 22 bp, Homo sapiens
ctcctggctttcccagaccagg

SEQ ID NO: 9286705 - DNA, 22 bp, Homo sapiens
agtcccctctcgcttggctgag

SEQ ID NO: 9286706 - DNA, 22 bp, Homo sapiens
agtcccctctaacccaacttta

SEQ ID NO: 9286707 - DNA, 22 bp, Homo sapiens
agtcccctggcaggagggacgt

SEQ ID NO: 9286708 - DNA, 23 bp, Homo sapiens
agtcccctacatagttcctgggg

SEQ ID NO: 9286709 - DNA, 21 bp, Homo sapiens
agtcccctgtccttacttcta

SEQ ID NO: 9286710 - DNA, 22 bp, Homo sapiens
ctcattgcaacctccgcctccc

SEQ ID NO: 9286711 - DNA, 22 bp, Homo sapiens
ctcattgcccagatccccacag

SEQ ID NO: 9286712 - DNA, 22 bp, Homo sapiens
ctcattgcccagatccccacag

SEQ ID NO: 9286713 - DNA, 22 bp, Homo sapiens
ctccaggaaagcctgaggcccg

SEQ ID NO: 9286714 - DNA, 22 bp, Homo sapiens
ctccaggctcgtccaagatcga

SEQ ID NO: 9286715 - DNA, 22 bp, Homo sapiens
agtcttccctgtgccagagtgt

SEQ ID NO: 9286716 - DNA, 22 bp, Homo sapiens
agtcttagaactacagtgccta

SEQ ID NO: 9286717 - DNA, 19 bp, Homo sapiens
ctctcagcctgtctccttg

SEQ ID NO: 9286718 - DNA, 22 bp, Homo sapiens
ctctgagcagaggccgtggcta

SEQ ID NO: 9286719 - DNA, 22 bp, Homo sapiens
ctctgcaggcctgtgaagggtg

SEQ ID NO: 9286720 - DNA, 22 bp, Homo sapiens
ctctgctgagccagagtcccca

SEQ ID NO: 9286721 - DNA, 21 bp, Homo sapiens
ctctgctgagtcctaggattc

SEQ ID NO: 9286722 - DNA, 23 bp, Homo sapiens
ctctggatcctgtagctcctggc

SEQ ID NO: 9286723 - DNA, 22 bp, Homo sapiens
ctctgggagaggacacttggag

SEQ ID NO: 9286724 - DNA, 22 bp, Homo sapiens
ctctggctttgctcatgcatcc

SEQ ID NO: 9286725 - DNA, 22 bp, Homo sapiens
ctctgggaaagattgtgcaggc

SEQ ID NO: 9286726 - DNA, 22 bp, Homo sapiens
ctctgggaagtagatttggcct

SEQ ID NO: 9286727 - DNA, 22 bp, Homo sapiens
ctctgggaagtggagacttcag

SEQ ID NO: 9286728 - DNA, 22 bp, Homo sapiens
ctgaaataaagttgctaaaatt

SEQ ID NO: 9286729 - DNA, 22 bp, Homo sapiens
ctgaatgtcgatcagcttgggt

SEQ ID NO: 9286730 - DNA, 22 bp, Homo sapiens
agttaggacacttgagggctaa

SEQ ID NO: 9286731 - DNA, 22 bp, Homo sapiens
agttaggacccacacccaccag

SEQ ID NO: 9286732 - DNA, 20 bp, Homo sapiens
agttaggaatttaagtgtta

SEQ ID NO: 9286733 - DNA, 20 bp, Homo sapiens
agttagcaggtgctggtgtc

SEQ ID NO: 9286734 - DNA, 22 bp, Homo sapiens
agttaggagcaaaataagatag

SEQ ID NO: 9286735 - DNA, 22 bp, Homo sapiens
agttaggagtataggaatgcct

SEQ ID NO: 9286736 - DNA, 22 bp, Homo sapiens
agttaggatttctccggggagg

SEQ ID NO: 9286737 - DNA, 22 bp, Homo sapiens
atcaacatgtcataaagtgaaa

SEQ ID NO: 9286738 - DNA, 22 bp, Homo sapiens
atattgttgactataagagtaa

SEQ ID NO: 9286739 - DNA, 22 bp, Homo sapiens
atattgagataagaactgacat

SEQ ID NO: 9286740 - DNA, 22 bp, Homo sapiens
atattgagatgaggatattaac

SEQ ID NO: 9286741 - DNA, 22 bp, Homo sapiens
atattttggcaaatgtctagat

SEQ ID NO: 9286742 - DNA, 22 bp, Homo sapiens
ctggctggccggaggcatccct

SEQ ID NO: 9286743 - DNA, 22 bp, Homo sapiens
atatgcagtctcttgcccttct

SEQ ID NO: 9286744 - DNA, 20 bp, Homo sapiens
ctgggctcaagtgatcctcc

SEQ ID NO: 9286745 - DNA, 22 bp, Homo sapiens
ctgggctgagcctgggctgtgt

SEQ ID NO: 9286746 - DNA, 22 bp, Homo sapiens
atattataagttatttcaagtt

SEQ ID NO: 9286747 - DNA, 22 bp, Homo sapiens
atattaggttggtgcaaaagta

SEQ ID NO: 9286748 - DNA, 22 bp, Homo sapiens
atattactctgatttagtaaat

SEQ ID NO: 9286749 - DNA, 22 bp, Homo sapiens
cttcttgcaattttcatcttat

SEQ ID NO: 9286750 - DNA, 22 bp, Homo sapiens
cttcttggaagtcgtccttcca

SEQ ID NO: 9286751 - DNA, 22 bp, Homo sapiens
cttcttgctgggggcctcagtg

SEQ ID NO: 9286752 - DNA, 22 bp, Homo sapiens
cttcttaatgacagattaaaat

SEQ ID NO: 9286753 - DNA, 22 bp, Homo sapiens
cttcttggctgcaagtctctgt

SEQ ID NO: 9286754 - DNA, 22 bp, Homo sapiens
atctgaaatagtcttatctgag

SEQ ID NO: 9286755 - DNA, 22 bp, Homo sapiens
cttcctctagcctagtaatgcc

SEQ ID NO: 9286756 - DNA, 22 bp, Homo sapiens
cttagaaggatgtttgctgttt

SEQ ID NO: 9286757 - DNA, 22 bp, Homo sapiens
cttcccactagtatcacagagc

SEQ ID NO: 9286758 - DNA, 22 bp, Homo sapiens
cttcctcccccacacactcact

SEQ ID NO: 9286759 - DNA, 17 bp, Homo sapiens
cttcccaccatctcctg

SEQ ID NO: 9286760 - DNA, 22 bp, Homo sapiens
atcctgggcaagtcaatgtccc

SEQ ID NO: 9286761 - DNA, 22 bp, Homo sapiens
ctgtgtggactggttgaggccc

SEQ ID NO: 9286762 - DNA, 22 bp, Homo sapiens
atccaggcgaatgcagaaggcc

SEQ ID NO: 9286763 - DNA, 22 bp, Homo sapiens
atccaggccccaagaccccgac

SEQ ID NO: 9286764 - DNA, 22 bp, Homo sapiens
ctggagacctctcctgagagtg

SEQ ID NO: 9286765 - DNA, 22 bp, Homo sapiens
ctggagaagccaaactagtcac

SEQ ID NO: 9286766 - DNA, 22 bp, Homo sapiens
ctggagaagaggtagtatgtag

SEQ ID NO: 9286767 - DNA, 22 bp, Homo sapiens
ataccttttagacatgtagttg

SEQ ID NO: 9286768 - DNA, 22 bp, Homo sapiens
atacatgttcgtgtacatgttc

SEQ ID NO: 9286769 - DNA, 22 bp, Homo sapiens
atacattcaaaggaaggataga

SEQ ID NO: 9286770 - DNA, 22 bp, Homo sapiens
atactacacattgactatattt

SEQ ID NO: 9286771 - DNA, 22 bp, Homo sapiens
atactacactatgcatggatgt

SEQ ID NO: 9286772 - DNA, 22 bp, Homo sapiens
atagagctcttcttcttttaac

SEQ ID NO: 9286773 - DNA, 22 bp, Homo sapiens
ataacagatgtgaagtgctaat

SEQ ID NO: 9286774 - DNA, 22 bp, Homo sapiens
ctgcctctccccagagtggccc

SEQ ID NO: 9286775 - DNA, 22 bp, Homo sapiens
ctgcctctcagcctgaccgcca

SEQ ID NO: 9286776 - DNA, 22 bp, Homo sapiens
ctgcctctcaggtccctgagat

SEQ ID NO: 9286777 - DNA, 22 bp, Homo sapiens
ctgctgagcctggtgcgggatg

SEQ ID NO: 9286778 - DNA, 22 bp, Homo sapiens
ctgctgaggtatactatgtgac

SEQ ID NO: 9286779 - DNA, 22 bp, Homo sapiens
atacaaatttatagatgcattt

SEQ ID NO: 9286780 - DNA, 17 bp, Homo sapiens
ataagacagaagacaat

SEQ ID NO: 9286781 - DNA, 22 bp, Homo sapiens
ctgcatccatgttgctgcaaag

SEQ ID NO: 9286782 - DNA, 22 bp, Homo sapiens
agttattgagtgcagagcaggg

SEQ ID NO: 9286783 - DNA, 22 bp, Homo sapiens
agttattgttcagtacaatgtc

SEQ ID NO: 9286784 - DNA, 22 bp, Homo sapiens
agttatattccatagattcaga

SEQ ID NO: 9286785 - DNA, 22 bp, Homo sapiens
agttatatgtgaaaacacgtat

SEQ ID NO: 9286786 - DNA, 22 bp, Homo sapiens
atgaaacaagggtattttctct

SEQ ID NO: 9286787 - DNA, 22 bp, Homo sapiens
atgaaaattgacagcggaagta

SEQ ID NO: 9286788 - DNA, 22 bp, Homo sapiens
atgaaaatgtacatgtgtataa

SEQ ID NO: 9286789 - DNA, 22 bp, Homo sapiens
ctttccccagtatatcattgcc

SEQ ID NO: 9286790 - DNA, 22 bp, Homo sapiens
ctttccccagtatatcattgcc

SEQ ID NO: 9286791 - DNA, 22 bp, Homo sapiens
ctttcccttagccccattctat

SEQ ID NO: 9286792 - DNA, 22 bp, Homo sapiens
atctggagatcagctggtggca

SEQ ID NO: 9286793 - DNA, 22 bp, Homo sapiens
cttctttactttctagaaataa

SEQ ID NO: 9286794 - DNA, 22 bp, Homo sapiens
atctggaggattctgggacttg

SEQ ID NO: 9286795 - DNA, 22 bp, Homo sapiens
atctggaggcaaaggggcgtga

SEQ ID NO: 9286796 - DNA, 23 bp, Homo sapiens
atctggagtgttgagtaggtact

SEQ ID NO: 9286797 - DNA, 22 bp, Homo sapiens
gaaaatgttagcttcatagtca

SEQ ID NO: 9286798 - DNA, 22 bp, Homo sapiens
atgacaggaggcagctgggcag

SEQ ID NO: 9286799 - DNA, 22 bp, Homo sapiens
gaaaccacagtacccaggaaaa

SEQ ID NO: 9286800 - DNA, 19 bp, Homo sapiens
atgatgcagagctgactca

SEQ ID NO: 9286801 - DNA, 21 bp, Homo sapiens
atgatatgcttgtatttccaa

SEQ ID NO: 9286802 - DNA, 23 bp, Homo sapiens
gaaagtcaatatggtagctttga

SEQ ID NO: 9286803 - DNA, 22 bp, Homo sapiens
gaatatttttaaagggactaat

SEQ ID NO: 9286804 - DNA, 17 bp, Homo sapiens
gaataagtggatggcac

SEQ ID NO: 9286805 - DNA, 22 bp, Homo sapiens
gaataagtgaagttggcagctt

SEQ ID NO: 9286806 - DNA, 22 bp, Homo sapiens
gactgggcagccggtagggaag

SEQ ID NO: 9286807 - DNA, 22 bp, Homo sapiens
gactggcctggggctgggcaca

SEQ ID NO: 9286808 - DNA, 22 bp, Homo sapiens
gactggcctggagatgcagctg

SEQ ID NO: 9286809 - DNA, 22 bp, Homo sapiens
gactggaaagcctgtcctcaga

SEQ ID NO: 9286810 - DNA, 22 bp, Homo sapiens
gacggagctggttgctgcggct

SEQ ID NO: 9286811 - DNA, 22 bp, Homo sapiens
gacctttagtgtcatgttatat

SEQ ID NO: 9286812 - DNA, 22 bp, Homo sapiens
gacctttagtgtccaatattca

SEQ ID NO: 9286813 - DNA, 22 bp, Homo sapiens
gacctttaatgtttctaccact

SEQ ID NO: 9286814 - DNA, 21 bp, Homo sapiens
gacctttacatttttcactgt

SEQ ID NO: 9286815 - DNA, 22 bp, Homo sapiens
gacatttctagcccataaaact

SEQ ID NO: 9286816 - DNA, 22 bp, Homo sapiens
atgctatgtaactggcagatag

SEQ ID NO: 9286817 - DNA, 22 bp, Homo sapiens
gaccacagaggtgtgggagaga

SEQ ID NO: 9286818 - DNA, 22 bp, Homo sapiens
gacacagtttttctcacggtgg

SEQ ID NO: 9286819 - DNA, 22 bp, Homo sapiens
gacacatatgcgtatagtttag

SEQ ID NO: 9286820 - DNA, 22 bp, Homo sapiens
gacacatagatctatctcactc

SEQ ID NO: 9286821 - DNA, 18 bp, Homo sapiens
gacacatccccaggcctc

SEQ ID NO: 9286822 - DNA, 22 bp, Homo sapiens
atgtcctcaaaactgattgcag

SEQ ID NO: 9286823 - DNA, 20 bp, Homo sapiens
atgtcctcagccactgccct

SEQ ID NO: 9286824 - DNA, 22 bp, Homo sapiens
atgtcctcggctctgtgctgct

SEQ ID NO: 9286825 - DNA, 22 bp, Homo sapiens
atgtcctcttctgcctcaggcc

SEQ ID NO: 9286826 - DNA, 22 bp, Homo sapiens
atgtcatgggccaaaaatagtt

SEQ ID NO: 9286827 - DNA, 22 bp, Homo sapiens
atgtcatgaaatgctactaact

SEQ ID NO: 9286828 - DNA, 22 bp, Homo sapiens
atgtagagctccttgatcctcc

SEQ ID NO: 9286829 - DNA, 22 bp, Homo sapiens
atgtagagtagaatagtacaac

SEQ ID NO: 9286830 - DNA, 22 bp, Homo sapiens
atgtagaatggtgattggcagg

SEQ ID NO: 9286831 - DNA, 22 bp, Homo sapiens
atgtctctcaggtttaacttta

SEQ ID NO: 9286832 - DNA, 22 bp, Homo sapiens
gagggcagagacagtgattcac

SEQ ID NO: 9286833 - DNA, 19 bp, Homo sapiens
atgtctctgtagcacatac

SEQ ID NO: 9286834 - DNA, 22 bp, Homo sapiens
atgtctctttactcttagaacc

SEQ ID NO: 9286835 - DNA, 22 bp, Homo sapiens
gataatgtggatttattgtgat

SEQ ID NO: 9286836 - DNA, 22 bp, Homo sapiens
gataatgttaagtcataggcta

SEQ ID NO: 9286837 - DNA, 22 bp, Homo sapiens
gataatggggaatgataagtca

SEQ ID NO: 9286838 - DNA, 22 bp, Homo sapiens
gataatgtgccgataatttcta

SEQ ID NO: 9286839 - DNA, 22 bp, Homo sapiens
gataatgtaattttatgttcac

SEQ ID NO: 9286840 - DNA, 22 bp, Homo sapiens
atgtttaaagggttgagaaata

SEQ ID NO: 9286841 - DNA, 22 bp, Homo sapiens
atgtttaaagggttgagaaata

SEQ ID NO: 9286842 - DNA, 22 bp, Homo sapiens
atgttggagtcgtaaggcatgg

SEQ ID NO: 9286843 - DNA, 22 bp, Homo sapiens
atgtgtccttataagaagaaga

SEQ ID NO: 9286844 - DNA, 22 bp, Homo sapiens
atgtgtccttgttcccattcca

SEQ ID NO: 9286845 - DNA, 22 bp, Homo sapiens
atggtgctcctgcaggaagcag

SEQ ID NO: 9286846 - DNA, 18 bp, Homo sapiens
atggtctcatactgggag

SEQ ID NO: 9286847 - DNA, 22 bp, Homo sapiens
gaggagaagggcacggagaaaa

SEQ ID NO: 9286848 - DNA, 22 bp, Homo sapiens
gaggagaaattatccttggtgt

SEQ ID NO: 9286849 - DNA, 22 bp, Homo sapiens
gaggagaagctaagaaacacag

SEQ ID NO: 9286850 - DNA, 22 bp, Homo sapiens
gaggagaagctaagaaacacag

SEQ ID NO: 9286851 - DNA, 22 bp, Homo sapiens
gaggagaagctattggaaggac

SEQ ID NO: 9286852 - DNA, 22 bp, Homo sapiens
gaggcacatatatacagagccc

SEQ ID NO: 9286853 - DNA, 22 bp, Homo sapiens
gaggcagcatctatggtgggaa

SEQ ID NO: 9286854 - DNA, 22 bp, Homo sapiens
gaggcagcattcgcatagacag

SEQ ID NO: 9286855 - DNA, 22 bp, Homo sapiens
atgggctgggatctgagtgtca

SEQ ID NO: 9286856 - DNA, 22 bp, Homo sapiens
atgggctgacccagtcgtggca

SEQ ID NO: 9286857 - DNA, 22 bp, Homo sapiens
atgggagaaacatcatgaggca

SEQ ID NO: 9286858 - DNA, 22 bp, Homo sapiens
atgggcagggcagtgtataaga

SEQ ID NO: 9286859 - DNA, 22 bp, Homo sapiens
gagatggggtcagctgggacat

SEQ ID NO: 9286860 - DNA, 17 bp, Homo sapiens
gagatgggtggatcacc

SEQ ID NO: 9286861 - DNA, 21 bp, Homo sapiens
atggccactatggtgcagcag

SEQ ID NO: 9286862 - DNA, 22 bp, Homo sapiens
atggccagagaaggcagggtca

SEQ ID NO: 9286863 - DNA, 22 bp, Homo sapiens
atggctggcactggcctgggtt

SEQ ID NO: 9286864 - DNA, 22 bp, Homo sapiens
atggccagagaggccagcctgg

SEQ ID NO: 9286865 - DNA, 22 bp, Homo sapiens
atggccagagagagcacacctg

SEQ ID NO: 9286866 - DNA, 22 bp, Homo sapiens
atggcttggcaccatctccttg

SEQ ID NO: 9286867 - DNA, 22 bp, Homo sapiens
gagacatcataatgaagtttcc

SEQ ID NO: 9286868 - DNA, 22 bp, Homo sapiens
gactggggctctagccaggcct

SEQ ID NO: 9286869 - DNA, 22 bp, Homo sapiens
gactgggctccaagagggagag

SEQ ID NO: 9286870 - DNA, 22 bp, Homo sapiens
gagagagctctgtgcctgggat

SEQ ID NO: 9286871 - DNA, 18 bp, Homo sapiens
atggaggcagagagctga

SEQ ID NO: 9286872 - DNA, 22 bp, Homo sapiens
gagatgggcgagaaggtggact

SEQ ID NO: 9286873 - DNA, 22 bp, Homo sapiens
gagatggccctggcatgtagct

SEQ ID NO: 9286874 - DNA, 21 bp, Homo sapiens
gagatggcccagtagcgggcc

SEQ ID NO: 9286875 - DNA, 22 bp, Homo sapiens
gagatggccagtgccaggacaa

SEQ ID NO: 9286876 - DNA, 22 bp, Homo sapiens
gagatggccagtgccaggacaa

SEQ ID NO: 9286877 - DNA, 22 bp, Homo sapiens
attgtgaggcagggaaaggtgg

SEQ ID NO: 9286878 - DNA, 22 bp, Homo sapiens
gccaaagcagtcttgcctctgc

SEQ ID NO: 9286879 - DNA, 22 bp, Homo sapiens
gccaaaactcccatattttaat

SEQ ID NO: 9286880 - DNA, 22 bp, Homo sapiens
attgtctttggtgcttccagga

SEQ ID NO: 9286881 - DNA, 22 bp, Homo sapiens
attgtctttccactgagaagtt

SEQ ID NO: 9286882 - DNA, 22 bp, Homo sapiens
attgtcttctggtcttatcttt

SEQ ID NO: 9286883 - DNA, 23 bp, Homo sapiens
gccaaaggtctgttcagtggtga

SEQ ID NO: 9286884 - DNA, 22 bp, Homo sapiens
gccaaaggacctgtgggtgaca

SEQ ID NO: 9286885 - DNA, 22 bp, Homo sapiens
gcatacaaaggtttacaactga

SEQ ID NO: 9286886 - DNA, 17 bp, Homo sapiens
gcatcacagataacacg

SEQ ID NO: 9286887 - DNA, 22 bp, Homo sapiens
attgtcattccagtcattgtta

SEQ ID NO: 9286888 - DNA, 22 bp, Homo sapiens
attgtatttgtacaagacatgt

SEQ ID NO: 9286889 - DNA, 22 bp, Homo sapiens
attgtatttgtacaagacatgt

SEQ ID NO: 9286890 - DNA, 22 bp, Homo sapiens
attgtatttgtacaagacatgt

SEQ ID NO: 9286891 - DNA, 22 bp, Homo sapiens
attgtcatcgatgttagccagt

SEQ ID NO: 9286892 - DNA, 23 bp, Homo sapiens
attgacctgtttagtctctccct

SEQ ID NO: 9286893 - DNA, 22 bp, Homo sapiens
attgacctggcagactggactg

SEQ ID NO: 9286894 - DNA, 22 bp, Homo sapiens
attgacctattggacatgaaac

SEQ ID NO: 9286895 - DNA, 22 bp, Homo sapiens
attgacctgattgttcctggaa

SEQ ID NO: 9286896 - DNA, 18 bp, Homo sapiens
attgattgggagaggatt

SEQ ID NO: 9286897 - DNA, 22 bp, Homo sapiens
gcagctggacccacacggctta

SEQ ID NO: 9286898 - DNA, 22 bp, Homo sapiens
gcagctggaagtgacactctgt

SEQ ID NO: 9286899 - DNA, 22 bp, Homo sapiens
gcagcgagtgcggctgccacag

SEQ ID NO: 9286900 - DNA, 19 bp, Homo sapiens
attcttgttaagtgtcatc

SEQ ID NO: 9286901 - DNA, 22 bp, Homo sapiens
attcttgtttaatttgcatccc

SEQ ID NO: 9286902 - DNA, 22 bp, Homo sapiens
attagttggggtggagaaggat

SEQ ID NO: 9286903 - DNA, 22 bp, Homo sapiens
attagttgatctatatccaaag

SEQ ID NO: 9286904 - DNA, 22 bp, Homo sapiens
attagttgaacaagttaagtaa

SEQ ID NO: 9286905 - DNA, 22 bp, Homo sapiens
attaggcattatggggataagg

SEQ ID NO: 9286906 - DNA, 22 bp, Homo sapiens
attaggcagggcatggtggctc

SEQ ID NO: 9286907 - DNA, 22 bp, Homo sapiens
attaggaagaggatgtcagcat

SEQ ID NO: 9286908 - DNA, 22 bp, Homo sapiens
attacatgagagaatgtaaata

SEQ ID NO: 9286909 - DNA, 22 bp, Homo sapiens
gatttcaggctatctatgcaga

SEQ ID NO: 9286910 - DNA, 21 bp, Homo sapiens
attcagaaagggaataaactc

SEQ ID NO: 9286911 - DNA, 22 bp, Homo sapiens
attcacagtttcctcatattct

SEQ ID NO: 9286912 - DNA, 22 bp, Homo sapiens
atttctgtgcagtaaatggtga

SEQ ID NO: 9286913 - DNA, 22 bp, Homo sapiens
atttctgttgcttataaattac

SEQ ID NO: 9286914 - DNA, 22 bp, Homo sapiens
atttctgttgcttataaattac

SEQ ID NO: 9286915 - DNA, 22 bp, Homo sapiens
gccccaggttgcctgtcccagg

SEQ ID NO: 9286916 - DNA, 17 bp, Homo sapiens
gcccacccttaggagct

SEQ ID NO: 9286917 - DNA, 22 bp, Homo sapiens
atttctgtagtccacattcttt

SEQ ID NO: 9286918 - DNA, 23 bp, Homo sapiens
gcccaccctcagcgtcctcacgg

SEQ ID NO: 9286919 - DNA, 22 bp, Homo sapiens
gccaggctggtcttgaactcct

SEQ ID NO: 9286920 - DNA, 22 bp, Homo sapiens
gccaggctggtgcaaggatatt

SEQ ID NO: 9286921 - DNA, 22 bp, Homo sapiens
gccaggctggccagcaccttct

SEQ ID NO: 9286922 - DNA, 22 bp, Homo sapiens
gccaggctggcaaaaggaaacc

SEQ ID NO: 9286923 - DNA, 22 bp, Homo sapiens
gccaggctggaaagaacagaca

SEQ ID NO: 9286924 - DNA, 22 bp, Homo sapiens
gccacaggtactatgggagaga

SEQ ID NO: 9286925 - DNA, 22 bp, Homo sapiens
gccaggtgagaggactgaggct

SEQ ID NO: 9286926 - DNA, 22 bp, Homo sapiens
gccaggtgcatattagaagcat

SEQ ID NO: 9286927 - DNA, 22 bp, Homo sapiens
gcctgaagaacagctgtgagga

SEQ ID NO: 9286928 - DNA, 19 bp, Homo sapiens
gcctctgagggcaggacac

SEQ ID NO: 9286929 - DNA, 22 bp, Homo sapiens
gcctcaagacatttttaattgc

SEQ ID NO: 9286930 - DNA, 22 bp, Homo sapiens
gcctagtggtgggtatgcagag

SEQ ID NO: 9286931 - DNA, 19 bp, Homo sapiens
gcctatgtcttcaaatcat

SEQ ID NO: 9286932 - DNA, 22 bp, Homo sapiens
gcctagtgcactggcagggctc

SEQ ID NO: 9286933 - DNA, 22 bp, Homo sapiens
gcctaggagtggggatggcggt

SEQ ID NO: 9286934 - DNA, 22 bp, Homo sapiens
gcctaggagtacagaatggttt

SEQ ID NO: 9286935 - DNA, 22 bp, Homo sapiens
gcctaggagacaagcgtgaaag

SEQ ID NO: 9286936 - DNA, 22 bp, Homo sapiens
gcccccgtagtagatgaggcgc

SEQ ID NO: 9286937 - DNA, 22 bp, Homo sapiens
gcctgaagtttcatgcctctat

SEQ ID NO: 9286938 - DNA, 22 bp, Homo sapiens
gcctggcaaggccctgttgact

SEQ ID NO: 9286939 - DNA, 22 bp, Homo sapiens
gcctggcaatggcctcaggaag

SEQ ID NO: 9286940 - DNA, 22 bp, Homo sapiens
gcctggcacaggaattaggagg

SEQ ID NO: 9286941 - DNA, 22 bp, Homo sapiens
gcctggcacagtagggacccaa

SEQ ID NO: 9286942 - DNA, 22 bp, Homo sapiens
gcctggagttgaaactattatt

SEQ ID NO: 9286943 - DNA, 22 bp, Homo sapiens
gcctggagttgtggtgaagcca

SEQ ID NO: 9286944 - DNA, 22 bp, Homo sapiens
gcctggattccttgtttctcag

SEQ ID NO: 9286945 - DNA, 22 bp, Homo sapiens
caaagtgctggaattacaggtg

SEQ ID NO: 9286946 - DNA, 22 bp, Homo sapiens
caaaggaggtgataggccctct

SEQ ID NO: 9286947 - DNA, 22 bp, Homo sapiens
caaagctggaaaaggaggctgg

SEQ ID NO: 9286948 - DNA, 18 bp, Homo sapiens
caaagctcacgttccatc

SEQ ID NO: 9286949 - DNA, 22 bp, Homo sapiens
caaagcctctgatttcacttgt

SEQ ID NO: 9286950 - DNA, 22 bp, Homo sapiens
caaagctcatgctcttagccat

SEQ ID NO: 9286951 - DNA, 22 bp, Homo sapiens
caaatactacgattcttgcagt

SEQ ID NO: 9286952 - DNA, 22 bp, Homo sapiens
gctgaaatgaaaacacaggtcg

SEQ ID NO: 9286953 - DNA, 22 bp, Homo sapiens
gctgaaatcccagcattcccca

SEQ ID NO: 9286954 - DNA, 19 bp, Homo sapiens
gctgaaatcaaatttggaa

SEQ ID NO: 9286955 - DNA, 18 bp, Homo sapiens
gctctttctgtctccagc

SEQ ID NO: 9286956 - DNA, 22 bp, Homo sapiens
gctctttactgtgagggtggtc

SEQ ID NO: 9286957 - DNA, 22 bp, Homo sapiens
gctctttactgtgagggtggtc

SEQ ID NO: 9286958 - DNA, 22 bp, Homo sapiens
gctctttaattcattcatggat

SEQ ID NO: 9286959 - DNA, 22 bp, Homo sapiens
gctctttagttgatggcctgcc

SEQ ID NO: 9286960 - DNA, 22 bp, Homo sapiens
gctctttagtccaagccatgtc

SEQ ID NO: 9286961 - DNA, 22 bp, Homo sapiens
gctctttagtccaagccatgtc

SEQ ID NO: 9286962 - DNA, 22 bp, Homo sapiens
gctctttagcgggggccaggcc

SEQ ID NO: 9286963 - DNA, 16 bp, Homo sapiens
gctctttagagggagg

SEQ ID NO: 9286964 - DNA, 22 bp, Homo sapiens
gctctttagcgggggccaggcc

SEQ ID NO: 9286965 - DNA, 22 bp, Homo sapiens
gctcttgtcaaaaattagttga

SEQ ID NO: 9286966 - DNA, 22 bp, Homo sapiens
caaatgctaacttctttccaaa

SEQ ID NO: 9286967 - DNA, 22 bp, Homo sapiens
caaatggctggcatccttctac

SEQ ID NO: 9286968 - DNA, 22 bp, Homo sapiens
caaacattcaagtacaagtctt

SEQ ID NO: 9286969 - DNA, 22 bp, Homo sapiens
caaagcagacgcagtaagggta

SEQ ID NO: 9286970 - DNA, 22 bp, Homo sapiens
caaagcagcggattgggatagt

SEQ ID NO: 9286971 - DNA, 22 bp, Homo sapiens
caaaatgtgagtcccacctcaa

SEQ ID NO: 9286972 - DNA, 22 bp, Homo sapiens
caaaatgttctggcacctttaa

SEQ ID NO: 9286973 - DNA, 22 bp, Homo sapiens
caaaattctgcatttctaataa

SEQ ID NO: 9286974 - DNA, 22 bp, Homo sapiens
caaaattctgcatttctaataa

SEQ ID NO: 9286975 - DNA, 22 bp, Homo sapiens
attttgctgtggtacattagga

SEQ ID NO: 9286976 - DNA, 22 bp, Homo sapiens
atttttccaattaggataaaga

SEQ ID NO: 9286977 - DNA, 22 bp, Homo sapiens
atttttccaattaggataaaga

SEQ ID NO: 9286978 - DNA, 22 bp, Homo sapiens
atttttccatgatacttatctg

SEQ ID NO: 9286979 - DNA, 22 bp, Homo sapiens
atttttccatgatacttatctg

SEQ ID NO: 9286980 - DNA, 22 bp, Homo sapiens
atttttctctcacacttaccag

SEQ ID NO: 9286981 - DNA, 22 bp, Homo sapiens
atttttctctccactccattaa

SEQ ID NO: 9286982 - DNA, 22 bp, Homo sapiens
atttttctctccactccattaa

SEQ ID NO: 9286983 - DNA, 22 bp, Homo sapiens
atttttctctttccactgagat

SEQ ID NO: 9286984 - DNA, 22 bp, Homo sapiens
cagctagggagtggcagagctt

SEQ ID NO: 9286985 - DNA, 22 bp, Homo sapiens
cagctaggaaaccagagggcag

SEQ ID NO: 9286986 - DNA, 22 bp, Homo sapiens
cagcctgtagaatacagtaaat

SEQ ID NO: 9286987 - DNA, 22 bp, Homo sapiens
cagcctggacagcgaccagagt

SEQ ID NO: 9286988 - DNA, 22 bp, Homo sapiens
cagcctggattgcagaatgcta

SEQ ID NO: 9286989 - DNA, 22 bp, Homo sapiens
gtgccctccgtgttcatagagc

SEQ ID NO: 9286990 - DNA, 22 bp, Homo sapiens
gtgctgagtagaatgaatgcct

SEQ ID NO: 9286991 - DNA, 22 bp, Homo sapiens
gtgctgagtcatctttatctgt

SEQ ID NO: 9286992 - DNA, 22 bp, Homo sapiens
cagcagctggtgagacacagcc

SEQ ID NO: 9286993 - DNA, 22 bp, Homo sapiens
cagcagcttctgttgatcagaa

SEQ ID NO: 9286994 - DNA, 22 bp, Homo sapiens
gtcagcattagcaatgactggt

SEQ ID NO: 9286995 - DNA, 22 bp, Homo sapiens
cagcagctgggaaggaggctga

SEQ ID NO: 9286996 - DNA, 22 bp, Homo sapiens
cagcagctgatggggaagtgat

SEQ ID NO: 9286997 - DNA, 22 bp, Homo sapiens
cagcagctgcctcagctgggga

SEQ ID NO: 9286998 - DNA, 22 bp, Homo sapiens
gtcatggtgctagcgggaatgt

SEQ ID NO: 9286999 - DNA, 22 bp, Homo sapiens
gtcatcttcgcagagtgatttt

SEQ ID NO: 9287000 - DNA, 22 bp, Homo sapiens
cagcccaggccgacagttcctc

SEQ ID NO: 9287001 - DNA, 22 bp, Homo sapiens
gtctggaaggaggagatggagc

SEQ ID NO: 9287002 - DNA, 22 bp, Homo sapiens
gtctggagccactgctgctgct

SEQ ID NO: 9287003 - DNA, 22 bp, Homo sapiens
gtctgctttctgggaactcttt

SEQ ID NO: 9287004 - DNA, 22 bp, Homo sapiens
gtctcttctttgccggtcctgc

SEQ ID NO: 9287005 - DNA, 22 bp, Homo sapiens
gtctgcttttctgaattgcctg

SEQ ID NO: 9287006 - DNA, 22 bp, Homo sapiens
gggctgagtcatctggggcctc

SEQ ID NO: 9287007 - DNA, 22 bp, Homo sapiens
cagagcctgccacctttctccc

SEQ ID NO: 9287008 - DNA, 22 bp, Homo sapiens
gggctgacaaccatctgacaag

SEQ ID NO: 9287009 - DNA, 22 bp, Homo sapiens
gggccagcctactgctagaccc

SEQ ID NO: 9287010 - DNA, 20 bp, Homo sapiens
gggctctgcttggcagaagt

SEQ ID NO: 9287011 - DNA, 22 bp, Homo sapiens
cagacagggtcctgtccgtcac

SEQ ID NO: 9287012 - DNA, 22 bp, Homo sapiens
cagactgggctggtggaaagct

SEQ ID NO: 9287013 - DNA, 22 bp, Homo sapiens
cagactgggagtcaggaagaag

SEQ ID NO: 9287014 - DNA, 22 bp, Homo sapiens
cagagacagcctgggagggaca

SEQ ID NO: 9287015 - DNA, 22 bp, Homo sapiens
gggcagtgggaccaggcaccag

SEQ ID NO: 9287016 - DNA, 20 bp, Homo sapiens
gggcagtggcgctatctcag

SEQ ID NO: 9287017 - DNA, 22 bp, Homo sapiens
cagagacagggcagggagtgtg

SEQ ID NO: 9287018 - DNA, 22 bp, Homo sapiens
gggcaggtatttatcttctatt

SEQ ID NO: 9287019 - DNA, 22 bp, Homo sapiens
ggtcatctgtaattctgttcct

SEQ ID NO: 9287020 - DNA, 22 bp, Homo sapiens
cagagggttgatgtgaggctta

SEQ ID NO: 9287021 - DNA, 22 bp, Homo sapiens
ggtcagtgtttcatctgtgaaa

SEQ ID NO: 9287022 - DNA, 22 bp, Homo sapiens
ggtcagtgtacacatgtgcagg

SEQ ID NO: 9287023 - DNA, 22 bp, Homo sapiens
ggtcagtgtatgtattgataag

SEQ ID NO: 9287024 - DNA, 22 bp, Homo sapiens
ggtcagtggagccggaaagacc

SEQ ID NO: 9287025 - DNA, 22 bp, Homo sapiens
ggtcagtggcagggggtacttc

SEQ ID NO: 9287026 - DNA, 21 bp, Homo sapiens
ggtcagtggctttcttgcacc

SEQ ID NO: 9287027 - DNA, 22 bp, Homo sapiens
ggtcagtggccaggaagcagtc

SEQ ID NO: 9287028 - DNA, 22 bp, Homo sapiens
ggtcagtgctgccagagtgacc

SEQ ID NO: 9287029 - DNA, 22 bp, Homo sapiens
ggtcagtggacaaaggagtttc

SEQ ID NO: 9287030 - DNA, 22 bp, Homo sapiens
ggtcagtgctgccagagtgacc

SEQ ID NO: 9287031 - DNA, 22 bp, Homo sapiens
ggtcagtggcagggggtacttc

SEQ ID NO: 9287032 - DNA, 22 bp, Homo sapiens
ggtcagtggacaaaggagtttc

SEQ ID NO: 9287033 - DNA, 22 bp, Homo sapiens
ggtcagtgcgatttcccactcc

SEQ ID NO: 9287034 - DNA, 22 bp, Homo sapiens
ggtcagtgcgtgcccgcgcgtg

SEQ ID NO: 9287035 - DNA, 22 bp, Homo sapiens
ggtcagtgagcaaacaaccacg

SEQ ID NO: 9287036 - DNA, 23 bp, Homo sapiens
ggtcagtgagttcgtttctctgg

SEQ ID NO: 9287037 - DNA, 22 bp, Homo sapiens
ggtcagtgcctatcatgtgggc

SEQ ID NO: 9287038 - DNA, 22 bp, Homo sapiens
ggtcagtgaatgtttgagcaga

SEQ ID NO: 9287039 - DNA, 22 bp, Homo sapiens
ggtcagtgacttttttctgtgg

SEQ ID NO: 9287040 - DNA, 22 bp, Homo sapiens
ggtcagtgagacaatttaagcc

SEQ ID NO: 9287041 - DNA, 22 bp, Homo sapiens
cagagggtggaggccaggctct

SEQ ID NO: 9287042 - DNA, 22 bp, Homo sapiens
ggggagctcatgatgtctttgt

SEQ ID NO: 9287043 - DNA, 22 bp, Homo sapiens
ggggagctgccacagttctctg

SEQ ID NO: 9287044 - DNA, 22 bp, Homo sapiens
ggggagctgagacactgccctc

SEQ ID NO: 9287045 - DNA, 22 bp, Homo sapiens
ggggagctgacaaccacatcct

SEQ ID NO: 9287046 - DNA, 22 bp, Homo sapiens
ggggagcttagggtctctgaat

SEQ ID NO: 9287047 - DNA, 22 bp, Homo sapiens
ggggagctgggaggtgagttac

SEQ ID NO: 9287048 - DNA, 22 bp, Homo sapiens
ggggagcttcaggtggcttaca

SEQ ID NO: 9287049 - DNA, 22 bp, Homo sapiens
ggggagcttggttattcatgca

SEQ ID NO: 9287050 - DNA, 22 bp, Homo sapiens
ggggagagtcctttccagttcc

SEQ ID NO: 9287051 - DNA, 22 bp, Homo sapiens
cagcacagtgaccagacccact

SEQ ID NO: 9287052 - DNA, 22 bp, Homo sapiens
ggtgctgacattcagagtctgg

SEQ ID NO: 9287053 - DNA, 19 bp, Homo sapiens
ggtgctgacatcatgcttt

SEQ ID NO: 9287054 - DNA, 22 bp, Homo sapiens
ggtgctgaattctggaggaggc

SEQ ID NO: 9287055 - DNA, 22 bp, Homo sapiens
ggtgctgaataaatactagtta

SEQ ID NO: 9287056 - DNA, 22 bp, Homo sapiens
ggtgctgaaggactataacggt

SEQ ID NO: 9287057 - DNA, 22 bp, Homo sapiens
ggtgctgaggccttggcaggga

SEQ ID NO: 9287058 - DNA, 20 bp, Homo sapiens
ggtgctgataagaaagaagt

SEQ ID NO: 9287059 - DNA, 22 bp, Homo sapiens
ggtgctgagtgagctagaggct

SEQ ID NO: 9287060 - DNA, 22 bp, Homo sapiens
ggtgctgatagtaacaataata

SEQ ID NO: 9287061 - DNA, 22 bp, Homo sapiens
ggtgctgatattgttttggtga

SEQ ID NO: 9287062 - DNA, 22 bp, Homo sapiens
ggtgctgatctaaatttaggac

SEQ ID NO: 9287063 - DNA, 22 bp, Homo sapiens
ggtgctgactgaggatggcttg

SEQ ID NO: 9287064 - DNA, 22 bp, Homo sapiens
ggtgctgactctgtcgtgagca

SEQ ID NO: 9287065 - DNA, 22 bp, Homo sapiens
ggtgctgagagcctaggagggc

SEQ ID NO: 9287066 - DNA, 22 bp, Homo sapiens
ggtgctgacttcacagtcttac

SEQ ID NO: 9287067 - DNA, 22 bp, Homo sapiens
ggtgctgatttgttgctgagat

SEQ ID NO: 9287068 - DNA, 22 bp, Homo sapiens
ggtgctgatgaagatgtagcct

SEQ ID NO: 9287069 - DNA, 22 bp, Homo sapiens
ggtgctgatgagttaggagagg

SEQ ID NO: 9287070 - DNA, 22 bp, Homo sapiens
ggtgctgattaagaactgtata

SEQ ID NO: 9287071 - DNA, 22 bp, Homo sapiens
ggtgctgatgttattgatgctg

SEQ ID NO: 9287072 - DNA, 22 bp, Homo sapiens
ggtgctgattcactgacttctg

SEQ ID NO: 9287073 - DNA, 22 bp, Homo sapiens
ggtgacggggcccaggtttcct

SEQ ID NO: 9287074 - DNA, 22 bp, Homo sapiens
ggtgacggggcccaggtttcct

SEQ ID NO: 9287075 - DNA, 22 bp, Homo sapiens
cagcaagatttttaaagcaagg

SEQ ID NO: 9287076 - DNA, 22 bp, Homo sapiens
cacagggaaccaaggctgggcc

SEQ ID NO: 9287077 - DNA, 22 bp, Homo sapiens
cacatacaagccatggggggat

SEQ ID NO: 9287078 - DNA, 22 bp, Homo sapiens
cacatacaaggcacactggagg

SEQ ID NO: 9287079 - DNA, 22 bp, Homo sapiens
cacatacaaggcacactggagg

SEQ ID NO: 9287080 - DNA, 22 bp, Homo sapiens
cacataagaaatgaatatgaga

SEQ ID NO: 9287081 - DNA, 22 bp, Homo sapiens
cacatacatacgtatgtataca

SEQ ID NO: 9287082 - DNA, 19 bp, Homo sapiens
cacatacagaaaagagtaa

SEQ ID NO: 9287083 - DNA, 22 bp, Homo sapiens
cacatacaatggtgttatttgg

SEQ ID NO: 9287084 - DNA, 22 bp, Homo sapiens
cacatactgagaatcacaccca

SEQ ID NO: 9287085 - DNA, 22 bp, Homo sapiens
cacatacattcatgttactcta

SEQ ID NO: 9287086 - DNA, 22 bp, Homo sapiens
cacatacattcatgttactcta

SEQ ID NO: 9287087 - DNA, 22 bp, Homo sapiens
cacatacatacgtatgtataca

SEQ ID NO: 9287088 - DNA, 22 bp, Homo sapiens
cacatacatgcacacctaaata

SEQ ID NO: 9287089 - DNA, 22 bp, Homo sapiens
cacatttacatataaaactttc

SEQ ID NO: 9287090 - DNA, 22 bp, Homo sapiens
cacatacttgtgtgtacatatg

SEQ ID NO: 9287091 - DNA, 22 bp, Homo sapiens
ggcaggcatcatcagttgatca

SEQ ID NO: 9287092 - DNA, 22 bp, Homo sapiens
cacctttaatgagcaccagccg

SEQ ID NO: 9287093 - DNA, 22 bp, Homo sapiens
cacctgggctttctctgggact

SEQ ID NO: 9287094 - DNA, 23 bp, Homo sapiens
ggccactgaattttctgcatctt

SEQ ID NO: 9287095 - DNA, 22 bp, Homo sapiens
ggccactgcctccgccatggct

SEQ ID NO: 9287096 - DNA, 22 bp, Homo sapiens
ggccactgctctccagcctggg

SEQ ID NO: 9287097 - DNA, 22 bp, Homo sapiens
ggccactgctgctctggtggag

SEQ ID NO: 9287098 - DNA, 22 bp, Homo sapiens
ggccctgtgatggatgtattag

SEQ ID NO: 9287099 - DNA, 22 bp, Homo sapiens
ggccccagggattaggccaacc

SEQ ID NO: 9287100 - DNA, 22 bp, Homo sapiens
ggccaaaccgcaattatttttg

SEQ ID NO: 9287101 - DNA, 22 bp, Homo sapiens
ggcatttagttttcatattctg

SEQ ID NO: 9287102 - DNA, 20 bp, Homo sapiens
ggcatttatgaaccaagcct

SEQ ID NO: 9287103 - DNA, 22 bp, Homo sapiens
ggcatttatctaatatagttta

SEQ ID NO: 9287104 - DNA, 22 bp, Homo sapiens
ggcatttatttgtctcattctt

SEQ ID NO: 9287105 - DNA, 22 bp, Homo sapiens
ggcatttaatccatctgattga

SEQ ID NO: 9287106 - DNA, 22 bp, Homo sapiens
ggcatttacataatcttattta

SEQ ID NO: 9287107 - DNA, 22 bp, Homo sapiens
ggcatttacgatactgcatagg

SEQ ID NO: 9287108 - DNA, 22 bp, Homo sapiens
ggcatttagagggcttttctga

SEQ ID NO: 9287109 - DNA, 22 bp, Homo sapiens
ggcatttactagagccacattt

SEQ ID NO: 9287110 - DNA, 22 bp, Homo sapiens
ggcatttagattgaatttctgt

SEQ ID NO: 9287111 - DNA, 22 bp, Homo sapiens
ggcatttaggcagataacagac

SEQ ID NO: 9287112 - DNA, 22 bp, Homo sapiens
ggcatttaggatctttagttga

SEQ ID NO: 9287113 - DNA, 22 bp, Homo sapiens
ggcaggtgatctagagtcaata

SEQ ID NO: 9287114 - DNA, 22 bp, Homo sapiens
ggcaggtgcacctgagccatct

SEQ ID NO: 9287115 - DNA, 22 bp, Homo sapiens
ggcaggtgccagttggcttggg

SEQ ID NO: 9287116 - DNA, 22 bp, Homo sapiens
ggcaggtgcccagagagcacga

SEQ ID NO: 9287117 - DNA, 22 bp, Homo sapiens
ggcagggcaggaaagtcaggaa

SEQ ID NO: 9287118 - DNA, 22 bp, Homo sapiens
ggcagggcaggaaagtcaggaa

SEQ ID NO: 9287119 - DNA, 22 bp, Homo sapiens
ggcagggcagcgctgattaggg

SEQ ID NO: 9287120 - DNA, 22 bp, Homo sapiens
ggcagggcagcgctgattaggg

SEQ ID NO: 9287121 - DNA, 19 bp, Homo sapiens
ggcctgtgcagagcccgtc

SEQ ID NO: 9287122 - DNA, 22 bp, Homo sapiens
ggctcaatgcaacttctgcctc

SEQ ID NO: 9287123 - DNA, 22 bp, Homo sapiens
cagaaataaacttctcacatcg

SEQ ID NO: 9287124 - DNA, 22 bp, Homo sapiens
cagaaaacctgactctagaact

SEQ ID NO: 9287125 - DNA, 22 bp, Homo sapiens
cagaaaacctgactctagaact

SEQ ID NO: 9287126 - DNA, 22 bp, Homo sapiens
cagaaaataaacatttgtggaa

SEQ ID NO: 9287127 - DNA, 22 bp, Homo sapiens
cagaaagacctgggctcaagag

SEQ ID NO: 9287128 - DNA, 22 bp, Homo sapiens
cagaaagccaactccaactgtc

SEQ ID NO: 9287129 - DNA, 22 bp, Homo sapiens
gctttctgtaggtagttactgt

SEQ ID NO: 9287130 - DNA, 18 bp, Homo sapiens
gctttctgtagaaaaggg

SEQ ID NO: 9287131 - DNA, 21 bp, Homo sapiens
gctttctgtggactctgcacc

SEQ ID NO: 9287132 - DNA, 22 bp, Homo sapiens
caagtactttgaaaagttgaat

SEQ ID NO: 9287133 - DNA, 22 bp, Homo sapiens
gctggaggaggaagtgtgaggg

SEQ ID NO: 9287134 - DNA, 22 bp, Homo sapiens
gctggaggatcacttgagccca

SEQ ID NO: 9287135 - DNA, 22 bp, Homo sapiens
gctggaggatggactggaagaa

SEQ ID NO: 9287136 - DNA, 22 bp, Homo sapiens
gctggaggatggactggaagaa

SEQ ID NO: 9287137 - DNA, 22 bp, Homo sapiens
caaatgtgacttttgggcttct

SEQ ID NO: 9287138 - DNA, 22 bp, Homo sapiens
caagcagggagcatcaagggag

SEQ ID NO: 9287139 - DNA, 22 bp, Homo sapiens
caaatgtaattgcggtttttgc

SEQ ID NO: 9287140 - DNA, 22 bp, Homo sapiens
gctggaggcagttcagacacca

SEQ ID NO: 9287141 - DNA, 22 bp, Homo sapiens
gctggaggctggagtgcagtgg

SEQ ID NO: 9287142 - DNA, 22 bp, Homo sapiens
cacaggcttgtcagcatgaggc

SEQ ID NO: 9287143 - DNA, 22 bp, Homo sapiens
cacaggcttccagtccccagct

SEQ ID NO: 9287144 - DNA, 22 bp, Homo sapiens
ggaggccaaagtgtgggcggct

SEQ ID NO: 9287145 - DNA, 22 bp, Homo sapiens
ggaggccaaggcaggtggatca

SEQ ID NO: 9287146 - DNA, 22 bp, Homo sapiens
ggaggccaaggaggagcttgcc

SEQ ID NO: 9287147 - DNA, 22 bp, Homo sapiens
ggaggccaaggaggagcttgcc

SEQ ID NO: 9287148 - DNA, 23 bp, Homo sapiens
ggagctgctgttgggggagctgc

SEQ ID NO: 9287149 - DNA, 22 bp, Homo sapiens
ggagcctgaaaagtctgcattt

SEQ ID NO: 9287150 - DNA, 22 bp, Homo sapiens
ggagctggaatatattgaaacc

SEQ ID NO: 9287151 - DNA, 22 bp, Homo sapiens
ggagctggagagtacagagttt

SEQ ID NO: 9287152 - DNA, 22 bp, Homo sapiens
ggagctggagagctagcctagg

SEQ ID NO: 9287153 - DNA, 23 bp, Homo sapiens
ggagctggacccttacacctttc

SEQ ID NO: 9287154 - DNA, 20 bp, Homo sapiens
ggagctggcatccagcctct

SEQ ID NO: 9287155 - DNA, 22 bp, Homo sapiens
ggagctggcagcgcaacccaga

SEQ ID NO: 9287156 - DNA, 21 bp, Homo sapiens
cacagaatatacattttagtt

SEQ ID NO: 9287157 - DNA, 22 bp, Homo sapiens
cacagaatcatattgtcagttt

SEQ ID NO: 9287158 - DNA, 22 bp, Homo sapiens
ggaaggggagctggaaagggta

SEQ ID NO: 9287159 - DNA, 22 bp, Homo sapiens
cacaattttaatacacagtcaa

SEQ ID NO: 9287160 - DNA, 22 bp, Homo sapiens
cacacagatggtaagggaggga

SEQ ID NO: 9287161 - DNA, 15 bp, Homo sapiens
cacacagacagcttg

SEQ ID NO: 9287162 - DNA, 22 bp, Homo sapiens
cacacagacagctctctgaaga

SEQ ID NO: 9287163 - DNA, 22 bp, Homo sapiens
ggactgggagaatggaggcaag

SEQ ID NO: 9287164 - DNA, 22 bp, Homo sapiens
cacagagaaaatgttggtgctt

SEQ ID NO: 9287165 - DNA, 22 bp, Homo sapiens
cacagacagtgtccctttgttg

SEQ ID NO: 9287166 - DNA, 22 bp, Homo sapiens
cacagaattttctctttacaat

SEQ ID NO: 9287167 - DNA, 22 bp, Homo sapiens
cacagaatggaccagttttaga

SEQ ID NO: 9287168 - DNA, 17 bp, Homo sapiens
ggactgggcggggcagg

SEQ ID NO: 9287169 - DNA, 22 bp, Homo sapiens
ggactgggccaggggttggact

SEQ ID NO: 9287170 - DNA, 22 bp, Homo sapiens
cacagagaccccttctggggcc

SEQ ID NO: 9287171 - DNA, 22 bp, Homo sapiens
cacagagagctacgtgcagcgt

SEQ ID NO: 9287172 - DNA, 22 bp, Homo sapiens
agaaatgttgaatacacaaaat

SEQ ID NO: 9287173 - DNA, 22 bp, Homo sapiens
agaaatgtcaggaaagaagtcc

SEQ ID NO: 9287174 - DNA, 22 bp, Homo sapiens
agaagcagttattttttgcaca

SEQ ID NO: 9287175 - DNA, 22 bp, Homo sapiens
agaaatgttgaatacatcagga

SEQ ID NO: 9287176 - DNA, 22 bp, Homo sapiens
atctgcttttgagaatttactt

SEQ ID NO: 9287177 - DNA, 20 bp, Homo sapiens
atctgcttgcctgtcctcgg

SEQ ID NO: 9287178 - DNA, 22 bp, Homo sapiens
agaagccattctcagttcctga

SEQ ID NO: 9287179 - DNA, 22 bp, Homo sapiens
agaagccattgaagcagacctc

SEQ ID NO: 9287180 - DNA, 22 bp, Homo sapiens
agaagccattccctgtaggctc

SEQ ID NO: 9287181 - DNA, 22 bp, Homo sapiens
atcctggcccaggtgtggaggg

SEQ ID NO: 9287182 - DNA, 22 bp, Homo sapiens
atatagtgagagattacagaag

SEQ ID NO: 9287183 - DNA, 22 bp, Homo sapiens
agaaagaacgcacttgtgctgc

SEQ ID NO: 9287184 - DNA, 19 bp, Homo sapiens
atatagcattattcaattt

SEQ ID NO: 9287185 - DNA, 22 bp, Homo sapiens
atatagtaagcagtctgtaaat

SEQ ID NO: 9287186 - DNA, 22 bp, Homo sapiens
atatagaaggtgctatttacat

SEQ ID NO: 9287187 - DNA, 22 bp, Homo sapiens
atatagaaggtgctatttacat

SEQ ID NO: 9287188 - DNA, 22 bp, Homo sapiens
atattaatgagcaagtaagtga

SEQ ID NO: 9287189 - DNA, 22 bp, Homo sapiens
agaaagacaaaatgcagtggct

SEQ ID NO: 9287190 - DNA, 21 bp, Homo sapiens
atcaatgacctggcatgaggg

SEQ ID NO: 9287191 - DNA, 22 bp, Homo sapiens
atcaatgttgggccaaagcaaa

SEQ ID NO: 9287192 - DNA, 22 bp, Homo sapiens
atattaattatttacacatgag

SEQ ID NO: 9287193 - DNA, 19 bp, Homo sapiens
agaaatagccttccttgtc

SEQ ID NO: 9287194 - DNA, 22 bp, Homo sapiens
agaaatatgctgattagatgaa

SEQ ID NO: 9287195 - DNA, 22 bp, Homo sapiens
ataaggtatgaaaagtaaatgg

SEQ ID NO: 9287196 - DNA, 22 bp, Homo sapiens
ataaggtaagggtattgtcaga

SEQ ID NO: 9287197 - DNA, 22 bp, Homo sapiens
atacactactaagcacagattg

SEQ ID NO: 9287198 - DNA, 22 bp, Homo sapiens
atacacactgctatcctttttt

SEQ ID NO: 9287199 - DNA, 22 bp, Homo sapiens
ataggagactgttcttggcttc

SEQ ID NO: 9287200 - DNA, 22 bp, Homo sapiens
atagctttacagaagagtttag

SEQ ID NO: 9287201 - DNA, 22 bp, Homo sapiens
atagctttttgtcatagagtct

SEQ ID NO: 9287202 - DNA, 22 bp, Homo sapiens
atagctttcttaaatatataaa

SEQ ID NO: 9287203 - DNA, 23 bp, Homo sapiens
agaaaagcttggacacatggcct

SEQ ID NO: 9287204 - DNA, 22 bp, Homo sapiens
agaaaaggattgatggatcaga

SEQ ID NO: 9287205 - DNA, 17 bp, Homo sapiens
agaaaagagaccagcag

SEQ ID NO: 9287206 - DNA, 22 bp, Homo sapiens
agaaaacttgtcacagctctca

SEQ ID NO: 9287207 - DNA, 22 bp, Homo sapiens
atacacttccaaatattgatta

SEQ ID NO: 9287208 - DNA, 22 bp, Homo sapiens
atactgtttctcttctacatga

SEQ ID NO: 9287209 - DNA, 22 bp, Homo sapiens
atagaagtatcaagatcttgaa

SEQ ID NO: 9287210 - DNA, 23 bp, Homo sapiens
atagaagattattgcaacagtcc

SEQ ID NO: 9287211 - DNA, 22 bp, Homo sapiens
atagcatttacttttcagaaat

SEQ ID NO: 9287212 - DNA, 22 bp, Homo sapiens
atagatgtctgacacagagaaa

SEQ ID NO: 9287213 - DNA, 22 bp, Homo sapiens
actttagagaaatgtagaagta

SEQ ID NO: 9287214 - DNA, 22 bp, Homo sapiens
actttactcaacaaatatttat

SEQ ID NO: 9287215 - DNA, 22 bp, Homo sapiens
actttacaggcacttcaagtat

SEQ ID NO: 9287216 - DNA, 22 bp, Homo sapiens
agtaacatatagcacttttgga

SEQ ID NO: 9287217 - DNA, 22 bp, Homo sapiens
agtaacatctttgacatttgtt

SEQ ID NO: 9287218 - DNA, 22 bp, Homo sapiens
agtcaggtactccgagggcatg

SEQ ID NO: 9287219 - DNA, 22 bp, Homo sapiens
agtcagtggatttaccatgcgt

SEQ ID NO: 9287220 - DNA, 22 bp, Homo sapiens
agtcagtggctccgagcctggt

SEQ ID NO: 9287221 - DNA, 22 bp, Homo sapiens
aggtggggaggagtgtctcttt

SEQ ID NO: 9287222 - DNA, 22 bp, Homo sapiens
aggtgggtatcatgagagatta

SEQ ID NO: 9287223 - DNA, 21 bp, Homo sapiens
aggtggtctgcagcagctgaa

SEQ ID NO: 9287224 - DNA, 19 bp, Homo sapiens
aggtggtctaggctggaga

SEQ ID NO: 9287225 - DNA, 22 bp, Homo sapiens
aggtggtcttaaactgctctgg

SEQ ID NO: 9287226 - DNA, 23 bp, Homo sapiens
aggtggtcttgtggatgctgcaa

SEQ ID NO: 9287227 - DNA, 22 bp, Homo sapiens
aggtggagaagagatgggcagt

SEQ ID NO: 9287228 - DNA, 20 bp, Homo sapiens
aggtgtcctgtagcttgagt

SEQ ID NO: 9287229 - DNA, 22 bp, Homo sapiens
aggtgtccaggaagatgctggc

SEQ ID NO: 9287230 - DNA, 22 bp, Homo sapiens
aggtgtccaatcctggttggat

SEQ ID NO: 9287231 - DNA, 22 bp, Homo sapiens
agggtgcaggggaagctgccct

SEQ ID NO: 9287232 - DNA, 18 bp, Homo sapiens
agggtcagtgtcactggc

SEQ ID NO: 9287233 - DNA, 19 bp, Homo sapiens
agggtccagggagcggctc

SEQ ID NO: 9287234 - DNA, 22 bp, Homo sapiens
agggtccatcaaggactgcaca

SEQ ID NO: 9287235 - DNA, 22 bp, Homo sapiens
agggtcccgtccctctgcaccc

SEQ ID NO: 9287236 - DNA, 19 bp, Homo sapiens
aggtgcaggtcacagggga

SEQ ID NO: 9287237 - DNA, 22 bp, Homo sapiens
agggtgcatgtttgcaagagtg

SEQ ID NO: 9287238 - DNA, 20 bp, Homo sapiens
agtgtggttttcaggaatat

SEQ ID NO: 9287239 - DNA, 22 bp, Homo sapiens
agtggggccggtgaggccgagg

SEQ ID NO: 9287240 - DNA, 22 bp, Homo sapiens
agtggggcggacaggaccagga

SEQ ID NO: 9287241 - DNA, 22 bp, Homo sapiens
agtggggtcctcagtatggttc

SEQ ID NO: 9287242 - DNA, 22 bp, Homo sapiens
agtggggtctcctccagccccc

SEQ ID NO: 9287243 - DNA, 22 bp, Homo sapiens
actggggcaggaaagtatgctg

SEQ ID NO: 9287244 - DNA, 22 bp, Homo sapiens
actggggtgaaattggagtgtc

SEQ ID NO: 9287245 - DNA, 22 bp, Homo sapiens
actggggtttaggcctgggcaa

SEQ ID NO: 9287246 - DNA, 22 bp, Homo sapiens
agtgagagtattaatgtgaact

SEQ ID NO: 9287247 - DNA, 22 bp, Homo sapiens
agtgctgaagactggctaggga

SEQ ID NO: 9287248 - DNA, 22 bp, Homo sapiens
agtgggaggcggctgacgggcg

SEQ ID NO: 9287249 - DNA, 22 bp, Homo sapiens
agtgggagccagcagcttgggg

SEQ ID NO: 9287250 - DNA, 20 bp, Homo sapiens
agtgggagagggcagactgc

SEQ ID NO: 9287251 - DNA, 22 bp, Homo sapiens
agtgctttatgttgttgtgcaa

SEQ ID NO: 9287252 - DNA, 22 bp, Homo sapiens
agtgctttagaccttttggggt

SEQ ID NO: 9287253 - DNA, 22 bp, Homo sapiens
agtggcagagcaggtgctggaa

SEQ ID NO: 9287254 - DNA, 22 bp, Homo sapiens
acaggacaactcagcagccagc

SEQ ID NO: 9287255 - DNA, 22 bp, Homo sapiens
acaggcaagtacacaggctcat

SEQ ID NO: 9287256 - DNA, 22 bp, Homo sapiens
acaggcaaagggtcagtagcag

SEQ ID NO: 9287257 - DNA, 22 bp, Homo sapiens
acaggacatgtaccaggtggtc

SEQ ID NO: 9287258 - DNA, 22 bp, Homo sapiens
acaggacatgtaccaggtggtc

SEQ ID NO: 9287259 - DNA, 22 bp, Homo sapiens
agcttcttgaccaagcctgtaa

SEQ ID NO: 9287260 - DNA, 23 bp, Homo sapiens
acagggcattgctggcctcgagg

SEQ ID NO: 9287261 - DNA, 22 bp, Homo sapiens
acagggcatttcctctatgtgt

SEQ ID NO: 9287262 - DNA, 21 bp, Homo sapiens
acagggcatgcagctggctgt

SEQ ID NO: 9287263 - DNA, 22 bp, Homo sapiens
acagggcatgtgcaagagacat

SEQ ID NO: 9287264 - DNA, 22 bp, Homo sapiens
acaggctctcagccagttggca

SEQ ID NO: 9287265 - DNA, 22 bp, Homo sapiens
acagggcaggtggctactggtc

SEQ ID NO: 9287266 - DNA, 22 bp, Homo sapiens
acagggcagtgtcttgaaaaat

SEQ ID NO: 9287267 - DNA, 17 bp, Homo sapiens
acagggcagaaacagct

SEQ ID NO: 9287268 - DNA, 21 bp, Homo sapiens
acaggctctggggatgctggg

SEQ ID NO: 9287269 - DNA, 22 bp, Homo sapiens
aggacatgaagaaagggcaagg

SEQ ID NO: 9287270 - DNA, 22 bp, Homo sapiens
aggactggccctgaggggaggc

SEQ ID NO: 9287271 - DNA, 22 bp, Homo sapiens
aggacatgtaaatggagaggga

SEQ ID NO: 9287272 - DNA, 22 bp, Homo sapiens
aggacacaggtaagccagtgga

SEQ ID NO: 9287273 - DNA, 22 bp, Homo sapiens
acagggccagcctgggacctgg

SEQ ID NO: 9287274 - DNA, 22 bp, Homo sapiens
acagtgaaaagaatattagaat

SEQ ID NO: 9287275 - DNA, 22 bp, Homo sapiens
acagtgaaaattctattgattt

SEQ ID NO: 9287276 - DNA, 22 bp, Homo sapiens
acagtgagatccaagggcaggc

SEQ ID NO: 9287277 - DNA, 20 bp, Homo sapiens
aggaggccaaagtaatgggg

SEQ ID NO: 9287278 - DNA, 22 bp, Homo sapiens
aggaggcccctcctgggttgct

SEQ ID NO: 9287279 - DNA, 22 bp, Homo sapiens
acatctgaggagaccagcctct

SEQ ID NO: 9287280 - DNA, 22 bp, Homo sapiens
aggcaggttggggaaaagcact

SEQ ID NO: 9287281 - DNA, 22 bp, Homo sapiens
aggcaggttacaaaaactttat

SEQ ID NO: 9287282 - DNA, 22 bp, Homo sapiens
aggcaggtgttgggagacacca

SEQ ID NO: 9287283 - DNA, 22 bp, Homo sapiens
aggcaggtgttacctctggttt

SEQ ID NO: 9287284 - DNA, 22 bp, Homo sapiens
aggcaggtgttaaccctctgag

SEQ ID NO: 9287285 - DNA, 22 bp, Homo sapiens
aggcaggtgggtcacttgagtc

SEQ ID NO: 9287286 - DNA, 22 bp, Homo sapiens
aggcaggtgggagtgattcctt

SEQ ID NO: 9287287 - DNA, 22 bp, Homo sapiens
aggcaggtgcttatgacttgct

SEQ ID NO: 9287288 - DNA, 18 bp, Homo sapiens
aggcaggtgctggaagtc

SEQ ID NO: 9287289 - DNA, 22 bp, Homo sapiens
aggcagcaaagaaatgatgctg

SEQ ID NO: 9287290 - DNA, 22 bp, Homo sapiens
aggcagatattggggtgatgtg

SEQ ID NO: 9287291 - DNA, 22 bp, Homo sapiens
aggcagacttcctgcttggatc

SEQ ID NO: 9287292 - DNA, 22 bp, Homo sapiens
aggcagactcaatggctagata

SEQ ID NO: 9287293 - DNA, 22 bp, Homo sapiens
aggggtgtgcatcctggaggat

SEQ ID NO: 9287294 - DNA, 22 bp, Homo sapiens
agggtcagtgatgagggagccc

SEQ ID NO: 9287295 - DNA, 22 bp, Homo sapiens
acctcccagctctgagcttggg

SEQ ID NO: 9287296 - DNA, 22 bp, Homo sapiens
acctcaagaatgtataacacag

SEQ ID NO: 9287297 - DNA, 21 bp, Homo sapiens
acctcaagcaacaaccaaggt

SEQ ID NO: 9287298 - DNA, 21 bp, Homo sapiens
acctcaagcaacaaccaaggt

SEQ ID NO: 9287299 - DNA, 22 bp, Homo sapiens
acctcaaggaaaatctagacag

SEQ ID NO: 9287300 - DNA, 22 bp, Homo sapiens
acctcaagtgatccactcacct

SEQ ID NO: 9287301 - DNA, 22 bp, Homo sapiens
aggggccacctgtggcaccctg

SEQ ID NO: 9287302 - DNA, 22 bp, Homo sapiens
agggctcactacaaccctggga

SEQ ID NO: 9287303 - DNA, 22 bp, Homo sapiens
agggctcactgggaggctataa

SEQ ID NO: 9287304 - DNA, 22 bp, Homo sapiens
agggctgacaaatggcagtgac

SEQ ID NO: 9287305 - DNA, 22 bp, Homo sapiens
agggctgaagggaggtgctcat

SEQ ID NO: 9287306 - DNA, 22 bp, Homo sapiens
agggagctgactggctgccatt

SEQ ID NO: 9287307 - DNA, 22 bp, Homo sapiens
agggaggcaggaaagttgtctg

SEQ ID NO: 9287308 - DNA, 22 bp, Homo sapiens
agggctcaatggtgggcatgta

SEQ ID NO: 9287309 - DNA, 22 bp, Homo sapiens
agggccagtaccaggtgggtgg

SEQ ID NO: 9287310 - DNA, 22 bp, Homo sapiens
agggccagcactcctggcagga

SEQ ID NO: 9287311 - DNA, 22 bp, Homo sapiens
agggccagcactcctggcagga

SEQ ID NO: 9287312 - DNA, 22 bp, Homo sapiens
aggctctaaggagggctgtcta

SEQ ID NO: 9287313 - DNA, 22 bp, Homo sapiens
aggctctagatcaaggtgggag

SEQ ID NO: 9287314 - DNA, 22 bp, Homo sapiens
aggctcaggtctcaggtctggc

SEQ ID NO: 9287315 - DNA, 20 bp, Homo sapiens
aggctcagggtgtttaggaa

SEQ ID NO: 9287316 - DNA, 22 bp, Homo sapiens
aggctctataccgctgggagtt

SEQ ID NO: 9287317 - DNA, 22 bp, Homo sapiens
aggctctggagttagccaggca

SEQ ID NO: 9287318 - DNA, 22 bp, Homo sapiens
aggctctggacagtgaggagtt

SEQ ID NO: 9287319 - DNA, 20 bp, Homo sapiens
aggctcagctgagctcttgg

SEQ ID NO: 9287320 - DNA, 22 bp, Homo sapiens
aggctcaggaggagctgccgga

SEQ ID NO: 9287321 - DNA, 22 bp, Homo sapiens
acatgtggaggaggcgagggta

SEQ ID NO: 9287322 - DNA, 22 bp, Homo sapiens
acatgtgtaaaagtggataaaa

SEQ ID NO: 9287323 - DNA, 22 bp, Homo sapiens
aggcagtgtgtagctggaagag

SEQ ID NO: 9287324 - DNA, 22 bp, Homo sapiens
aggctgggaaatgtagtcttcc

SEQ ID NO: 9287325 - DNA, 22 bp, Homo sapiens
aggctgggaaatgtattccagc

SEQ ID NO: 9287326 - DNA, 22 bp, Homo sapiens
aggctgggaaacctgaagttgt

SEQ ID NO: 9287327 - DNA, 22 bp, Homo sapiens
accagaaggaccagaggcaagg

SEQ ID NO: 9287328 - DNA, 22 bp, Homo sapiens
aggctgtgatgagcctcatgga

SEQ ID NO: 9287329 - DNA, 22 bp, Homo sapiens
aggctgctctgcgaagtcagct

SEQ ID NO: 9287330 - DNA, 21 bp, Homo sapiens
aggctgctctttcttgtggta

SEQ ID NO: 9287331 - DNA, 22 bp, Homo sapiens
aggctgctgccttggagagtgt

SEQ ID NO: 9287332 - DNA, 22 bp, Homo sapiens
aggctgctggcaggcgtggacg

SEQ ID NO: 9287333 - DNA, 22 bp, Homo sapiens
aggctgctggcaggcgtggacg

SEQ ID NO: 9287334 - DNA, 21 bp, Homo sapiens
aggctgctggctcagggtcct

SEQ ID NO: 9287335 - DNA, 21 bp, Homo sapiens
aggctgctggctcagggtcct

SEQ ID NO: 9287336 - DNA, 22 bp, Homo sapiens
aggctgcttcagctgcagggag

SEQ ID NO: 9287337 - DNA, 22 bp, Homo sapiens
aggctgcttcaatggataagat

SEQ ID NO: 9287338 - DNA, 22 bp, Homo sapiens
agagaagacttacagccacagt

SEQ ID NO: 9287339 - DNA, 22 bp, Homo sapiens
atggacagcaactggaagcttc

SEQ ID NO: 9287340 - DNA, 22 bp, Homo sapiens
atgggcagtaacagtggcagtc

SEQ ID NO: 9287341 - DNA, 22 bp, Homo sapiens
atggacaggtggataggtggat

SEQ ID NO: 9287342 - DNA, 22 bp, Homo sapiens
atggacaggtactgcagtgggt

SEQ ID NO: 9287343 - DNA, 18 bp, Homo sapiens
agagatgggagttggaaa

SEQ ID NO: 9287344 - DNA, 22 bp, Homo sapiens
agagactggagatgggcagtgt

SEQ ID NO: 9287345 - DNA, 22 bp, Homo sapiens
agagactgtaatgagaggtaca

SEQ ID NO: 9287346 - DNA, 22 bp, Homo sapiens
agagactgtacgtggcaagtat

SEQ ID NO: 9287347 - DNA, 22 bp, Homo sapiens
agagactgcaatgagtggtagg

SEQ ID NO: 9287348 - DNA, 22 bp, Homo sapiens
agagactgcaatgagtggtagg

SEQ ID NO: 9287349 - DNA, 22 bp, Homo sapiens
agagctaagaaacagaattgct

SEQ ID NO: 9287350 - DNA, 22 bp, Homo sapiens
agagcggggatagttaatattc

SEQ ID NO: 9287351 - DNA, 19 bp, Homo sapiens
atgttctatcctccaagtt

SEQ ID NO: 9287352 - DNA, 22 bp, Homo sapiens
atgttctatatcattattgtga

SEQ ID NO: 9287353 - DNA, 22 bp, Homo sapiens
atgttctacagatggaaagggg

SEQ ID NO: 9287354 - DNA, 22 bp, Homo sapiens
agagctcaagacgctcacagta

SEQ ID NO: 9287355 - DNA, 22 bp, Homo sapiens
atgtgcatgcacttacatgtgt

SEQ ID NO: 9287356 - DNA, 19 bp, Homo sapiens
atgtgcatttgtgtgaggt

SEQ ID NO: 9287357 - DNA, 18 bp, Homo sapiens
agagatggtgtagagttt

SEQ ID NO: 9287358 - DNA, 22 bp, Homo sapiens
atgtcttgatattttactgttt

SEQ ID NO: 9287359 - DNA, 22 bp, Homo sapiens
atgtgcagcttttctagagaag

SEQ ID NO: 9287360 - DNA, 22 bp, Homo sapiens
agagaaacaggtcagctgggag

SEQ ID NO: 9287361 - DNA, 22 bp, Homo sapiens
atgcttccctttgctccacatg

SEQ ID NO: 9287362 - DNA, 22 bp, Homo sapiens
atgctgagatcctcaggccaga

SEQ ID NO: 9287363 - DNA, 22 bp, Homo sapiens
atgctgagaaacagacgtgttg

SEQ ID NO: 9287364 - DNA, 22 bp, Homo sapiens
atgaccagccgagataaacaga

SEQ ID NO: 9287365 - DNA, 22 bp, Homo sapiens
atgactgctctgggctcccatg

SEQ ID NO: 9287366 - DNA, 22 bp, Homo sapiens
atctgggagtcttggctctgct

SEQ ID NO: 9287367 - DNA, 22 bp, Homo sapiens
atctggggccccggaagttcct

SEQ ID NO: 9287368 - DNA, 22 bp, Homo sapiens
atgattctcattttataaactt

SEQ ID NO: 9287369 - DNA, 22 bp, Homo sapiens
atgaggcacatcacagccaatg

SEQ ID NO: 9287370 - DNA, 22 bp, Homo sapiens
atgaggcaatagaatattgaat

SEQ ID NO: 9287371 - DNA, 22 bp, Homo sapiens
atgaggcaaggctggccgtgtt

SEQ ID NO: 9287372 - DNA, 22 bp, Homo sapiens
atgaggcacagagatgttaatg

SEQ ID NO: 9287373 - DNA, 22 bp, Homo sapiens
atgaggcaatcatggtccagtt

SEQ ID NO: 9287374 - DNA, 22 bp, Homo sapiens
atgaggcaaggatcaggtaagg

SEQ ID NO: 9287375 - DNA, 22 bp, Homo sapiens
atgaggcaaaggtggaggtggg

SEQ ID NO: 9287376 - DNA, 22 bp, Homo sapiens
attttgttataggagctgaaat

SEQ ID NO: 9287377 - DNA, 22 bp, Homo sapiens
caaagtgctgggattacaggtg

SEQ ID NO: 9287378 - DNA, 22 bp, Homo sapiens
caaagtgctgggattacaggct

SEQ ID NO: 9287379 - DNA, 22 bp, Homo sapiens
agatttaaatttgctacaattc

SEQ ID NO: 9287380 - DNA, 22 bp, Homo sapiens
agattgtatcctcggagacttc

SEQ ID NO: 9287381 - DNA, 22 bp, Homo sapiens
agatttatgtggtcacactcag

SEQ ID NO: 9287382 - DNA, 22 bp, Homo sapiens
atttcttgtgggaaatgcagca

SEQ ID NO: 9287383 - DNA, 22 bp, Homo sapiens
atttcttttcaagagggtgctt

SEQ ID NO: 9287384 - DNA, 22 bp, Homo sapiens
atttacaggacagcttggcatt

SEQ ID NO: 9287385 - DNA, 22 bp, Homo sapiens
attgaaaaatgactattgctta

SEQ ID NO: 9287386 - DNA, 22 bp, Homo sapiens
attgaaaaattcacaattctgg

SEQ ID NO: 9287387 - DNA, 22 bp, Homo sapiens
attgtatttccagcttgaatgt

SEQ ID NO: 9287388 - DNA, 22 bp, Homo sapiens
attgtattctgcacctttgtta

SEQ ID NO: 9287389 - DNA, 22 bp, Homo sapiens
attgtatttaggagaaaagggt

SEQ ID NO: 9287390 - DNA, 22 bp, Homo sapiens
attgtatttaggagaaaagggt

SEQ ID NO: 9287391 - DNA, 22 bp, Homo sapiens
attgtattcagttacaggtctt

SEQ ID NO: 9287392 - DNA, 22 bp, Homo sapiens
attgtattataattaggccaaa

SEQ ID NO: 9287393 - DNA, 22 bp, Homo sapiens
attgtattataattaggccaaa

SEQ ID NO: 9287394 - DNA, 22 bp, Homo sapiens
attgtattagcacaatacaatt

SEQ ID NO: 9287395 - DNA, 22 bp, Homo sapiens
attgttaaagtaataaccatgg

SEQ ID NO: 9287396 - DNA, 22 bp, Homo sapiens
attgttaaactgaagcattact

SEQ ID NO: 9287397 - DNA, 22 bp, Homo sapiens
attgtggtgtcagttataggca

SEQ ID NO: 9287398 - DNA, 22 bp, Homo sapiens
attgtggtgtcagttataggca

SEQ ID NO: 9287399 - DNA, 22 bp, Homo sapiens
attgttaataactattacattg

SEQ ID NO: 9287400 - DNA, 22 bp, Homo sapiens
agatacacagccctgccatcac

SEQ ID NO: 9287401 - DNA, 22 bp, Homo sapiens
agagctttgggacatttgctag

SEQ ID NO: 9287402 - DNA, 23 bp, Homo sapiens
agagctttctaaaatgtaaatct

SEQ ID NO: 9287403 - DNA, 22 bp, Homo sapiens
attatttctcactcacataata

SEQ ID NO: 9287404 - DNA, 22 bp, Homo sapiens
agaggcctccgaaaggtgggct

SEQ ID NO: 9287405 - DNA, 19 bp, Homo sapiens
agaggcctcagcagctggc

SEQ ID NO: 9287406 - DNA, 22 bp, Homo sapiens
agaggccggccgagcccatggg

SEQ ID NO: 9287407 - DNA, 22 bp, Homo sapiens
attctctgtgcagatttaagac

SEQ ID NO: 9287408 - DNA, 22 bp, Homo sapiens
attctctgaagtctttcagggc

SEQ ID NO: 9287409 - DNA, 22 bp, Homo sapiens
attctctgggttccagtaaatg

SEQ ID NO: 9287410 - DNA, 22 bp, Homo sapiens
attcgacaaccttgttttgtac

SEQ ID NO: 9287411 - DNA, 22 bp, Homo sapiens
cagatatgtggattctattagc

SEQ ID NO: 9287412 - DNA, 22 bp, Homo sapiens
agccgagagtatttgccagagc

SEQ ID NO: 9287413 - DNA, 22 bp, Homo sapiens
cagagcttaaaactccatggaa

SEQ ID NO: 9287414 - DNA, 22 bp, Homo sapiens
agccctgggctgtagataagca

SEQ ID NO: 9287415 - DNA, 22 bp, Homo sapiens
cagagtggagatgtgtgtggaa

SEQ ID NO: 9287416 - DNA, 22 bp, Homo sapiens
agccaagcaccactggcactcg

SEQ ID NO: 9287417 - DNA, 22 bp, Homo sapiens
cagctgagcatcactagtctgg

SEQ ID NO: 9287418 - DNA, 22 bp, Homo sapiens
cagctggaggagcagcttccag

SEQ ID NO: 9287419 - DNA, 22 bp, Homo sapiens
cagctggatctgcctcgagcca

SEQ ID NO: 9287420 - DNA, 22 bp, Homo sapiens
cagctggatccctgcagaactt

SEQ ID NO: 9287421 - DNA, 22 bp, Homo sapiens
cagctggacttttgatagaagt

SEQ ID NO: 9287422 - DNA, 19 bp, Homo sapiens
cagctggaatcatctgagg

SEQ ID NO: 9287423 - DNA, 22 bp, Homo sapiens
cagctggatgggagaccatgtt

SEQ ID NO: 9287424 - DNA, 22 bp, Homo sapiens
cagctggcaagtggagcagggt

SEQ ID NO: 9287425 - DNA, 22 bp, Homo sapiens
cagctggcagaacctgcatcca

SEQ ID NO: 9287426 - DNA, 22 bp, Homo sapiens
cagctgggtggctcttctgctc

SEQ ID NO: 9287427 - DNA, 22 bp, Homo sapiens
agctgagctcaggctgatgtaa

SEQ ID NO: 9287428 - DNA, 22 bp, Homo sapiens
agctgagctgcagatgactgta

SEQ ID NO: 9287429 - DNA, 22 bp, Homo sapiens
agctgagccagcagcaacagga

SEQ ID NO: 9287430 - DNA, 22 bp, Homo sapiens
agctgagcatttgatccacctc

SEQ ID NO: 9287431 - DNA, 22 bp, Homo sapiens
cagcactttagcggaggcatca

SEQ ID NO: 9287432 - DNA, 22 bp, Homo sapiens
cagcatggacaggggtggcgtt

SEQ ID NO: 9287433 - DNA, 22 bp, Homo sapiens
cagcatggacaggggtggcgtt

SEQ ID NO: 9287434 - DNA, 22 bp, Homo sapiens
cagcatggggcttggagtcagc

SEQ ID NO: 9287435 - DNA, 22 bp, Homo sapiens
cagcccaggtctctcttccagt

SEQ ID NO: 9287436 - DNA, 22 bp, Homo sapiens
cagcccaaagccccaggctaga

SEQ ID NO: 9287437 - DNA, 22 bp, Homo sapiens
agcgctgtgggcgtgcgaggag

SEQ ID NO: 9287438 - DNA, 22 bp, Homo sapiens
cacagctgccatggctgcactt

SEQ ID NO: 9287439 - DNA, 22 bp, Homo sapiens
cacagctgccctactccatgtg

SEQ ID NO: 9287440 - DNA, 22 bp, Homo sapiens
cacagctggggaagctgaggcc

SEQ ID NO: 9287441 - DNA, 22 bp, Homo sapiens
cacacatcttatcccagttatt

SEQ ID NO: 9287442 - DNA, 22 bp, Homo sapiens
cacacatcaacctagacattgt

SEQ ID NO: 9287443 - DNA, 22 bp, Homo sapiens
cacacagaaccgctcgccactt

SEQ ID NO: 9287444 - DNA, 22 bp, Homo sapiens
caatttctggaactaattctga

SEQ ID NO: 9287445 - DNA, 22 bp, Homo sapiens
caatttcttgttaattctcagg

SEQ ID NO: 9287446 - DNA, 22 bp, Homo sapiens
caagctgggtgcgggcagtata

SEQ ID NO: 9287447 - DNA, 22 bp, Homo sapiens
caagctggctgggagaggcacg

SEQ ID NO: 9287448 - DNA, 22 bp, Homo sapiens
agcaattttctaagcaaaatac

SEQ ID NO: 9287449 - DNA, 22 bp, Homo sapiens
agcagacatatctcatgtcaca

SEQ ID NO: 9287450 - DNA, 22 bp, Homo sapiens
agcagacatggcttggatgtgg

SEQ ID NO: 9287451 - DNA, 22 bp, Homo sapiens
agcagagaagacacaggcttca

SEQ ID NO: 9287452 - DNA, 22 bp, Homo sapiens
caagggctgctatcagctactg

SEQ ID NO: 9287453 - DNA, 20 bp, Homo sapiens
agcattttatggtaggaaac

SEQ ID NO: 9287454 - DNA, 22 bp, Homo sapiens
cactgggtaaatttgaggctga

SEQ ID NO: 9287455 - DNA, 22 bp, Homo sapiens
cactggggtgggcctggtagag

SEQ ID NO: 9287456 - DNA, 23 bp, Homo sapiens
cactgggggctgctacagagagg

SEQ ID NO: 9287457 - DNA, 22 bp, Homo sapiens
cagaaacatgtataaagttgta

SEQ ID NO: 9287458 - DNA, 22 bp, Homo sapiens
cactgcactccagcccgggcaa

SEQ ID NO: 9287459 - DNA, 22 bp, Homo sapiens
cactgcaacctccacctcctgg

SEQ ID NO: 9287460 - DNA, 22 bp, Homo sapiens
cactgcactccagcccgggcaa

SEQ ID NO: 9287461 - DNA, 22 bp, Homo sapiens
cactgcactccatcctgggaaa

SEQ ID NO: 9287462 - DNA, 22 bp, Homo sapiens
cactgcactccatcctgggaaa

SEQ ID NO: 9287463 - DNA, 22 bp, Homo sapiens
agcatttatttcttagaaattg

SEQ ID NO: 9287464 - DNA, 22 bp, Homo sapiens
agcatttattgagtgccctggg

SEQ ID NO: 9287465 - DNA, 22 bp, Homo sapiens
agcatttattgacctgctgctg

SEQ ID NO: 9287466 - DNA, 22 bp, Homo sapiens
agcatttccgccctcttctgcc

SEQ ID NO: 9287467 - DNA, 22 bp, Homo sapiens
agcatttagttagtaaatgttt

SEQ ID NO: 9287468 - DNA, 22 bp, Homo sapiens
agcatttagtctttattgcagc

SEQ ID NO: 9287469 - DNA, 22 bp, Homo sapiens
agcatttatagataccctatgg

SEQ ID NO: 9287470 - DNA, 22 bp, Homo sapiens
agcatttatagcccctatcatc

SEQ ID NO: 9287471 - DNA, 22 bp, Homo sapiens
agcatttatgactaatgtaaaa

SEQ ID NO: 9287472 - DNA, 22 bp, Homo sapiens
agcatttatcttttgtttgagt

SEQ ID NO: 9287473 - DNA, 22 bp, Homo sapiens
cactgcacttcagcctgggtga

SEQ ID NO: 9287474 - DNA, 22 bp, Homo sapiens
cactgcacttcagcctgggtga

SEQ ID NO: 9287475 - DNA, 20 bp, Homo sapiens
agcatttagcctttatccac

SEQ ID NO: 9287476 - DNA, 22 bp, Homo sapiens
agcatttaggagaatttgagaa

SEQ ID NO: 9287477 - DNA, 22 bp, Homo sapiens
cacattggcaaacggggttgca

SEQ ID NO: 9287478 - DNA, 22 bp, Homo sapiens
cacggtggcccacaggtgcaag

SEQ ID NO: 9287479 - DNA, 22 bp, Homo sapiens
cacctgagtgtcagtattctca

SEQ ID NO: 9287480 - DNA, 22 bp, Homo sapiens
agcaggtgggatcaagctggca

SEQ ID NO: 9287481 - DNA, 18 bp, Homo sapiens
agcaggtggcgtctgcag

SEQ ID NO: 9287482 - DNA, 22 bp, Homo sapiens
agcaggtggcctcctgtctgtc

SEQ ID NO: 9287483 - DNA, 22 bp, Homo sapiens
agcaggtggatttagacgggag

SEQ ID NO: 9287484 - DNA, 22 bp, Homo sapiens
agcaggtggccacgaggaggag

SEQ ID NO: 9287485 - DNA, 18 bp, Homo sapiens
agcaggtggatttattgg

SEQ ID NO: 9287486 - DNA, 22 bp, Homo sapiens
cacaggctcttctcacttgatt

SEQ ID NO: 9287487 - DNA, 22 bp, Homo sapiens
cacaggctgcccgcagctggga

SEQ ID NO: 9287488 - DNA, 22 bp, Homo sapiens
cacaggctccggccttgcagcc

SEQ ID NO: 9287489 - DNA, 18 bp, Homo sapiens
cacaggctcccagtgagg

SEQ ID NO: 9287490 - DNA, 20 bp, Homo sapiens
cacaggctatatgagagcca

SEQ ID NO: 9287491 - DNA, 22 bp, Homo sapiens
aaatgatagtatggaactagga

SEQ ID NO: 9287492 - DNA, 22 bp, Homo sapiens
aaatgaacagttgcattctctg

SEQ ID NO: 9287493 - DNA, 22 bp, Homo sapiens
aaatattgttttggtaagcttc

SEQ ID NO: 9287494 - DNA, 22 bp, Homo sapiens
aaatgcttgctcttgattattt

SEQ ID NO: 9287495 - DNA, 22 bp, Homo sapiens
aagagagaagtctctctggttc

SEQ ID NO: 9287496 - DNA, 22 bp, Homo sapiens
aagagagaccatgggggacagg

SEQ ID NO: 9287497 - DNA, 22 bp, Homo sapiens
aagagagagtgcgctcacagaa

SEQ ID NO: 9287498 - DNA, 22 bp, Homo sapiens
aagagagagtgcgctcacagaa

SEQ ID NO: 9287499 - DNA, 22 bp, Homo sapiens
aagagagagcattcttctgtta

SEQ ID NO: 9287500 - DNA, 22 bp, Homo sapiens
aagagagagcattcttctgtta

SEQ ID NO: 9287501 - DNA, 22 bp, Homo sapiens
aaatatacggtccctaacagtc

SEQ ID NO: 9287502 - DNA, 22 bp, Homo sapiens
aaatatagtgacacttatagtc

SEQ ID NO: 9287503 - DNA, 22 bp, Homo sapiens
aagagagaactcccttcgccag

SEQ ID NO: 9287504 - DNA, 22 bp, Homo sapiens
aagagagaactcccttcgccag

SEQ ID NO: 9287505 - DNA, 22 bp, Homo sapiens
aagagagaactcccttcgccag

SEQ ID NO: 9287506 - DNA, 22 bp, Homo sapiens
aacatgagcattcttgtgcttg

SEQ ID NO: 9287507 - DNA, 22 bp, Homo sapiens
aaaggctccttctcccatgacc

SEQ ID NO: 9287508 - DNA, 22 bp, Homo sapiens
aaagggaatgtgtaggacatgt

SEQ ID NO: 9287509 - DNA, 22 bp, Homo sapiens
aaagggaggggcgataagccgg

SEQ ID NO: 9287510 - DNA, 22 bp, Homo sapiens
aaagggagcatggctgcaggga

SEQ ID NO: 9287511 - DNA, 22 bp, Homo sapiens
aacttcttggtcctgagctgtt

SEQ ID NO: 9287512 - DNA, 20 bp, Homo sapiens
aaagtctcaacagctgagaa

SEQ ID NO: 9287513 - DNA, 22 bp, Homo sapiens
aaagtctcaggcaaaccaggac

SEQ ID NO: 9287514 - DNA, 22 bp, Homo sapiens
aaagtcctgttaactgttaaca

SEQ ID NO: 9287515 - DNA, 22 bp, Homo sapiens
aaagtccagagggcacactgaa

SEQ ID NO: 9287516 - DNA, 22 bp, Homo sapiens
aacatgaaacccaaacagaata

SEQ ID NO: 9287517 - DNA, 20 bp, Homo sapiens
aaaggcacagcaacagagct

SEQ ID NO: 9287518 - DNA, 22 bp, Homo sapiens
aaattgctgacacttgaccatt

SEQ ID NO: 9287519 - DNA, 22 bp, Homo sapiens
aaattgctgaccaagtatattc

SEQ ID NO: 9287520 - DNA, 22 bp, Homo sapiens
aaattccagaaactcagtatat

SEQ ID NO: 9287521 - DNA, 22 bp, Homo sapiens
aaattccattatgataatttcg

SEQ ID NO: 9287522 - DNA, 22 bp, Homo sapiens
aaattgtaggatcacatgacct

SEQ ID NO: 9287523 - DNA, 22 bp, Homo sapiens
aaattgtaatgacttcacttga

SEQ ID NO: 9287524 - DNA, 22 bp, Homo sapiens
aaattgtataatgttccagctg

SEQ ID NO: 9287525 - DNA, 22 bp, Homo sapiens
aaaataacttctactatttgca

SEQ ID NO: 9287526 - DNA, 22 bp, Homo sapiens
aaaagctctttctgctgtagat

SEQ ID NO: 9287527 - DNA, 22 bp, Homo sapiens
aaaaccacaaaagtggcttggt

SEQ ID NO: 9287528 - DNA, 22 bp, Homo sapiens
aaaagagtgactgataagtata

SEQ ID NO: 9287529 - DNA, 22 bp, Homo sapiens
aaaagagtcttaggcagtcata

SEQ ID NO: 9287530 - DNA, 22 bp, Homo sapiens
aaaaatgttatctactgtccga

SEQ ID NO: 9287531 - DNA, 20 bp, Homo sapiens
aaaagagtgcttcaactgct

SEQ ID NO: 9287532 - DNA, 22 bp, Homo sapiens
aaaagcaagaggctggattaaa

SEQ ID NO: 9287533 - DNA, 22 bp, Homo sapiens
aaaagcaagttgcctaggttga

SEQ ID NO: 9287534 - DNA, 22 bp, Homo sapiens
aaaagcaaggcagtctgtctga

SEQ ID NO: 9287535 - DNA, 22 bp, Homo sapiens
aaaacaggagttttggtaggct

SEQ ID NO: 9287536 - DNA, 22 bp, Homo sapiens
aaaagcaattgcgggttttgcc

SEQ ID NO: 9287537 - DNA, 22 bp, Homo sapiens
aaaagcctggatactatcatta

SEQ ID NO: 9287538 - DNA, 22 bp, Homo sapiens
aaagacacacagccagcaagtg

SEQ ID NO: 9287539 - DNA, 22 bp, Homo sapiens
aaagacacacagtgcttcagtt

SEQ ID NO: 9287540 - DNA, 22 bp, Homo sapiens
aaatgtctttcaatagagaaat

SEQ ID NO: 9287541 - DNA, 22 bp, Homo sapiens
aaagacacatatgcttaaccca

SEQ ID NO: 9287542 - DNA, 22 bp, Homo sapiens
aaagacacatgtctcttagatt

SEQ ID NO: 9287543 - DNA, 22 bp, Homo sapiens
aaacttagtagagttcatatta

SEQ ID NO: 9287544 - DNA, 22 bp, Homo sapiens
aaataacagtcagggacaacat

SEQ ID NO: 9287545 - DNA, 22 bp, Homo sapiens
aaataaactgaagcacagagag

SEQ ID NO: 9287546 - DNA, 22 bp, Homo sapiens
aaacttagatgtttttagagtt

SEQ ID NO: 9287547 - DNA, 22 bp, Homo sapiens
aaactgttgtggtttatcatta

SEQ ID NO: 9287548 - DNA, 22 bp, Homo sapiens
aaatgaactcaatgatctccca

SEQ ID NO: 9287549 - DNA, 22 bp, Homo sapiens
aaatgaacatcaagaatagcct

SEQ ID NO: 9287550 - DNA, 22 bp, Homo sapiens
aaagtcatacatggtgcttact

SEQ ID NO: 9287551 - DNA, 22 bp, Homo sapiens
aaagtcatgtttttgtttagca

SEQ ID NO: 9287552 - DNA, 22 bp, Homo sapiens
aaaggagataaagggcccttca

SEQ ID NO: 9287553 - DNA, 22 bp, Homo sapiens
aaaggagagtaggttactccat

SEQ ID NO: 9287554 - DNA, 22 bp, Homo sapiens
aaaggagagtgagtcagatgcc

SEQ ID NO: 9287555 - DNA, 22 bp, Homo sapiens
aaaggagacttcagatctcctt

SEQ ID NO: 9287556 - DNA, 22 bp, Homo sapiens
aaaggagacagtcttacctgga

SEQ ID NO: 9287557 - DNA, 22 bp, Homo sapiens
aaaggagaaaacatacaggact

SEQ ID NO: 9287558 - DNA, 22 bp, Homo sapiens
aaagctcacagtaatacaaggc

SEQ ID NO: 9287559 - DNA, 22 bp, Homo sapiens
aaagctatttattacagagaat

SEQ ID NO: 9287560 - DNA, 22 bp, Homo sapiens
aaaatttccaccatctttgtgt

SEQ ID NO: 9287561 - DNA, 22 bp, Homo sapiens
aagtgccatcatagcatggctg

SEQ ID NO: 9287562 - DNA, 22 bp, Homo sapiens
aagtgaaacatgtatctcttta

SEQ ID NO: 9287563 - DNA, 22 bp, Homo sapiens
aagggcaggtgggcatttctgg

SEQ ID NO: 9287564 - DNA, 22 bp, Homo sapiens
aaggtgtcggcagagccgcttc

SEQ ID NO: 9287565 - DNA, 19 bp, Homo sapiens
aaggtgtcccaactgcgtt

SEQ ID NO: 9287566 - DNA, 22 bp, Homo sapiens
aaggtgtctctctgcttcttgg

SEQ ID NO: 9287567 - DNA, 22 bp, Homo sapiens
aaggtgtcgggttagctcagcc

SEQ ID NO: 9287568 - DNA, 22 bp, Homo sapiens
aaggtgtcactgtttctggcct

SEQ ID NO: 9287569 - DNA, 22 bp, Homo sapiens
aaggtgtcatccaggatggtgg

SEQ ID NO: 9287570 - DNA, 22 bp, Homo sapiens
aaggtgtcaggcttgggaaagt

SEQ ID NO: 9287571 - DNA, 22 bp, Homo sapiens
aaggtgtcattgtttatggaga

SEQ ID NO: 9287572 - DNA, 23 bp, Homo sapiens
aaggtgtcattgatgggattcta

SEQ ID NO: 9287573 - DNA, 22 bp, Homo sapiens
aaggataagaatggaaggaaca

SEQ ID NO: 9287574 - DNA, 22 bp, Homo sapiens
aaggccaggtccctgcagtgca

SEQ ID NO: 9287575 - DNA, 23 bp, Homo sapiens
aaggccagagagaggctagtgtc

SEQ ID NO: 9287576 - DNA, 22 bp, Homo sapiens
aagggcaggagaagacggatat

SEQ ID NO: 9287577 - DNA, 22 bp, Homo sapiens
aagggcaggcacccaccctcac

SEQ ID NO: 9287578 - DNA, 22 bp, Homo sapiens
aagggcagggagtttgtgtcta

SEQ ID NO: 9287579 - DNA, 22 bp, Homo sapiens
aagggcaggcagagatcatata

SEQ ID NO: 9287580 - DNA, 22 bp, Homo sapiens
aatgcagaccagtatgaaaaac

SEQ ID NO: 9287581 - DNA, 22 bp, Homo sapiens
aatgaacaaaatatgctttgca

SEQ ID NO: 9287582 - DNA, 18 bp, Homo sapiens
aatgaaatgtacaccttt

SEQ ID NO: 9287583 - DNA, 22 bp, Homo sapiens
aatataattttattcctagagt

SEQ ID NO: 9287584 - DNA, 20 bp, Homo sapiens
aatataattctctgaattta

SEQ ID NO: 9287585 - DNA, 23 bp, Homo sapiens
aataatgtcttgtgctctcactt

SEQ ID NO: 9287586 - DNA, 22 bp, Homo sapiens
aataatgtctttggcttgacca

SEQ ID NO: 9287587 - DNA, 22 bp, Homo sapiens
aataatgtctatggttccaaaa

SEQ ID NO: 9287588 - DNA, 22 bp, Homo sapiens
aataatgtctgctattttaaaa

SEQ ID NO: 9287589 - DNA, 22 bp, Homo sapiens
aataatgtaggatgataaatga

SEQ ID NO: 9287590 - DNA, 22 bp, Homo sapiens
aataatgtacatacatatttcg

SEQ ID NO: 9287591 - DNA, 22 bp, Homo sapiens
aataatgataatggttatagct

SEQ ID NO: 9287592 - DNA, 22 bp, Homo sapiens
aacagtttatgataaattctta

SEQ ID NO: 9287593 - DNA, 22 bp, Homo sapiens
aagttaagcatggccatgtgac

SEQ ID NO: 9287594 - DNA, 22 bp, Homo sapiens
acacttctcatttgatactaac

SEQ ID NO: 9287595 - DNA, 22 bp, Homo sapiens
acactttaagcatttcacactg

SEQ ID NO: 9287596 - DNA, 22 bp, Homo sapiens
acacataagaaactacaaagag

SEQ ID NO: 9287597 - DNA, 22 bp, Homo sapiens
acacatataccactgtaaatga

SEQ ID NO: 9287598 - DNA, 22 bp, Homo sapiens
acacatacatggggaagatgag

SEQ ID NO: 9287599 - DNA, 22 bp, Homo sapiens
acacatacatggggaagatgag

SEQ ID NO: 9287600 - DNA, 17 bp, Homo sapiens
acacatacatgggccat

SEQ ID NO: 9287601 - DNA, 22 bp, Homo sapiens
acacataagcctaatcatctcc

SEQ ID NO: 9287602 - DNA, 20 bp, Homo sapiens
acacatatagcagcataaac

SEQ ID NO: 9287603 - DNA, 22 bp, Homo sapiens
acagactggcctgtctcgcacc

SEQ ID NO: 9287604 - DNA, 22 bp, Homo sapiens
acagagcaataacagggagagg

SEQ ID NO: 9287605 - DNA, 22 bp, Homo sapiens
acagccagggacatacaatggt

SEQ ID NO: 9287606 - DNA, 23 bp, Homo sapiens
acagccaggatgggagcagaagc

SEQ ID NO: 9287607 - DNA, 22 bp, Homo sapiens
acagccaggaattctggagaag

SEQ ID NO: 9287608 - DNA, 22 bp, Homo sapiens
acagctggacaggggagagttt

SEQ ID NO: 9287609 - DNA, 21 bp, Homo sapiens
acagctggaaattacttgccc

SEQ ID NO: 9287610 - DNA, 22 bp, Homo sapiens
aagcaggcgagggcctggagca

SEQ ID NO: 9287611 - DNA, 22 bp, Homo sapiens
aagcaggtaaatatgtttccct

SEQ ID NO: 9287612 - DNA, 22 bp, Homo sapiens
aagcagtttttcaactgtttag

SEQ ID NO: 9287613 - DNA, 19 bp, Homo sapiens
aagcagtttatatatttgt

SEQ ID NO: 9287614 - DNA, 22 bp, Homo sapiens
aagcagttactatttactatta

SEQ ID NO: 9287615 - DNA, 20 bp, Homo sapiens
aagcagtgaggtgaggagtg

SEQ ID NO: 9287616 - DNA, 22 bp, Homo sapiens
acaaaaagggagatgaggtaga

SEQ ID NO: 9287617 - DNA, 22 bp, Homo sapiens
aagaacatttatgatggcattt

SEQ ID NO: 9287618 - DNA, 22 bp, Homo sapiens
acaaatgaacctgaaatctcag

SEQ ID NO: 9287619 - DNA, 22 bp, Homo sapiens
acaaatgaacatataagcttga

SEQ ID NO: 9287620 - DNA, 22 bp, Homo sapiens
acaaatccagtgaactccagtg

SEQ ID NO: 9287621 - DNA, 22 bp, Homo sapiens
acaaatgaatcatacataatgt

SEQ ID NO: 9287622 - DNA, 22 bp, Homo sapiens
acaaagctagagaagagaattg

SEQ ID NO: 9287623 - DNA, 22 bp, Homo sapiens
acaaatatttactgaatccact

SEQ ID NO: 9287624 - DNA, 22 bp, Homo sapiens
acacagagccaaaccatatcac

SEQ ID NO: 9287625 - DNA, 22 bp, Homo sapiens
acacagccgtgaatctgcttct

SEQ ID NO: 9287626 - DNA, 22 bp, Homo sapiens
acaatgtagagtaaaatatgtt

SEQ ID NO: 9287627 - DNA, 22 bp, Homo sapiens
acaatgtaggctgaaaaagctt

SEQ ID NO: 9287628 - DNA, 22 bp, Homo sapiens
agagatttctactgcactcttt

SEQ ID NO: 9287629 - DNA, 22 bp, Homo sapiens
aatgtgtataagggagagctaa

SEQ ID NO: 9287630 - DNA, 22 bp, Homo sapiens
aatgtgtcagcttgtcgatctt

SEQ ID NO: 9287631 - DNA, 22 bp, Homo sapiens
aatgtgtcatttcccacaggtg

SEQ ID NO: 9287632 - DNA, 22 bp, Homo sapiens
aatgtgtcccttatttcacagg

SEQ ID NO: 9287633 - DNA, 22 bp, Homo sapiens
aatgtgtctatgtggttcacag

SEQ ID NO: 9287634 - DNA, 23 bp, Homo sapiens
agacatcaggatggtggctggga

SEQ ID NO: 9287635 - DNA, 22 bp, Homo sapiens
aatgctgctctcataattatag

SEQ ID NO: 9287636 - DNA, 22 bp, Homo sapiens
agacaggtagcaggacagatat

SEQ ID NO: 9287637 - DNA, 22 bp, Homo sapiens
agacaggtaaatagagatgctg

SEQ ID NO: 9287638 - DNA, 20 bp, Homo sapiens
aatgtatattttatgccagg

SEQ ID NO: 9287639 - DNA, 22 bp, Homo sapiens
aatgtatgagcgtgaaagcact

SEQ ID NO: 9287640 - DNA, 22 bp, Homo sapiens
aatgtatgggtgagaaagttga

SEQ ID NO: 9287641 - DNA, 22 bp, Homo sapiens
aatgtatgtgtatatcaaatca

SEQ ID NO: 9287642 - DNA, 21 bp, Homo sapiens
aatgtatgtttatctcacagt

SEQ ID NO: 9287643 - DNA, 22 bp, Homo sapiens
agacatgtcaccaattcttact

SEQ ID NO: 9287644 - DNA, 22 bp, Homo sapiens
agacatgtggtataatcagggg

SEQ ID NO: 9287645 - DNA, 21 bp, Homo sapiens
agacatgtgaactaaaggtga

SEQ ID NO: 9287646 - DNA, 22 bp, Homo sapiens
agacatgtccacaaagcattca

SEQ ID NO: 9287647 - DNA, 22 bp, Homo sapiens
aatgtataatatttaatgcttt

SEQ ID NO: 9287648 - DNA, 22 bp, Homo sapiens
agaggaatttctggaaggaggc

SEQ ID NO: 9287649 - DNA, 20 bp, Homo sapiens
agaggatttatgtggatgtg

SEQ ID NO: 9287650 - DNA, 22 bp, Homo sapiens
agaggattttaaaagcatatgt

SEQ ID NO: 9287651 - DNA, 22 bp, Homo sapiens
agagcacagaagaataggtgct

SEQ ID NO: 9287652 - DNA, 22 bp, Homo sapiens
agagcctggcaaaaggtcctgc

SEQ ID NO: 9287653 - DNA, 22 bp, Homo sapiens
aattcattaagaaagagctaaa

SEQ ID NO: 9287654 - DNA, 22 bp, Homo sapiens
agcaaggcagtcagctggctgg

SEQ ID NO: 9287655 - DNA, 22 bp, Homo sapiens
acaacatttccatttccttggt

SEQ ID NO: 9287656 - DNA, 22 bp, Homo sapiens
agcaaagtagctgctgttctta

SEQ ID NO: 9287657 - DNA, 22 bp, Homo sapiens
agcaaagtatgtgctgggagct

SEQ ID NO: 9287658 - DNA, 22 bp, Homo sapiens
agcacaagtttctggcagacag

SEQ ID NO: 9287659 - DNA, 22 bp, Homo sapiens
agcacaggaacatggagatggg

SEQ ID NO: 9287660 - DNA, 22 bp, Homo sapiens
agcacacatcacttctgctcat

SEQ ID NO: 9287661 - DNA, 22 bp, Homo sapiens
agcacaggaccaaggaagctgt

SEQ ID NO: 9287662 - DNA, 22 bp, Homo sapiens
agcacaggctttggtgtgaggg

SEQ ID NO: 9287663 - DNA, 22 bp, Homo sapiens
agcacagggacaatgccaggtg

SEQ ID NO: 9287664 - DNA, 19 bp, Homo sapiens
acaaagtgcgtgctctttt

SEQ ID NO: 9287665 - DNA, 22 bp, Homo sapiens
acaacagggtaaggcaggccat

SEQ ID NO: 9287666 - DNA, 21 bp, Homo sapiens
agatgctgatgctgcaggtcc

SEQ ID NO: 9287667 - DNA, 20 bp, Homo sapiens
agagtgggtgtcacaggctg

SEQ ID NO: 9287668 - DNA, 23 bp, Homo sapiens
aatttggttgatgaaagcattgt

SEQ ID NO: 9287669 - DNA, 22 bp, Homo sapiens
aatttggttttaagagcatcag

SEQ ID NO: 9287670 - DNA, 22 bp, Homo sapiens
aatttctctctcatgcttcatg

SEQ ID NO: 9287671 - DNA, 22 bp, Homo sapiens
agctgagaggtggcaagctgta

SEQ ID NO: 9287672 - DNA, 22 bp, Homo sapiens
agctgagattatgctcttctca

SEQ ID NO: 9287673 - DNA, 22 bp, Homo sapiens
agctgagaggtggcaagctgta

SEQ ID NO: 9287674 - DNA, 22 bp, Homo sapiens
acagcagcgtcaacttaaaatt

SEQ ID NO: 9287675 - DNA, 18 bp, Homo sapiens
agctgaggggactgaaga

SEQ ID NO: 9287676 - DNA, 21 bp, Homo sapiens
agctgaggtaaggcaagagag

SEQ ID NO: 9287677 - DNA, 22 bp, Homo sapiens
agctgagttaattcatcactta

SEQ ID NO: 9287678 - DNA, 22 bp, Homo sapiens
acagatataaactatagtagtg

SEQ ID NO: 9287679 - DNA, 22 bp, Homo sapiens
acagcagatctggctacaggtt

SEQ ID NO: 9287680 - DNA, 19 bp, Homo sapiens
acagaagcatagaaaagga

SEQ ID NO: 9287681 - DNA, 21 bp, Homo sapiens
acagaagtggcttggtctcag

SEQ ID NO: 9287682 - DNA, 22 bp, Homo sapiens
acagataattagcataaatgct

SEQ ID NO: 9287683 - DNA, 22 bp, Homo sapiens
agcggctgctccgcaggctggc

SEQ ID NO: 9287684 - DNA, 20 bp, Homo sapiens
agcggctggcggaggacacg

SEQ ID NO: 9287685 - DNA, 22 bp, Homo sapiens
acactgttccacactaagaagg

SEQ ID NO: 9287686 - DNA, 22 bp, Homo sapiens
agccagcttctttacggtggca

SEQ ID NO: 9287687 - DNA, 22 bp, Homo sapiens
agccagctgttctggggcagca

SEQ ID NO: 9287688 - DNA, 22 bp, Homo sapiens
agccagctgctcgggggaaaca

SEQ ID NO: 9287689 - DNA, 20 bp, Homo sapiens
agcatttacatcccttggtg

SEQ ID NO: 9287690 - DNA, 22 bp, Homo sapiens
agcatttacctcaatgcatctg

SEQ ID NO: 9287691 - DNA, 22 bp, Homo sapiens
agcatttaattacagtttaatt

SEQ ID NO: 9287692 - DNA, 22 bp, Homo sapiens
agcaggtggtctgttgctgctg

SEQ ID NO: 9287693 - DNA, 21 bp, Homo sapiens
agcaggtgtaaaggaggaaat

SEQ ID NO: 9287694 - DNA, 22 bp, Homo sapiens
agcaggtggtgggccagatttg

SEQ ID NO: 9287695 - DNA, 22 bp, Homo sapiens
agcaggtgatcgcgtgtgctcc

SEQ ID NO: 9287696 - DNA, 22 bp, Homo sapiens
agcaggtggtaggcagtcagca

SEQ ID NO: 9287697 - DNA, 22 bp, Homo sapiens
agcaggtgtatcggtcacctac

SEQ ID NO: 9287698 - DNA, 22 bp, Homo sapiens
agcaggtgtatataaggctgag

SEQ ID NO: 9287699 - DNA, 22 bp, Homo sapiens
agcaggtgtagggctctttgta

SEQ ID NO: 9287700 - DNA, 16 bp, Homo sapiens
agcaggtgtatagtgt

SEQ ID NO: 9287701 - DNA, 22 bp, Homo sapiens
agcaggtgtcactttcactcca

SEQ ID NO: 9287702 - DNA, 22 bp, Homo sapiens
acaccagtcatttattcagtca

SEQ ID NO: 9287703 - DNA, 22 bp, Homo sapiens
acacaagattgtgtattgaatt

SEQ ID NO: 9287704 - DNA, 22 bp, Homo sapiens
acacagttcaggatcaaatagc

SEQ ID NO: 9287705 - DNA, 22 bp, Homo sapiens
acacacacaagcaggttgtgga

SEQ ID NO: 9287706 - DNA, 22 bp, Homo sapiens
acacatatgtggcaactgtaga

SEQ ID NO: 9287707 - DNA, 22 bp, Homo sapiens
acacatcagaaatatgaatgag

SEQ ID NO: 9287708 - DNA, 22 bp, Homo sapiens
acacatctcaggggacactctc

SEQ ID NO: 9287709 - DNA, 22 bp, Homo sapiens
acacatcatgccaagtttcacc

SEQ ID NO: 9287710 - DNA, 22 bp, Homo sapiens
acacagttcgttgttttctact

SEQ ID NO: 9287711 - DNA, 22 bp, Homo sapiens
acacagttcgtgcttttctatt

SEQ ID NO: 9287712 - DNA, 22 bp, Homo sapiens
acacagttcatgcatgaggtct

SEQ ID NO: 9287713 - DNA, 22 bp, Homo sapiens
acacagtttatggtattctgtt

SEQ ID NO: 9287714 - DNA, 22 bp, Homo sapiens
acacagttgattgtcactcagg

SEQ ID NO: 9287715 - DNA, 22 bp, Homo sapiens
acatttcagtgagctattgaag

SEQ ID NO: 9287716 - DNA, 22 bp, Homo sapiens
aagggcagagggaatcccacat

SEQ ID NO: 9287717 - DNA, 20 bp, Homo sapiens
aagggcagagggaacagact

SEQ ID NO: 9287718 - DNA, 22 bp, Homo sapiens
aagggcagaatagagaagatgg

SEQ ID NO: 9287719 - DNA, 22 bp, Homo sapiens
aagggcagaaagggacgctttg

SEQ ID NO: 9287720 - DNA, 22 bp, Homo sapiens
acctctggccaagactcgtgtt

SEQ ID NO: 9287721 - DNA, 23 bp, Homo sapiens
aagtagatagctaaagttttgtt

SEQ ID NO: 9287722 - DNA, 22 bp, Homo sapiens
acctgcctatcagctgcctgct

SEQ ID NO: 9287723 - DNA, 22 bp, Homo sapiens
acctgcctatggagccacatgg

SEQ ID NO: 9287724 - DNA, 22 bp, Homo sapiens
acctgcctatcagctgcctgct

SEQ ID NO: 9287725 - DNA, 22 bp, Homo sapiens
acctgcctagttggttctgccc

SEQ ID NO: 9287726 - DNA, 22 bp, Homo sapiens
aaggtggtcttactgatggtat

SEQ ID NO: 9287727 - DNA, 22 bp, Homo sapiens
aaggtggttgtaggctggtctg

SEQ ID NO: 9287728 - DNA, 22 bp, Homo sapiens
aaggtggtttgattatcccact

SEQ ID NO: 9287729 - DNA, 22 bp, Homo sapiens
aaggtggtttgctaatcccaac

SEQ ID NO: 9287730 - DNA, 22 bp, Homo sapiens
aaggtggtttgcagacagaata

SEQ ID NO: 9287731 - DNA, 22 bp, Homo sapiens
aaggtggtgatcatcttgaagg

SEQ ID NO: 9287732 - DNA, 22 bp, Homo sapiens
aaggtggtgagtacagttaggt

SEQ ID NO: 9287733 - DNA, 22 bp, Homo sapiens
aaggtggttgcaattaccataa

SEQ ID NO: 9287734 - DNA, 22 bp, Homo sapiens
aaggtggttcgctggtacccag

SEQ ID NO: 9287735 - DNA, 22 bp, Homo sapiens
aaggtggtgcttctgctcctct

SEQ ID NO: 9287736 - DNA, 22 bp, Homo sapiens
aaggtgtcaaactagaagatgt

SEQ ID NO: 9287737 - DNA, 19 bp, Homo sapiens
aaggtggtttgtctctgta

SEQ ID NO: 9287738 - DNA, 22 bp, Homo sapiens
aaggtgtcaccagattggcagg

SEQ ID NO: 9287739 - DNA, 22 bp, Homo sapiens
acctctggcaccccctggcttg

SEQ ID NO: 9287740 - DNA, 22 bp, Homo sapiens
aaggaagatgctggcctgggga

SEQ ID NO: 9287741 - DNA, 22 bp, Homo sapiens
aaggacaaagcagagctggatg

SEQ ID NO: 9287742 - DNA, 22 bp, Homo sapiens
aaggacaaagcagagctggatg

SEQ ID NO: 9287743 - DNA, 22 bp, Homo sapiens
aaggaggcctggcagatgaaga

SEQ ID NO: 9287744 - DNA, 22 bp, Homo sapiens
aaggaggcctgcgagaaggggc

SEQ ID NO: 9287745 - DNA, 22 bp, Homo sapiens
aaggaggccctctccttctgga

SEQ ID NO: 9287746 - DNA, 19 bp, Homo sapiens
aaggacacaacagagatag

SEQ ID NO: 9287747 - DNA, 22 bp, Homo sapiens
acagctggagtgaggatggagt

SEQ ID NO: 9287748 - DNA, 22 bp, Homo sapiens
acagctggaggtctgtgagcac

SEQ ID NO: 9287749 - DNA, 22 bp, Homo sapiens
acagctggagtgaggatggagt

SEQ ID NO: 9287750 - DNA, 22 bp, Homo sapiens
acagctggaggggctgcagagg

SEQ ID NO: 9287751 - DNA, 22 bp, Homo sapiens
acagctggaggtctgtgagcac

SEQ ID NO: 9287752 - DNA, 22 bp, Homo sapiens
acagctggaggccccattgtcc

SEQ ID NO: 9287753 - DNA, 22 bp, Homo sapiens
acagctggagccctatggctgg

SEQ ID NO: 9287754 - DNA, 22 bp, Homo sapiens
acagctggaggccccattgtcc

SEQ ID NO: 9287755 - DNA, 22 bp, Homo sapiens
acagctggacaggggagagttt

SEQ ID NO: 9287756 - DNA, 22 bp, Homo sapiens
aagctgtggcttggaggaaaca

SEQ ID NO: 9287757 - DNA, 22 bp, Homo sapiens
aagctgtgaagagcaagtgagg

SEQ ID NO: 9287758 - DNA, 22 bp, Homo sapiens
aagctgtgtattacagaatatt

SEQ ID NO: 9287759 - DNA, 22 bp, Homo sapiens
aaggaagaagggaagttactta

SEQ ID NO: 9287760 - DNA, 22 bp, Homo sapiens
aaggccagagcagactggagtt

SEQ ID NO: 9287761 - DNA, 22 bp, Homo sapiens
aaggccagagcagactggagtt

SEQ ID NO: 9287762 - DNA, 22 bp, Homo sapiens
aaggccagagcgtgtcctgcct

SEQ ID NO: 9287763 - DNA, 22 bp, Homo sapiens
acatcccacagaaacatacata

SEQ ID NO: 9287764 - DNA, 22 bp, Homo sapiens
aaggccagcctgagagctaaca

SEQ ID NO: 9287765 - DNA, 22 bp, Homo sapiens
acatgaagtggtcagatcaaac

SEQ ID NO: 9287766 - DNA, 22 bp, Homo sapiens
acatgacacctctggctgggtg

SEQ ID NO: 9287767 - DNA, 22 bp, Homo sapiens
aatagcatgttcatgataaaat

SEQ ID NO: 9287768 - DNA, 21 bp, Homo sapiens
aatagcattcaggatgggctc

SEQ ID NO: 9287769 - DNA, 22 bp, Homo sapiens
aatagcatttttaagggaatca

SEQ ID NO: 9287770 - DNA, 22 bp, Homo sapiens
aatagcatgtaagtttaaaaga

SEQ ID NO: 9287771 - DNA, 22 bp, Homo sapiens
aatagcatgttaataaccagag

SEQ ID NO: 9287772 - DNA, 22 bp, Homo sapiens
aatagcatcttctgagacaaag

SEQ ID NO: 9287773 - DNA, 22 bp, Homo sapiens
aatagcatgcatcctgcataga

SEQ ID NO: 9287774 - DNA, 22 bp, Homo sapiens
acttttatcaaggaagtgatct

SEQ ID NO: 9287775 - DNA, 22 bp, Homo sapiens
acttttatgataatcaatgttc

SEQ ID NO: 9287776 - DNA, 23 bp, Homo sapiens
aatcaagttttgatgaggaagcc

SEQ ID NO: 9287777 - DNA, 22 bp, Homo sapiens
agaaagctggagtcaagcagag

SEQ ID NO: 9287778 - DNA, 22 bp, Homo sapiens
agaaagcttatgaatgggcaag

SEQ ID NO: 9287779 - DNA, 22 bp, Homo sapiens
agaaggacccggtgggagatga

SEQ ID NO: 9287780 - DNA, 22 bp, Homo sapiens
agaagccagcttcagctgcccg

SEQ ID NO: 9287781 - DNA, 22 bp, Homo sapiens
aatgccagtgtgttgattccag

SEQ ID NO: 9287782 - DNA, 22 bp, Homo sapiens
aatgccattccatcacacacct

SEQ ID NO: 9287783 - DNA, 22 bp, Homo sapiens
agaagaaactgtcggggatatt

SEQ ID NO: 9287784 - DNA, 19 bp, Homo sapiens
agaactgggtccatggctt

SEQ ID NO: 9287785 - DNA, 19 bp, Homo sapiens
agaactgggtccatggctt

SEQ ID NO: 9287786 - DNA, 22 bp, Homo sapiens
agaagccactggaggttgagat

SEQ ID NO: 9287787 - DNA, 22 bp, Homo sapiens
actgcattccagcctgggcaac

SEQ ID NO: 9287788 - DNA, 22 bp, Homo sapiens
actgcactccagcctgggtgac

SEQ ID NO: 9287789 - DNA, 22 bp, Homo sapiens
actctttagaggtacatctctt

SEQ ID NO: 9287790 - DNA, 22 bp, Homo sapiens
aagtgggtcagggacagatctt

SEQ ID NO: 9287791 - DNA, 22 bp, Homo sapiens
aagtgggtcataaaaaattgca

SEQ ID NO: 9287792 - DNA, 22 bp, Homo sapiens
aagtgggtgcactcaactttat

SEQ ID NO: 9287793 - DNA, 22 bp, Homo sapiens
aagtgggttcatgtggcattat

SEQ ID NO: 9287794 - DNA, 22 bp, Homo sapiens
acctgcctcagtgcagctggat

SEQ ID NO: 9287795 - DNA, 22 bp, Homo sapiens
acctgcctctaagcagcaggtg

SEQ ID NO: 9287796 - DNA, 19 bp, Homo sapiens
aagtgggtagcacattcac

SEQ ID NO: 9287797 - DNA, 22 bp, Homo sapiens
acctgcctatggagccacatgg

SEQ ID NO: 9287798 - DNA, 22 bp, Homo sapiens
acctgcctcagtgcagctggat

SEQ ID NO: 9287799 - DNA, 22 bp, Homo sapiens
actctttacttaaactctaagt

SEQ ID NO: 9287800 - DNA, 22 bp, Homo sapiens
aatagcatcctaaaacatactt

SEQ ID NO: 9287801 - DNA, 22 bp, Homo sapiens
aatagcatcttccctggtaacc

SEQ ID NO: 9287802 - DNA, 22 bp, Homo sapiens
aatagcatcctgtatctcttcc

SEQ ID NO: 9287803 - DNA, 22 bp, Homo sapiens
aatagcatagagttaaaatgca

SEQ ID NO: 9287804 - DNA, 22 bp, Homo sapiens
aatagcataagatgtcaaatag

SEQ ID NO: 9287805 - DNA, 22 bp, Homo sapiens
actgggagtcatgaggaaggag

SEQ ID NO: 9287806 - DNA, 22 bp, Homo sapiens
actgggagggtcttgaagaggg

SEQ ID NO: 9287807 - DNA, 22 bp, Homo sapiens
actgggaggcaaagagcaagga

SEQ ID NO: 9287808 - DNA, 22 bp, Homo sapiens
aataagttgcctgttgaatcat

SEQ ID NO: 9287809 - DNA, 22 bp, Homo sapiens
aataagttgcttcagcttggtg

SEQ ID NO: 9287810 - DNA, 22 bp, Homo sapiens
aataatagcagagtttacaatc

SEQ ID NO: 9287811 - DNA, 22 bp, Homo sapiens
actggggagagtcatgccagca

SEQ ID NO: 9287812 - DNA, 22 bp, Homo sapiens
tcagacctctgaccttgccaaa

SEQ ID NO: 9287813 - DNA, 22 bp, Homo sapiens
tcagacagtgtgatcagtctct

SEQ ID NO: 9287814 - DNA, 22 bp, Homo sapiens
tcagacagtttgcagtgtgcct

SEQ ID NO: 9287815 - DNA, 22 bp, Homo sapiens
tcacttttgatccctatgcagt

SEQ ID NO: 9287816 - DNA, 20 bp, Homo sapiens
tcagacagtcgcagttctgg

SEQ ID NO: 9287817 - DNA, 22 bp, Homo sapiens
tcagacagtcatcagagcttgt

SEQ ID NO: 9287818 - DNA, 22 bp, Homo sapiens
tcagacaggcttctttctccct

SEQ ID NO: 9287819 - DNA, 22 bp, Homo sapiens
tcagacaggctggacagcttgc

SEQ ID NO: 9287820 - DNA, 22 bp, Homo sapiens
tcagacagggcttctcaaactt

SEQ ID NO: 9287821 - DNA, 22 bp, Homo sapiens
tcagacagggagtcagaaaata

SEQ ID NO: 9287822 - DNA, 22 bp, Homo sapiens
tcagacagcttgggataactga

SEQ ID NO: 9287823 - DNA, 22 bp, Homo sapiens
tcagacaggcctctccagcctc

SEQ ID NO: 9287824 - DNA, 22 bp, Homo sapiens
tcagacagcttgcagggaggtg

SEQ ID NO: 9287825 - DNA, 22 bp, Homo sapiens
tcagacagattttgacacttgc

SEQ ID NO: 9287826 - DNA, 22 bp, Homo sapiens
tcagaggaaagggaacatagtc

SEQ ID NO: 9287827 - DNA, 22 bp, Homo sapiens
tcagaggaaaggtcagatggct

SEQ ID NO: 9287828 - DNA, 23 bp, Homo sapiens
tcagagaggccccctgcagagat

SEQ ID NO: 9287829 - DNA, 22 bp, Homo sapiens
tcagagctaaggggagagcaaa

SEQ ID NO: 9287830 - DNA, 22 bp, Homo sapiens
tcagagctttggagaccaggaa

SEQ ID NO: 9287831 - DNA, 22 bp, Homo sapiens
tcagagctgcccatgcaagggg

SEQ ID NO: 9287832 - DNA, 22 bp, Homo sapiens
tcacattttctactactgtacg

SEQ ID NO: 9287833 - DNA, 22 bp, Homo sapiens
tcacccagcgggcgcacactcg

SEQ ID NO: 9287834 - DNA, 22 bp, Homo sapiens
tcactgtgtcctttctgcgtag

SEQ ID NO: 9287835 - DNA, 22 bp, Homo sapiens
tcactgaagactgggctctaaa

SEQ ID NO: 9287836 - DNA, 22 bp, Homo sapiens
tcactgaatacttgtctcatcc

SEQ ID NO: 9287837 - DNA, 19 bp, Homo sapiens
tcacaggcatctccccaga

SEQ ID NO: 9287838 - DNA, 22 bp, Homo sapiens
tcacacatgagtaaatacaggg

SEQ ID NO: 9287839 - DNA, 22 bp, Homo sapiens
tcacacatgctaagccagagat

SEQ ID NO: 9287840 - DNA, 22 bp, Homo sapiens
tcaataactttgtttagcattg

SEQ ID NO: 9287841 - DNA, 22 bp, Homo sapiens
tcaagtctcaatgtattatggt

SEQ ID NO: 9287842 - DNA, 19 bp, Homo sapiens
tcaaggctccctgagggat

SEQ ID NO: 9287843 - DNA, 22 bp, Homo sapiens
tcaaggctaaactttcagagta

SEQ ID NO: 9287844 - DNA, 22 bp, Homo sapiens
tcaagagattgaataataactg

SEQ ID NO: 9287845 - DNA, 22 bp, Homo sapiens
tcaagagagtgctgcttggggt

SEQ ID NO: 9287846 - DNA, 22 bp, Homo sapiens
tcaagagaagtgctccacagta

SEQ ID NO: 9287847 - DNA, 22 bp, Homo sapiens
tcaagagaagtgctccacagta

SEQ ID NO: 9287848 - DNA, 22 bp, Homo sapiens
tcaagagacaggacgtgtttca

SEQ ID NO: 9287849 - DNA, 22 bp, Homo sapiens
tcaagagaaggggaaatagact

SEQ ID NO: 9287850 - DNA, 18 bp, Homo sapiens
tcaagacatcatgaaata

SEQ ID NO: 9287851 - DNA, 22 bp, Homo sapiens
tcaaggaaaagataacttgatg

SEQ ID NO: 9287852 - DNA, 22 bp, Homo sapiens
tatttctgtttatttgtacatc

SEQ ID NO: 9287853 - DNA, 22 bp, Homo sapiens
tatttctgtatgcataaaagga

SEQ ID NO: 9287854 - DNA, 22 bp, Homo sapiens
tatttctgtcagccagatatgg

SEQ ID NO: 9287855 - DNA, 22 bp, Homo sapiens
tatttctgggagttcagaaatt

SEQ ID NO: 9287856 - DNA, 22 bp, Homo sapiens
tatttctgaggcccaggaagtg

SEQ ID NO: 9287857 - DNA, 22 bp, Homo sapiens
tatttctgattgctcatgaggc

SEQ ID NO: 9287858 - DNA, 22 bp, Homo sapiens
tatttcttgagtggtcagtttc

SEQ ID NO: 9287859 - DNA, 21 bp, Homo sapiens
tcatatttctcttgctattgt

SEQ ID NO: 9287860 - DNA, 22 bp, Homo sapiens
tcatagatgtgctgtgcacaaa

SEQ ID NO: 9287861 - DNA, 22 bp, Homo sapiens
tcatataactggatattttcaa

SEQ ID NO: 9287862 - DNA, 22 bp, Homo sapiens
tcatatactgccttgtagatta

SEQ ID NO: 9287863 - DNA, 22 bp, Homo sapiens
tcatataccagagagtttatat

SEQ ID NO: 9287864 - DNA, 22 bp, Homo sapiens
tcatggagactttgagcctgtt

SEQ ID NO: 9287865 - DNA, 22 bp, Homo sapiens
tcatggcacttagcacagtcct

SEQ ID NO: 9287866 - DNA, 22 bp, Homo sapiens
tcatggcattgttaagggtttt

SEQ ID NO: 9287867 - DNA, 22 bp, Homo sapiens
tcattcaggttgggcaagtgtc

SEQ ID NO: 9287868 - DNA, 22 bp, Homo sapiens
tcattatagagttgtattttag

SEQ ID NO: 9287869 - DNA, 18 bp, Homo sapiens
tcattacttgtctcccct

SEQ ID NO: 9287870 - DNA, 22 bp, Homo sapiens
tcattactttttttgtgtctac

SEQ ID NO: 9287871 - DNA, 22 bp, Homo sapiens
tcattactgtctaactgtccct

SEQ ID NO: 9287872 - DNA, 22 bp, Homo sapiens
tcattactataacctaatcctt

SEQ ID NO: 9287873 - DNA, 22 bp, Homo sapiens
tcattacttattaaaagccttg

SEQ ID NO: 9287874 - DNA, 21 bp, Homo sapiens
tcagtgacaggtgctgacctc

SEQ ID NO: 9287875 - DNA, 22 bp, Homo sapiens
tcagtgatttctggggtgaggg

SEQ ID NO: 9287876 - DNA, 22 bp, Homo sapiens
tcagtctcctttcctctagaca

SEQ ID NO: 9287877 - DNA, 22 bp, Homo sapiens
tcagtctctctatctgtaaaat

SEQ ID NO: 9287878 - DNA, 22 bp, Homo sapiens
tcagtctctggggcttctgttt

SEQ ID NO: 9287879 - DNA, 22 bp, Homo sapiens
tcaggtgtttctggagaagtaa

SEQ ID NO: 9287880 - DNA, 18 bp, Homo sapiens
tcaggtgttttctgtata

SEQ ID NO: 9287881 - DNA, 22 bp, Homo sapiens
tcaggtgttagaagaaatttca

SEQ ID NO: 9287882 - DNA, 22 bp, Homo sapiens
tcaggtgttagaagaaatttca

SEQ ID NO: 9287883 - DNA, 22 bp, Homo sapiens
tcaggtgtgttgtattttacca

SEQ ID NO: 9287884 - DNA, 22 bp, Homo sapiens
tcaggtgttctccactcagttt

SEQ ID NO: 9287885 - DNA, 22 bp, Homo sapiens
tcaggtgtttaaggatagtgat

SEQ ID NO: 9287886 - DNA, 22 bp, Homo sapiens
tcaggtgtgtggctctggacca

SEQ ID NO: 9287887 - DNA, 22 bp, Homo sapiens
tcaggtgtgtggtggaaggcag

SEQ ID NO: 9287888 - DNA, 22 bp, Homo sapiens
tcaggtgtggtcaccacagggt

SEQ ID NO: 9287889 - DNA, 22 bp, Homo sapiens
tcaggtgtctgcctctttgagt

SEQ ID NO: 9287890 - DNA, 22 bp, Homo sapiens
tcaggtgtctatctaacctggt

SEQ ID NO: 9287891 - DNA, 22 bp, Homo sapiens
tcaggtgtgaactatttggaaa

SEQ ID NO: 9287892 - DNA, 22 bp, Homo sapiens
tcaggtgtcttgtgggatttta

SEQ ID NO: 9287893 - DNA, 23 bp, Homo sapiens
tcaggtgtgcggactgctgagtc

SEQ ID NO: 9287894 - DNA, 16 bp, Homo sapiens
tcaggtgtgacttttt

SEQ ID NO: 9287895 - DNA, 22 bp, Homo sapiens
tcaggtgtgggcagagaaacca

SEQ ID NO: 9287896 - DNA, 22 bp, Homo sapiens
tcaggtgtggaccgaggtcaga

SEQ ID NO: 9287897 - DNA, 21 bp, Homo sapiens
tcaggtggcagagtgtttatg

SEQ ID NO: 9287898 - DNA, 22 bp, Homo sapiens
tcaggtggagacctccttggcc

SEQ ID NO: 9287899 - DNA, 22 bp, Homo sapiens
tcagggacccctctgagtggag

SEQ ID NO: 9287900 - DNA, 22 bp, Homo sapiens
tcaggtgtattgatgtctgtga

SEQ ID NO: 9287901 - DNA, 22 bp, Homo sapiens
tcaggtgtcaagcagggagctg

SEQ ID NO: 9287902 - DNA, 22 bp, Homo sapiens
tcaggtggccaaatgggagcgc

SEQ ID NO: 9287903 - DNA, 17 bp, Homo sapiens
tcagggaatgaggttgt

SEQ ID NO: 9287904 - DNA, 22 bp, Homo sapiens
tcagctcctcatgcaggggata

SEQ ID NO: 9287905 - DNA, 23 bp, Homo sapiens
tcagcggattggctcagacaggc

SEQ ID NO: 9287906 - DNA, 22 bp, Homo sapiens
tcaggaggtgtaacgaatacag

SEQ ID NO: 9287907 - DNA, 22 bp, Homo sapiens
tcaggaggttgaccacggggca

SEQ ID NO: 9287908 - DNA, 22 bp, Homo sapiens
tcaggaaggcacttggtgtgtt

SEQ ID NO: 9287909 - DNA, 22 bp, Homo sapiens
tcaggaagctgctctgggtggt

SEQ ID NO: 9287910 - DNA, 22 bp, Homo sapiens
tcaggaagctgctctgggtggt

SEQ ID NO: 9287911 - DNA, 22 bp, Homo sapiens
tcaggctggaatgcagtggggc

SEQ ID NO: 9287912 - DNA, 22 bp, Homo sapiens
tcaggctttttctcaacctctt

SEQ ID NO: 9287913 - DNA, 22 bp, Homo sapiens
tcaggatgacttcaaggaggaa

SEQ ID NO: 9287914 - DNA, 22 bp, Homo sapiens
tcaggatgaagtcagaggggtc

SEQ ID NO: 9287915 - DNA, 22 bp, Homo sapiens
tcaggatccatagactcccaaa

SEQ ID NO: 9287916 - DNA, 22 bp, Homo sapiens
tcaggatggagggaagcacaga

SEQ ID NO: 9287917 - DNA, 22 bp, Homo sapiens
tcaggccagcaccatccctatc

SEQ ID NO: 9287918 - DNA, 22 bp, Homo sapiens
tccagcctttctactcactgag

SEQ ID NO: 9287919 - DNA, 22 bp, Homo sapiens
tccagcattttgatacttgaaa

SEQ ID NO: 9287920 - DNA, 22 bp, Homo sapiens
tccagctcagggttggctcaag

SEQ ID NO: 9287921 - DNA, 21 bp, Homo sapiens
tccagctctcatagtgttcca

SEQ ID NO: 9287922 - DNA, 22 bp, Homo sapiens
tccagctctgcttcacagtctc

SEQ ID NO: 9287923 - DNA, 21 bp, Homo sapiens
tccagctgtgattatgaatgt

SEQ ID NO: 9287924 - DNA, 22 bp, Homo sapiens
tccagctgtgctccaggaggtg

SEQ ID NO: 9287925 - DNA, 22 bp, Homo sapiens
tccagctgtactttgtcctggc

SEQ ID NO: 9287926 - DNA, 22 bp, Homo sapiens
tccagctggggccgaagtggat

SEQ ID NO: 9287927 - DNA, 19 bp, Homo sapiens
tccagctggtatgcccaga

SEQ ID NO: 9287928 - DNA, 22 bp, Homo sapiens
tccagctggggacatgggcttc

SEQ ID NO: 9287929 - DNA, 22 bp, Homo sapiens
tccagctggggcagtggctggg

SEQ ID NO: 9287930 - DNA, 19 bp, Homo sapiens
tccagctgttttgagtcac

SEQ ID NO: 9287931 - DNA, 20 bp, Homo sapiens
tccagctgttgagatctgag

SEQ ID NO: 9287932 - DNA, 22 bp, Homo sapiens
tccagagggcgatggctggggg

SEQ ID NO: 9287933 - DNA, 22 bp, Homo sapiens
tcccaagtgtcttggaccaggg

SEQ ID NO: 9287934 - DNA, 22 bp, Homo sapiens
tcccaattaacaggtatcaggc

SEQ ID NO: 9287935 - DNA, 22 bp, Homo sapiens
tcccacacttgaaacaaggctg

SEQ ID NO: 9287936 - DNA, 22 bp, Homo sapiens
tcccacacagcccgctcaccgg

SEQ ID NO: 9287937 - DNA, 22 bp, Homo sapiens
tcccacactacacggttgttgg

SEQ ID NO: 9287938 - DNA, 22 bp, Homo sapiens
tcccacacctgtctattcctag

SEQ ID NO: 9287939 - DNA, 22 bp, Homo sapiens
tccaggagtttgagactgcagt

SEQ ID NO: 9287940 - DNA, 22 bp, Homo sapiens
tccaggagtgctggttagagta

SEQ ID NO: 9287941 - DNA, 22 bp, Homo sapiens
tccaggaggtttggaggaagca

SEQ ID NO: 9287942 - DNA, 22 bp, Homo sapiens
tccaggaggttgagactgcagt

SEQ ID NO: 9287943 - DNA, 22 bp, Homo sapiens
tccaggagggattgggctgtgg

SEQ ID NO: 9287944 - DNA, 22 bp, Homo sapiens
tccaggctaggtttacaggaca

SEQ ID NO: 9287945 - DNA, 22 bp, Homo sapiens
tccaggctctaggctgctctcc

SEQ ID NO: 9287946 - DNA, 22 bp, Homo sapiens
tccccacacagatacagagtag

SEQ ID NO: 9287947 - DNA, 22 bp, Homo sapiens
tccccacagcagaagatctgag

SEQ ID NO: 9287948 - DNA, 22 bp, Homo sapiens
tccccacactttcactcctggc

SEQ ID NO: 9287949 - DNA, 22 bp, Homo sapiens
tccccacatctctgcatcaggc

SEQ ID NO: 9287950 - DNA, 21 bp, Homo sapiens
tccccacatttctaaacagac

SEQ ID NO: 9287951 - DNA, 21 bp, Homo sapiens
tccccacatttctaaacagac

SEQ ID NO: 9287952 - DNA, 22 bp, Homo sapiens
tccccaggaaggcccttcctgg

SEQ ID NO: 9287953 - DNA, 22 bp, Homo sapiens
tccccacctaagatacccatct

SEQ ID NO: 9287954 - DNA, 22 bp, Homo sapiens
tccccaccccagaactactagg

SEQ ID NO: 9287955 - DNA, 22 bp, Homo sapiens
tcccagtgaggtcctggctgtc

SEQ ID NO: 9287956 - DNA, 22 bp, Homo sapiens
tcccagtgggtgactggaggct

SEQ ID NO: 9287957 - DNA, 22 bp, Homo sapiens
tcccagtgtggcaggccatgga

SEQ ID NO: 9287958 - DNA, 22 bp, Homo sapiens
tcccacaggagcctgagtccca

SEQ ID NO: 9287959 - DNA, 22 bp, Homo sapiens
tcccacaggaaagtagacattg

SEQ ID NO: 9287960 - DNA, 22 bp, Homo sapiens
tacttttagcctatttgattct

SEQ ID NO: 9287961 - DNA, 19 bp, Homo sapiens
tactttttcaggacagagt

SEQ ID NO: 9287962 - DNA, 22 bp, Homo sapiens
tacttttctataggtttgaaat

SEQ ID NO: 9287963 - DNA, 22 bp, Homo sapiens
tactttttatgataagaactga

SEQ ID NO: 9287964 - DNA, 22 bp, Homo sapiens
tagaaacagaaaactgtaatag

SEQ ID NO: 9287965 - DNA, 22 bp, Homo sapiens
tagaatgtgcaaatgtgcacac

SEQ ID NO: 9287966 - DNA, 22 bp, Homo sapiens
tagacacatcaagtatagttaa

SEQ ID NO: 9287967 - DNA, 22 bp, Homo sapiens
tagacacatcttcatccacaat

SEQ ID NO: 9287968 - DNA, 22 bp, Homo sapiens
tagaaagtcaaaacactgtgtt

SEQ ID NO: 9287969 - DNA, 22 bp, Homo sapiens
tagcagagctgcaatatagacc

SEQ ID NO: 9287970 - DNA, 22 bp, Homo sapiens
tagcagagcagggatcagagcc

SEQ ID NO: 9287971 - DNA, 22 bp, Homo sapiens
tagcagaaccagtcagtgagcc

SEQ ID NO: 9287972 - DNA, 22 bp, Homo sapiens
tagcagagaggtttcagctaat

SEQ ID NO: 9287973 - DNA, 22 bp, Homo sapiens
tagctttaatgagttggtaaga

SEQ ID NO: 9287974 - DNA, 22 bp, Homo sapiens
tagccgggtgtggtggaactcc

SEQ ID NO: 9287975 - DNA, 22 bp, Homo sapiens
tagccctgtccttggcctgtgc

SEQ ID NO: 9287976 - DNA, 22 bp, Homo sapiens
taggaaacaaagcttagcagga

SEQ ID NO: 9287977 - DNA, 22 bp, Homo sapiens
taggattccagaacagtgctgc

SEQ ID NO: 9287978 - DNA, 22 bp, Homo sapiens
taggatgtgccaggaaagaaag

SEQ ID NO: 9287979 - DNA, 22 bp, Homo sapiens
taggatctcaccatagaaggaa

SEQ ID NO: 9287980 - DNA, 22 bp, Homo sapiens
taggatatgtgaaatcatatta

SEQ ID NO: 9287981 - DNA, 22 bp, Homo sapiens
taggatatggtagaaatcattc

SEQ ID NO: 9287982 - DNA, 22 bp, Homo sapiens
taggatatgagtaagcctttgt

SEQ ID NO: 9287983 - DNA, 22 bp, Homo sapiens
taggatatgcatttttatacat

SEQ ID NO: 9287984 - DNA, 22 bp, Homo sapiens
tagctttcagaatccactgagt

SEQ ID NO: 9287985 - DNA, 22 bp, Homo sapiens
tagctttagtgaaaaatatcag

SEQ ID NO: 9287986 - DNA, 22 bp, Homo sapiens
tagctttacaaagtgctgcacc

SEQ ID NO: 9287987 - DNA, 22 bp, Homo sapiens
tagggcagagcttgtacacgat

SEQ ID NO: 9287988 - DNA, 22 bp, Homo sapiens
tagggactgtgtgagggacttg

SEQ ID NO: 9287989 - DNA, 20 bp, Homo sapiens
tagggagatatgctcttttc

SEQ ID NO: 9287990 - DNA, 22 bp, Homo sapiens
tagggagatgcaagggacggag

SEQ ID NO: 9287991 - DNA, 22 bp, Homo sapiens
tagggactagtttcaaggctaa

SEQ ID NO: 9287992 - DNA, 22 bp, Homo sapiens
taggattttttggattctggat

SEQ ID NO: 9287993 - DNA, 22 bp, Homo sapiens
taggatttggctttagtcaggt

SEQ ID NO: 9287994 - DNA, 21 bp, Homo sapiens
tatgtgtctgtggaaaactag

SEQ ID NO: 9287995 - DNA, 18 bp, Homo sapiens
tatgtgtctgttacaact

SEQ ID NO: 9287996 - DNA, 22 bp, Homo sapiens
tatgtgtctttatctggctctt

SEQ ID NO: 9287997 - DNA, 22 bp, Homo sapiens
tatgtgtcctgttaccggcagc

SEQ ID NO: 9287998 - DNA, 22 bp, Homo sapiens
tatgtgtctcagttgtgattga

SEQ ID NO: 9287999 - DNA, 22 bp, Homo sapiens
tatgtgtctgtcgtgcataaat

SEQ ID NO: 9288000 - DNA, 16 bp, Homo sapiens
tatgtgtctcatctac

SEQ ID NO: 9288001 - DNA, 22 bp, Homo sapiens
tattacagaatcaggcataact

SEQ ID NO: 9288002 - DNA, 22 bp, Homo sapiens
tatgtacatacatgtgcatacg

SEQ ID NO: 9288003 - DNA, 22 bp, Homo sapiens
tatgtacacacacatgcatgta

SEQ ID NO: 9288004 - DNA, 22 bp, Homo sapiens
tatgtacaatcagcagttcata

SEQ ID NO: 9288005 - DNA, 22 bp, Homo sapiens
tatgaggctaagatgttcagtg

SEQ ID NO: 9288006 - DNA, 22 bp, Homo sapiens
tattcattatgaccaaatctag

SEQ ID NO: 9288007 - DNA, 22 bp, Homo sapiens
tattaggcatttgaggataaac

SEQ ID NO: 9288008 - DNA, 20 bp, Homo sapiens
tattaggaaggaggaaggaa

SEQ ID NO: 9288009 - DNA, 22 bp, Homo sapiens
tattcttgtaccttaaatgatt

SEQ ID NO: 9288010 - DNA, 22 bp, Homo sapiens
tattcttgtatactacaatctt

SEQ ID NO: 9288011 - DNA, 22 bp, Homo sapiens
tattctcatcatcactggagct

SEQ ID NO: 9288012 - DNA, 22 bp, Homo sapiens
tatttattctttgtactgcctt

SEQ ID NO: 9288013 - DNA, 22 bp, Homo sapiens
tatttattggacagtgttgctg

SEQ ID NO: 9288014 - DNA, 22 bp, Homo sapiens
tatttattggacagtgttgctg

SEQ ID NO: 9288015 - DNA, 22 bp, Homo sapiens
tatttattcattcagcaagcat

SEQ ID NO: 9288016 - DNA, 22 bp, Homo sapiens
tatttctgaatccaaaaggtca

SEQ ID NO: 9288017 - DNA, 22 bp, Homo sapiens
tatttctgagaaccaacttacc

SEQ ID NO: 9288018 - DNA, 22 bp, Homo sapiens
tatttaattagtgattgtagag

SEQ ID NO: 9288019 - DNA, 22 bp, Homo sapiens
tatttataacagtgagaacggg

SEQ ID NO: 9288020 - DNA, 21 bp, Homo sapiens
tatttattaatttgtaaggct

SEQ ID NO: 9288021 - DNA, 22 bp, Homo sapiens
tatttataccaggtgatcggag

SEQ ID NO: 9288022 - DNA, 22 bp, Homo sapiens
tatacacatgtgtgtattcata

SEQ ID NO: 9288023 - DNA, 22 bp, Homo sapiens
taggtgtctttctgtccttgtt

SEQ ID NO: 9288024 - DNA, 22 bp, Homo sapiens
taggtgtcttgtgtatggtaca

SEQ ID NO: 9288025 - DNA, 23 bp, Homo sapiens
taggtgtctagtgtccactatgt

SEQ ID NO: 9288026 - DNA, 22 bp, Homo sapiens
taggtgtctgctcttatttaac

SEQ ID NO: 9288027 - DNA, 22 bp, Homo sapiens
taggtgtctgtcctgggctgtg

SEQ ID NO: 9288028 - DNA, 22 bp, Homo sapiens
taggtgtctggacaactttgta

SEQ ID NO: 9288029 - DNA, 22 bp, Homo sapiens
taggtgtcttgtcactaccgtt

SEQ ID NO: 9288030 - DNA, 22 bp, Homo sapiens
taggtgtcaggcctcctccagc

SEQ ID NO: 9288031 - DNA, 22 bp, Homo sapiens
taggtgtccatatatgtgtgta

SEQ ID NO: 9288032 - DNA, 22 bp, Homo sapiens
taggtgtcaggtatagaattta

SEQ ID NO: 9288033 - DNA, 22 bp, Homo sapiens
taggtgtctaacaataagtgta

SEQ ID NO: 9288034 - DNA, 22 bp, Homo sapiens
taggtgtcctcgtccaaagatt

SEQ ID NO: 9288035 - DNA, 19 bp, Homo sapiens
taggtgtccgccggaggtg

SEQ ID NO: 9288036 - DNA, 22 bp, Homo sapiens
taggtggttataaattcaaggc

SEQ ID NO: 9288037 - DNA, 22 bp, Homo sapiens
taggtggtgtgcgaagagcgtg

SEQ ID NO: 9288038 - DNA, 22 bp, Homo sapiens
taggtggtgggatatgagcatc

SEQ ID NO: 9288039 - DNA, 22 bp, Homo sapiens
taggtggttgtctgctttccta

SEQ ID NO: 9288040 - DNA, 17 bp, Homo sapiens
taggtggttgctggtct

SEQ ID NO: 9288041 - DNA, 22 bp, Homo sapiens
taggtggttatgtcagcctaga

SEQ ID NO: 9288042 - DNA, 22 bp, Homo sapiens
taggtggtagagcctggcttgc

SEQ ID NO: 9288043 - DNA, 22 bp, Homo sapiens
tatgacattgctttttagaact

SEQ ID NO: 9288044 - DNA, 22 bp, Homo sapiens
tatgacattatgtattacatgt

SEQ ID NO: 9288045 - DNA, 22 bp, Homo sapiens
tatccttgtactatagtattta

SEQ ID NO: 9288046 - DNA, 22 bp, Homo sapiens
tatatcatggagattaacattc

SEQ ID NO: 9288047 - DNA, 22 bp, Homo sapiens
tacagatacagatctagataca

SEQ ID NO: 9288048 - DNA, 22 bp, Homo sapiens
tacagcaaagaaaccctcagtc

SEQ ID NO: 9288049 - DNA, 22 bp, Homo sapiens
tacagcaatggttctaagagtc

SEQ ID NO: 9288050 - DNA, 22 bp, Homo sapiens
tacagatatagagatttataga

SEQ ID NO: 9288051 - DNA, 22 bp, Homo sapiens
tacattctggaaaggcacagac

SEQ ID NO: 9288052 - DNA, 22 bp, Homo sapiens
tacatatactgagtgatttgct

SEQ ID NO: 9288053 - DNA, 22 bp, Homo sapiens
tacattcccccaattaccaatg

SEQ ID NO: 9288054 - DNA, 22 bp, Homo sapiens
tacattcctgttagcatctaag

SEQ ID NO: 9288055 - DNA, 22 bp, Homo sapiens
tacatacatggtggaatggtta

SEQ ID NO: 9288056 - DNA, 22 bp, Homo sapiens
tacagtaagatgaaatagcaat

SEQ ID NO: 9288057 - DNA, 22 bp, Homo sapiens
taaggccaattacatatgttca

SEQ ID NO: 9288058 - DNA, 22 bp, Homo sapiens
taagggctcctgtcctggcttg

SEQ ID NO: 9288059 - DNA, 20 bp, Homo sapiens
taagggctaccagtgtttgg

SEQ ID NO: 9288060 - DNA, 22 bp, Homo sapiens
taagggctatgtgactgattaa

SEQ ID NO: 9288061 - DNA, 22 bp, Homo sapiens
taagggcttagttactggcaga

SEQ ID NO: 9288062 - DNA, 22 bp, Homo sapiens
taagggcttttaggtatttagt

SEQ ID NO: 9288063 - DNA, 22 bp, Homo sapiens
taagggctctatcctactgttt

SEQ ID NO: 9288064 - DNA, 22 bp, Homo sapiens
taagggctgaacatttgtgtcc

SEQ ID NO: 9288065 - DNA, 22 bp, Homo sapiens
taagggctgacttggaactgtc

SEQ ID NO: 9288066 - DNA, 22 bp, Homo sapiens
taaggtagccctaatgtgggtt

SEQ ID NO: 9288067 - DNA, 22 bp, Homo sapiens
tacaaaggcttaaagagatttc

SEQ ID NO: 9288068 - DNA, 22 bp, Homo sapiens
tacaaaggcggtttttctgggc

SEQ ID NO: 9288069 - DNA, 22 bp, Homo sapiens
tacaaaaaattgatactgacga

SEQ ID NO: 9288070 - DNA, 22 bp, Homo sapiens
tacaaaaaattgatactgacga

SEQ ID NO: 9288071 - DNA, 22 bp, Homo sapiens
tacaaagaggtaattgcatata

SEQ ID NO: 9288072 - DNA, 22 bp, Homo sapiens
tacaaagaggtaattgcatata

SEQ ID NO: 9288073 - DNA, 22 bp, Homo sapiens
tacaaagagtttggtctctaga

SEQ ID NO: 9288074 - DNA, 22 bp, Homo sapiens
tacaaagaggcagctccatttt

SEQ ID NO: 9288075 - DNA, 22 bp, Homo sapiens
taatgtaaacacagagacagaa

SEQ ID NO: 9288076 - DNA, 22 bp, Homo sapiens
taatggtatttcaagacttgcc

SEQ ID NO: 9288077 - DNA, 22 bp, Homo sapiens
taatggtatttgttgaaaaact

SEQ ID NO: 9288078 - DNA, 23 bp, Homo sapiens
taaattacctttccagtgcaggg

SEQ ID NO: 9288079 - DNA, 22 bp, Homo sapiens
taaagtagcaagtttagactga

SEQ ID NO: 9288080 - DNA, 22 bp, Homo sapiens
taaagtagcgcctaactaatgt

SEQ ID NO: 9288081 - DNA, 22 bp, Homo sapiens
taaagtatattttttctcaata

SEQ ID NO: 9288082 - DNA, 22 bp, Homo sapiens
taaagggtaggttttactgtaa

SEQ ID NO: 9288083 - DNA, 22 bp, Homo sapiens
taaaatgtttgcaagagaccag

SEQ ID NO: 9288084 - DNA, 18 bp, Homo sapiens
taaaattcaaggcagggt

SEQ ID NO: 9288085 - DNA, 22 bp, Homo sapiens
gttttgttttgagtcaactcca

SEQ ID NO: 9288086 - DNA, 22 bp, Homo sapiens
gttttcttcctgcaattggcat

SEQ ID NO: 9288087 - DNA, 21 bp, Homo sapiens
gttttctttgatagagggaag

SEQ ID NO: 9288088 - DNA, 21 bp, Homo sapiens
gttttctttgatagagggaag

SEQ ID NO: 9288089 - DNA, 22 bp, Homo sapiens
gtgtgggaaggctaggatgctg

SEQ ID NO: 9288090 - DNA, 22 bp, Homo sapiens
gtgtggcctcaacgggatgcaa

SEQ ID NO: 9288091 - DNA, 22 bp, Homo sapiens
gttaaggatgcagagcatggaa

SEQ ID NO: 9288092 - DNA, 22 bp, Homo sapiens
gttacaaactcaggtgccaaaa

SEQ ID NO: 9288093 - DNA, 22 bp, Homo sapiens
gttacaaagcacttcaagtgaa

SEQ ID NO: 9288094 - DNA, 22 bp, Homo sapiens
gttacaaaggaagcttcactgc

SEQ ID NO: 9288095 - DNA, 22 bp, Homo sapiens
gtgctctgagtttgcatgtcag

SEQ ID NO: 9288096 - DNA, 22 bp, Homo sapiens
gtgctctgcctggggtcatggc

SEQ ID NO: 9288097 - DNA, 22 bp, Homo sapiens
gtgctctaggggtcagtggtta

SEQ ID NO: 9288098 - DNA, 22 bp, Homo sapiens
gtgctctaggctacagggatgc

SEQ ID NO: 9288099 - DNA, 22 bp, Homo sapiens
gtgctctagaaattgtcagtgg

SEQ ID NO: 9288100 - DNA, 22 bp, Homo sapiens
gtgctctagaaatagtcagtgg

SEQ ID NO: 9288101 - DNA, 22 bp, Homo sapiens
gtgctctaaggcaccactgagc

SEQ ID NO: 9288102 - DNA, 22 bp, Homo sapiens
gtgctctacatgctccatgttt

SEQ ID NO: 9288103 - DNA, 22 bp, Homo sapiens
gtgtgcagtgagcaaaagatct

SEQ ID NO: 9288104 - DNA, 22 bp, Homo sapiens
gtgctctgtggattgagttgaa

SEQ ID NO: 9288105 - DNA, 22 bp, Homo sapiens
gtgctctggctggtctcccggt

SEQ ID NO: 9288106 - DNA, 22 bp, Homo sapiens
gttacaaaggactgggggccac

SEQ ID NO: 9288107 - DNA, 22 bp, Homo sapiens
gttcaggaagtctcagctggga

SEQ ID NO: 9288108 - DNA, 22 bp, Homo sapiens
gttgagtgggttaggatgctga

SEQ ID NO: 9288109 - DNA, 22 bp, Homo sapiens
gttgggaaggtgaacatgatgc

SEQ ID NO: 9288110 - DNA, 22 bp, Homo sapiens
gttgggaaggcaagaagtagaa

SEQ ID NO: 9288111 - DNA, 22 bp, Homo sapiens
gttggggtccaatgaagcgagc

SEQ ID NO: 9288112 - DNA, 22 bp, Homo sapiens
gttggggtgctataaaaatgat

SEQ ID NO: 9288113 - DNA, 22 bp, Homo sapiens
gttgcagatgtggaactcgtgc

SEQ ID NO: 9288114 - DNA, 22 bp, Homo sapiens
gtgctaggattacaggcatggg

SEQ ID NO: 9288115 - DNA, 22 bp, Homo sapiens
gtgcagtgaccctggagagctg

SEQ ID NO: 9288116 - DNA, 22 bp, Homo sapiens
gtgcagtgagcagtgcagcacc

SEQ ID NO: 9288117 - DNA, 22 bp, Homo sapiens
gtgcagagcaagggctgagggc

SEQ ID NO: 9288118 - DNA, 22 bp, Homo sapiens
gtgcagaggacgtggcggcctc

SEQ ID NO: 9288119 - DNA, 21 bp, Homo sapiens
gtgcagaggaatgtagggggc

SEQ ID NO: 9288120 - DNA, 22 bp, Homo sapiens
gtgagcagctcagggtggtctc

SEQ ID NO: 9288121 - DNA, 22 bp, Homo sapiens
gtgagcaggatttcatggtgta

SEQ ID NO: 9288122 - DNA, 22 bp, Homo sapiens
gtgcacatcgtgcaggtttgtt

SEQ ID NO: 9288123 - DNA, 22 bp, Homo sapiens
gtgcagagaggaccttggggag

SEQ ID NO: 9288124 - DNA, 22 bp, Homo sapiens
gtgcagagaaggagcagtagtt

SEQ ID NO: 9288125 - DNA, 22 bp, Homo sapiens
gtgcagagaggtggagggactt

SEQ ID NO: 9288126 - DNA, 22 bp, Homo sapiens
gtgcagagaaatgagaagtcga

SEQ ID NO: 9288127 - DNA, 22 bp, Homo sapiens
gtgcagagaaatgagaagtcga

SEQ ID NO: 9288128 - DNA, 22 bp, Homo sapiens
gtgaaaataaggctggttcttg

SEQ ID NO: 9288129 - DNA, 22 bp, Homo sapiens
gtctggagtggggcctgagaat

SEQ ID NO: 9288130 - DNA, 17 bp, Homo sapiens
gtctggagtggccttca

SEQ ID NO: 9288131 - DNA, 22 bp, Homo sapiens
gtctggaggcccgtcagcccta

SEQ ID NO: 9288132 - DNA, 18 bp, Homo sapiens
gtctggaggtcaggagct

SEQ ID NO: 9288133 - DNA, 22 bp, Homo sapiens
gtctggagcctgggtccctgct

SEQ ID NO: 9288134 - DNA, 22 bp, Homo sapiens
gtattaggaggaacacaggcct

SEQ ID NO: 9288135 - DNA, 22 bp, Homo sapiens
gtattagggccaaaggcaggaa

SEQ ID NO: 9288136 - DNA, 22 bp, Homo sapiens
gtattaggttggtgcaaaagta

SEQ ID NO: 9288137 - DNA, 22 bp, Homo sapiens
gtattcacatggtggtagattg

SEQ ID NO: 9288138 - DNA, 22 bp, Homo sapiens
gtattcacctaaatgtagtttg

SEQ ID NO: 9288139 - DNA, 22 bp, Homo sapiens
gtatttataggggaatgagagt

SEQ ID NO: 9288140 - DNA, 22 bp, Homo sapiens
gtacatttatttttgcagcata

SEQ ID NO: 9288141 - DNA, 22 bp, Homo sapiens
gtacatttcagtttccttaaga

SEQ ID NO: 9288142 - DNA, 22 bp, Homo sapiens
gtacatttatttttgcagcata

SEQ ID NO: 9288143 - DNA, 22 bp, Homo sapiens
gtacatttctcccaacactaaa

SEQ ID NO: 9288144 - DNA, 22 bp, Homo sapiens
gtcattttctagaattatttga

SEQ ID NO: 9288145 - DNA, 22 bp, Homo sapiens
gtcattttgctgcatatttaga

SEQ ID NO: 9288146 - DNA, 22 bp, Homo sapiens
gtccaaaagagccagccgggcg

SEQ ID NO: 9288147 - DNA, 22 bp, Homo sapiens
gtccacagagggctgggcaggc

SEQ ID NO: 9288148 - DNA, 22 bp, Homo sapiens
gtccctctgtgtccctgcagtc

SEQ ID NO: 9288149 - DNA, 22 bp, Homo sapiens
gtcccctgtccagggccagcca

SEQ ID NO: 9288150 - DNA, 22 bp, Homo sapiens
gtcccctggcccccagcgtcgg

SEQ ID NO: 9288151 - DNA, 22 bp, Homo sapiens
gtcccctcagccacccatgggg

SEQ ID NO: 9288152 - DNA, 22 bp, Homo sapiens
gtcccctcaaaattcatatgtt

SEQ ID NO: 9288153 - DNA, 22 bp, Homo sapiens
gtccccgacgtttggcttgatg

SEQ ID NO: 9288154 - DNA, 22 bp, Homo sapiens
gtccctgcatctgcaggccatg

SEQ ID NO: 9288155 - DNA, 18 bp, Homo sapiens
gggcatggatgcagcatc

SEQ ID NO: 9288156 - DNA, 22 bp, Homo sapiens
gggcatggccaggtgaggggtc

SEQ ID NO: 9288157 - DNA, 22 bp, Homo sapiens
gggcatggccaggtgaggggtc

SEQ ID NO: 9288158 - DNA, 22 bp, Homo sapiens
gggcatggcgtgtgctggattc

SEQ ID NO: 9288159 - DNA, 22 bp, Homo sapiens
gggcatggtgctggtgttcatg

SEQ ID NO: 9288160 - DNA, 22 bp, Homo sapiens
gggccaaggggagctggaaggg

SEQ ID NO: 9288161 - DNA, 22 bp, Homo sapiens
ggggctggctcactaagagact

SEQ ID NO: 9288162 - DNA, 22 bp, Homo sapiens
ggggctgagtcagtgggaagag

SEQ ID NO: 9288163 - DNA, 22 bp, Homo sapiens
ggggctgaacctggaggtggtc

SEQ ID NO: 9288164 - DNA, 22 bp, Homo sapiens
ggggctctgctctgagccgtgt

SEQ ID NO: 9288165 - DNA, 22 bp, Homo sapiens
ggggctctggagaaaggccagt

SEQ ID NO: 9288166 - DNA, 22 bp, Homo sapiens
ggggctcttagagagcctagtg

SEQ ID NO: 9288167 - DNA, 22 bp, Homo sapiens
ggggctctcaggtctccccaaa

SEQ ID NO: 9288168 - DNA, 22 bp, Homo sapiens
ggggtggggttactcattgtgc

SEQ ID NO: 9288169 - DNA, 21 bp, Homo sapiens
ggggttggcaagagcagagac

SEQ ID NO: 9288170 - DNA, 22 bp, Homo sapiens
ggggtgggcgtgcagggacacc

SEQ ID NO: 9288171 - DNA, 22 bp, Homo sapiens
ggggtgggcgtgcagggacacc

SEQ ID NO: 9288172 - DNA, 22 bp, Homo sapiens
ggggctgggatttgaacccagg

SEQ ID NO: 9288173 - DNA, 22 bp, Homo sapiens
ggggctggtggtggtttctcca

SEQ ID NO: 9288174 - DNA, 22 bp, Homo sapiens
ggggtgggcgtgcagggacacc

SEQ ID NO: 9288175 - DNA, 22 bp, Homo sapiens
ggggtgggcgtgcagggacacc

SEQ ID NO: 9288176 - DNA, 22 bp, Homo sapiens
gggtagggtgacttaggctggc

SEQ ID NO: 9288177 - DNA, 22 bp, Homo sapiens
gggtaggagaggtgtctgtgtg

SEQ ID NO: 9288178 - DNA, 22 bp, Homo sapiens
gggtaggagaggtgtctgtgtg

SEQ ID NO: 9288179 - DNA, 22 bp, Homo sapiens
gggtaggatggtagaagggacc

SEQ ID NO: 9288180 - DNA, 22 bp, Homo sapiens
gggtggagcttggacaccagta

SEQ ID NO: 9288181 - DNA, 22 bp, Homo sapiens
gggtggcacaggtgcagagggt

SEQ ID NO: 9288182 - DNA, 22 bp, Homo sapiens
gggtggccttcatagctcaggg

SEQ ID NO: 9288183 - DNA, 22 bp, Homo sapiens
ggtaggggaagacaagtgaaaa

SEQ ID NO: 9288184 - DNA, 22 bp, Homo sapiens
ggtagggcaaagtagggcacct

SEQ ID NO: 9288185 - DNA, 22 bp, Homo sapiens
ggtcagagccatggagcaactg

SEQ ID NO: 9288186 - DNA, 22 bp, Homo sapiens
ggtcagaaggattctgggaaat

SEQ ID NO: 9288187 - DNA, 22 bp, Homo sapiens
ggtcacgtgaccgcacctgcct

SEQ ID NO: 9288188 - DNA, 22 bp, Homo sapiens
ggtagggtgggccgaagctcaa

SEQ ID NO: 9288189 - DNA, 22 bp, Homo sapiens
ggtctctgtcactgagtggccc

SEQ ID NO: 9288190 - DNA, 22 bp, Homo sapiens
ggtctctgacttagagatggat

SEQ ID NO: 9288191 - DNA, 22 bp, Homo sapiens
ggtctctgagtgaggacctggg

SEQ ID NO: 9288192 - DNA, 22 bp, Homo sapiens
ggtgtggatcatctgaggtcag

SEQ ID NO: 9288193 - DNA, 22 bp, Homo sapiens
ggtgtccttgctccttcagctt

SEQ ID NO: 9288194 - DNA, 22 bp, Homo sapiens
ggtgtccttgcagaaggcggcg

SEQ ID NO: 9288195 - DNA, 22 bp, Homo sapiens
ggtgtccttcgtccgctggcat

SEQ ID NO: 9288196 - DNA, 22 bp, Homo sapiens
ggtgtccttagaaagcagacct

SEQ ID NO: 9288197 - DNA, 22 bp, Homo sapiens
ggtgttgcagttgaagactggt

SEQ ID NO: 9288198 - DNA, 22 bp, Homo sapiens
ggtgttgcagttgaagactggt

SEQ ID NO: 9288199 - DNA, 22 bp, Homo sapiens
ggtgttgggctcactggtcctt

SEQ ID NO: 9288200 - DNA, 22 bp, Homo sapiens
ggtggccttttatgagcagggt

SEQ ID NO: 9288201 - DNA, 22 bp, Homo sapiens
ggtggctcccacccagctttga

SEQ ID NO: 9288202 - DNA, 22 bp, Homo sapiens
ggtggcctgccctgatccctgg

SEQ ID NO: 9288203 - DNA, 22 bp, Homo sapiens
ggtggcctggaatcttaacaag

SEQ ID NO: 9288204 - DNA, 22 bp, Homo sapiens
ggtggcctggctctcaccttgg

SEQ ID NO: 9288205 - DNA, 22 bp, Homo sapiens
ggtggcctgttttcaggtttgc

SEQ ID NO: 9288206 - DNA, 18 bp, Homo sapiens
ggtggccttgacttctct

SEQ ID NO: 9288207 - DNA, 21 bp, Homo sapiens
ggtggccttggtgagagacct

SEQ ID NO: 9288208 - DNA, 22 bp, Homo sapiens
ggtggccttggacaagtaacct

SEQ ID NO: 9288209 - DNA, 22 bp, Homo sapiens
ggtggcctttcagtggatcagg

SEQ ID NO: 9288210 - DNA, 22 bp, Homo sapiens
ggtggcctgaattagctcaggg

SEQ ID NO: 9288211 - DNA, 22 bp, Homo sapiens
ggtggcctgcaagtgcagatgg

SEQ ID NO: 9288212 - DNA, 17 bp, Homo sapiens
ggtggcctgcagtggct

SEQ ID NO: 9288213 - DNA, 17 bp, Homo sapiens
ggtggcctgcagtggct

SEQ ID NO: 9288214 - DNA, 22 bp, Homo sapiens
ggtggcctcgccgcggctctgc

SEQ ID NO: 9288215 - DNA, 22 bp, Homo sapiens
ggtggcctccagggcataggtg

SEQ ID NO: 9288216 - DNA, 22 bp, Homo sapiens
ggtggcctcagcaaggctggca

SEQ ID NO: 9288217 - DNA, 22 bp, Homo sapiens
ggtggcctcggtggtgcacagg

SEQ ID NO: 9288218 - DNA, 22 bp, Homo sapiens
ggtggcctctcatgcaaggtag

SEQ ID NO: 9288219 - DNA, 22 bp, Homo sapiens
ggtggcctcttgtttagccagc

SEQ ID NO: 9288220 - DNA, 22 bp, Homo sapiens
ggtggcctctgcaggcctcgac

SEQ ID NO: 9288221 - DNA, 22 bp, Homo sapiens
ggtctctgtttggggctggcaa

SEQ ID NO: 9288222 - DNA, 22 bp, Homo sapiens
ggtggcctagaggttaaagtag

SEQ ID NO: 9288223 - DNA, 22 bp, Homo sapiens
ggtggcctagggcccagcctgt

SEQ ID NO: 9288224 - DNA, 22 bp, Homo sapiens
ggtggcctagaagataagggga

SEQ ID NO: 9288225 - DNA, 18 bp, Homo sapiens
gggagctgggaagctggt

SEQ ID NO: 9288226 - DNA, 22 bp, Homo sapiens
gggagctgtagtccagataccg

SEQ ID NO: 9288227 - DNA, 19 bp, Homo sapiens
gggagctgtctgcccgtgg

SEQ ID NO: 9288228 - DNA, 22 bp, Homo sapiens
gggagctgtcatcagtgttgtc

SEQ ID NO: 9288229 - DNA, 22 bp, Homo sapiens
gggagctgggctggttttgctg

SEQ ID NO: 9288230 - DNA, 22 bp, Homo sapiens
gggagctggggcatttataccc

SEQ ID NO: 9288231 - DNA, 22 bp, Homo sapiens
gggagctggttcctgccctcca

SEQ ID NO: 9288232 - DNA, 22 bp, Homo sapiens
gggagctgtaagggacaggtag

SEQ ID NO: 9288233 - DNA, 22 bp, Homo sapiens
ggctttatagggtagaggatca

SEQ ID NO: 9288234 - DNA, 22 bp, Homo sapiens
ggcttgggagcaggcatgtgac

SEQ ID NO: 9288235 - DNA, 22 bp, Homo sapiens
gggacaggcccctcgctagctt

SEQ ID NO: 9288236 - DNA, 22 bp, Homo sapiens
gggacaggctgagacttgagct

SEQ ID NO: 9288237 - DNA, 22 bp, Homo sapiens
gggacaggctgagacttgagct

SEQ ID NO: 9288238 - DNA, 22 bp, Homo sapiens
gggacatgaagcatcggaggca

SEQ ID NO: 9288239 - DNA, 22 bp, Homo sapiens
gggacatgaagcatcggaggca

SEQ ID NO: 9288240 - DNA, 22 bp, Homo sapiens
gggacatgcccctcagtgggtg

SEQ ID NO: 9288241 - DNA, 22 bp, Homo sapiens
gggacatgaggccatagtgatt

SEQ ID NO: 9288242 - DNA, 22 bp, Homo sapiens
gggacatggaggcgcgcaggca

SEQ ID NO: 9288243 - DNA, 22 bp, Homo sapiens
gggacatggctaggattccaat

SEQ ID NO: 9288244 - DNA, 22 bp, Homo sapiens
gggacatggaggcgcgcaggca

SEQ ID NO: 9288245 - DNA, 22 bp, Homo sapiens
gggatggggagctggaaagggg

SEQ ID NO: 9288246 - DNA, 22 bp, Homo sapiens
gggatggggagctggaaagggg

SEQ ID NO: 9288247 - DNA, 22 bp, Homo sapiens
gggaggagctgagtgtgtgtgc

SEQ ID NO: 9288248 - DNA, 22 bp, Homo sapiens
gggaggaaagagaagtggtcca

SEQ ID NO: 9288249 - DNA, 23 bp, Homo sapiens
gggagctgtggtgaaaagaggtg

SEQ ID NO: 9288250 - DNA, 22 bp, Homo sapiens
gggagctgtgggattggttgag

SEQ ID NO: 9288251 - DNA, 22 bp, Homo sapiens
gggcaggagaaggtggatgtcc

SEQ ID NO: 9288252 - DNA, 23 bp, Homo sapiens
gggcatggagtgtaggtggaagg

SEQ ID NO: 9288253 - DNA, 22 bp, Homo sapiens
gggcagctctggctgtgggaag

SEQ ID NO: 9288254 - DNA, 21 bp, Homo sapiens
ggctgctgggagagctgcgtg

SEQ ID NO: 9288255 - DNA, 22 bp, Homo sapiens
ggctgctgggaatatgccagct

SEQ ID NO: 9288256 - DNA, 22 bp, Homo sapiens
ggctgctgggaatatgccagct

SEQ ID NO: 9288257 - DNA, 22 bp, Homo sapiens
ggctgctggcattgaggtaggt

SEQ ID NO: 9288258 - DNA, 22 bp, Homo sapiens
ggctgctgctgtgtaggcctgt

SEQ ID NO: 9288259 - DNA, 22 bp, Homo sapiens
ggctgctgctgtgtaggcctgt

SEQ ID NO: 9288260 - DNA, 22 bp, Homo sapiens
ggctgctgccctcctaagtgca

SEQ ID NO: 9288261 - DNA, 22 bp, Homo sapiens
ggctgctgagttggccaggaga

SEQ ID NO: 9288262 - DNA, 22 bp, Homo sapiens
ggctgctgagttggccaggaga

SEQ ID NO: 9288263 - DNA, 22 bp, Homo sapiens
ggctgctgaagtgtggcaatct

SEQ ID NO: 9288264 - DNA, 22 bp, Homo sapiens
ggctgctgacaaacatgatcat

SEQ ID NO: 9288265 - DNA, 21 bp, Homo sapiens
ggctgggcaggacccacccct

SEQ ID NO: 9288266 - DNA, 22 bp, Homo sapiens
ggctgggccagggcctgtggac

SEQ ID NO: 9288267 - DNA, 22 bp, Homo sapiens
ggctgggcctctccctcagctg

SEQ ID NO: 9288268 - DNA, 19 bp, Homo sapiens
ggctgggccctgtttctcc

SEQ ID NO: 9288269 - DNA, 22 bp, Homo sapiens
ggctgggccgcggctacccaga

SEQ ID NO: 9288270 - DNA, 22 bp, Homo sapiens
ggctgggctgcggctgtacctg

SEQ ID NO: 9288271 - DNA, 22 bp, Homo sapiens
ggcttctctcccccagctccac

SEQ ID NO: 9288272 - DNA, 22 bp, Homo sapiens
ggcttctctcttcacatggctt

SEQ ID NO: 9288273 - DNA, 22 bp, Homo sapiens
ggcttctgaaactgtattgaga

SEQ ID NO: 9288274 - DNA, 22 bp, Homo sapiens
ggctctgctgcacccttggctc

SEQ ID NO: 9288275 - DNA, 22 bp, Homo sapiens
ggctctgctcctggtgccagtg

SEQ ID NO: 9288276 - DNA, 22 bp, Homo sapiens
ggctctgctgcaagtcttcctc

SEQ ID NO: 9288277 - DNA, 22 bp, Homo sapiens
ggctctgctcacagcccgcagc

SEQ ID NO: 9288278 - DNA, 22 bp, Homo sapiens
ggcgggaagttcttgcccactt

SEQ ID NO: 9288279 - DNA, 22 bp, Homo sapiens
ggctctgggcatagaaggaagc

SEQ ID NO: 9288280 - DNA, 23 bp, Homo sapiens
ggagtgcaatggcgccatctcgg

SEQ ID NO: 9288281 - DNA, 22 bp, Homo sapiens
ggagtgcggtggcaccatctca

SEQ ID NO: 9288282 - DNA, 22 bp, Homo sapiens
ggcaaagagacatgcatcgggg

SEQ ID NO: 9288283 - DNA, 22 bp, Homo sapiens
ggcaagagggcagatggagtgc

SEQ ID NO: 9288284 - DNA, 22 bp, Homo sapiens
ggagtccaacgtgcagccagga

SEQ ID NO: 9288285 - DNA, 22 bp, Homo sapiens
ggcagaggaagctggaagtggg

SEQ ID NO: 9288286 - DNA, 22 bp, Homo sapiens
ggcagaggagctggaaacatgg

SEQ ID NO: 9288287 - DNA, 22 bp, Homo sapiens
ggcaggcaaggcagcctggtga

SEQ ID NO: 9288288 - DNA, 22 bp, Homo sapiens
ggcaggaggaagagttagcacc

SEQ ID NO: 9288289 - DNA, 22 bp, Homo sapiens
ggcaggagggcggacaatgacc

SEQ ID NO: 9288290 - DNA, 22 bp, Homo sapiens
ggcaggaggtgagtggcgggtg

SEQ ID NO: 9288291 - DNA, 22 bp, Homo sapiens
ggcagaggtagctggaaccagg

SEQ ID NO: 9288292 - DNA, 22 bp, Homo sapiens
ggcagaggtagctggaaccagg

SEQ ID NO: 9288293 - DNA, 22 bp, Homo sapiens
ggcagtgaaaaagtatgtttcc

SEQ ID NO: 9288294 - DNA, 22 bp, Homo sapiens
ggcatggcacgggaaacaccag

SEQ ID NO: 9288295 - DNA, 22 bp, Homo sapiens
ggcaggtgggaaccctccccac

SEQ ID NO: 9288296 - DNA, 22 bp, Homo sapiens
ggcaggtggtaaggatttcata

SEQ ID NO: 9288297 - DNA, 21 bp, Homo sapiens
ggcaggtgggtctctgttgct

SEQ ID NO: 9288298 - DNA, 22 bp, Homo sapiens
ggcaggtggccaagtgtctaag

SEQ ID NO: 9288299 - DNA, 22 bp, Homo sapiens
ggcaggtgtgagatcgaggcca

SEQ ID NO: 9288300 - DNA, 22 bp, Homo sapiens
ggcaggtggcactgctgctccc

SEQ ID NO: 9288301 - DNA, 22 bp, Homo sapiens
ggcaggtggattttctactcta

SEQ ID NO: 9288302 - DNA, 22 bp, Homo sapiens
ggcaggtggacgtgctaaagct

SEQ ID NO: 9288303 - DNA, 15 bp, Homo sapiens
ggcaggtggatcact

SEQ ID NO: 9288304 - DNA, 22 bp, Homo sapiens
ggccaggtccagtggaaggccc

SEQ ID NO: 9288305 - DNA, 22 bp, Homo sapiens
ggccagtgtgggagtagttctt

SEQ ID NO: 9288306 - DNA, 22 bp, Homo sapiens
ggccagtaagagataggaggca

SEQ ID NO: 9288307 - DNA, 22 bp, Homo sapiens
ggccaggttgggtggaagtggc

SEQ ID NO: 9288308 - DNA, 22 bp, Homo sapiens
ggccagtgaccagtaaccagtg

SEQ ID NO: 9288309 - DNA, 22 bp, Homo sapiens
ggccagtggctctgtgcttggg

SEQ ID NO: 9288310 - DNA, 22 bp, Homo sapiens
ggccagtgtgcaggtcagagat

SEQ ID NO: 9288311 - DNA, 21 bp, Homo sapiens
ggccagtggaattttatgtca

SEQ ID NO: 9288312 - DNA, 21 bp, Homo sapiens
ggccagtggccttgactttcc

SEQ ID NO: 9288313 - DNA, 22 bp, Homo sapiens
ggccttgggatgtggctgcagc

SEQ ID NO: 9288314 - DNA, 22 bp, Homo sapiens
ggccttggttctgtcacagccg

SEQ ID NO: 9288315 - DNA, 22 bp, Homo sapiens
ggccttggttccaaagcaggca

SEQ ID NO: 9288316 - DNA, 22 bp, Homo sapiens
ggccttggtggctttgctgatg

SEQ ID NO: 9288317 - DNA, 22 bp, Homo sapiens
ggccttggtgctctgtgttgca

SEQ ID NO: 9288318 - DNA, 22 bp, Homo sapiens
ggccttggtgccatggccagtt

SEQ ID NO: 9288319 - DNA, 22 bp, Homo sapiens
ggccttggtactgtaaaccgag

SEQ ID NO: 9288320 - DNA, 20 bp, Homo sapiens
ggccttgggtttcgcctgtt

SEQ ID NO: 9288321 - DNA, 22 bp, Homo sapiens
ggccttggtaatgggggactgt

SEQ ID NO: 9288322 - DNA, 22 bp, Homo sapiens
ggccttggtaaagggatgcatg

SEQ ID NO: 9288323 - DNA, 22 bp, Homo sapiens
ggccttggtaaattggcatttg

SEQ ID NO: 9288324 - DNA, 22 bp, Homo sapiens
ggccttgggctggctgcagtat

SEQ ID NO: 9288325 - DNA, 17 bp, Homo sapiens
ggccttgggctgctctt

SEQ ID NO: 9288326 - DNA, 22 bp, Homo sapiens
ggccttgggcgagtccctcagt

SEQ ID NO: 9288327 - DNA, 22 bp, Homo sapiens
ggccttgggcagacacgtcaca

SEQ ID NO: 9288328 - DNA, 22 bp, Homo sapiens
ggccttggggaggatggtgtcc

SEQ ID NO: 9288329 - DNA, 17 bp, Homo sapiens
ggccttggggcctcagt

SEQ ID NO: 9288330 - DNA, 19 bp, Homo sapiens
ggccttggggtcccaaagt

SEQ ID NO: 9288331 - DNA, 22 bp, Homo sapiens
ggccttggggtggccttgtccc

SEQ ID NO: 9288332 - DNA, 22 bp, Homo sapiens
ggccttgggtataggtgggtat

SEQ ID NO: 9288333 - DNA, 23 bp, Homo sapiens
ggccatggagacttagaatgggc

SEQ ID NO: 9288334 - DNA, 23 bp, Homo sapiens
ggccatggagacttagaatgggc

SEQ ID NO: 9288335 - DNA, 22 bp, Homo sapiens
ggcctcagagaaggctgtgcgg

SEQ ID NO: 9288336 - DNA, 19 bp, Homo sapiens
ggccatggcgggggtcaca

SEQ ID NO: 9288337 - DNA, 19 bp, Homo sapiens
ggccatggcgggggtcaca

SEQ ID NO: 9288338 - DNA, 22 bp, Homo sapiens
gcccagcctccaagctccaagg

SEQ ID NO: 9288339 - DNA, 22 bp, Homo sapiens
gcccagctcctctgcagaccct

SEQ ID NO: 9288340 - DNA, 22 bp, Homo sapiens
gcccagcttttcacttccacac

SEQ ID NO: 9288341 - DNA, 22 bp, Homo sapiens
gcccagctgtctggcagggatg

SEQ ID NO: 9288342 - DNA, 22 bp, Homo sapiens
gcccagctggcttccagcacat

SEQ ID NO: 9288343 - DNA, 22 bp, Homo sapiens
gcccagctttttgaggcaggca

SEQ ID NO: 9288344 - DNA, 22 bp, Homo sapiens
gcccatggtcagggaggcaggg

SEQ ID NO: 9288345 - DNA, 22 bp, Homo sapiens
gccccaccttgagagcagaaac

SEQ ID NO: 9288346 - DNA, 22 bp, Homo sapiens
gccccacagcctgcggtctcag

SEQ ID NO: 9288347 - DNA, 22 bp, Homo sapiens
gcctcctggaagtcacatgttt

SEQ ID NO: 9288348 - DNA, 22 bp, Homo sapiens
gcctctgggctctgcccctggc

SEQ ID NO: 9288349 - DNA, 22 bp, Homo sapiens
gcctctggcttctgcatcagtg

SEQ ID NO: 9288350 - DNA, 22 bp, Homo sapiens
gcctctggagtcgcagcgtctt

SEQ ID NO: 9288351 - DNA, 22 bp, Homo sapiens
gcctctggagttgcttgtaaat

SEQ ID NO: 9288352 - DNA, 22 bp, Homo sapiens
gccctgtgtatcccctgtgctt

SEQ ID NO: 9288353 - DNA, 22 bp, Homo sapiens
gcctccggagttgcagtgtctt

SEQ ID NO: 9288354 - DNA, 22 bp, Homo sapiens
gcctccggagttgcagtgtctt

SEQ ID NO: 9288355 - DNA, 22 bp, Homo sapiens
gcctccggagtcacagtgtctt

SEQ ID NO: 9288356 - DNA, 22 bp, Homo sapiens
gcctccggagtcacagtgtctt

SEQ ID NO: 9288357 - DNA, 22 bp, Homo sapiens
gccccagcctcccgagtagctg

SEQ ID NO: 9288358 - DNA, 22 bp, Homo sapiens
gccccaggataaatttgtaaga

SEQ ID NO: 9288359 - DNA, 15 bp, Homo sapiens
gccccaggaatcaaa

SEQ ID NO: 9288360 - DNA, 22 bp, Homo sapiens
gccctggatgtacaggcatgtt

SEQ ID NO: 9288361 - DNA, 22 bp, Homo sapiens
gcatgcatctagatatgcagac

SEQ ID NO: 9288362 - DNA, 22 bp, Homo sapiens
gccacatagaggaggatattaa

SEQ ID NO: 9288363 - DNA, 22 bp, Homo sapiens
gccacatagaggaggatattaa

SEQ ID NO: 9288364 - DNA, 22 bp, Homo sapiens
gcagtgggagcttaggcagtgc

SEQ ID NO: 9288365 - DNA, 22 bp, Homo sapiens
gcagtgggaaggttggcacatg

SEQ ID NO: 9288366 - DNA, 21 bp, Homo sapiens
gccagggagttaaagagtctt

SEQ ID NO: 9288367 - DNA, 22 bp, Homo sapiens
gccagctgaatttccaactgtt

SEQ ID NO: 9288368 - DNA, 22 bp, Homo sapiens
gccagctgaagccctggtggaa

SEQ ID NO: 9288369 - DNA, 22 bp, Homo sapiens
gccagctgaaatttcagttctg

SEQ ID NO: 9288370 - DNA, 22 bp, Homo sapiens
gcagaggagtgattatgccgtg

SEQ ID NO: 9288371 - DNA, 22 bp, Homo sapiens
gcagaggatcaggctctggaaa

SEQ ID NO: 9288372 - DNA, 22 bp, Homo sapiens
gcagaggatagcatatgaacct

SEQ ID NO: 9288373 - DNA, 20 bp, Homo sapiens
gcagagtgtgagagggtgaa

SEQ ID NO: 9288374 - DNA, 20 bp, Homo sapiens
gcagagtgtgagagggtgaa

SEQ ID NO: 9288375 - DNA, 22 bp, Homo sapiens
gcacagtggagtgtgtccaggg

SEQ ID NO: 9288376 - DNA, 22 bp, Homo sapiens
gcacagtggtgaaagcatgggt

SEQ ID NO: 9288377 - DNA, 22 bp, Homo sapiens
gcacagttaaagggtcatgtga

SEQ ID NO: 9288378 - DNA, 22 bp, Homo sapiens
gcacataactgaccacatctaa

SEQ ID NO: 9288379 - DNA, 22 bp, Homo sapiens
gcacataaagggcatgggaggt

SEQ ID NO: 9288380 - DNA, 19 bp, Homo sapiens
gcagacaggtccagagagg

SEQ ID NO: 9288381 - DNA, 22 bp, Homo sapiens
gcagacaggggcttaggaaagg

SEQ ID NO: 9288382 - DNA, 22 bp, Homo sapiens
gcacataccccaggaatggtag

SEQ ID NO: 9288383 - DNA, 22 bp, Homo sapiens
gcacatactgcaaagattacta

SEQ ID NO: 9288384 - DNA, 22 bp, Homo sapiens
gcacatacccactgtcaagcac

SEQ ID NO: 9288385 - DNA, 22 bp, Homo sapiens
gcacatacacataagcgaactg

SEQ ID NO: 9288386 - DNA, 23 bp, Homo sapiens
gcacatactacacagaaaatggc

SEQ ID NO: 9288387 - DNA, 22 bp, Homo sapiens
gcacacattcggattcttaacc

SEQ ID NO: 9288388 - DNA, 22 bp, Homo sapiens
gcacacatgcatgcacaggagt

SEQ ID NO: 9288389 - DNA, 22 bp, Homo sapiens
gcacacagtatatgctcattaa

SEQ ID NO: 9288390 - DNA, 22 bp, Homo sapiens
gcacacactgttttcctcacat

SEQ ID NO: 9288391 - DNA, 22 bp, Homo sapiens
gcacacagtagggattcaatga

SEQ ID NO: 9288392 - DNA, 22 bp, Homo sapiens
gcacacaggggagttctcagaa

SEQ ID NO: 9288393 - DNA, 19 bp, Homo sapiens
gcacaccctgcaccaccat

SEQ ID NO: 9288394 - DNA, 22 bp, Homo sapiens
gcacaccctctcaccagcactg

SEQ ID NO: 9288395 - DNA, 22 bp, Homo sapiens
gcacagtgataggcagttgtgc

SEQ ID NO: 9288396 - DNA, 22 bp, Homo sapiens
gcaaagctgggtgtgaatgcac

SEQ ID NO: 9288397 - DNA, 22 bp, Homo sapiens
gcaaagctgggtgtgaatgcac

SEQ ID NO: 9288398 - DNA, 22 bp, Homo sapiens
gcaaagtattaagtattaagtt

SEQ ID NO: 9288399 - DNA, 22 bp, Homo sapiens
gcaaaggccactggggcgatgg

SEQ ID NO: 9288400 - DNA, 17 bp, Homo sapiens
gcaaaggtgaggagaga

SEQ ID NO: 9288401 - DNA, 22 bp, Homo sapiens
gcaaaggtagccaaggagctca

SEQ ID NO: 9288402 - DNA, 17 bp, Homo sapiens
gcaaaggtgaggagaga

SEQ ID NO: 9288403 - DNA, 20 bp, Homo sapiens
gaggcccagagaggtgaagc

SEQ ID NO: 9288404 - DNA, 18 bp, Homo sapiens
gcaaagacaggctgggct

SEQ ID NO: 9288405 - DNA, 22 bp, Homo sapiens
gcaaagacggactcaggagtgc

SEQ ID NO: 9288406 - DNA, 22 bp, Homo sapiens
gcagggaagacccggagcagcg

SEQ ID NO: 9288407 - DNA, 22 bp, Homo sapiens
gcagggaccaaaagaggcagta

SEQ ID NO: 9288408 - DNA, 22 bp, Homo sapiens
gcagggacaaggcaggtgttct

SEQ ID NO: 9288409 - DNA, 22 bp, Homo sapiens
gcagggacatctttgtctagta

SEQ ID NO: 9288410 - DNA, 22 bp, Homo sapiens
gcagggacagggcagggccttt

SEQ ID NO: 9288411 - DNA, 22 bp, Homo sapiens
gcagggacagggcagggccttt

SEQ ID NO: 9288412 - DNA, 22 bp, Homo sapiens
gcagcctcaaactccccagctc

SEQ ID NO: 9288413 - DNA, 22 bp, Homo sapiens
gcagcctcaaactccccagctc

SEQ ID NO: 9288414 - DNA, 22 bp, Homo sapiens
gcaggaagccttaccaagccca

SEQ ID NO: 9288415 - DNA, 22 bp, Homo sapiens
gcaggaagatgagctcaggtaa

SEQ ID NO: 9288416 - DNA, 22 bp, Homo sapiens
gcagctttgtggagaggcccat

SEQ ID NO: 9288417 - DNA, 22 bp, Homo sapiens
gcagctttttggatgtcagtta

SEQ ID NO: 9288418 - DNA, 22 bp, Homo sapiens
gcggtaggagagacagaagtta

SEQ ID NO: 9288419 - DNA, 22 bp, Homo sapiens
gcctttatttacgaaagggaaa

SEQ ID NO: 9288420 - DNA, 22 bp, Homo sapiens
gcctttaaagctggcaggcttt

SEQ ID NO: 9288421 - DNA, 22 bp, Homo sapiens
gcctttaaagccccgagagccc

SEQ ID NO: 9288422 - DNA, 22 bp, Homo sapiens
gcctttaaagccccgagagccc

SEQ ID NO: 9288423 - DNA, 22 bp, Homo sapiens
gcctttatccctgtacaaggtg

SEQ ID NO: 9288424 - DNA, 22 bp, Homo sapiens
gcgggggtggccagcaagacct

SEQ ID NO: 9288425 - DNA, 19 bp, Homo sapiens
gcctgagccagccatgcaa

SEQ ID NO: 9288426 - DNA, 22 bp, Homo sapiens
gcctgagcaggcgtggaccatg

SEQ ID NO: 9288427 - DNA, 22 bp, Homo sapiens
gcctctgggggctcagacctgt

SEQ ID NO: 9288428 - DNA, 22 bp, Homo sapiens
gcctctggggcagctgagtcat

SEQ ID NO: 9288429 - DNA, 22 bp, Homo sapiens
gcctctggggttaatagagttt

SEQ ID NO: 9288430 - DNA, 22 bp, Homo sapiens
gcctctggggtggagcccagca

SEQ ID NO: 9288431 - DNA, 22 bp, Homo sapiens
gcctctggtccctcatgctgtg

SEQ ID NO: 9288432 - DNA, 22 bp, Homo sapiens
gcctctgggttggtgacaggct

SEQ ID NO: 9288433 - DNA, 22 bp, Homo sapiens
gcctctgggtgacgaaaggtga

SEQ ID NO: 9288434 - DNA, 20 bp, Homo sapiens
gcctgagctattgccaggat

SEQ ID NO: 9288435 - DNA, 22 bp, Homo sapiens
gcctgagccgcctgagcggcgg

SEQ ID NO: 9288436 - DNA, 22 bp, Homo sapiens
gccttggccttcctaggcctga

SEQ ID NO: 9288437 - DNA, 22 bp, Homo sapiens
gccttggcccacagtgctcctg

SEQ ID NO: 9288438 - DNA, 19 bp, Homo sapiens
gccttggcattctctgctt

SEQ ID NO: 9288439 - DNA, 22 bp, Homo sapiens
gccttggcaggctgataacatg

SEQ ID NO: 9288440 - DNA, 22 bp, Homo sapiens
gccttggccaacaccttgcaaa

SEQ ID NO: 9288441 - DNA, 22 bp, Homo sapiens
gccttggctgatgtgcgaatga

SEQ ID NO: 9288442 - DNA, 22 bp, Homo sapiens
gccttggctccagccctttccg

SEQ ID NO: 9288443 - DNA, 23 bp, Homo sapiens
gccttggcgatccgtggggcatc

SEQ ID NO: 9288444 - DNA, 22 bp, Homo sapiens
gccttggctgccaagctgctga

SEQ ID NO: 9288445 - DNA, 22 bp, Homo sapiens
gccttggctgttggagcttgat

SEQ ID NO: 9288446 - DNA, 22 bp, Homo sapiens
gctcagctacttacaggtggct

SEQ ID NO: 9288447 - DNA, 18 bp, Homo sapiens
gctcagctatgggaggtt

SEQ ID NO: 9288448 - DNA, 22 bp, Homo sapiens
gctcagctatcagtgttcctga

SEQ ID NO: 9288449 - DNA, 22 bp, Homo sapiens
gctcagctgagcgaaggacatg

SEQ ID NO: 9288450 - DNA, 22 bp, Homo sapiens
gctcagctgagcgaaggacatg

SEQ ID NO: 9288451 - DNA, 22 bp, Homo sapiens
gctccaggtgtcccaggtaaaa

SEQ ID NO: 9288452 - DNA, 22 bp, Homo sapiens
gctcccacaaccttcttgctcc

SEQ ID NO: 9288453 - DNA, 20 bp, Homo sapiens
gctccaggtcagagaggacg

SEQ ID NO: 9288454 - DNA, 22 bp, Homo sapiens
gctcccacgcaattcttttcag

SEQ ID NO: 9288455 - DNA, 22 bp, Homo sapiens
gctcccactgcagccctgagcc

SEQ ID NO: 9288456 - DNA, 22 bp, Homo sapiens
gctcccaccttaaccttcacat

SEQ ID NO: 9288457 - DNA, 22 bp, Homo sapiens
gctcccacctttgctatcagta

SEQ ID NO: 9288458 - DNA, 22 bp, Homo sapiens
gctcccacctccagcctgagtt

SEQ ID NO: 9288459 - DNA, 22 bp, Homo sapiens
gctcccaccgccgctatgggta

SEQ ID NO: 9288460 - DNA, 22 bp, Homo sapiens
gctcccaccaggcagacctacc

SEQ ID NO: 9288461 - DNA, 22 bp, Homo sapiens
gctgagggaggctgaactgagt

SEQ ID NO: 9288462 - DNA, 22 bp, Homo sapiens
gctccgtgggcattgctaggtg

SEQ ID NO: 9288463 - DNA, 22 bp, Homo sapiens
gctctgggaactgactgccttc

SEQ ID NO: 9288464 - DNA, 22 bp, Homo sapiens
gctctgggaagtcctttaccat

SEQ ID NO: 9288465 - DNA, 22 bp, Homo sapiens
gctctggggatgcttctgccgt

SEQ ID NO: 9288466 - DNA, 22 bp, Homo sapiens
gctctgggccatcctggccggg

SEQ ID NO: 9288467 - DNA, 22 bp, Homo sapiens
gctgctagacagcatgtgagct

SEQ ID NO: 9288468 - DNA, 22 bp, Homo sapiens
gctgctaagcgtttctgttcca

SEQ ID NO: 9288469 - DNA, 20 bp, Homo sapiens
gctgcggttacagagacaca

SEQ ID NO: 9288470 - DNA, 22 bp, Homo sapiens
gctgcgccggatcccacgttcc

SEQ ID NO: 9288471 - DNA, 22 bp, Homo sapiens
gctgcctgtgtggccactcact

SEQ ID NO: 9288472 - DNA, 22 bp, Homo sapiens
gctgctcagtgggcctgagcct

SEQ ID NO: 9288473 - DNA, 22 bp, Homo sapiens
gctgcttcctttcctgctgacc

SEQ ID NO: 9288474 - DNA, 22 bp, Homo sapiens
gctgctttaactggacggctcc

SEQ ID NO: 9288475 - DNA, 22 bp, Homo sapiens
gctgagggcatgtgtggcgact

SEQ ID NO: 9288476 - DNA, 22 bp, Homo sapiens
gctgagggctgtaacagcagag

SEQ ID NO: 9288477 - DNA, 22 bp, Homo sapiens
gctggagaacccaggaggaaga

SEQ ID NO: 9288478 - DNA, 22 bp, Homo sapiens
gctgctttaggttgagctcagc

SEQ ID NO: 9288479 - DNA, 22 bp, Homo sapiens
gctgctttataatctcggcaga

SEQ ID NO: 9288480 - DNA, 20 bp, Homo sapiens
gctgctttcaaatgacacgt

SEQ ID NO: 9288481 - DNA, 19 bp, Homo sapiens
gctgggcttgggtttgtag

SEQ ID NO: 9288482 - DNA, 22 bp, Homo sapiens
gctggggaggcagcagagaaca

SEQ ID NO: 9288483 - DNA, 19 bp, Homo sapiens
gctggggcctgaccagaca

SEQ ID NO: 9288484 - DNA, 22 bp, Homo sapiens
gctggggctgggctgaggaaga

SEQ ID NO: 9288485 - DNA, 22 bp, Homo sapiens
gctgtggcttgcagctggggct

SEQ ID NO: 9288486 - DNA, 22 bp, Homo sapiens
gctgtgggccatggccaagtga

SEQ ID NO: 9288487 - DNA, 18 bp, Homo sapiens
gctttatttcttggggaa

SEQ ID NO: 9288488 - DNA, 22 bp, Homo sapiens
gctttatgtaagtccaaaggca

SEQ ID NO: 9288489 - DNA, 18 bp, Homo sapiens
gctttatttcttggggaa

SEQ ID NO: 9288490 - DNA, 22 bp, Homo sapiens
gctttatgtgagtagcactgtc

SEQ ID NO: 9288491 - DNA, 22 bp, Homo sapiens
gctgtgtatcagatgccacggg

SEQ ID NO: 9288492 - DNA, 22 bp, Homo sapiens
ggaccagtggcagggtgctgtg

SEQ ID NO: 9288493 - DNA, 20 bp, Homo sapiens
ggaccagctgtctgaggggc

SEQ ID NO: 9288494 - DNA, 22 bp, Homo sapiens
ggacacagctgcagccacaccc

SEQ ID NO: 9288495 - DNA, 22 bp, Homo sapiens
ggacacaggcagctgggtgggt

SEQ ID NO: 9288496 - DNA, 22 bp, Homo sapiens
ggacagggtaagtactagtgtg

SEQ ID NO: 9288497 - DNA, 22 bp, Homo sapiens
ggacagggttggggcatataaa

SEQ ID NO: 9288498 - DNA, 22 bp, Homo sapiens
ggacaggtgactgcccagagtg

SEQ ID NO: 9288499 - DNA, 22 bp, Homo sapiens
ggacacagtggaagacagcttg

SEQ ID NO: 9288500 - DNA, 22 bp, Homo sapiens
ggacaggtgtgaggctggcaca

SEQ ID NO: 9288501 - DNA, 22 bp, Homo sapiens
ggacaggtgtgaggctggcaca

SEQ ID NO: 9288502 - DNA, 22 bp, Homo sapiens
ggacaggtgcaaagggcacatg

SEQ ID NO: 9288503 - DNA, 22 bp, Homo sapiens
ggacagtattcattggagagaa

SEQ ID NO: 9288504 - DNA, 22 bp, Homo sapiens
ggacaggttcagcagtttataa

SEQ ID NO: 9288505 - DNA, 22 bp, Homo sapiens
ggacagtgtctgcttcaggccc

SEQ ID NO: 9288506 - DNA, 22 bp, Homo sapiens
ggacagtggcctggtggtatag

SEQ ID NO: 9288507 - DNA, 22 bp, Homo sapiens
ggagcagggaattacagcgcag

SEQ ID NO: 9288508 - DNA, 22 bp, Homo sapiens
ggagacagtgacttagagactg

SEQ ID NO: 9288509 - DNA, 22 bp, Homo sapiens
ggagactcgggttctagccttg

SEQ ID NO: 9288510 - DNA, 22 bp, Homo sapiens
ggagagaaattgaggtagcaag

SEQ ID NO: 9288511 - DNA, 22 bp, Homo sapiens
ggagagaactgacctgaaagga

SEQ ID NO: 9288512 - DNA, 22 bp, Homo sapiens
ggagagaattccatggacatgt

SEQ ID NO: 9288513 - DNA, 22 bp, Homo sapiens
ggagagaattccatggacatgt

SEQ ID NO: 9288514 - DNA, 22 bp, Homo sapiens
gctttgctggcttgaaatgctg

SEQ ID NO: 9288515 - DNA, 22 bp, Homo sapiens
gctttgcttcctgttctagcct

SEQ ID NO: 9288516 - DNA, 22 bp, Homo sapiens
gctttattttgtgagggattac

SEQ ID NO: 9288517 - DNA, 22 bp, Homo sapiens
gctttattttgtgagggattac

SEQ ID NO: 9288518 - DNA, 22 bp, Homo sapiens
ggaagaggctctcattgagggc

SEQ ID NO: 9288519 - DNA, 22 bp, Homo sapiens
ggaagacagaagcctacagctt

SEQ ID NO: 9288520 - DNA, 22 bp, Homo sapiens
ggaagacaagcagtggctgagc

SEQ ID NO: 9288521 - DNA, 17 bp, Homo sapiens
ggacacagctcatggct

SEQ ID NO: 9288522 - DNA, 22 bp, Homo sapiens
cttattttgctgatgacccagg

SEQ ID NO: 9288523 - DNA, 22 bp, Homo sapiens
cttattgaaagcccctgtgcct

SEQ ID NO: 9288524 - DNA, 22 bp, Homo sapiens
cttatcagattatctgggctgt

SEQ ID NO: 9288525 - DNA, 20 bp, Homo sapiens
cttcaggacccatcctcccc

SEQ ID NO: 9288526 - DNA, 22 bp, Homo sapiens
cttgactctgtgatgaccttga

SEQ ID NO: 9288527 - DNA, 22 bp, Homo sapiens
cttcctgcatggagtctgaatg

SEQ ID NO: 9288528 - DNA, 22 bp, Homo sapiens
cttcctgcaggacagccatctg

SEQ ID NO: 9288529 - DNA, 22 bp, Homo sapiens
cttgtagacccctggactcacg

SEQ ID NO: 9288530 - DNA, 22 bp, Homo sapiens
cttgtagacccctggactcacg

SEQ ID NO: 9288531 - DNA, 22 bp, Homo sapiens
cttgtattaagcttagagaggc

SEQ ID NO: 9288532 - DNA, 22 bp, Homo sapiens
cttgtattcccctatctctaaa

SEQ ID NO: 9288533 - DNA, 22 bp, Homo sapiens
cttgtcctttacttgagactca

SEQ ID NO: 9288534 - DNA, 22 bp, Homo sapiens
ctgtgagtcttcagcaagtgtt

SEQ ID NO: 9288535 - DNA, 22 bp, Homo sapiens
ctgtgagggccagagtcagggc

SEQ ID NO: 9288536 - DNA, 22 bp, Homo sapiens
ctgtgtcctgcgtcaagccaat

SEQ ID NO: 9288537 - DNA, 22 bp, Homo sapiens
ctgtgtcctgtctcctaaggtg

SEQ ID NO: 9288538 - DNA, 22 bp, Homo sapiens
ctgtgtcctttaaaaaagacac

SEQ ID NO: 9288539 - DNA, 22 bp, Homo sapiens
ctgtgtcctcccgctgcaccca

SEQ ID NO: 9288540 - DNA, 22 bp, Homo sapiens
ctgtgtccttttagttgctgtg

SEQ ID NO: 9288541 - DNA, 22 bp, Homo sapiens
ctgtgtagagcggctgcgagcg

SEQ ID NO: 9288542 - DNA, 22 bp, Homo sapiens
ctgttctatcattaaaagctat

SEQ ID NO: 9288543 - DNA, 22 bp, Homo sapiens
ctgttgcttcaggaaacagtaa

SEQ ID NO: 9288544 - DNA, 22 bp, Homo sapiens
ctgttgctccagggaacacaga

SEQ ID NO: 9288545 - DNA, 18 bp, Homo sapiens
ctgttgagatgtggctga

SEQ ID NO: 9288546 - DNA, 22 bp, Homo sapiens
ctggctcttgcgactcagcttg

SEQ ID NO: 9288547 - DNA, 22 bp, Homo sapiens
ctggccaggccccttgcagggc

SEQ ID NO: 9288548 - DNA, 22 bp, Homo sapiens
ctggccaggcatcccctgatcc

SEQ ID NO: 9288549 - DNA, 19 bp, Homo sapiens
ctggccaggccaggggccc

SEQ ID NO: 9288550 - DNA, 22 bp, Homo sapiens
ctggccagctgacagcagggct

SEQ ID NO: 9288551 - DNA, 22 bp, Homo sapiens
ctggccaggaggtaaccagatg

SEQ ID NO: 9288552 - DNA, 22 bp, Homo sapiens
ctggccagcctgtcgatgccct

SEQ ID NO: 9288553 - DNA, 22 bp, Homo sapiens
ctggccagcctcccaggtaccc

SEQ ID NO: 9288554 - DNA, 22 bp, Homo sapiens
ctggccagagttggagggtgtg

SEQ ID NO: 9288555 - DNA, 22 bp, Homo sapiens
ctggccagcatttttgctttag

SEQ ID NO: 9288556 - DNA, 22 bp, Homo sapiens
ctggccagcatggctgaagtac

SEQ ID NO: 9288557 - DNA, 22 bp, Homo sapiens
ctggccagatgttacgtccaat

SEQ ID NO: 9288558 - DNA, 22 bp, Homo sapiens
ctggcaggagcattcacagagg

SEQ ID NO: 9288559 - DNA, 22 bp, Homo sapiens
ctgccagcagaggccagcgctg

SEQ ID NO: 9288560 - DNA, 22 bp, Homo sapiens
ctgcatccatgttgctgcaaag

SEQ ID NO: 9288561 - DNA, 22 bp, Homo sapiens
ctgggaggcactattcaggagg

SEQ ID NO: 9288562 - DNA, 22 bp, Homo sapiens
ctgggaggcagaggttgcagtg

SEQ ID NO: 9288563 - DNA, 22 bp, Homo sapiens
ctgggaggcccacgttgggaag

SEQ ID NO: 9288564 - DNA, 22 bp, Homo sapiens
ctgggaggcagtctctctagaa

SEQ ID NO: 9288565 - DNA, 22 bp, Homo sapiens
ctgggcaggagaggtggttgga

SEQ ID NO: 9288566 - DNA, 23 bp, Homo sapiens
ctgggcatggagcttcagaggct

SEQ ID NO: 9288567 - DNA, 22 bp, Homo sapiens
ctggctttgaaatgcatttcag

SEQ ID NO: 9288568 - DNA, 18 bp, Homo sapiens
ctggctttcttatccatc

SEQ ID NO: 9288569 - DNA, 22 bp, Homo sapiens
ctggctttgaaggtctttccta

SEQ ID NO: 9288570 - DNA, 22 bp, Homo sapiens
ctggctttgtatagttccctga

SEQ ID NO: 9288571 - DNA, 22 bp, Homo sapiens
ctgggaggcaccgcgtcgtgct

SEQ ID NO: 9288572 - DNA, 22 bp, Homo sapiens
ctgggctgcaggagtggggcaa

SEQ ID NO: 9288573 - DNA, 22 bp, Homo sapiens
ctgggctgcggtggtaggttgt

SEQ ID NO: 9288574 - DNA, 22 bp, Homo sapiens
ctgggctgcttgctgaaggggt

SEQ ID NO: 9288575 - DNA, 22 bp, Homo sapiens
ctggggctctctggaatgcttg

SEQ ID NO: 9288576 - DNA, 22 bp, Homo sapiens
ctggggctgcagcgatcttcat

SEQ ID NO: 9288577 - DNA, 22 bp, Homo sapiens
ctggggcattgggagaggcctg

SEQ ID NO: 9288578 - DNA, 22 bp, Homo sapiens
ctggggctgcggtggaggagcc

SEQ ID NO: 9288579 - DNA, 22 bp, Homo sapiens
ctggggtgtgctcagagcaggg

SEQ ID NO: 9288580 - DNA, 22 bp, Homo sapiens
ctggggttggccagggccctag

SEQ ID NO: 9288581 - DNA, 22 bp, Homo sapiens
gacccagtgactcgtctctgtg

SEQ ID NO: 9288582 - DNA, 22 bp, Homo sapiens
gacccatataggaccctccaaa

SEQ ID NO: 9288583 - DNA, 22 bp, Homo sapiens
gacctatttaagtgtagttcaa

SEQ ID NO: 9288584 - DNA, 22 bp, Homo sapiens
gaccctttggaggtagtcacca

SEQ ID NO: 9288585 - DNA, 22 bp, Homo sapiens
gacaggtggggaaactaaggta

SEQ ID NO: 9288586 - DNA, 22 bp, Homo sapiens
gacaggtgggtacctttatgga

SEQ ID NO: 9288587 - DNA, 18 bp, Homo sapiens
gacaggtgggtgagacca

SEQ ID NO: 9288588 - DNA, 22 bp, Homo sapiens
gacaggtgctaagggacctggc

SEQ ID NO: 9288589 - DNA, 22 bp, Homo sapiens
gacaggtgggttctcgtatctg

SEQ ID NO: 9288590 - DNA, 22 bp, Homo sapiens
gacaggtgtgtgtatattaggg

SEQ ID NO: 9288591 - DNA, 22 bp, Homo sapiens
gacaggtgtgatgatttaggct

SEQ ID NO: 9288592 - DNA, 21 bp, Homo sapiens
gacaggtgattcagagcaggg

SEQ ID NO: 9288593 - DNA, 20 bp, Homo sapiens
gacaggtgctaaagaggggc

SEQ ID NO: 9288594 - DNA, 22 bp, Homo sapiens
gacaggtgaaacagcaaggtaa

SEQ ID NO: 9288595 - DNA, 22 bp, Homo sapiens
gacaggtatttgagagctggga

SEQ ID NO: 9288596 - DNA, 22 bp, Homo sapiens
gacaggtgagatgaggaacacc

SEQ ID NO: 9288597 - DNA, 22 bp, Homo sapiens
gacagggtccaaaggcagggga

SEQ ID NO: 9288598 - DNA, 22 bp, Homo sapiens
gacagggtacgggctaggcaca

SEQ ID NO: 9288599 - DNA, 22 bp, Homo sapiens
gacacagaaggtcacatgttca

SEQ ID NO: 9288600 - DNA, 22 bp, Homo sapiens
gacacagacagttagaggtaat

SEQ ID NO: 9288601 - DNA, 22 bp, Homo sapiens
gacacagaatttactcccgata

SEQ ID NO: 9288602 - DNA, 22 bp, Homo sapiens
gacagggacacagccagtgagg

SEQ ID NO: 9288603 - DNA, 22 bp, Homo sapiens
gacaggctgtgatggccgggag

SEQ ID NO: 9288604 - DNA, 22 bp, Homo sapiens
gacaggcttcatgatggcagga

SEQ ID NO: 9288605 - DNA, 22 bp, Homo sapiens
gaatatcccgctatgcaaagta

SEQ ID NO: 9288606 - DNA, 22 bp, Homo sapiens
gaatacatgtgtgtatagaggt

SEQ ID NO: 9288607 - DNA, 22 bp, Homo sapiens
gaaccacaagattcaaaggggt

SEQ ID NO: 9288608 - DNA, 21 bp, Homo sapiens
gaacatttgggttgtttctac

SEQ ID NO: 9288609 - DNA, 22 bp, Homo sapiens
gaagacaattctgggtggagga

SEQ ID NO: 9288610 - DNA, 22 bp, Homo sapiens
gaagacaagctgagtgttgtcc

SEQ ID NO: 9288611 - DNA, 22 bp, Homo sapiens
gaagacacaattggtgggtcca

SEQ ID NO: 9288612 - DNA, 20 bp, Homo sapiens
gaagacacagagttcatctc

SEQ ID NO: 9288613 - DNA, 21 bp, Homo sapiens
gaagacacataacctctctcc

SEQ ID NO: 9288614 - DNA, 22 bp, Homo sapiens
gaaccatgagaaattgctattt

SEQ ID NO: 9288615 - DNA, 22 bp, Homo sapiens
gaagacactctgcagagttatc

SEQ ID NO: 9288616 - DNA, 22 bp, Homo sapiens
gaagacactaaggcccagggag

SEQ ID NO: 9288617 - DNA, 22 bp, Homo sapiens
gaagacactaaactggggcttc

SEQ ID NO: 9288618 - DNA, 22 bp, Homo sapiens
gaagacacctactgtcatttct

SEQ ID NO: 9288619 - DNA, 22 bp, Homo sapiens
gaagacatgtttttaatatgta

SEQ ID NO: 9288620 - DNA, 22 bp, Homo sapiens
gaagacatgtggattctagttt

SEQ ID NO: 9288621 - DNA, 22 bp, Homo sapiens
gaagacattttatgcatactct

SEQ ID NO: 9288622 - DNA, 22 bp, Homo sapiens
gaagaccaatttgggccatggc

SEQ ID NO: 9288623 - DNA, 22 bp, Homo sapiens
gaagagctgcacactggggact

SEQ ID NO: 9288624 - DNA, 22 bp, Homo sapiens
gaagagaagcatcaataggtaa

SEQ ID NO: 9288625 - DNA, 22 bp, Homo sapiens
gaagagaaaggcaaggagtttt

SEQ ID NO: 9288626 - DNA, 22 bp, Homo sapiens
gaagattgaaggctgggaatta

SEQ ID NO: 9288627 - DNA, 22 bp, Homo sapiens
gaacaggaacatattggctctc

SEQ ID NO: 9288628 - DNA, 22 bp, Homo sapiens
gaacagcttcttgggagctggg

SEQ ID NO: 9288629 - DNA, 22 bp, Homo sapiens
gaacagctgctagagatctgtg

SEQ ID NO: 9288630 - DNA, 22 bp, Homo sapiens
gaaatatttctcttgagcccct

SEQ ID NO: 9288631 - DNA, 22 bp, Homo sapiens
gaaatcaaacccttttctgata

SEQ ID NO: 9288632 - DNA, 22 bp, Homo sapiens
gaaatcaatttcttggttgata

SEQ ID NO: 9288633 - DNA, 22 bp, Homo sapiens
gaaatcaaggctacattcaggt

SEQ ID NO: 9288634 - DNA, 22 bp, Homo sapiens
ctttcattcttagatattagtg

SEQ ID NO: 9288635 - DNA, 23 bp, Homo sapiens
ctttcattgtggtttcacagagc

SEQ ID NO: 9288636 - DNA, 23 bp, Homo sapiens
ctttcattgtggtttcacagagc

SEQ ID NO: 9288637 - DNA, 22 bp, Homo sapiens
ctttcatttgataagaatgcca

SEQ ID NO: 9288638 - DNA, 22 bp, Homo sapiens
ctttcagaagaggacctttcca

SEQ ID NO: 9288639 - DNA, 22 bp, Homo sapiens
ctttcacataattgaccttgaa

SEQ ID NO: 9288640 - DNA, 22 bp, Homo sapiens
ctttcacagtcctgactgagcg

SEQ ID NO: 9288641 - DNA, 22 bp, Homo sapiens
ctttcacagctgtgcttatgat

SEQ ID NO: 9288642 - DNA, 18 bp, Homo sapiens
ctttcagatggatatgct

SEQ ID NO: 9288643 - DNA, 22 bp, Homo sapiens
gagccaagggttgccatggaga

SEQ ID NO: 9288644 - DNA, 22 bp, Homo sapiens
gagccaagggcgtgctggagag

SEQ ID NO: 9288645 - DNA, 22 bp, Homo sapiens
gagccaagatcgcaccactgca

SEQ ID NO: 9288646 - DNA, 22 bp, Homo sapiens
gagcatttttgtctgcatttta

SEQ ID NO: 9288647 - DNA, 22 bp, Homo sapiens
gagcagcagttgttacaatgat

SEQ ID NO: 9288648 - DNA, 22 bp, Homo sapiens
gagcagcatctccggcttaaag

SEQ ID NO: 9288649 - DNA, 22 bp, Homo sapiens
gagcagcaggtggggctggctt

SEQ ID NO: 9288650 - DNA, 18 bp, Homo sapiens
gagcagcaggatcaagaa

SEQ ID NO: 9288651 - DNA, 22 bp, Homo sapiens
gagcagcaggtggctgtgatgg

SEQ ID NO: 9288652 - DNA, 22 bp, Homo sapiens
gagcagcaggccaggttgcagg

SEQ ID NO: 9288653 - DNA, 22 bp, Homo sapiens
gagcagcaaagggagggtaaat

SEQ ID NO: 9288654 - DNA, 22 bp, Homo sapiens
gagcagcactgagttagcagct

SEQ ID NO: 9288655 - DNA, 22 bp, Homo sapiens
gagcagcaagcactcaaaggct

SEQ ID NO: 9288656 - DNA, 22 bp, Homo sapiens
gagcagcagattgtctccatgg

SEQ ID NO: 9288657 - DNA, 22 bp, Homo sapiens
gagcagcagctgggccaggttc

SEQ ID NO: 9288658 - DNA, 22 bp, Homo sapiens
gagcagcacttgaggcatgtca

SEQ ID NO: 9288659 - DNA, 22 bp, Homo sapiens
gagaattcttcaacaaagtatt

SEQ ID NO: 9288660 - DNA, 22 bp, Homo sapiens
gagaaggccaggaacccagtgt

SEQ ID NO: 9288661 - DNA, 22 bp, Homo sapiens
gagaggctgtgtgccattgttg

SEQ ID NO: 9288662 - DNA, 22 bp, Homo sapiens
gagaggctggtaaagtctgaac

SEQ ID NO: 9288663 - DNA, 22 bp, Homo sapiens
gagaggctgggttggagatcga

SEQ ID NO: 9288664 - DNA, 22 bp, Homo sapiens
gagaggcttaagggctgtgaag

SEQ ID NO: 9288665 - DNA, 22 bp, Homo sapiens
gagaggcttgtgtgaagaacaa

SEQ ID NO: 9288666 - DNA, 22 bp, Homo sapiens
gagaggctatgaggttctgtgt

SEQ ID NO: 9288667 - DNA, 22 bp, Homo sapiens
gagaggctcagggacttgctga

SEQ ID NO: 9288668 - DNA, 22 bp, Homo sapiens
gagaggcctgggcccgtgagct

SEQ ID NO: 9288669 - DNA, 22 bp, Homo sapiens
gagaggcctgggcccgtgagct

SEQ ID NO: 9288670 - DNA, 22 bp, Homo sapiens
gagaggccatggggtgggatgc

SEQ ID NO: 9288671 - DNA, 22 bp, Homo sapiens
gagaggccatggctgtgcagtg

SEQ ID NO: 9288672 - DNA, 22 bp, Homo sapiens
gagcttttcccgtctttctcgt

SEQ ID NO: 9288673 - DNA, 22 bp, Homo sapiens
gagcttttcttccagttaatga

SEQ ID NO: 9288674 - DNA, 22 bp, Homo sapiens
gagcttcaaatggacgaccttt

SEQ ID NO: 9288675 - DNA, 22 bp, Homo sapiens
gagcttcagaatttaacagact

SEQ ID NO: 9288676 - DNA, 22 bp, Homo sapiens
gagcttcacgggggacagcatt

SEQ ID NO: 9288677 - DNA, 22 bp, Homo sapiens
gagcttcatatgttgcagagaa

SEQ ID NO: 9288678 - DNA, 22 bp, Homo sapiens
gagcttcagctgccatgactgt

SEQ ID NO: 9288679 - DNA, 22 bp, Homo sapiens
gagctcttcctttcaggaggcc

SEQ ID NO: 9288680 - DNA, 22 bp, Homo sapiens
gagcctgatgaaacaggcagac

SEQ ID NO: 9288681 - DNA, 22 bp, Homo sapiens
gagctcttagatagggcaggaa

SEQ ID NO: 9288682 - DNA, 22 bp, Homo sapiens
gagctctaaccagggacaatta

SEQ ID NO: 9288683 - DNA, 22 bp, Homo sapiens
gaggcacatcacttggtgcatt

SEQ ID NO: 9288684 - DNA, 22 bp, Homo sapiens
gaggccagcgcgcagcactttt

SEQ ID NO: 9288685 - DNA, 22 bp, Homo sapiens
gaggccagctacccaagggtca

SEQ ID NO: 9288686 - DNA, 22 bp, Homo sapiens
gaggccagctacccaagggtca

SEQ ID NO: 9288687 - DNA, 22 bp, Homo sapiens
gaggccaggacatgaaagctga

SEQ ID NO: 9288688 - DNA, 22 bp, Homo sapiens
gaggaggaaaccctgttcctct

SEQ ID NO: 9288689 - DNA, 19 bp, Homo sapiens
gaggaggaaaactagtgta

SEQ ID NO: 9288690 - DNA, 22 bp, Homo sapiens
gaggaggaagttctctgtaggc

SEQ ID NO: 9288691 - DNA, 22 bp, Homo sapiens
gaggaggcactagttagtgaca

SEQ ID NO: 9288692 - DNA, 22 bp, Homo sapiens
gaggaggcacttgagcagatgt

SEQ ID NO: 9288693 - DNA, 22 bp, Homo sapiens
gaggaggctaagtgggctctgg

SEQ ID NO: 9288694 - DNA, 22 bp, Homo sapiens
gaggaggctatcagcaatcagg

SEQ ID NO: 9288695 - DNA, 22 bp, Homo sapiens
gaggagcttcagaggaatctta

SEQ ID NO: 9288696 - DNA, 22 bp, Homo sapiens
gaggagcttgaggctaggagcc

SEQ ID NO: 9288697 - DNA, 22 bp, Homo sapiens
gaggagcttgtgagaagatgtc

SEQ ID NO: 9288698 - DNA, 22 bp, Homo sapiens
gaggagctgttccctcacctct

SEQ ID NO: 9288699 - DNA, 19 bp, Homo sapiens
gaggagctatcggagacag

SEQ ID NO: 9288700 - DNA, 22 bp, Homo sapiens
gaggaaaatattcagggaggtt

SEQ ID NO: 9288701 - DNA, 22 bp, Homo sapiens
gaggaaaataacaactaagggc

SEQ ID NO: 9288702 - DNA, 22 bp, Homo sapiens
tttcctaaggctcattttaaaa

SEQ ID NO: 9288703 - DNA, 22 bp, Homo sapiens
tttcacataaatattatgccta

SEQ ID NO: 9288704 - DNA, 22 bp, Homo sapiens
tttcacagttagcatgaggact

SEQ ID NO: 9288705 - DNA, 20 bp, Homo sapiens
tttccactgtaatgtatgat

SEQ ID NO: 9288706 - DNA, 22 bp, Homo sapiens
tttcaatgtatgtctttctgag

SEQ ID NO: 9288707 - DNA, 22 bp, Homo sapiens
ctctctgagtggctgtactttc

SEQ ID NO: 9288708 - DNA, 22 bp, Homo sapiens
ctctctctatgcgttgttccta

SEQ ID NO: 9288709 - DNA, 22 bp, Homo sapiens
ctcccctccttaggtcttctag

SEQ ID NO: 9288710 - DNA, 22 bp, Homo sapiens
ctccccattgtgacctcatcca

SEQ ID NO: 9288711 - DNA, 22 bp, Homo sapiens
ctcccgtggatgttcttcagtc

SEQ ID NO: 9288712 - DNA, 22 bp, Homo sapiens
tttagtactgtttaaaaatgga

SEQ ID NO: 9288713 - DNA, 22 bp, Homo sapiens
tttattgttgttagtcataagt

SEQ ID NO: 9288714 - DNA, 22 bp, Homo sapiens
tttattgttgttagtcataagt

SEQ ID NO: 9288715 - DNA, 22 bp, Homo sapiens
tttattgttgggtcttaagctg

SEQ ID NO: 9288716 - DNA, 22 bp, Homo sapiens
tttattccatgtgtctatgacc

SEQ ID NO: 9288717 - DNA, 18 bp, Homo sapiens
ctcctccacagcccctgc

SEQ ID NO: 9288718 - DNA, 22 bp, Homo sapiens
tttatttaccttatgtcctcca

SEQ ID NO: 9288719 - DNA, 22 bp, Homo sapiens
ctcctggcactcagtgtggaag

SEQ ID NO: 9288720 - DNA, 22 bp, Homo sapiens
ctcctggcactgtcttgaccca

SEQ ID NO: 9288721 - DNA, 22 bp, Homo sapiens
ctcctggcaggctgagtgaaat

SEQ ID NO: 9288722 - DNA, 22 bp, Homo sapiens
ctcctggcagttccccttgtca

SEQ ID NO: 9288723 - DNA, 22 bp, Homo sapiens
ctcccaggcacagggaggagcc

SEQ ID NO: 9288724 - DNA, 22 bp, Homo sapiens
tttaatatccagtggatacaaa

SEQ ID NO: 9288725 - DNA, 22 bp, Homo sapiens
tttaatagggcccaatgagact

SEQ ID NO: 9288726 - DNA, 22 bp, Homo sapiens
ctcccaaggggtaagggagctg

SEQ ID NO: 9288727 - DNA, 22 bp, Homo sapiens
ctcccactcctggctcaccaca

SEQ ID NO: 9288728 - DNA, 22 bp, Homo sapiens
ctccacagcccctccagtggca

SEQ ID NO: 9288729 - DNA, 22 bp, Homo sapiens
ttgtacaaatgcatattcctgg

SEQ ID NO: 9288730 - DNA, 22 bp, Homo sapiens
ttgtacaacacatattctacag

SEQ ID NO: 9288731 - DNA, 22 bp, Homo sapiens
ttggtcagcactgatgtttcag

SEQ ID NO: 9288732 - DNA, 22 bp, Homo sapiens
ttgtacaaagatttcacagctc

SEQ ID NO: 9288733 - DNA, 22 bp, Homo sapiens
ttgtacaaaggatttggaagag

SEQ ID NO: 9288734 - DNA, 22 bp, Homo sapiens
ttgtacaaataggaacctctga

SEQ ID NO: 9288735 - DNA, 22 bp, Homo sapiens
ttctttcttagcaatctatggt

SEQ ID NO: 9288736 - DNA, 22 bp, Homo sapiens
ctcacaggtcatgtggtggctt

SEQ ID NO: 9288737 - DNA, 21 bp, Homo sapiens
ttgaaagtaaattcagcagct

SEQ ID NO: 9288738 - DNA, 22 bp, Homo sapiens
ctcatttagggggcatggtaca

SEQ ID NO: 9288739 - DNA, 22 bp, Homo sapiens
ttgaaatagatgcgtcagagat

SEQ ID NO: 9288740 - DNA, 22 bp, Homo sapiens
ttgaaagtaataactttgttca

SEQ ID NO: 9288741 - DNA, 22 bp, Homo sapiens
ttgaaagtctaggcttacagta

SEQ ID NO: 9288742 - DNA, 22 bp, Homo sapiens
ttgaaagttaggatttagctgg

SEQ ID NO: 9288743 - DNA, 22 bp, Homo sapiens
ttgaaagtgatggggaagatgg

SEQ ID NO: 9288744 - DNA, 22 bp, Homo sapiens
ttttaagttaatataattgagg

SEQ ID NO: 9288745 - DNA, 22 bp, Homo sapiens
ttttaatactgctattgtagga

SEQ ID NO: 9288746 - DNA, 22 bp, Homo sapiens
tttgtacatatataaaatctgt

SEQ ID NO: 9288747 - DNA, 22 bp, Homo sapiens
ttttaagatgctagtatttcag

SEQ ID NO: 9288748 - DNA, 22 bp, Homo sapiens
tttgtacacaggatgttataat

SEQ ID NO: 9288749 - DNA, 22 bp, Homo sapiens
tttgtacactgtctactatgaa

SEQ ID NO: 9288750 - DNA, 22 bp, Homo sapiens
ttttcacttaaggaatttcatg

SEQ ID NO: 9288751 - DNA, 22 bp, Homo sapiens
ttttcacttaaggaatttcatg

SEQ ID NO: 9288752 - DNA, 22 bp, Homo sapiens
ctcttcattagttcctgtccca

SEQ ID NO: 9288753 - DNA, 23 bp, Homo sapiens
ttttagtgactcctttatctgcc

SEQ ID NO: 9288754 - DNA, 22 bp, Homo sapiens
ctctgtttctcagcctatttcc

SEQ ID NO: 9288755 - DNA, 22 bp, Homo sapiens
ctctgcagaggcccaaggctga

SEQ ID NO: 9288756 - DNA, 21 bp, Homo sapiens
ctctgcccagggcctcctgcc

SEQ ID NO: 9288757 - DNA, 22 bp, Homo sapiens
tttgcaaagttatttagactca

SEQ ID NO: 9288758 - DNA, 22 bp, Homo sapiens
ctctgccctcgcacatctgcca

SEQ ID NO: 9288759 - DNA, 22 bp, Homo sapiens
tttgggaataattgcacagatt

SEQ ID NO: 9288760 - DNA, 20 bp, Homo sapiens
ctctgctttccacctttcag

SEQ ID NO: 9288761 - DNA, 20 bp, Homo sapiens
ctctgctttaggagagtcag

SEQ ID NO: 9288762 - DNA, 20 bp, Homo sapiens
ctctgctttaggagagtcag

SEQ ID NO: 9288763 - DNA, 22 bp, Homo sapiens
ctctgctttctcaaaccctgtg

SEQ ID NO: 9288764 - DNA, 22 bp, Homo sapiens
ctctgctttcctcttacacact

SEQ ID NO: 9288765 - DNA, 22 bp, Homo sapiens
ctctgctttttaaaaggagtcc

SEQ ID NO: 9288766 - DNA, 22 bp, Homo sapiens
ctctgctttttagggagcctag

SEQ ID NO: 9288767 - DNA, 22 bp, Homo sapiens
ctctgctttgtaagttgtgagg

SEQ ID NO: 9288768 - DNA, 22 bp, Homo sapiens
ctctgcttttatgtgccggcgc

SEQ ID NO: 9288769 - DNA, 22 bp, Homo sapiens
ctgagccagggccacacatgga

SEQ ID NO: 9288770 - DNA, 22 bp, Homo sapiens
ctgagccatgagcctgcgccca

SEQ ID NO: 9288771 - DNA, 21 bp, Homo sapiens
ctctttatatagtaaagatat

SEQ ID NO: 9288772 - DNA, 22 bp, Homo sapiens
ctctttcctcagccacagtcta

SEQ ID NO: 9288773 - DNA, 17 bp, Homo sapiens
ctctttataaagagtta

SEQ ID NO: 9288774 - DNA, 22 bp, Homo sapiens
ctctttctgattcgctgggacc

SEQ ID NO: 9288775 - DNA, 22 bp, Homo sapiens
ctgacagatgctgctggcagta

SEQ ID NO: 9288776 - DNA, 22 bp, Homo sapiens
ctgcaggcccccttcctggagt

SEQ ID NO: 9288777 - DNA, 22 bp, Homo sapiens
ctgcactgagctctcccagccc

SEQ ID NO: 9288778 - DNA, 19 bp, Homo sapiens
ccttcctccccagggccat

SEQ ID NO: 9288779 - DNA, 22 bp, Homo sapiens
ccttcctggctgtccgcctgat

SEQ ID NO: 9288780 - DNA, 22 bp, Homo sapiens
cctgtctctttcaatctgagag

SEQ ID NO: 9288781 - DNA, 22 bp, Homo sapiens
cctgtctgaatcatgatttcct

SEQ ID NO: 9288782 - DNA, 22 bp, Homo sapiens
cctgtctgcatgatccctgcca

SEQ ID NO: 9288783 - DNA, 22 bp, Homo sapiens
cctgtctgtcctttgcattctt

SEQ ID NO: 9288784 - DNA, 22 bp, Homo sapiens
cctgtctggggactccctgggt

SEQ ID NO: 9288785 - DNA, 19 bp, Homo sapiens
cctgtctgtcttcagctag

SEQ ID NO: 9288786 - DNA, 22 bp, Homo sapiens
cctgtgggttttctgtagaaat

SEQ ID NO: 9288787 - DNA, 22 bp, Homo sapiens
tgttacaagtcttgaggtactt

SEQ ID NO: 9288788 - DNA, 22 bp, Homo sapiens
cctggtggcttctgggtggacg

SEQ ID NO: 9288789 - DNA, 19 bp, Homo sapiens
tgtgtctctgtgtagcctg

SEQ ID NO: 9288790 - DNA, 22 bp, Homo sapiens
tgtgtctgaactagttgctctc

SEQ ID NO: 9288791 - DNA, 22 bp, Homo sapiens
tgtgtatacaacttataggagc

SEQ ID NO: 9288792 - DNA, 22 bp, Homo sapiens
cctgggagtgtgccatctctgt

SEQ ID NO: 9288793 - DNA, 22 bp, Homo sapiens
cctgggaggctgaggctgcagt

SEQ ID NO: 9288794 - DNA, 22 bp, Homo sapiens
tggggctgtccttagtctgaga

SEQ ID NO: 9288795 - DNA, 22 bp, Homo sapiens
tggggcagctccatctattcca

SEQ ID NO: 9288796 - DNA, 22 bp, Homo sapiens
ctcacagagctcatactgggag

SEQ ID NO: 9288797 - DNA, 22 bp, Homo sapiens
ctcacagcaaggaggtaaggta

SEQ ID NO: 9288798 - DNA, 22 bp, Homo sapiens
ctattaggttggtgcaaaagta

SEQ ID NO: 9288799 - DNA, 22 bp, Homo sapiens
ctagatgccaatttttatggat

SEQ ID NO: 9288800 - DNA, 21 bp, Homo sapiens
ttctctggataggccagtcct

SEQ ID NO: 9288801 - DNA, 22 bp, Homo sapiens
ctagccataccaggattaacaa

SEQ ID NO: 9288802 - DNA, 22 bp, Homo sapiens
ctagcaggtcaaaccagctgat

SEQ ID NO: 9288803 - DNA, 22 bp, Homo sapiens
ctatgagaagaaaacaagatta

SEQ ID NO: 9288804 - DNA, 22 bp, Homo sapiens
ttcctggctctctgttgcacag

SEQ ID NO: 9288805 - DNA, 22 bp, Homo sapiens
ttcctggctgaactgaactcct

SEQ ID NO: 9288806 - DNA, 22 bp, Homo sapiens
ttccaggactcgttctggctca

SEQ ID NO: 9288807 - DNA, 22 bp, Homo sapiens
ctaaatgacttccagtggttat

SEQ ID NO: 9288808 - DNA, 22 bp, Homo sapiens
ctactttaacatggaggcactt

SEQ ID NO: 9288809 - DNA, 22 bp, Homo sapiens
ctacttctgtgatgaaactaca

SEQ ID NO: 9288810 - DNA, 22 bp, Homo sapiens
ttctctggagagtatcttctta

SEQ ID NO: 9288811 - DNA, 22 bp, Homo sapiens
ttcacagaagaggtcacatttc

SEQ ID NO: 9288812 - DNA, 22 bp, Homo sapiens
ttcacagaatggcaagttatgg

SEQ ID NO: 9288813 - DNA, 22 bp, Homo sapiens
ttcacagaattgtcttgactgg

SEQ ID NO: 9288814 - DNA, 22 bp, Homo sapiens
ttcaggagtgtcaggagtgcct

SEQ ID NO: 9288815 - DNA, 22 bp, Homo sapiens
ttcagggagagcgggacgggtg

SEQ ID NO: 9288816 - DNA, 22 bp, Homo sapiens
ttcagggacttagtgtcagttt

SEQ ID NO: 9288817 - DNA, 17 bp, Homo sapiens
ctaaatacttgcgtttc

SEQ ID NO: 9288818 - DNA, 22 bp, Homo sapiens
ctaaatactagccttcagattt

SEQ ID NO: 9288819 - DNA, 22 bp, Homo sapiens
cgtaggatactcagtgctcatt

SEQ ID NO: 9288820 - DNA, 22 bp, Homo sapiens
cgtaggtggctcagcacctggg

SEQ ID NO: 9288821 - DNA, 22 bp, Homo sapiens
cggtcagttgccaggccctgcc

SEQ ID NO: 9288822 - DNA, 21 bp, Homo sapiens
ttcatcattggtaaaaagtgg

SEQ ID NO: 9288823 - DNA, 22 bp, Homo sapiens
cgtcagtgtaaaagacagcacc

SEQ ID NO: 9288824 - DNA, 22 bp, Homo sapiens
cgtcacttcttagtctattttc

SEQ ID NO: 9288825 - DNA, 22 bp, Homo sapiens
cgtattcactcaggacacatag

SEQ ID NO: 9288826 - DNA, 22 bp, Homo sapiens
cgcccaggctggagtgcagtgg

SEQ ID NO: 9288827 - DNA, 22 bp, Homo sapiens
cgcccaggctggagtgcagtga

SEQ ID NO: 9288828 - DNA, 22 bp, Homo sapiens
cgccccggacgtctgaccaaac

SEQ ID NO: 9288829 - DNA, 20 bp, Homo sapiens
ttaggaagtcacaatttcag

SEQ ID NO: 9288830 - DNA, 20 bp, Homo sapiens
ttaggaagtcacaatttcag

SEQ ID NO: 9288831 - DNA, 22 bp, Homo sapiens
ttaggaaggccttgaatgccag

SEQ ID NO: 9288832 - DNA, 22 bp, Homo sapiens
ttaggaaggacttggattctgg

SEQ ID NO: 9288833 - DNA, 22 bp, Homo sapiens
ttaggaagttatagtggaaatg

SEQ ID NO: 9288834 - DNA, 22 bp, Homo sapiens
ttaggaagtttcagaaaatgca

SEQ ID NO: 9288835 - DNA, 22 bp, Homo sapiens
ttaggaagtttcagaaaatgca

SEQ ID NO: 9288836 - DNA, 22 bp, Homo sapiens
ttaggaagtgtgtccagaagcg

SEQ ID NO: 9288837 - DNA, 22 bp, Homo sapiens
ttaggaagttatagtggaaatg

SEQ ID NO: 9288838 - DNA, 18 bp, Homo sapiens
ttaggaagtttctccgtc

SEQ ID NO: 9288839 - DNA, 22 bp, Homo sapiens
ttaggccacagggaaaatcaaa

SEQ ID NO: 9288840 - DNA, 22 bp, Homo sapiens
cgccagtggcagctggaacagg

SEQ ID NO: 9288841 - DNA, 22 bp, Homo sapiens
cgccaggcttggtagctcatgc

SEQ ID NO: 9288842 - DNA, 22 bp, Homo sapiens
cgcatacatagaaacacacaga

SEQ ID NO: 9288843 - DNA, 22 bp, Homo sapiens
cgcaggtgtgttttcaggacta

SEQ ID NO: 9288844 - DNA, 22 bp, Homo sapiens
cgcaggtgggcccttcattgat

SEQ ID NO: 9288845 - DNA, 22 bp, Homo sapiens
cgcaggtgttcagtaaatgtat

SEQ ID NO: 9288846 - DNA, 19 bp, Homo sapiens
cgcaggtggaaggagccgc

SEQ ID NO: 9288847 - DNA, 22 bp, Homo sapiens
cgcaggtgccggcagatggggt

SEQ ID NO: 9288848 - DNA, 22 bp, Homo sapiens
tagaaaatgttccactgccatt

SEQ ID NO: 9288849 - DNA, 22 bp, Homo sapiens
tagaaaatagggcctgtggagc

SEQ ID NO: 9288850 - DNA, 22 bp, Homo sapiens
tagaaaatagggcctgtggagc

SEQ ID NO: 9288851 - DNA, 22 bp, Homo sapiens
tagaaaatccagtgtggggaga

SEQ ID NO: 9288852 - DNA, 22 bp, Homo sapiens
tagaaaatggccaagcaggact

SEQ ID NO: 9288853 - DNA, 22 bp, Homo sapiens
tagaaaatggccaagcaggact

SEQ ID NO: 9288854 - DNA, 22 bp, Homo sapiens
caggctgggaacgccacccgct

SEQ ID NO: 9288855 - DNA, 22 bp, Homo sapiens
caggctgtctgaatggaggccc

SEQ ID NO: 9288856 - DNA, 22 bp, Homo sapiens
caggcttgggagcagagccact

SEQ ID NO: 9288857 - DNA, 22 bp, Homo sapiens
caggctttactttctctctgaa

SEQ ID NO: 9288858 - DNA, 22 bp, Homo sapiens
caggctttttctgctgtcctct

SEQ ID NO: 9288859 - DNA, 22 bp, Homo sapiens
cagggaagaatagttagcaaag

SEQ ID NO: 9288860 - DNA, 22 bp, Homo sapiens
tagatacaggctctctgagcct

SEQ ID NO: 9288861 - DNA, 22 bp, Homo sapiens
tagattctggagagacagcagt

SEQ ID NO: 9288862 - DNA, 22 bp, Homo sapiens
cagggacaatggcagagcctga

SEQ ID NO: 9288863 - DNA, 22 bp, Homo sapiens
tacattgttcatgcatgagaaa

SEQ ID NO: 9288864 - DNA, 22 bp, Homo sapiens
tactttattgtaaatgctgatg

SEQ ID NO: 9288865 - DNA, 18 bp, Homo sapiens
tactttattccccctcca

SEQ ID NO: 9288866 - DNA, 22 bp, Homo sapiens
tactttattcaggaaggctggt

SEQ ID NO: 9288867 - DNA, 22 bp, Homo sapiens
tactttatcagcgtcaaaggta

SEQ ID NO: 9288868 - DNA, 22 bp, Homo sapiens
tactttatattgtggctggcca

SEQ ID NO: 9288869 - DNA, 22 bp, Homo sapiens
caggctaaggaaaggctcaggt

SEQ ID NO: 9288870 - DNA, 22 bp, Homo sapiens
gtgcttctcttcacacccaact

SEQ ID NO: 9288871 - DNA, 22 bp, Homo sapiens
caggcaccccaggtgagcactg

SEQ ID NO: 9288872 - DNA, 22 bp, Homo sapiens
tacaaaagtaattacggttttt

SEQ ID NO: 9288873 - DNA, 22 bp, Homo sapiens
tacaaaaggaagagggatctta

SEQ ID NO: 9288874 - DNA, 21 bp, Homo sapiens
caggccaaaaggttcaacatt

SEQ ID NO: 9288875 - DNA, 22 bp, Homo sapiens
tacaaaaaattgatactgacga

SEQ ID NO: 9288876 - DNA, 22 bp, Homo sapiens
caggccagggttgagaagagaa

SEQ ID NO: 9288877 - DNA, 19 bp, Homo sapiens
caggccagtgtcagggggc

SEQ ID NO: 9288878 - DNA, 22 bp, Homo sapiens
caggccagtgggaaatagggat

SEQ ID NO: 9288879 - DNA, 22 bp, Homo sapiens
caggccaggtggcaggcaaaac

SEQ ID NO: 9288880 - DNA, 22 bp, Homo sapiens
taatgtcaaggtgatagatttg

SEQ ID NO: 9288881 - DNA, 22 bp, Homo sapiens
taatgtgtgtcatcagtagagt

SEQ ID NO: 9288882 - DNA, 22 bp, Homo sapiens
taatcacagaaacagactgttt

SEQ ID NO: 9288883 - DNA, 22 bp, Homo sapiens
taatgtcaaggtcattctagag

SEQ ID NO: 9288884 - DNA, 20 bp, Homo sapiens
taatgtcaaagtcacaaggt

SEQ ID NO: 9288885 - DNA, 22 bp, Homo sapiens
taatgtataacaaatactcatc

SEQ ID NO: 9288886 - DNA, 22 bp, Homo sapiens
taatgtatttgttcagaagagt

SEQ ID NO: 9288887 - DNA, 22 bp, Homo sapiens
taatgtacctccagatgttgta

SEQ ID NO: 9288888 - DNA, 22 bp, Homo sapiens
taatgtactgatgggaagtggt

SEQ ID NO: 9288889 - DNA, 22 bp, Homo sapiens
taatgtaaagaagatgtaggaa

SEQ ID NO: 9288890 - DNA, 22 bp, Homo sapiens
tcaagcagggtagcaagctggt

SEQ ID NO: 9288891 - DNA, 22 bp, Homo sapiens
tattttacatgacaggtgttta

SEQ ID NO: 9288892 - DNA, 22 bp, Homo sapiens
caggtgggtgtatgaatgcaaa

SEQ ID NO: 9288893 - DNA, 22 bp, Homo sapiens
caggtgggtgtatgaatgcaaa

SEQ ID NO: 9288894 - DNA, 19 bp, Homo sapiens
caggtggtaatctgagcct

SEQ ID NO: 9288895 - DNA, 22 bp, Homo sapiens
caggtggtcaggcaaggacacg

SEQ ID NO: 9288896 - DNA, 23 bp, Homo sapiens
caggtggtagagaaaaatccaga

SEQ ID NO: 9288897 - DNA, 22 bp, Homo sapiens
caggtggtacttaaagtcagaa

SEQ ID NO: 9288898 - DNA, 22 bp, Homo sapiens
cagtcacataggtatacacata

SEQ ID NO: 9288899 - DNA, 22 bp, Homo sapiens
tatttgaagattcttctgatgt

SEQ ID NO: 9288900 - DNA, 22 bp, Homo sapiens
cagtcagtaatgtggcacctgt

SEQ ID NO: 9288901 - DNA, 22 bp, Homo sapiens
caggtaagtctgtcctcacaag

SEQ ID NO: 9288902 - DNA, 22 bp, Homo sapiens
caggtagtccacagtgagggag

SEQ ID NO: 9288903 - DNA, 22 bp, Homo sapiens
caggtcagaggcgcagccccca

SEQ ID NO: 9288904 - DNA, 22 bp, Homo sapiens
caggtgaatcacttgagtccag

SEQ ID NO: 9288905 - DNA, 18 bp, Homo sapiens
caggtgggtctcctgccc

SEQ ID NO: 9288906 - DNA, 22 bp, Homo sapiens
caggtgggtacatcacagagac

SEQ ID NO: 9288907 - DNA, 22 bp, Homo sapiens
tattattaaatggcagaatttt

SEQ ID NO: 9288908 - DNA, 22 bp, Homo sapiens
cagggctcttccggagcaggga

SEQ ID NO: 9288909 - DNA, 22 bp, Homo sapiens
cagggctcttcatcacacagta

SEQ ID NO: 9288910 - DNA, 20 bp, Homo sapiens
cagggctctgggcctggcct

SEQ ID NO: 9288911 - DNA, 22 bp, Homo sapiens
caggggctgtttgcctcaggcc

SEQ ID NO: 9288912 - DNA, 22 bp, Homo sapiens
caggggtgtttttggccaggag

SEQ ID NO: 9288913 - DNA, 22 bp, Homo sapiens
cagggggtggtccaggctgcgc

SEQ ID NO: 9288914 - DNA, 22 bp, Homo sapiens
taggccagaggagcagctttgg

SEQ ID NO: 9288915 - DNA, 22 bp, Homo sapiens
taggccacgaaggagatgatag

SEQ ID NO: 9288916 - DNA, 22 bp, Homo sapiens
taggccactctcctttgtctca

SEQ ID NO: 9288917 - DNA, 22 bp, Homo sapiens
taggaggcttaaagctgctcag

SEQ ID NO: 9288918 - DNA, 18 bp, Homo sapiens
taggaggctcctgggggc

SEQ ID NO: 9288919 - DNA, 22 bp, Homo sapiens
taggaggccatccagcctgcct

SEQ ID NO: 9288920 - DNA, 22 bp, Homo sapiens
taggaggcatttgctcccaggg

SEQ ID NO: 9288921 - DNA, 22 bp, Homo sapiens
taggccaaatgacttgatgttt

SEQ ID NO: 9288922 - DNA, 22 bp, Homo sapiens
tagattgtagatcatgagactt

SEQ ID NO: 9288923 - DNA, 22 bp, Homo sapiens
cagggagcagcgctggggcctc

SEQ ID NO: 9288924 - DNA, 22 bp, Homo sapiens
cagggccagggacacgctgtca

SEQ ID NO: 9288925 - DNA, 22 bp, Homo sapiens
cagggccatatcttgtgcacca

SEQ ID NO: 9288926 - DNA, 22 bp, Homo sapiens
cagggccatgaggcacagggtc

SEQ ID NO: 9288927 - DNA, 20 bp, Homo sapiens
tccagctgggaacagctgat

SEQ ID NO: 9288928 - DNA, 20 bp, Homo sapiens
tccagctgggaacagctgat

SEQ ID NO: 9288929 - DNA, 22 bp, Homo sapiens
catggccacatctagctgcaag

SEQ ID NO: 9288930 - DNA, 22 bp, Homo sapiens
catggccaaggatgctcaacca

SEQ ID NO: 9288931 - DNA, 22 bp, Homo sapiens
catggccaaagaattatatttt

SEQ ID NO: 9288932 - DNA, 22 bp, Homo sapiens
catgcatgtttactacagtgac

SEQ ID NO: 9288933 - DNA, 22 bp, Homo sapiens
catgcatgtcagggatcctgga

SEQ ID NO: 9288934 - DNA, 22 bp, Homo sapiens
tcaggtgtatcatggagttgaa

SEQ ID NO: 9288935 - DNA, 22 bp, Homo sapiens
tcagggaggtgtctgccagaga

SEQ ID NO: 9288936 - DNA, 22 bp, Homo sapiens
tcagggagtgttggcaggatca

SEQ ID NO: 9288937 - DNA, 22 bp, Homo sapiens
catctgtctgcatgctctgggt

SEQ ID NO: 9288938 - DNA, 22 bp, Homo sapiens
catctgaagtgaattgcttttt

SEQ ID NO: 9288939 - DNA, 22 bp, Homo sapiens
catctgaatttgccttagtttc

SEQ ID NO: 9288940 - DNA, 22 bp, Homo sapiens
catctgtcacctgtgaatgttg

SEQ ID NO: 9288941 - DNA, 22 bp, Homo sapiens
catctgggttctcagatggata

SEQ ID NO: 9288942 - DNA, 22 bp, Homo sapiens
catctgctgttccttggactca

SEQ ID NO: 9288943 - DNA, 19 bp, Homo sapiens
catctggatgattctcctg

SEQ ID NO: 9288944 - DNA, 22 bp, Homo sapiens
tcaggctgtgggcactggccat

SEQ ID NO: 9288945 - DNA, 17 bp, Homo sapiens
tcaggctgtgcctggta

SEQ ID NO: 9288946 - DNA, 22 bp, Homo sapiens
tcaggcccttctcccaggactc

SEQ ID NO: 9288947 - DNA, 22 bp, Homo sapiens
tcaggccctttgctgctgcccc

SEQ ID NO: 9288948 - DNA, 22 bp, Homo sapiens
catagaaaagagtaggtaatgt

SEQ ID NO: 9288949 - DNA, 22 bp, Homo sapiens
cataatgtctgacacagtaaga

SEQ ID NO: 9288950 - DNA, 22 bp, Homo sapiens
cataatgtatgcattttccagc

SEQ ID NO: 9288951 - DNA, 22 bp, Homo sapiens
cataacatccttgctactttga

SEQ ID NO: 9288952 - DNA, 22 bp, Homo sapiens
cataatgtgtgtcatacagact

SEQ ID NO: 9288953 - DNA, 22 bp, Homo sapiens
cataatgttaatcttgactcca

SEQ ID NO: 9288954 - DNA, 22 bp, Homo sapiens
cataatgttgtaacacatagag

SEQ ID NO: 9288955 - DNA, 22 bp, Homo sapiens
tcaggcccagagtcacggatcc

SEQ ID NO: 9288956 - DNA, 22 bp, Homo sapiens
tcaggccaggagatcagattga

SEQ ID NO: 9288957 - DNA, 22 bp, Homo sapiens
cagttttggtgatatttgagaa

SEQ ID NO: 9288958 - DNA, 22 bp, Homo sapiens
cagttttcttgttatatttggg

SEQ ID NO: 9288959 - DNA, 22 bp, Homo sapiens
tcagatatagtcatttaaataa

SEQ ID NO: 9288960 - DNA, 22 bp, Homo sapiens
tcagatatgaattcatatctct

SEQ ID NO: 9288961 - DNA, 22 bp, Homo sapiens
cagttggtcttcccttggagca

SEQ ID NO: 9288962 - DNA, 22 bp, Homo sapiens
cagttggtgatgaggctagtag

SEQ ID NO: 9288963 - DNA, 22 bp, Homo sapiens
tcagagatcttcaggatgggac

SEQ ID NO: 9288964 - DNA, 22 bp, Homo sapiens
tcagagagttttcactagggtg

SEQ ID NO: 9288965 - DNA, 17 bp, Homo sapiens
tccttcagtgcctctgc

SEQ ID NO: 9288966 - DNA, 22 bp, Homo sapiens
tccttcagtgtcccgctcaggt

SEQ ID NO: 9288967 - DNA, 21 bp, Homo sapiens
tccttcagttctgcactttct

SEQ ID NO: 9288968 - DNA, 22 bp, Homo sapiens
tccttcccaggtgtcgccgcct

SEQ ID NO: 9288969 - DNA, 22 bp, Homo sapiens
tcctttaaagaactgtgctttt

SEQ ID NO: 9288970 - DNA, 22 bp, Homo sapiens
tcctttaaactcctttcaagtc

SEQ ID NO: 9288971 - DNA, 22 bp, Homo sapiens
tcctttaacttgattattttca

SEQ ID NO: 9288972 - DNA, 23 bp, Homo sapiens
tcctttaagatatcttattcctt

SEQ ID NO: 9288973 - DNA, 22 bp, Homo sapiens
tcctttcaccaaaaagtgttgt

SEQ ID NO: 9288974 - DNA, 22 bp, Homo sapiens
ccagacagttccttgaggttca

SEQ ID NO: 9288975 - DNA, 22 bp, Homo sapiens
ccaaggctggagtgcagtggcg

SEQ ID NO: 9288976 - DNA, 22 bp, Homo sapiens
ccaaggcttcccagagatgctc

SEQ ID NO: 9288977 - DNA, 22 bp, Homo sapiens
tcctggcactttgggggctcgc

SEQ ID NO: 9288978 - DNA, 22 bp, Homo sapiens
tcctggcacccttgggttggag

SEQ ID NO: 9288979 - DNA, 22 bp, Homo sapiens
tcctggcagagggcggcctcga

SEQ ID NO: 9288980 - DNA, 22 bp, Homo sapiens
tcctggcagaaatggggctgtg

SEQ ID NO: 9288981 - DNA, 20 bp, Homo sapiens
tcctaataacctgaagaaat

SEQ ID NO: 9288982 - DNA, 22 bp, Homo sapiens
tcctacagaaccaggctaggtg

SEQ ID NO: 9288983 - DNA, 22 bp, Homo sapiens
ccacacagtcagtttccaagaa

SEQ ID NO: 9288984 - DNA, 22 bp, Homo sapiens
ccacacagggggatgagttatt

SEQ ID NO: 9288985 - DNA, 22 bp, Homo sapiens
ccacactaaactgctcaaacca

SEQ ID NO: 9288986 - DNA, 19 bp, Homo sapiens
ccacacagtgtgcaattta

SEQ ID NO: 9288987 - DNA, 22 bp, Homo sapiens
tcctggcagggtctaggtctag

SEQ ID NO: 9288988 - DNA, 22 bp, Homo sapiens
tcctggcagcccgcaggtgctg

SEQ ID NO: 9288989 - DNA, 22 bp, Homo sapiens
tcctggcagtaatttgatgttg

SEQ ID NO: 9288990 - DNA, 22 bp, Homo sapiens
tcctgggagagtgggactgtat

SEQ ID NO: 9288991 - DNA, 22 bp, Homo sapiens
catttattcatgatctgtagct

SEQ ID NO: 9288992 - DNA, 22 bp, Homo sapiens
catttattctcagatccttgtc

SEQ ID NO: 9288993 - DNA, 22 bp, Homo sapiens
catttattcatttgctagggct

SEQ ID NO: 9288994 - DNA, 22 bp, Homo sapiens
catttattcagctcagtcggtt

SEQ ID NO: 9288995 - DNA, 22 bp, Homo sapiens
tccctctctagcctgttcagta

SEQ ID NO: 9288996 - DNA, 22 bp, Homo sapiens
tccctctccctattgcctggag

SEQ ID NO: 9288997 - DNA, 22 bp, Homo sapiens
catttattgagtggccacagtg

SEQ ID NO: 9288998 - DNA, 22 bp, Homo sapiens
tccctgctttcttgtgagggga

SEQ ID NO: 9288999 - DNA, 22 bp, Homo sapiens
tccctcctggccgtcaccgctg

SEQ ID NO: 9289000 - DNA, 22 bp, Homo sapiens
catttaatagatgctgtttcag

SEQ ID NO: 9289001 - DNA, 22 bp, Homo sapiens
catttaatccatagaggaatgt

SEQ ID NO: 9289002 - DNA, 22 bp, Homo sapiens
cattgtcctgtgggctccctgg

SEQ ID NO: 9289003 - DNA, 22 bp, Homo sapiens
tcccactcactgtctctgacac

SEQ ID NO: 9289004 - DNA, 22 bp, Homo sapiens
tcccactcccaggcaggcctct

SEQ ID NO: 9289005 - DNA, 22 bp, Homo sapiens
cattcatttatgaaatatctat

SEQ ID NO: 9289006 - DNA, 22 bp, Homo sapiens
cattctatgaaaactaggcaat

SEQ ID NO: 9289007 - DNA, 22 bp, Homo sapiens
cattagctcagatacctctgag

SEQ ID NO: 9289008 - DNA, 22 bp, Homo sapiens
cattacttctcatgcttcatgc

SEQ ID NO: 9289009 - DNA, 22 bp, Homo sapiens
cattacatttcaaaatgtttcc

SEQ ID NO: 9289010 - DNA, 22 bp, Homo sapiens
cattagaacctataaaaagcat

SEQ ID NO: 9289011 - DNA, 22 bp, Homo sapiens
tcccaccccctccaaggaggaa

SEQ ID NO: 9289012 - DNA, 22 bp, Homo sapiens
tcccaccccggtcaagggctga

SEQ ID NO: 9289013 - DNA, 22 bp, Homo sapiens
tcccaccccttgactctttaag

SEQ ID NO: 9289014 - DNA, 22 bp, Homo sapiens
tcccacccatcctgcatctctt

SEQ ID NO: 9289015 - DNA, 22 bp, Homo sapiens
tcccaccaggtgaccatttcat

SEQ ID NO: 9289016 - DNA, 22 bp, Homo sapiens
tcccacattaccctgactgaca

SEQ ID NO: 9289017 - DNA, 22 bp, Homo sapiens
tcccacatgtgaatcctcaggt

SEQ ID NO: 9289018 - DNA, 22 bp, Homo sapiens
tccaggagaggtagagggttcc

SEQ ID NO: 9289019 - DNA, 22 bp, Homo sapiens
tctgctttcttactaaaaatga

SEQ ID NO: 9289020 - DNA, 22 bp, Homo sapiens
tctgctttcaaattcacttagt

SEQ ID NO: 9289021 - DNA, 22 bp, Homo sapiens
tctgctttattacactagccaa

SEQ ID NO: 9289022 - DNA, 22 bp, Homo sapiens
tctgctttatggctcagagact

SEQ ID NO: 9289023 - DNA, 22 bp, Homo sapiens
tctgctttagtgcaaagtctta

SEQ ID NO: 9289024 - DNA, 22 bp, Homo sapiens
tctgctttagaatccagtagct

SEQ ID NO: 9289025 - DNA, 22 bp, Homo sapiens
tctgctttagacataaaaggta

SEQ ID NO: 9289026 - DNA, 22 bp, Homo sapiens
tctgctttcttgcgcagatgtg

SEQ ID NO: 9289027 - DNA, 22 bp, Homo sapiens
tctgctttgctgcctcctgatc

SEQ ID NO: 9289028 - DNA, 22 bp, Homo sapiens
tctgctttgaccttcttgatgc

SEQ ID NO: 9289029 - DNA, 22 bp, Homo sapiens
tctgctttgaccttcttgatgc

SEQ ID NO: 9289030 - DNA, 22 bp, Homo sapiens
tctgctttttcattgactgaaa

SEQ ID NO: 9289031 - DNA, 22 bp, Homo sapiens
ccagagagaaaatggagggcca

SEQ ID NO: 9289032 - DNA, 22 bp, Homo sapiens
ccagctctctgtcctccccaca

SEQ ID NO: 9289033 - DNA, 22 bp, Homo sapiens
ccagctctgcatgtttcccttg

SEQ ID NO: 9289034 - DNA, 22 bp, Homo sapiens
ccagctctgattttgacctcca

SEQ ID NO: 9289035 - DNA, 22 bp, Homo sapiens
ccagctgattcggtggtggttg

SEQ ID NO: 9289036 - DNA, 20 bp, Homo sapiens
ccagctgagccaaggggaga

SEQ ID NO: 9289037 - DNA, 22 bp, Homo sapiens
ccagctgaggcagccacacagg

SEQ ID NO: 9289038 - DNA, 22 bp, Homo sapiens
tctggcagcagcatcagtggct

SEQ ID NO: 9289039 - DNA, 22 bp, Homo sapiens
tctggcagcaagtctgtttctc

SEQ ID NO: 9289040 - DNA, 22 bp, Homo sapiens
tctggtcccttttcctgcagtc

SEQ ID NO: 9289041 - DNA, 22 bp, Homo sapiens
tctggtgtcagtattctttgaa

SEQ ID NO: 9289042 - DNA, 22 bp, Homo sapiens
tctgggagcagctcagcagatt

SEQ ID NO: 9289043 - DNA, 22 bp, Homo sapiens
tctgggagcctgaaagtgaatg

SEQ ID NO: 9289044 - DNA, 22 bp, Homo sapiens
tctggtaacctttatccctcct

SEQ ID NO: 9289045 - DNA, 22 bp, Homo sapiens
tctggtaactcagaagaaagga

SEQ ID NO: 9289046 - DNA, 22 bp, Homo sapiens
tctgggagatccaagcagaact

SEQ ID NO: 9289047 - DNA, 22 bp, Homo sapiens
tctgggagcacacgcagtgatc

SEQ ID NO: 9289048 - DNA, 22 bp, Homo sapiens
tctggcaggacatgctgaccat

SEQ ID NO: 9289049 - DNA, 22 bp, Homo sapiens
tctggcaggatatcgaagtgaa

SEQ ID NO: 9289050 - DNA, 22 bp, Homo sapiens
tctggcaggatatcgaagtgaa

SEQ ID NO: 9289051 - DNA, 22 bp, Homo sapiens
tctggcaggaccatgaagcgta

SEQ ID NO: 9289052 - DNA, 22 bp, Homo sapiens
tctggcaggcaatcggctctgg

SEQ ID NO: 9289053 - DNA, 21 bp, Homo sapiens
tctggcaggcacgggcccagc

SEQ ID NO: 9289054 - DNA, 22 bp, Homo sapiens
tctggcagctcagttcaggtct

SEQ ID NO: 9289055 - DNA, 22 bp, Homo sapiens
tctggcagctctcctcggcgga

SEQ ID NO: 9289056 - DNA, 21 bp, Homo sapiens
tctggcaggaagacggatggg

SEQ ID NO: 9289057 - DNA, 22 bp, Homo sapiens
tctggcagctatcctctggcca

SEQ ID NO: 9289058 - DNA, 22 bp, Homo sapiens
tctggcagcgaagcgtgtactt

SEQ ID NO: 9289059 - DNA, 21 bp, Homo sapiens
tctggcagcagtttgttgagt

SEQ ID NO: 9289060 - DNA, 22 bp, Homo sapiens
tctggcaggggttctgcacttg

SEQ ID NO: 9289061 - DNA, 22 bp, Homo sapiens
tctggcaggccttgtcaatctg

SEQ ID NO: 9289062 - DNA, 21 bp, Homo sapiens
ccaggctcctgaggctggtca

SEQ ID NO: 9289063 - DNA, 22 bp, Homo sapiens
ccaggctctgttccccgaggag

SEQ ID NO: 9289064 - DNA, 23 bp, Homo sapiens
ccaggctctttcacctgctattc

SEQ ID NO: 9289065 - DNA, 22 bp, Homo sapiens
ccaggctgaatatgttccaggg

SEQ ID NO: 9289066 - DNA, 22 bp, Homo sapiens
ccaggctggagtgcaatggtgc

SEQ ID NO: 9289067 - DNA, 22 bp, Homo sapiens
ccaggctgctgttggtgtccgc

SEQ ID NO: 9289068 - DNA, 18 bp, Homo sapiens
ccaggccatgaacctctg

SEQ ID NO: 9289069 - DNA, 22 bp, Homo sapiens
tctttcttattagccattgttc

SEQ ID NO: 9289070 - DNA, 22 bp, Homo sapiens
ccaggcccagggtactgaccaa

SEQ ID NO: 9289071 - DNA, 22 bp, Homo sapiens
ccaggagggaccgcggcatccc

SEQ ID NO: 9289072 - DNA, 22 bp, Homo sapiens
ccaggaggttgaggctgcagtg

SEQ ID NO: 9289073 - DNA, 22 bp, Homo sapiens
ccaggccagcaggcacacctgc

SEQ ID NO: 9289074 - DNA, 22 bp, Homo sapiens
tcttcccccgtgctccagtgca

SEQ ID NO: 9289075 - DNA, 22 bp, Homo sapiens
cccaccctcaagggtgtctata

SEQ ID NO: 9289076 - DNA, 22 bp, Homo sapiens
tgattcaagagagttggggtat

SEQ ID NO: 9289077 - DNA, 22 bp, Homo sapiens
tgattcaagattggttagctgt

SEQ ID NO: 9289078 - DNA, 22 bp, Homo sapiens
tgatttctcatattgttcaaaa

SEQ ID NO: 9289079 - DNA, 22 bp, Homo sapiens
ccattctgaagtgcaggctaag

SEQ ID NO: 9289080 - DNA, 22 bp, Homo sapiens
ccatgtgttgagattccagcct

SEQ ID NO: 9289081 - DNA, 22 bp, Homo sapiens
ccatgtgttgattctctgcaga

SEQ ID NO: 9289082 - DNA, 22 bp, Homo sapiens
ccattcatacaattttgttcta

SEQ ID NO: 9289083 - DNA, 22 bp, Homo sapiens
tgagggctgcttccagagctag

SEQ ID NO: 9289084 - DNA, 22 bp, Homo sapiens
tgagggctgcttccagagctag

SEQ ID NO: 9289085 - DNA, 22 bp, Homo sapiens
tgagggcaaagtggtgctgagg

SEQ ID NO: 9289086 - DNA, 22 bp, Homo sapiens
tgagggctaaattgtggcaggt

SEQ ID NO: 9289087 - DNA, 22 bp, Homo sapiens
tgaggtagtgtttagtccagtc

SEQ ID NO: 9289088 - DNA, 22 bp, Homo sapiens
tgaggtaggtggtaagagatac

SEQ ID NO: 9289089 - DNA, 22 bp, Homo sapiens
tgaggtaggtgtcgagagaggt

SEQ ID NO: 9289090 - DNA, 22 bp, Homo sapiens
tgaggtaggataagacaatgag

SEQ ID NO: 9289091 - DNA, 22 bp, Homo sapiens
ccatgtgtcgggcctgcagtgg

SEQ ID NO: 9289092 - DNA, 22 bp, Homo sapiens
ccatgtgtaaattagataactc

SEQ ID NO: 9289093 - DNA, 18 bp, Homo sapiens
ccatgtgttccttttggg

SEQ ID NO: 9289094 - DNA, 22 bp, Homo sapiens
ccatgtgttcaataagggagtt

SEQ ID NO: 9289095 - DNA, 22 bp, Homo sapiens
ccatgtgtctcccctggaagta

SEQ ID NO: 9289096 - DNA, 22 bp, Homo sapiens
ccatgtgggattttggtgtctg

SEQ ID NO: 9289097 - DNA, 22 bp, Homo sapiens
ccatgtggctgtgtggtttatt

SEQ ID NO: 9289098 - DNA, 22 bp, Homo sapiens
ccatgtgggattttggtgtctg

SEQ ID NO: 9289099 - DNA, 22 bp, Homo sapiens
ccaggctggagtgcagtagtgt

SEQ ID NO: 9289100 - DNA, 22 bp, Homo sapiens
ccaggctggagtgtagtcgcat

SEQ ID NO: 9289101 - DNA, 22 bp, Homo sapiens
tgacataataatccaaacatac

SEQ ID NO: 9289102 - DNA, 21 bp, Homo sapiens
tgagaagtatgtcttcagcca

SEQ ID NO: 9289103 - DNA, 22 bp, Homo sapiens
ccaggtggaaggtctgtgctct

SEQ ID NO: 9289104 - DNA, 19 bp, Homo sapiens
ccaggtggaactgaggtag

SEQ ID NO: 9289105 - DNA, 19 bp, Homo sapiens
ccaggtggaactgaggtag

SEQ ID NO: 9289106 - DNA, 17 bp, Homo sapiens
ccaggtggaatcgtgga

SEQ ID NO: 9289107 - DNA, 22 bp, Homo sapiens
ccaggtggaaggtctgtgctct

SEQ ID NO: 9289108 - DNA, 22 bp, Homo sapiens
ccaggtggacaaggctttcaca

SEQ ID NO: 9289109 - DNA, 22 bp, Homo sapiens
ccaggtggacggcgagtacagg

SEQ ID NO: 9289110 - DNA, 22 bp, Homo sapiens
ccaggtgtaggacaccaaggga

SEQ ID NO: 9289111 - DNA, 22 bp, Homo sapiens
ccaggtgtcatgcgtgtgaccc

SEQ ID NO: 9289112 - DNA, 22 bp, Homo sapiens
ccaggtgtcatggataatgggt

SEQ ID NO: 9289113 - DNA, 22 bp, Homo sapiens
ccaggtgtctgtggccagccct

SEQ ID NO: 9289114 - DNA, 22 bp, Homo sapiens
ccaggtgtgagcattctgtctt

SEQ ID NO: 9289115 - DNA, 22 bp, Homo sapiens
ccaggtgtctgtctctttttca

SEQ ID NO: 9289116 - DNA, 22 bp, Homo sapiens
ccaggtgtccccgtcactgcag

SEQ ID NO: 9289117 - DNA, 22 bp, Homo sapiens
ccaggtgtaagacatggtccta

SEQ ID NO: 9289118 - DNA, 22 bp, Homo sapiens
ccaggtgggcgtgtcttcacct

SEQ ID NO: 9289119 - DNA, 22 bp, Homo sapiens
ccaggtgtagcactgctcacag

SEQ ID NO: 9289120 - DNA, 22 bp, Homo sapiens
tgagacgaagtcttgctctgtt

SEQ ID NO: 9289121 - DNA, 17 bp, Homo sapiens
ccaggtgggaggtgggg

SEQ ID NO: 9289122 - DNA, 22 bp, Homo sapiens
ccaggtgtgccagcagggactg

SEQ ID NO: 9289123 - DNA, 22 bp, Homo sapiens
ccaggtgtgctctgcagtggat

SEQ ID NO: 9289124 - DNA, 22 bp, Homo sapiens
ccaggtgtgatttcatctgagg

SEQ ID NO: 9289125 - DNA, 22 bp, Homo sapiens
ccaggtgtgatttggcagtgtc

SEQ ID NO: 9289126 - DNA, 22 bp, Homo sapiens
ccaggtgtggggaggactcaca

SEQ ID NO: 9289127 - DNA, 22 bp, Homo sapiens
ccaggtgtggccacatggctgg

SEQ ID NO: 9289128 - DNA, 22 bp, Homo sapiens
ccaggtgtggtggcatacacct

SEQ ID NO: 9289129 - DNA, 22 bp, Homo sapiens
ccaggtgtgtacagaacagcac

SEQ ID NO: 9289130 - DNA, 22 bp, Homo sapiens
tgaggactacctggggtgggag

SEQ ID NO: 9289131 - DNA, 19 bp, Homo sapiens
cctcttcctctgacactat

SEQ ID NO: 9289132 - DNA, 22 bp, Homo sapiens
cctcttcctgcactgacatttt

SEQ ID NO: 9289133 - DNA, 22 bp, Homo sapiens
tgggctggcccaccacacctcg

SEQ ID NO: 9289134 - DNA, 22 bp, Homo sapiens
tgggctggagcttgttgcttcc

SEQ ID NO: 9289135 - DNA, 22 bp, Homo sapiens
tggggagcccactcacctcccc

SEQ ID NO: 9289136 - DNA, 22 bp, Homo sapiens
tgggccctgcccttgtctgtcc

SEQ ID NO: 9289137 - DNA, 19 bp, Homo sapiens
cctctgtgggagtcagtga

SEQ ID NO: 9289138 - DNA, 22 bp, Homo sapiens
cctcttcctcaccatctacaac

SEQ ID NO: 9289139 - DNA, 22 bp, Homo sapiens
tgggaaggacagaacataattg

SEQ ID NO: 9289140 - DNA, 22 bp, Homo sapiens
tgggaaggaactgcctttagct

SEQ ID NO: 9289141 - DNA, 22 bp, Homo sapiens
tgggaagctgcattttaacaag

SEQ ID NO: 9289142 - DNA, 22 bp, Homo sapiens
cctctgcctgcacatcatcctg

SEQ ID NO: 9289143 - DNA, 22 bp, Homo sapiens
cctctgctctggtccatgtgct

SEQ ID NO: 9289144 - DNA, 19 bp, Homo sapiens
cctctgctccagtttcctt

SEQ ID NO: 9289145 - DNA, 17 bp, Homo sapiens
tggctctgtcctcagct

SEQ ID NO: 9289146 - DNA, 22 bp, Homo sapiens
tggctctgtcactgtgagctat

SEQ ID NO: 9289147 - DNA, 19 bp, Homo sapiens
tggctctgtcgaaggcaca

SEQ ID NO: 9289148 - DNA, 19 bp, Homo sapiens
tggctctgtcgaaggcaca

SEQ ID NO: 9289149 - DNA, 22 bp, Homo sapiens
tggctgctagccagagcttcag

SEQ ID NO: 9289150 - DNA, 22 bp, Homo sapiens
tggctgctcaagggaggaggct

SEQ ID NO: 9289151 - DNA, 20 bp, Homo sapiens
cctcagtgtcctggactggg

SEQ ID NO: 9289152 - DNA, 22 bp, Homo sapiens
tggctctggtaacattgggtag

SEQ ID NO: 9289153 - DNA, 22 bp, Homo sapiens
tggctctggtgcgggctcctgc

SEQ ID NO: 9289154 - DNA, 22 bp, Homo sapiens
tggctctgtcaaactgcacaca

SEQ ID NO: 9289155 - DNA, 21 bp, Homo sapiens
tggctctgggtaggagagtgc

SEQ ID NO: 9289156 - DNA, 21 bp, Homo sapiens
tggctctgggtaggagagtgc

SEQ ID NO: 9289157 - DNA, 22 bp, Homo sapiens
tggctctgaccaggtagaggag

SEQ ID NO: 9289158 - DNA, 22 bp, Homo sapiens
tggcctggctgccctgtctgga

SEQ ID NO: 9289159 - DNA, 17 bp, Homo sapiens
cctcagcttctttcctc

SEQ ID NO: 9289160 - DNA, 22 bp, Homo sapiens
cctcagagtaggtctcagctgt

SEQ ID NO: 9289161 - DNA, 22 bp, Homo sapiens
cccttccttgtgactggtgggg

SEQ ID NO: 9289162 - DNA, 19 bp, Homo sapiens
tggcagaggacaaggactt

SEQ ID NO: 9289163 - DNA, 22 bp, Homo sapiens
cccttcctcccaggcttctgtg

SEQ ID NO: 9289164 - DNA, 22 bp, Homo sapiens
cccttcctgggtgtcccggagt

SEQ ID NO: 9289165 - DNA, 22 bp, Homo sapiens
cccttccttgattttaactgga

SEQ ID NO: 9289166 - DNA, 22 bp, Homo sapiens
tggagcaggccggaagtggctt

SEQ ID NO: 9289167 - DNA, 22 bp, Homo sapiens
ccctgtgggccatgtgtctaca

SEQ ID NO: 9289168 - DNA, 21 bp, Homo sapiens
cctagcctcttacccagcttt

SEQ ID NO: 9289169 - DNA, 18 bp, Homo sapiens
cctagcctccaagctcat

SEQ ID NO: 9289170 - DNA, 22 bp, Homo sapiens
cctagagctctgctttatctaa

SEQ ID NO: 9289171 - DNA, 19 bp, Homo sapiens
tggcagaggcagtttgtac

SEQ ID NO: 9289172 - DNA, 22 bp, Homo sapiens
tggcagaggaggctcagattga

SEQ ID NO: 9289173 - DNA, 22 bp, Homo sapiens
tggcagaggagaattaagatta

SEQ ID NO: 9289174 - DNA, 22 bp, Homo sapiens
tggcagaggctctgtgatgttg

SEQ ID NO: 9289175 - DNA, 22 bp, Homo sapiens
tggcaggtacccattggctgta

SEQ ID NO: 9289176 - DNA, 18 bp, Homo sapiens
tggcaggtagactcaggt

SEQ ID NO: 9289177 - DNA, 22 bp, Homo sapiens
tggcaggtagagttctgagatg

SEQ ID NO: 9289178 - DNA, 22 bp, Homo sapiens
tggcaggtagtcagaggcgaca

SEQ ID NO: 9289179 - DNA, 22 bp, Homo sapiens
tggcagggttggccaccttacc

SEQ ID NO: 9289180 - DNA, 22 bp, Homo sapiens
tggcagggtgggcttcagcccc

SEQ ID NO: 9289181 - DNA, 22 bp, Homo sapiens
tggcagggtgggcttcagcccc

SEQ ID NO: 9289182 - DNA, 22 bp, Homo sapiens
ccccacccacctaagagaaact

SEQ ID NO: 9289183 - DNA, 22 bp, Homo sapiens
ccccaccctcgctccatttcgg

SEQ ID NO: 9289184 - DNA, 22 bp, Homo sapiens
tgctggagcccaggcggccttt

SEQ ID NO: 9289185 - DNA, 22 bp, Homo sapiens
ccccacacctgccgggcagcag

SEQ ID NO: 9289186 - DNA, 20 bp, Homo sapiens
ccccacactattgagcactt

SEQ ID NO: 9289187 - DNA, 22 bp, Homo sapiens
ccccacactctttacattcata

SEQ ID NO: 9289188 - DNA, 22 bp, Homo sapiens
cccgagtgtctactcactccca

SEQ ID NO: 9289189 - DNA, 22 bp, Homo sapiens
ccctcgctctaggcagccctgt

SEQ ID NO: 9289190 - DNA, 22 bp, Homo sapiens
tggaatggaaacaaactgagga

SEQ ID NO: 9289191 - DNA, 22 bp, Homo sapiens
tggaatggaaacaaactgagga

SEQ ID NO: 9289192 - DNA, 20 bp, Homo sapiens
ccctgagaccagagagcagc

SEQ ID NO: 9289193 - DNA, 20 bp, Homo sapiens
ccctgagacaaaggaggggc

SEQ ID NO: 9289194 - DNA, 22 bp, Homo sapiens
ccctgagagtgagtgccacctt

SEQ ID NO: 9289195 - DNA, 22 bp, Homo sapiens
ccctgagatgcctcaccctagt

SEQ ID NO: 9289196 - DNA, 22 bp, Homo sapiens
ccctgagcgtgaggaggaagta

SEQ ID NO: 9289197 - DNA, 22 bp, Homo sapiens
ccctgagctcaggcccttgggg

SEQ ID NO: 9289198 - DNA, 22 bp, Homo sapiens
ccctgagcccatagttgacatt

SEQ ID NO: 9289199 - DNA, 22 bp, Homo sapiens
tggagcaggacggggagtggta

SEQ ID NO: 9289200 - DNA, 22 bp, Homo sapiens
tggagcaagctggagagaacat

SEQ ID NO: 9289201 - DNA, 22 bp, Homo sapiens
tggagcaagctggagagaacat

SEQ ID NO: 9289202 - DNA, 22 bp, Homo sapiens
tggagcaaacccatggctgtgc

SEQ ID NO: 9289203 - DNA, 22 bp, Homo sapiens
cccaggtaaggatgctcctcat

SEQ ID NO: 9289204 - DNA, 22 bp, Homo sapiens
cccagggtccctgctctctgtg

SEQ ID NO: 9289205 - DNA, 22 bp, Homo sapiens
tgccctggttacactggagtcc

SEQ ID NO: 9289206 - DNA, 22 bp, Homo sapiens
tgccctggtgaagtgctctcct

SEQ ID NO: 9289207 - DNA, 22 bp, Homo sapiens
cccaggctggcactgctgaagt

SEQ ID NO: 9289208 - DNA, 22 bp, Homo sapiens
cccagggaatgactctggcctt

SEQ ID NO: 9289209 - DNA, 22 bp, Homo sapiens
cccagggaatgactctggcctt

SEQ ID NO: 9289210 - DNA, 22 bp, Homo sapiens
tgccagctccgaggagctgcag

SEQ ID NO: 9289211 - DNA, 22 bp, Homo sapiens
cccaggagacctagatctgttt

SEQ ID NO: 9289212 - DNA, 22 bp, Homo sapiens
tgccagtgcttgtgtctgagca

SEQ ID NO: 9289213 - DNA, 22 bp, Homo sapiens
tgccagtgcttgtgtctgagca

SEQ ID NO: 9289214 - DNA, 22 bp, Homo sapiens
tgccagtgcctgctgcccaata

SEQ ID NO: 9289215 - DNA, 22 bp, Homo sapiens
tgccagtgaaacgtggtctcat

SEQ ID NO: 9289216 - DNA, 22 bp, Homo sapiens
tgccagtgagccctgggatgtg

SEQ ID NO: 9289217 - DNA, 22 bp, Homo sapiens
tgccagtgaaacatggaagaat

SEQ ID NO: 9289218 - DNA, 22 bp, Homo sapiens
tgccaggctaagtggaggactt

SEQ ID NO: 9289219 - DNA, 22 bp, Homo sapiens
tgccatagcaatggtaagctga

SEQ ID NO: 9289220 - DNA, 22 bp, Homo sapiens
tgccatcacacggaacccgatt

SEQ ID NO: 9289221 - DNA, 22 bp, Homo sapiens
tgccagtgggtgtgcagagact

SEQ ID NO: 9289222 - DNA, 22 bp, Homo sapiens
tgccagtgtagtagctggttta

SEQ ID NO: 9289223 - DNA, 22 bp, Homo sapiens
tgccagtgtggaactaggaaga

SEQ ID NO: 9289224 - DNA, 22 bp, Homo sapiens
tgccagtgtctgctatctgaga

SEQ ID NO: 9289225 - DNA, 22 bp, Homo sapiens
tgccagtgtgtgccttaagctc

SEQ ID NO: 9289226 - DNA, 22 bp, Homo sapiens
tgccagtgtggaactaggaaga

SEQ ID NO: 9289227 - DNA, 22 bp, Homo sapiens
tgccagtgtgagtggagttctt

SEQ ID NO: 9289228 - DNA, 20 bp, Homo sapiens
tgccagtgtgtcaatttata

SEQ ID NO: 9289229 - DNA, 22 bp, Homo sapiens
tgccctgggagttggagctgct

SEQ ID NO: 9289230 - DNA, 22 bp, Homo sapiens
tgccctgggctttgctatgact

SEQ ID NO: 9289231 - DNA, 23 bp, Homo sapiens
tttctcatccagagagtcagtcc

SEQ ID NO: 9289232 - DNA, 22 bp, Homo sapiens
tttcctgttgccatcaagaatg

SEQ ID NO: 9289233 - DNA, 22 bp, Homo sapiens
tttcctgcctggacctctgctt

SEQ ID NO: 9289234 - DNA, 22 bp, Homo sapiens
tttcctgcacccgctgatgcca

SEQ ID NO: 9289235 - DNA, 21 bp, Homo sapiens
tttcctgccctttgtcatcac

SEQ ID NO: 9289236 - DNA, 22 bp, Homo sapiens
tttcctgagccagagtttcatt

SEQ ID NO: 9289237 - DNA, 22 bp, Homo sapiens
tttcctctttgtaccttgacta

SEQ ID NO: 9289238 - DNA, 22 bp, Homo sapiens
tttccttctcagggagcttcaa

SEQ ID NO: 9289239 - DNA, 22 bp, Homo sapiens
tttccttccaggttcctaaggc

SEQ ID NO: 9289240 - DNA, 22 bp, Homo sapiens
tttctacatgttttctattgaa

SEQ ID NO: 9289241 - DNA, 22 bp, Homo sapiens
tttcattgtcaataaactgtat

SEQ ID NO: 9289242 - DNA, 22 bp, Homo sapiens
tttcattgtccccaggcaagac

SEQ ID NO: 9289243 - DNA, 22 bp, Homo sapiens
tttcattttggttatgccataa

SEQ ID NO: 9289244 - DNA, 22 bp, Homo sapiens
tttcattttggttatgccataa

SEQ ID NO: 9289245 - DNA, 22 bp, Homo sapiens
tttcctctgggccctgccaccc

SEQ ID NO: 9289246 - DNA, 22 bp, Homo sapiens
tttcctcttatacagtgtttat

SEQ ID NO: 9289247 - DNA, 22 bp, Homo sapiens
tttcctcttcttcccatgtcat

SEQ ID NO: 9289248 - DNA, 20 bp, Homo sapiens
tttcttgtacttggagaagg

SEQ ID NO: 9289249 - DNA, 20 bp, Homo sapiens
tttcttgtcggctgttgctg

SEQ ID NO: 9289250 - DNA, 22 bp, Homo sapiens
tttcttctgagatcagggagaa

SEQ ID NO: 9289251 - DNA, 22 bp, Homo sapiens
tttcttgtttcatggtgtctca

SEQ ID NO: 9289252 - DNA, 22 bp, Homo sapiens
tttcttccttaccttactagag

SEQ ID NO: 9289253 - DNA, 22 bp, Homo sapiens
tttcttccttaccttactagag

SEQ ID NO: 9289254 - DNA, 22 bp, Homo sapiens
tttcttctaagatttcaaacta

SEQ ID NO: 9289255 - DNA, 22 bp, Homo sapiens
tttcttctaggactaataagag

SEQ ID NO: 9289256 - DNA, 23 bp, Homo sapiens
tttcttctcgaagagggagctta

SEQ ID NO: 9289257 - DNA, 22 bp, Homo sapiens
tttcttctcatccctgaaatca

SEQ ID NO: 9289258 - DNA, 22 bp, Homo sapiens
tttcttctcacccaggacagag

SEQ ID NO: 9289259 - DNA, 22 bp, Homo sapiens
tttcttatggggtagtccttta

SEQ ID NO: 9289260 - DNA, 22 bp, Homo sapiens
tttcttcattgacaaggaaaaa

SEQ ID NO: 9289261 - DNA, 22 bp, Homo sapiens
tttctgtcattactttcctccc

SEQ ID NO: 9289262 - DNA, 22 bp, Homo sapiens
tttctgtagtgtggtatgtagg

SEQ ID NO: 9289263 - DNA, 22 bp, Homo sapiens
tttctgtatttaaaagatctgg

SEQ ID NO: 9289264 - DNA, 21 bp, Homo sapiens
tttctgtctctgccactagtt

SEQ ID NO: 9289265 - DNA, 22 bp, Homo sapiens
tttctgtctgacatccctgcct

SEQ ID NO: 9289266 - DNA, 22 bp, Homo sapiens
tttctcctctccagagtgcagt

SEQ ID NO: 9289267 - DNA, 22 bp, Homo sapiens
tttctctgtgccatttccataa

SEQ ID NO: 9289268 - DNA, 22 bp, Homo sapiens
tttctctaaatagggaggctta

SEQ ID NO: 9289269 - DNA, 22 bp, Homo sapiens
tttctcttaatgtctctgtgct

SEQ ID NO: 9289270 - DNA, 22 bp, Homo sapiens
tttctgacctgcaacagtttac

SEQ ID NO: 9289271 - DNA, 22 bp, Homo sapiens
tttctgaggaattaatacagaa

SEQ ID NO: 9289272 - DNA, 22 bp, Homo sapiens
tttctgagaaattaaacacttt

SEQ ID NO: 9289273 - DNA, 22 bp, Homo sapiens
tttctgtaagtggcaaataatg

SEQ ID NO: 9289274 - DNA, 22 bp, Homo sapiens
tttctgtacacccactattcat

SEQ ID NO: 9289275 - DNA, 17 bp, Homo sapiens
tttctggaatgggcaaa

SEQ ID NO: 9289276 - DNA, 22 bp, Homo sapiens
tttaattgttgtgggtacatag

SEQ ID NO: 9289277 - DNA, 22 bp, Homo sapiens
tttaattgcatttaaagatgga

SEQ ID NO: 9289278 - DNA, 22 bp, Homo sapiens
tttaattgattcacagtctgta

SEQ ID NO: 9289279 - DNA, 22 bp, Homo sapiens
tttaattgcatttaaagatgga

SEQ ID NO: 9289280 - DNA, 22 bp, Homo sapiens
tttaattagcaagccagagagc

SEQ ID NO: 9289281 - DNA, 23 bp, Homo sapiens
ttgtttttagaggtggcatgaga

SEQ ID NO: 9289282 - DNA, 22 bp, Homo sapiens
tttaatgttcatctcaaaggat

SEQ ID NO: 9289283 - DNA, 22 bp, Homo sapiens
tttacttgatatggagctgagg

SEQ ID NO: 9289284 - DNA, 22 bp, Homo sapiens
tttaccatacatcaaaatattt

SEQ ID NO: 9289285 - DNA, 22 bp, Homo sapiens
tttatttcttagtttgccacag

SEQ ID NO: 9289286 - DNA, 22 bp, Homo sapiens
tttatttcactctccggatact

SEQ ID NO: 9289287 - DNA, 22 bp, Homo sapiens
tttatttggcatctctgccaag

SEQ ID NO: 9289288 - DNA, 22 bp, Homo sapiens
tttatttggcatccagggagaa

SEQ ID NO: 9289289 - DNA, 22 bp, Homo sapiens
tttattagtgcttgtatcactg

SEQ ID NO: 9289290 - DNA, 22 bp, Homo sapiens
tttattatccagtgttgtcatg

SEQ ID NO: 9289291 - DNA, 22 bp, Homo sapiens
tttattatagtggtggggactg

SEQ ID NO: 9289292 - DNA, 22 bp, Homo sapiens
tttattagattatcaaagaggt

SEQ ID NO: 9289293 - DNA, 22 bp, Homo sapiens
tttattagattatcaaagaggt

SEQ ID NO: 9289294 - DNA, 22 bp, Homo sapiens
tttattatgtacaggcactata

SEQ ID NO: 9289295 - DNA, 22 bp, Homo sapiens
tttattattctctggagaatgt

SEQ ID NO: 9289296 - DNA, 22 bp, Homo sapiens
tttattattctgttctctctac

SEQ ID NO: 9289297 - DNA, 22 bp, Homo sapiens
tttattattctgttctctctac

SEQ ID NO: 9289298 - DNA, 22 bp, Homo sapiens
tttattatgatggacaccttcg

SEQ ID NO: 9289299 - DNA, 22 bp, Homo sapiens
tttattatccagtgttgtcatg

SEQ ID NO: 9289300 - DNA, 21 bp, Homo sapiens
tttattaacaactgtggacgt

SEQ ID NO: 9289301 - DNA, 22 bp, Homo sapiens
tttattaagatgcgaatgctga

SEQ ID NO: 9289302 - DNA, 22 bp, Homo sapiens
tttatataacagagactgctat

SEQ ID NO: 9289303 - DNA, 22 bp, Homo sapiens
tttatagacaaactcagaggct

SEQ ID NO: 9289304 - DNA, 22 bp, Homo sapiens
tttataacatttcttacctgtg

SEQ ID NO: 9289305 - DNA, 22 bp, Homo sapiens
ttgtttaagccacccaatctgt

SEQ ID NO: 9289306 - DNA, 20 bp, Homo sapiens
ttgtttaaaggtgaagaggc

SEQ ID NO: 9289307 - DNA, 22 bp, Homo sapiens
ttgttacagcagtgatttcaga

SEQ ID NO: 9289308 - DNA, 22 bp, Homo sapiens
ttgttttagtaggtacactgag

SEQ ID NO: 9289309 - DNA, 22 bp, Homo sapiens
ttgttttattctgcaatttccc

SEQ ID NO: 9289310 - DNA, 20 bp, Homo sapiens
ttgtttctgctattttctaa

SEQ ID NO: 9289311 - DNA, 22 bp, Homo sapiens
ttgtcgggcttacgcagggcca

SEQ ID NO: 9289312 - DNA, 22 bp, Homo sapiens
ttggtgttgaacaaaactaaat

SEQ ID NO: 9289313 - DNA, 22 bp, Homo sapiens
tttgtttagatggtaaatcagt

SEQ ID NO: 9289314 - DNA, 22 bp, Homo sapiens
tttgttttcaatgtgtcattca

SEQ ID NO: 9289315 - DNA, 22 bp, Homo sapiens
tttgttttcaatgtgtcattca

SEQ ID NO: 9289316 - DNA, 22 bp, Homo sapiens
ttttatcaatcattaagacatt

SEQ ID NO: 9289317 - DNA, 22 bp, Homo sapiens
tttgtattacaaagtcacagta

SEQ ID NO: 9289318 - DNA, 22 bp, Homo sapiens
tttgtagcagcatgatttataa

SEQ ID NO: 9289319 - DNA, 22 bp, Homo sapiens
tttgtagcagcatgatttataa

SEQ ID NO: 9289320 - DNA, 22 bp, Homo sapiens
tttgtatttttcccagctagct

SEQ ID NO: 9289321 - DNA, 22 bp, Homo sapiens
tttctttatcctcctttgcaca

SEQ ID NO: 9289322 - DNA, 22 bp, Homo sapiens
tttgtacaattagcagaggcta

SEQ ID NO: 9289323 - DNA, 22 bp, Homo sapiens
tttgtacaattagcagaggcta

SEQ ID NO: 9289324 - DNA, 23 bp, Homo sapiens
tttgtacattgaggaggcagaat

SEQ ID NO: 9289325 - DNA, 22 bp, Homo sapiens
tttggcagctaaggcagctcgc

SEQ ID NO: 9289326 - DNA, 22 bp, Homo sapiens
tttggcagaggttgtcaggcca

SEQ ID NO: 9289327 - DNA, 22 bp, Homo sapiens
ttttctaacatctagtaatttg

SEQ ID NO: 9289328 - DNA, 20 bp, Homo sapiens
ttttccttctgagtatgttg

SEQ ID NO: 9289329 - DNA, 19 bp, Homo sapiens
ttttccttctcctcttaat

SEQ ID NO: 9289330 - DNA, 22 bp, Homo sapiens
ttttatctgcttcattagttga

SEQ ID NO: 9289331 - DNA, 22 bp, Homo sapiens
tttttcctagcgatttgtcagc

SEQ ID NO: 9289332 - DNA, 22 bp, Homo sapiens
tttttcatgagactagaagtca

SEQ ID NO: 9289333 - DNA, 22 bp, Homo sapiens
tttttgaaggctgatgtgatta

SEQ ID NO: 9289334 - DNA, 22 bp, Homo sapiens
tgtgtgaggtggttctgagaag

SEQ ID NO: 9289335 - DNA, 22 bp, Homo sapiens
tgtgtgagtaaggctgagagag

SEQ ID NO: 9289336 - DNA, 22 bp, Homo sapiens
tgtgtcctactgaggagctcct

SEQ ID NO: 9289337 - DNA, 22 bp, Homo sapiens
tgtgtcccttggaacctcagct

SEQ ID NO: 9289338 - DNA, 19 bp, Homo sapiens
tgtgtcctagcagccagtc

SEQ ID NO: 9289339 - DNA, 22 bp, Homo sapiens
tgtgtcctatgaaagagggtta

SEQ ID NO: 9289340 - DNA, 22 bp, Homo sapiens
tgtgtcctcactgtatgcaagg

SEQ ID NO: 9289341 - DNA, 22 bp, Homo sapiens
tgtgtcctcagggaagcagaga

SEQ ID NO: 9289342 - DNA, 22 bp, Homo sapiens
tgtgtcctcatgaggtttgcag

SEQ ID NO: 9289343 - DNA, 22 bp, Homo sapiens
tgtgtccttctgggagtcccag

SEQ ID NO: 9289344 - DNA, 22 bp, Homo sapiens
tgtgtcctttctaatgcccaga

SEQ ID NO: 9289345 - DNA, 22 bp, Homo sapiens
tgtgtccttccagtttttcctg

SEQ ID NO: 9289346 - DNA, 22 bp, Homo sapiens
tgtgtccttatgaaaatactgt

SEQ ID NO: 9289347 - DNA, 23 bp, Homo sapiens
tgtgtccttaactgtatatacta

SEQ ID NO: 9289348 - DNA, 22 bp, Homo sapiens
tgtgtcctttggaggatcagcg

SEQ ID NO: 9289349 - DNA, 22 bp, Homo sapiens
tgtgtcctttcttaagagtgag

SEQ ID NO: 9289350 - DNA, 22 bp, Homo sapiens
tgtgtcctgtgatctctagggt

SEQ ID NO: 9289351 - DNA, 22 bp, Homo sapiens
tgtgtcctgtgcaaggggatga

SEQ ID NO: 9289352 - DNA, 22 bp, Homo sapiens
tgtgtcctggtgttaattttat

SEQ ID NO: 9289353 - DNA, 22 bp, Homo sapiens
tgtgtcctgtccccttgctgct

SEQ ID NO: 9289354 - DNA, 22 bp, Homo sapiens
tgtgtcctgcaggtgctgcctg

SEQ ID NO: 9289355 - DNA, 22 bp, Homo sapiens
tgtgtcctgcagacagactcag

SEQ ID NO: 9289356 - DNA, 22 bp, Homo sapiens
tgtgtcctcatgtggcagagag

SEQ ID NO: 9289357 - DNA, 22 bp, Homo sapiens
tgtgtcctcttacctctgaccc

SEQ ID NO: 9289358 - DNA, 22 bp, Homo sapiens
tgtgtcctccagggagatgtaa

SEQ ID NO: 9289359 - DNA, 22 bp, Homo sapiens
tgtgggtggcatcgtcctggcc

SEQ ID NO: 9289360 - DNA, 22 bp, Homo sapiens
tgtggggactttcaaagccaat

SEQ ID NO: 9289361 - DNA, 22 bp, Homo sapiens
tgtggcctgattttgcatctct

SEQ ID NO: 9289362 - DNA, 23 bp, Homo sapiens
tgtggcctgcagctctggtttgg

SEQ ID NO: 9289363 - DNA, 22 bp, Homo sapiens
tgtggcctctcaggcttgatca

SEQ ID NO: 9289364 - DNA, 22 bp, Homo sapiens
tgtggcctggaaggggctgctc

SEQ ID NO: 9289365 - DNA, 22 bp, Homo sapiens
tgtggcctccccacttctgggg

SEQ ID NO: 9289366 - DNA, 22 bp, Homo sapiens
tgtggcctcaaggctgccctca

SEQ ID NO: 9289367 - DNA, 22 bp, Homo sapiens
tgtggcagctgctgcaggagct

SEQ ID NO: 9289368 - DNA, 22 bp, Homo sapiens
tgtggcagaggaggcagcgtcc

SEQ ID NO: 9289369 - DNA, 22 bp, Homo sapiens
tcccccaggctggagtgcagtg

SEQ ID NO: 9289370 - DNA, 22 bp, Homo sapiens
tcccccactctaaaggagcctt

SEQ ID NO: 9289371 - DNA, 23 bp, Homo sapiens
tcccctcaggcagccagtgccct

SEQ ID NO: 9289372 - DNA, 22 bp, Homo sapiens
tcccctgcagcgcctgcttcta

SEQ ID NO: 9289373 - DNA, 22 bp, Homo sapiens
tcccctctctgcgctcccaggt

SEQ ID NO: 9289374 - DNA, 22 bp, Homo sapiens
tcccctgagacccctcagcact

SEQ ID NO: 9289375 - DNA, 22 bp, Homo sapiens
tgtggacgtcattaaagcagtg

SEQ ID NO: 9289376 - DNA, 22 bp, Homo sapiens
tgtgttcaagattagttctagt

SEQ ID NO: 9289377 - DNA, 22 bp, Homo sapiens
tgtgttttaaatggaaatttga

SEQ ID NO: 9289378 - DNA, 22 bp, Homo sapiens
tgttcctgaggcatgtgtcaat

SEQ ID NO: 9289379 - DNA, 22 bp, Homo sapiens
tgttccgaccgtggggtttgat

SEQ ID NO: 9289380 - DNA, 22 bp, Homo sapiens
tgttatctgagcaacgtcgacg

SEQ ID NO: 9289381 - DNA, 22 bp, Homo sapiens
tgttattgggtcccaactaggt

SEQ ID NO: 9289382 - DNA, 22 bp, Homo sapiens
tgttatttatttcacctccaga

SEQ ID NO: 9289383 - DNA, 22 bp, Homo sapiens
tgtttacacttcaaggttaagg

SEQ ID NO: 9289384 - DNA, 22 bp, Homo sapiens
tgtttacagggtgattttacct

SEQ ID NO: 9289385 - DNA, 22 bp, Homo sapiens
tgtttacaaggagtttatattg

SEQ ID NO: 9289386 - DNA, 22 bp, Homo sapiens
tgtttacaagccacttgttaag

SEQ ID NO: 9289387 - DNA, 22 bp, Homo sapiens
tgtttaatttcacaaagttgac

SEQ ID NO: 9289388 - DNA, 22 bp, Homo sapiens
tgtttaattcaccatcatgttc

SEQ ID NO: 9289389 - DNA, 22 bp, Homo sapiens
tgtttaataattctatgatagt

SEQ ID NO: 9289390 - DNA, 22 bp, Homo sapiens
tgtttaatctataaaatggaga

SEQ ID NO: 9289391 - DNA, 22 bp, Homo sapiens
tgtttaagctgatgaggtatcg

SEQ ID NO: 9289392 - DNA, 22 bp, Homo sapiens
tgtttctttgtagatattcttt

SEQ ID NO: 9289393 - DNA, 20 bp, Homo sapiens
tgtttcttttaatgagcggc

SEQ ID NO: 9289394 - DNA, 22 bp, Homo sapiens
tgtttccatggtgacagcagct

SEQ ID NO: 9289395 - DNA, 22 bp, Homo sapiens
tgtttcagtccctgtgttcaat

SEQ ID NO: 9289396 - DNA, 22 bp, Homo sapiens
tgttttctgatggttaatgagt

SEQ ID NO: 9289397 - DNA, 17 bp, Homo sapiens
tgttttctgctaccttt

SEQ ID NO: 9289398 - DNA, 22 bp, Homo sapiens
tgttttcttcctaattgctcat

SEQ ID NO: 9289399 - DNA, 22 bp, Homo sapiens
tgttttctgggtggaaggtact

SEQ ID NO: 9289400 - DNA, 22 bp, Homo sapiens
tgttttctgtgtagagatcaca

SEQ ID NO: 9289401 - DNA, 22 bp, Homo sapiens
ttaaatattatgttgtctgcaa

SEQ ID NO: 9289402 - DNA, 22 bp, Homo sapiens
ttaagacatgtgagcataactt

SEQ ID NO: 9289403 - DNA, 17 bp, Homo sapiens
ttaaggtggatcagcac

SEQ ID NO: 9289404 - DNA, 22 bp, Homo sapiens
ttaattgtaaagtttgcctgtt

SEQ ID NO: 9289405 - DNA, 22 bp, Homo sapiens
ttaattgtctgtgagtacctga

SEQ ID NO: 9289406 - DNA, 22 bp, Homo sapiens
ttaattgttggaaatagattat

SEQ ID NO: 9289407 - DNA, 22 bp, Homo sapiens
ttacatattatccaaaactgct

SEQ ID NO: 9289408 - DNA, 22 bp, Homo sapiens
ttacatattgtctattgttcaa

SEQ ID NO: 9289409 - DNA, 21 bp, Homo sapiens
ttacaggtcatccaagtcacc

SEQ ID NO: 9289410 - DNA, 22 bp, Homo sapiens
ttaccaaatgaaatagagattt

SEQ ID NO: 9289411 - DNA, 22 bp, Homo sapiens
ttactttagatcatactgtgtg

SEQ ID NO: 9289412 - DNA, 22 bp, Homo sapiens
ttcctaatggcaaaacatgttt

SEQ ID NO: 9289413 - DNA, 22 bp, Homo sapiens
ttcctaatcacgaacattattt

SEQ ID NO: 9289414 - DNA, 22 bp, Homo sapiens
ttccacaggtttcagactgttc

SEQ ID NO: 9289415 - DNA, 20 bp, Homo sapiens
ttccacatctttgcacatgc

SEQ ID NO: 9289416 - DNA, 20 bp, Homo sapiens
ttccacatctttgcacatgc

SEQ ID NO: 9289417 - DNA, 22 bp, Homo sapiens
ttcctcagttagtgcctgaggc

SEQ ID NO: 9289418 - DNA, 22 bp, Homo sapiens
ttcctcagggaggctagcagta

SEQ ID NO: 9289419 - DNA, 22 bp, Homo sapiens
ttcctcagtgcccccatacggt

SEQ ID NO: 9289420 - DNA, 22 bp, Homo sapiens
ttcctcagctggcctgattggg

SEQ ID NO: 9289421 - DNA, 20 bp, Homo sapiens
ttcctcaggagaggatgtta

SEQ ID NO: 9289422 - DNA, 22 bp, Homo sapiens
ttcctcagccagcacttagggg

SEQ ID NO: 9289423 - DNA, 22 bp, Homo sapiens
ttcctcagcacaaagccaagat

SEQ ID NO: 9289424 - DNA, 22 bp, Homo sapiens
ttcctcaacaacttccctacag

SEQ ID NO: 9289425 - DNA, 22 bp, Homo sapiens
ttctagagccagggcagctgca

SEQ ID NO: 9289426 - DNA, 22 bp, Homo sapiens
ttctaattattcccttgtccca

SEQ ID NO: 9289427 - DNA, 22 bp, Homo sapiens
ttctaagttactgttatggtct

SEQ ID NO: 9289428 - DNA, 22 bp, Homo sapiens
ttcctcttccatcttcccaggg

SEQ ID NO: 9289429 - DNA, 22 bp, Homo sapiens
ttcctctttagggctggccagg

SEQ ID NO: 9289430 - DNA, 22 bp, Homo sapiens
ttccttctcagccctcgaggat

SEQ ID NO: 9289431 - DNA, 22 bp, Homo sapiens
ttccttctgaagcctttgtgtt

SEQ ID NO: 9289432 - DNA, 22 bp, Homo sapiens
ttctaaggggttcacaggcata

SEQ ID NO: 9289433 - DNA, 22 bp, Homo sapiens
ttccttctagagcttgtttagg

SEQ ID NO: 9289434 - DNA, 22 bp, Homo sapiens
ttcaggagctagggatgtgaaa

SEQ ID NO: 9289435 - DNA, 20 bp, Homo sapiens
ttcatgggagcaaagaggcc

SEQ ID NO: 9289436 - DNA, 22 bp, Homo sapiens
ttcacaaaatggtttgttgatg

SEQ ID NO: 9289437 - DNA, 22 bp, Homo sapiens
ttcacaaaaatgctgaacagtt

SEQ ID NO: 9289438 - DNA, 22 bp, Homo sapiens
ttcacaaagctggagcatttcc

SEQ ID NO: 9289439 - DNA, 22 bp, Homo sapiens
ttcacaaagctggagcatttcc

SEQ ID NO: 9289440 - DNA, 22 bp, Homo sapiens
ttcacaataatgtccatcctct

SEQ ID NO: 9289441 - DNA, 21 bp, Homo sapiens
ttagagtagagaacatgatcc

SEQ ID NO: 9289442 - DNA, 22 bp, Homo sapiens
ttctttcagaacacaagtgatt

SEQ ID NO: 9289443 - DNA, 22 bp, Homo sapiens
ttctttcaatagctggcatatg

SEQ ID NO: 9289444 - DNA, 22 bp, Homo sapiens
ttctttcactcaagaaggatct

SEQ ID NO: 9289445 - DNA, 22 bp, Homo sapiens
ttctttattagtttagtgagct

SEQ ID NO: 9289446 - DNA, 22 bp, Homo sapiens
ttgagcaggatggctatgcaca

SEQ ID NO: 9289447 - DNA, 19 bp, Homo sapiens
ttgagcagtgcttagcacc

SEQ ID NO: 9289448 - DNA, 23 bp, Homo sapiens
ttgaggcaaactcttttctgaaa

SEQ ID NO: 9289449 - DNA, 22 bp, Homo sapiens
ttgaggcacacacaggttgcat

SEQ ID NO: 9289450 - DNA, 22 bp, Homo sapiens
ttgaggcattactgtaatgaga

SEQ ID NO: 9289451 - DNA, 22 bp, Homo sapiens
ttgaggcaggtccgggtccttc

SEQ ID NO: 9289452 - DNA, 20 bp, Homo sapiens
ttgaggcatgtctagaagta

SEQ ID NO: 9289453 - DNA, 22 bp, Homo sapiens
ttgaggcagggcatggtggccc

SEQ ID NO: 9289454 - DNA, 22 bp, Homo sapiens
ttgattcagagaagattggccc

SEQ ID NO: 9289455 - DNA, 22 bp, Homo sapiens
ttgattcatatagatatgcgtg

SEQ ID NO: 9289456 - DNA, 22 bp, Homo sapiens
ttgattcatttattgagtgcct

SEQ ID NO: 9289457 - DNA, 22 bp, Homo sapiens
ttgattaaaatgagacatcatt

SEQ ID NO: 9289458 - DNA, 22 bp, Homo sapiens
ttctgcttttctctgtctgagt

SEQ ID NO: 9289459 - DNA, 22 bp, Homo sapiens
ttctgcttttctctgtctgagt

SEQ ID NO: 9289460 - DNA, 22 bp, Homo sapiens
ttctgcttttattgccagagtt

SEQ ID NO: 9289461 - DNA, 22 bp, Homo sapiens
ttctgctttcagttcttctggg

SEQ ID NO: 9289462 - DNA, 22 bp, Homo sapiens
ttctgcttattctgtagccttt

SEQ ID NO: 9289463 - DNA, 22 bp, Homo sapiens
ttctgcttattcaaatgatctt

SEQ ID NO: 9289464 - DNA, 22 bp, Homo sapiens
ttctgcttctgtgtgtcccagg

SEQ ID NO: 9289465 - DNA, 20 bp, Homo sapiens
ttctgcttttgcttagggac

SEQ ID NO: 9289466 - DNA, 22 bp, Homo sapiens
ttctagtgtccttggacttgct

SEQ ID NO: 9289467 - DNA, 22 bp, Homo sapiens
ttctgaatttctgtgtatctta

SEQ ID NO: 9289468 - DNA, 22 bp, Homo sapiens
ttctgttttagaaataagtagt

SEQ ID NO: 9289469 - DNA, 22 bp, Homo sapiens
ttctgtttctggggtctctgac

SEQ ID NO: 9289470 - DNA, 22 bp, Homo sapiens
ttctgtttgccatatatagtag

SEQ ID NO: 9289471 - DNA, 22 bp, Homo sapiens
ttctgtttataatttgcagttg

SEQ ID NO: 9289472 - DNA, 22 bp, Homo sapiens
ttcttacatattttcatatggt

SEQ ID NO: 9289473 - DNA, 22 bp, Homo sapiens
ttctttaaaatagtgagaaaga

SEQ ID NO: 9289474 - DNA, 22 bp, Homo sapiens
catattctgttggtcacataga

SEQ ID NO: 9289475 - DNA, 22 bp, Homo sapiens
cagtggtggaatgaggaattgt

SEQ ID NO: 9289476 - DNA, 22 bp, Homo sapiens
cagtggtgaagagcaggggctc

SEQ ID NO: 9289477 - DNA, 22 bp, Homo sapiens
cagtggtgaagagcaggggctc

SEQ ID NO: 9289478 - DNA, 22 bp, Homo sapiens
cagtgggtggctaagtggctga

SEQ ID NO: 9289479 - DNA, 22 bp, Homo sapiens
cagtgggtggcctcttgagtca

SEQ ID NO: 9289480 - DNA, 22 bp, Homo sapiens
cagtgggtgccatcgtgccctt

SEQ ID NO: 9289481 - DNA, 22 bp, Homo sapiens
cagtgggtgcctctcattatat

SEQ ID NO: 9289482 - DNA, 22 bp, Homo sapiens
cagtgggtgatgagtcctgggg

SEQ ID NO: 9289483 - DNA, 22 bp, Homo sapiens
cagtttctctcaataagcatcg

SEQ ID NO: 9289484 - DNA, 22 bp, Homo sapiens
cagtttccctgcttgaaaacgt

SEQ ID NO: 9289485 - DNA, 22 bp, Homo sapiens
caggtgggagcggagactgatt

SEQ ID NO: 9289486 - DNA, 22 bp, Homo sapiens
aggacatgtgcctccagggcag

SEQ ID NO: 9289487 - DNA, 22 bp, Homo sapiens
aggacatgtttgtatcttcctt

SEQ ID NO: 9289488 - DNA, 22 bp, Homo sapiens
ccaaaggccaggcactgaggtt

SEQ ID NO: 9289489 - DNA, 18 bp, Homo sapiens
aggcaggctggagtgact

SEQ ID NO: 9289490 - DNA, 18 bp, Homo sapiens
aggcaggctggagtgact

SEQ ID NO: 9289491 - DNA, 22 bp, Homo sapiens
ccaagggctatttacagaacag

SEQ ID NO: 9289492 - DNA, 22 bp, Homo sapiens
aggcactgtgctgatgtcttat

SEQ ID NO: 9289493 - DNA, 22 bp, Homo sapiens
aggcactgtgctgatgtcttat

SEQ ID NO: 9289494 - DNA, 22 bp, Homo sapiens
catttgttgggacaatgaaaag

SEQ ID NO: 9289495 - DNA, 17 bp, Homo sapiens
catttgttgatcagttg

SEQ ID NO: 9289496 - DNA, 22 bp, Homo sapiens
catttgttaatgctgcttttaa

SEQ ID NO: 9289497 - DNA, 22 bp, Homo sapiens
catttgttaagaaggaaaaagg

SEQ ID NO: 9289498 - DNA, 22 bp, Homo sapiens
aggatgtgttcatagctgacgc

SEQ ID NO: 9289499 - DNA, 22 bp, Homo sapiens
aggatgtgttttgagctgacta

SEQ ID NO: 9289500 - DNA, 22 bp, Homo sapiens
aggatgtgtgtaggctggttaa

SEQ ID NO: 9289501 - DNA, 22 bp, Homo sapiens
aggcactgcagattacaggcgc

SEQ ID NO: 9289502 - DNA, 22 bp, Homo sapiens
catggggcccatgtgctccaag

SEQ ID NO: 9289503 - DNA, 22 bp, Homo sapiens
aggatttacaatgattctaggt

SEQ ID NO: 9289504 - DNA, 22 bp, Homo sapiens
aggatttgaacctaggcaatca

SEQ ID NO: 9289505 - DNA, 22 bp, Homo sapiens
cagctgaaggtaggaaccagga

SEQ ID NO: 9289506 - DNA, 22 bp, Homo sapiens
cagctgaattcttcagactcca

SEQ ID NO: 9289507 - DNA, 22 bp, Homo sapiens
cagctgagaaatggggaaaggg

SEQ ID NO: 9289508 - DNA, 22 bp, Homo sapiens
cagctgagaaaggcaggctcac

SEQ ID NO: 9289509 - DNA, 22 bp, Homo sapiens
cagctgagaaggtctgatcagg

SEQ ID NO: 9289510 - DNA, 22 bp, Homo sapiens
cagctgagaagtgatagctgca

SEQ ID NO: 9289511 - DNA, 22 bp, Homo sapiens
cagctgagaccagaatgcaggt

SEQ ID NO: 9289512 - DNA, 22 bp, Homo sapiens
cagctgagaccagaatgcaggt

SEQ ID NO: 9289513 - DNA, 22 bp, Homo sapiens
cagctgagagacaatgagtcat

SEQ ID NO: 9289514 - DNA, 22 bp, Homo sapiens
agctgattccactttttcccca

SEQ ID NO: 9289515 - DNA, 22 bp, Homo sapiens
agctgcagaggtttgtgcaaca

SEQ ID NO: 9289516 - DNA, 22 bp, Homo sapiens
caggaggagcattagcgtctca

SEQ ID NO: 9289517 - DNA, 22 bp, Homo sapiens
caggaggacatactggctcaca

SEQ ID NO: 9289518 - DNA, 22 bp, Homo sapiens
agctggccggcctccaggtgga

SEQ ID NO: 9289519 - DNA, 22 bp, Homo sapiens
cagggtgcgccactcagatgta

SEQ ID NO: 9289520 - DNA, 22 bp, Homo sapiens
cagggtgcctgtcctcagcaaa

SEQ ID NO: 9289521 - DNA, 22 bp, Homo sapiens
cagggtgcctcccgctcgccgg

SEQ ID NO: 9289522 - DNA, 22 bp, Homo sapiens
caggggctgagaaggaacgtcc

SEQ ID NO: 9289523 - DNA, 22 bp, Homo sapiens
caggggctgtggcacatggtgt

SEQ ID NO: 9289524 - DNA, 22 bp, Homo sapiens
caggggctgtgggcggagcctc

SEQ ID NO: 9289525 - DNA, 22 bp, Homo sapiens
cagggtgcagtgtcgctgctag

SEQ ID NO: 9289526 - DNA, 22 bp, Homo sapiens
cagggctccccgcaccgcagcc

SEQ ID NO: 9289527 - DNA, 22 bp, Homo sapiens
caggggctccctgggtgccagt

SEQ ID NO: 9289528 - DNA, 22 bp, Homo sapiens
cagggcctcgaagcctctgggc

SEQ ID NO: 9289529 - DNA, 22 bp, Homo sapiens
caggctcagctctggccagtgc

SEQ ID NO: 9289530 - DNA, 22 bp, Homo sapiens
caggctcagtcagaaaatgtat

SEQ ID NO: 9289531 - DNA, 22 bp, Homo sapiens
caggctcactttctcagtcaca

SEQ ID NO: 9289532 - DNA, 22 bp, Homo sapiens
caggctcactgtaaggtcagct

SEQ ID NO: 9289533 - DNA, 18 bp, Homo sapiens
agctggggcctctggtcc

SEQ ID NO: 9289534 - DNA, 22 bp, Homo sapiens
agctggggcatttatccactaa

SEQ ID NO: 9289535 - DNA, 22 bp, Homo sapiens
agctggggcatttatccactaa

SEQ ID NO: 9289536 - DNA, 22 bp, Homo sapiens
agctgtggaaatcaggcaatga

SEQ ID NO: 9289537 - DNA, 22 bp, Homo sapiens
agctgtggcagcactttggagt

SEQ ID NO: 9289538 - DNA, 22 bp, Homo sapiens
agctgtggcagcactttggagt

SEQ ID NO: 9289539 - DNA, 22 bp, Homo sapiens
caggctgcggtcggctctggtc

SEQ ID NO: 9289540 - DNA, 22 bp, Homo sapiens
caggctggagttacctttaggg

SEQ ID NO: 9289541 - DNA, 22 bp, Homo sapiens
caggctggagttacctttaggg

SEQ ID NO: 9289542 - DNA, 22 bp, Homo sapiens
cagggagctggagttggagtac

SEQ ID NO: 9289543 - DNA, 22 bp, Homo sapiens
cagggagctggctggctgtgcc

SEQ ID NO: 9289544 - DNA, 22 bp, Homo sapiens
agggccccatagtcactgcccg

SEQ ID NO: 9289545 - DNA, 22 bp, Homo sapiens
ccgcatttccaatgaggcaaag

SEQ ID NO: 9289546 - DNA, 22 bp, Homo sapiens
agggctctgtccccagaggccc

SEQ ID NO: 9289547 - DNA, 22 bp, Homo sapiens
agggctctggggtggcagagat

SEQ ID NO: 9289548 - DNA, 22 bp, Homo sapiens
agggctctgttggggtcagcac

SEQ ID NO: 9289549 - DNA, 22 bp, Homo sapiens
agggctctcttggacaactgct

SEQ ID NO: 9289550 - DNA, 22 bp, Homo sapiens
agggctctgagctggaccacct

SEQ ID NO: 9289551 - DNA, 19 bp, Homo sapiens
cctcctgctagatatgcaa

SEQ ID NO: 9289552 - DNA, 22 bp, Homo sapiens
cctcctggaaaaattccctggc

SEQ ID NO: 9289553 - DNA, 22 bp, Homo sapiens
cctcctgcacttgctttccttc

SEQ ID NO: 9289554 - DNA, 22 bp, Homo sapiens
cctcctggaggctctagggaaa

SEQ ID NO: 9289555 - DNA, 22 bp, Homo sapiens
cctctgggccagcctggaccct

SEQ ID NO: 9289556 - DNA, 22 bp, Homo sapiens
cctctgggagactgctactgag

SEQ ID NO: 9289557 - DNA, 22 bp, Homo sapiens
cctctgggcaggtagcagcagc

SEQ ID NO: 9289558 - DNA, 22 bp, Homo sapiens
cctctgggaagccagtcctgct

SEQ ID NO: 9289559 - DNA, 22 bp, Homo sapiens
agggctgcaggcaagatatggc

SEQ ID NO: 9289560 - DNA, 17 bp, Homo sapiens
aggggagagtgggaaga

SEQ ID NO: 9289561 - DNA, 22 bp, Homo sapiens
aggggagagaacataaggaagt

SEQ ID NO: 9289562 - DNA, 22 bp, Homo sapiens
cctctgggcggagatctgctgc

SEQ ID NO: 9289563 - DNA, 22 bp, Homo sapiens
aggggctggcttatctgagagt

SEQ ID NO: 9289564 - DNA, 22 bp, Homo sapiens
aggggctgcctggcttggcact

SEQ ID NO: 9289565 - DNA, 22 bp, Homo sapiens
agggcagagatctgagtgggca

SEQ ID NO: 9289566 - DNA, 22 bp, Homo sapiens
ccctctctgacttctgaacttg

SEQ ID NO: 9289567 - DNA, 22 bp, Homo sapiens
ccctctggtttgcccttgggtg

SEQ ID NO: 9289568 - DNA, 22 bp, Homo sapiens
ccctctggctgtgtgttcttag

SEQ ID NO: 9289569 - DNA, 17 bp, Homo sapiens
ccctctggggagggagg

SEQ ID NO: 9289570 - DNA, 22 bp, Homo sapiens
ccctctggctcttctcaggccg

SEQ ID NO: 9289571 - DNA, 22 bp, Homo sapiens
agggagaaggtttagctgtgag

SEQ ID NO: 9289572 - DNA, 22 bp, Homo sapiens
aggcttgactgctgattttgcc

SEQ ID NO: 9289573 - DNA, 22 bp, Homo sapiens
aggcttgaaatgaaatctgtaa

SEQ ID NO: 9289574 - DNA, 23 bp, Homo sapiens
cccaggagtttcactgcaaaggt

SEQ ID NO: 9289575 - DNA, 22 bp, Homo sapiens
ccagcctgaaatgcctcatcct

SEQ ID NO: 9289576 - DNA, 22 bp, Homo sapiens
ccagccctgccagagagagctg

SEQ ID NO: 9289577 - DNA, 22 bp, Homo sapiens
aggccagagttaaggagaacag

SEQ ID NO: 9289578 - DNA, 22 bp, Homo sapiens
ccagcttctctctgatgcagct

SEQ ID NO: 9289579 - DNA, 19 bp, Homo sapiens
ccagctggcctgggacctc

SEQ ID NO: 9289580 - DNA, 22 bp, Homo sapiens
ccagcttgaagatgtgctggtt

SEQ ID NO: 9289581 - DNA, 22 bp, Homo sapiens
ccagcttgtttgaagctcgtca

SEQ ID NO: 9289582 - DNA, 22 bp, Homo sapiens
ccagcctggactgggtcttgtg

SEQ ID NO: 9289583 - DNA, 22 bp, Homo sapiens
aggcccagagagccagttagtg

SEQ ID NO: 9289584 - DNA, 22 bp, Homo sapiens
aggccctggcccccagagattc

SEQ ID NO: 9289585 - DNA, 22 bp, Homo sapiens
aggccctgggcagttctgtagc

SEQ ID NO: 9289586 - DNA, 22 bp, Homo sapiens
aggcagggtgatgataatgatt

SEQ ID NO: 9289587 - DNA, 22 bp, Homo sapiens
aggcagggtcttgctatgttgc

SEQ ID NO: 9289588 - DNA, 22 bp, Homo sapiens
aggcaggggagctggaagggta

SEQ ID NO: 9289589 - DNA, 22 bp, Homo sapiens
aggcaggggagctggaagggta

SEQ ID NO: 9289590 - DNA, 17 bp, Homo sapiens
aggcaggtaagagttat

SEQ ID NO: 9289591 - DNA, 22 bp, Homo sapiens
ccagagagtaaacattttccgg

SEQ ID NO: 9289592 - DNA, 22 bp, Homo sapiens
ccagagaggtagcttaccctct

SEQ ID NO: 9289593 - DNA, 22 bp, Homo sapiens
aggccagaaatttggagtatgt

SEQ ID NO: 9289594 - DNA, 23 bp, Homo sapiens
aggcatggcatggatggtggctc

SEQ ID NO: 9289595 - DNA, 22 bp, Homo sapiens
aggcatggatgtagcagtgacc

SEQ ID NO: 9289596 - DNA, 22 bp, Homo sapiens
aggctcagttctgtggtgagcc

SEQ ID NO: 9289597 - DNA, 22 bp, Homo sapiens
aggctcattcttgcctctgagc

SEQ ID NO: 9289598 - DNA, 22 bp, Homo sapiens
aggctcagcctgggcctagagc

SEQ ID NO: 9289599 - DNA, 22 bp, Homo sapiens
aggctcaggtgcctcattcaca

SEQ ID NO: 9289600 - DNA, 22 bp, Homo sapiens
aggctcagtcccggcccgcgcc

SEQ ID NO: 9289601 - DNA, 22 bp, Homo sapiens
aggctcagtatagctggcaagt

SEQ ID NO: 9289602 - DNA, 22 bp, Homo sapiens
aggctcagtctgttcatgcact

SEQ ID NO: 9289603 - DNA, 22 bp, Homo sapiens
ccaggaggaaattctaaaggta

SEQ ID NO: 9289604 - DNA, 22 bp, Homo sapiens
ccaggaggaaagaccagcccat

SEQ ID NO: 9289605 - DNA, 22 bp, Homo sapiens
ccagggtcttggagaggagtgc

SEQ ID NO: 9289606 - DNA, 22 bp, Homo sapiens
aggctcctgagaggcagaggct

SEQ ID NO: 9289607 - DNA, 22 bp, Homo sapiens
aggctcctgcaggtgaggtgct

SEQ ID NO: 9289608 - DNA, 20 bp, Homo sapiens
aggctcctccaggatgtgtg

SEQ ID NO: 9289609 - DNA, 21 bp, Homo sapiens
cccagagcctagggagggcac

SEQ ID NO: 9289610 - DNA, 22 bp, Homo sapiens
cccagagccggtggtgctcaca

SEQ ID NO: 9289611 - DNA, 22 bp, Homo sapiens
aggctctgtgcatcctccccaa

SEQ ID NO: 9289612 - DNA, 22 bp, Homo sapiens
aggctctgtgcagcctgcatct

SEQ ID NO: 9289613 - DNA, 22 bp, Homo sapiens
aggctctgtgacaatcaagctg

SEQ ID NO: 9289614 - DNA, 22 bp, Homo sapiens
aggctctgtgactaaagaggat

SEQ ID NO: 9289615 - DNA, 22 bp, Homo sapiens
agtaatgtcccttaaatgtggt

SEQ ID NO: 9289616 - DNA, 22 bp, Homo sapiens
agtaatgtgcctgaaatacttg

SEQ ID NO: 9289617 - DNA, 19 bp, Homo sapiens
cctttagttgctcagagaa

SEQ ID NO: 9289618 - DNA, 22 bp, Homo sapiens
cctttatgagatcctggggtga

SEQ ID NO: 9289619 - DNA, 22 bp, Homo sapiens
cctttatgatagatgctttcag

SEQ ID NO: 9289620 - DNA, 21 bp, Homo sapiens
cctttatgcaaggactggcat

SEQ ID NO: 9289621 - DNA, 22 bp, Homo sapiens
cctttatgtcactctggagagc

SEQ ID NO: 9289622 - DNA, 22 bp, Homo sapiens
cctttatgtttctgcagccccc

SEQ ID NO: 9289623 - DNA, 20 bp, Homo sapiens
cctttattatttgtatgatg

SEQ ID NO: 9289624 - DNA, 22 bp, Homo sapiens
cctttattcaattagtcctaat

SEQ ID NO: 9289625 - DNA, 22 bp, Homo sapiens
aggttggctgctcttttcctaa

SEQ ID NO: 9289626 - DNA, 22 bp, Homo sapiens
aggtgtcttcagggtgagacag

SEQ ID NO: 9289627 - DNA, 22 bp, Homo sapiens
aggtggggttcagtctcagccg

SEQ ID NO: 9289628 - DNA, 22 bp, Homo sapiens
agtcagagagctctcagcatag

SEQ ID NO: 9289629 - DNA, 22 bp, Homo sapiens
agtcagtgtagaaagcccaggc

SEQ ID NO: 9289630 - DNA, 22 bp, Homo sapiens
agtcagtgtgattctcaggagg

SEQ ID NO: 9289631 - DNA, 22 bp, Homo sapiens
cgcgaggtggaggttgcagtga

SEQ ID NO: 9289632 - DNA, 22 bp, Homo sapiens
ctaaaattatcaagataattcc

SEQ ID NO: 9289633 - DNA, 22 bp, Homo sapiens
cgtggcctttgagtgagctccc

SEQ ID NO: 9289634 - DNA, 23 bp, Homo sapiens
cgtgcttccaggcccagctgagc

SEQ ID NO: 9289635 - DNA, 22 bp, Homo sapiens
cgtggccagccatttcctggaa

SEQ ID NO: 9289636 - DNA, 22 bp, Homo sapiens
cgtggccacccagtggtgcgtg

SEQ ID NO: 9289637 - DNA, 22 bp, Homo sapiens
cctgcctggatcagccatcctg

SEQ ID NO: 9289638 - DNA, 22 bp, Homo sapiens
agtggggacttatgccagcatt

SEQ ID NO: 9289639 - DNA, 22 bp, Homo sapiens
agtgtcctggcaagggtttcag

SEQ ID NO: 9289640 - DNA, 22 bp, Homo sapiens
agtgtcctctattatgacttta

SEQ ID NO: 9289641 - DNA, 22 bp, Homo sapiens
ctctgtttttcaatagttcttg

SEQ ID NO: 9289642 - DNA, 22 bp, Homo sapiens
ctcttaatgaccttaattcaag

SEQ ID NO: 9289643 - DNA, 22 bp, Homo sapiens
ctgagaggcagccagagaaaat

SEQ ID NO: 9289644 - DNA, 19 bp, Homo sapiens
ctgagagatgcttcacaca

SEQ ID NO: 9289645 - DNA, 22 bp, Homo sapiens
ctctgagatgataccttctgga

SEQ ID NO: 9289646 - DNA, 21 bp, Homo sapiens
agtgggatactggaaggtaga

SEQ ID NO: 9289647 - DNA, 22 bp, Homo sapiens
agtgggcagcccaggaggtctt

SEQ ID NO: 9289648 - DNA, 22 bp, Homo sapiens
agtgggcaggcagggtgcgcag

SEQ ID NO: 9289649 - DNA, 22 bp, Homo sapiens
agtgggcttactgagggagtgt

SEQ ID NO: 9289650 - DNA, 22 bp, Homo sapiens
agtgggctggtggcagggagaa

SEQ ID NO: 9289651 - DNA, 22 bp, Homo sapiens
ctctgagaatataagactattt

SEQ ID NO: 9289652 - DNA, 22 bp, Homo sapiens
ctctgagacttagcatctacat

SEQ ID NO: 9289653 - DNA, 22 bp, Homo sapiens
ctctctgggcccagttggcacc

SEQ ID NO: 9289654 - DNA, 22 bp, Homo sapiens
ctctctggcttggcacggagat

SEQ ID NO: 9289655 - DNA, 22 bp, Homo sapiens
ctctctggggttccagacgtgg

SEQ ID NO: 9289656 - DNA, 19 bp, Homo sapiens
agtgcagggagcaccctca

SEQ ID NO: 9289657 - DNA, 22 bp, Homo sapiens
ctctctccttagctgcagacca

SEQ ID NO: 9289658 - DNA, 22 bp, Homo sapiens
agtgcaggctcgcttgtgaggc

SEQ ID NO: 9289659 - DNA, 22 bp, Homo sapiens
agtgcaggccccaggccaggcc

SEQ ID NO: 9289660 - DNA, 17 bp, Homo sapiens
agtggcaggcagatggg

SEQ ID NO: 9289661 - DNA, 22 bp, Homo sapiens
agtgactgggcagggcagggcc

SEQ ID NO: 9289662 - DNA, 22 bp, Homo sapiens
agtgcaggagcctggccagagc

SEQ ID NO: 9289663 - DNA, 22 bp, Homo sapiens
ctcctccctctttgccacacat

SEQ ID NO: 9289664 - DNA, 22 bp, Homo sapiens
ctcctccctgcgattgctctgc

SEQ ID NO: 9289665 - DNA, 22 bp, Homo sapiens
ctcctccctgcgattgctctgc

SEQ ID NO: 9289666 - DNA, 22 bp, Homo sapiens
ctcccagggtagggagagacta

SEQ ID NO: 9289667 - DNA, 22 bp, Homo sapiens
ctcccaggttacatctgagcct

SEQ ID NO: 9289668 - DNA, 22 bp, Homo sapiens
agtcttacatgagaaagaacct

SEQ ID NO: 9289669 - DNA, 23 bp, Homo sapiens
agtcttactgtcccagaacaggg

SEQ ID NO: 9289670 - DNA, 22 bp, Homo sapiens
ctcaggagttggaggctacagt

SEQ ID NO: 9289671 - DNA, 22 bp, Homo sapiens
agtctctcacagaggattctcc

SEQ ID NO: 9289672 - DNA, 22 bp, Homo sapiens
agtctctttctaaataaggtca

SEQ ID NO: 9289673 - DNA, 22 bp, Homo sapiens
ataatgtgaagataatgcaaga

SEQ ID NO: 9289674 - DNA, 22 bp, Homo sapiens
ataatgtttgattgagcagata

SEQ ID NO: 9289675 - DNA, 22 bp, Homo sapiens
ataatgtttttgtataagcatg

SEQ ID NO: 9289676 - DNA, 22 bp, Homo sapiens
ataatggccgggggctgaatgc

SEQ ID NO: 9289677 - DNA, 22 bp, Homo sapiens
ataatgtaggctcctgggagaa

SEQ ID NO: 9289678 - DNA, 22 bp, Homo sapiens
ataatgtaggtatgtgtattta

SEQ ID NO: 9289679 - DNA, 22 bp, Homo sapiens
ataatgtacaactgcttttaat

SEQ ID NO: 9289680 - DNA, 21 bp, Homo sapiens
ataatgtacaaaaactgtctt

SEQ ID NO: 9289681 - DNA, 22 bp, Homo sapiens
ataatggtgaacaaaatgactc

SEQ ID NO: 9289682 - DNA, 22 bp, Homo sapiens
ataatgtaaggctccctacagt

SEQ ID NO: 9289683 - DNA, 20 bp, Homo sapiens
atacacattcatagaaaaat

SEQ ID NO: 9289684 - DNA, 22 bp, Homo sapiens
atacatgactcacacattctgc

SEQ ID NO: 9289685 - DNA, 22 bp, Homo sapiens
atacatcttgtcagattcatgt

SEQ ID NO: 9289686 - DNA, 22 bp, Homo sapiens
atacatcttccttttaaaatgc

SEQ ID NO: 9289687 - DNA, 22 bp, Homo sapiens
atacatctcatgtaagagataa

SEQ ID NO: 9289688 - DNA, 22 bp, Homo sapiens
ctggccaggctctcacgtggtc

SEQ ID NO: 9289689 - DNA, 22 bp, Homo sapiens
ctggccagaggttcctctgccc

SEQ ID NO: 9289690 - DNA, 22 bp, Homo sapiens
ctggccaggcttgggacagaca

SEQ ID NO: 9289691 - DNA, 22 bp, Homo sapiens
ctggccaggttttgaacagttg

SEQ ID NO: 9289692 - DNA, 22 bp, Homo sapiens
ctggccagggtgcgatcgtggt

SEQ ID NO: 9289693 - DNA, 22 bp, Homo sapiens
ctggccagtgcctgtgggcccc

SEQ ID NO: 9289694 - DNA, 22 bp, Homo sapiens
ctggccagtgactgctcacccg

SEQ ID NO: 9289695 - DNA, 22 bp, Homo sapiens
atagaatatgacttttagatcc

SEQ ID NO: 9289696 - DNA, 22 bp, Homo sapiens
atagggcctaaaaagtattgct

SEQ ID NO: 9289697 - DNA, 22 bp, Homo sapiens
atagggcctaaaaagtattgct

SEQ ID NO: 9289698 - DNA, 22 bp, Homo sapiens
ataggccatttgagggccaggt

SEQ ID NO: 9289699 - DNA, 22 bp, Homo sapiens
agtttatgttgtttataagcca

SEQ ID NO: 9289700 - DNA, 19 bp, Homo sapiens
agtttattataggtgattc

SEQ ID NO: 9289701 - DNA, 22 bp, Homo sapiens
agtgttagtggctgcagctggt

SEQ ID NO: 9289702 - DNA, 22 bp, Homo sapiens
agtttattctgcttggccctcc

SEQ ID NO: 9289703 - DNA, 22 bp, Homo sapiens
agtttattctctggtcttagta

SEQ ID NO: 9289704 - DNA, 20 bp, Homo sapiens
agtttattccaggagaactg

SEQ ID NO: 9289705 - DNA, 22 bp, Homo sapiens
agtttattgtatatggtagttt

SEQ ID NO: 9289706 - DNA, 22 bp, Homo sapiens
agtttattctgcttggccctcc

SEQ ID NO: 9289707 - DNA, 22 bp, Homo sapiens
agtttatttctccatttaccta

SEQ ID NO: 9289708 - DNA, 17 bp, Homo sapiens
agtttatttagccttct

SEQ ID NO: 9289709 - DNA, 22 bp, Homo sapiens
agtttatttttgataagtcttg

SEQ ID NO: 9289710 - DNA, 22 bp, Homo sapiens
agtttctgcaaatcatttttat

SEQ ID NO: 9289711 - DNA, 22 bp, Homo sapiens
agtttctgttaccatatttgac

SEQ ID NO: 9289712 - DNA, 22 bp, Homo sapiens
agtttctagcctcactgtttag

SEQ ID NO: 9289713 - DNA, 22 bp, Homo sapiens
agttttattccaatgtgcagca

SEQ ID NO: 9289714 - DNA, 22 bp, Homo sapiens
ctgagtgttttcagccacggcc

SEQ ID NO: 9289715 - DNA, 22 bp, Homo sapiens
ctgataatgtcctgcagtaaat

SEQ ID NO: 9289716 - DNA, 22 bp, Homo sapiens
ctgcctgctctatccaggcctg

SEQ ID NO: 9289717 - DNA, 22 bp, Homo sapiens
ctgcctgctgccctccagagcc

SEQ ID NO: 9289718 - DNA, 22 bp, Homo sapiens
ctgcctgcttaccatgcatcag

SEQ ID NO: 9289719 - DNA, 22 bp, Homo sapiens
ctgccctgtggctctgagtcat

SEQ ID NO: 9289720 - DNA, 22 bp, Homo sapiens
ctgccctgtctgcagcctggct

SEQ ID NO: 9289721 - DNA, 22 bp, Homo sapiens
ataagtgttaggtaaacatctt

SEQ ID NO: 9289722 - DNA, 22 bp, Homo sapiens
agttttcctctcatttatcaat

SEQ ID NO: 9289723 - DNA, 22 bp, Homo sapiens
agttttgaaatgaaatgtagtt

SEQ ID NO: 9289724 - DNA, 22 bp, Homo sapiens
ctgccctggtcccatggctgat

SEQ ID NO: 9289725 - DNA, 22 bp, Homo sapiens
ctgccctgtagctgttctagca

SEQ ID NO: 9289726 - DNA, 22 bp, Homo sapiens
ctgccctgacctgcctcagagt

SEQ ID NO: 9289727 - DNA, 21 bp, Homo sapiens
agttttgagagtgggtagtgt

SEQ ID NO: 9289728 - DNA, 17 bp, Homo sapiens
agttttgatataatggc

SEQ ID NO: 9289729 - DNA, 22 bp, Homo sapiens
agttttgactaagatggcttgg

SEQ ID NO: 9289730 - DNA, 22 bp, Homo sapiens
ctgccctcgggccctcccatag

SEQ ID NO: 9289731 - DNA, 22 bp, Homo sapiens
cttcagcacctcagctggagag

SEQ ID NO: 9289732 - DNA, 22 bp, Homo sapiens
cttcagcagcctcttgcataaa

SEQ ID NO: 9289733 - DNA, 22 bp, Homo sapiens
cttcagcagatgcaaaacccct

SEQ ID NO: 9289734 - DNA, 22 bp, Homo sapiens
cttcagcatctttttcttgggg

SEQ ID NO: 9289735 - DNA, 19 bp, Homo sapiens
cttcagcatctccggagct

SEQ ID NO: 9289736 - DNA, 22 bp, Homo sapiens
atccttggatgtgtctttttgt

SEQ ID NO: 9289737 - DNA, 21 bp, Homo sapiens
cttcagcaaatacttggcagg

SEQ ID NO: 9289738 - DNA, 22 bp, Homo sapiens
cttcatgagtgtacaacctgtg

SEQ ID NO: 9289739 - DNA, 22 bp, Homo sapiens
cttcatgagactccactgccat

SEQ ID NO: 9289740 - DNA, 22 bp, Homo sapiens
cttcatgagactccactgccat

SEQ ID NO: 9289741 - DNA, 22 bp, Homo sapiens
atctcccagccacagcattctt

SEQ ID NO: 9289742 - DNA, 22 bp, Homo sapiens
atctccaggattttcacactca

SEQ ID NO: 9289743 - DNA, 22 bp, Homo sapiens
ctgtgtcccagtaccttgggta

SEQ ID NO: 9289744 - DNA, 22 bp, Homo sapiens
ctgtgtcccagccaggataatg

SEQ ID NO: 9289745 - DNA, 22 bp, Homo sapiens
ctgtgtcccttgtcccagagcc

SEQ ID NO: 9289746 - DNA, 22 bp, Homo sapiens
ctgtgtccccctcagccaggtg

SEQ ID NO: 9289747 - DNA, 22 bp, Homo sapiens
ctgtgtcctccccatcacttct

SEQ ID NO: 9289748 - DNA, 22 bp, Homo sapiens
atcattccacatgtaccactag

SEQ ID NO: 9289749 - DNA, 22 bp, Homo sapiens
ctgttatttctgccaggtgagt

SEQ ID NO: 9289750 - DNA, 22 bp, Homo sapiens
ctgtgggagcacatgacagata

SEQ ID NO: 9289751 - DNA, 22 bp, Homo sapiens
ctgtgtccatgttctaatttgg

SEQ ID NO: 9289752 - DNA, 22 bp, Homo sapiens
ctgtgtcccacacgaggtgtat

SEQ ID NO: 9289753 - DNA, 22 bp, Homo sapiens
ctgtgtccatttatcattgtca

SEQ ID NO: 9289754 - DNA, 22 bp, Homo sapiens
ctgtgtccaatggccttagcag

SEQ ID NO: 9289755 - DNA, 22 bp, Homo sapiens
ctgtgtccaatggccttagcag

SEQ ID NO: 9289756 - DNA, 22 bp, Homo sapiens
ctgtccagcttggctcctgggg

SEQ ID NO: 9289757 - DNA, 19 bp, Homo sapiens
ctggtgcttgagtgagtca

SEQ ID NO: 9289758 - DNA, 22 bp, Homo sapiens
ctggtgctgggcagggctcagg

SEQ ID NO: 9289759 - DNA, 22 bp, Homo sapiens
ctggtgggaggcaaggtggaag

SEQ ID NO: 9289760 - DNA, 22 bp, Homo sapiens
atatttgttagagtctatgtgt

SEQ ID NO: 9289761 - DNA, 22 bp, Homo sapiens
ctggggatgggacctggcataa

SEQ ID NO: 9289762 - DNA, 22 bp, Homo sapiens
atattttgaagttaataatgtg

SEQ ID NO: 9289763 - DNA, 22 bp, Homo sapiens
ctgtaatcccagctactcggga

SEQ ID NO: 9289764 - DNA, 22 bp, Homo sapiens
ctgtatttagttaaaatgctaa

SEQ ID NO: 9289765 - DNA, 22 bp, Homo sapiens
ctgtattctgggcagggaagga

SEQ ID NO: 9289766 - DNA, 22 bp, Homo sapiens
ctgtattcaaagtgaggatgta

SEQ ID NO: 9289767 - DNA, 22 bp, Homo sapiens
ctgggccagggaggtgtctgta

SEQ ID NO: 9289768 - DNA, 22 bp, Homo sapiens
ggcaaggggtcaggctgagaca

SEQ ID NO: 9289769 - DNA, 22 bp, Homo sapiens
ggcaagtggaggtgttcatcag

SEQ ID NO: 9289770 - DNA, 22 bp, Homo sapiens
cacaggtgtatgaatatgtcca

SEQ ID NO: 9289771 - DNA, 22 bp, Homo sapiens
cacaggtggcttctttcatctt

SEQ ID NO: 9289772 - DNA, 21 bp, Homo sapiens
cacaggtgggtcagtgaggcc

SEQ ID NO: 9289773 - DNA, 22 bp, Homo sapiens
cacaggtgtccaatacctgctt

SEQ ID NO: 9289774 - DNA, 22 bp, Homo sapiens
cacaggtgtctctagtagcgtt

SEQ ID NO: 9289775 - DNA, 17 bp, Homo sapiens
cacaggtgtggtttgag

SEQ ID NO: 9289776 - DNA, 22 bp, Homo sapiens
cacaggtgtgtgccttatcaaa

SEQ ID NO: 9289777 - DNA, 22 bp, Homo sapiens
cacaggtgtgtcctggtcttgt

SEQ ID NO: 9289778 - DNA, 22 bp, Homo sapiens
cacaggtgttcttgcagtgaaa

SEQ ID NO: 9289779 - DNA, 22 bp, Homo sapiens
cacaggtgtttgttatactcag

SEQ ID NO: 9289780 - DNA, 23 bp, Homo sapiens
cacaggtgtttcatcttctcagt

SEQ ID NO: 9289781 - DNA, 22 bp, Homo sapiens
cacaggcacgcctctggccagg

SEQ ID NO: 9289782 - DNA, 22 bp, Homo sapiens
cacaggcaggaggttctccagt

SEQ ID NO: 9289783 - DNA, 22 bp, Homo sapiens
cacaggaggttaggaagtggtc

SEQ ID NO: 9289784 - DNA, 22 bp, Homo sapiens
cacaggtgccatctcttcatgg

SEQ ID NO: 9289785 - DNA, 22 bp, Homo sapiens
cacaggtgcaagaagttgcagt

SEQ ID NO: 9289786 - DNA, 22 bp, Homo sapiens
cacaggtgctcctcggggagct

SEQ ID NO: 9289787 - DNA, 22 bp, Homo sapiens
cacaggtggctccaagttagag

SEQ ID NO: 9289788 - DNA, 22 bp, Homo sapiens
cacattcatcagtgttgtactg

SEQ ID NO: 9289789 - DNA, 22 bp, Homo sapiens
cacattcatggagtttgcctgt

SEQ ID NO: 9289790 - DNA, 22 bp, Homo sapiens
cacattcagggcagaccactca

SEQ ID NO: 9289791 - DNA, 22 bp, Homo sapiens
cacattcagggaacattggagg

SEQ ID NO: 9289792 - DNA, 22 bp, Homo sapiens
cacattcaggtggcatgttaga

SEQ ID NO: 9289793 - DNA, 22 bp, Homo sapiens
cacattcctggtgctcagcagc

SEQ ID NO: 9289794 - DNA, 21 bp, Homo sapiens
cacatgtgaattactgaactg

SEQ ID NO: 9289795 - DNA, 22 bp, Homo sapiens
cacatgtgcagttacatgaatt

SEQ ID NO: 9289796 - DNA, 22 bp, Homo sapiens
cacatgtgcaaatactgaggct

SEQ ID NO: 9289797 - DNA, 22 bp, Homo sapiens
cacatgtgggaaatggtgctta

SEQ ID NO: 9289798 - DNA, 22 bp, Homo sapiens
cacatgtgtatatgtgaggggg

SEQ ID NO: 9289799 - DNA, 22 bp, Homo sapiens
cacatgtgtgctgaggactgtg

SEQ ID NO: 9289800 - DNA, 20 bp, Homo sapiens
cacattaaggaaaacaactg

SEQ ID NO: 9289801 - DNA, 22 bp, Homo sapiens
cacattcaggattttccatgtc

SEQ ID NO: 9289802 - DNA, 22 bp, Homo sapiens
cacattcagctcattaatggtc

SEQ ID NO: 9289803 - DNA, 22 bp, Homo sapiens
cacattcacatttttccctcta

SEQ ID NO: 9289804 - DNA, 22 bp, Homo sapiens
cacattcacttctctgtccacc

SEQ ID NO: 9289805 - DNA, 22 bp, Homo sapiens
cacattcaattacacagatagg

SEQ ID NO: 9289806 - DNA, 22 bp, Homo sapiens
ggcagagttggtggagtcagtt

SEQ ID NO: 9289807 - DNA, 22 bp, Homo sapiens
ggcagagtgctctgggcagggg

SEQ ID NO: 9289808 - DNA, 22 bp, Homo sapiens
cacatatatgaaatgaggaatt

SEQ ID NO: 9289809 - DNA, 22 bp, Homo sapiens
cacttattatgggctaggaact

SEQ ID NO: 9289810 - DNA, 22 bp, Homo sapiens
cacttatttatgcagaaaagtt

SEQ ID NO: 9289811 - DNA, 20 bp, Homo sapiens
ggctctgcttgtgagcagcc

SEQ ID NO: 9289812 - DNA, 22 bp, Homo sapiens
cacttgttggtggtgaaatcac

SEQ ID NO: 9289813 - DNA, 17 bp, Homo sapiens
ggctgctgtgctggtgc

SEQ ID NO: 9289814 - DNA, 22 bp, Homo sapiens
cactgcactccagcctgggtga

SEQ ID NO: 9289815 - DNA, 22 bp, Homo sapiens
cactgcactccagcctgggtga

SEQ ID NO: 9289816 - DNA, 22 bp, Homo sapiens
cactgcactccagcctgggtca

SEQ ID NO: 9289817 - DNA, 22 bp, Homo sapiens
cactgcactccagcctgggtca

SEQ ID NO: 9289818 - DNA, 22 bp, Homo sapiens
ggctctgcttcctggaattgtg

SEQ ID NO: 9289819 - DNA, 22 bp, Homo sapiens
ggctctgcttcctggaattgtg

SEQ ID NO: 9289820 - DNA, 22 bp, Homo sapiens
ggctctgcttctcacctgttcc

SEQ ID NO: 9289821 - DNA, 22 bp, Homo sapiens
ggctctgcttgaggccagcctg

SEQ ID NO: 9289822 - DNA, 22 bp, Homo sapiens
ggctctgctggattgaggccag

SEQ ID NO: 9289823 - DNA, 22 bp, Homo sapiens
ggctctgcttcagaaggctcat

SEQ ID NO: 9289824 - DNA, 22 bp, Homo sapiens
ggctctgctggtaagatgcctc

SEQ ID NO: 9289825 - DNA, 22 bp, Homo sapiens
cactgcactccagcctgggaga

SEQ ID NO: 9289826 - DNA, 22 bp, Homo sapiens
cactgcactccagcctgggaga

SEQ ID NO: 9289827 - DNA, 21 bp, Homo sapiens
cactccacttagaacagggtt

SEQ ID NO: 9289828 - DNA, 22 bp, Homo sapiens
cacctgggctttctctggaact

SEQ ID NO: 9289829 - DNA, 22 bp, Homo sapiens
ggccaggctggtctcagacttc

SEQ ID NO: 9289830 - DNA, 20 bp, Homo sapiens
caccaggcgctctgagaaca

SEQ ID NO: 9289831 - DNA, 22 bp, Homo sapiens
caccaggctgaaccagagggga

SEQ ID NO: 9289832 - DNA, 22 bp, Homo sapiens
caccaggctggagtgcagaggt

SEQ ID NO: 9289833 - DNA, 22 bp, Homo sapiens
caaagtgctaggattacaggcg

SEQ ID NO: 9289834 - DNA, 22 bp, Homo sapiens
caaagtgctaggattacaggcc

SEQ ID NO: 9289835 - DNA, 22 bp, Homo sapiens
gctctggaggctggaagaccat

SEQ ID NO: 9289836 - DNA, 22 bp, Homo sapiens
gctctgctgtgtttgttcagca

SEQ ID NO: 9289837 - DNA, 22 bp, Homo sapiens
gctctgcttgcatcatgactgc

SEQ ID NO: 9289838 - DNA, 22 bp, Homo sapiens
gctctgctttctggggggatcc

SEQ ID NO: 9289839 - DNA, 22 bp, Homo sapiens
gctctggactggggcctgagaa

SEQ ID NO: 9289840 - DNA, 22 bp, Homo sapiens
gctctggagagccataggccct

SEQ ID NO: 9289841 - DNA, 22 bp, Homo sapiens
gctctggaccctggagtggctg

SEQ ID NO: 9289842 - DNA, 22 bp, Homo sapiens
gctgcttttcacagagacaaga

SEQ ID NO: 9289843 - DNA, 22 bp, Homo sapiens
gctgctttgaaagaggagcttt

SEQ ID NO: 9289844 - DNA, 22 bp, Homo sapiens
gctgcctgcctagttccacagt

SEQ ID NO: 9289845 - DNA, 18 bp, Homo sapiens
gctgcctgcattcctcac

SEQ ID NO: 9289846 - DNA, 19 bp, Homo sapiens
caagacaaagcccatcttc

SEQ ID NO: 9289847 - DNA, 22 bp, Homo sapiens
caagctccttacatccacaggg

SEQ ID NO: 9289848 - DNA, 22 bp, Homo sapiens
cacaaataccagtttcctaaca

SEQ ID NO: 9289849 - DNA, 22 bp, Homo sapiens
ggaagctccccaagcctgccct

SEQ ID NO: 9289850 - DNA, 22 bp, Homo sapiens
ggacagcttgcctggtaatgca

SEQ ID NO: 9289851 - DNA, 20 bp, Homo sapiens
cacaactgtccacatgctcc

SEQ ID NO: 9289852 - DNA, 23 bp, Homo sapiens
ggacatgtctctgggtattttga

SEQ ID NO: 9289853 - DNA, 22 bp, Homo sapiens
ggacatgtgcaacttctttgga

SEQ ID NO: 9289854 - DNA, 22 bp, Homo sapiens
ggacatgttccttttcatcttt

SEQ ID NO: 9289855 - DNA, 22 bp, Homo sapiens
ggacatttttcttcctacaatg

SEQ ID NO: 9289856 - DNA, 22 bp, Homo sapiens
ggaccaaatgctttttaattga

SEQ ID NO: 9289857 - DNA, 22 bp, Homo sapiens
ggacatttgcacctacctcagc

SEQ ID NO: 9289858 - DNA, 21 bp, Homo sapiens
cacacagtgatctatccacat

SEQ ID NO: 9289859 - DNA, 22 bp, Homo sapiens
cacacagtaggcactcattaat

SEQ ID NO: 9289860 - DNA, 22 bp, Homo sapiens
ggactgggtaggagcccagggc

SEQ ID NO: 9289861 - DNA, 22 bp, Homo sapiens
ggagaaggcacacccacctctg

SEQ ID NO: 9289862 - DNA, 22 bp, Homo sapiens
cacacaggagagtgctggaggt

SEQ ID NO: 9289863 - DNA, 22 bp, Homo sapiens
cacacaggagagtgctggaggt

SEQ ID NO: 9289864 - DNA, 22 bp, Homo sapiens
cacacaggatgaagcagcagaa

SEQ ID NO: 9289865 - DNA, 22 bp, Homo sapiens
ggagaagggacagactcagctt

SEQ ID NO: 9289866 - DNA, 22 bp, Homo sapiens
ggagaagggccaattccatgta

SEQ ID NO: 9289867 - DNA, 22 bp, Homo sapiens
caatactgagtttacattcatc

SEQ ID NO: 9289868 - DNA, 22 bp, Homo sapiens
caatagaaaactcaatacttaa

SEQ ID NO: 9289869 - DNA, 22 bp, Homo sapiens
caattgtatgtgagaaataaat

SEQ ID NO: 9289870 - DNA, 22 bp, Homo sapiens
caatcacaaagagacaagtgtc

SEQ ID NO: 9289871 - DNA, 22 bp, Homo sapiens
caatttctaacattccatggat

SEQ ID NO: 9289872 - DNA, 22 bp, Homo sapiens
cagaaacagagaaatattggct

SEQ ID NO: 9289873 - DNA, 22 bp, Homo sapiens
cagaattatagttgctttttaa

SEQ ID NO: 9289874 - DNA, 22 bp, Homo sapiens
ggctggcactgaggagagctct

SEQ ID NO: 9289875 - DNA, 22 bp, Homo sapiens
cagaaaataaagtttctacgca

SEQ ID NO: 9289876 - DNA, 22 bp, Homo sapiens
cagaaaatagagtttctctgag

SEQ ID NO: 9289877 - DNA, 19 bp, Homo sapiens
ggctggcaagtgacagtgt

SEQ ID NO: 9289878 - DNA, 22 bp, Homo sapiens
gggagctgatcaggtggattca

SEQ ID NO: 9289879 - DNA, 22 bp, Homo sapiens
gggagctgatgatgtaagtccc

SEQ ID NO: 9289880 - DNA, 22 bp, Homo sapiens
gggagctgcacacgccccggaa

SEQ ID NO: 9289881 - DNA, 22 bp, Homo sapiens
gggagctgccaccacccctggg

SEQ ID NO: 9289882 - DNA, 21 bp, Homo sapiens
gggagctggaaactgggtgac

SEQ ID NO: 9289883 - DNA, 21 bp, Homo sapiens
gggagctggaaactgggtgac

SEQ ID NO: 9289884 - DNA, 20 bp, Homo sapiens
gggagctggaattgtcttag

SEQ ID NO: 9289885 - DNA, 22 bp, Homo sapiens
gggagctgcggtcttgcgaaga

SEQ ID NO: 9289886 - DNA, 22 bp, Homo sapiens
gggagctgctgaacacaagggt

SEQ ID NO: 9289887 - DNA, 22 bp, Homo sapiens
gggagctgccttagaccggagg

SEQ ID NO: 9289888 - DNA, 22 bp, Homo sapiens
cagagcactgcttggaggattt

SEQ ID NO: 9289889 - DNA, 22 bp, Homo sapiens
cagacttgacggcagctgcttt

SEQ ID NO: 9289890 - DNA, 22 bp, Homo sapiens
gggcaggggtcagtggccccaa

SEQ ID NO: 9289891 - DNA, 22 bp, Homo sapiens
gggcaggtactgggtggtgagc

SEQ ID NO: 9289892 - DNA, 22 bp, Homo sapiens
gggcaggtacaagatgcttctt

SEQ ID NO: 9289893 - DNA, 22 bp, Homo sapiens
gggcaggtaggtgaaataatga

SEQ ID NO: 9289894 - DNA, 22 bp, Homo sapiens
cagagcagtgaggagttgtgta

SEQ ID NO: 9289895 - DNA, 18 bp, Homo sapiens
cagagcagaggtggagcg

SEQ ID NO: 9289896 - DNA, 22 bp, Homo sapiens
gggcaggggtagcattccaagt

SEQ ID NO: 9289897 - DNA, 22 bp, Homo sapiens
gggcaggggtcagtggccccaa

SEQ ID NO: 9289898 - DNA, 22 bp, Homo sapiens
gggcaggggtagcattccaagt

SEQ ID NO: 9289899 - DNA, 22 bp, Homo sapiens
gggtgggatctgtggagcctca

SEQ ID NO: 9289900 - DNA, 18 bp, Homo sapiens
gggtccccagctgcaggg

SEQ ID NO: 9289901 - DNA, 20 bp, Homo sapiens
gggtcctgacttggtctcct

SEQ ID NO: 9289902 - DNA, 21 bp, Homo sapiens
gggtagcgtgtggaagatccg

SEQ ID NO: 9289903 - DNA, 22 bp, Homo sapiens
gggtagccagacaaggggatgc

SEQ ID NO: 9289904 - DNA, 22 bp, Homo sapiens
gggtaggaaatccagaggtggc

SEQ ID NO: 9289905 - DNA, 22 bp, Homo sapiens
gggtaggaaatccagaggtggc

SEQ ID NO: 9289906 - DNA, 22 bp, Homo sapiens
gggtccaggtcttcaggcagag

SEQ ID NO: 9289907 - DNA, 22 bp, Homo sapiens
gggttcagtccctcttgctact

SEQ ID NO: 9289908 - DNA, 22 bp, Homo sapiens
ggtagtttaagaaataattgtt

SEQ ID NO: 9289909 - DNA, 22 bp, Homo sapiens
ggtagtgaggtgaaagagaggt

SEQ ID NO: 9289910 - DNA, 22 bp, Homo sapiens
ggtatggagtctgagtttctag

SEQ ID NO: 9289911 - DNA, 22 bp, Homo sapiens
ggtatggatcagatgggctcaa

SEQ ID NO: 9289912 - DNA, 22 bp, Homo sapiens
gggttaggttctagaggcacaa

SEQ ID NO: 9289913 - DNA, 20 bp, Homo sapiens
cagatggcacgtcagggcat

SEQ ID NO: 9289914 - DNA, 19 bp, Homo sapiens
ggtcctcagcagagcatgc

SEQ ID NO: 9289915 - DNA, 22 bp, Homo sapiens
ggtcctcaatcccaacaaggca

SEQ ID NO: 9289916 - DNA, 22 bp, Homo sapiens
ggggcctgtagagcttcaggga

SEQ ID NO: 9289917 - DNA, 22 bp, Homo sapiens
gggtaaatctcttttcatggct

SEQ ID NO: 9289918 - DNA, 20 bp, Homo sapiens
ggggttggctggcacaggga

SEQ ID NO: 9289919 - DNA, 22 bp, Homo sapiens
gggtaaggtcagccagaagttc

SEQ ID NO: 9289920 - DNA, 22 bp, Homo sapiens
gggtacagagagatgaggtaac

SEQ ID NO: 9289921 - DNA, 21 bp, Homo sapiens
ggggcagagctaggccctgca

SEQ ID NO: 9289922 - DNA, 22 bp, Homo sapiens
ggggcagaagtagtgcccctga

SEQ ID NO: 9289923 - DNA, 18 bp, Homo sapiens
gggctgtgagatgggaag

SEQ ID NO: 9289924 - DNA, 22 bp, Homo sapiens
gggctgtgagagtggggctgct

SEQ ID NO: 9289925 - DNA, 22 bp, Homo sapiens
gggctgtgcctcaggtggggtc

SEQ ID NO: 9289926 - DNA, 22 bp, Homo sapiens
gggctgtggagccgcgagggct

SEQ ID NO: 9289927 - DNA, 22 bp, Homo sapiens
cagattctcactgtattcaggt

SEQ ID NO: 9289928 - DNA, 22 bp, Homo sapiens
cagattctcactgtattcaggt

SEQ ID NO: 9289929 - DNA, 22 bp, Homo sapiens
cagattctccaggggctgcaga

SEQ ID NO: 9289930 - DNA, 22 bp, Homo sapiens
cagattcttcattgccccattc

SEQ ID NO: 9289931 - DNA, 22 bp, Homo sapiens
cagatttaggtcactagaattt

SEQ ID NO: 9289932 - DNA, 22 bp, Homo sapiens
cagcaaaatttgaggattgcct

SEQ ID NO: 9289933 - DNA, 22 bp, Homo sapiens
gtaggcagataggagtgcagcc

SEQ ID NO: 9289934 - DNA, 22 bp, Homo sapiens
gtactttagagtaaaatagacc

SEQ ID NO: 9289935 - DNA, 22 bp, Homo sapiens
gtactttaagactccagtagca

SEQ ID NO: 9289936 - DNA, 22 bp, Homo sapiens
gtactttaaatcaatgtagatt

SEQ ID NO: 9289937 - DNA, 21 bp, Homo sapiens
gtacacacaggtggatgggct

SEQ ID NO: 9289938 - DNA, 22 bp, Homo sapiens
gtacacactatttaaagtgttt

SEQ ID NO: 9289939 - DNA, 22 bp, Homo sapiens
gtacacactatgtattgtacac

SEQ ID NO: 9289940 - DNA, 22 bp, Homo sapiens
gtacacactgtttgatcatttc

SEQ ID NO: 9289941 - DNA, 22 bp, Homo sapiens
gtacacagatgcttgagaatct

SEQ ID NO: 9289942 - DNA, 22 bp, Homo sapiens
gtcacaggcctggatgaggggc

SEQ ID NO: 9289943 - DNA, 22 bp, Homo sapiens
gtcacaggcagtaactaggacc

SEQ ID NO: 9289944 - DNA, 22 bp, Homo sapiens
gtagggacttgttttactagta

SEQ ID NO: 9289945 - DNA, 22 bp, Homo sapiens
gtagggacccacagtctatatt

SEQ ID NO: 9289946 - DNA, 19 bp, Homo sapiens
gtagggacagtggttctga

SEQ ID NO: 9289947 - DNA, 21 bp, Homo sapiens
gtagggacagagagttggtga

SEQ ID NO: 9289948 - DNA, 22 bp, Homo sapiens
gtagggaagggagcactggaca

SEQ ID NO: 9289949 - DNA, 21 bp, Homo sapiens
gtcacacaggcctggagctga

SEQ ID NO: 9289950 - DNA, 22 bp, Homo sapiens
gtcacacagggcctccaaatca

SEQ ID NO: 9289951 - DNA, 22 bp, Homo sapiens
gtccagagaggcaggaggctac

SEQ ID NO: 9289952 - DNA, 22 bp, Homo sapiens
cagccaggatggagaactgttg

SEQ ID NO: 9289953 - DNA, 22 bp, Homo sapiens
cagccagaacctaggatgagct

SEQ ID NO: 9289954 - DNA, 22 bp, Homo sapiens
cagccagaaagtctgttaggga

SEQ ID NO: 9289955 - DNA, 22 bp, Homo sapiens
cagccagaaagtatgttaggga

SEQ ID NO: 9289956 - DNA, 19 bp, Homo sapiens
cagccctcttaccactgtg

SEQ ID NO: 9289957 - DNA, 22 bp, Homo sapiens
atgcagtggcttcagtgtcagt

SEQ ID NO: 9289958 - DNA, 22 bp, Homo sapiens
gaagcggcatcaggaggctgcc

SEQ ID NO: 9289959 - DNA, 22 bp, Homo sapiens
gaagccttgaactgcaaacccc

SEQ ID NO: 9289960 - DNA, 22 bp, Homo sapiens
atgagctgtaaggtggcttcct

SEQ ID NO: 9289961 - DNA, 22 bp, Homo sapiens
atgagctgggccatccagtgat

SEQ ID NO: 9289962 - DNA, 22 bp, Homo sapiens
atgatgtaacataaagatgtct

SEQ ID NO: 9289963 - DNA, 22 bp, Homo sapiens
atgatgtaatggaaagaacaga

SEQ ID NO: 9289964 - DNA, 22 bp, Homo sapiens
atgatgtaagggtaattgtcta

SEQ ID NO: 9289965 - DNA, 22 bp, Homo sapiens
atgatgtactagttaaatatta

SEQ ID NO: 9289966 - DNA, 22 bp, Homo sapiens
atgatgtaccactttctcagtt

SEQ ID NO: 9289967 - DNA, 22 bp, Homo sapiens
atgatgtagacaaaaatatgct

SEQ ID NO: 9289968 - DNA, 22 bp, Homo sapiens
atgccactgcactccagcctag

SEQ ID NO: 9289969 - DNA, 22 bp, Homo sapiens
atgccactgcactccagcctag

SEQ ID NO: 9289970 - DNA, 22 bp, Homo sapiens
atgccactgcactccagcctgg

SEQ ID NO: 9289971 - DNA, 22 bp, Homo sapiens
atgccactgcactccagcctgg

SEQ ID NO: 9289972 - DNA, 22 bp, Homo sapiens
atgccactgcacttcagcctgg

SEQ ID NO: 9289973 - DNA, 23 bp, Homo sapiens
gaagtcagccctacagagagcag

SEQ ID NO: 9289974 - DNA, 22 bp, Homo sapiens
atgcatttgacgggatatattt

SEQ ID NO: 9289975 - DNA, 22 bp, Homo sapiens
gaagtctctctggagagtagaa

SEQ ID NO: 9289976 - DNA, 22 bp, Homo sapiens
gaagtctctctgggctcagttc

SEQ ID NO: 9289977 - DNA, 22 bp, Homo sapiens
gaagtctcatagttaaaattct

SEQ ID NO: 9289978 - DNA, 22 bp, Homo sapiens
gaagtctcacagacagatcaga

SEQ ID NO: 9289979 - DNA, 22 bp, Homo sapiens
gaagtctcatttggtgtcagtt

SEQ ID NO: 9289980 - DNA, 23 bp, Homo sapiens
atgacactcctgtgcgcaccctg

SEQ ID NO: 9289981 - DNA, 22 bp, Homo sapiens
atgacacttggtgatactttgt

SEQ ID NO: 9289982 - DNA, 22 bp, Homo sapiens
atgagaaagagttgtatctaga

SEQ ID NO: 9289983 - DNA, 22 bp, Homo sapiens
atgagatgtgtctaatggaacc

SEQ ID NO: 9289984 - DNA, 22 bp, Homo sapiens
atgagataggaacaaacttaca

SEQ ID NO: 9289985 - DNA, 22 bp, Homo sapiens
atgacagaccctctaaagacaa

SEQ ID NO: 9289986 - DNA, 22 bp, Homo sapiens
atgacagaggagtgcaggtgat

SEQ ID NO: 9289987 - DNA, 22 bp, Homo sapiens
atgacagaggattgtaaagagg

SEQ ID NO: 9289988 - DNA, 21 bp, Homo sapiens
atctttattacgcagagaaga

SEQ ID NO: 9289989 - DNA, 22 bp, Homo sapiens
atctttctctgcactatacaat

SEQ ID NO: 9289990 - DNA, 22 bp, Homo sapiens
atctttcctgttttcagacagc

SEQ ID NO: 9289991 - DNA, 19 bp, Homo sapiens
cttctccagcttctagaag

SEQ ID NO: 9289992 - DNA, 22 bp, Homo sapiens
ctttattgtccttcttaggtgg

SEQ ID NO: 9289993 - DNA, 22 bp, Homo sapiens
ctttattgtccttcttaggtgg

SEQ ID NO: 9289994 - DNA, 22 bp, Homo sapiens
ctttattgtccttcttaggtgg

SEQ ID NO: 9289995 - DNA, 22 bp, Homo sapiens
ctttattagatgtagactttct

SEQ ID NO: 9289996 - DNA, 22 bp, Homo sapiens
ctttacagtgctgctaatggct

SEQ ID NO: 9289997 - DNA, 22 bp, Homo sapiens
atgctgggaaactgaaaggaat

SEQ ID NO: 9289998 - DNA, 22 bp, Homo sapiens
atgctgggaagacaaggtggag

SEQ ID NO: 9289999 - DNA, 22 bp, Homo sapiens
atgctgggaagacaaggtggag

SEQ ID NO: 9290000 - DNA, 16 bp, Homo sapiens
atgctgctattagagg

SEQ ID NO: 9290001 - DNA, 22 bp, Homo sapiens
atgctgggaaactgaaaggaat

SEQ ID NO: 9290002 - DNA, 22 bp, Homo sapiens
atgctggggcctcagaccagaa

SEQ ID NO: 9290003 - DNA, 22 bp, Homo sapiens
atgctggggcctcagaccagaa

SEQ ID NO: 9290004 - DNA, 22 bp, Homo sapiens
gagacaggatttaaccaaagct

SEQ ID NO: 9290005 - DNA, 22 bp, Homo sapiens
gagacaggcagctagtgggtca

SEQ ID NO: 9290006 - DNA, 22 bp, Homo sapiens
gagacaggccaggtggtactta

SEQ ID NO: 9290007 - DNA, 22 bp, Homo sapiens
gagaatcatttacagaatgatt

SEQ ID NO: 9290008 - DNA, 22 bp, Homo sapiens
gagaatcatggcaacagaatga

SEQ ID NO: 9290009 - DNA, 21 bp, Homo sapiens
gagaatagaggggaagctgaa

SEQ ID NO: 9290010 - DNA, 22 bp, Homo sapiens
gagaatatcttggcagtctctg

SEQ ID NO: 9290011 - DNA, 22 bp, Homo sapiens
gagacaggatttaaccaaagct

SEQ ID NO: 9290012 - DNA, 22 bp, Homo sapiens
atggatggcctgagcacagctg

SEQ ID NO: 9290013 - DNA, 22 bp, Homo sapiens
atggcagacacaggcaggcaga

SEQ ID NO: 9290014 - DNA, 22 bp, Homo sapiens
atggcagacctcctggccacaa

SEQ ID NO: 9290015 - DNA, 22 bp, Homo sapiens
atggcagaagtcaagatgagtt

SEQ ID NO: 9290016 - DNA, 22 bp, Homo sapiens
atggcagaaaggcatgtgggcc

SEQ ID NO: 9290017 - DNA, 22 bp, Homo sapiens
atgggcagagctggtgggaggc

SEQ ID NO: 9290018 - DNA, 22 bp, Homo sapiens
atggcagagaacaaagcaacaa

SEQ ID NO: 9290019 - DNA, 22 bp, Homo sapiens
atggcagagaaagcgagccaca

SEQ ID NO: 9290020 - DNA, 22 bp, Homo sapiens
atggcagacgaggcagcagggg

SEQ ID NO: 9290021 - DNA, 22 bp, Homo sapiens
atggcagacgaggcagcagggg

SEQ ID NO: 9290022 - DNA, 19 bp, Homo sapiens
atggctctgatttaatgtg

SEQ ID NO: 9290023 - DNA, 19 bp, Homo sapiens
gagcacagcggcatttggt

SEQ ID NO: 9290024 - DNA, 22 bp, Homo sapiens
atgtcagaagaacaatgagata

SEQ ID NO: 9290025 - DNA, 22 bp, Homo sapiens
atgtcagatcctcagaaagtct

SEQ ID NO: 9290026 - DNA, 22 bp, Homo sapiens
atgttacatagtccttatttgt

SEQ ID NO: 9290027 - DNA, 22 bp, Homo sapiens
gaggttggcgccctgcctggcc

SEQ ID NO: 9290028 - DNA, 22 bp, Homo sapiens
gaggttgggatgagggatacag

SEQ ID NO: 9290029 - DNA, 22 bp, Homo sapiens
atgggcagctgcagcagtggtg

SEQ ID NO: 9290030 - DNA, 22 bp, Homo sapiens
gaggagctgggtcagggagaca

SEQ ID NO: 9290031 - DNA, 22 bp, Homo sapiens
atgggcagcagctgtcattttc

SEQ ID NO: 9290032 - DNA, 22 bp, Homo sapiens
atgggcagagtggggacaggaa

SEQ ID NO: 9290033 - DNA, 22 bp, Homo sapiens
gaggcacagtcccgaggcaagg

SEQ ID NO: 9290034 - DNA, 22 bp, Homo sapiens
atgtattcaagccacatacatt

SEQ ID NO: 9290035 - DNA, 22 bp, Homo sapiens
atgtatttctatgtagtgaaga

SEQ ID NO: 9290036 - DNA, 22 bp, Homo sapiens
gaggctctgtgatgtgccaggc

SEQ ID NO: 9290037 - DNA, 22 bp, Homo sapiens
gcccagtgctgagggtgctgct

SEQ ID NO: 9290038 - DNA, 22 bp, Homo sapiens
gcccagtgggaagctaaggtgg

SEQ ID NO: 9290039 - DNA, 20 bp, Homo sapiens
gccctgtgatgtcttgacct

SEQ ID NO: 9290040 - DNA, 18 bp, Homo sapiens
gccctggtggagctggtg

SEQ ID NO: 9290041 - DNA, 22 bp, Homo sapiens
atttcttcaggtcagaaataga

SEQ ID NO: 9290042 - DNA, 22 bp, Homo sapiens
atttcttaaaacttcagggaga

SEQ ID NO: 9290043 - DNA, 19 bp, Homo sapiens
atttattgtatgattccat

SEQ ID NO: 9290044 - DNA, 19 bp, Homo sapiens
atttattgtatgattccat

SEQ ID NO: 9290045 - DNA, 22 bp, Homo sapiens
atttattggtttgcatggtgaa

SEQ ID NO: 9290046 - DNA, 22 bp, Homo sapiens
gccatgcatttcgctgggaggg

SEQ ID NO: 9290047 - DNA, 22 bp, Homo sapiens
gccatgcaatggaataaaatca

SEQ ID NO: 9290048 - DNA, 22 bp, Homo sapiens
gccatcctctgagcactaggca

SEQ ID NO: 9290049 - DNA, 22 bp, Homo sapiens
gccaggtggctgagcagctgca

SEQ ID NO: 9290050 - DNA, 22 bp, Homo sapiens
atttatgcatcccagcatgtga

SEQ ID NO: 9290051 - DNA, 22 bp, Homo sapiens
atttatctctggaaactaagca

SEQ ID NO: 9290052 - DNA, 22 bp, Homo sapiens
atttagtttaggaaaagtaggt

SEQ ID NO: 9290053 - DNA, 22 bp, Homo sapiens
gccagctggagtgagagtgggc

SEQ ID NO: 9290054 - DNA, 22 bp, Homo sapiens
gccagctggagtgagagtgggc

SEQ ID NO: 9290055 - DNA, 22 bp, Homo sapiens
gccagctggagactggcagggg

SEQ ID NO: 9290056 - DNA, 22 bp, Homo sapiens
gccagctggaaatctgcttgaa

SEQ ID NO: 9290057 - DNA, 22 bp, Homo sapiens
gccagccaggaagaaagtaaga

SEQ ID NO: 9290058 - DNA, 22 bp, Homo sapiens
gccagctgctcgcgtagggtag

SEQ ID NO: 9290059 - DNA, 22 bp, Homo sapiens
gccagctgcatctcctgggctg

SEQ ID NO: 9290060 - DNA, 22 bp, Homo sapiens
gccagctgccctctgctggtcc

SEQ ID NO: 9290061 - DNA, 22 bp, Homo sapiens
attgtacatgcagtgagtcatc

SEQ ID NO: 9290062 - DNA, 19 bp, Homo sapiens
attgtacattgagtttggc

SEQ ID NO: 9290063 - DNA, 22 bp, Homo sapiens
atttgtatcaatctcaatatat

SEQ ID NO: 9290064 - DNA, 22 bp, Homo sapiens
atttggtgcctgggaaatctct

SEQ ID NO: 9290065 - DNA, 22 bp, Homo sapiens
attttgactgcattacagaaca

SEQ ID NO: 9290066 - DNA, 18 bp, Homo sapiens
gccttcggtctgatttga

SEQ ID NO: 9290067 - DNA, 20 bp, Homo sapiens
caaaagcaatgaagttatga

SEQ ID NO: 9290068 - DNA, 22 bp, Homo sapiens
gctctgctgtggaatcctctcc

SEQ ID NO: 9290069 - DNA, 22 bp, Homo sapiens
gctctgctgggtgggcagttat

SEQ ID NO: 9290070 - DNA, 22 bp, Homo sapiens
gctctgctgtcttcttgcaggc

SEQ ID NO: 9290071 - DNA, 22 bp, Homo sapiens
gctctgagattgagcctttggt

SEQ ID NO: 9290072 - DNA, 22 bp, Homo sapiens
gctctgctggagggaaagagaa

SEQ ID NO: 9290073 - DNA, 22 bp, Homo sapiens
gctctgagataaacgttgccct

SEQ ID NO: 9290074 - DNA, 22 bp, Homo sapiens
attataggcttgagccaccgtg

SEQ ID NO: 9290075 - DNA, 22 bp, Homo sapiens
attagttgtgtggttctcaatt

SEQ ID NO: 9290076 - DNA, 22 bp, Homo sapiens
attagttgtacagttcattttg

SEQ ID NO: 9290077 - DNA, 22 bp, Homo sapiens
attatattgagtataaccagag

SEQ ID NO: 9290078 - DNA, 22 bp, Homo sapiens
gcacacagctagattaccattc

SEQ ID NO: 9290079 - DNA, 22 bp, Homo sapiens
gcaccaggcttagagccccagg

SEQ ID NO: 9290080 - DNA, 22 bp, Homo sapiens
gcaccatgatggagcctcatta

SEQ ID NO: 9290081 - DNA, 22 bp, Homo sapiens
attatgtagctaaaaattgtgt

SEQ ID NO: 9290082 - DNA, 22 bp, Homo sapiens
gatgtgtcatttggtcatctgc

SEQ ID NO: 9290083 - DNA, 22 bp, Homo sapiens
gattcccatgtctgaggaggtg

SEQ ID NO: 9290084 - DNA, 22 bp, Homo sapiens
gattcttgggccttctgaagtt

SEQ ID NO: 9290085 - DNA, 22 bp, Homo sapiens
gagtgggcaccgtgggcacact

SEQ ID NO: 9290086 - DNA, 22 bp, Homo sapiens
gatggccacatacatggctggg

SEQ ID NO: 9290087 - DNA, 22 bp, Homo sapiens
gatggcaggtagtggtctcatc

SEQ ID NO: 9290088 - DNA, 22 bp, Homo sapiens
atgttatttattgaaacacttt

SEQ ID NO: 9290089 - DNA, 22 bp, Homo sapiens
gcagcttggtgaaaggtgatgg

SEQ ID NO: 9290090 - DNA, 22 bp, Homo sapiens
gcagcttggatttctgtagttt

SEQ ID NO: 9290091 - DNA, 22 bp, Homo sapiens
attccacttccactagtttctc

SEQ ID NO: 9290092 - DNA, 22 bp, Homo sapiens
attccacacagtaatactcaat

SEQ ID NO: 9290093 - DNA, 22 bp, Homo sapiens
attccacagctacatcaatcta

SEQ ID NO: 9290094 - DNA, 22 bp, Homo sapiens
attcacaactgatccttgctca

SEQ ID NO: 9290095 - DNA, 22 bp, Homo sapiens
gcaggtgttttaagacattgaa

SEQ ID NO: 9290096 - DNA, 21 bp, Homo sapiens
gcaggtgtggtatcagcttcc

SEQ ID NO: 9290097 - DNA, 22 bp, Homo sapiens
gcaggtgttctcagaggaggct

SEQ ID NO: 9290098 - DNA, 22 bp, Homo sapiens
gcaggtgtggatttgcatccag

SEQ ID NO: 9290099 - DNA, 22 bp, Homo sapiens
gcaggtgtgggtggctgccagg

SEQ ID NO: 9290100 - DNA, 19 bp, Homo sapiens
gcaggtggatgtggtcagc

SEQ ID NO: 9290101 - DNA, 22 bp, Homo sapiens
gcaggtgtggagagtggtcggg

SEQ ID NO: 9290102 - DNA, 22 bp, Homo sapiens
gcaggtgtggagtggggtgagc

SEQ ID NO: 9290103 - DNA, 18 bp, Homo sapiens
gcaggtgtggagaagggg

SEQ ID NO: 9290104 - DNA, 22 bp, Homo sapiens
gcagggcatccctgagcgggtg

SEQ ID NO: 9290105 - DNA, 22 bp, Homo sapiens
gcagggcatagaggcacggagg

SEQ ID NO: 9290106 - DNA, 20 bp, Homo sapiens
gcagggcatcttggccccca

SEQ ID NO: 9290107 - DNA, 22 bp, Homo sapiens
attctttggacaataagtggtg

SEQ ID NO: 9290108 - DNA, 22 bp, Homo sapiens
gcagggcagtgtgtctgtgggg

SEQ ID NO: 9290109 - DNA, 22 bp, Homo sapiens
gcagggcaaacccaggtgttca

SEQ ID NO: 9290110 - DNA, 22 bp, Homo sapiens
aatgttttaaaagagattgaga

SEQ ID NO: 9290111 - DNA, 22 bp, Homo sapiens
aatgttttatagctcaagcaat

SEQ ID NO: 9290112 - DNA, 22 bp, Homo sapiens
aatgttttgcattagttttcta

SEQ ID NO: 9290113 - DNA, 22 bp, Homo sapiens
aagaataagtagatgggagaag

SEQ ID NO: 9290114 - DNA, 22 bp, Homo sapiens
aagacaggaacatagcaaatcc

SEQ ID NO: 9290115 - DNA, 22 bp, Homo sapiens
aagacagctcaggacagattca

SEQ ID NO: 9290116 - DNA, 22 bp, Homo sapiens
aagacaggaaaagctccaggcc

SEQ ID NO: 9290117 - DNA, 22 bp, Homo sapiens
aagacagcactggcattttcaa

SEQ ID NO: 9290118 - DNA, 22 bp, Homo sapiens
acaaggagagcacacatgggga

SEQ ID NO: 9290119 - DNA, 22 bp, Homo sapiens
acaaagattcatttgcattatt

SEQ ID NO: 9290120 - DNA, 22 bp, Homo sapiens
aagagagaacacagcttgggca

SEQ ID NO: 9290121 - DNA, 22 bp, Homo sapiens
acaaagatgtttaaagcattta

SEQ ID NO: 9290122 - DNA, 20 bp, Homo sapiens
acaaagactggaaaagcaag

SEQ ID NO: 9290123 - DNA, 22 bp, Homo sapiens
aagacataaaacagtcagcgaa

SEQ ID NO: 9290124 - DNA, 22 bp, Homo sapiens
aagagctggagctgctacagga

SEQ ID NO: 9290125 - DNA, 22 bp, Homo sapiens
acaaggctgttggtcacaaacc

SEQ ID NO: 9290126 - DNA, 20 bp, Homo sapiens
aagagctgactcacagtggt

SEQ ID NO: 9290127 - DNA, 22 bp, Homo sapiens
acaaggctgaacagtgaagccg

SEQ ID NO: 9290128 - DNA, 17 bp, Homo sapiens
aagcatttaatttgcta

SEQ ID NO: 9290129 - DNA, 22 bp, Homo sapiens
acagcagctgccttcaggctct

SEQ ID NO: 9290130 - DNA, 18 bp, Homo sapiens
acagacaaaatggaaatg

SEQ ID NO: 9290131 - DNA, 18 bp, Homo sapiens
acagacaaaatggaaatg

SEQ ID NO: 9290132 - DNA, 22 bp, Homo sapiens
aagcagcatgctatgctggtgg

SEQ ID NO: 9290133 - DNA, 22 bp, Homo sapiens
aagcacaggatcttgaggagcg

SEQ ID NO: 9290134 - DNA, 22 bp, Homo sapiens
acacaggggaaagtggagctga

SEQ ID NO: 9290135 - DNA, 22 bp, Homo sapiens
aacagagctctgctctcagatt

SEQ ID NO: 9290136 - DNA, 22 bp, Homo sapiens
aagtcattatctcttctaatct

SEQ ID NO: 9290137 - DNA, 22 bp, Homo sapiens
aacactgacgacgtgaactaaa

SEQ ID NO: 9290138 - DNA, 22 bp, Homo sapiens
aacactgagaacaatacagagt

SEQ ID NO: 9290139 - DNA, 22 bp, Homo sapiens
aacactgacctctaccctcagt

SEQ ID NO: 9290140 - DNA, 22 bp, Homo sapiens
aacactgaaatgtcttaagatt

SEQ ID NO: 9290141 - DNA, 22 bp, Homo sapiens
aacaaatggaacacaaatcttt

SEQ ID NO: 9290142 - DNA, 22 bp, Homo sapiens
aacaaatggaacacaaatcttt

SEQ ID NO: 9290143 - DNA, 22 bp, Homo sapiens
aacaccagtcccaagagaggct

SEQ ID NO: 9290144 - DNA, 22 bp, Homo sapiens
aacaaatgtaaaatgcagatgc

SEQ ID NO: 9290145 - DNA, 22 bp, Homo sapiens
aagctgaggcccatggcaaggt

SEQ ID NO: 9290146 - DNA, 22 bp, Homo sapiens
aaattccattttgtgactattc

SEQ ID NO: 9290147 - DNA, 22 bp, Homo sapiens
aaattcctctgatcataagaat

SEQ ID NO: 9290148 - DNA, 22 bp, Homo sapiens
aacaaaggccgttaataaccac

SEQ ID NO: 9290149 - DNA, 22 bp, Homo sapiens
aaattctttggcctactttgaa

SEQ ID NO: 9290150 - DNA, 22 bp, Homo sapiens
aaattctcaagtgatcctgttg

SEQ ID NO: 9290151 - DNA, 22 bp, Homo sapiens
aaattctctaaagaaaacatga

SEQ ID NO: 9290152 - DNA, 22 bp, Homo sapiens
aaattctatgtcaatgtttatt

SEQ ID NO: 9290153 - DNA, 22 bp, Homo sapiens
aacaggagaggggaatgtagag

SEQ ID NO: 9290154 - DNA, 22 bp, Homo sapiens
aaccacatgaaaagagtaatat

SEQ ID NO: 9290155 - DNA, 21 bp, Homo sapiens
aaccacatggattagtcagag

SEQ ID NO: 9290156 - DNA, 22 bp, Homo sapiens
aaccacatggctcagtggacat

SEQ ID NO: 9290157 - DNA, 22 bp, Homo sapiens
aacttaggaaaataaggcatga

SEQ ID NO: 9290158 - DNA, 22 bp, Homo sapiens
aatataatgctgttttatgcca

SEQ ID NO: 9290159 - DNA, 22 bp, Homo sapiens
aatataatgctgttttatgcca

SEQ ID NO: 9290160 - DNA, 22 bp, Homo sapiens
aatataatgctgttttatgcca

SEQ ID NO: 9290161 - DNA, 22 bp, Homo sapiens
aactacattgtcctttctgaag

SEQ ID NO: 9290162 - DNA, 22 bp, Homo sapiens
aatcataattttgtgaatgtag

SEQ ID NO: 9290163 - DNA, 22 bp, Homo sapiens
aacagcaatagcactattcatt

SEQ ID NO: 9290164 - DNA, 22 bp, Homo sapiens
aaagccttttctgtttaacaca

SEQ ID NO: 9290165 - DNA, 22 bp, Homo sapiens
aaagctgctgccaatcaggctt

SEQ ID NO: 9290166 - DNA, 22 bp, Homo sapiens
aacaaacaaacattttgtcatc

SEQ ID NO: 9290167 - DNA, 22 bp, Homo sapiens
aacaaaagccgaagtaggtgtc

SEQ ID NO: 9290168 - DNA, 22 bp, Homo sapiens
aaagatcacgtcccaggactcg

SEQ ID NO: 9290169 - DNA, 22 bp, Homo sapiens
aaagatcaatagataaagctac

SEQ ID NO: 9290170 - DNA, 22 bp, Homo sapiens
aaagatcaagtaggcatggcct

SEQ ID NO: 9290171 - DNA, 22 bp, Homo sapiens
aactaacagtcattaaaagaac

SEQ ID NO: 9290172 - DNA, 22 bp, Homo sapiens
aaagtagaacattttcttatct

SEQ ID NO: 9290173 - DNA, 22 bp, Homo sapiens
aaagtactaatgaatattttgc

SEQ ID NO: 9290174 - DNA, 22 bp, Homo sapiens
aactaaatctggcatttagagc

SEQ ID NO: 9290175 - DNA, 22 bp, Homo sapiens
aaagtatgttgtggcttttaaa

SEQ ID NO: 9290176 - DNA, 22 bp, Homo sapiens
aaagtgggaacaatggagagtg

SEQ ID NO: 9290177 - DNA, 22 bp, Homo sapiens
aaagtggggtctagagggcctg

SEQ ID NO: 9290178 - DNA, 22 bp, Homo sapiens
aaagtgtactatgtcatgaaca

SEQ ID NO: 9290179 - DNA, 22 bp, Homo sapiens
aaatgtagttgaaaagttaagg

SEQ ID NO: 9290180 - DNA, 22 bp, Homo sapiens
aaatgcagttggtggggatatg

SEQ ID NO: 9290181 - DNA, 22 bp, Homo sapiens
aaatcccagatagtaatgtatt

SEQ ID NO: 9290182 - DNA, 22 bp, Homo sapiens
aagcacagactccctctgagtg

SEQ ID NO: 9290183 - DNA, 22 bp, Homo sapiens
aaataacagtcagggacaacat

SEQ ID NO: 9290184 - DNA, 22 bp, Homo sapiens
aaataagttaaactagaatgat

SEQ ID NO: 9290185 - DNA, 22 bp, Homo sapiens
aaatagcagaagcagagggggt

SEQ ID NO: 9290186 - DNA, 22 bp, Homo sapiens
aaatagcacagcagctgaggct

SEQ ID NO: 9290187 - DNA, 23 bp, Homo sapiens
aaataggagtatctggatcatga

SEQ ID NO: 9290188 - DNA, 22 bp, Homo sapiens
aaatagcataaaataggaagct

SEQ ID NO: 9290189 - DNA, 22 bp, Homo sapiens
aaatagcagctttgacagcaca

SEQ ID NO: 9290190 - DNA, 22 bp, Homo sapiens
aaaaacctcaattacttttgca

SEQ ID NO: 9290191 - DNA, 20 bp, Homo sapiens
aaaaacagtaatgctgaaga

SEQ ID NO: 9290192 - DNA, 22 bp, Homo sapiens
aaacaaggtccttctgtgacat

SEQ ID NO: 9290193 - DNA, 22 bp, Homo sapiens
aaacaagtgtaaactagtctgt

SEQ ID NO: 9290194 - DNA, 22 bp, Homo sapiens
aaaatcctctaattctagaata

SEQ ID NO: 9290195 - DNA, 22 bp, Homo sapiens
aaactcaagtctatgaacaagg

SEQ ID NO: 9290196 - DNA, 22 bp, Homo sapiens
aaactctaagacactgtacaat

SEQ ID NO: 9290197 - DNA, 22 bp, Homo sapiens
aaactctacatggtcgcaaaaa

SEQ ID NO: 9290198 - DNA, 22 bp, Homo sapiens
aaactctaattatgcagttctt

SEQ ID NO: 9290199 - DNA, 22 bp, Homo sapiens
aaactctaatcaaatatagcat

SEQ ID NO: 9290200 - DNA, 22 bp, Homo sapiens
aaactctactgaggaaataaga

SEQ ID NO: 9290201 - DNA, 22 bp, Homo sapiens
aaactctagctactaggataac

SEQ ID NO: 9290202 - DNA, 20 bp, Homo sapiens
aaactctacctcaatcgtca

SEQ ID NO: 9290203 - DNA, 22 bp, Homo sapiens
aaactctaggacgatgggatag

SEQ ID NO: 9290204 - DNA, 21 bp, Homo sapiens
aaactgaccttgcctgagaca

SEQ ID NO: 9290205 - DNA, 22 bp, Homo sapiens
aaactgataaaataagtacatt

SEQ ID NO: 9290206 - DNA, 22 bp, Homo sapiens
aaagaatcagaagtctcaaaca

SEQ ID NO: 9290207 - DNA, 22 bp, Homo sapiens
aaagaatagcctttgtccaaat

SEQ ID NO: 9290208 - DNA, 22 bp, Homo sapiens
aaagacacaaatgtagaccaaa

SEQ ID NO: 9290209 - DNA, 20 bp, Homo sapiens
aaattactgccacacatttc

SEQ ID NO: 9290210 - DNA, 22 bp, Homo sapiens
aaattacagatcaccaatgcat

SEQ ID NO: 9290211 - DNA, 22 bp, Homo sapiens
aaagagtctggcactgtaccag

SEQ ID NO: 9290212 - DNA, 22 bp, Homo sapiens
aaagagtcaaaggcatgtctct

SEQ ID NO: 9290213 - DNA, 22 bp, Homo sapiens
aaagagtcgtgttccaggtttg

SEQ ID NO: 9290214 - DNA, 22 bp, Homo sapiens
aaacagtgtgtttcagagaggc

SEQ ID NO: 9290215 - DNA, 22 bp, Homo sapiens
aaacagtgtaggtggccaggca

SEQ ID NO: 9290216 - DNA, 22 bp, Homo sapiens
aaacagtgcctggcatggagga

SEQ ID NO: 9290217 - DNA, 22 bp, Homo sapiens
aaacagtttcattttcatgacc

SEQ ID NO: 9290218 - DNA, 22 bp, Homo sapiens
aaacagtttataacatgatact

SEQ ID NO: 9290219 - DNA, 22 bp, Homo sapiens
aaacagtttctaatcatggaga

SEQ ID NO: 9290220 - DNA, 22 bp, Homo sapiens
aaaggtagtacttctagaaggg

SEQ ID NO: 9290221 - DNA, 22 bp, Homo sapiens
aaacagtgccaggcagatgcca

SEQ ID NO: 9290222 - DNA, 22 bp, Homo sapiens
aaacctttctgctctcagcgta

SEQ ID NO: 9290223 - DNA, 22 bp, Homo sapiens
aaaccttttcagctgaatggag

SEQ ID NO: 9290224 - DNA, 22 bp, Homo sapiens
aaagttagtcagaaccagccat

SEQ ID NO: 9290225 - DNA, 22 bp, Homo sapiens
aaagttcactgaccagcactgg

SEQ ID NO: 9290226 - DNA, 22 bp, Homo sapiens
aaactctagtaaaatgtattca

SEQ ID NO: 9290227 - DNA, 22 bp, Homo sapiens
aaactctagggctccacattcc

SEQ ID NO: 9290228 - DNA, 22 bp, Homo sapiens
aaactctatttctgttggctta

SEQ ID NO: 9290229 - DNA, 22 bp, Homo sapiens
aaactctataggcagaagcaat

SEQ ID NO: 9290230 - DNA, 22 bp, Homo sapiens
aaactctatgaaccttctacca

SEQ ID NO: 9290231 - DNA, 22 bp, Homo sapiens
aaactctagttatgaagtttgt

SEQ ID NO: 9290232 - DNA, 22 bp, Homo sapiens
aaactctataaataagggctat

SEQ ID NO: 9290233 - DNA, 22 bp, Homo sapiens
aagtttagtgaaactctagggg

SEQ ID NO: 9290234 - DNA, 22 bp, Homo sapiens
aataatgtttatttgtattctc

SEQ ID NO: 9290235 - DNA, 22 bp, Homo sapiens
aataatgttgacgatagtctta

SEQ ID NO: 9290236 - DNA, 19 bp, Homo sapiens
aataatgttcatgagattg

SEQ ID NO: 9290237 - DNA, 22 bp, Homo sapiens
aataatgtgatagataagggaa

SEQ ID NO: 9290238 - DNA, 22 bp, Homo sapiens
aataatgttatgtcattcttct

SEQ ID NO: 9290239 - DNA, 22 bp, Homo sapiens
aataatgtgtgctgcagtctta

SEQ ID NO: 9290240 - DNA, 22 bp, Homo sapiens
aataagattgacacaagtacct

SEQ ID NO: 9290241 - DNA, 22 bp, Homo sapiens
actcccactccagagtagaagc

SEQ ID NO: 9290242 - DNA, 22 bp, Homo sapiens
aagttaggagagtaaagtggta

SEQ ID NO: 9290243 - DNA, 22 bp, Homo sapiens
aagttaggatgaatgccttagc

SEQ ID NO: 9290244 - DNA, 22 bp, Homo sapiens
aagttaggcttagttgagattt

SEQ ID NO: 9290245 - DNA, 22 bp, Homo sapiens
aagttaggttgcattggtcatc

SEQ ID NO: 9290246 - DNA, 22 bp, Homo sapiens
aagttactggcaagggctgcag

SEQ ID NO: 9290247 - DNA, 22 bp, Homo sapiens
aatcaaaacctacagaggtaat

SEQ ID NO: 9290248 - DNA, 22 bp, Homo sapiens
aatcaactgtttccacagggag

SEQ ID NO: 9290249 - DNA, 22 bp, Homo sapiens
aatgaggctggctatggattaa

SEQ ID NO: 9290250 - DNA, 22 bp, Homo sapiens
aatgaggctggatttggagctc

SEQ ID NO: 9290251 - DNA, 22 bp, Homo sapiens
aatgacctgggtgtcatttcat

SEQ ID NO: 9290252 - DNA, 22 bp, Homo sapiens
aatgaacatgggagtactaata

SEQ ID NO: 9290253 - DNA, 22 bp, Homo sapiens
aatgaacatgggagtactaata

SEQ ID NO: 9290254 - DNA, 22 bp, Homo sapiens
aatgaacatcaaatgcctacca

SEQ ID NO: 9290255 - DNA, 22 bp, Homo sapiens
aatgaacatggacaagttaata

SEQ ID NO: 9290256 - DNA, 22 bp, Homo sapiens
aatgaacagatacacataggca

SEQ ID NO: 9290257 - DNA, 22 bp, Homo sapiens
aatgaacaggtgaatgtcagat

SEQ ID NO: 9290258 - DNA, 22 bp, Homo sapiens
aatgaacagtgggtgaggtacc

SEQ ID NO: 9290259 - DNA, 22 bp, Homo sapiens
aatgaacacatgtggtcagttt

SEQ ID NO: 9290260 - DNA, 22 bp, Homo sapiens
aatgaacacgctggtggtgcaa

SEQ ID NO: 9290261 - DNA, 22 bp, Homo sapiens
aatgaacacagccctctacttt

SEQ ID NO: 9290262 - DNA, 22 bp, Homo sapiens
agaaaacataggagacaggaaa

SEQ ID NO: 9290263 - DNA, 22 bp, Homo sapiens
aaggtgggtggatcacgaggtc

SEQ ID NO: 9290264 - DNA, 22 bp, Homo sapiens
aaggtggtaatagtgcaggatt

SEQ ID NO: 9290265 - DNA, 22 bp, Homo sapiens
aaggtggtaggctatatcagta

SEQ ID NO: 9290266 - DNA, 22 bp, Homo sapiens
aaggtgctcgttatggccagtg

SEQ ID NO: 9290267 - DNA, 22 bp, Homo sapiens
aaggtgctcacgggctcaggga

SEQ ID NO: 9290268 - DNA, 17 bp, Homo sapiens
aaggtgagagctgttct

SEQ ID NO: 9290269 - DNA, 22 bp, Homo sapiens
aagggctcttctatttatggcc

SEQ ID NO: 9290270 - DNA, 22 bp, Homo sapiens
aagtacttgatagattaactgt

SEQ ID NO: 9290271 - DNA, 22 bp, Homo sapiens
aagtactttaggatatgtaact

SEQ ID NO: 9290272 - DNA, 22 bp, Homo sapiens
aagtatgaatcaaagactatct

SEQ ID NO: 9290273 - DNA, 22 bp, Homo sapiens
accccaggcccagggaagaggc

SEQ ID NO: 9290274 - DNA, 22 bp, Homo sapiens
accccagggctgccagcctcct

SEQ ID NO: 9290275 - DNA, 22 bp, Homo sapiens
accccaggtcatctgagagtcc

SEQ ID NO: 9290276 - DNA, 22 bp, Homo sapiens
accccaggtctccaggctctgg

SEQ ID NO: 9290277 - DNA, 22 bp, Homo sapiens
aagggcaggaaaagatggatgt

SEQ ID NO: 9290278 - DNA, 22 bp, Homo sapiens
aagggctctgttgccatttcag

SEQ ID NO: 9290279 - DNA, 22 bp, Homo sapiens
aagggctctgtgtgcctcccca

SEQ ID NO: 9290280 - DNA, 22 bp, Homo sapiens
aagggctctgtgcttgtcccat

SEQ ID NO: 9290281 - DNA, 22 bp, Homo sapiens
aagggctctgggctacgcactg

SEQ ID NO: 9290282 - DNA, 22 bp, Homo sapiens
aagggctccacttgaatcacac

SEQ ID NO: 9290283 - DNA, 22 bp, Homo sapiens
aagggctccaagaggtagctgg

SEQ ID NO: 9290284 - DNA, 22 bp, Homo sapiens
aagggctcccaactcatctttt

SEQ ID NO: 9290285 - DNA, 22 bp, Homo sapiens
aagggctccatccttataaatg

SEQ ID NO: 9290286 - DNA, 22 bp, Homo sapiens
aagggctcggtagcagtcctga

SEQ ID NO: 9290287 - DNA, 22 bp, Homo sapiens
aagggctccctgcctgaggtgg

SEQ ID NO: 9290288 - DNA, 22 bp, Homo sapiens
aagggctctgctgtctctcccc

SEQ ID NO: 9290289 - DNA, 22 bp, Homo sapiens
aagggctctctgcattgaaatt

SEQ ID NO: 9290290 - DNA, 22 bp, Homo sapiens
aagggctcacccaactcacttc

SEQ ID NO: 9290291 - DNA, 22 bp, Homo sapiens
aagggccataacttgcagtgtt

SEQ ID NO: 9290292 - DNA, 22 bp, Homo sapiens
aagggccagtagaattttagtg

SEQ ID NO: 9290293 - DNA, 22 bp, Homo sapiens
aagggccatcccagaacagaaa

SEQ ID NO: 9290294 - DNA, 22 bp, Homo sapiens
aagggccatgcctctactttct

SEQ ID NO: 9290295 - DNA, 22 bp, Homo sapiens
aagggccatcttggactcccca

SEQ ID NO: 9290296 - DNA, 22 bp, Homo sapiens
aagggccattgctgagagcagt

SEQ ID NO: 9290297 - DNA, 22 bp, Homo sapiens
aagggccaagctcttctcccat

SEQ ID NO: 9290298 - DNA, 22 bp, Homo sapiens
aagggccagggctctagagata

SEQ ID NO: 9290299 - DNA, 22 bp, Homo sapiens
aagggccagggcagggttgtga

SEQ ID NO: 9290300 - DNA, 22 bp, Homo sapiens
aagggccacatttgggtccctg

SEQ ID NO: 9290301 - DNA, 22 bp, Homo sapiens
aagggccacttactcctgctgt

SEQ ID NO: 9290302 - DNA, 22 bp, Homo sapiens
aagggccacatgccatttaaaa

SEQ ID NO: 9290303 - DNA, 22 bp, Homo sapiens
acatgtgtgacaacagaggtga

SEQ ID NO: 9290304 - DNA, 22 bp, Homo sapiens
acatgtgtctaagaatgaaaga

SEQ ID NO: 9290305 - DNA, 22 bp, Homo sapiens
acatgtgtatagcctgtataga

SEQ ID NO: 9290306 - DNA, 22 bp, Homo sapiens
acatgtgtggacatgaatctac

SEQ ID NO: 9290307 - DNA, 22 bp, Homo sapiens
acatgtgtggccgctgtagaca

SEQ ID NO: 9290308 - DNA, 22 bp, Homo sapiens
acatgtgtgtatacgtatttat

SEQ ID NO: 9290309 - DNA, 22 bp, Homo sapiens
aaggcttggagtaagcttggct

SEQ ID NO: 9290310 - DNA, 19 bp, Homo sapiens
aaggcttggctgagctggg

SEQ ID NO: 9290311 - DNA, 22 bp, Homo sapiens
aaggcttgtagatttgggcttt

SEQ ID NO: 9290312 - DNA, 22 bp, Homo sapiens
aaggcttgtgtgttcagtgagg

SEQ ID NO: 9290313 - DNA, 22 bp, Homo sapiens
acatgtgtacatatatatgtgc

SEQ ID NO: 9290314 - DNA, 22 bp, Homo sapiens
acatgtgtacttttaaggatgt

SEQ ID NO: 9290315 - DNA, 22 bp, Homo sapiens
aaggctcttggagtgaatgcag

SEQ ID NO: 9290316 - DNA, 22 bp, Homo sapiens
aaggcagaaagggatgtgagtg

SEQ ID NO: 9290317 - DNA, 22 bp, Homo sapiens
aaggaagaaatgaataggtgga

SEQ ID NO: 9290318 - DNA, 22 bp, Homo sapiens
aaggcagtcaaagcagacttct

SEQ ID NO: 9290319 - DNA, 18 bp, Homo sapiens
aaggcagtatgattgcac

SEQ ID NO: 9290320 - DNA, 22 bp, Homo sapiens
aaggcaggtattgatgccacag

SEQ ID NO: 9290321 - DNA, 22 bp, Homo sapiens
aaggcaggatgcggacccatct

SEQ ID NO: 9290322 - DNA, 22 bp, Homo sapiens
acagttcccgtcttgcacagct

SEQ ID NO: 9290323 - DNA, 22 bp, Homo sapiens
acaggtgtggggctgtggtact

SEQ ID NO: 9290324 - DNA, 22 bp, Homo sapiens
acaggtgtgttcccggaaagcc

SEQ ID NO: 9290325 - DNA, 22 bp, Homo sapiens
acagagagggagtgataaatcc

SEQ ID NO: 9290326 - DNA, 22 bp, Homo sapiens
acagagcagtaagaacacagct

SEQ ID NO: 9290327 - DNA, 22 bp, Homo sapiens
acagagaggtaaaatatatagt

SEQ ID NO: 9290328 - DNA, 22 bp, Homo sapiens
agccatggcgccactagaggga

SEQ ID NO: 9290329 - DNA, 22 bp, Homo sapiens
agccatggcgccactagaggga

SEQ ID NO: 9290330 - DNA, 22 bp, Homo sapiens
agccatggtctcagggccataa

SEQ ID NO: 9290331 - DNA, 22 bp, Homo sapiens
agccacagtctgatgcctgaga

SEQ ID NO: 9290332 - DNA, 22 bp, Homo sapiens
acagagttgtaaacatttacca

SEQ ID NO: 9290333 - DNA, 22 bp, Homo sapiens
acagagtcctagctgcaaagaa

SEQ ID NO: 9290334 - DNA, 22 bp, Homo sapiens
agctatttattgagctccattg

SEQ ID NO: 9290335 - DNA, 22 bp, Homo sapiens
agctatttctcttattatatcc

SEQ ID NO: 9290336 - DNA, 22 bp, Homo sapiens
agctctagggaagaaaggcaca

SEQ ID NO: 9290337 - DNA, 22 bp, Homo sapiens
agctatcaccttaataaactga

SEQ ID NO: 9290338 - DNA, 22 bp, Homo sapiens
agctaggggaccaaggtggccc

SEQ ID NO: 9290339 - DNA, 22 bp, Homo sapiens
agctagggcaaatatgagatac

SEQ ID NO: 9290340 - DNA, 22 bp, Homo sapiens
agctagggctttcgtagacagt

SEQ ID NO: 9290341 - DNA, 22 bp, Homo sapiens
acagcaagacccctagcatggt

SEQ ID NO: 9290342 - DNA, 22 bp, Homo sapiens
agcctgccttgggctgcttgag

SEQ ID NO: 9290343 - DNA, 22 bp, Homo sapiens
acagattcactgcactggccat

SEQ ID NO: 9290344 - DNA, 17 bp, Homo sapiens
agcctgccccatgctgc

SEQ ID NO: 9290345 - DNA, 22 bp, Homo sapiens
agcagtggtgtgaggagggctc

SEQ ID NO: 9290346 - DNA, 22 bp, Homo sapiens
agcagtgggtgacagagctgag

SEQ ID NO: 9290347 - DNA, 22 bp, Homo sapiens
acagaaattctgggacagaaaa

SEQ ID NO: 9290348 - DNA, 23 bp, Homo sapiens
acactgtctcatggatagactgc

SEQ ID NO: 9290349 - DNA, 22 bp, Homo sapiens
acactgtctgggactcaggagt

SEQ ID NO: 9290350 - DNA, 22 bp, Homo sapiens
acactgtctcatatgaggggac

SEQ ID NO: 9290351 - DNA, 22 bp, Homo sapiens
agcagggccaacagtaaacacc

SEQ ID NO: 9290352 - DNA, 18 bp, Homo sapiens
agcagggcattttgccat

SEQ ID NO: 9290353 - DNA, 22 bp, Homo sapiens
agcagggcatgaataagggttt

SEQ ID NO: 9290354 - DNA, 22 bp, Homo sapiens
agcagggcccactaggggagat

SEQ ID NO: 9290355 - DNA, 23 bp, Homo sapiens
agcagggccagaatacttgctgt

SEQ ID NO: 9290356 - DNA, 19 bp, Homo sapiens
acacatttgcacaatccac

SEQ ID NO: 9290357 - DNA, 22 bp, Homo sapiens
acacatttgcataatacctcat

SEQ ID NO: 9290358 - DNA, 22 bp, Homo sapiens
acacattttcaacactgtcaag

SEQ ID NO: 9290359 - DNA, 22 bp, Homo sapiens
agcagggcagtgcttcagctct

SEQ ID NO: 9290360 - DNA, 22 bp, Homo sapiens
agcagggcagttaaagggtcct

SEQ ID NO: 9290361 - DNA, 22 bp, Homo sapiens
acaattctgatggtttcccagt

SEQ ID NO: 9290362 - DNA, 22 bp, Homo sapiens
agcaccctttgtgagcataagt

SEQ ID NO: 9290363 - DNA, 22 bp, Homo sapiens
agcacccttcagcccagcctgg

SEQ ID NO: 9290364 - DNA, 22 bp, Homo sapiens
agcaccctggggaagcacaaag

SEQ ID NO: 9290365 - DNA, 21 bp, Homo sapiens
agcaccctcccttctggaggg

SEQ ID NO: 9290366 - DNA, 22 bp, Homo sapiens
agcaccctcccaccctctcaga

SEQ ID NO: 9290367 - DNA, 22 bp, Homo sapiens
agcaccctccaacttccctgta

SEQ ID NO: 9290368 - DNA, 22 bp, Homo sapiens
agcaccctcagccttatccaga

SEQ ID NO: 9290369 - DNA, 23 bp, Homo sapiens
acacaggatacatacggaagcaa

SEQ ID NO: 9290370 - DNA, 22 bp, Homo sapiens
agcagcagtcatgcctatgctc

SEQ ID NO: 9290371 - DNA, 23 bp, Homo sapiens
acacatatattcagatacagatg

SEQ ID NO: 9290372 - DNA, 22 bp, Homo sapiens
agcaaggcagctttcactgctt

SEQ ID NO: 9290373 - DNA, 21 bp, Homo sapiens
agcaaggcagcctctcagcct

SEQ ID NO: 9290374 - DNA, 22 bp, Homo sapiens
agatgggtaactggagtctgct

SEQ ID NO: 9290375 - DNA, 22 bp, Homo sapiens
agatggggctcagtgtggaggc

SEQ ID NO: 9290376 - DNA, 22 bp, Homo sapiens
agatggggctcagtgtggaggc

SEQ ID NO: 9290377 - DNA, 22 bp, Homo sapiens
acaattctctcatatcttatta

SEQ ID NO: 9290378 - DNA, 22 bp, Homo sapiens
acaattcctgagaatacttgtt

SEQ ID NO: 9290379 - DNA, 22 bp, Homo sapiens
acaattctctcatatcttatta

SEQ ID NO: 9290380 - DNA, 22 bp, Homo sapiens
acaattctgatggtttcccagt

SEQ ID NO: 9290381 - DNA, 22 bp, Homo sapiens
acaaatgtggacatggataatg

SEQ ID NO: 9290382 - DNA, 22 bp, Homo sapiens
agatggggcagaatggagccat

SEQ ID NO: 9290383 - DNA, 22 bp, Homo sapiens
acaaacagagttgaaaaatagg

SEQ ID NO: 9290384 - DNA, 23 bp, Homo sapiens
acaaaatgttctgctgggaggtg

SEQ ID NO: 9290385 - DNA, 19 bp, Homo sapiens
acaaatgatgttgcactga

SEQ ID NO: 9290386 - DNA, 22 bp, Homo sapiens
acaaatgactatttggtacagg

SEQ ID NO: 9290387 - DNA, 22 bp, Homo sapiens
acaaatgactcaaacaccactt

SEQ ID NO: 9290388 - DNA, 22 bp, Homo sapiens
acaaatgactatttggtacagg

SEQ ID NO: 9290389 - DNA, 22 bp, Homo sapiens
agagctgggtggtggtgactca

SEQ ID NO: 9290390 - DNA, 22 bp, Homo sapiens
agaggccccaggtgagcatgcc

SEQ ID NO: 9290391 - DNA, 22 bp, Homo sapiens
agacagactttgatctggatgt

SEQ ID NO: 9290392 - DNA, 21 bp, Homo sapiens
agacagagtgcagtctacata

SEQ ID NO: 9290393 - DNA, 22 bp, Homo sapiens
aatgtcattgagctccaatcct

SEQ ID NO: 9290394 - DNA, 22 bp, Homo sapiens
aatgtcctaggcatgattttgt

SEQ ID NO: 9290395 - DNA, 22 bp, Homo sapiens
aatgtcatttaaaataattctg

SEQ ID NO: 9290396 - DNA, 22 bp, Homo sapiens
aatgtctcttgagaggcgaaac

SEQ ID NO: 9290397 - DNA, 22 bp, Homo sapiens
aattatacatgaaggcattata

SEQ ID NO: 9290398 - DNA, 22 bp, Homo sapiens
aattatacattgaacaatctag

SEQ ID NO: 9290399 - DNA, 22 bp, Homo sapiens
aattatacattgaacaatctag

SEQ ID NO: 9290400 - DNA, 22 bp, Homo sapiens
aattatatgttaatcttcaatt

SEQ ID NO: 9290401 - DNA, 22 bp, Homo sapiens
aatgttattgtcctttccaaaa

SEQ ID NO: 9290402 - DNA, 22 bp, Homo sapiens
aatgttatttctgcatagtagt

SEQ ID NO: 9290403 - DNA, 22 bp, Homo sapiens
aattagctttccgccatcacac

SEQ ID NO: 9290404 - DNA, 22 bp, Homo sapiens
agtaaaattaatggatcagaag

SEQ ID NO: 9290405 - DNA, 22 bp, Homo sapiens
acgcctgtaatcccagcacttt

SEQ ID NO: 9290406 - DNA, 23 bp, Homo sapiens
acgctgggtggccagaacgacag

SEQ ID NO: 9290407 - DNA, 22 bp, Homo sapiens
acgcagtttgtggacatttttt

SEQ ID NO: 9290408 - DNA, 22 bp, Homo sapiens
actcaggagggatcagctatca

SEQ ID NO: 9290409 - DNA, 22 bp, Homo sapiens
actcaggaagaaagcagctggt

SEQ ID NO: 9290410 - DNA, 22 bp, Homo sapiens
actcaggaaattgagataatgg

SEQ ID NO: 9290411 - DNA, 18 bp, Homo sapiens
actcaggaaatgatgaca

SEQ ID NO: 9290412 - DNA, 22 bp, Homo sapiens
actcaggaaaaatgtagtgata

SEQ ID NO: 9290413 - DNA, 22 bp, Homo sapiens
actcaggaaatgaagactggtt

SEQ ID NO: 9290414 - DNA, 22 bp, Homo sapiens
actaggaattcaagtagacaga

SEQ ID NO: 9290415 - DNA, 22 bp, Homo sapiens
actaggaaggcatatgggcaga

SEQ ID NO: 9290416 - DNA, 22 bp, Homo sapiens
agtcaaagctacaggcatttga

SEQ ID NO: 9290417 - DNA, 22 bp, Homo sapiens
agtcaaagttgtccccagcacc

SEQ ID NO: 9290418 - DNA, 22 bp, Homo sapiens
acctgaggcctccccagcagac

SEQ ID NO: 9290419 - DNA, 22 bp, Homo sapiens
acctgaggctgttagtctaggt

SEQ ID NO: 9290420 - DNA, 22 bp, Homo sapiens
acctgagggcccaaacttggta

SEQ ID NO: 9290421 - DNA, 19 bp, Homo sapiens
accctctctgtagaaagat

SEQ ID NO: 9290422 - DNA, 19 bp, Homo sapiens
accctctcagtgcctgagg

SEQ ID NO: 9290423 - DNA, 19 bp, Homo sapiens
accctctcagtgcctgagg

SEQ ID NO: 9290424 - DNA, 22 bp, Homo sapiens
acctctgggcagcacctttgta

SEQ ID NO: 9290425 - DNA, 22 bp, Homo sapiens
acctctgggaaaagtatggaaa

SEQ ID NO: 9290426 - DNA, 22 bp, Homo sapiens
acctctggccttcaggcatcat

SEQ ID NO: 9290427 - DNA, 23 bp, Homo sapiens
agtgttggttgggaagccaagca

SEQ ID NO: 9290428 - DNA, 22 bp, Homo sapiens
agtgttgggtctttagaattta

SEQ ID NO: 9290429 - DNA, 22 bp, Homo sapiens
agtgttctttgcatgaggatag

SEQ ID NO: 9290430 - DNA, 22 bp, Homo sapiens
actgcacttcagcctgggtgtc

SEQ ID NO: 9290431 - DNA, 22 bp, Homo sapiens
agtgtacatcagaacatatcaa

SEQ ID NO: 9290432 - DNA, 19 bp, Homo sapiens
agtgtagctaggatgtgct

SEQ ID NO: 9290433 - DNA, 22 bp, Homo sapiens
agtgtagcctagtggttaaggg

SEQ ID NO: 9290434 - DNA, 22 bp, Homo sapiens
agtggcaggtgtttcgtggtgc

SEQ ID NO: 9290435 - DNA, 22 bp, Homo sapiens
agtggcagagctgtgtcttgaa

SEQ ID NO: 9290436 - DNA, 22 bp, Homo sapiens
agtggcagggctggctgctgca

SEQ ID NO: 9290437 - DNA, 22 bp, Homo sapiens
actgcacttcagcctgggtgac

SEQ ID NO: 9290438 - DNA, 22 bp, Homo sapiens
agtctttaacatttggagattg

SEQ ID NO: 9290439 - DNA, 22 bp, Homo sapiens
agtgcagtggttaggagccagg

SEQ ID NO: 9290440 - DNA, 22 bp, Homo sapiens
agtgcaggttaaggaactggcc

SEQ ID NO: 9290441 - DNA, 22 bp, Homo sapiens
agtgcagggggaaagggtgtct

SEQ ID NO: 9290442 - DNA, 22 bp, Homo sapiens
actctgtcacctactcactgta

SEQ ID NO: 9290443 - DNA, 22 bp, Homo sapiens
agtgcatagggggatgcacagc

SEQ ID NO: 9290444 - DNA, 22 bp, Homo sapiens
agtgcatagctgcgaagcattt

SEQ ID NO: 9290445 - DNA, 22 bp, Homo sapiens
agtgcataatgaaggagcttga

SEQ ID NO: 9290446 - DNA, 22 bp, Homo sapiens
actttcacatgtgtgcagacag

SEQ ID NO: 9290447 - DNA, 22 bp, Homo sapiens
actttcatggatctctgttcag

SEQ ID NO: 9290448 - DNA, 22 bp, Homo sapiens
actttcatgttcatttggaacc

SEQ ID NO: 9290449 - DNA, 22 bp, Homo sapiens
actttcccacttaatgtattta

SEQ ID NO: 9290450 - DNA, 22 bp, Homo sapiens
atatggaatggtaatctacaat

SEQ ID NO: 9290451 - DNA, 22 bp, Homo sapiens
atattcatcgtgtagaaatact

SEQ ID NO: 9290452 - DNA, 22 bp, Homo sapiens
agaaagctccccatgagatgat

SEQ ID NO: 9290453 - DNA, 20 bp, Homo sapiens
atatttcaggtagtgtgccc

SEQ ID NO: 9290454 - DNA, 22 bp, Homo sapiens
atatttcaggttttgcaggccg

SEQ ID NO: 9290455 - DNA, 22 bp, Homo sapiens
atacatctatgcctttctgaca

SEQ ID NO: 9290456 - DNA, 22 bp, Homo sapiens
acttcttgggaccctggcaccg

SEQ ID NO: 9290457 - DNA, 22 bp, Homo sapiens
atacatctagagtcataaaaac

SEQ ID NO: 9290458 - DNA, 22 bp, Homo sapiens
acttctggtgtcatactgcatt

SEQ ID NO: 9290459 - DNA, 22 bp, Homo sapiens
atacatgttgagaaaatatctg

SEQ ID NO: 9290460 - DNA, 22 bp, Homo sapiens
atacatgttgtaccatatgttt

SEQ ID NO: 9290461 - DNA, 22 bp, Homo sapiens
atacattagctcatatgattaa

SEQ ID NO: 9290462 - DNA, 22 bp, Homo sapiens
atactgtaatacctaaatgaac

SEQ ID NO: 9290463 - DNA, 22 bp, Homo sapiens
atactgtaatacctaaatgaac

SEQ ID NO: 9290464 - DNA, 22 bp, Homo sapiens
atacagggacatccagtttttc

SEQ ID NO: 9290465 - DNA, 22 bp, Homo sapiens
ataatgcatttagaataattca

SEQ ID NO: 9290466 - DNA, 22 bp, Homo sapiens
ataatgctgggagaaattgtta

SEQ ID NO: 9290467 - DNA, 22 bp, Homo sapiens
actgtgcattccccaacctgtg

SEQ ID NO: 9290468 - DNA, 22 bp, Homo sapiens
ataaaatttgctactgttaaat

SEQ ID NO: 9290469 - DNA, 22 bp, Homo sapiens
aggagcaaatgatgagacagca

SEQ ID NO: 9290470 - DNA, 22 bp, Homo sapiens
aggagatggagctcagtgggca

SEQ ID NO: 9290471 - DNA, 22 bp, Homo sapiens
acagtaaacaatgcagcaaatt

SEQ ID NO: 9290472 - DNA, 22 bp, Homo sapiens
acagtaaaacatttttattagg

SEQ ID NO: 9290473 - DNA, 18 bp, Homo sapiens
acagtaaagaaaggaatt

SEQ ID NO: 9290474 - DNA, 22 bp, Homo sapiens
aggacacacttctgaggtcttt

SEQ ID NO: 9290475 - DNA, 22 bp, Homo sapiens
acaggtgttgactcacaggccc

SEQ ID NO: 9290476 - DNA, 22 bp, Homo sapiens
acaggtgttgaatgatgtcaca

SEQ ID NO: 9290477 - DNA, 22 bp, Homo sapiens
acaggtgtaatttgcccgaggt

SEQ ID NO: 9290478 - DNA, 22 bp, Homo sapiens
acaggtgtacaatgcatgacag

SEQ ID NO: 9290479 - DNA, 22 bp, Homo sapiens
acaggtgttttggaggatgatt

SEQ ID NO: 9290480 - DNA, 22 bp, Homo sapiens
acagtcaatcagaacagcatgt

SEQ ID NO: 9290481 - DNA, 22 bp, Homo sapiens
acagtggggtcttaatagaaca

SEQ ID NO: 9290482 - DNA, 22 bp, Homo sapiens
acagtgggatgaggctggcccc

SEQ ID NO: 9290483 - DNA, 22 bp, Homo sapiens
acagtgggacagtgacggggga

SEQ ID NO: 9290484 - DNA, 22 bp, Homo sapiens
acatattaactgcactacacta

SEQ ID NO: 9290485 - DNA, 21 bp, Homo sapiens
aggcagctggaaggcctggct

SEQ ID NO: 9290486 - DNA, 22 bp, Homo sapiens
aggcagctagagagtgaaactg

SEQ ID NO: 9290487 - DNA, 22 bp, Homo sapiens
aggatgagattccagggtcaat

SEQ ID NO: 9290488 - DNA, 22 bp, Homo sapiens
aggcactgggaatatgctgagg

SEQ ID NO: 9290489 - DNA, 18 bp, Homo sapiens
aggcactggaattaaggg

SEQ ID NO: 9290490 - DNA, 22 bp, Homo sapiens
aggcactgcttctaagtaggaa

SEQ ID NO: 9290491 - DNA, 20 bp, Homo sapiens
aggcactggggataggtaag

SEQ ID NO: 9290492 - DNA, 22 bp, Homo sapiens
aggcactgggaatatgctgagg

SEQ ID NO: 9290493 - DNA, 22 bp, Homo sapiens
agctggtggagaagcagacctc

SEQ ID NO: 9290494 - DNA, 18 bp, Homo sapiens
agctggtggggagacagc

SEQ ID NO: 9290495 - DNA, 18 bp, Homo sapiens
agctggtggggagacagc

SEQ ID NO: 9290496 - DNA, 22 bp, Homo sapiens
agctggtgtgctctggaatcct

SEQ ID NO: 9290497 - DNA, 22 bp, Homo sapiens
acaggagggacaccttcctgct

SEQ ID NO: 9290498 - DNA, 22 bp, Homo sapiens
acaggaggagctgtttcaggga

SEQ ID NO: 9290499 - DNA, 22 bp, Homo sapiens
agctggaggggccagcaggtgt

SEQ ID NO: 9290500 - DNA, 21 bp, Homo sapiens
acagctggtgcagggcgggga

SEQ ID NO: 9290501 - DNA, 21 bp, Homo sapiens
acagctggtgcagggcgggga

SEQ ID NO: 9290502 - DNA, 22 bp, Homo sapiens
acagctgtatccccagagctca

SEQ ID NO: 9290503 - DNA, 21 bp, Homo sapiens
acagctggtgcagggcgggga

SEQ ID NO: 9290504 - DNA, 22 bp, Homo sapiens
acagctgggtgctgctcagagc

SEQ ID NO: 9290505 - DNA, 22 bp, Homo sapiens
acagctgggtgctgctcagagc

SEQ ID NO: 9290506 - DNA, 22 bp, Homo sapiens
acagctgggtgtcccacttctg

SEQ ID NO: 9290507 - DNA, 22 bp, Homo sapiens
acagctggtgaatgttctctgt

SEQ ID NO: 9290508 - DNA, 22 bp, Homo sapiens
acagctgggaatcagctgggga

SEQ ID NO: 9290509 - DNA, 22 bp, Homo sapiens
acagctggccgaggctcaggga

SEQ ID NO: 9290510 - DNA, 22 bp, Homo sapiens
acagctgggaactcacacagca

SEQ ID NO: 9290511 - DNA, 21 bp, Homo sapiens
acagctggccgcgcgggtcgg

SEQ ID NO: 9290512 - DNA, 22 bp, Homo sapiens
acagctggcaggggggcatgaa

SEQ ID NO: 9290513 - DNA, 22 bp, Homo sapiens
acagctggcaggggggcatgaa

SEQ ID NO: 9290514 - DNA, 22 bp, Homo sapiens
acagctggcaggggggcatgaa

SEQ ID NO: 9290515 - DNA, 22 bp, Homo sapiens
agctgagacacttgagagacta

SEQ ID NO: 9290516 - DNA, 23 bp, Homo sapiens
agctgagaataaggagccgtttg

SEQ ID NO: 9290517 - DNA, 22 bp, Homo sapiens
agctgaaggctagaacagctgg

SEQ ID NO: 9290518 - DNA, 22 bp, Homo sapiens
aggaagaacagataatggacgc

SEQ ID NO: 9290519 - DNA, 22 bp, Homo sapiens
aggaagaacctaagaaagtctc

SEQ ID NO: 9290520 - DNA, 22 bp, Homo sapiens
aggaagaacagataatggacgc

SEQ ID NO: 9290521 - DNA, 22 bp, Homo sapiens
aggaagacaatctgtgtgctgt

SEQ ID NO: 9290522 - DNA, 18 bp, Homo sapiens
aggaagaccatcagatat

SEQ ID NO: 9290523 - DNA, 22 bp, Homo sapiens
acaggggcaagggctcacggcc

SEQ ID NO: 9290524 - DNA, 22 bp, Homo sapiens
aggacacactgcaagagcctgg

SEQ ID NO: 9290525 - DNA, 22 bp, Homo sapiens
aggacacacagaatacaaatcc

SEQ ID NO: 9290526 - DNA, 22 bp, Homo sapiens
acaggcagggaccttggctaag

SEQ ID NO: 9290527 - DNA, 22 bp, Homo sapiens
acagggaagctcaggggctctg

SEQ ID NO: 9290528 - DNA, 22 bp, Homo sapiens
acaggcagggacctcttgagtt

SEQ ID NO: 9290529 - DNA, 22 bp, Homo sapiens
acaggcaggcttcggccagagc

SEQ ID NO: 9290530 - DNA, 22 bp, Homo sapiens
acagggaagttctgcaacagga

SEQ ID NO: 9290531 - DNA, 22 bp, Homo sapiens
acagggaatggagggatcagta

SEQ ID NO: 9290532 - DNA, 19 bp, Homo sapiens
acagggaatttccacagaa

SEQ ID NO: 9290533 - DNA, 22 bp, Homo sapiens
acaggcaggcgggacagcccga

SEQ ID NO: 9290534 - DNA, 22 bp, Homo sapiens
acaggcagattaagggtaggca

SEQ ID NO: 9290535 - DNA, 22 bp, Homo sapiens
acatccagatctcagcatggct

SEQ ID NO: 9290536 - DNA, 22 bp, Homo sapiens
acatcacagtagttaagccaga

SEQ ID NO: 9290537 - DNA, 22 bp, Homo sapiens
acatcacagagcccagataaag

SEQ ID NO: 9290538 - DNA, 22 bp, Homo sapiens
acatcacacgccttccaggagg

SEQ ID NO: 9290539 - DNA, 22 bp, Homo sapiens
acatgtgtaaggtctctcagtc

SEQ ID NO: 9290540 - DNA, 22 bp, Homo sapiens
acatgtgtaagatgtgatatat

SEQ ID NO: 9290541 - DNA, 22 bp, Homo sapiens
acatgtttaagtttgttatatg

SEQ ID NO: 9290542 - DNA, 22 bp, Homo sapiens
acatttctttgctagacagcag

SEQ ID NO: 9290543 - DNA, 22 bp, Homo sapiens
acatttctttctattcagtagc

SEQ ID NO: 9290544 - DNA, 22 bp, Homo sapiens
aggctctgttattctagagggc

SEQ ID NO: 9290545 - DNA, 16 bp, Homo sapiens
agggagagaggaacat

SEQ ID NO: 9290546 - DNA, 22 bp, Homo sapiens
agggagacacatgaggaagtca

SEQ ID NO: 9290547 - DNA, 22 bp, Homo sapiens
agggagacacatgaggaagtca

SEQ ID NO: 9290548 - DNA, 22 bp, Homo sapiens
accagcatcacctggaggcctg

SEQ ID NO: 9290549 - DNA, 22 bp, Homo sapiens
accagccaccaccaggagatcg

SEQ ID NO: 9290550 - DNA, 22 bp, Homo sapiens
accaggctggagtgcagtggcg

SEQ ID NO: 9290551 - DNA, 22 bp, Homo sapiens
accaggctgtgaagtgagacta

SEQ ID NO: 9290552 - DNA, 22 bp, Homo sapiens
agggctgcccagtgtgagagct

SEQ ID NO: 9290553 - DNA, 22 bp, Homo sapiens
agggctgacagtgaggagtcaa

SEQ ID NO: 9290554 - DNA, 22 bp, Homo sapiens
agggggaggctgtgctgcgtct

SEQ ID NO: 9290555 - DNA, 22 bp, Homo sapiens
agggggcatcaggtcctggctc

SEQ ID NO: 9290556 - DNA, 22 bp, Homo sapiens
agggggctcagcatggatggag

SEQ ID NO: 9290557 - DNA, 22 bp, Homo sapiens
agggctgcctgactccagagcc

SEQ ID NO: 9290558 - DNA, 22 bp, Homo sapiens
agaccaggaaggcctacagata

SEQ ID NO: 9290559 - DNA, 22 bp, Homo sapiens
agaccagggtcccacagagtct

SEQ ID NO: 9290560 - DNA, 22 bp, Homo sapiens
agagaagagcaatgataaattt

SEQ ID NO: 9290561 - DNA, 22 bp, Homo sapiens
agagaagagcaatgataaattt

SEQ ID NO: 9290562 - DNA, 22 bp, Homo sapiens
atggccagggtggcactgtggt

SEQ ID NO: 9290563 - DNA, 22 bp, Homo sapiens
atggccagtcaagcctctggct

SEQ ID NO: 9290564 - DNA, 22 bp, Homo sapiens
atggccaggcacctctggctga

SEQ ID NO: 9290565 - DNA, 22 bp, Homo sapiens
atggccagggccaaaagagatg

SEQ ID NO: 9290566 - DNA, 22 bp, Homo sapiens
atggccagcttataggggctca

SEQ ID NO: 9290567 - DNA, 22 bp, Homo sapiens
atggccagcaagttcagaattt

SEQ ID NO: 9290568 - DNA, 22 bp, Homo sapiens
atggccagcccttcccgcagct

SEQ ID NO: 9290569 - DNA, 22 bp, Homo sapiens
atggccagccactcctgatggc

SEQ ID NO: 9290570 - DNA, 22 bp, Homo sapiens
atggccagctcagagcactcag

SEQ ID NO: 9290571 - DNA, 22 bp, Homo sapiens
atggccagcctggtacttggca

SEQ ID NO: 9290572 - DNA, 22 bp, Homo sapiens
atggccagctagcacttgcatt

SEQ ID NO: 9290573 - DNA, 20 bp, Homo sapiens
atggccttcctctctgtcca

SEQ ID NO: 9290574 - DNA, 22 bp, Homo sapiens
atggccttagtgatgattaata

SEQ ID NO: 9290575 - DNA, 22 bp, Homo sapiens
atggctagcaccgcgttgctgg

SEQ ID NO: 9290576 - DNA, 22 bp, Homo sapiens
atggcctgatgcacctgtccca

SEQ ID NO: 9290577 - DNA, 22 bp, Homo sapiens
atggcctgcagtgctgccacag

SEQ ID NO: 9290578 - DNA, 22 bp, Homo sapiens
atggcctggggattcctgagca

SEQ ID NO: 9290579 - DNA, 22 bp, Homo sapiens
agagacctttctcctgcctttc

SEQ ID NO: 9290580 - DNA, 22 bp, Homo sapiens
agagactgatggagctcactct

SEQ ID NO: 9290581 - DNA, 22 bp, Homo sapiens
agagcagcctgtgatgatgcac

SEQ ID NO: 9290582 - DNA, 22 bp, Homo sapiens
agagatggccttaggtgggaat

SEQ ID NO: 9290583 - DNA, 22 bp, Homo sapiens
agagatggagagcactggggct

SEQ ID NO: 9290584 - DNA, 22 bp, Homo sapiens
atgtgggtgagtgagagataga

SEQ ID NO: 9290585 - DNA, 22 bp, Homo sapiens
atgtgggttgatggaggtgtca

SEQ ID NO: 9290586 - DNA, 22 bp, Homo sapiens
atgtatttgcgtatggacatac

SEQ ID NO: 9290587 - DNA, 22 bp, Homo sapiens
agagcctgcagtggagaccttg

SEQ ID NO: 9290588 - DNA, 22 bp, Homo sapiens
agacagctgctcgcagagctat

SEQ ID NO: 9290589 - DNA, 22 bp, Homo sapiens
agacagacttgaaaatgttctt

SEQ ID NO: 9290590 - DNA, 22 bp, Homo sapiens
agacagactgtgtttgaatcct

SEQ ID NO: 9290591 - DNA, 22 bp, Homo sapiens
agacagcagggagcaggattca

SEQ ID NO: 9290592 - DNA, 22 bp, Homo sapiens
agacagctagggctgcagggac

SEQ ID NO: 9290593 - DNA, 22 bp, Homo sapiens
agacagcatggagctgataaca

SEQ ID NO: 9290594 - DNA, 22 bp, Homo sapiens
atgcacctgaactccatcagct

SEQ ID NO: 9290595 - DNA, 22 bp, Homo sapiens
atgcaccccagaagctgcagtg

SEQ ID NO: 9290596 - DNA, 22 bp, Homo sapiens
agacagacgtagtgtgagagta

SEQ ID NO: 9290597 - DNA, 22 bp, Homo sapiens
agacagactggtttgaattggt

SEQ ID NO: 9290598 - DNA, 21 bp, Homo sapiens
agacagactgcctgacccacg

SEQ ID NO: 9290599 - DNA, 17 bp, Homo sapiens
agacagacctctgcatc

SEQ ID NO: 9290600 - DNA, 22 bp, Homo sapiens
agacagacggctttatacacag

SEQ ID NO: 9290601 - DNA, 22 bp, Homo sapiens
agacagaccatggctattcaga

SEQ ID NO: 9290602 - DNA, 22 bp, Homo sapiens
agacagacattctagagccacc

SEQ ID NO: 9290603 - DNA, 22 bp, Homo sapiens
agacagacatgctagttttctt

SEQ ID NO: 9290604 - DNA, 22 bp, Homo sapiens
agacaaagaaaccgtagaagca

SEQ ID NO: 9290605 - DNA, 22 bp, Homo sapiens
agacaaagaaaccgtagaagca

SEQ ID NO: 9290606 - DNA, 22 bp, Homo sapiens
agacaaatggagtatgagcaac

SEQ ID NO: 9290607 - DNA, 22 bp, Homo sapiens
agacaaattgggacattgtgtt

SEQ ID NO: 9290608 - DNA, 22 bp, Homo sapiens
atgaaattgatcttgaactttt

SEQ ID NO: 9290609 - DNA, 22 bp, Homo sapiens
atgaacaacttgaagctccatg

SEQ ID NO: 9290610 - DNA, 22 bp, Homo sapiens
agaagtggtgtgtggccgagct

SEQ ID NO: 9290611 - DNA, 22 bp, Homo sapiens
agaagttaccacatacttctct

SEQ ID NO: 9290612 - DNA, 22 bp, Homo sapiens
agaagtttggtcctataaactc

SEQ ID NO: 9290613 - DNA, 22 bp, Homo sapiens
atgaaacatgctttgtggatga

SEQ ID NO: 9290614 - DNA, 23 bp, Homo sapiens
agaagtggaatggccgtggggtc

SEQ ID NO: 9290615 - DNA, 22 bp, Homo sapiens
agaagtctggaattcctgcagg

SEQ ID NO: 9290616 - DNA, 22 bp, Homo sapiens
agaagtctggttgcaaagcgct

SEQ ID NO: 9290617 - DNA, 22 bp, Homo sapiens
atttattgaagcttattacgtt

SEQ ID NO: 9290618 - DNA, 22 bp, Homo sapiens
agagtttggagagggtgaggca

SEQ ID NO: 9290619 - DNA, 22 bp, Homo sapiens
agagtttgaagttatctttgac

SEQ ID NO: 9290620 - DNA, 22 bp, Homo sapiens
agagtttggaggtgttcctgga

SEQ ID NO: 9290621 - DNA, 22 bp, Homo sapiens
agagtttgtatttttcagtgaa

SEQ ID NO: 9290622 - DNA, 22 bp, Homo sapiens
agagtttggtgaagcaatttga

SEQ ID NO: 9290623 - DNA, 22 bp, Homo sapiens
agagtttgtgggcttttcctcc

SEQ ID NO: 9290624 - DNA, 22 bp, Homo sapiens
agagtttgttgaatttacttgg

SEQ ID NO: 9290625 - DNA, 22 bp, Homo sapiens
atttgttgctagcagcactgat

SEQ ID NO: 9290626 - DNA, 21 bp, Homo sapiens
caaaaggataggaaattaggg

SEQ ID NO: 9290627 - DNA, 22 bp, Homo sapiens
caaaagtaattgtggttttcac

SEQ ID NO: 9290628 - DNA, 22 bp, Homo sapiens
caaaagtaattgcagtttttgc

SEQ ID NO: 9290629 - DNA, 22 bp, Homo sapiens
atttgtgggactataatgcagg

SEQ ID NO: 9290630 - DNA, 22 bp, Homo sapiens
atttcctgatatatcctgtagt

SEQ ID NO: 9290631 - DNA, 22 bp, Homo sapiens
agaggctgtctcatattttgta

SEQ ID NO: 9290632 - DNA, 22 bp, Homo sapiens
agaggctgtgcagagggagtgc

SEQ ID NO: 9290633 - DNA, 22 bp, Homo sapiens
attccagagaggttctggaggt

SEQ ID NO: 9290634 - DNA, 19 bp, Homo sapiens
attcattggccagggtggt

SEQ ID NO: 9290635 - DNA, 22 bp, Homo sapiens
agaggcctgtgtgctccagtgg

SEQ ID NO: 9290636 - DNA, 22 bp, Homo sapiens
agaggctcactcttggaaccca

SEQ ID NO: 9290637 - DNA, 22 bp, Homo sapiens
attcatgttagcccacatgtag

SEQ ID NO: 9290638 - DNA, 22 bp, Homo sapiens
attcagtagaagttagctatta

SEQ ID NO: 9290639 - DNA, 20 bp, Homo sapiens
attcatgtctttataaaagc

SEQ ID NO: 9290640 - DNA, 21 bp, Homo sapiens
agagctggtaggtaggtaggt

SEQ ID NO: 9290641 - DNA, 22 bp, Homo sapiens
agagctggtttactcaggaatt

SEQ ID NO: 9290642 - DNA, 22 bp, Homo sapiens
atgtttacaattcagtattaca

SEQ ID NO: 9290643 - DNA, 21 bp, Homo sapiens
atgtttacactgactactgtg

SEQ ID NO: 9290644 - DNA, 22 bp, Homo sapiens
atgtttactggtttatagaata

SEQ ID NO: 9290645 - DNA, 22 bp, Homo sapiens
atgtttatgcaaacatgtgagt

SEQ ID NO: 9290646 - DNA, 23 bp, Homo sapiens
attattaaggacatggactttgt

SEQ ID NO: 9290647 - DNA, 22 bp, Homo sapiens
attattattgttgatgttaggg

SEQ ID NO: 9290648 - DNA, 22 bp, Homo sapiens
agaggcactgttcttagcgact

SEQ ID NO: 9290649 - DNA, 22 bp, Homo sapiens
cagacttttgacattaatacag

SEQ ID NO: 9290650 - DNA, 22 bp, Homo sapiens
cagagaaagggtgaattccttc

SEQ ID NO: 9290651 - DNA, 22 bp, Homo sapiens
agccatcatttctgtcactggc

SEQ ID NO: 9290652 - DNA, 22 bp, Homo sapiens
agccatcactggggcccaccat

SEQ ID NO: 9290653 - DNA, 22 bp, Homo sapiens
agccatcacttgagaatctatt

SEQ ID NO: 9290654 - DNA, 23 bp, Homo sapiens
agccatcatcctgctgctggggc

SEQ ID NO: 9290655 - DNA, 16 bp, Homo sapiens
agccatcatcaacttg

SEQ ID NO: 9290656 - DNA, 22 bp, Homo sapiens
agcccagggaaccaggaagtgg

SEQ ID NO: 9290657 - DNA, 22 bp, Homo sapiens
agcccaggctggagtgcagtgg

SEQ ID NO: 9290658 - DNA, 22 bp, Homo sapiens
cagacagggttttggtctttgg

SEQ ID NO: 9290659 - DNA, 22 bp, Homo sapiens
cagacagggtgggtttctgggc

SEQ ID NO: 9290660 - DNA, 22 bp, Homo sapiens
cagacaggaagttcagaagaaa

SEQ ID NO: 9290661 - DNA, 22 bp, Homo sapiens
agccagacatggctcctgctcc

SEQ ID NO: 9290662 - DNA, 22 bp, Homo sapiens
agccagacctcggagtagtgag

SEQ ID NO: 9290663 - DNA, 22 bp, Homo sapiens
agccagactcatttggaagtat

SEQ ID NO: 9290664 - DNA, 22 bp, Homo sapiens
agccagactgtgatgtgattaa

SEQ ID NO: 9290665 - DNA, 22 bp, Homo sapiens
agccagactttaaaatagatga

SEQ ID NO: 9290666 - DNA, 22 bp, Homo sapiens
cagacaggtagggacagaacat

SEQ ID NO: 9290667 - DNA, 22 bp, Homo sapiens
cagacaggttgcaaaacttcaa

SEQ ID NO: 9290668 - DNA, 22 bp, Homo sapiens
cagaaatatttattgagtgaca

SEQ ID NO: 9290669 - DNA, 22 bp, Homo sapiens
cagaaatatgtgccatgcctta

SEQ ID NO: 9290670 - DNA, 22 bp, Homo sapiens
agcatataaatggacatatttg

SEQ ID NO: 9290671 - DNA, 22 bp, Homo sapiens
agcatatacaaactcatataca

SEQ ID NO: 9290672 - DNA, 22 bp, Homo sapiens
cagcagttatgagtagaatagt

SEQ ID NO: 9290673 - DNA, 22 bp, Homo sapiens
cagcagggtatacagggaattt

SEQ ID NO: 9290674 - DNA, 20 bp, Homo sapiens
agctcctgagggttactttc

SEQ ID NO: 9290675 - DNA, 22 bp, Homo sapiens
cagcgtgggatttggaaaccag

SEQ ID NO: 9290676 - DNA, 23 bp, Homo sapiens
agcctcttttctcctgccctgca

SEQ ID NO: 9290677 - DNA, 22 bp, Homo sapiens
cagcagctcactcaggtggctc

SEQ ID NO: 9290678 - DNA, 22 bp, Homo sapiens
cagcagctccaaagaatagcca

SEQ ID NO: 9290679 - DNA, 22 bp, Homo sapiens
cagcagctgactccaagagagc

SEQ ID NO: 9290680 - DNA, 22 bp, Homo sapiens
cagcagctcagtctctcagtag

SEQ ID NO: 9290681 - DNA, 22 bp, Homo sapiens
cagcagctgaggcgctggcgtg

SEQ ID NO: 9290682 - DNA, 21 bp, Homo sapiens
agcagcagggaagcctcatcc

SEQ ID NO: 9290683 - DNA, 21 bp, Homo sapiens
agcagcagggaagcctcatcc

SEQ ID NO: 9290684 - DNA, 22 bp, Homo sapiens
agcagcagggtgatagtgccca

SEQ ID NO: 9290685 - DNA, 22 bp, Homo sapiens
cacaaggaggtcctgaggaagc

SEQ ID NO: 9290686 - DNA, 22 bp, Homo sapiens
cacaaggactggatggagtggg

SEQ ID NO: 9290687 - DNA, 22 bp, Homo sapiens
agcagctcctctaggaacggat

SEQ ID NO: 9290688 - DNA, 22 bp, Homo sapiens
agcagcaggctgtgtggactga

SEQ ID NO: 9290689 - DNA, 22 bp, Homo sapiens
caagacaatgggtaagtgtaac

SEQ ID NO: 9290690 - DNA, 22 bp, Homo sapiens
caaaagtctgtcctttaacttc

SEQ ID NO: 9290691 - DNA, 22 bp, Homo sapiens
agcaaagcaccatatggcagtt

SEQ ID NO: 9290692 - DNA, 22 bp, Homo sapiens
agcaaagcagtggctaagctga

SEQ ID NO: 9290693 - DNA, 22 bp, Homo sapiens
cacacacagttttgtattctgt

SEQ ID NO: 9290694 - DNA, 22 bp, Homo sapiens
cacacactgacaccttatcttg

SEQ ID NO: 9290695 - DNA, 22 bp, Homo sapiens
cacacactcttcctggcaccta

SEQ ID NO: 9290696 - DNA, 22 bp, Homo sapiens
agcaggagcatttccatgattc

SEQ ID NO: 9290697 - DNA, 22 bp, Homo sapiens
cacacactgttaatgtaggagt

SEQ ID NO: 9290698 - DNA, 22 bp, Homo sapiens
cacacactggagcaaggagatg

SEQ ID NO: 9290699 - DNA, 22 bp, Homo sapiens
agcatacaggtctgaaacagct

SEQ ID NO: 9290700 - DNA, 20 bp, Homo sapiens
agcatacatcataagaaacc

SEQ ID NO: 9290701 - DNA, 22 bp, Homo sapiens
cacccaggctggagtgcagtgg

SEQ ID NO: 9290702 - DNA, 22 bp, Homo sapiens
agcagggctgtgctccttccga

SEQ ID NO: 9290703 - DNA, 22 bp, Homo sapiens
agcagggggagttagactagat

SEQ ID NO: 9290704 - DNA, 22 bp, Homo sapiens
agcagggggccacagtcacagc

SEQ ID NO: 9290705 - DNA, 22 bp, Homo sapiens
agcaggggtaacagaaggaaag

SEQ ID NO: 9290706 - DNA, 20 bp, Homo sapiens
agcaggtaaggcacagcagt

SEQ ID NO: 9290707 - DNA, 22 bp, Homo sapiens
cacccaggctggagagcagtgg

SEQ ID NO: 9290708 - DNA, 22 bp, Homo sapiens
cacccaggctggagtgcagggg

SEQ ID NO: 9290709 - DNA, 22 bp, Homo sapiens
cacccaggctggagtgcagtga

SEQ ID NO: 9290710 - DNA, 22 bp, Homo sapiens
gtgaggatgcagatgagggcct

SEQ ID NO: 9290711 - DNA, 22 bp, Homo sapiens
gtgcagcaaactagtgcgaggg

SEQ ID NO: 9290712 - DNA, 22 bp, Homo sapiens
gtgcagcaaactagtgcgaggg

SEQ ID NO: 9290713 - DNA, 22 bp, Homo sapiens
gtgctgagtgactttttcttca

SEQ ID NO: 9290714 - DNA, 20 bp, Homo sapiens
gtgctgagtgaaatgagatt

SEQ ID NO: 9290715 - DNA, 22 bp, Homo sapiens
gtgctgagaacaaaagtggaca

SEQ ID NO: 9290716 - DNA, 22 bp, Homo sapiens
gtgctgagtgcagagtgcagag

SEQ ID NO: 9290717 - DNA, 22 bp, Homo sapiens
gtgctgagtgcggccgaattct

SEQ ID NO: 9290718 - DNA, 20 bp, Homo sapiens
gtgctgagtgtctaactcct

SEQ ID NO: 9290719 - DNA, 23 bp, Homo sapiens
gtgctgcaaaatcggccactgca

SEQ ID NO: 9290720 - DNA, 22 bp, Homo sapiens
gtgctgcagggcctcctgcacc

SEQ ID NO: 9290721 - DNA, 22 bp, Homo sapiens
gtgctgcagagtctcgtgccgc

SEQ ID NO: 9290722 - DNA, 22 bp, Homo sapiens
gtgctgcatgacttgctcctga

SEQ ID NO: 9290723 - DNA, 22 bp, Homo sapiens
gtgccaggtgctaagctgtgct

SEQ ID NO: 9290724 - DNA, 22 bp, Homo sapiens
gtgccagtctctgagttaggac

SEQ ID NO: 9290725 - DNA, 22 bp, Homo sapiens
gtctttctatgcatagagcaga

SEQ ID NO: 9290726 - DNA, 21 bp, Homo sapiens
gtctttctacctctatgtggc

SEQ ID NO: 9290727 - DNA, 22 bp, Homo sapiens
gtgaaaaatgatttgttaactg

SEQ ID NO: 9290728 - DNA, 22 bp, Homo sapiens
gtgagccgagtatagttcatag

SEQ ID NO: 9290729 - DNA, 22 bp, Homo sapiens
gtgaggagctgacactggggtg

SEQ ID NO: 9290730 - DNA, 22 bp, Homo sapiens
gtctacagtgaatgggtcctaa

SEQ ID NO: 9290731 - DNA, 22 bp, Homo sapiens
gtctaaagtctatacttttgtg

SEQ ID NO: 9290732 - DNA, 22 bp, Homo sapiens
gtctatatattgcttgaataat

SEQ ID NO: 9290733 - DNA, 22 bp, Homo sapiens
gtctatgatattttgttatagc

SEQ ID NO: 9290734 - DNA, 22 bp, Homo sapiens
gtaggggatggttccctagaaa

SEQ ID NO: 9290735 - DNA, 22 bp, Homo sapiens
gtagggttggagagcacaacca

SEQ ID NO: 9290736 - DNA, 22 bp, Homo sapiens
gtaggaagctctgaggctagtt

SEQ ID NO: 9290737 - DNA, 22 bp, Homo sapiens
gtaggtgagtgatgctcagatt

SEQ ID NO: 9290738 - DNA, 22 bp, Homo sapiens
gtacaaaagttattgcggtttt

SEQ ID NO: 9290739 - DNA, 22 bp, Homo sapiens
gtacaagttctactctataaat

SEQ ID NO: 9290740 - DNA, 22 bp, Homo sapiens
gtcaaaacaaagttaagaattc

SEQ ID NO: 9290741 - DNA, 22 bp, Homo sapiens
gtcaaaaagtagtcatttctgt

SEQ ID NO: 9290742 - DNA, 22 bp, Homo sapiens
gtagttctgcagtgtcacctga

SEQ ID NO: 9290743 - DNA, 22 bp, Homo sapiens
gtagttctgcagtgtcacctga

SEQ ID NO: 9290744 - DNA, 22 bp, Homo sapiens
gtcctgcaggagttgtactctg

SEQ ID NO: 9290745 - DNA, 22 bp, Homo sapiens
gtcctctggtgaaagcattccc

SEQ ID NO: 9290746 - DNA, 22 bp, Homo sapiens
gtcctctggtgaaagcattccc

SEQ ID NO: 9290747 - DNA, 22 bp, Homo sapiens
gtcctctgggctttgagcagtc

SEQ ID NO: 9290748 - DNA, 22 bp, Homo sapiens
gtcctctgggctttgagcagtc

SEQ ID NO: 9290749 - DNA, 22 bp, Homo sapiens
gtcctctgtagggctgggccac

SEQ ID NO: 9290750 - DNA, 22 bp, Homo sapiens
gtcctctgtccctggggcacgg

SEQ ID NO: 9290751 - DNA, 22 bp, Homo sapiens
gtcctggcacctcactggctac

SEQ ID NO: 9290752 - DNA, 22 bp, Homo sapiens
gtcctggcccactggcaggctg

SEQ ID NO: 9290753 - DNA, 22 bp, Homo sapiens
gtcctggcccaggagtacacat

SEQ ID NO: 9290754 - DNA, 22 bp, Homo sapiens
gtcctggctggttctgtggggc

SEQ ID NO: 9290755 - DNA, 19 bp, Homo sapiens
gtcctggcgccgccacacc

SEQ ID NO: 9290756 - DNA, 22 bp, Homo sapiens
gtcgggtagtgctggaaggatt

SEQ ID NO: 9290757 - DNA, 22 bp, Homo sapiens
gtcctctgggagccttgagcct

SEQ ID NO: 9290758 - DNA, 22 bp, Homo sapiens
gtcctctggcctttcccaggac

SEQ ID NO: 9290759 - DNA, 22 bp, Homo sapiens
gtcctctgggagccttgagcct

SEQ ID NO: 9290760 - DNA, 22 bp, Homo sapiens
gtcctctgggcagctgccccac

SEQ ID NO: 9290761 - DNA, 22 bp, Homo sapiens
gtcctctgggcagctgccccac

SEQ ID NO: 9290762 - DNA, 23 bp, Homo sapiens
gtcctctggagagaaaggcagta

SEQ ID NO: 9290763 - DNA, 22 bp, Homo sapiens
gtcctctggaggtttttaggtg

SEQ ID NO: 9290764 - DNA, 22 bp, Homo sapiens
gtcctctggcctttcccaggac

SEQ ID NO: 9290765 - DNA, 22 bp, Homo sapiens
gtcctctgcttcatgccctgat

SEQ ID NO: 9290766 - DNA, 22 bp, Homo sapiens
gtcctctggaagatgagttctt

SEQ ID NO: 9290767 - DNA, 22 bp, Homo sapiens
gtcacctctcatcacatgctac

SEQ ID NO: 9290768 - DNA, 22 bp, Homo sapiens
gtcagaggaatggatgagtgat

SEQ ID NO: 9290769 - DNA, 22 bp, Homo sapiens
gtccagctctgagaagaaacat

SEQ ID NO: 9290770 - DNA, 22 bp, Homo sapiens
gtccagctgcagctgggcagaa

SEQ ID NO: 9290771 - DNA, 22 bp, Homo sapiens
gggtggtggccagcagtgggca

SEQ ID NO: 9290772 - DNA, 22 bp, Homo sapiens
gggtgagggatgagccttcttc

SEQ ID NO: 9290773 - DNA, 22 bp, Homo sapiens
gggtgctttggctcacgcctgt

SEQ ID NO: 9290774 - DNA, 22 bp, Homo sapiens
gggtggaagccagagaggtcat

SEQ ID NO: 9290775 - DNA, 22 bp, Homo sapiens
ggggtagggcgattgctgcttt

SEQ ID NO: 9290776 - DNA, 22 bp, Homo sapiens
ggggtaggcaggtgatctgatc

SEQ ID NO: 9290777 - DNA, 22 bp, Homo sapiens
ggggccagcaatgttgaggaat

SEQ ID NO: 9290778 - DNA, 22 bp, Homo sapiens
ggggtggcctgtaggcagcatg

SEQ ID NO: 9290779 - DNA, 22 bp, Homo sapiens
ggggtggagatggtggcccttt

SEQ ID NO: 9290780 - DNA, 22 bp, Homo sapiens
ggggtggattcctacaggtcca

SEQ ID NO: 9290781 - DNA, 22 bp, Homo sapiens
ggggtggattcctacaggtcca

SEQ ID NO: 9290782 - DNA, 22 bp, Homo sapiens
ggggaggaagctggaacacggg

SEQ ID NO: 9290783 - DNA, 22 bp, Homo sapiens
ggggaggacctttccaaggctt

SEQ ID NO: 9290784 - DNA, 22 bp, Homo sapiens
ggggaggctgatgtgggcaaag

SEQ ID NO: 9290785 - DNA, 22 bp, Homo sapiens
ggggcaggaggtgttctctttt

SEQ ID NO: 9290786 - DNA, 22 bp, Homo sapiens
ggggcagggaggttatcgccga

SEQ ID NO: 9290787 - DNA, 20 bp, Homo sapiens
ggggcaggtttttatggcta

SEQ ID NO: 9290788 - DNA, 22 bp, Homo sapiens
gggctgtgtgcccacttcccat

SEQ ID NO: 9290789 - DNA, 18 bp, Homo sapiens
gggctgtgttcatgccca

SEQ ID NO: 9290790 - DNA, 16 bp, Homo sapiens
gggctgggggattctg

SEQ ID NO: 9290791 - DNA, 22 bp, Homo sapiens
gggctctggggtgccctggcat

SEQ ID NO: 9290792 - DNA, 22 bp, Homo sapiens
gggctctggggaggacccttca

SEQ ID NO: 9290793 - DNA, 22 bp, Homo sapiens
ggtggactcaaaatgtgcttga

SEQ ID NO: 9290794 - DNA, 22 bp, Homo sapiens
ggtggagctatacgggatggct

SEQ ID NO: 9290795 - DNA, 22 bp, Homo sapiens
ggtggcagagaggaggtagttt

SEQ ID NO: 9290796 - DNA, 22 bp, Homo sapiens
ggtggcactcaaccttttatta

SEQ ID NO: 9290797 - DNA, 22 bp, Homo sapiens
ggtggggcctgctccagcggcc

SEQ ID NO: 9290798 - DNA, 22 bp, Homo sapiens
ggtggggcctgctccagcggcc

SEQ ID NO: 9290799 - DNA, 22 bp, Homo sapiens
ggtggggctaggacctcaggat

SEQ ID NO: 9290800 - DNA, 22 bp, Homo sapiens
ggtgggtgagccctgggagctg

SEQ ID NO: 9290801 - DNA, 22 bp, Homo sapiens
ggtggggagtcaggcattcttg

SEQ ID NO: 9290802 - DNA, 22 bp, Homo sapiens
ggtggggccagggctccaacct

SEQ ID NO: 9290803 - DNA, 22 bp, Homo sapiens
ggtggggccagggctccaacct

SEQ ID NO: 9290804 - DNA, 22 bp, Homo sapiens
ggtggggcccaggcatctgatg

SEQ ID NO: 9290805 - DNA, 22 bp, Homo sapiens
ggtggggcccaggcatctgatg

SEQ ID NO: 9290806 - DNA, 22 bp, Homo sapiens
ggtggggccctggcactggtat

SEQ ID NO: 9290807 - DNA, 22 bp, Homo sapiens
ggtggggccctggcactggtat

SEQ ID NO: 9290808 - DNA, 22 bp, Homo sapiens
ggttaggatcagatcctggagg

SEQ ID NO: 9290809 - DNA, 22 bp, Homo sapiens
ggttaggatcagatcctggagg

SEQ ID NO: 9290810 - DNA, 23 bp, Homo sapiens
ggttagggaatgatctcaggcat

SEQ ID NO: 9290811 - DNA, 22 bp, Homo sapiens
gtaatgctgtacaccattaaca

SEQ ID NO: 9290812 - DNA, 22 bp, Homo sapiens
gtaatgcttttgatacagggac

SEQ ID NO: 9290813 - DNA, 22 bp, Homo sapiens
gtaatgctacaggagtctacat

SEQ ID NO: 9290814 - DNA, 22 bp, Homo sapiens
gtaattacatgagtactgtaag

SEQ ID NO: 9290815 - DNA, 22 bp, Homo sapiens
gtaatgtactgcagccagatgt

SEQ ID NO: 9290816 - DNA, 22 bp, Homo sapiens
gtaattgtgggcttagtagagt

SEQ ID NO: 9290817 - DNA, 22 bp, Homo sapiens
gtaattgtcttgaattcacaac

SEQ ID NO: 9290818 - DNA, 22 bp, Homo sapiens
ggttccacctggcgaggggtat

SEQ ID NO: 9290819 - DNA, 22 bp, Homo sapiens
ggttggggcgagctggaggccc

SEQ ID NO: 9290820 - DNA, 22 bp, Homo sapiens
ggttggtaactccctgtgcagt

SEQ ID NO: 9290821 - DNA, 22 bp, Homo sapiens
ggttggtaactccctgtgcagt

SEQ ID NO: 9290822 - DNA, 22 bp, Homo sapiens
gggttggatcctggtggctgcc

SEQ ID NO: 9290823 - DNA, 22 bp, Homo sapiens
gggttgggactgtcatctggag

SEQ ID NO: 9290824 - DNA, 22 bp, Homo sapiens
ggtccccgtggaggctggagcg

SEQ ID NO: 9290825 - DNA, 22 bp, Homo sapiens
ggtgagggagtggaacgaggtg

SEQ ID NO: 9290826 - DNA, 22 bp, Homo sapiens
ggtgctctggtcatggtggagt

SEQ ID NO: 9290827 - DNA, 18 bp, Homo sapiens
ggtgaggcggcggccagc

SEQ ID NO: 9290828 - DNA, 22 bp, Homo sapiens
ggtgacagcgggtcaagaggag

SEQ ID NO: 9290829 - DNA, 22 bp, Homo sapiens
ggtgaggaattggggactgacc

SEQ ID NO: 9290830 - DNA, 22 bp, Homo sapiens
ggtgaggaaagatggtgacagt

SEQ ID NO: 9290831 - DNA, 22 bp, Homo sapiens
ggtgagcctggagtcttgctgg

SEQ ID NO: 9290832 - DNA, 22 bp, Homo sapiens
ggcactgactgtgcagcgcacc

SEQ ID NO: 9290833 - DNA, 22 bp, Homo sapiens
ggcagaggtgaagttcacaagg

SEQ ID NO: 9290834 - DNA, 22 bp, Homo sapiens
ggcagatggagaagcagcaggt

SEQ ID NO: 9290835 - DNA, 22 bp, Homo sapiens
ggcacctggatgtagcagtgaa

SEQ ID NO: 9290836 - DNA, 22 bp, Homo sapiens
ggcacccttggggggccacagc

SEQ ID NO: 9290837 - DNA, 18 bp, Homo sapiens
ggcagggaaaagataggg

SEQ ID NO: 9290838 - DNA, 22 bp, Homo sapiens
ggcagggcttgtctctgtgatg

SEQ ID NO: 9290839 - DNA, 22 bp, Homo sapiens
ggcagggccctgattcctgggg

SEQ ID NO: 9290840 - DNA, 20 bp, Homo sapiens
ggcagggcatcaacagctct

SEQ ID NO: 9290841 - DNA, 22 bp, Homo sapiens
ggcagtgagaggtctcctggtc

SEQ ID NO: 9290842 - DNA, 22 bp, Homo sapiens
ggctctgaacatggggaggagt

SEQ ID NO: 9290843 - DNA, 22 bp, Homo sapiens
ggctctgaaggagacagctgct

SEQ ID NO: 9290844 - DNA, 22 bp, Homo sapiens
ggctcagcacagggctggcatc

SEQ ID NO: 9290845 - DNA, 22 bp, Homo sapiens
ggctctgcaaaagtagatactt

SEQ ID NO: 9290846 - DNA, 22 bp, Homo sapiens
ggctctgcactcagagtcattc

SEQ ID NO: 9290847 - DNA, 22 bp, Homo sapiens
ggctctgcagagggcccagctt

SEQ ID NO: 9290848 - DNA, 22 bp, Homo sapiens
ggctctgcagcttggggtcctg

SEQ ID NO: 9290849 - DNA, 22 bp, Homo sapiens
ggctctgcagcttgctaactgt

SEQ ID NO: 9290850 - DNA, 22 bp, Homo sapiens
ggctctgcagcttgctaactgt

SEQ ID NO: 9290851 - DNA, 22 bp, Homo sapiens
ggctctgcatgcaggttgtcag

SEQ ID NO: 9290852 - DNA, 22 bp, Homo sapiens
ggctctgcagtgacttgagggg

SEQ ID NO: 9290853 - DNA, 22 bp, Homo sapiens
ggctctgcatgtgagtgggtgg

SEQ ID NO: 9290854 - DNA, 22 bp, Homo sapiens
ggctctgcctgcccagcagcac

SEQ ID NO: 9290855 - DNA, 22 bp, Homo sapiens
ggctctgcgcctgcggggactt

SEQ ID NO: 9290856 - DNA, 22 bp, Homo sapiens
ggctctgcctgcctgagtgtcc

SEQ ID NO: 9290857 - DNA, 22 bp, Homo sapiens
ggctctgccgtgtgctcacatg

SEQ ID NO: 9290858 - DNA, 22 bp, Homo sapiens
ggctctgcctctgaccctctgg

SEQ ID NO: 9290859 - DNA, 22 bp, Homo sapiens
ggctctgccacttcttggctgt

SEQ ID NO: 9290860 - DNA, 22 bp, Homo sapiens
ggctctgccatttcctagctgc

SEQ ID NO: 9290861 - DNA, 22 bp, Homo sapiens
ggctctgcccgcggctgcccac

SEQ ID NO: 9290862 - DNA, 20 bp, Homo sapiens
ggctctgccccaccccgtcc

SEQ ID NO: 9290863 - DNA, 22 bp, Homo sapiens
ggctctgcccagatgaagagga

SEQ ID NO: 9290864 - DNA, 22 bp, Homo sapiens
ggctctgcccaggtggacagca

SEQ ID NO: 9290865 - DNA, 22 bp, Homo sapiens
ggctagggaaatcctgatccaa

SEQ ID NO: 9290866 - DNA, 22 bp, Homo sapiens
ggctagggacacagctctgctc

SEQ ID NO: 9290867 - DNA, 22 bp, Homo sapiens
ggctagggacacagctctgctc

SEQ ID NO: 9290868 - DNA, 18 bp, Homo sapiens
ggcctctggactggcagc

SEQ ID NO: 9290869 - DNA, 22 bp, Homo sapiens
ggcctctctgagagcagacgtt

SEQ ID NO: 9290870 - DNA, 22 bp, Homo sapiens
ggccacatgtggctgctcgtat

SEQ ID NO: 9290871 - DNA, 22 bp, Homo sapiens
ggccagctggatgtgggtgacg

SEQ ID NO: 9290872 - DNA, 22 bp, Homo sapiens
ggccagctggagttccgggtgg

SEQ ID NO: 9290873 - DNA, 22 bp, Homo sapiens
ggcccagcgaggccacctacag

SEQ ID NO: 9290874 - DNA, 20 bp, Homo sapiens
ggccagctggaggcgccggg

SEQ ID NO: 9290875 - DNA, 20 bp, Homo sapiens
ggccagctgatgcacgatgc

SEQ ID NO: 9290876 - DNA, 22 bp, Homo sapiens
ggccagctgccaccagccctat

SEQ ID NO: 9290877 - DNA, 22 bp, Homo sapiens
ggccagctctgcacagcagctg

SEQ ID NO: 9290878 - DNA, 20 bp, Homo sapiens
ggcccagtgaaccaggacgg

SEQ ID NO: 9290879 - DNA, 22 bp, Homo sapiens
ggcccagtctggggccctgtga

SEQ ID NO: 9290880 - DNA, 22 bp, Homo sapiens
ggcccaggtccagcgagtacct

SEQ ID NO: 9290881 - DNA, 22 bp, Homo sapiens
ggcccagtgtaccccaggcagt

SEQ ID NO: 9290882 - DNA, 22 bp, Homo sapiens
ggcccagtgtcccggtcgtggc

SEQ ID NO: 9290883 - DNA, 22 bp, Homo sapiens
ggcccagtgtcccggtcgtggc

SEQ ID NO: 9290884 - DNA, 22 bp, Homo sapiens
ggcccagtgtgggtggatgttg

SEQ ID NO: 9290885 - DNA, 22 bp, Homo sapiens
ggcccagtgtgggtggatgttg

SEQ ID NO: 9290886 - DNA, 22 bp, Homo sapiens
ggcccaggatgcaagaactgaa

SEQ ID NO: 9290887 - DNA, 22 bp, Homo sapiens
ggcccaggctggagtgcagtgg

SEQ ID NO: 9290888 - DNA, 22 bp, Homo sapiens
ggctgcaggttggttggcagct

SEQ ID NO: 9290889 - DNA, 17 bp, Homo sapiens
ggctgcagtccaggagg

SEQ ID NO: 9290890 - DNA, 22 bp, Homo sapiens
ggctctgcggcgtgtgcgcagg

SEQ ID NO: 9290891 - DNA, 22 bp, Homo sapiens
ggctctgcgcggtaaagtgact

SEQ ID NO: 9290892 - DNA, 22 bp, Homo sapiens
ggctgcaggcttccctccagca

SEQ ID NO: 9290893 - DNA, 21 bp, Homo sapiens
ggctgcagggagccctggggt

SEQ ID NO: 9290894 - DNA, 22 bp, Homo sapiens
ggctgcagttgtgtgaaggccg

SEQ ID NO: 9290895 - DNA, 22 bp, Homo sapiens
ggctgcagtttgtcttttgctt

SEQ ID NO: 9290896 - DNA, 22 bp, Homo sapiens
ggctggagatatgtctggaaca

SEQ ID NO: 9290897 - DNA, 22 bp, Homo sapiens
gggaaggcagtgggaggaactg

SEQ ID NO: 9290898 - DNA, 23 bp, Homo sapiens
gggagccaggacctcgcgcccca

SEQ ID NO: 9290899 - DNA, 22 bp, Homo sapiens
ggctgtgctgagggggaagccc

SEQ ID NO: 9290900 - DNA, 18 bp, Homo sapiens
ggctgtgcgtggaggctg

SEQ ID NO: 9290901 - DNA, 22 bp, Homo sapiens
ggctgtggcagctggaagtggt

SEQ ID NO: 9290902 - DNA, 22 bp, Homo sapiens
ggctgtggcagctggaagtggt

SEQ ID NO: 9290903 - DNA, 22 bp, Homo sapiens
ggctgtggcattaggtgaggcc

SEQ ID NO: 9290904 - DNA, 22 bp, Homo sapiens
ggctgtggcattaggtgaggcc

SEQ ID NO: 9290905 - DNA, 22 bp, Homo sapiens
ggctgtggcagctggaagtggt

SEQ ID NO: 9290906 - DNA, 22 bp, Homo sapiens
ggctgtggccagcggggctgag

SEQ ID NO: 9290907 - DNA, 20 bp, Homo sapiens
gggcagagccagccagtccc

SEQ ID NO: 9290908 - DNA, 22 bp, Homo sapiens
gggcactggtgctgccatcttg

SEQ ID NO: 9290909 - DNA, 22 bp, Homo sapiens
gggcactgggtcttctccacgc

SEQ ID NO: 9290910 - DNA, 22 bp, Homo sapiens
gggcactgtacactgtgcatgg

SEQ ID NO: 9290911 - DNA, 22 bp, Homo sapiens
gggcagagactcagaaacagaa

SEQ ID NO: 9290912 - DNA, 22 bp, Homo sapiens
gggcaggtgccagctccctgtc

SEQ ID NO: 9290913 - DNA, 22 bp, Homo sapiens
gggcaggtgcccagggccagag

SEQ ID NO: 9290914 - DNA, 22 bp, Homo sapiens
gggcaggtgcccagggccagag

SEQ ID NO: 9290915 - DNA, 22 bp, Homo sapiens
gggcaggtgacctcttgtcctg

SEQ ID NO: 9290916 - DNA, 22 bp, Homo sapiens
gggcaggtgattttggctccat

SEQ ID NO: 9290917 - DNA, 21 bp, Homo sapiens
gggcaggtctctgatgtcaac

SEQ ID NO: 9290918 - DNA, 17 bp, Homo sapiens
gggcagggactcctggg

SEQ ID NO: 9290919 - DNA, 22 bp, Homo sapiens
gggcaggtctgggtcagcctga

SEQ ID NO: 9290920 - DNA, 15 bp, Homo sapiens
gggcaggtctggggc

SEQ ID NO: 9290921 - DNA, 17 bp, Homo sapiens
gggcagggactcctggg

SEQ ID NO: 9290922 - DNA, 21 bp, Homo sapiens
gggcagaggggcctcctgggt

SEQ ID NO: 9290923 - DNA, 21 bp, Homo sapiens
gggcagaggggcctcctgggt

SEQ ID NO: 9290924 - DNA, 19 bp, Homo sapiens
gggatcagcccagggctct

SEQ ID NO: 9290925 - DNA, 20 bp, Homo sapiens
gggatcaggaaaggaggcta

SEQ ID NO: 9290926 - DNA, 20 bp, Homo sapiens
gggatcaggaaaggaggcta

SEQ ID NO: 9290927 - DNA, 22 bp, Homo sapiens
gggataggagattgggagtgtt

SEQ ID NO: 9290928 - DNA, 22 bp, Homo sapiens
gggataggtttggaagaggtgg

SEQ ID NO: 9290929 - DNA, 22 bp, Homo sapiens
gggagctcgtgcgcccaggtgc

SEQ ID NO: 9290930 - DNA, 22 bp, Homo sapiens
gggagctgaagtaggggtaaat

SEQ ID NO: 9290931 - DNA, 22 bp, Homo sapiens
gggagctgaaggagccggcggg

SEQ ID NO: 9290932 - DNA, 22 bp, Homo sapiens
gggagctctccctgaggcctgg

SEQ ID NO: 9290933 - DNA, 22 bp, Homo sapiens
gggagctgaactgctgaagttg

SEQ ID NO: 9290934 - DNA, 22 bp, Homo sapiens
gggagctgaatggcaatggaga

SEQ ID NO: 9290935 - DNA, 22 bp, Homo sapiens
gggaggttgaggctgcagtgag

SEQ ID NO: 9290936 - DNA, 22 bp, Homo sapiens
gggctcagagcatttgggttgg

SEQ ID NO: 9290937 - DNA, 22 bp, Homo sapiens
gggctcagctccttccttccta

SEQ ID NO: 9290938 - DNA, 22 bp, Homo sapiens
gggctctgactgaatattgaat

SEQ ID NO: 9290939 - DNA, 22 bp, Homo sapiens
gggcaggtgtttccaaggtgag

SEQ ID NO: 9290940 - DNA, 22 bp, Homo sapiens
gggcaggtgttgtcaatctaat

SEQ ID NO: 9290941 - DNA, 22 bp, Homo sapiens
gggcaggtgtgcagagctgttg

SEQ ID NO: 9290942 - DNA, 22 bp, Homo sapiens
gggcaggtggcctcttgtacta

SEQ ID NO: 9290943 - DNA, 22 bp, Homo sapiens
gggcaggtggcagggtctctgg

SEQ ID NO: 9290944 - DNA, 22 bp, Homo sapiens
gggcaggtggagggcccagcca

SEQ ID NO: 9290945 - DNA, 22 bp, Homo sapiens
gggcaggtggcaaagccagagg

SEQ ID NO: 9290946 - DNA, 22 bp, Homo sapiens
gggccccttgtatctctggctc

SEQ ID NO: 9290947 - DNA, 22 bp, Homo sapiens
gggccccttgctgctctgctgg

SEQ ID NO: 9290948 - DNA, 22 bp, Homo sapiens
gggccctgccccgtggctctga

SEQ ID NO: 9290949 - DNA, 22 bp, Homo sapiens
gggccctgggattcagagcaag

SEQ ID NO: 9290950 - DNA, 22 bp, Homo sapiens
gggccctgggattcagagcaag

SEQ ID NO: 9290951 - DNA, 20 bp, Homo sapiens
gggctaggtagccatttggc

SEQ ID NO: 9290952 - DNA, 22 bp, Homo sapiens
gggccctggggcctgatttgca

SEQ ID NO: 9290953 - DNA, 22 bp, Homo sapiens
gcaggtggaagcagcagactca

SEQ ID NO: 9290954 - DNA, 22 bp, Homo sapiens
gcagtgtttgtgttctcacatg

SEQ ID NO: 9290955 - DNA, 22 bp, Homo sapiens
gcattctttagactgagagata

SEQ ID NO: 9290956 - DNA, 22 bp, Homo sapiens
gcattctttccacgaggaggta

SEQ ID NO: 9290957 - DNA, 19 bp, Homo sapiens
gcataaaatgtcaatgtgt

SEQ ID NO: 9290958 - DNA, 22 bp, Homo sapiens
gcattgattctgaagtgaaatg

SEQ ID NO: 9290959 - DNA, 23 bp, Homo sapiens
gcattgtagaatgtttagcagca

SEQ ID NO: 9290960 - DNA, 22 bp, Homo sapiens
gcattggcagggatgcattacg

SEQ ID NO: 9290961 - DNA, 22 bp, Homo sapiens
gcatttattatctgccaggcac

SEQ ID NO: 9290962 - DNA, 22 bp, Homo sapiens
gcatttatattctgttcggata

SEQ ID NO: 9290963 - DNA, 18 bp, Homo sapiens
gcatttatgcggggctac

SEQ ID NO: 9290964 - DNA, 22 bp, Homo sapiens
gcatttatttctttactgcatc

SEQ ID NO: 9290965 - DNA, 22 bp, Homo sapiens
gccaggctccaggccctcctga

SEQ ID NO: 9290966 - DNA, 22 bp, Homo sapiens
gccaggctccaggccctcctga

SEQ ID NO: 9290967 - DNA, 22 bp, Homo sapiens
gccaggctccccggatccctgg

SEQ ID NO: 9290968 - DNA, 23 bp, Homo sapiens
gccaggctccggtctgtggccac

SEQ ID NO: 9290969 - DNA, 22 bp, Homo sapiens
gccaggctcagcagtcaacctg

SEQ ID NO: 9290970 - DNA, 22 bp, Homo sapiens
gccaggctaagaaaggtgtgat

SEQ ID NO: 9290971 - DNA, 22 bp, Homo sapiens
gccaggctctcagtgactgccc

SEQ ID NO: 9290972 - DNA, 22 bp, Homo sapiens
gcccaagggcatcaagttctac

SEQ ID NO: 9290973 - DNA, 22 bp, Homo sapiens
gccagctgtttcagagcccagt

SEQ ID NO: 9290974 - DNA, 22 bp, Homo sapiens
gccagctgtaggtggtgggttg

SEQ ID NO: 9290975 - DNA, 22 bp, Homo sapiens
gccagctgtctaagagagtaaa

SEQ ID NO: 9290976 - DNA, 22 bp, Homo sapiens
gccagctgtaagctggggtgat

SEQ ID NO: 9290977 - DNA, 22 bp, Homo sapiens
gccagctgggccttagggctgg

SEQ ID NO: 9290978 - DNA, 22 bp, Homo sapiens
gccagctggtaggcacctagcc

SEQ ID NO: 9290979 - DNA, 22 bp, Homo sapiens
gccagctggtaggcacctagcc

SEQ ID NO: 9290980 - DNA, 22 bp, Homo sapiens
gccagacactcccctgggcagg

SEQ ID NO: 9290981 - DNA, 22 bp, Homo sapiens
gccagctgaggccgtgcaggct

SEQ ID NO: 9290982 - DNA, 22 bp, Homo sapiens
gcctggagacagcagaggcggc

SEQ ID NO: 9290983 - DNA, 22 bp, Homo sapiens
gcctggagacaaggacaaaggg

SEQ ID NO: 9290984 - DNA, 22 bp, Homo sapiens
gcctggagaattaaaaggaagg

SEQ ID NO: 9290985 - DNA, 22 bp, Homo sapiens
gcctggagaaaggaaggtggga

SEQ ID NO: 9290986 - DNA, 22 bp, Homo sapiens
gcctggagaagatggaactagc

SEQ ID NO: 9290987 - DNA, 23 bp, Homo sapiens
gcctggagaaaagctgcagttca

SEQ ID NO: 9290988 - DNA, 22 bp, Homo sapiens
gcctggagaggaagccggtgga

SEQ ID NO: 9290989 - DNA, 22 bp, Homo sapiens
gcctggagcagacgtgtcccgg

SEQ ID NO: 9290990 - DNA, 22 bp, Homo sapiens
gcctggagcccagtgtggggct

SEQ ID NO: 9290991 - DNA, 22 bp, Homo sapiens
gcctggagagcactgtgcgctt

SEQ ID NO: 9290992 - DNA, 22 bp, Homo sapiens
gcctggagacctgctcctctac

SEQ ID NO: 9290993 - DNA, 22 bp, Homo sapiens
gcctggagtgcagtggcgtgat

SEQ ID NO: 9290994 - DNA, 16 bp, Homo sapiens
gcctggagtggcaggg

SEQ ID NO: 9290995 - DNA, 22 bp, Homo sapiens
gcctggagtggacttggcccct

SEQ ID NO: 9290996 - DNA, 18 bp, Homo sapiens
gcctgcaggcacgggggt

SEQ ID NO: 9290997 - DNA, 22 bp, Homo sapiens
gcctgcagggcccttgtgggtc

SEQ ID NO: 9290998 - DNA, 22 bp, Homo sapiens
gcccctctccttgtgcacctgc

SEQ ID NO: 9290999 - DNA, 22 bp, Homo sapiens
gcccctggctggccagctcctc

SEQ ID NO: 9291000 - DNA, 22 bp, Homo sapiens
gccccaggtggtaaacctaaga

SEQ ID NO: 9291001 - DNA, 22 bp, Homo sapiens
gcccacacaccagctcaggagg

SEQ ID NO: 9291002 - DNA, 22 bp, Homo sapiens
gcccacaccatttattctttgt

SEQ ID NO: 9291003 - DNA, 22 bp, Homo sapiens
gcccacacagcagatcctttgg

SEQ ID NO: 9291004 - DNA, 22 bp, Homo sapiens
gccccaggggaggtgccctgca

SEQ ID NO: 9291005 - DNA, 23 bp, Homo sapiens
gccctgctactcacaagctgtgt

SEQ ID NO: 9291006 - DNA, 22 bp, Homo sapiens
gcctcaggtaaaacttgagttt

SEQ ID NO: 9291007 - DNA, 22 bp, Homo sapiens
gcctcagtttatacacctgtaa

SEQ ID NO: 9291008 - DNA, 22 bp, Homo sapiens
gcagacagggctacagaggtac

SEQ ID NO: 9291009 - DNA, 19 bp, Homo sapiens
gcagagtggggtggagggt

SEQ ID NO: 9291010 - DNA, 19 bp, Homo sapiens
gcagagtggggtggagggt

SEQ ID NO: 9291011 - DNA, 22 bp, Homo sapiens
gcagagtgaagggagaggtgtg

SEQ ID NO: 9291012 - DNA, 22 bp, Homo sapiens
gcagagtgatggaatgtgggtg

SEQ ID NO: 9291013 - DNA, 22 bp, Homo sapiens
gcagaaggatccgcaggtgcaa

SEQ ID NO: 9291014 - DNA, 22 bp, Homo sapiens
gcagacagactgcagtgatttt

SEQ ID NO: 9291015 - DNA, 23 bp, Homo sapiens
gcagacagagcagactaagacaa

SEQ ID NO: 9291016 - DNA, 22 bp, Homo sapiens
gcagacagaagctaagtagaca

SEQ ID NO: 9291017 - DNA, 22 bp, Homo sapiens
gcagacagatgagggtgctggg

SEQ ID NO: 9291018 - DNA, 22 bp, Homo sapiens
gcagacagcatgttgggctatt

SEQ ID NO: 9291019 - DNA, 22 bp, Homo sapiens
gcagacaggattgggttaatag

SEQ ID NO: 9291020 - DNA, 22 bp, Homo sapiens
gcagacagccagactgcactgg

SEQ ID NO: 9291021 - DNA, 22 bp, Homo sapiens
gcagacaggcccagtggaggga

SEQ ID NO: 9291022 - DNA, 22 bp, Homo sapiens
gcaaggcagcgcggagtagcta

SEQ ID NO: 9291023 - DNA, 20 bp, Homo sapiens
gcaaggcacagtgaggaggg

SEQ ID NO: 9291024 - DNA, 22 bp, Homo sapiens
gagtagggatgctggtgactcc

SEQ ID NO: 9291025 - DNA, 20 bp, Homo sapiens
gcacagagatgagcaaagta

SEQ ID NO: 9291026 - DNA, 22 bp, Homo sapiens
gcacagagacagtcctgagatc

SEQ ID NO: 9291027 - DNA, 22 bp, Homo sapiens
gcacagagagcagtgggggaca

SEQ ID NO: 9291028 - DNA, 22 bp, Homo sapiens
gcacagagtcactagctaagca

SEQ ID NO: 9291029 - DNA, 22 bp, Homo sapiens
gcacagagtgggtgagatgtgg

SEQ ID NO: 9291030 - DNA, 22 bp, Homo sapiens
gcagccagaagactcagaacaa

SEQ ID NO: 9291031 - DNA, 21 bp, Homo sapiens
gcagccagacgggattcagtt

SEQ ID NO: 9291032 - DNA, 21 bp, Homo sapiens
gcagccagccgagaccatgcc

SEQ ID NO: 9291033 - DNA, 23 bp, Homo sapiens
gcagctggttagaagggaaggag

SEQ ID NO: 9291034 - DNA, 22 bp, Homo sapiens
gcagctggttaatgggagaatt

SEQ ID NO: 9291035 - DNA, 22 bp, Homo sapiens
gcagctggtgcaaatgtcactc

SEQ ID NO: 9291036 - DNA, 22 bp, Homo sapiens
gcagctggtctggcctagagta

SEQ ID NO: 9291037 - DNA, 22 bp, Homo sapiens
gcagctggtctggcctagagta

SEQ ID NO: 9291038 - DNA, 21 bp, Homo sapiens
gcagctggtctcagagcttgc

SEQ ID NO: 9291039 - DNA, 22 bp, Homo sapiens
gcagctgggtctgtgtgggctg

SEQ ID NO: 9291040 - DNA, 22 bp, Homo sapiens
gcagctggggccacacttaggc

SEQ ID NO: 9291041 - DNA, 22 bp, Homo sapiens
gcagctgggccccagcctctcc

SEQ ID NO: 9291042 - DNA, 22 bp, Homo sapiens
gcagctgggacactgaggccag

SEQ ID NO: 9291043 - DNA, 22 bp, Homo sapiens
gcagctggggaggtcgtgggga

SEQ ID NO: 9291044 - DNA, 22 bp, Homo sapiens
gcagctggctctgggaaaaact

SEQ ID NO: 9291045 - DNA, 22 bp, Homo sapiens
gcagctggctcagagaggtggg

SEQ ID NO: 9291046 - DNA, 22 bp, Homo sapiens
gcagctggctcagagaggtggg

SEQ ID NO: 9291047 - DNA, 22 bp, Homo sapiens
gcagccaggtttgaggaccact

SEQ ID NO: 9291048 - DNA, 22 bp, Homo sapiens
gcaggccaagccctcgcagaga

SEQ ID NO: 9291049 - DNA, 22 bp, Homo sapiens
gcaggccacagtggagtctctg

SEQ ID NO: 9291050 - DNA, 22 bp, Homo sapiens
gcaggccactgtctcctctggg

SEQ ID NO: 9291051 - DNA, 22 bp, Homo sapiens
gcaggccattcaggagatgtgc

SEQ ID NO: 9291052 - DNA, 22 bp, Homo sapiens
gcaggccaggctaggggctgtc

SEQ ID NO: 9291053 - DNA, 22 bp, Homo sapiens
gcaggccagctgtgcagatggg

SEQ ID NO: 9291054 - DNA, 19 bp, Homo sapiens
gcaggccaggaggcggagg

SEQ ID NO: 9291055 - DNA, 22 bp, Homo sapiens
gcagggcagctcactgtggttc

SEQ ID NO: 9291056 - DNA, 22 bp, Homo sapiens
gcagggcagctgaagctaggtg

SEQ ID NO: 9291057 - DNA, 22 bp, Homo sapiens
gcagggcagcttagtccctgtc

SEQ ID NO: 9291058 - DNA, 22 bp, Homo sapiens
gcagggcagtaagagctagagt

SEQ ID NO: 9291059 - DNA, 22 bp, Homo sapiens
gcagggcaggatttgaacccag

SEQ ID NO: 9291060 - DNA, 22 bp, Homo sapiens
gcagggcagggcaagaactggg

SEQ ID NO: 9291061 - DNA, 22 bp, Homo sapiens
gcagggcatgggccctgtctgc

SEQ ID NO: 9291062 - DNA, 22 bp, Homo sapiens
gcaggtgaaagtgagtagtgag

SEQ ID NO: 9291063 - DNA, 22 bp, Homo sapiens
gcaggtgatgtgatgtgagcat

SEQ ID NO: 9291064 - DNA, 22 bp, Homo sapiens
gcaggtgaatgatggactagga

SEQ ID NO: 9291065 - DNA, 22 bp, Homo sapiens
gctagggaacctcttctgagga

SEQ ID NO: 9291066 - DNA, 22 bp, Homo sapiens
gctagggactagggaaggagca

SEQ ID NO: 9291067 - DNA, 19 bp, Homo sapiens
gctagggttggtggcgtgc

SEQ ID NO: 9291068 - DNA, 22 bp, Homo sapiens
gctaggctgtgtttcagaccct

SEQ ID NO: 9291069 - DNA, 22 bp, Homo sapiens
gcctggcactcaatcatctgct

SEQ ID NO: 9291070 - DNA, 22 bp, Homo sapiens
gcctggagtggtcctgctgccc

SEQ ID NO: 9291071 - DNA, 22 bp, Homo sapiens
gcctggagtgttggtatttctc

SEQ ID NO: 9291072 - DNA, 20 bp, Homo sapiens
gcctggagttagttttcctt

SEQ ID NO: 9291073 - DNA, 22 bp, Homo sapiens
gcctggagttcagccaagtccc

SEQ ID NO: 9291074 - DNA, 22 bp, Homo sapiens
gctcagtgtgcacgagtactct

SEQ ID NO: 9291075 - DNA, 22 bp, Homo sapiens
gctcagtgtggtcctcagatgt

SEQ ID NO: 9291076 - DNA, 22 bp, Homo sapiens
gctctctcttggggattcagca

SEQ ID NO: 9291077 - DNA, 22 bp, Homo sapiens
gctctctcgtgaacaggtggtt

SEQ ID NO: 9291078 - DNA, 22 bp, Homo sapiens
gctctctccctaggcaagtgag

SEQ ID NO: 9291079 - DNA, 22 bp, Homo sapiens
gctccctccatgaggcagaccg

SEQ ID NO: 9291080 - DNA, 22 bp, Homo sapiens
gctccctcatctgtgctgtttt

SEQ ID NO: 9291081 - DNA, 19 bp, Homo sapiens
gctctgtgatgctgagggg

SEQ ID NO: 9291082 - DNA, 22 bp, Homo sapiens
gctctgtggcaggaggtcttgt

SEQ ID NO: 9291083 - DNA, 22 bp, Homo sapiens
gctctgtgagccacttgatgta

SEQ ID NO: 9291084 - DNA, 22 bp, Homo sapiens
gctctgtgagtattggccctgg

SEQ ID NO: 9291085 - DNA, 22 bp, Homo sapiens
gctctgtcaacagctagctgtg

SEQ ID NO: 9291086 - DNA, 22 bp, Homo sapiens
gctctgggtagccactgcctgg

SEQ ID NO: 9291087 - DNA, 22 bp, Homo sapiens
gctctctgtcgttatgcttcat

SEQ ID NO: 9291088 - DNA, 21 bp, Homo sapiens
gctctctgcatggtggctcag

SEQ ID NO: 9291089 - DNA, 22 bp, Homo sapiens
gctgcctgaagtgtctacactg

SEQ ID NO: 9291090 - DNA, 22 bp, Homo sapiens
gctggaggggtaataggatggg

SEQ ID NO: 9291091 - DNA, 22 bp, Homo sapiens
gctggaggggtaataggatggg

SEQ ID NO: 9291092 - DNA, 22 bp, Homo sapiens
gctggaggggtaataggatggg

SEQ ID NO: 9291093 - DNA, 18 bp, Homo sapiens
gctgctggtggagggagc

SEQ ID NO: 9291094 - DNA, 18 bp, Homo sapiens
gctgctggtggagggagc

SEQ ID NO: 9291095 - DNA, 22 bp, Homo sapiens
gctggccaaagtgtacctggag

SEQ ID NO: 9291096 - DNA, 22 bp, Homo sapiens
gctggcagtttcctcaccgagg

SEQ ID NO: 9291097 - DNA, 22 bp, Homo sapiens
gctggcagtgtgaatgacaagc

SEQ ID NO: 9291098 - DNA, 22 bp, Homo sapiens
gctggcagtaaagggtttggca

SEQ ID NO: 9291099 - DNA, 22 bp, Homo sapiens
gctggcagtcccatcagctggg

SEQ ID NO: 9291100 - DNA, 22 bp, Homo sapiens
gctggcagtgtattgttagctg

SEQ ID NO: 9291101 - DNA, 22 bp, Homo sapiens
gctggcaggtccaagatagagc

SEQ ID NO: 9291102 - DNA, 22 bp, Homo sapiens
gctggcaggtaaagccccgggg

SEQ ID NO: 9291103 - DNA, 22 bp, Homo sapiens
gctggcagggttctcactgaaa

SEQ ID NO: 9291104 - DNA, 22 bp, Homo sapiens
gctggatccacaaataactttg

SEQ ID NO: 9291105 - DNA, 22 bp, Homo sapiens
gctggagttggcaaggcatgta

SEQ ID NO: 9291106 - DNA, 22 bp, Homo sapiens
gctggcagggtggttgagagag

SEQ ID NO: 9291107 - DNA, 22 bp, Homo sapiens
gctggagtcttgaaagtggact

SEQ ID NO: 9291108 - DNA, 22 bp, Homo sapiens
gctggagtgatgcctgtgtctc

SEQ ID NO: 9291109 - DNA, 22 bp, Homo sapiens
gctggagtccagtggtatgatc

SEQ ID NO: 9291110 - DNA, 22 bp, Homo sapiens
gctggagtatctggggaaggag

SEQ ID NO: 9291111 - DNA, 22 bp, Homo sapiens
gctggagtccagtggcatgatc

SEQ ID NO: 9291112 - DNA, 22 bp, Homo sapiens
gctggaggtttcacctgagttt

SEQ ID NO: 9291113 - DNA, 22 bp, Homo sapiens
gctggaggtggtgagaaaaggt

SEQ ID NO: 9291114 - DNA, 22 bp, Homo sapiens
gctgcagggagctggaaggctc

SEQ ID NO: 9291115 - DNA, 22 bp, Homo sapiens
gctgaggtttcaggagtggcag

SEQ ID NO: 9291116 - DNA, 20 bp, Homo sapiens
gctctgtggtttgagtctcc

SEQ ID NO: 9291117 - DNA, 20 bp, Homo sapiens
gctgaggggtctatggcata

SEQ ID NO: 9291118 - DNA, 22 bp, Homo sapiens
ggactgggtcactaagatagta

SEQ ID NO: 9291119 - DNA, 22 bp, Homo sapiens
ggactgggaatcagggagatgc

SEQ ID NO: 9291120 - DNA, 22 bp, Homo sapiens
ggacttgggctggtctgtttct

SEQ ID NO: 9291121 - DNA, 23 bp, Homo sapiens
ggacagggccctgccctatggcc

SEQ ID NO: 9291122 - DNA, 22 bp, Homo sapiens
ggacaggggcgtggggattgtt

SEQ ID NO: 9291123 - DNA, 22 bp, Homo sapiens
ggacagagggttgacagagtat

SEQ ID NO: 9291124 - DNA, 22 bp, Homo sapiens
ggaaggctttgtagaagtgcca

SEQ ID NO: 9291125 - DNA, 19 bp, Homo sapiens
ggaaggccacggcaggctt

SEQ ID NO: 9291126 - DNA, 22 bp, Homo sapiens
ggagctggtcagccttgagcat

SEQ ID NO: 9291127 - DNA, 22 bp, Homo sapiens
ggagctggggttggcatcttcc

SEQ ID NO: 9291128 - DNA, 21 bp, Homo sapiens
ggaggaaaaaggaatgacttg

SEQ ID NO: 9291129 - DNA, 22 bp, Homo sapiens
ggagctgggaactatgtagtat

SEQ ID NO: 9291130 - DNA, 22 bp, Homo sapiens
ggagctgggaattggatcatct

SEQ ID NO: 9291131 - DNA, 22 bp, Homo sapiens
ggagctgggaccctgtcatctg

SEQ ID NO: 9291132 - DNA, 18 bp, Homo sapiens
ggagctgggccccactcc

SEQ ID NO: 9291133 - DNA, 18 bp, Homo sapiens
ggagctgggcctggttcc

SEQ ID NO: 9291134 - DNA, 21 bp, Homo sapiens
ggagctggggagctggcccca

SEQ ID NO: 9291135 - DNA, 21 bp, Homo sapiens
ggagctgcaggagccgaaggc

SEQ ID NO: 9291136 - DNA, 20 bp, Homo sapiens
ggagctgccctgggctggag

SEQ ID NO: 9291137 - DNA, 22 bp, Homo sapiens
ggagctggctacagagaactcc

SEQ ID NO: 9291138 - DNA, 22 bp, Homo sapiens
ggagaaagtacagcaggcaaca

SEQ ID NO: 9291139 - DNA, 22 bp, Homo sapiens
ggagaagaggagctggaagcct

SEQ ID NO: 9291140 - DNA, 22 bp, Homo sapiens
gctgtcctcgtctctcacgcaa

SEQ ID NO: 9291141 - DNA, 23 bp, Homo sapiens
gctgtcctcctgggcccagcagc

SEQ ID NO: 9291142 - DNA, 23 bp, Homo sapiens
gctgtcctcctgggcccagcagc

SEQ ID NO: 9291143 - DNA, 22 bp, Homo sapiens
gctgtcctgggaacaggcacta

SEQ ID NO: 9291144 - DNA, 22 bp, Homo sapiens
gctgtgtgccaggggaaggctg

SEQ ID NO: 9291145 - DNA, 22 bp, Homo sapiens
gctgtatttattttctagggtt

SEQ ID NO: 9291146 - DNA, 22 bp, Homo sapiens
gctgtatttaacaactggctca

SEQ ID NO: 9291147 - DNA, 22 bp, Homo sapiens
gctgtattcctgcactgtatag

SEQ ID NO: 9291148 - DNA, 22 bp, Homo sapiens
gctgtcacacatggccccagct

SEQ ID NO: 9291149 - DNA, 22 bp, Homo sapiens
gctggccacactgctgatggag

SEQ ID NO: 9291150 - DNA, 22 bp, Homo sapiens
gctggccacattgtgccgtcct

SEQ ID NO: 9291151 - DNA, 22 bp, Homo sapiens
gctttatgagtgaggcaggata

SEQ ID NO: 9291152 - DNA, 22 bp, Homo sapiens
gctttatgcaaacctggtactt

SEQ ID NO: 9291153 - DNA, 22 bp, Homo sapiens
gctttatggattgtaaactgca

SEQ ID NO: 9291154 - DNA, 22 bp, Homo sapiens
gctttatgctacgatttctagt

SEQ ID NO: 9291155 - DNA, 22 bp, Homo sapiens
gctttatgggccatgcggtgtc

SEQ ID NO: 9291156 - DNA, 22 bp, Homo sapiens
gctttgtgaattattactcaca

SEQ ID NO: 9291157 - DNA, 22 bp, Homo sapiens
gcttttggccagatggggaaac

SEQ ID NO: 9291158 - DNA, 22 bp, Homo sapiens
gctttttcaaatgaaagctggt

SEQ ID NO: 9291159 - DNA, 20 bp, Homo sapiens
gctttttctaatagcagtcc

SEQ ID NO: 9291160 - DNA, 22 bp, Homo sapiens
gcttttatttcttcacaaaagt

SEQ ID NO: 9291161 - DNA, 22 bp, Homo sapiens
gcttttctccttagtgtccctg

SEQ ID NO: 9291162 - DNA, 22 bp, Homo sapiens
gcttttctccttagtgtccctg

SEQ ID NO: 9291163 - DNA, 22 bp, Homo sapiens
gcttttctataagaactttcaa

SEQ ID NO: 9291164 - DNA, 22 bp, Homo sapiens
gctgtgtgctgggcatggcact

SEQ ID NO: 9291165 - DNA, 22 bp, Homo sapiens
gctgtttaaatttaagtgtttc

SEQ ID NO: 9291166 - DNA, 22 bp, Homo sapiens
gctttaatgcaatttcacctca

SEQ ID NO: 9291167 - DNA, 22 bp, Homo sapiens
gcttggcagggcctgctggagc

SEQ ID NO: 9291168 - DNA, 22 bp, Homo sapiens
gcttggagaagatgttctcaat

SEQ ID NO: 9291169 - DNA, 22 bp, Homo sapiens
taccaaggtagtggagacagaa

SEQ ID NO: 9291170 - DNA, 22 bp, Homo sapiens
tacatgtatgtgttaatatctg

SEQ ID NO: 9291171 - DNA, 22 bp, Homo sapiens
tacagagatgtgaaaagctcta

SEQ ID NO: 9291172 - DNA, 22 bp, Homo sapiens
tacagagatactctagatcaaa

SEQ ID NO: 9291173 - DNA, 20 bp, Homo sapiens
tacagacatgacaataatgg

SEQ ID NO: 9291174 - DNA, 22 bp, Homo sapiens
taccaggcagctgcacagaggc

SEQ ID NO: 9291175 - DNA, 22 bp, Homo sapiens
tactacattaataaaacattca

SEQ ID NO: 9291176 - DNA, 22 bp, Homo sapiens
tactgtgtgcccagccgagctg

SEQ ID NO: 9291177 - DNA, 22 bp, Homo sapiens
taattcctagaaattattctca

SEQ ID NO: 9291178 - DNA, 22 bp, Homo sapiens
taatttatgatgcaaagaaaag

SEQ ID NO: 9291179 - DNA, 22 bp, Homo sapiens
taattgctccaaggagaactaa

SEQ ID NO: 9291180 - DNA, 22 bp, Homo sapiens
taatcgtatgtgtatcaaatca

SEQ ID NO: 9291181 - DNA, 22 bp, Homo sapiens
taaggagggggaatgattggca

SEQ ID NO: 9291182 - DNA, 22 bp, Homo sapiens
taaggagagaatttagaggttt

SEQ ID NO: 9291183 - DNA, 22 bp, Homo sapiens
taatataccaaactgtaatttt

SEQ ID NO: 9291184 - DNA, 22 bp, Homo sapiens
taatataccaaactgtaatttt

SEQ ID NO: 9291185 - DNA, 22 bp, Homo sapiens
taatatatacctttgttaggaa

SEQ ID NO: 9291186 - DNA, 22 bp, Homo sapiens
taatatacttcccatagtttga

SEQ ID NO: 9291187 - DNA, 22 bp, Homo sapiens
tacacaactgacaaccattctg

SEQ ID NO: 9291188 - DNA, 22 bp, Homo sapiens
tacaagaaggaaaactagcaat

SEQ ID NO: 9291189 - DNA, 22 bp, Homo sapiens
taatttatttcaactgccaagg

SEQ ID NO: 9291190 - DNA, 21 bp, Homo sapiens
taatttattcagcacagtgtt

SEQ ID NO: 9291191 - DNA, 22 bp, Homo sapiens
tacacacagaggccatgggatt

SEQ ID NO: 9291192 - DNA, 22 bp, Homo sapiens
tacacacatgcatttgccttat

SEQ ID NO: 9291193 - DNA, 22 bp, Homo sapiens
tacacacttactggagatgaag

SEQ ID NO: 9291194 - DNA, 22 bp, Homo sapiens
tacacataggagggtaataaaa

SEQ ID NO: 9291195 - DNA, 22 bp, Homo sapiens
tacacataggtctgaataaaaa

SEQ ID NO: 9291196 - DNA, 22 bp, Homo sapiens
tacagacaaagagcatgcggta

SEQ ID NO: 9291197 - DNA, 22 bp, Homo sapiens
tacagacagacttcccaccctc

SEQ ID NO: 9291198 - DNA, 22 bp, Homo sapiens
tacagacaaagtgctatagggt

SEQ ID NO: 9291199 - DNA, 22 bp, Homo sapiens
tacagacagtttttcagatatt

SEQ ID NO: 9291200 - DNA, 22 bp, Homo sapiens
taacatctttagcagctcgaac

SEQ ID NO: 9291201 - DNA, 22 bp, Homo sapiens
taaatgtggagactcaggagtc

SEQ ID NO: 9291202 - DNA, 22 bp, Homo sapiens
taagacaattcttcagtcacaa

SEQ ID NO: 9291203 - DNA, 22 bp, Homo sapiens
taagacaattcttcagtcacaa

SEQ ID NO: 9291204 - DNA, 22 bp, Homo sapiens
taagacaagcctcgcatttgta

SEQ ID NO: 9291205 - DNA, 22 bp, Homo sapiens
taagacaaatactatttcaaga

SEQ ID NO: 9291206 - DNA, 22 bp, Homo sapiens
taagacatgtccaggctgtgag

SEQ ID NO: 9291207 - DNA, 22 bp, Homo sapiens
taaaacttctcatttttatggt

SEQ ID NO: 9291208 - DNA, 22 bp, Homo sapiens
taaaaggattagcaggatgggc

SEQ ID NO: 9291209 - DNA, 22 bp, Homo sapiens
taaaaggaggttgaagctgtca

SEQ ID NO: 9291210 - DNA, 22 bp, Homo sapiens
taaaagtaggaatgaaacgcat

SEQ ID NO: 9291211 - DNA, 22 bp, Homo sapiens
taaagcaaggcaaattgttggt

SEQ ID NO: 9291212 - DNA, 17 bp, Homo sapiens
gtgctggcctggggctc

SEQ ID NO: 9291213 - DNA, 22 bp, Homo sapiens
gtgctggctgccaggaggctgc

SEQ ID NO: 9291214 - DNA, 22 bp, Homo sapiens
gttctgcttaaattattgatcc

SEQ ID NO: 9291215 - DNA, 22 bp, Homo sapiens
gttctgctgtgtctcagcaggt

SEQ ID NO: 9291216 - DNA, 22 bp, Homo sapiens
gttcttccctttggggattgtg

SEQ ID NO: 9291217 - DNA, 22 bp, Homo sapiens
gttatataagacaaatcagagt

SEQ ID NO: 9291218 - DNA, 22 bp, Homo sapiens
gttcttcctcattgctttgaag

SEQ ID NO: 9291219 - DNA, 21 bp, Homo sapiens
gttcttcctgactagagtagt

SEQ ID NO: 9291220 - DNA, 22 bp, Homo sapiens
gttcttcctggaagtggatttc

SEQ ID NO: 9291221 - DNA, 22 bp, Homo sapiens
gttgaaatcctaaccccctagt

SEQ ID NO: 9291222 - DNA, 22 bp, Homo sapiens
gtttattagagttttctgtctg

SEQ ID NO: 9291223 - DNA, 22 bp, Homo sapiens
gtttatgaggaaaagttatgat

SEQ ID NO: 9291224 - DNA, 22 bp, Homo sapiens
gtttatgaatgtgtcagacata

SEQ ID NO: 9291225 - DNA, 22 bp, Homo sapiens
gtttatgaatgttactatagag

SEQ ID NO: 9291226 - DNA, 22 bp, Homo sapiens
gtttcttaggtaaattctttga

SEQ ID NO: 9291227 - DNA, 21 bp, Homo sapiens
gttttaagggagaaaacctag

SEQ ID NO: 9291228 - DNA, 22 bp, Homo sapiens
tagcaaaggccttggacacgct

SEQ ID NO: 9291229 - DNA, 23 bp, Homo sapiens
tagcaaagttgtttgggaaattt

SEQ ID NO: 9291230 - DNA, 22 bp, Homo sapiens
tagcaaagttttgtggtgatta

SEQ ID NO: 9291231 - DNA, 22 bp, Homo sapiens
tagcaaagaagatattattgca

SEQ ID NO: 9291232 - DNA, 22 bp, Homo sapiens
tagcaaagaacctgatacccca

SEQ ID NO: 9291233 - DNA, 18 bp, Homo sapiens
tagcaaagatgtggattg

SEQ ID NO: 9291234 - DNA, 22 bp, Homo sapiens
tagctgggaattatctggttgc

SEQ ID NO: 9291235 - DNA, 22 bp, Homo sapiens
tagactggtgaattagggggaa

SEQ ID NO: 9291236 - DNA, 22 bp, Homo sapiens
tagacaggaaacattaggatgg

SEQ ID NO: 9291237 - DNA, 22 bp, Homo sapiens
tagaagaaagtgaagctgggga

SEQ ID NO: 9291238 - DNA, 22 bp, Homo sapiens
tagaagattcatttcctctgaa

SEQ ID NO: 9291239 - DNA, 21 bp, Homo sapiens
tagatactgtattaaacctag

SEQ ID NO: 9291240 - DNA, 22 bp, Homo sapiens
tagatataaggtccttagaaca

SEQ ID NO: 9291241 - DNA, 22 bp, Homo sapiens
tagatataggacagtactgtat

SEQ ID NO: 9291242 - DNA, 22 bp, Homo sapiens
tagagagagctgtggtggctct

SEQ ID NO: 9291243 - DNA, 22 bp, Homo sapiens
tagagtatagctaactgtatta

SEQ ID NO: 9291244 - DNA, 21 bp, Homo sapiens
tagagaaaagaagctgttcct

SEQ ID NO: 9291245 - DNA, 22 bp, Homo sapiens
tagagaaataagctttgccttg

SEQ ID NO: 9291246 - DNA, 22 bp, Homo sapiens
tagagaaaagcagggatcagga

SEQ ID NO: 9291247 - DNA, 22 bp, Homo sapiens
tagtttatgctgctgcagtgag

SEQ ID NO: 9291248 - DNA, 22 bp, Homo sapiens
tagtttatagttagcgagcacg

SEQ ID NO: 9291249 - DNA, 22 bp, Homo sapiens
tagtttatgattttttggaagg

SEQ ID NO: 9291250 - DNA, 22 bp, Homo sapiens
tagtttctaaagcttcctaggt

SEQ ID NO: 9291251 - DNA, 22 bp, Homo sapiens
tagttaggaatagcagcgactc

SEQ ID NO: 9291252 - DNA, 22 bp, Homo sapiens
tagttaggggaaaaacgacagg

SEQ ID NO: 9291253 - DNA, 22 bp, Homo sapiens
tagtttactcatctataaaatg

SEQ ID NO: 9291254 - DNA, 19 bp, Homo sapiens
tagtctctgatgaggcttt

SEQ ID NO: 9291255 - DNA, 22 bp, Homo sapiens
tagtctctgtggtcctgaggaa

SEQ ID NO: 9291256 - DNA, 22 bp, Homo sapiens
tagtctctggagactctagggg

SEQ ID NO: 9291257 - DNA, 23 bp, Homo sapiens
taggggctggcgtggagcctgcg

SEQ ID NO: 9291258 - DNA, 23 bp, Homo sapiens
tagggcagctgggagggacatgc

SEQ ID NO: 9291259 - DNA, 22 bp, Homo sapiens
tagggcagccttatagctccca

SEQ ID NO: 9291260 - DNA, 22 bp, Homo sapiens
tagggcagctgcatcaggcact

SEQ ID NO: 9291261 - DNA, 23 bp, Homo sapiens
tagggcagctgggagggacatgc

SEQ ID NO: 9291262 - DNA, 23 bp, Homo sapiens
tagggcagctgggagggacatgc

SEQ ID NO: 9291263 - DNA, 22 bp, Homo sapiens
tagggcagattcggtggagttt

SEQ ID NO: 9291264 - DNA, 22 bp, Homo sapiens
tagggcagattcggtggagttt

SEQ ID NO: 9291265 - DNA, 22 bp, Homo sapiens
tagggcagccacccaggctgct

SEQ ID NO: 9291266 - DNA, 22 bp, Homo sapiens
tagggcagagtccaggatgggc

SEQ ID NO: 9291267 - DNA, 22 bp, Homo sapiens
tagggcagagtccaggatgggc

SEQ ID NO: 9291268 - DNA, 22 bp, Homo sapiens
tagggcagagtccaggatgggc

SEQ ID NO: 9291269 - DNA, 22 bp, Homo sapiens
tagggctgtggtcagtcctcta

SEQ ID NO: 9291270 - DNA, 22 bp, Homo sapiens
tagggctggcgtgctcagggaa

SEQ ID NO: 9291271 - DNA, 22 bp, Homo sapiens
tagctgggttgaggtcatctac

SEQ ID NO: 9291272 - DNA, 22 bp, Homo sapiens
tagctgggtctctgttttctca

SEQ ID NO: 9291273 - DNA, 22 bp, Homo sapiens
tagctgggagtgtctgatgggt

SEQ ID NO: 9291274 - DNA, 22 bp, Homo sapiens
tagctggggctttcattcttgc

SEQ ID NO: 9291275 - DNA, 22 bp, Homo sapiens
tagctgggactactggccctgc

SEQ ID NO: 9291276 - DNA, 22 bp, Homo sapiens
taggccagattactagagtagg

SEQ ID NO: 9291277 - DNA, 22 bp, Homo sapiens
taggccagcccttagtcctgtc

SEQ ID NO: 9291278 - DNA, 22 bp, Homo sapiens
taggccaggaatcagcaagctt

SEQ ID NO: 9291279 - DNA, 22 bp, Homo sapiens
taggccagtaaaatgtttcagt

SEQ ID NO: 9291280 - DNA, 23 bp, Homo sapiens
taggccagggtgacctggggaga

SEQ ID NO: 9291281 - DNA, 22 bp, Homo sapiens
taggccaggagtcagacagatt

SEQ ID NO: 9291282 - DNA, 22 bp, Homo sapiens
tatgtaaagtagatggcaggta

SEQ ID NO: 9291283 - DNA, 20 bp, Homo sapiens
tatgaagatatgtgaacagc

SEQ ID NO: 9291284 - DNA, 22 bp, Homo sapiens
tatgaagctctcactgtgtgtc

SEQ ID NO: 9291285 - DNA, 18 bp, Homo sapiens
tatcttttccagtggtat

SEQ ID NO: 9291286 - DNA, 22 bp, Homo sapiens
tatcacagccttttggtgaggg

SEQ ID NO: 9291287 - DNA, 22 bp, Homo sapiens
tataaactatatgttagccaga

SEQ ID NO: 9291288 - DNA, 22 bp, Homo sapiens
tataaactttaaccaggatgtc

SEQ ID NO: 9291289 - DNA, 22 bp, Homo sapiens
tatttgatgaaggtaaagtctt

SEQ ID NO: 9291290 - DNA, 22 bp, Homo sapiens
tatttgaaggcatacattttga

SEQ ID NO: 9291291 - DNA, 22 bp, Homo sapiens
tatttgaagggagaaagtgcca

SEQ ID NO: 9291292 - DNA, 22 bp, Homo sapiens
tatttcttgttattctcgttga

SEQ ID NO: 9291293 - DNA, 22 bp, Homo sapiens
tattttctggacagtcttgctt

SEQ ID NO: 9291294 - DNA, 22 bp, Homo sapiens
tattgtatcttctgtttagaag

SEQ ID NO: 9291295 - DNA, 22 bp, Homo sapiens
tattgtgagttcagactaaaaa

SEQ ID NO: 9291296 - DNA, 22 bp, Homo sapiens
tattgtgaagggaaaaatagtg

SEQ ID NO: 9291297 - DNA, 22 bp, Homo sapiens
tcaaatgaagacagttgacttg

SEQ ID NO: 9291298 - DNA, 22 bp, Homo sapiens
tcaaataccagcaatttcatgt

SEQ ID NO: 9291299 - DNA, 22 bp, Homo sapiens
tcaaagtaaaagtatagagttt

SEQ ID NO: 9291300 - DNA, 19 bp, Homo sapiens
tcaaaggcttttaggagac

SEQ ID NO: 9291301 - DNA, 22 bp, Homo sapiens
tcaaagtaggggtaagccaggc

SEQ ID NO: 9291302 - DNA, 22 bp, Homo sapiens
tcaaagtaccagagtgaactga

SEQ ID NO: 9291303 - DNA, 22 bp, Homo sapiens
tattttgcgttgagtcagattt

SEQ ID NO: 9291304 - DNA, 20 bp, Homo sapiens
tattttgcaattatggttca

SEQ ID NO: 9291305 - DNA, 22 bp, Homo sapiens
tattttgtaattggtcatagct

SEQ ID NO: 9291306 - DNA, 22 bp, Homo sapiens
tattttgcaaacctgagtttga

SEQ ID NO: 9291307 - DNA, 22 bp, Homo sapiens
tcaaagaagtgcaaacctcatc

SEQ ID NO: 9291308 - DNA, 22 bp, Homo sapiens
tcatttctattgctactgtctg

SEQ ID NO: 9291309 - DNA, 22 bp, Homo sapiens
tcatttatcatttgtgctgtag

SEQ ID NO: 9291310 - DNA, 22 bp, Homo sapiens
tcatttatattgtattctgtag

SEQ ID NO: 9291311 - DNA, 22 bp, Homo sapiens
tcatttctcccggccaaaaact

SEQ ID NO: 9291312 - DNA, 22 bp, Homo sapiens
tcatttctctgagtctgataat

SEQ ID NO: 9291313 - DNA, 22 bp, Homo sapiens
tcatttctgttgtgcatcactg

SEQ ID NO: 9291314 - DNA, 22 bp, Homo sapiens
tcatttctgagccttccatgat

SEQ ID NO: 9291315 - DNA, 22 bp, Homo sapiens
tcatttatagaagtgggcagta

SEQ ID NO: 9291316 - DNA, 22 bp, Homo sapiens
tcatttataaggatgcaattaa

SEQ ID NO: 9291317 - DNA, 22 bp, Homo sapiens
tcatttatagctaaccttgaat

SEQ ID NO: 9291318 - DNA, 22 bp, Homo sapiens
tcatttactgtaggagtgaacc

SEQ ID NO: 9291319 - DNA, 19 bp, Homo sapiens
tcatttactttctgggtga

SEQ ID NO: 9291320 - DNA, 22 bp, Homo sapiens
tccaaggctccggccctggcgt

SEQ ID NO: 9291321 - DNA, 22 bp, Homo sapiens
tccaatcatgagtctatactag

SEQ ID NO: 9291322 - DNA, 23 bp, Homo sapiens
tccaattcaattgggtcaggaag

SEQ ID NO: 9291323 - DNA, 22 bp, Homo sapiens
tccaaggagcagatccagagga

SEQ ID NO: 9291324 - DNA, 22 bp, Homo sapiens
tccaaggactcttgtcagctgt

SEQ ID NO: 9291325 - DNA, 22 bp, Homo sapiens
tccaaggaggagctggagattg

SEQ ID NO: 9291326 - DNA, 22 bp, Homo sapiens
tcatttgttcatctgctcttct

SEQ ID NO: 9291327 - DNA, 21 bp, Homo sapiens
tcatttttattgctaccttgc

SEQ ID NO: 9291328 - DNA, 22 bp, Homo sapiens
tcatctttaccccttgcttcaa

SEQ ID NO: 9291329 - DNA, 22 bp, Homo sapiens
tcatcttctattaatagggaga

SEQ ID NO: 9291330 - DNA, 22 bp, Homo sapiens
tcatcttctattaatagggaga

SEQ ID NO: 9291331 - DNA, 23 bp, Homo sapiens
tcataaatattagcacagtagga

SEQ ID NO: 9291332 - DNA, 22 bp, Homo sapiens
tcagtctccatctgcttgtctt

SEQ ID NO: 9291333 - DNA, 22 bp, Homo sapiens
tcaggcttccaggctctgctga

SEQ ID NO: 9291334 - DNA, 22 bp, Homo sapiens
tcaggcttttcctgcctcctac

SEQ ID NO: 9291335 - DNA, 22 bp, Homo sapiens
tcagggcaggacagtgtaggcc

SEQ ID NO: 9291336 - DNA, 22 bp, Homo sapiens
tcagggcaggcgagcagctgct

SEQ ID NO: 9291337 - DNA, 22 bp, Homo sapiens
tcagggcaggttaacttgggtg

SEQ ID NO: 9291338 - DNA, 21 bp, Homo sapiens
tcagggcagtgggaggttcct

SEQ ID NO: 9291339 - DNA, 19 bp, Homo sapiens
tcagggcagtccggtcccc

SEQ ID NO: 9291340 - DNA, 17 bp, Homo sapiens
tcaggctgggtgcagtg

SEQ ID NO: 9291341 - DNA, 22 bp, Homo sapiens
tcaggctggtggtcagatggct

SEQ ID NO: 9291342 - DNA, 22 bp, Homo sapiens
tcagggcatccattgcctgttg

SEQ ID NO: 9291343 - DNA, 22 bp, Homo sapiens
tcagggcatctcttaagtggtg

SEQ ID NO: 9291344 - DNA, 22 bp, Homo sapiens
tcagggcatcatcatgaatata

SEQ ID NO: 9291345 - DNA, 22 bp, Homo sapiens
tcagggcatactcttcaaggtc

SEQ ID NO: 9291346 - DNA, 22 bp, Homo sapiens
tcaacagacatttttaagcact

SEQ ID NO: 9291347 - DNA, 22 bp, Homo sapiens
tcaacatataggcaacctgtaa

SEQ ID NO: 9291348 - DNA, 22 bp, Homo sapiens
tcaacaataggatatagcaggt

SEQ ID NO: 9291349 - DNA, 22 bp, Homo sapiens
tcaaatgaggctgatgaatgtg

SEQ ID NO: 9291350 - DNA, 22 bp, Homo sapiens
tcaaatgagtgactcacacagg

SEQ ID NO: 9291351 - DNA, 22 bp, Homo sapiens
tcaacaatgggtctgtaatgga

SEQ ID NO: 9291352 - DNA, 22 bp, Homo sapiens
tcaagaaactgtgctacagagt

SEQ ID NO: 9291353 - DNA, 22 bp, Homo sapiens
tcacatactgaaagtccagtga

SEQ ID NO: 9291354 - DNA, 22 bp, Homo sapiens
tcacatttctttatgtagtctt

SEQ ID NO: 9291355 - DNA, 22 bp, Homo sapiens
tcacatacactaggatattttt

SEQ ID NO: 9291356 - DNA, 23 bp, Homo sapiens
tcacataatccttcatccacagg

SEQ ID NO: 9291357 - DNA, 22 bp, Homo sapiens
tcacataaattatacaatttca

SEQ ID NO: 9291358 - DNA, 22 bp, Homo sapiens
tcacataaatttaccagatgat

SEQ ID NO: 9291359 - DNA, 18 bp, Homo sapiens
tcacagtgctcttgccta

SEQ ID NO: 9291360 - DNA, 22 bp, Homo sapiens
tcactgccattagttggttaat

SEQ ID NO: 9291361 - DNA, 22 bp, Homo sapiens
tcactgcaacctccacctcctg

SEQ ID NO: 9291362 - DNA, 22 bp, Homo sapiens
tcactgcaacctccacctcctg

SEQ ID NO: 9291363 - DNA, 22 bp, Homo sapiens
tcactgcaacctccacctcctg

SEQ ID NO: 9291364 - DNA, 22 bp, Homo sapiens
tcactgcaacctccacctcccg

SEQ ID NO: 9291365 - DNA, 22 bp, Homo sapiens
tcactgcaacctccacctcccg

SEQ ID NO: 9291366 - DNA, 22 bp, Homo sapiens
tcactgcaacctccacctcctg

SEQ ID NO: 9291367 - DNA, 22 bp, Homo sapiens
tcacatttgtgttttattagag

SEQ ID NO: 9291368 - DNA, 22 bp, Homo sapiens
tcacattttatctattttaagt

SEQ ID NO: 9291369 - DNA, 22 bp, Homo sapiens
tcactgcaacctccacctcccg

SEQ ID NO: 9291370 - DNA, 22 bp, Homo sapiens
tcactgcaacctccacctcccg

SEQ ID NO: 9291371 - DNA, 22 bp, Homo sapiens
tcagaaagaacacaggcagtag

SEQ ID NO: 9291372 - DNA, 22 bp, Homo sapiens
tcagaagccggaagtgctcctc

SEQ ID NO: 9291373 - DNA, 22 bp, Homo sapiens
tcagctgctcaaatttatgtca

SEQ ID NO: 9291374 - DNA, 22 bp, Homo sapiens
tcagctgcgacaggggcctgag

SEQ ID NO: 9291375 - DNA, 22 bp, Homo sapiens
tcagctgctctgttgagctgaa

SEQ ID NO: 9291376 - DNA, 22 bp, Homo sapiens
tcagctgccccgggcactgccc

SEQ ID NO: 9291377 - DNA, 22 bp, Homo sapiens
tcagcattcctgaagacaagca

SEQ ID NO: 9291378 - DNA, 22 bp, Homo sapiens
tcagcattttttgggtgtaact

SEQ ID NO: 9291379 - DNA, 22 bp, Homo sapiens
tcagcattgtggcagagaatgg

SEQ ID NO: 9291380 - DNA, 22 bp, Homo sapiens
tcagcatttcagaagtggcata

SEQ ID NO: 9291381 - DNA, 18 bp, Homo sapiens
tcagctgggtttctgggt

SEQ ID NO: 9291382 - DNA, 22 bp, Homo sapiens
tcagctgggtgagtgttctgca

SEQ ID NO: 9291383 - DNA, 22 bp, Homo sapiens
tcagctggtgaatggactcatc

SEQ ID NO: 9291384 - DNA, 22 bp, Homo sapiens
tcagctggtgccactcagtcaa

SEQ ID NO: 9291385 - DNA, 22 bp, Homo sapiens
tcagctggtgagtggatagaca

SEQ ID NO: 9291386 - DNA, 22 bp, Homo sapiens
tcagctggtgtttcttctcctt

SEQ ID NO: 9291387 - DNA, 18 bp, Homo sapiens
tcagctggggctgcagcc

SEQ ID NO: 9291388 - DNA, 22 bp, Homo sapiens
tcagctggggccccctctgtcc

SEQ ID NO: 9291389 - DNA, 22 bp, Homo sapiens
tcagctgggaagttctcgcttg

SEQ ID NO: 9291390 - DNA, 22 bp, Homo sapiens
tcagctggcagttcagaggctg

SEQ ID NO: 9291391 - DNA, 22 bp, Homo sapiens
tcagctggcatcggctcaccca

SEQ ID NO: 9291392 - DNA, 22 bp, Homo sapiens
tcagctggcaggttctgggaag

SEQ ID NO: 9291393 - DNA, 22 bp, Homo sapiens
tcagctggagatgagaaccgaa

SEQ ID NO: 9291394 - DNA, 22 bp, Homo sapiens
tcagctggagatccttgttgtg

SEQ ID NO: 9291395 - DNA, 19 bp, Homo sapiens
tcagctggcaggcctcctc

SEQ ID NO: 9291396 - DNA, 22 bp, Homo sapiens
tcagctggatgtggaagtgcta

SEQ ID NO: 9291397 - DNA, 22 bp, Homo sapiens
tcagctggaagatggtgcagaa

SEQ ID NO: 9291398 - DNA, 22 bp, Homo sapiens
tcagctggagactgctcaatga

SEQ ID NO: 9291399 - DNA, 19 bp, Homo sapiens
tcagaattctgtctcttga

SEQ ID NO: 9291400 - DNA, 23 bp, Homo sapiens
tcagaattccagtttctttgaag

SEQ ID NO: 9291401 - DNA, 22 bp, Homo sapiens
tcagaattaagctcttggtcag

SEQ ID NO: 9291402 - DNA, 22 bp, Homo sapiens
tcagaattagagctcttcttga

SEQ ID NO: 9291403 - DNA, 22 bp, Homo sapiens
tcagaattggaacgtgaagatt

SEQ ID NO: 9291404 - DNA, 22 bp, Homo sapiens
tcagaattggacaatagaagca

SEQ ID NO: 9291405 - DNA, 22 bp, Homo sapiens
tcagaattgtggagaaagggga

SEQ ID NO: 9291406 - DNA, 22 bp, Homo sapiens
tcagacagagaagtacaatgag

SEQ ID NO: 9291407 - DNA, 22 bp, Homo sapiens
tcagacagaaagatgagtatgg

SEQ ID NO: 9291408 - DNA, 22 bp, Homo sapiens
tcagacagaaggactatttgaa

SEQ ID NO: 9291409 - DNA, 22 bp, Homo sapiens
tcagacagaggagctcgtgcag

SEQ ID NO: 9291410 - DNA, 18 bp, Homo sapiens
tcagatttaactgtatcc

SEQ ID NO: 9291411 - DNA, 22 bp, Homo sapiens
tccctctgtgttgggcatgcct

SEQ ID NO: 9291412 - DNA, 20 bp, Homo sapiens
tccctccctccagctctggg

SEQ ID NO: 9291413 - DNA, 20 bp, Homo sapiens
tccctccctccagctctggg

SEQ ID NO: 9291414 - DNA, 22 bp, Homo sapiens
tccctccccacttctgagcttt

SEQ ID NO: 9291415 - DNA, 22 bp, Homo sapiens
tcctcagcatggaatctggact

SEQ ID NO: 9291416 - DNA, 22 bp, Homo sapiens
tcctcaggtcaaagcaggagaa

SEQ ID NO: 9291417 - DNA, 22 bp, Homo sapiens
tcctagagcctccagagggaga

SEQ ID NO: 9291418 - DNA, 20 bp, Homo sapiens
tcctagcttctctctgtaca

SEQ ID NO: 9291419 - DNA, 22 bp, Homo sapiens
tcctagcttgtcagttctctaa

SEQ ID NO: 9291420 - DNA, 22 bp, Homo sapiens
tcctagctggcctctcaccagc

SEQ ID NO: 9291421 - DNA, 23 bp, Homo sapiens
tccctggaggcaggtccagggcc

SEQ ID NO: 9291422 - DNA, 22 bp, Homo sapiens
tccctggagataacttctggga

SEQ ID NO: 9291423 - DNA, 22 bp, Homo sapiens
tccctgcctcctggcagtgcca

SEQ ID NO: 9291424 - DNA, 22 bp, Homo sapiens
tccaggctaggtttacaggaca

SEQ ID NO: 9291425 - DNA, 22 bp, Homo sapiens
tccaggctggacatgaggcggg

SEQ ID NO: 9291426 - DNA, 22 bp, Homo sapiens
tccaggctggctcttcaaaatt

SEQ ID NO: 9291427 - DNA, 22 bp, Homo sapiens
tccaggctaattttgcattgtt

SEQ ID NO: 9291428 - DNA, 22 bp, Homo sapiens
tccaggctttttcatgctgtct

SEQ ID NO: 9291429 - DNA, 22 bp, Homo sapiens
tcccaaagtattagcatttcaa

SEQ ID NO: 9291430 - DNA, 22 bp, Homo sapiens
tcccagccttatctcccctggc

SEQ ID NO: 9291431 - DNA, 22 bp, Homo sapiens
tcccagcctggaccctgccagt

SEQ ID NO: 9291432 - DNA, 22 bp, Homo sapiens
tcccagccttccagtctggttt

SEQ ID NO: 9291433 - DNA, 22 bp, Homo sapiens
tcctgaaatgtgcacatgacat

SEQ ID NO: 9291434 - DNA, 19 bp, Homo sapiens
tcctgaaaacttctggaat

SEQ ID NO: 9291435 - DNA, 19 bp, Homo sapiens
tcctgaagatttcctcagc

SEQ ID NO: 9291436 - DNA, 22 bp, Homo sapiens
tcctcttcaaaaggatttcctt

SEQ ID NO: 9291437 - DNA, 22 bp, Homo sapiens
tcctctggttatacttgcaccc

SEQ ID NO: 9291438 - DNA, 22 bp, Homo sapiens
tcctcttcaaaatagctctgaa

SEQ ID NO: 9291439 - DNA, 22 bp, Homo sapiens
tcctcttcagagggacctcggg

SEQ ID NO: 9291440 - DNA, 22 bp, Homo sapiens
tcctcttctgtggattccctga

SEQ ID NO: 9291441 - DNA, 22 bp, Homo sapiens
tcctcttctgcccatcagaggc

SEQ ID NO: 9291442 - DNA, 22 bp, Homo sapiens
tcctcttctgcccatcagaggc

SEQ ID NO: 9291443 - DNA, 22 bp, Homo sapiens
tcctcttctgcctatatctgcc

SEQ ID NO: 9291444 - DNA, 22 bp, Homo sapiens
tcctctggggcgtggtcctgga

SEQ ID NO: 9291445 - DNA, 22 bp, Homo sapiens
tcctctggtcctgcagcagatc

SEQ ID NO: 9291446 - DNA, 22 bp, Homo sapiens
tcctctggtcttcggtgtggac

SEQ ID NO: 9291447 - DNA, 22 bp, Homo sapiens
tcctgagcaacacagctaagtg

SEQ ID NO: 9291448 - DNA, 22 bp, Homo sapiens
tcctgagcacagagacaaggaa

SEQ ID NO: 9291449 - DNA, 22 bp, Homo sapiens
tcctgagcctgacaatcaccat

SEQ ID NO: 9291450 - DNA, 22 bp, Homo sapiens
tcctgagccctgtaggaccctg

SEQ ID NO: 9291451 - DNA, 22 bp, Homo sapiens
tcctgagtgagagctgggaggt

SEQ ID NO: 9291452 - DNA, 22 bp, Homo sapiens
tcctgagctgccgcatcagcag

SEQ ID NO: 9291453 - DNA, 22 bp, Homo sapiens
tcctgagctacagtagtatgat

SEQ ID NO: 9291454 - DNA, 22 bp, Homo sapiens
tcctgcagacatttacaccttt

SEQ ID NO: 9291455 - DNA, 22 bp, Homo sapiens
tcctgcagcatccgtcgtctgt

SEQ ID NO: 9291456 - DNA, 22 bp, Homo sapiens
tcctgcagccactgcaggcaga

SEQ ID NO: 9291457 - DNA, 22 bp, Homo sapiens
tcctgcagccttgggctggagc

SEQ ID NO: 9291458 - DNA, 22 bp, Homo sapiens
tcctgcctctccatgctaacta

SEQ ID NO: 9291459 - DNA, 22 bp, Homo sapiens
tcctgcctcaggctctggagta

SEQ ID NO: 9291460 - DNA, 22 bp, Homo sapiens
tcctgcctcacagttgaagttt

SEQ ID NO: 9291461 - DNA, 22 bp, Homo sapiens
tcctgcctaccttgcggaggtg

SEQ ID NO: 9291462 - DNA, 22 bp, Homo sapiens
tcctgcctagcaggtgacctat

SEQ ID NO: 9291463 - DNA, 22 bp, Homo sapiens
tcctgcctgagcgtggaggagg

SEQ ID NO: 9291464 - DNA, 22 bp, Homo sapiens
tcctgcctgcaatcccagcact

SEQ ID NO: 9291465 - DNA, 22 bp, Homo sapiens
tcctgcctcttttcttattcca

SEQ ID NO: 9291466 - DNA, 22 bp, Homo sapiens
tcctgcctcttgccttcttcac

SEQ ID NO: 9291467 - DNA, 19 bp, Homo sapiens
gaatgggaatgggaaagct

SEQ ID NO: 9291468 - DNA, 22 bp, Homo sapiens
gaatgtaagtgggcagaagaca

SEQ ID NO: 9291469 - DNA, 21 bp, Homo sapiens
gaagacaaatgggaatagctg

SEQ ID NO: 9291470 - DNA, 18 bp, Homo sapiens
gacaaaagtacagacaga

SEQ ID NO: 9291471 - DNA, 22 bp, Homo sapiens
gacaaaagtgttttgaacaagg

SEQ ID NO: 9291472 - DNA, 22 bp, Homo sapiens
gacaaatgaagtcactgacctt

SEQ ID NO: 9291473 - DNA, 22 bp, Homo sapiens
gacaaatgaatgatgaacacca

SEQ ID NO: 9291474 - DNA, 22 bp, Homo sapiens
gacaaatgagtctcatacccgg

SEQ ID NO: 9291475 - DNA, 22 bp, Homo sapiens
gacagcagcatgtttacaggcc

SEQ ID NO: 9291476 - DNA, 22 bp, Homo sapiens
gacatgtgtctgcaagttgatc

SEQ ID NO: 9291477 - DNA, 22 bp, Homo sapiens
gacatgtgctgtctcttaaatt

SEQ ID NO: 9291478 - DNA, 22 bp, Homo sapiens
gacatgtgagcaagcgtgcggc

SEQ ID NO: 9291479 - DNA, 22 bp, Homo sapiens
gacctgcctgagctgcctctgc

SEQ ID NO: 9291480 - DNA, 22 bp, Homo sapiens
gacatggatacttgataagggg

SEQ ID NO: 9291481 - DNA, 22 bp, Homo sapiens
gacatgtgagagctcggttttc

SEQ ID NO: 9291482 - DNA, 22 bp, Homo sapiens
gacagctgaaaaatgtaaggta

SEQ ID NO: 9291483 - DNA, 22 bp, Homo sapiens
gacagctggcagtggaaaggtg

SEQ ID NO: 9291484 - DNA, 22 bp, Homo sapiens
gacagctgaacaggtgggataa

SEQ ID NO: 9291485 - DNA, 22 bp, Homo sapiens
gacagctgcctctgtgtagatc

SEQ ID NO: 9291486 - DNA, 22 bp, Homo sapiens
gacagcagtttttctctagggt

SEQ ID NO: 9291487 - DNA, 22 bp, Homo sapiens
gacagctgggaggatgacataa

SEQ ID NO: 9291488 - DNA, 22 bp, Homo sapiens
gacatctgaggccctcagagcc

SEQ ID NO: 9291489 - DNA, 22 bp, Homo sapiens
gagcacctgctaaatgacagtt

SEQ ID NO: 9291490 - DNA, 22 bp, Homo sapiens
gagcacagtaaagcagtgtcac

SEQ ID NO: 9291491 - DNA, 22 bp, Homo sapiens
gagcacagtgcagtttctgcta

SEQ ID NO: 9291492 - DNA, 22 bp, Homo sapiens
gagcacccttgagagactctcg

SEQ ID NO: 9291493 - DNA, 22 bp, Homo sapiens
gagcaccctttgcacatcagtc

SEQ ID NO: 9291494 - DNA, 22 bp, Homo sapiens
gagcaccctacctgccactgag

SEQ ID NO: 9291495 - DNA, 22 bp, Homo sapiens
gagcacccgtcggtggtaggaa

SEQ ID NO: 9291496 - DNA, 22 bp, Homo sapiens
gagcacccatgcagagggaaca

SEQ ID NO: 9291497 - DNA, 22 bp, Homo sapiens
gagcacagatcctggagccaca

SEQ ID NO: 9291498 - DNA, 22 bp, Homo sapiens
gagcaaagcttttagggccttt

SEQ ID NO: 9291499 - DNA, 22 bp, Homo sapiens
gagcaacagtttatggtttttc

SEQ ID NO: 9291500 - DNA, 22 bp, Homo sapiens
gagaagccgagtcagctgagcc

SEQ ID NO: 9291501 - DNA, 22 bp, Homo sapiens
gagagaagaaagccatggtcct

SEQ ID NO: 9291502 - DNA, 22 bp, Homo sapiens
gagagaagggggatatgagcct

SEQ ID NO: 9291503 - DNA, 22 bp, Homo sapiens
gagagaagaatgttccgaggcc

SEQ ID NO: 9291504 - DNA, 22 bp, Homo sapiens
gagaacaggctctggagtcaga

SEQ ID NO: 9291505 - DNA, 19 bp, Homo sapiens
gactccaactttaagcatg

SEQ ID NO: 9291506 - DNA, 22 bp, Homo sapiens
gagaacagtgttgtattttttc

SEQ ID NO: 9291507 - DNA, 22 bp, Homo sapiens
gagaacctctccacaagtctgg

SEQ ID NO: 9291508 - DNA, 22 bp, Homo sapiens
gagagacagcacacagtgtggg

SEQ ID NO: 9291509 - DNA, 22 bp, Homo sapiens
gagagactgatgtggctatgta

SEQ ID NO: 9291510 - DNA, 22 bp, Homo sapiens
gagagactgggcagggccggca

SEQ ID NO: 9291511 - DNA, 22 bp, Homo sapiens
gagagactggaatgggctgtgg

SEQ ID NO: 9291512 - DNA, 18 bp, Homo sapiens
gagagcccagcaggtggt

SEQ ID NO: 9291513 - DNA, 22 bp, Homo sapiens
gagagccatggtggagatgggg

SEQ ID NO: 9291514 - DNA, 22 bp, Homo sapiens
gagaggaggtggctatgacagc

SEQ ID NO: 9291515 - DNA, 17 bp, Homo sapiens
gagagccctcagatgtc

SEQ ID NO: 9291516 - DNA, 22 bp, Homo sapiens
gaggtgagaagggggtcagatg

SEQ ID NO: 9291517 - DNA, 22 bp, Homo sapiens
gaggtgagaagggggtcagatg

SEQ ID NO: 9291518 - DNA, 22 bp, Homo sapiens
gaggtgagtggatcacgaggtc

SEQ ID NO: 9291519 - DNA, 22 bp, Homo sapiens
gagtaacatgtattggaaggcc

SEQ ID NO: 9291520 - DNA, 22 bp, Homo sapiens
gaggtgtctgttaggaataggc

SEQ ID NO: 9291521 - DNA, 19 bp, Homo sapiens
gaggtgtctttcctgagta

SEQ ID NO: 9291522 - DNA, 22 bp, Homo sapiens
gagggccacgttcagggctctc

SEQ ID NO: 9291523 - DNA, 22 bp, Homo sapiens
gagggccagagtcctggggtca

SEQ ID NO: 9291524 - DNA, 22 bp, Homo sapiens
gagggccattctgagggggtga

SEQ ID NO: 9291525 - DNA, 22 bp, Homo sapiens
gagggccagcctgccaagggcc

SEQ ID NO: 9291526 - DNA, 22 bp, Homo sapiens
gagggccaggcagcaagaaggc

SEQ ID NO: 9291527 - DNA, 22 bp, Homo sapiens
gagggccagagtcctggggtca

SEQ ID NO: 9291528 - DNA, 22 bp, Homo sapiens
gagggccagatcccaggaggaa

SEQ ID NO: 9291529 - DNA, 22 bp, Homo sapiens
gagggccagatcccaggaggaa

SEQ ID NO: 9291530 - DNA, 22 bp, Homo sapiens
gaggctaaggtgccagacgaat

SEQ ID NO: 9291531 - DNA, 22 bp, Homo sapiens
gaggctaaggttctgccagaag

SEQ ID NO: 9291532 - DNA, 22 bp, Homo sapiens
gaggcctggtttgcatgagaat

SEQ ID NO: 9291533 - DNA, 22 bp, Homo sapiens
gaggcctggtctatgagatgtt

SEQ ID NO: 9291534 - DNA, 22 bp, Homo sapiens
gaggcctgtagtcatggatgta

SEQ ID NO: 9291535 - DNA, 22 bp, Homo sapiens
gagctcattcattcattgcctg

SEQ ID NO: 9291536 - DNA, 22 bp, Homo sapiens
gagctccacttagcaaggccac

SEQ ID NO: 9291537 - DNA, 22 bp, Homo sapiens
gagctccagcatctctgccaaa

SEQ ID NO: 9291538 - DNA, 22 bp, Homo sapiens
gagctcatccccatggtccgtc

SEQ ID NO: 9291539 - DNA, 22 bp, Homo sapiens
gagctcaggagcatcagaagaa

SEQ ID NO: 9291540 - DNA, 22 bp, Homo sapiens
gagctgtggtcaacaggaaatt

SEQ ID NO: 9291541 - DNA, 22 bp, Homo sapiens
gagctgggatttgaacctggga

SEQ ID NO: 9291542 - DNA, 22 bp, Homo sapiens
gagctgggatttgaacctggga

SEQ ID NO: 9291543 - DNA, 22 bp, Homo sapiens
gagctgggattcatctatgtct

SEQ ID NO: 9291544 - DNA, 22 bp, Homo sapiens
gagctgggcacacgccacttga

SEQ ID NO: 9291545 - DNA, 22 bp, Homo sapiens
gagctgggtatatggctttatg

SEQ ID NO: 9291546 - DNA, 22 bp, Homo sapiens
gagctgggtctccaccttggca

SEQ ID NO: 9291547 - DNA, 22 bp, Homo sapiens
gagctgggtctccaccttggca

SEQ ID NO: 9291548 - DNA, 22 bp, Homo sapiens
gagctgggtgtttatttgccaa

SEQ ID NO: 9291549 - DNA, 22 bp, Homo sapiens
gaggactctgggcgtgtatggg

SEQ ID NO: 9291550 - DNA, 22 bp, Homo sapiens
gaggagtctttttagggcctga

SEQ ID NO: 9291551 - DNA, 22 bp, Homo sapiens
gaggatggaggcagttagggcc

SEQ ID NO: 9291552 - DNA, 22 bp, Homo sapiens
gaggcaacaatgatggtgtgta

SEQ ID NO: 9291553 - DNA, 22 bp, Homo sapiens
gaggcaacaatgatggtgtgta

SEQ ID NO: 9291554 - DNA, 22 bp, Homo sapiens
gaggcaacacatttggaaagca

SEQ ID NO: 9291555 - DNA, 22 bp, Homo sapiens
gaggccagaatgagtctctggg

SEQ ID NO: 9291556 - DNA, 22 bp, Homo sapiens
gaggcctgggttggaggtgcat

SEQ ID NO: 9291557 - DNA, 22 bp, Homo sapiens
gaggccactgtccctgccttcc

SEQ ID NO: 9291558 - DNA, 22 bp, Homo sapiens
gaggccagaagtctgagatcag

SEQ ID NO: 9291559 - DNA, 22 bp, Homo sapiens
gaggccagaagtgcctcgggct

SEQ ID NO: 9291560 - DNA, 22 bp, Homo sapiens
ctgtgacaaaagcagcctgcct

SEQ ID NO: 9291561 - DNA, 22 bp, Homo sapiens
ctgtgacagggatcagaatgca

SEQ ID NO: 9291562 - DNA, 22 bp, Homo sapiens
ctgtgacagtttctcagaattt

SEQ ID NO: 9291563 - DNA, 22 bp, Homo sapiens
ctgtccctctcacacctcacca

SEQ ID NO: 9291564 - DNA, 22 bp, Homo sapiens
ctgtctgttatctcaccagtcc

SEQ ID NO: 9291565 - DNA, 22 bp, Homo sapiens
ctgtgaggcgggtggagtggag

SEQ ID NO: 9291566 - DNA, 22 bp, Homo sapiens
ctggttggaagtgcagactctc

SEQ ID NO: 9291567 - DNA, 22 bp, Homo sapiens
ctggttgggaggttggctttca

SEQ ID NO: 9291568 - DNA, 19 bp, Homo sapiens
ctgtgggtgtgcaagggtg

SEQ ID NO: 9291569 - DNA, 22 bp, Homo sapiens
ctgtgtgagcatcacttcagat

SEQ ID NO: 9291570 - DNA, 22 bp, Homo sapiens
ctggtggttcaggagaatggct

SEQ ID NO: 9291571 - DNA, 22 bp, Homo sapiens
ctggtgtggactccgcgcggag

SEQ ID NO: 9291572 - DNA, 22 bp, Homo sapiens
ctgggtgtagatggaagtttgg

SEQ ID NO: 9291573 - DNA, 22 bp, Homo sapiens
ctgggtgtagcccagtatgagg

SEQ ID NO: 9291574 - DNA, 22 bp, Homo sapiens
ctgggtgtcaggagacatgatg

SEQ ID NO: 9291575 - DNA, 22 bp, Homo sapiens
ctgggtgttcacccgaggcgct

SEQ ID NO: 9291576 - DNA, 22 bp, Homo sapiens
ctgggtgtgggtcaagcaacca

SEQ ID NO: 9291577 - DNA, 22 bp, Homo sapiens
ctgggtgttcaggagctgggct

SEQ ID NO: 9291578 - DNA, 22 bp, Homo sapiens
ctgggtgttgggtactgaccgt

SEQ ID NO: 9291579 - DNA, 22 bp, Homo sapiens
ctgggttggggttacatgactg

SEQ ID NO: 9291580 - DNA, 22 bp, Homo sapiens
ctgggttgccctgggcctgtga

SEQ ID NO: 9291581 - DNA, 22 bp, Homo sapiens
ctggtaaagaagacaaacaggg

SEQ ID NO: 9291582 - DNA, 23 bp, Homo sapiens
ctggtaaatcactaaaattacaa

SEQ ID NO: 9291583 - DNA, 22 bp, Homo sapiens
ctggtaaatgatgagaagcacc

SEQ ID NO: 9291584 - DNA, 22 bp, Homo sapiens
ctggggctggtgaggcaggctc

SEQ ID NO: 9291585 - DNA, 22 bp, Homo sapiens
ctggggtatctgccacaactct

SEQ ID NO: 9291586 - DNA, 22 bp, Homo sapiens
ctggggggctactgacagagga

SEQ ID NO: 9291587 - DNA, 22 bp, Homo sapiens
ctggggggctactgacagagga

SEQ ID NO: 9291588 - DNA, 22 bp, Homo sapiens
ctggggtggagattggcaatct

SEQ ID NO: 9291589 - DNA, 22 bp, Homo sapiens
ctgggagtccctggaatagctc

SEQ ID NO: 9291590 - DNA, 22 bp, Homo sapiens
ctgggagtcagtataagaagca

SEQ ID NO: 9291591 - DNA, 22 bp, Homo sapiens
ctgggagtccaggatacagatg

SEQ ID NO: 9291592 - DNA, 22 bp, Homo sapiens
ctgggagtcaccaggagcaagg

SEQ ID NO: 9291593 - DNA, 22 bp, Homo sapiens
ctgggagtttgttagtaatgca

SEQ ID NO: 9291594 - DNA, 22 bp, Homo sapiens
ctgggagtttctagagaaagac

SEQ ID NO: 9291595 - DNA, 22 bp, Homo sapiens
ctgggccagcaactgcaatgga

SEQ ID NO: 9291596 - DNA, 22 bp, Homo sapiens
cttgcctccctcagctcacagc

SEQ ID NO: 9291597 - DNA, 22 bp, Homo sapiens
ctttctcttacccaaggatctg

SEQ ID NO: 9291598 - DNA, 22 bp, Homo sapiens
ctttctctgtgtttcacatgct

SEQ ID NO: 9291599 - DNA, 22 bp, Homo sapiens
ctttctctggaggggagtggtt

SEQ ID NO: 9291600 - DNA, 22 bp, Homo sapiens
ctttctctgtgtttcacatgct

SEQ ID NO: 9291601 - DNA, 22 bp, Homo sapiens
ctttctctgtgtttcacatgct

SEQ ID NO: 9291602 - DNA, 16 bp, Homo sapiens
cttcacagaggagagt

SEQ ID NO: 9291603 - DNA, 22 bp, Homo sapiens
cttcacagatgctgagagggct

SEQ ID NO: 9291604 - DNA, 22 bp, Homo sapiens
ctgttaaagatagttaagcttc

SEQ ID NO: 9291605 - DNA, 20 bp, Homo sapiens
ctgttaaaaggtatgaattc

SEQ ID NO: 9291606 - DNA, 22 bp, Homo sapiens
cttccctcctggattccagact

SEQ ID NO: 9291607 - DNA, 22 bp, Homo sapiens
cttccctgataagagcctcaga

SEQ ID NO: 9291608 - DNA, 22 bp, Homo sapiens
cttctgtgacgtatgtgaggac

SEQ ID NO: 9291609 - DNA, 22 bp, Homo sapiens
cttcttcagcacaatattgatg

SEQ ID NO: 9291610 - DNA, 22 bp, Homo sapiens
cttttttaaggtagctcctcct

SEQ ID NO: 9291611 - DNA, 22 bp, Homo sapiens
gaaactagatgtattagagatt

SEQ ID NO: 9291612 - DNA, 22 bp, Homo sapiens
gaaacctcttagcctctctttg

SEQ ID NO: 9291613 - DNA, 22 bp, Homo sapiens
gaaacttgcctgaagtcaacca

SEQ ID NO: 9291614 - DNA, 22 bp, Homo sapiens
gaaacttcttgtctcacagttc

SEQ ID NO: 9291615 - DNA, 22 bp, Homo sapiens
gaaagaagctttagatggctat

SEQ ID NO: 9291616 - DNA, 22 bp, Homo sapiens
ctttttcccaggtggagagagg

SEQ ID NO: 9291617 - DNA, 22 bp, Homo sapiens
cttttgttaggagaaaacatca

SEQ ID NO: 9291618 - DNA, 20 bp, Homo sapiens
ctttggcaatgagaacaggg

SEQ ID NO: 9291619 - DNA, 20 bp, Homo sapiens
ctttttctccagctctgagc

SEQ ID NO: 9291620 - DNA, 22 bp, Homo sapiens
gaacttcttctttaagagactc

SEQ ID NO: 9291621 - DNA, 22 bp, Homo sapiens
gaaagacttcctttgagagtac

SEQ ID NO: 9291622 - DNA, 22 bp, Homo sapiens
ccttcagcctagaacttgagag

SEQ ID NO: 9291623 - DNA, 22 bp, Homo sapiens
ccttcagccagttttctttgtt

SEQ ID NO: 9291624 - DNA, 22 bp, Homo sapiens
ttacataactttaaaatgccgt

SEQ ID NO: 9291625 - DNA, 22 bp, Homo sapiens
ttacataacggtatgaaaaatg

SEQ ID NO: 9291626 - DNA, 22 bp, Homo sapiens
ttagcaaatatcttgaaacagg

SEQ ID NO: 9291627 - DNA, 22 bp, Homo sapiens
ccttcagcctttgtttatcaga

SEQ ID NO: 9291628 - DNA, 22 bp, Homo sapiens
ttatcattgtcgcagtctaatt

SEQ ID NO: 9291629 - DNA, 22 bp, Homo sapiens
ccttgaaatgttctcactgggg

SEQ ID NO: 9291630 - DNA, 22 bp, Homo sapiens
ttacaaagcgttgagacaagta

SEQ ID NO: 9291631 - DNA, 22 bp, Homo sapiens
tgtcagcaagacatcagagtga

SEQ ID NO: 9291632 - DNA, 21 bp, Homo sapiens
tgtcagagcttgtaggacatt

SEQ ID NO: 9291633 - DNA, 22 bp, Homo sapiens
tgtcagagcaatgaggttcagc

SEQ ID NO: 9291634 - DNA, 22 bp, Homo sapiens
cgtggggcgggtggacacttgc

SEQ ID NO: 9291635 - DNA, 22 bp, Homo sapiens
cggggctgacagcaggtgtgct

SEQ ID NO: 9291636 - DNA, 22 bp, Homo sapiens
cgggctggctgcagctgctgga

SEQ ID NO: 9291637 - DNA, 22 bp, Homo sapiens
cggcaggtgtgctcactctgcc

SEQ ID NO: 9291638 - DNA, 22 bp, Homo sapiens
cggggcaggagtccctgtagag

SEQ ID NO: 9291639 - DNA, 22 bp, Homo sapiens
cggaggttgaggctgcagtgag

SEQ ID NO: 9291640 - DNA, 22 bp, Homo sapiens
cggcagggttggttttctctga

SEQ ID NO: 9291641 - DNA, 22 bp, Homo sapiens
cggcagggctccatgcatttct

SEQ ID NO: 9291642 - DNA, 22 bp, Homo sapiens
cggcagagcttcctgctcagcg

SEQ ID NO: 9291643 - DNA, 22 bp, Homo sapiens
cggcagagccctgagtcagcct

SEQ ID NO: 9291644 - DNA, 22 bp, Homo sapiens
cctttttcaatatagaattgca

SEQ ID NO: 9291645 - DNA, 22 bp, Homo sapiens
cctttttccctggagggacagc

SEQ ID NO: 9291646 - DNA, 22 bp, Homo sapiens
ccttttcccatgtttctggagc

SEQ ID NO: 9291647 - DNA, 22 bp, Homo sapiens
cgagagttagctaggagtcaca

SEQ ID NO: 9291648 - DNA, 22 bp, Homo sapiens
ttattcagattggctacaggat

SEQ ID NO: 9291649 - DNA, 22 bp, Homo sapiens
ttattgagtatctgcttggtgt

SEQ ID NO: 9291650 - DNA, 23 bp, Homo sapiens
ttattgagggtgtagattggtgt

SEQ ID NO: 9291651 - DNA, 16 bp, Homo sapiens
ttattgaggccaagga

SEQ ID NO: 9291652 - DNA, 22 bp, Homo sapiens
ttattgagtttacagctttaga

SEQ ID NO: 9291653 - DNA, 22 bp, Homo sapiens
ttattgagttgtaagagctctt

SEQ ID NO: 9291654 - DNA, 22 bp, Homo sapiens
ttattgcaactcctaaatagag

SEQ ID NO: 9291655 - DNA, 22 bp, Homo sapiens
ttattgcaactttagggataga

SEQ ID NO: 9291656 - DNA, 22 bp, Homo sapiens
ttatttattgtgtacctactgt

SEQ ID NO: 9291657 - DNA, 22 bp, Homo sapiens
ttatttcaaaagagcttggggt

SEQ ID NO: 9291658 - DNA, 21 bp, Homo sapiens
ttatttcacatggacttccag

SEQ ID NO: 9291659 - DNA, 20 bp, Homo sapiens
ttatttcagttgctagattg

SEQ ID NO: 9291660 - DNA, 22 bp, Homo sapiens
ttatttcatataatgttatcaa

SEQ ID NO: 9291661 - DNA, 22 bp, Homo sapiens
ttatttcatataatgttatcaa

SEQ ID NO: 9291662 - DNA, 22 bp, Homo sapiens
cgctgataaacgtcacgttccc

SEQ ID NO: 9291663 - DNA, 22 bp, Homo sapiens
ctagagaatatgagggagtgaa

SEQ ID NO: 9291664 - DNA, 22 bp, Homo sapiens
ctagaggtagaggcagtgggaa

SEQ ID NO: 9291665 - DNA, 23 bp, Homo sapiens
cgtgtccttcagggagagtgtgg

SEQ ID NO: 9291666 - DNA, 22 bp, Homo sapiens
cgtgtccttttagcttcaggtc

SEQ ID NO: 9291667 - DNA, 20 bp, Homo sapiens
cgtgtccttggcgggagagc

SEQ ID NO: 9291668 - DNA, 22 bp, Homo sapiens
cgtgtggtcccggcaaggcaag

SEQ ID NO: 9291669 - DNA, 22 bp, Homo sapiens
cgtgtggtcccggcaaggcaag

SEQ ID NO: 9291670 - DNA, 22 bp, Homo sapiens
ttctatttcttaatcttggctg

SEQ ID NO: 9291671 - DNA, 22 bp, Homo sapiens
ttctgaagctcccttttgtagt

SEQ ID NO: 9291672 - DNA, 22 bp, Homo sapiens
ttctgaaggctcctcaggaaag

SEQ ID NO: 9291673 - DNA, 22 bp, Homo sapiens
ttctgcataggctatatttgtt

SEQ ID NO: 9291674 - DNA, 22 bp, Homo sapiens
ttctgcaggctgtacaagaagc

SEQ ID NO: 9291675 - DNA, 22 bp, Homo sapiens
ttctatttccagtccttcagag

SEQ ID NO: 9291676 - DNA, 22 bp, Homo sapiens
ttctgcatgaacagtttattcc

SEQ ID NO: 9291677 - DNA, 17 bp, Homo sapiens
ttctgcatgtgaagatg

SEQ ID NO: 9291678 - DNA, 22 bp, Homo sapiens
ttctggaagctgcaggtggccg

SEQ ID NO: 9291679 - DNA, 22 bp, Homo sapiens
ttctggaagcagtggggagtga

SEQ ID NO: 9291680 - DNA, 22 bp, Homo sapiens
ctcactgcaacctctgcctccc

SEQ ID NO: 9291681 - DNA, 22 bp, Homo sapiens
ctcaccccactaccccttggtg

SEQ ID NO: 9291682 - DNA, 22 bp, Homo sapiens
ttctttctggggtccttcggct

SEQ ID NO: 9291683 - DNA, 22 bp, Homo sapiens
ttctttctgggaagagttcaga

SEQ ID NO: 9291684 - DNA, 22 bp, Homo sapiens
ttctttctgggaagagttcaga

SEQ ID NO: 9291685 - DNA, 22 bp, Homo sapiens
ctcaggagtagttcagcagctg

SEQ ID NO: 9291686 - DNA, 22 bp, Homo sapiens
ctcaggaggatgactgccttgg

SEQ ID NO: 9291687 - DNA, 22 bp, Homo sapiens
ctcaggaggaggaagttcattg

SEQ ID NO: 9291688 - DNA, 22 bp, Homo sapiens
ctcaggagcttcctcagcccat

SEQ ID NO: 9291689 - DNA, 22 bp, Homo sapiens
ctcaggaggtttcctgtctagg

SEQ ID NO: 9291690 - DNA, 22 bp, Homo sapiens
ctcaggaggtggtagaggccct

SEQ ID NO: 9291691 - DNA, 22 bp, Homo sapiens
ctcaggaggccattctcaaggt

SEQ ID NO: 9291692 - DNA, 22 bp, Homo sapiens
ctcaggacccggtccaggtggg

SEQ ID NO: 9291693 - DNA, 22 bp, Homo sapiens
ctcaggagatgacagaaggtat

SEQ ID NO: 9291694 - DNA, 22 bp, Homo sapiens
ctcaggagacagtgtccacatg

SEQ ID NO: 9291695 - DNA, 22 bp, Homo sapiens
ctcaggagagtcttatatctcc

SEQ ID NO: 9291696 - DNA, 22 bp, Homo sapiens
ctcagctgtctcatgggtctgt

SEQ ID NO: 9291697 - DNA, 19 bp, Homo sapiens
ctcagctgtagctcatgtg

SEQ ID NO: 9291698 - DNA, 19 bp, Homo sapiens
ctcagctgtagctcatgtg

SEQ ID NO: 9291699 - DNA, 22 bp, Homo sapiens
ctcagctggcaattctggctcc

SEQ ID NO: 9291700 - DNA, 22 bp, Homo sapiens
ctcagtagacatactcatgcca

SEQ ID NO: 9291701 - DNA, 22 bp, Homo sapiens
ctcaggtcacaggatggccagg

SEQ ID NO: 9291702 - DNA, 22 bp, Homo sapiens
ttgccctgtcttaagctggcaa

SEQ ID NO: 9291703 - DNA, 22 bp, Homo sapiens
ttgccctgtcagtagaagtgca

SEQ ID NO: 9291704 - DNA, 22 bp, Homo sapiens
ttgccctgcgttaccatctctt

SEQ ID NO: 9291705 - DNA, 22 bp, Homo sapiens
ttgccctgcgggtcctgcgcaa

SEQ ID NO: 9291706 - DNA, 22 bp, Homo sapiens
ttgccctggggctggcctggca

SEQ ID NO: 9291707 - DNA, 22 bp, Homo sapiens
ttggaagggatattggcatatg

SEQ ID NO: 9291708 - DNA, 22 bp, Homo sapiens
ttggaagatctaacagaggcat

SEQ ID NO: 9291709 - DNA, 22 bp, Homo sapiens
ttggaagattctgtgtctggtg

SEQ ID NO: 9291710 - DNA, 22 bp, Homo sapiens
ttggaagcagtgtacactgtac

SEQ ID NO: 9291711 - DNA, 19 bp, Homo sapiens
ctcagtctggctctgcctg

SEQ ID NO: 9291712 - DNA, 22 bp, Homo sapiens
ctcagtctgtcttgtctgtgtt

SEQ ID NO: 9291713 - DNA, 22 bp, Homo sapiens
ctcagtctcttgggctgtgaag

SEQ ID NO: 9291714 - DNA, 22 bp, Homo sapiens
ctcagtcttctcctccaatgga

SEQ ID NO: 9291715 - DNA, 22 bp, Homo sapiens
ctccaggactcaggcccctggg

SEQ ID NO: 9291716 - DNA, 22 bp, Homo sapiens
ctccaggactgaggacagagct

SEQ ID NO: 9291717 - DNA, 22 bp, Homo sapiens
ctccaggacccagtggctccag

SEQ ID NO: 9291718 - DNA, 22 bp, Homo sapiens
ttggctctttcctcacacagga

SEQ ID NO: 9291719 - DNA, 22 bp, Homo sapiens
ttggctcttctcccagtggcct

SEQ ID NO: 9291720 - DNA, 22 bp, Homo sapiens
ttggctctttctcagtcacgtt

SEQ ID NO: 9291721 - DNA, 22 bp, Homo sapiens
ttggctctgtgtctccactcaa

SEQ ID NO: 9291722 - DNA, 22 bp, Homo sapiens
ttggctctgatggggatcagga

SEQ ID NO: 9291723 - DNA, 20 bp, Homo sapiens
ttggctctgatcagtggagc

SEQ ID NO: 9291724 - DNA, 22 bp, Homo sapiens
ttggctctggcaaggggcaccg

SEQ ID NO: 9291725 - DNA, 22 bp, Homo sapiens
ttggctctggaactatttctga

SEQ ID NO: 9291726 - DNA, 22 bp, Homo sapiens
ttggctctggttgccctgtgac

SEQ ID NO: 9291727 - DNA, 22 bp, Homo sapiens
ttggctctcattttccccatta

SEQ ID NO: 9291728 - DNA, 17 bp, Homo sapiens
ttggctctattgcctct

SEQ ID NO: 9291729 - DNA, 21 bp, Homo sapiens
ttggctctgaaacttgcacct

SEQ ID NO: 9291730 - DNA, 22 bp, Homo sapiens
ttggctctgacattaaaacaat

SEQ ID NO: 9291731 - DNA, 22 bp, Homo sapiens
ttggctctgaactatgcagttt

SEQ ID NO: 9291732 - DNA, 22 bp, Homo sapiens
ttggctctgaaacccaagctct

SEQ ID NO: 9291733 - DNA, 22 bp, Homo sapiens
ctgctgagcatcagggctgccc

SEQ ID NO: 9291734 - DNA, 22 bp, Homo sapiens
ctgctgagatgccaggagctct

SEQ ID NO: 9291735 - DNA, 22 bp, Homo sapiens
ctgctgagcatcagggctgccc

SEQ ID NO: 9291736 - DNA, 22 bp, Homo sapiens
ctgctgagagccacgtggcaca

SEQ ID NO: 9291737 - DNA, 20 bp, Homo sapiens
ctgctgagagcctggcttgc

SEQ ID NO: 9291738 - DNA, 22 bp, Homo sapiens
ctgctgagagctgaaggctgta

SEQ ID NO: 9291739 - DNA, 22 bp, Homo sapiens
ctgctgagatgccaggagctct

SEQ ID NO: 9291740 - DNA, 22 bp, Homo sapiens
ctgctgagaaaagactgaggga

SEQ ID NO: 9291741 - DNA, 22 bp, Homo sapiens
ctgctgagaaaagactgaggga

SEQ ID NO: 9291742 - DNA, 22 bp, Homo sapiens
ctgctgagaaccagggagaatt

SEQ ID NO: 9291743 - DNA, 22 bp, Homo sapiens
ctgctgagactggctttgtgtc

SEQ ID NO: 9291744 - DNA, 22 bp, Homo sapiens
ctgctcttcccactcactccca

SEQ ID NO: 9291745 - DNA, 22 bp, Homo sapiens
ctgctcttgagggactgcggtc

SEQ ID NO: 9291746 - DNA, 19 bp, Homo sapiens
ctgctgggtgctgagggag

SEQ ID NO: 9291747 - DNA, 22 bp, Homo sapiens
ctgctgggtctatgcaagtgga

SEQ ID NO: 9291748 - DNA, 22 bp, Homo sapiens
ctgctgtcatagccatccctcc

SEQ ID NO: 9291749 - DNA, 22 bp, Homo sapiens
ctgcctgtggtctgtgatctaa

SEQ ID NO: 9291750 - DNA, 22 bp, Homo sapiens
ctgcctttgcccttgacactgt

SEQ ID NO: 9291751 - DNA, 22 bp, Homo sapiens
ctgctctgtttcttagctgggt

SEQ ID NO: 9291752 - DNA, 22 bp, Homo sapiens
ctgctcttcacactacacccgt

SEQ ID NO: 9291753 - DNA, 22 bp, Homo sapiens
ctgctctgaccctttcaccttc

SEQ ID NO: 9291754 - DNA, 22 bp, Homo sapiens
ctggagaaacatcaggcatagg

SEQ ID NO: 9291755 - DNA, 22 bp, Homo sapiens
ctggagaggctgggaacaggtt

SEQ ID NO: 9291756 - DNA, 22 bp, Homo sapiens
ctggagagaccgaaagaggctg

SEQ ID NO: 9291757 - DNA, 22 bp, Homo sapiens
ctggagataagtaaagaggcaa

SEQ ID NO: 9291758 - DNA, 22 bp, Homo sapiens
ctcttcttatggccgtggctga

SEQ ID NO: 9291759 - DNA, 22 bp, Homo sapiens
ttttgctttaagatggagagga

SEQ ID NO: 9291760 - DNA, 22 bp, Homo sapiens
ctgagcagtggttcttgagcgc

SEQ ID NO: 9291761 - DNA, 22 bp, Homo sapiens
ctgcaggagggctggggaagcc

SEQ ID NO: 9291762 - DNA, 22 bp, Homo sapiens
ctgcaggagcaaagcctctgct

SEQ ID NO: 9291763 - DNA, 22 bp, Homo sapiens
ctgcaggacgaccgcctcatct

SEQ ID NO: 9291764 - DNA, 22 bp, Homo sapiens
ctgcagctttggaaacctgttt

SEQ ID NO: 9291765 - DNA, 22 bp, Homo sapiens
ctgcagctgtctctactgggca

SEQ ID NO: 9291766 - DNA, 22 bp, Homo sapiens
tttgaaaaaggcctttggtatg

SEQ ID NO: 9291767 - DNA, 22 bp, Homo sapiens
ctctgaaggtttctgttactgt

SEQ ID NO: 9291768 - DNA, 22 bp, Homo sapiens
tttgaaaatttaagtgctacac

SEQ ID NO: 9291769 - DNA, 22 bp, Homo sapiens
tttgacctctggaccctctgaa

SEQ ID NO: 9291770 - DNA, 22 bp, Homo sapiens
tttgacttctatctagtaagaa

SEQ ID NO: 9291771 - DNA, 22 bp, Homo sapiens
tttgagaaccctgtattttaag

SEQ ID NO: 9291772 - DNA, 22 bp, Homo sapiens
tttgcaaagaaattattgctgt

SEQ ID NO: 9291773 - DNA, 19 bp, Homo sapiens
ctctggcctctggatgctg

SEQ ID NO: 9291774 - DNA, 21 bp, Homo sapiens
tttgttcaggcaagttacagt

SEQ ID NO: 9291775 - DNA, 22 bp, Homo sapiens
tttgttcagctctcattgatta

SEQ ID NO: 9291776 - DNA, 22 bp, Homo sapiens
ctctgggtggtctcactgagtg

SEQ ID NO: 9291777 - DNA, 23 bp, Homo sapiens
ctctgggtccgatgtcctgacag

SEQ ID NO: 9291778 - DNA, 22 bp, Homo sapiens
ctctgtggtggagtgggtcacc

SEQ ID NO: 9291779 - DNA, 22 bp, Homo sapiens
ctctgtggcttgcctttctgtc

SEQ ID NO: 9291780 - DNA, 22 bp, Homo sapiens
ctctgtggttagactatggctg

SEQ ID NO: 9291781 - DNA, 22 bp, Homo sapiens
ctctgtgttcagcctagcagaa

SEQ ID NO: 9291782 - DNA, 22 bp, Homo sapiens
ctctgtgttcagcctagcagaa

SEQ ID NO: 9291783 - DNA, 22 bp, Homo sapiens
ctctgtgtggtcctctgtattg

SEQ ID NO: 9291784 - DNA, 21 bp, Homo sapiens
ttttgctgttttagaatgaga

SEQ ID NO: 9291785 - DNA, 22 bp, Homo sapiens
ttttgctgcattgaagtcagat

SEQ ID NO: 9291786 - DNA, 22 bp, Homo sapiens
tttatgattattttaaagcagc

SEQ ID NO: 9291787 - DNA, 22 bp, Homo sapiens
tttattcacttcagtgccaaag

SEQ ID NO: 9291788 - DNA, 22 bp, Homo sapiens
tttattcactggggtctgcccg

SEQ ID NO: 9291789 - DNA, 19 bp, Homo sapiens
ctccaggatggctgggcga

SEQ ID NO: 9291790 - DNA, 22 bp, Homo sapiens
ctccaggagtggcctggacacc

SEQ ID NO: 9291791 - DNA, 22 bp, Homo sapiens
ctccaggagggcttcctgtgat

SEQ ID NO: 9291792 - DNA, 22 bp, Homo sapiens
ctccaggccatggctgcggagg

SEQ ID NO: 9291793 - DNA, 22 bp, Homo sapiens
ctccaggccagggaagtggaca

SEQ ID NO: 9291794 - DNA, 22 bp, Homo sapiens
tttattcattgtttcgtcgcag

SEQ ID NO: 9291795 - DNA, 22 bp, Homo sapiens
tttattcatcatctgttcatat

SEQ ID NO: 9291796 - DNA, 22 bp, Homo sapiens
tttcattaaagtcaaatctggt

SEQ ID NO: 9291797 - DNA, 22 bp, Homo sapiens
tttcatgttggatactgtttca

SEQ ID NO: 9291798 - DNA, 22 bp, Homo sapiens
tttcattacttgttaagggtag

SEQ ID NO: 9291799 - DNA, 22 bp, Homo sapiens
tttcattacgtgtttgacttgt

SEQ ID NO: 9291800 - DNA, 22 bp, Homo sapiens
tttcattagtatgacagcacgc

SEQ ID NO: 9291801 - DNA, 22 bp, Homo sapiens
tttcattataaaaagttggctt

SEQ ID NO: 9291802 - DNA, 18 bp, Homo sapiens
tttcattataaagcaggc

SEQ ID NO: 9291803 - DNA, 22 bp, Homo sapiens
tttctacacttcgtggtgtttt

SEQ ID NO: 9291804 - DNA, 22 bp, Homo sapiens
tttccactcctattgcatctca

SEQ ID NO: 9291805 - DNA, 22 bp, Homo sapiens
tttccactctggccaccatctt

SEQ ID NO: 9291806 - DNA, 22 bp, Homo sapiens
tttccacagctgtataaaataa

SEQ ID NO: 9291807 - DNA, 18 bp, Homo sapiens
ctctctttccactctttg

SEQ ID NO: 9291808 - DNA, 22 bp, Homo sapiens
ctctgaaagcaaaactagagaa

SEQ ID NO: 9291809 - DNA, 22 bp, Homo sapiens
ctctgaaagttagagaaaatag

SEQ ID NO: 9291810 - DNA, 22 bp, Homo sapiens
ctctcttcccgtgagtgttgca

SEQ ID NO: 9291811 - DNA, 22 bp, Homo sapiens
ctctcttcccgtgagtgttgca

SEQ ID NO: 9291812 - DNA, 22 bp, Homo sapiens
ctctctgtggtggctgtcccat

SEQ ID NO: 9291813 - DNA, 22 bp, Homo sapiens
ctctctgtggtggctgtcccat

SEQ ID NO: 9291814 - DNA, 22 bp, Homo sapiens
tttctacatgtcaatccaaacc

SEQ ID NO: 9291815 - DNA, 22 bp, Homo sapiens
tttctcaaggtgtcatgtattt

SEQ ID NO: 9291816 - DNA, 22 bp, Homo sapiens
ctctctggtcccagattccaga

SEQ ID NO: 9291817 - DNA, 19 bp, Homo sapiens
ctctctggcggtgtctgcg

SEQ ID NO: 9291818 - DNA, 22 bp, Homo sapiens
tttctcaagttcagatatttga

SEQ ID NO: 9291819 - DNA, 22 bp, Homo sapiens
ccaggctgagcatgattggagc

SEQ ID NO: 9291820 - DNA, 22 bp, Homo sapiens
ccaggctgccgaggaaagaaag

SEQ ID NO: 9291821 - DNA, 22 bp, Homo sapiens
ccaggctgctcacaagctgccc

SEQ ID NO: 9291822 - DNA, 22 bp, Homo sapiens
ccaggctgctcacaagctgccc

SEQ ID NO: 9291823 - DNA, 22 bp, Homo sapiens
tgaaagcaggcgggctacttta

SEQ ID NO: 9291824 - DNA, 22 bp, Homo sapiens
tgaaagctgtccactaggctgt

SEQ ID NO: 9291825 - DNA, 22 bp, Homo sapiens
ccaggctcacagcatcccagga

SEQ ID NO: 9291826 - DNA, 22 bp, Homo sapiens
ccaggctccccaggaggccctt

SEQ ID NO: 9291827 - DNA, 22 bp, Homo sapiens
ccaggctcaggtgcgagagaca

SEQ ID NO: 9291828 - DNA, 22 bp, Homo sapiens
tctttaatatctgccccagagc

SEQ ID NO: 9291829 - DNA, 22 bp, Homo sapiens
tctttatttctgaatcccccat

SEQ ID NO: 9291830 - DNA, 22 bp, Homo sapiens
tctttatttaagtctgttgtaa

SEQ ID NO: 9291831 - DNA, 22 bp, Homo sapiens
tctttatttaagtctgttgtaa

SEQ ID NO: 9291832 - DNA, 22 bp, Homo sapiens
tctttatttctgaatcccccat

SEQ ID NO: 9291833 - DNA, 22 bp, Homo sapiens
tctttatttctgaatcccccat

SEQ ID NO: 9291834 - DNA, 22 bp, Homo sapiens
tctttattttatgcttgtgcaa

SEQ ID NO: 9291835 - DNA, 22 bp, Homo sapiens
tctttattttatgcttgtgcaa

SEQ ID NO: 9291836 - DNA, 22 bp, Homo sapiens
tctttattttatgcttgtgcaa

SEQ ID NO: 9291837 - DNA, 22 bp, Homo sapiens
ccagcccttgctgaagggtggc

SEQ ID NO: 9291838 - DNA, 22 bp, Homo sapiens
tcttgtaattaactagaaagat

SEQ ID NO: 9291839 - DNA, 22 bp, Homo sapiens
ccagcctcactggcatcaccta

SEQ ID NO: 9291840 - DNA, 21 bp, Homo sapiens
tcttgtccttgctctcccact

SEQ ID NO: 9291841 - DNA, 22 bp, Homo sapiens
tgaccctcttccccatgcgctc

SEQ ID NO: 9291842 - DNA, 22 bp, Homo sapiens
tgactttacagatatgtttcct

SEQ ID NO: 9291843 - DNA, 22 bp, Homo sapiens
tgaccactgaatatgactgcct

SEQ ID NO: 9291844 - DNA, 22 bp, Homo sapiens
tgaccaggatactgcagggatg

SEQ ID NO: 9291845 - DNA, 22 bp, Homo sapiens
tgaccagtgacccgaggcaagt

SEQ ID NO: 9291846 - DNA, 22 bp, Homo sapiens
tgaccagtgcagggggagttag

SEQ ID NO: 9291847 - DNA, 22 bp, Homo sapiens
tgaccagtggcgctgggtgcaa

SEQ ID NO: 9291848 - DNA, 22 bp, Homo sapiens
tgacagactactgcctctattg

SEQ ID NO: 9291849 - DNA, 22 bp, Homo sapiens
tgacagactttacttctcctat

SEQ ID NO: 9291850 - DNA, 22 bp, Homo sapiens
tgacagaggagctggaatgatt

SEQ ID NO: 9291851 - DNA, 22 bp, Homo sapiens
ccagggcatgtccaagacttag

SEQ ID NO: 9291852 - DNA, 22 bp, Homo sapiens
ccagggcatgtaactaatggtg

SEQ ID NO: 9291853 - DNA, 22 bp, Homo sapiens
ccagggccaagagacctcgagg

SEQ ID NO: 9291854 - DNA, 22 bp, Homo sapiens
ccagtgggaacactggcattgc

SEQ ID NO: 9291855 - DNA, 22 bp, Homo sapiens
ccagtgtggactctctcctttg

SEQ ID NO: 9291856 - DNA, 22 bp, Homo sapiens
ccagtgtggccaggtcttctgg

SEQ ID NO: 9291857 - DNA, 23 bp, Homo sapiens
ccagtggcgtaaactagaggata

SEQ ID NO: 9291858 - DNA, 22 bp, Homo sapiens
tgagcacctccctgacagtggg

SEQ ID NO: 9291859 - DNA, 22 bp, Homo sapiens
tgagcacctggaccagattctg

SEQ ID NO: 9291860 - DNA, 22 bp, Homo sapiens
tgagcaccatctgtttgtgtgc

SEQ ID NO: 9291861 - DNA, 22 bp, Homo sapiens
tgagagtctgttcctcttgcag

SEQ ID NO: 9291862 - DNA, 22 bp, Homo sapiens
tgagagtctcagacctcctggt

SEQ ID NO: 9291863 - DNA, 22 bp, Homo sapiens
ccaggtcctgttttcaccacag

SEQ ID NO: 9291864 - DNA, 22 bp, Homo sapiens
ccagggtgtgggcgtcggcacg

SEQ ID NO: 9291865 - DNA, 22 bp, Homo sapiens
ccagggtgtgagaaggaagtag

SEQ ID NO: 9291866 - DNA, 22 bp, Homo sapiens
ccagggtgtagggattccagat

SEQ ID NO: 9291867 - DNA, 22 bp, Homo sapiens
ccaggtaggagagtcaacatgt

SEQ ID NO: 9291868 - DNA, 22 bp, Homo sapiens
ccagtgtgtttttctctgactc

SEQ ID NO: 9291869 - DNA, 22 bp, Homo sapiens
ccagtgtgttccctgcctcact

SEQ ID NO: 9291870 - DNA, 22 bp, Homo sapiens
ccagtgtgtttaatgcattcca

SEQ ID NO: 9291871 - DNA, 22 bp, Homo sapiens
ccagtgtgggctggtggaggac

SEQ ID NO: 9291872 - DNA, 22 bp, Homo sapiens
ccagtgtgggcccggcctcctc

SEQ ID NO: 9291873 - DNA, 22 bp, Homo sapiens
ccagtgtggccaggtgctggta

SEQ ID NO: 9291874 - DNA, 22 bp, Homo sapiens
ccagtgtggccaggtgctggta

SEQ ID NO: 9291875 - DNA, 23 bp, Homo sapiens
ccagtgtggctctgtccgctctc

SEQ ID NO: 9291876 - DNA, 22 bp, Homo sapiens
ccagtgtggtaggtccacaggt

SEQ ID NO: 9291877 - DNA, 23 bp, Homo sapiens
ccagtgtggtaggtccacaggtg

SEQ ID NO: 9291878 - DNA, 22 bp, Homo sapiens
ccagtgtggtttaggataggga

SEQ ID NO: 9291879 - DNA, 22 bp, Homo sapiens
ccattgtaaattctgtggaagt

SEQ ID NO: 9291880 - DNA, 22 bp, Homo sapiens
tgattcaaatattgtgtatgat

SEQ ID NO: 9291881 - DNA, 22 bp, Homo sapiens
tgcagaggtttttaatacattt

SEQ ID NO: 9291882 - DNA, 22 bp, Homo sapiens
cccacagggctgctgatggcag

SEQ ID NO: 9291883 - DNA, 22 bp, Homo sapiens
cccacactctgagaaatgctga

SEQ ID NO: 9291884 - DNA, 22 bp, Homo sapiens
tgcatatttgtatgatgtttag

SEQ ID NO: 9291885 - DNA, 22 bp, Homo sapiens
cccaggagataacgttcccaag

SEQ ID NO: 9291886 - DNA, 22 bp, Homo sapiens
tgccctggttctgtgggtgagc

SEQ ID NO: 9291887 - DNA, 22 bp, Homo sapiens
cccagcccacggtcctgggtgg

SEQ ID NO: 9291888 - DNA, 22 bp, Homo sapiens
cccagcccccgagtgtctggaa

SEQ ID NO: 9291889 - DNA, 22 bp, Homo sapiens
cccagcccatctcaaaggtcta

SEQ ID NO: 9291890 - DNA, 20 bp, Homo sapiens
cccagcccctacctgttgcc

SEQ ID NO: 9291891 - DNA, 22 bp, Homo sapiens
cccagcatggagtgaggactca

SEQ ID NO: 9291892 - DNA, 22 bp, Homo sapiens
cccagcatttctgggctgcact

SEQ ID NO: 9291893 - DNA, 22 bp, Homo sapiens
cccagcatgcacgctgacactc

SEQ ID NO: 9291894 - DNA, 22 bp, Homo sapiens
cccagcatctccaggcatggcc

SEQ ID NO: 9291895 - DNA, 22 bp, Homo sapiens
tgcaggtggacacgggagacgg

SEQ ID NO: 9291896 - DNA, 22 bp, Homo sapiens
cccagctccagagccagaaaca

SEQ ID NO: 9291897 - DNA, 22 bp, Homo sapiens
tggaggtgaaatgagattttgt

SEQ ID NO: 9291898 - DNA, 22 bp, Homo sapiens
ccctgccttggggtccacaccg

SEQ ID NO: 9291899 - DNA, 22 bp, Homo sapiens
ccctgccttggggtccacaccg

SEQ ID NO: 9291900 - DNA, 22 bp, Homo sapiens
ccctgccttcttggcctttaaa

SEQ ID NO: 9291901 - DNA, 22 bp, Homo sapiens
ccctgccttgttggagcctatg

SEQ ID NO: 9291902 - DNA, 22 bp, Homo sapiens
ccctgccttgtctgggctaggt

SEQ ID NO: 9291903 - DNA, 22 bp, Homo sapiens
tggaggccaggaaggcagcgag

SEQ ID NO: 9291904 - DNA, 22 bp, Homo sapiens
ccctgctcttagtgcctgtgtg

SEQ ID NO: 9291905 - DNA, 22 bp, Homo sapiens
ccctgctcttagtgcctgtgtg

SEQ ID NO: 9291906 - DNA, 23 bp, Homo sapiens
ccctgctcaggggtctgattctc

SEQ ID NO: 9291907 - DNA, 22 bp, Homo sapiens
ccctgctcttctgactcaagct

SEQ ID NO: 9291908 - DNA, 22 bp, Homo sapiens
ccctgcctacagggttttcttt

SEQ ID NO: 9291909 - DNA, 22 bp, Homo sapiens
ccctgcctctgaagctgctcag

SEQ ID NO: 9291910 - DNA, 22 bp, Homo sapiens
ccctgcctctgaagctgctcag

SEQ ID NO: 9291911 - DNA, 22 bp, Homo sapiens
ccctgcctgtgggcatcaacat

SEQ ID NO: 9291912 - DNA, 22 bp, Homo sapiens
ccctgcctgtgggcatcaacat

SEQ ID NO: 9291913 - DNA, 22 bp, Homo sapiens
tggacatgacctcgagcgagat

SEQ ID NO: 9291914 - DNA, 22 bp, Homo sapiens
tggacagttgtcttgtagctaa

SEQ ID NO: 9291915 - DNA, 22 bp, Homo sapiens
tggacatgtaaaggctcaaggt

SEQ ID NO: 9291916 - DNA, 22 bp, Homo sapiens
tggacatgagctgagtgggtgt

SEQ ID NO: 9291917 - DNA, 22 bp, Homo sapiens
tggacagtaggaagagtgtggg

SEQ ID NO: 9291918 - DNA, 22 bp, Homo sapiens
tgctttcacctgtttgcaccca

SEQ ID NO: 9291919 - DNA, 22 bp, Homo sapiens
tgctttattttaaatatgccat

SEQ ID NO: 9291920 - DNA, 22 bp, Homo sapiens
tgctttatttataaaatagcaa

SEQ ID NO: 9291921 - DNA, 22 bp, Homo sapiens
tgctttattttaaatatgccat

SEQ ID NO: 9291922 - DNA, 22 bp, Homo sapiens
tgctttattgcatcagtgtggg

SEQ ID NO: 9291923 - DNA, 22 bp, Homo sapiens
tgctttattggaacctcatcct

SEQ ID NO: 9291924 - DNA, 22 bp, Homo sapiens
tgctttattggaacctcatcct

SEQ ID NO: 9291925 - DNA, 22 bp, Homo sapiens
tgctttatttataaaatagcaa

SEQ ID NO: 9291926 - DNA, 22 bp, Homo sapiens
tgctttattgcatcagtgtggg

SEQ ID NO: 9291927 - DNA, 22 bp, Homo sapiens
tgcctgctccagtcctgtccac

SEQ ID NO: 9291928 - DNA, 22 bp, Homo sapiens
tgcctgctaggccctgctgggt

SEQ ID NO: 9291929 - DNA, 22 bp, Homo sapiens
tgcctcagtttcatctgcagaa

SEQ ID NO: 9291930 - DNA, 22 bp, Homo sapiens
tgcctgcctctggcagccctgc

SEQ ID NO: 9291931 - DNA, 22 bp, Homo sapiens
cccgtgtggacagcgtgccagt

SEQ ID NO: 9291932 - DNA, 22 bp, Homo sapiens
tggaagaataggatagaagaac

SEQ ID NO: 9291933 - DNA, 22 bp, Homo sapiens
tggaagaagctacaagcggtga

SEQ ID NO: 9291934 - DNA, 22 bp, Homo sapiens
tggaagaatagaagatggttga

SEQ ID NO: 9291935 - DNA, 22 bp, Homo sapiens
tggaagaaggcagagaggcatt

SEQ ID NO: 9291936 - DNA, 22 bp, Homo sapiens
tggaagacaggcatggaagtgg

SEQ ID NO: 9291937 - DNA, 22 bp, Homo sapiens
tggaagacaggctgtattttaa

SEQ ID NO: 9291938 - DNA, 22 bp, Homo sapiens
tggaagacagttgatgggagtt

SEQ ID NO: 9291939 - DNA, 22 bp, Homo sapiens
tggaagacagtgactggttgtg

SEQ ID NO: 9291940 - DNA, 22 bp, Homo sapiens
tggaagacaagtgttagcatgg

SEQ ID NO: 9291941 - DNA, 22 bp, Homo sapiens
tggaagacaaagattcaatatt

SEQ ID NO: 9291942 - DNA, 22 bp, Homo sapiens
tggaagacactatttaccaggt

SEQ ID NO: 9291943 - DNA, 22 bp, Homo sapiens
tggaagacaggagatgtgtgta

SEQ ID NO: 9291944 - DNA, 20 bp, Homo sapiens
tggaagacactgaagggcca

SEQ ID NO: 9291945 - DNA, 22 bp, Homo sapiens
tggaagacaatgtacatgcagt

SEQ ID NO: 9291946 - DNA, 22 bp, Homo sapiens
tggaagacaatttgaaaacatt

SEQ ID NO: 9291947 - DNA, 22 bp, Homo sapiens
ccctgtctcattgatcacttgt

SEQ ID NO: 9291948 - DNA, 22 bp, Homo sapiens
ccctgtccttggctgtgaggct

SEQ ID NO: 9291949 - DNA, 22 bp, Homo sapiens
ccctgtctgtaccgtgatgagc

SEQ ID NO: 9291950 - DNA, 22 bp, Homo sapiens
ccctggttgacaagccagctca

SEQ ID NO: 9291951 - DNA, 22 bp, Homo sapiens
ccctggtgccctgggtcagcct

SEQ ID NO: 9291952 - DNA, 22 bp, Homo sapiens
ccctggtggggccagacttgct

SEQ ID NO: 9291953 - DNA, 22 bp, Homo sapiens
ccctgtgcctagttggcctaaa

SEQ ID NO: 9291954 - DNA, 22 bp, Homo sapiens
ccctgtggaggcagcatcctgc

SEQ ID NO: 9291955 - DNA, 22 bp, Homo sapiens
ccctgtgggaactcctgagttg

SEQ ID NO: 9291956 - DNA, 22 bp, Homo sapiens
ccggctactcgggaggctgacg

SEQ ID NO: 9291957 - DNA, 22 bp, Homo sapiens
cctccccatgacccggtgctgg

SEQ ID NO: 9291958 - DNA, 22 bp, Homo sapiens
cctccctccctcttatggttta

SEQ ID NO: 9291959 - DNA, 22 bp, Homo sapiens
cctccctccattgccatcgtct

SEQ ID NO: 9291960 - DNA, 18 bp, Homo sapiens
cctccctcattttcccag

SEQ ID NO: 9291961 - DNA, 19 bp, Homo sapiens
cctccccttggaccagcaa

SEQ ID NO: 9291962 - DNA, 19 bp, Homo sapiens
tggctaaggccagcggaaa

SEQ ID NO: 9291963 - DNA, 22 bp, Homo sapiens
cctcactgtcatcagtagttat

SEQ ID NO: 9291964 - DNA, 22 bp, Homo sapiens
tggcctcccctaacagcctctt

SEQ ID NO: 9291965 - DNA, 22 bp, Homo sapiens
cctcagctgcttccctggagcc

SEQ ID NO: 9291966 - DNA, 22 bp, Homo sapiens
cctcagctgcttccctggagcc

SEQ ID NO: 9291967 - DNA, 22 bp, Homo sapiens
cctcagctgctgcacagctttt

SEQ ID NO: 9291968 - DNA, 22 bp, Homo sapiens
cctcagctcttccctgtgcaca

SEQ ID NO: 9291969 - DNA, 22 bp, Homo sapiens
cctcagctgtcttttccgaggt

SEQ ID NO: 9291970 - DNA, 22 bp, Homo sapiens
cctcagctgcttccctggagcc

SEQ ID NO: 9291971 - DNA, 22 bp, Homo sapiens
cctctttaagtggtaaccctta

SEQ ID NO: 9291972 - DNA, 22 bp, Homo sapiens
cctctttaatcccatccatgtg

SEQ ID NO: 9291973 - DNA, 22 bp, Homo sapiens
cctcttctgagtgagactccct

SEQ ID NO: 9291974 - DNA, 22 bp, Homo sapiens
cctcttctgcttcaggagcact

SEQ ID NO: 9291975 - DNA, 22 bp, Homo sapiens
tgggccagaggcatggagctat

SEQ ID NO: 9291976 - DNA, 22 bp, Homo sapiens
tgggcagggagctggaaccaca

SEQ ID NO: 9291977 - DNA, 22 bp, Homo sapiens
tgggagcaggtgtgctagggaa

SEQ ID NO: 9291978 - DNA, 21 bp, Homo sapiens
tggctctgaaagagtgctgca

SEQ ID NO: 9291979 - DNA, 22 bp, Homo sapiens
cctccctgctcctcaactggca

SEQ ID NO: 9291980 - DNA, 22 bp, Homo sapiens
tggctctcagctcccagcagcc

SEQ ID NO: 9291981 - DNA, 22 bp, Homo sapiens
cctccctctttcagtcccacag

SEQ ID NO: 9291982 - DNA, 22 bp, Homo sapiens
cctgcacttctcacagctgctg

SEQ ID NO: 9291983 - DNA, 22 bp, Homo sapiens
cctgccaggagctggtgctgca

SEQ ID NO: 9291984 - DNA, 22 bp, Homo sapiens
cctgccaggccagtgagcttcc

SEQ ID NO: 9291985 - DNA, 22 bp, Homo sapiens
cctgcagaagagtccagctcat

SEQ ID NO: 9291986 - DNA, 22 bp, Homo sapiens
cctgccagagcagcttgtcctc

SEQ ID NO: 9291987 - DNA, 22 bp, Homo sapiens
tggggtaggagtcagcgagaga

SEQ ID NO: 9291988 - DNA, 22 bp, Homo sapiens
tggggtaggtatgaaaactagg

SEQ ID NO: 9291989 - DNA, 22 bp, Homo sapiens
tggggtagggaaaagaagtcga

SEQ ID NO: 9291990 - DNA, 22 bp, Homo sapiens
tgggggagagaggcattctttc

SEQ ID NO: 9291991 - DNA, 21 bp, Homo sapiens
cctgagggtggttgtgaagat

SEQ ID NO: 9291992 - DNA, 22 bp, Homo sapiens
cctgacctatttttctcagctg

SEQ ID NO: 9291993 - DNA, 22 bp, Homo sapiens
tgtattcatgtgagcctaggaa

SEQ ID NO: 9291994 - DNA, 22 bp, Homo sapiens
tgtattcagtgcctagcatatg

SEQ ID NO: 9291995 - DNA, 22 bp, Homo sapiens
tgtattcagtgatttcacaata

SEQ ID NO: 9291996 - DNA, 22 bp, Homo sapiens
cctggaggggaccaggaccagg

SEQ ID NO: 9291997 - DNA, 22 bp, Homo sapiens
cctggagggcgccgcacagtcc

SEQ ID NO: 9291998 - DNA, 22 bp, Homo sapiens
cctggagggaccctggccctgt

SEQ ID NO: 9291999 - DNA, 22 bp, Homo sapiens
cctggagggcagcccattctgg

SEQ ID NO: 9292000 - DNA, 22 bp, Homo sapiens
cctggaggcggaggttgcagtg

SEQ ID NO: 9292001 - DNA, 22 bp, Homo sapiens
cctggaggcggaggttgcagtg

SEQ ID NO: 9292002 - DNA, 22 bp, Homo sapiens
cctggaggagcgctgaccagct

SEQ ID NO: 9292003 - DNA, 19 bp, Homo sapiens
tgtacatatagagctcagt

SEQ ID NO: 9292004 - DNA, 22 bp, Homo sapiens
tgtacatacatagatatacaca

SEQ ID NO: 9292005 - DNA, 18 bp, Homo sapiens
tgtaatgcagcgggtggc

SEQ ID NO: 9292006 - DNA, 21 bp, Homo sapiens
tgtaagtttcatctgaattgg

SEQ ID NO: 9292007 - DNA, 22 bp, Homo sapiens
tgtaagtagtaatggaaggaca

SEQ ID NO: 9292008 - DNA, 22 bp, Homo sapiens
cctgcttcagggatgatggcac

SEQ ID NO: 9292009 - DNA, 22 bp, Homo sapiens
cctgcttcagggatgatggcac

SEQ ID NO: 9292010 - DNA, 22 bp, Homo sapiens
cctgccttcagccctgaagtct

SEQ ID NO: 9292011 - DNA, 22 bp, Homo sapiens
cctgctctaaatctcatggaac

SEQ ID NO: 9292012 - DNA, 22 bp, Homo sapiens
tgggtcagagcagacctctgga

SEQ ID NO: 9292013 - DNA, 22 bp, Homo sapiens
tgggtcagaatcagagagttgc

SEQ ID NO: 9292014 - DNA, 22 bp, Homo sapiens
tgggtcagacagccagtgggcc

SEQ ID NO: 9292015 - DNA, 22 bp, Homo sapiens
tgggtaggtgtggcctgaatgt

SEQ ID NO: 9292016 - DNA, 22 bp, Homo sapiens
tgggtaggtgtggcctgaatgt

SEQ ID NO: 9292017 - DNA, 22 bp, Homo sapiens
tgggtaggtgctggggattcag

SEQ ID NO: 9292018 - DNA, 22 bp, Homo sapiens
cctgccaggctttgggcttctg

SEQ ID NO: 9292019 - DNA, 18 bp, Homo sapiens
cctgccagtctggagcag

SEQ ID NO: 9292020 - DNA, 22 bp, Homo sapiens
cctgcctgtactagagacccag

SEQ ID NO: 9292021 - DNA, 22 bp, Homo sapiens
tgggtcagaggacctcgtggcc

SEQ ID NO: 9292022 - DNA, 23 bp, Homo sapiens
tgggtcagctgcctccaggacaa

SEQ ID NO: 9292023 - DNA, 22 bp, Homo sapiens
tgggtcaggctgggagtcctga

SEQ ID NO: 9292024 - DNA, 22 bp, Homo sapiens
cagtggctgtttctggaaggca

SEQ ID NO: 9292025 - DNA, 22 bp, Homo sapiens
cagtggctggttagggacagga

SEQ ID NO: 9292026 - DNA, 22 bp, Homo sapiens
cagtggggaggccaggatagaa

SEQ ID NO: 9292027 - DNA, 22 bp, Homo sapiens
cagtgggggggccatgctgcag

SEQ ID NO: 9292028 - DNA, 22 bp, Homo sapiens
cagtggggggactgaggcctga

SEQ ID NO: 9292029 - DNA, 22 bp, Homo sapiens
cagtgggggtgaggccgaggta

SEQ ID NO: 9292030 - DNA, 22 bp, Homo sapiens
cagtgggtaaataagtgggtaa

SEQ ID NO: 9292031 - DNA, 22 bp, Homo sapiens
cagtgggtagtggggattagca

SEQ ID NO: 9292032 - DNA, 22 bp, Homo sapiens
cagtgggtaggaaaggctcttc

SEQ ID NO: 9292033 - DNA, 22 bp, Homo sapiens
cagtgggtatttactgattcct

SEQ ID NO: 9292034 - DNA, 22 bp, Homo sapiens
cagtgggtcctaagtacagttc

SEQ ID NO: 9292035 - DNA, 22 bp, Homo sapiens
cagtgggaatgaagtggaggcc

SEQ ID NO: 9292036 - DNA, 22 bp, Homo sapiens
cagtgggatatgggggcagcat

SEQ ID NO: 9292037 - DNA, 22 bp, Homo sapiens
tcagagaaaggccaaaatatca

SEQ ID NO: 9292038 - DNA, 22 bp, Homo sapiens
cataaactctctgtaccaatat

SEQ ID NO: 9292039 - DNA, 22 bp, Homo sapiens
cataaagttaagctgtaagtat

SEQ ID NO: 9292040 - DNA, 22 bp, Homo sapiens
tcagctttgccaccagctgtaa

SEQ ID NO: 9292041 - DNA, 22 bp, Homo sapiens
tcacagagaactataatccatc

SEQ ID NO: 9292042 - DNA, 22 bp, Homo sapiens
tcacagagaaatgtggcacaaa

SEQ ID NO: 9292043 - DNA, 22 bp, Homo sapiens
tcacagagaaaagctatcacaa

SEQ ID NO: 9292044 - DNA, 22 bp, Homo sapiens
tcacaacgcctctgcaaatcct

SEQ ID NO: 9292045 - DNA, 22 bp, Homo sapiens
tcacaaatttcagctccctgaa

SEQ ID NO: 9292046 - DNA, 22 bp, Homo sapiens
tatttgaaagtgtacaaaaact

SEQ ID NO: 9292047 - DNA, 22 bp, Homo sapiens
tcacagacctggtgggaggtgg

SEQ ID NO: 9292048 - DNA, 22 bp, Homo sapiens
cagtgaggaagctgtctggacc

SEQ ID NO: 9292049 - DNA, 22 bp, Homo sapiens
tatttataacagtgagaacggg

SEQ ID NO: 9292050 - DNA, 22 bp, Homo sapiens
tatttcaggtatggtgtgaaat

SEQ ID NO: 9292051 - DNA, 22 bp, Homo sapiens
tatttcagtcacttcttctctg

SEQ ID NO: 9292052 - DNA, 22 bp, Homo sapiens
caggttggggacttaggatgac

SEQ ID NO: 9292053 - DNA, 22 bp, Homo sapiens
caggttggtattcatctccaca

SEQ ID NO: 9292054 - DNA, 22 bp, Homo sapiens
caggttggtcggcaagtacaca

SEQ ID NO: 9292055 - DNA, 22 bp, Homo sapiens
caggtggtcaggcagatgggct

SEQ ID NO: 9292056 - DNA, 22 bp, Homo sapiens
cagtagggaatgtgggaggctg

SEQ ID NO: 9292057 - DNA, 22 bp, Homo sapiens
cagtagtagttaaactgtgtat

SEQ ID NO: 9292058 - DNA, 21 bp, Homo sapiens
tatttctttgactctctccct

SEQ ID NO: 9292059 - DNA, 22 bp, Homo sapiens
tatttctttcaggtatgtgttg

SEQ ID NO: 9292060 - DNA, 22 bp, Homo sapiens
tagtgataatgtttatgctttt

SEQ ID NO: 9292061 - DNA, 22 bp, Homo sapiens
tatcatgtccctaaagagagga

SEQ ID NO: 9292062 - DNA, 22 bp, Homo sapiens
tatcatgtctggagatactttt

SEQ ID NO: 9292063 - DNA, 22 bp, Homo sapiens
tagggccagttagggaagcttt

SEQ ID NO: 9292064 - DNA, 18 bp, Homo sapiens
tagggccaaaatggaaaa

SEQ ID NO: 9292065 - DNA, 22 bp, Homo sapiens
tagggcagtttcatgttatctt

SEQ ID NO: 9292066 - DNA, 22 bp, Homo sapiens
tagggctcgggcacaggacagg

SEQ ID NO: 9292067 - DNA, 22 bp, Homo sapiens
tagggctccactcccagagatt

SEQ ID NO: 9292068 - DNA, 21 bp, Homo sapiens
tagggcaggcattggaagaga

SEQ ID NO: 9292069 - DNA, 22 bp, Homo sapiens
tagggcaggggaggaatctgaa

SEQ ID NO: 9292070 - DNA, 22 bp, Homo sapiens
tagggcaggtgaagaaaagcta

SEQ ID NO: 9292071 - DNA, 22 bp, Homo sapiens
tagggcagttataacattagtg

SEQ ID NO: 9292072 - DNA, 21 bp, Homo sapiens
tagggcaggcattggaagaga

SEQ ID NO: 9292073 - DNA, 22 bp, Homo sapiens
tagggacaaagagctgaggcct

SEQ ID NO: 9292074 - DNA, 19 bp, Homo sapiens
taggtaggtaggtaggtat

SEQ ID NO: 9292075 - DNA, 22 bp, Homo sapiens
taggtaggtaaacaggactaat

SEQ ID NO: 9292076 - DNA, 22 bp, Homo sapiens
cagggcagagccaggatttcaa

SEQ ID NO: 9292077 - DNA, 22 bp, Homo sapiens
cagggcagagggaaactccttt

SEQ ID NO: 9292078 - DNA, 22 bp, Homo sapiens
cagggcaggaatttgacattgc

SEQ ID NO: 9292079 - DNA, 22 bp, Homo sapiens
cagggcagcttcctttgttagg

SEQ ID NO: 9292080 - DNA, 22 bp, Homo sapiens
cagggcagccaggccccgtggg

SEQ ID NO: 9292081 - DNA, 22 bp, Homo sapiens
taggaacacatcctcctctagc

SEQ ID NO: 9292082 - DNA, 22 bp, Homo sapiens
tagctttaagatgagatgtgga

SEQ ID NO: 9292083 - DNA, 22 bp, Homo sapiens
cagggctcactcggctggcgtc

SEQ ID NO: 9292084 - DNA, 22 bp, Homo sapiens
taggagaagagtcagggcctaa

SEQ ID NO: 9292085 - DNA, 19 bp, Homo sapiens
taggaccctggtggccccc

SEQ ID NO: 9292086 - DNA, 22 bp, Homo sapiens
tagcgatcaggattaaagtcca

SEQ ID NO: 9292087 - DNA, 22 bp, Homo sapiens
cagggcagaacatatagatagt

SEQ ID NO: 9292088 - DNA, 22 bp, Homo sapiens
cagggcagaaggcactctactc

SEQ ID NO: 9292089 - DNA, 20 bp, Homo sapiens
tagagcttaggttttattct

SEQ ID NO: 9292090 - DNA, 23 bp, Homo sapiens
tagagcttcagcgaatgtgctca

SEQ ID NO: 9292091 - DNA, 22 bp, Homo sapiens
tagaatatgtggtgtatacttt

SEQ ID NO: 9292092 - DNA, 22 bp, Homo sapiens
tagaatatgtggtgtatacttt

SEQ ID NO: 9292093 - DNA, 18 bp, Homo sapiens
tagaatcaaatattttac

SEQ ID NO: 9292094 - DNA, 22 bp, Homo sapiens
tagaatatgtggtgtatacttt

SEQ ID NO: 9292095 - DNA, 22 bp, Homo sapiens
caggctgggcagcctccccggc

SEQ ID NO: 9292096 - DNA, 22 bp, Homo sapiens
caggctgggctccggagataaa

SEQ ID NO: 9292097 - DNA, 22 bp, Homo sapiens
gtgagggcagaacccccaggcc

SEQ ID NO: 9292098 - DNA, 22 bp, Homo sapiens
tagaatatgattaattttctta

SEQ ID NO: 9292099 - DNA, 22 bp, Homo sapiens
tagaatatacactacagcttaa

SEQ ID NO: 9292100 - DNA, 22 bp, Homo sapiens
caggctggagtgcaatgacgcc

SEQ ID NO: 9292101 - DNA, 22 bp, Homo sapiens
caggctggagtgcaatgacgcc

SEQ ID NO: 9292102 - DNA, 22 bp, Homo sapiens
caggctggagtgcaatggcaca

SEQ ID NO: 9292103 - DNA, 22 bp, Homo sapiens
tcccggcgctgggaggtgggtc

SEQ ID NO: 9292104 - DNA, 22 bp, Homo sapiens
cattgattatggaaagcagtgg

SEQ ID NO: 9292105 - DNA, 22 bp, Homo sapiens
cattcattagaatagatatgta

SEQ ID NO: 9292106 - DNA, 22 bp, Homo sapiens
cattcattacactcataaggtt

SEQ ID NO: 9292107 - DNA, 22 bp, Homo sapiens
cattcactcagcgatgccagta

SEQ ID NO: 9292108 - DNA, 22 bp, Homo sapiens
cattcacagagggggaagcatc

SEQ ID NO: 9292109 - DNA, 22 bp, Homo sapiens
cattcacaaaaccacatgccat

SEQ ID NO: 9292110 - DNA, 22 bp, Homo sapiens
catgttctaacaatgagaaacc

SEQ ID NO: 9292111 - DNA, 22 bp, Homo sapiens
catgttctaatattgtgacata

SEQ ID NO: 9292112 - DNA, 19 bp, Homo sapiens
catgttatgctgtagtatc

SEQ ID NO: 9292113 - DNA, 19 bp, Homo sapiens
catgttatgctgtagtatc

SEQ ID NO: 9292114 - DNA, 22 bp, Homo sapiens
catgttatttatccattaaaca

SEQ ID NO: 9292115 - DNA, 22 bp, Homo sapiens
catgtttctgagaaaagtagga

SEQ ID NO: 9292116 - DNA, 22 bp, Homo sapiens
catgtttaattgcgatgtttga

SEQ ID NO: 9292117 - DNA, 22 bp, Homo sapiens
tcccagccaggctctaccactt

SEQ ID NO: 9292118 - DNA, 22 bp, Homo sapiens
tcccagccacagtttccacctg

SEQ ID NO: 9292119 - DNA, 22 bp, Homo sapiens
cattcattcagcaactgttatt

SEQ ID NO: 9292120 - DNA, 22 bp, Homo sapiens
cattcattcacattttgtctat

SEQ ID NO: 9292121 - DNA, 22 bp, Homo sapiens
cattcattctgtaagtaactat

SEQ ID NO: 9292122 - DNA, 22 bp, Homo sapiens
cattcatttactttcaacagct

SEQ ID NO: 9292123 - DNA, 22 bp, Homo sapiens
cattcatttactttcaacagct

SEQ ID NO: 9292124 - DNA, 22 bp, Homo sapiens
tcccagagcccaagttggagag

SEQ ID NO: 9292125 - DNA, 22 bp, Homo sapiens
tcccagagctctggaggttgga

SEQ ID NO: 9292126 - DNA, 22 bp, Homo sapiens
catgtgtccacccttgaacaca

SEQ ID NO: 9292127 - DNA, 22 bp, Homo sapiens
tccaggctccctcaggatgcac

SEQ ID NO: 9292128 - DNA, 21 bp, Homo sapiens
catgtgtcattggagagcaat

SEQ ID NO: 9292129 - DNA, 20 bp, Homo sapiens
catgtgtcagttctcaccca

SEQ ID NO: 9292130 - DNA, 22 bp, Homo sapiens
tccaggctcccctgcgtgctcc

SEQ ID NO: 9292131 - DNA, 22 bp, Homo sapiens
tccagctggcccggccatgaat

SEQ ID NO: 9292132 - DNA, 22 bp, Homo sapiens
tccagctggcttcggaagtgga

SEQ ID NO: 9292133 - DNA, 22 bp, Homo sapiens
tccagctgcaaggggcacagct

SEQ ID NO: 9292134 - DNA, 22 bp, Homo sapiens
tccagctgaggtggcctctgtg

SEQ ID NO: 9292135 - DNA, 22 bp, Homo sapiens
tccagctgctgccagccaagct

SEQ ID NO: 9292136 - DNA, 22 bp, Homo sapiens
tccagctgctgacccagtagcc

SEQ ID NO: 9292137 - DNA, 21 bp, Homo sapiens
tccagctgcacaagcatgggg

SEQ ID NO: 9292138 - DNA, 23 bp, Homo sapiens
tccagctgcagtgggatggggaa

SEQ ID NO: 9292139 - DNA, 22 bp, Homo sapiens
tccagagagccacggacagggg

SEQ ID NO: 9292140 - DNA, 22 bp, Homo sapiens
tcattcatctggtgttagtcct

SEQ ID NO: 9292141 - DNA, 23 bp, Homo sapiens
tcattccacaaatacttatctag

SEQ ID NO: 9292142 - DNA, 21 bp, Homo sapiens
tcatttattgagaaatgactg

SEQ ID NO: 9292143 - DNA, 22 bp, Homo sapiens
tcatttatgtctttgccatcca

SEQ ID NO: 9292144 - DNA, 22 bp, Homo sapiens
tcatttatgcaggaatggcata

SEQ ID NO: 9292145 - DNA, 22 bp, Homo sapiens
tcatttatgcaggaatggcata

SEQ ID NO: 9292146 - DNA, 22 bp, Homo sapiens
tcatttatcgctgccttttaaa

SEQ ID NO: 9292147 - DNA, 22 bp, Homo sapiens
tcattccctcattgttcactgg

SEQ ID NO: 9292148 - DNA, 22 bp, Homo sapiens
tcatttatttgactttggagtg

SEQ ID NO: 9292149 - DNA, 22 bp, Homo sapiens
tcatttatttataccattgcct

SEQ ID NO: 9292150 - DNA, 22 bp, Homo sapiens
tccacattagaatgttttctca

SEQ ID NO: 9292151 - DNA, 22 bp, Homo sapiens
tccacatagtcattaatttctg

SEQ ID NO: 9292152 - DNA, 22 bp, Homo sapiens
tctccacaccagaaggagctga

SEQ ID NO: 9292153 - DNA, 22 bp, Homo sapiens
tctccacactttctctcccagg

SEQ ID NO: 9292154 - DNA, 22 bp, Homo sapiens
tctcaagctagtgtttatagta

SEQ ID NO: 9292155 - DNA, 22 bp, Homo sapiens
tctcaagcttgttggtatgttt

SEQ ID NO: 9292156 - DNA, 22 bp, Homo sapiens
tctcaagagggaggcaatcatg

SEQ ID NO: 9292157 - DNA, 22 bp, Homo sapiens
ccacctgagataagagagctca

SEQ ID NO: 9292158 - DNA, 22 bp, Homo sapiens
ccacctcctcggccatgtgacg

SEQ ID NO: 9292159 - DNA, 22 bp, Homo sapiens
tctccctctgtaagatcagggg

SEQ ID NO: 9292160 - DNA, 22 bp, Homo sapiens
tctccctctcagatttattcac

SEQ ID NO: 9292161 - DNA, 22 bp, Homo sapiens
tctccctctcagatttattcac

SEQ ID NO: 9292162 - DNA, 22 bp, Homo sapiens
tctccctcattcctgcttccat

SEQ ID NO: 9292163 - DNA, 22 bp, Homo sapiens
tctcccacggtacaggataaac

SEQ ID NO: 9292164 - DNA, 22 bp, Homo sapiens
ccagagaggcaaaactccttcc

SEQ ID NO: 9292165 - DNA, 22 bp, Homo sapiens
ccagagaggccaaggtcgtggt

SEQ ID NO: 9292166 - DNA, 22 bp, Homo sapiens
tctcccacagtctcccatggct

SEQ ID NO: 9292167 - DNA, 23 bp, Homo sapiens
tctccctgaggttgttagcatta

SEQ ID NO: 9292168 - DNA, 22 bp, Homo sapiens
tctccctctttgtctgctttgg

SEQ ID NO: 9292169 - DNA, 20 bp, Homo sapiens
tctccctgcccatctcagat

SEQ ID NO: 9292170 - DNA, 22 bp, Homo sapiens
tctccctggagccctgaagcat

SEQ ID NO: 9292171 - DNA, 22 bp, Homo sapiens
tctccctggagccctgaagcat

SEQ ID NO: 9292172 - DNA, 19 bp, Homo sapiens
ccagagagctaggtacaga

SEQ ID NO: 9292173 - DNA, 22 bp, Homo sapiens
ccagagagattgcttctaaaga

SEQ ID NO: 9292174 - DNA, 19 bp, Homo sapiens
ccaccctgggagctcactc

SEQ ID NO: 9292175 - DNA, 22 bp, Homo sapiens
tcctttccagcctcacctcagc

SEQ ID NO: 9292176 - DNA, 22 bp, Homo sapiens
ccaccagaccaccaagagcaac

SEQ ID NO: 9292177 - DNA, 22 bp, Homo sapiens
tcctctccatgtctcacgccac

SEQ ID NO: 9292178 - DNA, 22 bp, Homo sapiens
ccacattctcatgtaatccttt

SEQ ID NO: 9292179 - DNA, 21 bp, Homo sapiens
ccacattctcattctgactgc

SEQ ID NO: 9292180 - DNA, 22 bp, Homo sapiens
ccacattcaccagctgcacgac

SEQ ID NO: 9292181 - DNA, 22 bp, Homo sapiens
ccacattcatcagttgttaatg

SEQ ID NO: 9292182 - DNA, 22 bp, Homo sapiens
ccacattcagtccaggcttgga

SEQ ID NO: 9292183 - DNA, 22 bp, Homo sapiens
ccacattcactcatttcattgt

SEQ ID NO: 9292184 - DNA, 22 bp, Homo sapiens
tcctgactccaggtcctgtgtg

SEQ ID NO: 9292185 - DNA, 22 bp, Homo sapiens
tctctgtgtgtgtgacagcatt

SEQ ID NO: 9292186 - DNA, 22 bp, Homo sapiens
tctctgtgtgttggctgtatat

SEQ ID NO: 9292187 - DNA, 22 bp, Homo sapiens
tctgaaatgaactcttgaactt

SEQ ID NO: 9292188 - DNA, 22 bp, Homo sapiens
tctgaaatgacctttccccact

SEQ ID NO: 9292189 - DNA, 22 bp, Homo sapiens
tctctgtgtgccttcatctgcc

SEQ ID NO: 9292190 - DNA, 22 bp, Homo sapiens
tctctgtgtgggagatcttttt

SEQ ID NO: 9292191 - DNA, 22 bp, Homo sapiens
ccagcatttgcttaatttggag

SEQ ID NO: 9292192 - DNA, 22 bp, Homo sapiens
ccagcccttagataaacctggc

SEQ ID NO: 9292193 - DNA, 22 bp, Homo sapiens
ccagccctgtcaccaactggag

SEQ ID NO: 9292194 - DNA, 22 bp, Homo sapiens
tctctgcccatcctcagtccac

SEQ ID NO: 9292195 - DNA, 22 bp, Homo sapiens
tctctgccacagcttctgcctt

SEQ ID NO: 9292196 - DNA, 21 bp, Homo sapiens
tctctgggaggacttgtgaga

SEQ ID NO: 9292197 - DNA, 22 bp, Homo sapiens
tctctgcatccccagggctctc

SEQ ID NO: 9292198 - DNA, 22 bp, Homo sapiens
tctctgcatgacccaaggctga

SEQ ID NO: 9292199 - DNA, 22 bp, Homo sapiens
ttgcagagatcagcaggtttga

SEQ ID NO: 9292200 - DNA, 22 bp, Homo sapiens
ttgcatggaggaacatggccca

SEQ ID NO: 9292201 - DNA, 22 bp, Homo sapiens
ttgcatggggattggagcacag

SEQ ID NO: 9292202 - DNA, 22 bp, Homo sapiens
ttggaaagtttttactgaagac

SEQ ID NO: 9292203 - DNA, 22 bp, Homo sapiens
ttggaaagaagggctgagcaag

SEQ ID NO: 9292204 - DNA, 22 bp, Homo sapiens
ttggaaagggaggaatgtagac

SEQ ID NO: 9292205 - DNA, 22 bp, Homo sapiens
ttggaaaatgtatttctagaag

SEQ ID NO: 9292206 - DNA, 22 bp, Homo sapiens
ttggaaacgtcaccttttcctt

SEQ ID NO: 9292207 - DNA, 22 bp, Homo sapiens
ttgctgagagcgtgtcaacaag

SEQ ID NO: 9292208 - DNA, 22 bp, Homo sapiens
ttgtaaactgttaaaagccaga

SEQ ID NO: 9292209 - DNA, 22 bp, Homo sapiens
ttgtaaactgctgcaggagtgc

SEQ ID NO: 9292210 - DNA, 21 bp, Homo sapiens
ttgtaccttagagcacaccct

SEQ ID NO: 9292211 - DNA, 22 bp, Homo sapiens
ttgtatttcgatgcacgtgtag

SEQ ID NO: 9292212 - DNA, 22 bp, Homo sapiens
ttgtacaagttttgagcttaag

SEQ ID NO: 9292213 - DNA, 22 bp, Homo sapiens
ttgtacaagtattatgtgaaca

SEQ ID NO: 9292214 - DNA, 21 bp, Homo sapiens
ttgtgtccttctaaagggcca

SEQ ID NO: 9292215 - DNA, 22 bp, Homo sapiens
ttgtgtcctctaatctcaccac

SEQ ID NO: 9292216 - DNA, 22 bp, Homo sapiens
ttgtgtcctgatttgacacaat

SEQ ID NO: 9292217 - DNA, 22 bp, Homo sapiens
ttgtgtccctgcggctgaggag

SEQ ID NO: 9292218 - DNA, 22 bp, Homo sapiens
ttgtgtccctgtaagacaaagc

SEQ ID NO: 9292219 - DNA, 22 bp, Homo sapiens
ttgtgtccctggagcttctgtg

SEQ ID NO: 9292220 - DNA, 22 bp, Homo sapiens
ttgtgtcctaacatctagttaa

SEQ ID NO: 9292221 - DNA, 22 bp, Homo sapiens
ttgtgtcctatatgcatgttct

SEQ ID NO: 9292222 - DNA, 22 bp, Homo sapiens
ttgtgtcctaagcaccagatgg

SEQ ID NO: 9292223 - DNA, 22 bp, Homo sapiens
ttgtgtccaaggctatggtgat

SEQ ID NO: 9292224 - DNA, 22 bp, Homo sapiens
ttgtgtccatttgagtcatgtg

SEQ ID NO: 9292225 - DNA, 22 bp, Homo sapiens
ttgtgtcccctgttctacctgt

SEQ ID NO: 9292226 - DNA, 22 bp, Homo sapiens
ttgtgtccccctttgagagcca

SEQ ID NO: 9292227 - DNA, 22 bp, Homo sapiens
ttgtcctggaggttaatagagt

SEQ ID NO: 9292228 - DNA, 22 bp, Homo sapiens
ttgtcctgcaacctcacatggc

SEQ ID NO: 9292229 - DNA, 23 bp, Homo sapiens
ttgtcctctggatcggtttggtt

SEQ ID NO: 9292230 - DNA, 23 bp, Homo sapiens
ttgtccagctggtttgggccaca

SEQ ID NO: 9292231 - DNA, 22 bp, Homo sapiens
ttggccagtgaaccaggcctgg

SEQ ID NO: 9292232 - DNA, 22 bp, Homo sapiens
ttggccagtgcttgtgattttc

SEQ ID NO: 9292233 - DNA, 22 bp, Homo sapiens
ttggccaggtgtaggtcacacc

SEQ ID NO: 9292234 - DNA, 22 bp, Homo sapiens
ttggccaggtgtccagcccagg

SEQ ID NO: 9292235 - DNA, 22 bp, Homo sapiens
ttggccagtggaaagaggagga

SEQ ID NO: 9292236 - DNA, 22 bp, Homo sapiens
ttggccagcagctctggcttag

SEQ ID NO: 9292237 - DNA, 22 bp, Homo sapiens
ttggccagcgacgaccttctta

SEQ ID NO: 9292238 - DNA, 22 bp, Homo sapiens
ttggccaggtccatttctccat

SEQ ID NO: 9292239 - DNA, 22 bp, Homo sapiens
ttggccaggcatgaataaaaga

SEQ ID NO: 9292240 - DNA, 22 bp, Homo sapiens
ttggccagctctggaaagtggt

SEQ ID NO: 9292241 - DNA, 22 bp, Homo sapiens
ttgggaagaggcccctggattc

SEQ ID NO: 9292242 - DNA, 22 bp, Homo sapiens
ttgggaagtaatatggtggtct

SEQ ID NO: 9292243 - DNA, 22 bp, Homo sapiens
ttgggaagtaatatggtggtct

SEQ ID NO: 9292244 - DNA, 22 bp, Homo sapiens
ttgggaagtttaatgacagact

SEQ ID NO: 9292245 - DNA, 22 bp, Homo sapiens
ttgggaagaatggaggtggtta

SEQ ID NO: 9292246 - DNA, 22 bp, Homo sapiens
ttgggaagaatggaggtggtta

SEQ ID NO: 9292247 - DNA, 22 bp, Homo sapiens
ttgggaagtttaatgacagact

SEQ ID NO: 9292248 - DNA, 17 bp, Homo sapiens
ttgggagagaaaggtat

SEQ ID NO: 9292249 - DNA, 22 bp, Homo sapiens
ttgggagacaaaggctctgtct

SEQ ID NO: 9292250 - DNA, 22 bp, Homo sapiens
ttgggacatctggcatacagtt

SEQ ID NO: 9292251 - DNA, 17 bp, Homo sapiens
ttgggagagaaaggtat

SEQ ID NO: 9292252 - DNA, 22 bp, Homo sapiens
ttgggcagtgattagttcatga

SEQ ID NO: 9292253 - DNA, 22 bp, Homo sapiens
ttgggcaggtgaagagagggct

SEQ ID NO: 9292254 - DNA, 22 bp, Homo sapiens
ttgggcagtagcctcttggtgt

SEQ ID NO: 9292255 - DNA, 22 bp, Homo sapiens
ttgggcagggaaaggacaggca

SEQ ID NO: 9292256 - DNA, 22 bp, Homo sapiens
ttggcagggctgcttgtctagg

SEQ ID NO: 9292257 - DNA, 23 bp, Homo sapiens
ttggagagggtgagtagtgtcag

SEQ ID NO: 9292258 - DNA, 22 bp, Homo sapiens
ttggagagatttaggtctcagt

SEQ ID NO: 9292259 - DNA, 22 bp, Homo sapiens
tttatctgaggaaagcagacaa

SEQ ID NO: 9292260 - DNA, 22 bp, Homo sapiens
tttattcaagatgaggttcatg

SEQ ID NO: 9292261 - DNA, 22 bp, Homo sapiens
tttatatatggctggtctggat

SEQ ID NO: 9292262 - DNA, 22 bp, Homo sapiens
tttagatgctgtatgttatttc

SEQ ID NO: 9292263 - DNA, 22 bp, Homo sapiens
tttacatttccctctgtcagtt

SEQ ID NO: 9292264 - DNA, 20 bp, Homo sapiens
tttacattttgaaacagtga

SEQ ID NO: 9292265 - DNA, 20 bp, Homo sapiens
tttaccaaaggagttatgat

SEQ ID NO: 9292266 - DNA, 22 bp, Homo sapiens
tttaaatgtttatagagagtac

SEQ ID NO: 9292267 - DNA, 22 bp, Homo sapiens
tttaaatgtgttcttagtagct

SEQ ID NO: 9292268 - DNA, 22 bp, Homo sapiens
tttaaatggcattttcccagat

SEQ ID NO: 9292269 - DNA, 22 bp, Homo sapiens
tttaatgatagctgtttcacat

SEQ ID NO: 9292270 - DNA, 23 bp, Homo sapiens
tttaatgaccaatagaaggaaca

SEQ ID NO: 9292271 - DNA, 22 bp, Homo sapiens
tttaatgtagcgtgaaatgatt

SEQ ID NO: 9292272 - DNA, 22 bp, Homo sapiens
tttcacaattttaaggagcaaa

SEQ ID NO: 9292273 - DNA, 22 bp, Homo sapiens
tttcacagaaagaagctagttt

SEQ ID NO: 9292274 - DNA, 23 bp, Homo sapiens
tttcacagaaggattgtagggcc

SEQ ID NO: 9292275 - DNA, 22 bp, Homo sapiens
tttcacagaactcactaaggag

SEQ ID NO: 9292276 - DNA, 22 bp, Homo sapiens
tttcacagatcctacagcttgt

SEQ ID NO: 9292277 - DNA, 22 bp, Homo sapiens
tttattgaacacttgcactggc

SEQ ID NO: 9292278 - DNA, 22 bp, Homo sapiens
tttattgaattgtaaccctatt

SEQ ID NO: 9292279 - DNA, 22 bp, Homo sapiens
tttattgaacacttgcactggc

SEQ ID NO: 9292280 - DNA, 19 bp, Homo sapiens
tttattcacctttaccttg

SEQ ID NO: 9292281 - DNA, 22 bp, Homo sapiens
tttattgagtatctactatgtg

SEQ ID NO: 9292282 - DNA, 22 bp, Homo sapiens
tttattgagcacccgttgtgcg

SEQ ID NO: 9292283 - DNA, 22 bp, Homo sapiens
tttattgagtatctactatgtg

SEQ ID NO: 9292284 - DNA, 20 bp, Homo sapiens
tttattgagcacgtactgtg

SEQ ID NO: 9292285 - DNA, 22 bp, Homo sapiens
tttattgacccaaagcgagagt

SEQ ID NO: 9292286 - DNA, 20 bp, Homo sapiens
tttattgagcacgtactgtg

SEQ ID NO: 9292287 - DNA, 22 bp, Homo sapiens
tttattgacttcagtgagtctt

SEQ ID NO: 9292288 - DNA, 22 bp, Homo sapiens
tttattgagcacccgttgtgcg

SEQ ID NO: 9292289 - DNA, 22 bp, Homo sapiens
tttattgaattgtaaccctatt

SEQ ID NO: 9292290 - DNA, 22 bp, Homo sapiens
tttattgacccaaagcgagagt

SEQ ID NO: 9292291 - DNA, 22 bp, Homo sapiens
tttattgacccaaagcgagagt

SEQ ID NO: 9292292 - DNA, 22 bp, Homo sapiens
tttattgacttcagtgagtctt

SEQ ID NO: 9292293 - DNA, 22 bp, Homo sapiens
tttcatgtatttcccaaagctt

SEQ ID NO: 9292294 - DNA, 22 bp, Homo sapiens
tttcatgtggcgatgtctctgg

SEQ ID NO: 9292295 - DNA, 22 bp, Homo sapiens
tttcattgagactatagacatc

SEQ ID NO: 9292296 - DNA, 21 bp, Homo sapiens
tttcattgaatgagataaggt

SEQ ID NO: 9292297 - DNA, 22 bp, Homo sapiens
tttcattgagaatataagattt

SEQ ID NO: 9292298 - DNA, 22 bp, Homo sapiens
tttcattatgttcctggaagag

SEQ ID NO: 9292299 - DNA, 22 bp, Homo sapiens
tttcattgaactaaagaatctg

SEQ ID NO: 9292300 - DNA, 21 bp, Homo sapiens
tttcattgaatgagataaggt

SEQ ID NO: 9292301 - DNA, 22 bp, Homo sapiens
tttcattatacagcttcataaa

SEQ ID NO: 9292302 - DNA, 22 bp, Homo sapiens
tttcattattcatgctagttat

SEQ ID NO: 9292303 - DNA, 22 bp, Homo sapiens
tttcacctcagtctttttatat

SEQ ID NO: 9292304 - DNA, 22 bp, Homo sapiens
tttcacagcatataggtgtact

SEQ ID NO: 9292305 - DNA, 22 bp, Homo sapiens
tttcacagctgggaagagatat

SEQ ID NO: 9292306 - DNA, 22 bp, Homo sapiens
tttcacagctgggtggcagagt

SEQ ID NO: 9292307 - DNA, 22 bp, Homo sapiens
tttcagagagatcaacatagct

SEQ ID NO: 9292308 - DNA, 22 bp, Homo sapiens
ttagctttgaattccatggagg

SEQ ID NO: 9292309 - DNA, 22 bp, Homo sapiens
tcctgcctgtttacctgtactt

SEQ ID NO: 9292310 - DNA, 18 bp, Homo sapiens
tcctgcctgcgggctccc

SEQ ID NO: 9292311 - DNA, 19 bp, Homo sapiens
tcctgcctggggccgcctg

SEQ ID NO: 9292312 - DNA, 18 bp, Homo sapiens
tcctgcctgtgccccagg

SEQ ID NO: 9292313 - DNA, 22 bp, Homo sapiens
tcctgcctgtttacctgtactt

SEQ ID NO: 9292314 - DNA, 19 bp, Homo sapiens
tcctgcctggggccgcctg

SEQ ID NO: 9292315 - DNA, 18 bp, Homo sapiens
tcctgcctgtgccccagg

SEQ ID NO: 9292316 - DNA, 22 bp, Homo sapiens
ttagccataattgtttttccca

SEQ ID NO: 9292317 - DNA, 22 bp, Homo sapiens
ttagccatgatgagtatatttg

SEQ ID NO: 9292318 - DNA, 22 bp, Homo sapiens
ttagccatatagtgctcttgta

SEQ ID NO: 9292319 - DNA, 19 bp, Homo sapiens
ttagccatccacagtgaaa

SEQ ID NO: 9292320 - DNA, 22 bp, Homo sapiens
ttagccatgagctgggcgactc

SEQ ID NO: 9292321 - DNA, 22 bp, Homo sapiens
ttagccatatagaaaaagagct

SEQ ID NO: 9292322 - DNA, 22 bp, Homo sapiens
ttagccattctgataggtatgt

SEQ ID NO: 9292323 - DNA, 21 bp, Homo sapiens
ttagccattgggacattcagc

SEQ ID NO: 9292324 - DNA, 23 bp, Homo sapiens
ttagccattccactgacatttga

SEQ ID NO: 9292325 - DNA, 22 bp, Homo sapiens
ttagccattaatgtcctgtgca

SEQ ID NO: 9292326 - DNA, 22 bp, Homo sapiens
ttagccatgttgaagatttaga

SEQ ID NO: 9292327 - DNA, 22 bp, Homo sapiens
ttagccattaaattacaaggtg

SEQ ID NO: 9292328 - DNA, 22 bp, Homo sapiens
ttagccatgtgggaaaaacagc

SEQ ID NO: 9292329 - DNA, 22 bp, Homo sapiens
ttagccatgcttcttgggtcta

SEQ ID NO: 9292330 - DNA, 22 bp, Homo sapiens
ttagccatgccctagaagagga

SEQ ID NO: 9292331 - DNA, 22 bp, Homo sapiens
ttagccatggactgaattgact

SEQ ID NO: 9292332 - DNA, 16 bp, Homo sapiens
ttagccatggcattct

SEQ ID NO: 9292333 - DNA, 22 bp, Homo sapiens
ttagccattgtcagcacatggc

SEQ ID NO: 9292334 - DNA, 22 bp, Homo sapiens
ttagccatttgaggtcttcatt

SEQ ID NO: 9292335 - DNA, 22 bp, Homo sapiens
ttagccattttatacaagtgta

SEQ ID NO: 9292336 - DNA, 22 bp, Homo sapiens
ttagccattttattcagcaggt

SEQ ID NO: 9292337 - DNA, 22 bp, Homo sapiens
ttattgagcacctactatgtgt

SEQ ID NO: 9292338 - DNA, 22 bp, Homo sapiens
ttattgtagcactttggcagtg

SEQ ID NO: 9292339 - DNA, 22 bp, Homo sapiens
ttattgactgatcagagaggga

SEQ ID NO: 9292340 - DNA, 22 bp, Homo sapiens
ttattgacttattaattgtgct

SEQ ID NO: 9292341 - DNA, 22 bp, Homo sapiens
ttattgacttgtttgtcctggt

SEQ ID NO: 9292342 - DNA, 22 bp, Homo sapiens
ttattgactgaaatgagagtga

SEQ ID NO: 9292343 - DNA, 22 bp, Homo sapiens
ttattgactgatcagagaggga

SEQ ID NO: 9292344 - DNA, 22 bp, Homo sapiens
ttattgagcacatagtatgtgg

SEQ ID NO: 9292345 - DNA, 22 bp, Homo sapiens
ttattgagcaactctggggctc

SEQ ID NO: 9292346 - DNA, 22 bp, Homo sapiens
ttattgagagctgttttatggc

SEQ ID NO: 9292347 - DNA, 22 bp, Homo sapiens
ttattgagaccgtaagtcaggt

SEQ ID NO: 9292348 - DNA, 22 bp, Homo sapiens
ttattgagaccgtaagtcaggt

SEQ ID NO: 9292349 - DNA, 21 bp, Homo sapiens
ttattgagacatttgtggaaa

SEQ ID NO: 9292350 - DNA, 22 bp, Homo sapiens
ttattgactcccagcttttcca

SEQ ID NO: 9292351 - DNA, 22 bp, Homo sapiens
ttattgactatttgctatgtgt

SEQ ID NO: 9292352 - DNA, 22 bp, Homo sapiens
ttattgacacatctggatgttt

SEQ ID NO: 9292353 - DNA, 22 bp, Homo sapiens
ttattaggaactcaggattttt

SEQ ID NO: 9292354 - DNA, 22 bp, Homo sapiens
ttattaggaaaaggtcagatgt

SEQ ID NO: 9292355 - DNA, 22 bp, Homo sapiens
ttattagggtggtttatgttct

SEQ ID NO: 9292356 - DNA, 22 bp, Homo sapiens
ttattaggttattctctgtact

SEQ ID NO: 9292357 - DNA, 22 bp, Homo sapiens
ttattaggtttacataaaggtt

SEQ ID NO: 9292358 - DNA, 22 bp, Homo sapiens
ttatatgaactggactttagga

SEQ ID NO: 9292359 - DNA, 22 bp, Homo sapiens
ttcacagatgagaaaattgagg

SEQ ID NO: 9292360 - DNA, 22 bp, Homo sapiens
ttcacagatgcctgatgtgtgg

SEQ ID NO: 9292361 - DNA, 18 bp, Homo sapiens
ttcacagatccacaggaa

SEQ ID NO: 9292362 - DNA, 18 bp, Homo sapiens
ttcacagatccacaggaa

SEQ ID NO: 9292363 - DNA, 22 bp, Homo sapiens
ttcacagataacacaggcaaat

SEQ ID NO: 9292364 - DNA, 22 bp, Homo sapiens
ttcacagagcactgccaagtac

SEQ ID NO: 9292365 - DNA, 22 bp, Homo sapiens
ttcacagagcactgccaagtac

SEQ ID NO: 9292366 - DNA, 22 bp, Homo sapiens
ttcacagagagtatgcagagaa

SEQ ID NO: 9292367 - DNA, 22 bp, Homo sapiens
ttcacagagagaactcaaacca

SEQ ID NO: 9292368 - DNA, 22 bp, Homo sapiens
ttcacagagcttgttcatggcc

SEQ ID NO: 9292369 - DNA, 22 bp, Homo sapiens
ttcacagagcgggatgctggga

SEQ ID NO: 9292370 - DNA, 20 bp, Homo sapiens
ttcacagaggactcaggtca

SEQ ID NO: 9292371 - DNA, 22 bp, Homo sapiens
ttcacagagttatttttatgct

SEQ ID NO: 9292372 - DNA, 21 bp, Homo sapiens
ttcacagatgggaaaactgag

SEQ ID NO: 9292373 - DNA, 22 bp, Homo sapiens
ttcacagatgtattggaactcc

SEQ ID NO: 9292374 - DNA, 23 bp, Homo sapiens
ttcacagattaaatatttcttct

SEQ ID NO: 9292375 - DNA, 22 bp, Homo sapiens
ttcacagattgactggattcct

SEQ ID NO: 9292376 - DNA, 22 bp, Homo sapiens
ttcacagatttccctgcacatg

SEQ ID NO: 9292377 - DNA, 22 bp, Homo sapiens
ttcaaagaccttacttggcaaa

SEQ ID NO: 9292378 - DNA, 22 bp, Homo sapiens
ttcacagactttccatagattg

SEQ ID NO: 9292379 - DNA, 22 bp, Homo sapiens
ttcagagcatctctaaagccag

SEQ ID NO: 9292380 - DNA, 22 bp, Homo sapiens
ttcagagccacttcaagtctaa

SEQ ID NO: 9292381 - DNA, 22 bp, Homo sapiens
ttccaggctcccttggaggtgt

SEQ ID NO: 9292382 - DNA, 22 bp, Homo sapiens
ttccaggctatccggtgaaggg

SEQ ID NO: 9292383 - DNA, 22 bp, Homo sapiens
ttccaggcatgtcagacatagg

SEQ ID NO: 9292384 - DNA, 22 bp, Homo sapiens
ttccaggcttctctggggcgtc

SEQ ID NO: 9292385 - DNA, 22 bp, Homo sapiens
ttccaggctgatgggccacagg

SEQ ID NO: 9292386 - DNA, 22 bp, Homo sapiens
ttccagtgaccatagagtatgg

SEQ ID NO: 9292387 - DNA, 23 bp, Homo sapiens
ttccagtgagactgagaggtctt

SEQ ID NO: 9292388 - DNA, 22 bp, Homo sapiens
ttccagtgactaagcttctgct

SEQ ID NO: 9292389 - DNA, 23 bp, Homo sapiens
ttccaggcagagcagggattaga

SEQ ID NO: 9292390 - DNA, 22 bp, Homo sapiens
ttcagtgtgtcagtttcagcag

SEQ ID NO: 9292391 - DNA, 22 bp, Homo sapiens
ttcagttccatttcaggtgggt

SEQ ID NO: 9292392 - DNA, 22 bp, Homo sapiens
ttcattgcagttcttcaggtta

SEQ ID NO: 9292393 - DNA, 20 bp, Homo sapiens
ttctttgttccttacatttg

SEQ ID NO: 9292394 - DNA, 22 bp, Homo sapiens
ttcttcaattattggaaagaaa

SEQ ID NO: 9292395 - DNA, 22 bp, Homo sapiens
ttcttcaaaatccagcatgatt

SEQ ID NO: 9292396 - DNA, 21 bp, Homo sapiens
ttcttcaaagaagaaggcaca

SEQ ID NO: 9292397 - DNA, 19 bp, Homo sapiens
ttgaaattgtttgatatgg

SEQ ID NO: 9292398 - DNA, 17 bp, Homo sapiens
ttgaacctagacacctt

SEQ ID NO: 9292399 - DNA, 22 bp, Homo sapiens
ttgaaatatttgggagtgtttg

SEQ ID NO: 9292400 - DNA, 22 bp, Homo sapiens
ttctgtgttgtgacattctaga

SEQ ID NO: 9292401 - DNA, 22 bp, Homo sapiens
ttctgtctgtaaacttctcaat

SEQ ID NO: 9292402 - DNA, 22 bp, Homo sapiens
ttctggaatatttgacacaatt

SEQ ID NO: 9292403 - DNA, 22 bp, Homo sapiens
ttctctggggttcagtatctct

SEQ ID NO: 9292404 - DNA, 22 bp, Homo sapiens
ttctctgaaggccatgctcact

SEQ ID NO: 9292405 - DNA, 22 bp, Homo sapiens
ttctctcttactgccatgctgt

SEQ ID NO: 9292406 - DNA, 22 bp, Homo sapiens
ttctctctgtggtcccattttg

SEQ ID NO: 9292407 - DNA, 22 bp, Homo sapiens
ttctctgagatagactaagtgg

SEQ ID NO: 9292408 - DNA, 22 bp, Homo sapiens
ttctctgacccccttaaatatt

SEQ ID NO: 9292409 - DNA, 22 bp, Homo sapiens
ttctctgatcttgctagactga

SEQ ID NO: 9292410 - DNA, 21 bp, Homo sapiens
ttctctccatatgcccagccc

SEQ ID NO: 9292411 - DNA, 22 bp, Homo sapiens
ttctctctgagagcatctggaa

SEQ ID NO: 9292412 - DNA, 22 bp, Homo sapiens
ttctctcccatgaagcttctat

SEQ ID NO: 9292413 - DNA, 22 bp, Homo sapiens
ttctctaggttttagatgaaga

SEQ ID NO: 9292414 - DNA, 21 bp, Homo sapiens
ttctctacctctagtgctgta

SEQ ID NO: 9292415 - DNA, 22 bp, Homo sapiens
ttctctacttcacaagggatgg

SEQ ID NO: 9292416 - DNA, 22 bp, Homo sapiens
ttccttcttccaaacccatcat

SEQ ID NO: 9292417 - DNA, 22 bp, Homo sapiens
ttcctgcccctgagagctccca

SEQ ID NO: 9292418 - DNA, 22 bp, Homo sapiens
ttcctggctcacagcagtgggg

SEQ ID NO: 9292419 - DNA, 22 bp, Homo sapiens
ttcctggcgccacggagccggt

SEQ ID NO: 9292420 - DNA, 22 bp, Homo sapiens
ttcctggcctaaggtaggtgac

SEQ ID NO: 9292421 - DNA, 22 bp, Homo sapiens
ttcctggcctaaggtaggtgac

SEQ ID NO: 9292422 - DNA, 22 bp, Homo sapiens
ttcctggcatagagagggcaca

SEQ ID NO: 9292423 - DNA, 22 bp, Homo sapiens
ttcctggcagaggccccgacag

SEQ ID NO: 9292424 - DNA, 22 bp, Homo sapiens
ttcctggcactgcagtggttga

SEQ ID NO: 9292425 - DNA, 22 bp, Homo sapiens
ttcctggccccacccctggaga

SEQ ID NO: 9292426 - DNA, 22 bp, Homo sapiens
ttcctggccaagcagagtggaa

SEQ ID NO: 9292427 - DNA, 22 bp, Homo sapiens
ttcctgcacagcccttcctgag

SEQ ID NO: 9292428 - DNA, 22 bp, Homo sapiens
ttcctgcaaagccagatgtcga

SEQ ID NO: 9292429 - DNA, 22 bp, Homo sapiens
ttttcttactgtctgtgatcct

SEQ ID NO: 9292430 - DNA, 22 bp, Homo sapiens
ttttcttactgtctgtgatcct

SEQ ID NO: 9292431 - DNA, 22 bp, Homo sapiens
ttttcttatgtgcagctatatg

SEQ ID NO: 9292432 - DNA, 22 bp, Homo sapiens
ttttctcttccctctggacctg

SEQ ID NO: 9292433 - DNA, 22 bp, Homo sapiens
ttttccacagcaccataagatt

SEQ ID NO: 9292434 - DNA, 19 bp, Homo sapiens
ttttccacagaaatatgtt

SEQ ID NO: 9292435 - DNA, 22 bp, Homo sapiens
ttttattggagtgataccaagc

SEQ ID NO: 9292436 - DNA, 22 bp, Homo sapiens
ttttcacacaaggtgataagtt

SEQ ID NO: 9292437 - DNA, 22 bp, Homo sapiens
ttttcattgttactatgagcta

SEQ ID NO: 9292438 - DNA, 22 bp, Homo sapiens
ttttattgcaataaagtgtgta

SEQ ID NO: 9292439 - DNA, 22 bp, Homo sapiens
ttttattgcaataaagtgtgta

SEQ ID NO: 9292440 - DNA, 22 bp, Homo sapiens
ttttattgcaataaagtgtgta

SEQ ID NO: 9292441 - DNA, 22 bp, Homo sapiens
ttttattggagtgataccaagc

SEQ ID NO: 9292442 - DNA, 22 bp, Homo sapiens
ttttattggagtgataccaagc

SEQ ID NO: 9292443 - DNA, 22 bp, Homo sapiens
ttttattggagtgataccaagc

SEQ ID NO: 9292444 - DNA, 22 bp, Homo sapiens
ttttattggagtgataccaagc

SEQ ID NO: 9292445 - DNA, 22 bp, Homo sapiens
tttgttcaacaggtgaaataga

SEQ ID NO: 9292446 - DNA, 22 bp, Homo sapiens
tttgttaaaatgcagattctgt

SEQ ID NO: 9292447 - DNA, 22 bp, Homo sapiens
tttgtgttgtacttctgtgcat

SEQ ID NO: 9292448 - DNA, 22 bp, Homo sapiens
tttgtgtttatgaagttattct

SEQ ID NO: 9292449 - DNA, 22 bp, Homo sapiens
tttgttcaatccagacaatagc

SEQ ID NO: 9292450 - DNA, 22 bp, Homo sapiens
ttttaagaaatgtatgactgtc

SEQ ID NO: 9292451 - DNA, 22 bp, Homo sapiens
ttttaattcaaagtgaatagtg

SEQ ID NO: 9292452 - DNA, 22 bp, Homo sapiens
ttttaattgcaattatggtccc

SEQ ID NO: 9292453 - DNA, 22 bp, Homo sapiens
tttgcttgttcaagatttctgt

SEQ ID NO: 9292454 - DNA, 22 bp, Homo sapiens
tttgctttgggaggttgtctgg

SEQ ID NO: 9292455 - DNA, 22 bp, Homo sapiens
tttgatgacctgtatctttttc

SEQ ID NO: 9292456 - DNA, 22 bp, Homo sapiens
tttgatttactggatattctca

SEQ ID NO: 9292457 - DNA, 22 bp, Homo sapiens
tttgatttactggatattctca

SEQ ID NO: 9292458 - DNA, 22 bp, Homo sapiens
tttgaggttagctagcagatca

SEQ ID NO: 9292459 - DNA, 22 bp, Homo sapiens
tttgataacagtgaatatcatg

SEQ ID NO: 9292460 - DNA, 22 bp, Homo sapiens
tttggtgttggcttaaccagtt

SEQ ID NO: 9292461 - DNA, 22 bp, Homo sapiens
tttggaaatttcatcaatagcc

SEQ ID NO: 9292462 - DNA, 22 bp, Homo sapiens
tttggaaaaagcctgaacatag

SEQ ID NO: 9292463 - DNA, 22 bp, Homo sapiens
tttggaaacatctcagaaaata

SEQ ID NO: 9292464 - DNA, 22 bp, Homo sapiens
tttccctgaggcctggacatta

SEQ ID NO: 9292465 - DNA, 22 bp, Homo sapiens
tttcctctgactgctcccctgc

SEQ ID NO: 9292466 - DNA, 22 bp, Homo sapiens
tttcctctccggggcctccagg

SEQ ID NO: 9292467 - DNA, 22 bp, Homo sapiens
tttcctctccaccaggaggtct

SEQ ID NO: 9292468 - DNA, 22 bp, Homo sapiens
tttcttttgccctgtgggttag

SEQ ID NO: 9292469 - DNA, 22 bp, Homo sapiens
tttgacaacacgttatttgcct

SEQ ID NO: 9292470 - DNA, 22 bp, Homo sapiens
tttgacaataattgcatttata

SEQ ID NO: 9292471 - DNA, 22 bp, Homo sapiens
tttttataactcttttgtgaca

SEQ ID NO: 9292472 - DNA, 22 bp, Homo sapiens
cagcaggtgtctagcaagggtc

SEQ ID NO: 9292473 - DNA, 20 bp, Homo sapiens
gtctcaagtatctcacagtc

SEQ ID NO: 9292474 - DNA, 22 bp, Homo sapiens
gtcctctgtgtaggctgcagac

SEQ ID NO: 9292475 - DNA, 22 bp, Homo sapiens
gtcctctgttagaaatgtgctt

SEQ ID NO: 9292476 - DNA, 22 bp, Homo sapiens
gtcctctgttagaaatgtgctt

SEQ ID NO: 9292477 - DNA, 22 bp, Homo sapiens
gtcctctgtttccatctgactt

SEQ ID NO: 9292478 - DNA, 22 bp, Homo sapiens
gtcctgcaaagttcagcttgct

SEQ ID NO: 9292479 - DNA, 22 bp, Homo sapiens
gtctttcttcagagcttggact

SEQ ID NO: 9292480 - DNA, 22 bp, Homo sapiens
gtctctgttatttccagggtca

SEQ ID NO: 9292481 - DNA, 22 bp, Homo sapiens
gtctctgtgtctgagagagccc

SEQ ID NO: 9292482 - DNA, 22 bp, Homo sapiens
gtctcagttgtatcacctggtt

SEQ ID NO: 9292483 - DNA, 22 bp, Homo sapiens
gtctcagttactctccctggta

SEQ ID NO: 9292484 - DNA, 22 bp, Homo sapiens
gtctcagtgtcacctccagctg

SEQ ID NO: 9292485 - DNA, 22 bp, Homo sapiens
gtgcatcaatttcccatgtgtc

SEQ ID NO: 9292486 - DNA, 22 bp, Homo sapiens
gtgcatgcaaattactgtaaag

SEQ ID NO: 9292487 - DNA, 22 bp, Homo sapiens
gtgcatgcagtaagtgttttaa

SEQ ID NO: 9292488 - DNA, 22 bp, Homo sapiens
gtgcatgcacacatgtgtgagg

SEQ ID NO: 9292489 - DNA, 22 bp, Homo sapiens
gtgcatgccctaagatatttat

SEQ ID NO: 9292490 - DNA, 18 bp, Homo sapiens
gtgcatgcatgctctgcc

SEQ ID NO: 9292491 - DNA, 22 bp, Homo sapiens
gtgcatgctgcagtatgatttc

SEQ ID NO: 9292492 - DNA, 22 bp, Homo sapiens
gtgccctgacacacctggtgtg

SEQ ID NO: 9292493 - DNA, 22 bp, Homo sapiens
gtgctgagattggagtgagcag

SEQ ID NO: 9292494 - DNA, 22 bp, Homo sapiens
gtgctgagattacaggtgtgag

SEQ ID NO: 9292495 - DNA, 19 bp, Homo sapiens
gtgctgagatgtggtacta

SEQ ID NO: 9292496 - DNA, 22 bp, Homo sapiens
gtgctgagcacagctgcccagg

SEQ ID NO: 9292497 - DNA, 22 bp, Homo sapiens
gtgctgagcacaccttggagca

SEQ ID NO: 9292498 - DNA, 22 bp, Homo sapiens
gtgctgagcacaaggcccagag

SEQ ID NO: 9292499 - DNA, 22 bp, Homo sapiens
gtgctgaggagagggggtggtc

SEQ ID NO: 9292500 - DNA, 22 bp, Homo sapiens
gtgctgaggatataaaactcag

SEQ ID NO: 9292501 - DNA, 21 bp, Homo sapiens
gtgctgaggatacagtagtaa

SEQ ID NO: 9292502 - DNA, 22 bp, Homo sapiens
gtgctgaggatacagctgtgaa

SEQ ID NO: 9292503 - DNA, 22 bp, Homo sapiens
gtgctgagcatcatgaggcact

SEQ ID NO: 9292504 - DNA, 22 bp, Homo sapiens
gtgctgaggaaggaagacttat

SEQ ID NO: 9292505 - DNA, 22 bp, Homo sapiens
gtgctgagctgcagatgcgctc

SEQ ID NO: 9292506 - DNA, 22 bp, Homo sapiens
gtgctgagagtttattatgata

SEQ ID NO: 9292507 - DNA, 22 bp, Homo sapiens
gtgctgagatcttccctcactg

SEQ ID NO: 9292508 - DNA, 22 bp, Homo sapiens
gtgctgagaattgatgtccttg

SEQ ID NO: 9292509 - DNA, 22 bp, Homo sapiens
gtgctgaggccaatgtcagggt

SEQ ID NO: 9292510 - DNA, 20 bp, Homo sapiens
gtgctgagggctgggcaatg

SEQ ID NO: 9292511 - DNA, 22 bp, Homo sapiens
gtgctgaggtgggtgggcagcc

SEQ ID NO: 9292512 - DNA, 22 bp, Homo sapiens
gtgctgaggtacacaaattcta

SEQ ID NO: 9292513 - DNA, 22 bp, Homo sapiens
ggtgggaaggggccagtgtgcg

SEQ ID NO: 9292514 - DNA, 22 bp, Homo sapiens
ggtgtccttgtcctttggtacc

SEQ ID NO: 9292515 - DNA, 22 bp, Homo sapiens
ggtgtccttgttgaacgaaaat

SEQ ID NO: 9292516 - DNA, 22 bp, Homo sapiens
ggtgtcctttgggggctccgag

SEQ ID NO: 9292517 - DNA, 22 bp, Homo sapiens
cagaggctgatgtgggatgggc

SEQ ID NO: 9292518 - DNA, 22 bp, Homo sapiens
cagaggctgatgtgggatgggc

SEQ ID NO: 9292519 - DNA, 21 bp, Homo sapiens
cagaggctgagagggcaatct

SEQ ID NO: 9292520 - DNA, 22 bp, Homo sapiens
cagaggctgctctgggtggcat

SEQ ID NO: 9292521 - DNA, 22 bp, Homo sapiens
ggggtatgcttagtaagtacca

SEQ ID NO: 9292522 - DNA, 22 bp, Homo sapiens
ggggtaggtcatagcccctcta

SEQ ID NO: 9292523 - DNA, 22 bp, Homo sapiens
cagaggctgctctgggtggcat

SEQ ID NO: 9292524 - DNA, 22 bp, Homo sapiens
ggggtagggtgattgtgaagta

SEQ ID NO: 9292525 - DNA, 22 bp, Homo sapiens
cagagtgtttctttgggtgggt

SEQ ID NO: 9292526 - DNA, 22 bp, Homo sapiens
cagagtggtgcaagggcagtgt

SEQ ID NO: 9292527 - DNA, 22 bp, Homo sapiens
ggggtctgggcttagctggaat

SEQ ID NO: 9292528 - DNA, 22 bp, Homo sapiens
ggggtcggggcatagccactta

SEQ ID NO: 9292529 - DNA, 22 bp, Homo sapiens
cagataaaggcttactagtagt

SEQ ID NO: 9292530 - DNA, 22 bp, Homo sapiens
cagagagagtctgtccctgaag

SEQ ID NO: 9292531 - DNA, 22 bp, Homo sapiens
cagagagcttagtgtgctgcat

SEQ ID NO: 9292532 - DNA, 22 bp, Homo sapiens
gggccagctctgtgatgtaggg

SEQ ID NO: 9292533 - DNA, 22 bp, Homo sapiens
gggccctgcgtccggaagtctg

SEQ ID NO: 9292534 - DNA, 22 bp, Homo sapiens
cagagcagcagagcttccatgg

SEQ ID NO: 9292535 - DNA, 20 bp, Homo sapiens
gggccctgggattcagagca

SEQ ID NO: 9292536 - DNA, 22 bp, Homo sapiens
cagaagcaaatgccttgctgag

SEQ ID NO: 9292537 - DNA, 22 bp, Homo sapiens
cagagagagcaggaaacctccg

SEQ ID NO: 9292538 - DNA, 19 bp, Homo sapiens
cagagagaccaaggcgcca

SEQ ID NO: 9292539 - DNA, 22 bp, Homo sapiens
cagagagagtcaaatctttgct

SEQ ID NO: 9292540 - DNA, 22 bp, Homo sapiens
cagagagaggccactgctatta

SEQ ID NO: 9292541 - DNA, 22 bp, Homo sapiens
cagagactggagtgcagtggcg

SEQ ID NO: 9292542 - DNA, 22 bp, Homo sapiens
cagagagaatcttggcagctga

SEQ ID NO: 9292543 - DNA, 22 bp, Homo sapiens
cagagagaatcttggcagctga

SEQ ID NO: 9292544 - DNA, 22 bp, Homo sapiens
cagaggacctgtgtggccagag

SEQ ID NO: 9292545 - DNA, 22 bp, Homo sapiens
gggggagctgttattggcaggg

SEQ ID NO: 9292546 - DNA, 22 bp, Homo sapiens
cagaggacaactggggcaagga

SEQ ID NO: 9292547 - DNA, 22 bp, Homo sapiens
gggggatgctcaggaggctgct

SEQ ID NO: 9292548 - DNA, 22 bp, Homo sapiens
gggggcaggtctggaactttga

SEQ ID NO: 9292549 - DNA, 22 bp, Homo sapiens
cagagcttgaatgtccatggtt

SEQ ID NO: 9292550 - DNA, 22 bp, Homo sapiens
cagagcttctgacagctgctgc

SEQ ID NO: 9292551 - DNA, 22 bp, Homo sapiens
gggctcaggagtttgaggctgc

SEQ ID NO: 9292552 - DNA, 22 bp, Homo sapiens
gggctcagggacacatgtgtgt

SEQ ID NO: 9292553 - DNA, 22 bp, Homo sapiens
gggctcagtcctggttctaccc

SEQ ID NO: 9292554 - DNA, 22 bp, Homo sapiens
gctggtgtctaacctggctctt

SEQ ID NO: 9292555 - DNA, 22 bp, Homo sapiens
gctggtggtaaggaggaaaaag

SEQ ID NO: 9292556 - DNA, 22 bp, Homo sapiens
ggaaaattggcgcgtggggctg

SEQ ID NO: 9292557 - DNA, 22 bp, Homo sapiens
ggaaaatttccttcaaaatgtg

SEQ ID NO: 9292558 - DNA, 18 bp, Homo sapiens
ggaacaaggctctgactc

SEQ ID NO: 9292559 - DNA, 22 bp, Homo sapiens
gctggccatatattttgctgtt

SEQ ID NO: 9292560 - DNA, 22 bp, Homo sapiens
gctggccatggcctgcgccatc

SEQ ID NO: 9292561 - DNA, 22 bp, Homo sapiens
gctggccattctctttgagatg

SEQ ID NO: 9292562 - DNA, 22 bp, Homo sapiens
gctggccatggggagtgaggag

SEQ ID NO: 9292563 - DNA, 20 bp, Homo sapiens
gctgggctaccactggccct

SEQ ID NO: 9292564 - DNA, 22 bp, Homo sapiens
gctgggccgacctgggctgcag

SEQ ID NO: 9292565 - DNA, 22 bp, Homo sapiens
gctgaggtgaggctggaaagga

SEQ ID NO: 9292566 - DNA, 23 bp, Homo sapiens
gctgaggtcctgctgagtggtgg

SEQ ID NO: 9292567 - DNA, 23 bp, Homo sapiens
gctgaggtcctgctgagtggtgg

SEQ ID NO: 9292568 - DNA, 22 bp, Homo sapiens
gctggccagtgtggtgaccacc

SEQ ID NO: 9292569 - DNA, 22 bp, Homo sapiens
gctggcagcattagaccctggg

SEQ ID NO: 9292570 - DNA, 20 bp, Homo sapiens
gctggcagatgtcttgagat

SEQ ID NO: 9292571 - DNA, 19 bp, Homo sapiens
gctggcagatgtggccgtg

SEQ ID NO: 9292572 - DNA, 22 bp, Homo sapiens
gctggcagagagctggtgagga

SEQ ID NO: 9292573 - DNA, 22 bp, Homo sapiens
gctggcagagctctgggctggg

SEQ ID NO: 9292574 - DNA, 19 bp, Homo sapiens
gctgaggtggaggaaggag

SEQ ID NO: 9292575 - DNA, 22 bp, Homo sapiens
cacagccttgagcgaggacaag

SEQ ID NO: 9292576 - DNA, 22 bp, Homo sapiens
cacagctgaagtagccatgtgg

SEQ ID NO: 9292577 - DNA, 22 bp, Homo sapiens
ggaggggcagccatggaactcc

SEQ ID NO: 9292578 - DNA, 22 bp, Homo sapiens
cacagcattaactgggacagct

SEQ ID NO: 9292579 - DNA, 22 bp, Homo sapiens
ggaggagaccctgtgtcagttt

SEQ ID NO: 9292580 - DNA, 22 bp, Homo sapiens
ggagctggccctctgagtttgt

SEQ ID NO: 9292581 - DNA, 22 bp, Homo sapiens
ggagctggccgcctatgtgcag

SEQ ID NO: 9292582 - DNA, 22 bp, Homo sapiens
ggaagacatctgcttgcaccag

SEQ ID NO: 9292583 - DNA, 22 bp, Homo sapiens
ggaagagaaatgagtcaagact

SEQ ID NO: 9292584 - DNA, 22 bp, Homo sapiens
ggacaaaggtctggggaacctg

SEQ ID NO: 9292585 - DNA, 19 bp, Homo sapiens
ggacacagaaagctgcatt

SEQ ID NO: 9292586 - DNA, 22 bp, Homo sapiens
cacagagacatgatgtcattgc

SEQ ID NO: 9292587 - DNA, 22 bp, Homo sapiens
cacagagaatgatgagtcactg

SEQ ID NO: 9292588 - DNA, 22 bp, Homo sapiens
cacagagaatgatgagtcactg

SEQ ID NO: 9292589 - DNA, 22 bp, Homo sapiens
cacagagaattcccatatgtga

SEQ ID NO: 9292590 - DNA, 22 bp, Homo sapiens
cacagagaattcccatatgtga

SEQ ID NO: 9292591 - DNA, 22 bp, Homo sapiens
cacagagacagaagcacttatg

SEQ ID NO: 9292592 - DNA, 22 bp, Homo sapiens
cacagagacagatctattttgc

SEQ ID NO: 9292593 - DNA, 22 bp, Homo sapiens
cacagagacagaagcacttatg

SEQ ID NO: 9292594 - DNA, 22 bp, Homo sapiens
ggagatatttgtattctgtctc

SEQ ID NO: 9292595 - DNA, 22 bp, Homo sapiens
cacagagaactgtgggagtgtg

SEQ ID NO: 9292596 - DNA, 22 bp, Homo sapiens
cacagagaatactgctcttgct

SEQ ID NO: 9292597 - DNA, 22 bp, Homo sapiens
ggacagcattctactgtaggca

SEQ ID NO: 9292598 - DNA, 22 bp, Homo sapiens
ggctgggagccccacagagtca

SEQ ID NO: 9292599 - DNA, 22 bp, Homo sapiens
cagaacagacttaacagggctg

SEQ ID NO: 9292600 - DNA, 22 bp, Homo sapiens
ggctgctgtactgatgtcagtt

SEQ ID NO: 9292601 - DNA, 22 bp, Homo sapiens
ggctgctgtactgatgtcagtt

SEQ ID NO: 9292602 - DNA, 20 bp, Homo sapiens
ggctgctggtttggctctgt

SEQ ID NO: 9292603 - DNA, 22 bp, Homo sapiens
ggctgctggtaggggtaggaag

SEQ ID NO: 9292604 - DNA, 22 bp, Homo sapiens
ggctgctggtaggggtaggaag

SEQ ID NO: 9292605 - DNA, 22 bp, Homo sapiens
ggctgctggtggaatggtaggc

SEQ ID NO: 9292606 - DNA, 21 bp, Homo sapiens
ggctgctgtcaccgctgtcac

SEQ ID NO: 9292607 - DNA, 22 bp, Homo sapiens
ggcttgaagactatgacatttc

SEQ ID NO: 9292608 - DNA, 22 bp, Homo sapiens
cagaagaggactgggtagctca

SEQ ID NO: 9292609 - DNA, 22 bp, Homo sapiens
cactgccctcactgtggttctc

SEQ ID NO: 9292610 - DNA, 22 bp, Homo sapiens
cactgcccaggcacccatcttg

SEQ ID NO: 9292611 - DNA, 22 bp, Homo sapiens
cactgcccaggacctgccaccc

SEQ ID NO: 9292612 - DNA, 22 bp, Homo sapiens
cactgcccaggcacccatcttg

SEQ ID NO: 9292613 - DNA, 22 bp, Homo sapiens
cactgccctgggggttgccatc

SEQ ID NO: 9292614 - DNA, 22 bp, Homo sapiens
cactgcccttacatgccctgca

SEQ ID NO: 9292615 - DNA, 20 bp, Homo sapiens
cactgccctccagcctgagc

SEQ ID NO: 9292616 - DNA, 22 bp, Homo sapiens
cactgcccagagggcagcattg

SEQ ID NO: 9292617 - DNA, 22 bp, Homo sapiens
cactgcccagcgtcttaggcac

SEQ ID NO: 9292618 - DNA, 19 bp, Homo sapiens
ggctcctgtggctgcagcc

SEQ ID NO: 9292619 - DNA, 22 bp, Homo sapiens
cactgattaagtctgctagagg

SEQ ID NO: 9292620 - DNA, 22 bp, Homo sapiens
ggcgctctggacctggctctcg

SEQ ID NO: 9292621 - DNA, 22 bp, Homo sapiens
ggctgctcaaggactctgatcg

SEQ ID NO: 9292622 - DNA, 22 bp, Homo sapiens
ggctgcagccctcgcctagcca

SEQ ID NO: 9292623 - DNA, 22 bp, Homo sapiens
cactgtccctgtttcctggaaa

SEQ ID NO: 9292624 - DNA, 22 bp, Homo sapiens
cactgtccatgcttgctaaccc

SEQ ID NO: 9292625 - DNA, 22 bp, Homo sapiens
cactgtccaatagatacataat

SEQ ID NO: 9292626 - DNA, 22 bp, Homo sapiens
ggctgcagattgtagtctgtta

SEQ ID NO: 9292627 - DNA, 22 bp, Homo sapiens
ggctgcagatagccagccacca

SEQ ID NO: 9292628 - DNA, 22 bp, Homo sapiens
ggataggaattgagatgctatt

SEQ ID NO: 9292629 - DNA, 22 bp, Homo sapiens
ggcaggaagcattaaaacgatt

SEQ ID NO: 9292630 - DNA, 21 bp, Homo sapiens
ggagtttttctggaagggact

SEQ ID NO: 9292631 - DNA, 22 bp, Homo sapiens
ggagtctgctcccagacatgat

SEQ ID NO: 9292632 - DNA, 22 bp, Homo sapiens
ggcaggtgtgagctgtaaagga

SEQ ID NO: 9292633 - DNA, 19 bp, Homo sapiens
ggcaggtgtgcttatgctt

SEQ ID NO: 9292634 - DNA, 22 bp, Homo sapiens
ggcaggtgtggtgaccagagat

SEQ ID NO: 9292635 - DNA, 22 bp, Homo sapiens
ggcaggtgtggagtgttatttt

SEQ ID NO: 9292636 - DNA, 22 bp, Homo sapiens
ggcaggtgccttctgtgctagc

SEQ ID NO: 9292637 - DNA, 22 bp, Homo sapiens
ggcaggtgtttttatattaaag

SEQ ID NO: 9292638 - DNA, 22 bp, Homo sapiens
ggccactgtttcctgggcagtt

SEQ ID NO: 9292639 - DNA, 22 bp, Homo sapiens
ggccagctacccatctgcgtca

SEQ ID NO: 9292640 - DNA, 22 bp, Homo sapiens
cacccaggcaaggattctgcaa

SEQ ID NO: 9292641 - DNA, 22 bp, Homo sapiens
ggccagctccttggcagtgcct

SEQ ID NO: 9292642 - DNA, 18 bp, Homo sapiens
ggccagctcctgaggcag

SEQ ID NO: 9292643 - DNA, 22 bp, Homo sapiens
ggccccagcagaccctcctctg

SEQ ID NO: 9292644 - DNA, 22 bp, Homo sapiens
ggccccagcagtgcttgtttat

SEQ ID NO: 9292645 - DNA, 19 bp, Homo sapiens
ggccccagccagggtatca

SEQ ID NO: 9292646 - DNA, 21 bp, Homo sapiens
ggccccagcccatgggttctc

SEQ ID NO: 9292647 - DNA, 22 bp, Homo sapiens
ggcgcagtgtgcagaggagtga

SEQ ID NO: 9292648 - DNA, 22 bp, Homo sapiens
ggccccaggcctttggtctggc

SEQ ID NO: 9292649 - DNA, 22 bp, Homo sapiens
ggccccagggaagaaggtggtc

SEQ ID NO: 9292650 - DNA, 22 bp, Homo sapiens
ggccccagcctcagtcccctga

SEQ ID NO: 9292651 - DNA, 22 bp, Homo sapiens
ggccccagctgtggtgaataga

SEQ ID NO: 9292652 - DNA, 22 bp, Homo sapiens
ggccccaggacctccacggtcc

SEQ ID NO: 9292653 - DNA, 22 bp, Homo sapiens
ggccccagcttcaaccccgtgg

SEQ ID NO: 9292654 - DNA, 22 bp, Homo sapiens
atgtaagactttaagaacctaa

SEQ ID NO: 9292655 - DNA, 17 bp, Homo sapiens
atgtaagaagaaagcag

SEQ ID NO: 9292656 - DNA, 21 bp, Homo sapiens
atgtcaaatgctttattttat

SEQ ID NO: 9292657 - DNA, 18 bp, Homo sapiens
atgtcacagagggctgaa

SEQ ID NO: 9292658 - DNA, 22 bp, Homo sapiens
atgtcacagtgttgctggaagt

SEQ ID NO: 9292659 - DNA, 22 bp, Homo sapiens
gaggaagcagggcttggctgag

SEQ ID NO: 9292660 - DNA, 22 bp, Homo sapiens
gaggaagcagggcttggctgag

SEQ ID NO: 9292661 - DNA, 22 bp, Homo sapiens
gagcttggtgttatttctgtgg

SEQ ID NO: 9292662 - DNA, 22 bp, Homo sapiens
gagctggggcggatactcagct

SEQ ID NO: 9292663 - DNA, 22 bp, Homo sapiens
gagctggggcggatactcagct

SEQ ID NO: 9292664 - DNA, 22 bp, Homo sapiens
gagcaggtctttcatggtgcat

SEQ ID NO: 9292665 - DNA, 22 bp, Homo sapiens
gagcggaggcttggaggccagc

SEQ ID NO: 9292666 - DNA, 22 bp, Homo sapiens
gagcctttgcacttgctgtgtt

SEQ ID NO: 9292667 - DNA, 22 bp, Homo sapiens
gagcctttctagataatccagg

SEQ ID NO: 9292668 - DNA, 18 bp, Homo sapiens
gagctctgcctcccagtc

SEQ ID NO: 9292669 - DNA, 22 bp, Homo sapiens
gagaggctggcagtgccaggtt

SEQ ID NO: 9292670 - DNA, 22 bp, Homo sapiens
gagaggctgcatatgcacactg

SEQ ID NO: 9292671 - DNA, 22 bp, Homo sapiens
gagaggctggcagtgccaggtt

SEQ ID NO: 9292672 - DNA, 22 bp, Homo sapiens
gagaggctgatcctgcagagaa

SEQ ID NO: 9292673 - DNA, 22 bp, Homo sapiens
gagaggctgaaatcacaggagc

SEQ ID NO: 9292674 - DNA, 22 bp, Homo sapiens
gagaggctgactggctgtcctg

SEQ ID NO: 9292675 - DNA, 22 bp, Homo sapiens
gagaggctccgccactgctcag

SEQ ID NO: 9292676 - DNA, 22 bp, Homo sapiens
gagaggctccatgaccccggca

SEQ ID NO: 9292677 - DNA, 22 bp, Homo sapiens
gagaggctctgaggactggggt

SEQ ID NO: 9292678 - DNA, 22 bp, Homo sapiens
gagaggctctgaggactggggt

SEQ ID NO: 9292679 - DNA, 22 bp, Homo sapiens
gagaggtgaatgtggatgccac

SEQ ID NO: 9292680 - DNA, 22 bp, Homo sapiens
gagaggtgaaatagttgtccgg

SEQ ID NO: 9292681 - DNA, 22 bp, Homo sapiens
gagaggtgaaggctgccctggg

SEQ ID NO: 9292682 - DNA, 22 bp, Homo sapiens
gagaggtggaggttgcagtgag

SEQ ID NO: 9292683 - DNA, 22 bp, Homo sapiens
gagaggtggaggttgcagtgag

SEQ ID NO: 9292684 - DNA, 22 bp, Homo sapiens
gagaggtggaggttgcagtgag

SEQ ID NO: 9292685 - DNA, 22 bp, Homo sapiens
gagttagggccccgcggccgtg

SEQ ID NO: 9292686 - DNA, 22 bp, Homo sapiens
atgtttcatttagatatcaggc

SEQ ID NO: 9292687 - DNA, 22 bp, Homo sapiens
atgtttcatgactgagcaaaat

SEQ ID NO: 9292688 - DNA, 21 bp, Homo sapiens
gagtgcaggtctgatgccatc

SEQ ID NO: 9292689 - DNA, 21 bp, Homo sapiens
gagtgcagcaaggtagagtct

SEQ ID NO: 9292690 - DNA, 23 bp, Homo sapiens
gagtgcagaatagacatgcagtg

SEQ ID NO: 9292691 - DNA, 22 bp, Homo sapiens
gagtgcagatgaacagaagatt

SEQ ID NO: 9292692 - DNA, 23 bp, Homo sapiens
gagtgcagaatagacatgcagtg

SEQ ID NO: 9292693 - DNA, 22 bp, Homo sapiens
gagtccagtagttaggacagag

SEQ ID NO: 9292694 - DNA, 19 bp, Homo sapiens
gaggggaggaattgacaag

SEQ ID NO: 9292695 - DNA, 22 bp, Homo sapiens
gagggcagaaaattatgcggtg

SEQ ID NO: 9292696 - DNA, 22 bp, Homo sapiens
gaggttggggctgcagtgagct

SEQ ID NO: 9292697 - DNA, 22 bp, Homo sapiens
gaggtaggctgtgaaagggggt

SEQ ID NO: 9292698 - DNA, 17 bp, Homo sapiens
gaggtaggaagtgagtc

SEQ ID NO: 9292699 - DNA, 22 bp, Homo sapiens
gaggctgctttgatgacaggag

SEQ ID NO: 9292700 - DNA, 22 bp, Homo sapiens
gaggctgtgtcttggggtggaa

SEQ ID NO: 9292701 - DNA, 22 bp, Homo sapiens
gaggctgttaggagggactctg

SEQ ID NO: 9292702 - DNA, 22 bp, Homo sapiens
gaggccacagtcagtgttcatc

SEQ ID NO: 9292703 - DNA, 22 bp, Homo sapiens
gaggccacagctatcagggaca

SEQ ID NO: 9292704 - DNA, 22 bp, Homo sapiens
gaggccaatgaagtgagtttaa

SEQ ID NO: 9292705 - DNA, 21 bp, Homo sapiens
gaaaaccatttgcatcatgag

SEQ ID NO: 9292706 - DNA, 22 bp, Homo sapiens
gaaaaccacctcccatcaagca

SEQ ID NO: 9292707 - DNA, 22 bp, Homo sapiens
ctttttccagcttcagggtggg

SEQ ID NO: 9292708 - DNA, 22 bp, Homo sapiens
atgaatgtacctgaaatagcct

SEQ ID NO: 9292709 - DNA, 22 bp, Homo sapiens
atgaatgagattaccaatgtga

SEQ ID NO: 9292710 - DNA, 22 bp, Homo sapiens
atgaatgatgcaaaagacactg

SEQ ID NO: 9292711 - DNA, 22 bp, Homo sapiens
atgaatgattaaagagtacagt

SEQ ID NO: 9292712 - DNA, 21 bp, Homo sapiens
atgaatgatttctactcttaa

SEQ ID NO: 9292713 - DNA, 22 bp, Homo sapiens
atgaatgatttgtcagtcacag

SEQ ID NO: 9292714 - DNA, 22 bp, Homo sapiens
atgaatgattttatgtaaatga

SEQ ID NO: 9292715 - DNA, 21 bp, Homo sapiens
atcttcaactgattggaggag

SEQ ID NO: 9292716 - DNA, 22 bp, Homo sapiens
atcttcaaggaaaaaatacagt

SEQ ID NO: 9292717 - DNA, 22 bp, Homo sapiens
atgaatgaaatacagagtactt

SEQ ID NO: 9292718 - DNA, 22 bp, Homo sapiens
atgaatgaataccatgcaacta

SEQ ID NO: 9292719 - DNA, 22 bp, Homo sapiens
gaacatttgatgatgacattgg

SEQ ID NO: 9292720 - DNA, 22 bp, Homo sapiens
gaacatttgatgatgacattgg

SEQ ID NO: 9292721 - DNA, 22 bp, Homo sapiens
gaactttaggattttcacaggt

SEQ ID NO: 9292722 - DNA, 22 bp, Homo sapiens
gaactttgcgcagttcccgggg

SEQ ID NO: 9292723 - DNA, 22 bp, Homo sapiens
gaacattcttgggcaagttact

SEQ ID NO: 9292724 - DNA, 22 bp, Homo sapiens
gaaaatgcctctggcattaaac

SEQ ID NO: 9292725 - DNA, 22 bp, Homo sapiens
atgaggcattccactcaaactc

SEQ ID NO: 9292726 - DNA, 22 bp, Homo sapiens
atgaggcattcacagaaggcac

SEQ ID NO: 9292727 - DNA, 23 bp, Homo sapiens
atgaggcattaaacaggcttttt

SEQ ID NO: 9292728 - DNA, 22 bp, Homo sapiens
atgaggcatgtgaggagaaggg

SEQ ID NO: 9292729 - DNA, 22 bp, Homo sapiens
gaacataactattgtgaatagt

SEQ ID NO: 9292730 - DNA, 22 bp, Homo sapiens
gaacataattaaatgtcctggg

SEQ ID NO: 9292731 - DNA, 16 bp, Homo sapiens
atgaggcataggctgc

SEQ ID NO: 9292732 - DNA, 22 bp, Homo sapiens
atgaggcatatcctcctatggt

SEQ ID NO: 9292733 - DNA, 22 bp, Homo sapiens
atgaggcatctaacattgcaaa

SEQ ID NO: 9292734 - DNA, 22 bp, Homo sapiens
atgaggcatgggatcaaaatga

SEQ ID NO: 9292735 - DNA, 21 bp, Homo sapiens
atgaggcatgagagggtttct

SEQ ID NO: 9292736 - DNA, 22 bp, Homo sapiens
atgaggcatctgcagtcactag

SEQ ID NO: 9292737 - DNA, 22 bp, Homo sapiens
atgaggcagtctggcctgaggg

SEQ ID NO: 9292738 - DNA, 22 bp, Homo sapiens
atgaggcatagcagggatcgga

SEQ ID NO: 9292739 - DNA, 22 bp, Homo sapiens
atgcttgtactaaaaaaatatt

SEQ ID NO: 9292740 - DNA, 22 bp, Homo sapiens
gacagtggttccaaggcagctt

SEQ ID NO: 9292741 - DNA, 22 bp, Homo sapiens
gacagtggattcatctagtcaa

SEQ ID NO: 9292742 - DNA, 22 bp, Homo sapiens
gacagggaggaaagagactgct

SEQ ID NO: 9292743 - DNA, 22 bp, Homo sapiens
atgcttttatgtcacatggtca

SEQ ID NO: 9292744 - DNA, 22 bp, Homo sapiens
gactttcttaggccccctaata

SEQ ID NO: 9292745 - DNA, 22 bp, Homo sapiens
gaccctctagatggaagcactg

SEQ ID NO: 9292746 - DNA, 22 bp, Homo sapiens
gactggggtaaggtgaggaggt

SEQ ID NO: 9292747 - DNA, 22 bp, Homo sapiens
gactttattttaacggagattc

SEQ ID NO: 9292748 - DNA, 22 bp, Homo sapiens
atgctttattgcttctgggcac

SEQ ID NO: 9292749 - DNA, 22 bp, Homo sapiens
gacccggctccaggcccagcag

SEQ ID NO: 9292750 - DNA, 22 bp, Homo sapiens
atgccacttcattccagcctcg

SEQ ID NO: 9292751 - DNA, 22 bp, Homo sapiens
atgccacttcattccagcctcg

SEQ ID NO: 9292752 - DNA, 22 bp, Homo sapiens
atgccctgctgctggggcagtg

SEQ ID NO: 9292753 - DNA, 22 bp, Homo sapiens
atgccctgcatcaagtgacact

SEQ ID NO: 9292754 - DNA, 22 bp, Homo sapiens
atgccctgctctcgggaaggga

SEQ ID NO: 9292755 - DNA, 22 bp, Homo sapiens
gacagggactccctggttagaa

SEQ ID NO: 9292756 - DNA, 22 bp, Homo sapiens
gacagggacgaggcttcaggca

SEQ ID NO: 9292757 - DNA, 20 bp, Homo sapiens
atgcctctaattttgcaaac

SEQ ID NO: 9292758 - DNA, 22 bp, Homo sapiens
atgcctggactgacatgcactg

SEQ ID NO: 9292759 - DNA, 22 bp, Homo sapiens
atgccctgtggttcatgtgaga

SEQ ID NO: 9292760 - DNA, 20 bp, Homo sapiens
atgccctgtcctcttctgtt

SEQ ID NO: 9292761 - DNA, 22 bp, Homo sapiens
atgccctgtgactctcctggac

SEQ ID NO: 9292762 - DNA, 22 bp, Homo sapiens
atgccctgggagtgctgtacca

SEQ ID NO: 9292763 - DNA, 22 bp, Homo sapiens
atgccctggggctacctctgag

SEQ ID NO: 9292764 - DNA, 23 bp, Homo sapiens
atgccctgtagaggctgctgacc

SEQ ID NO: 9292765 - DNA, 22 bp, Homo sapiens
gaatgtcagggccagaagaggc

SEQ ID NO: 9292766 - DNA, 22 bp, Homo sapiens
gaagcagagcctaaggcagaca

SEQ ID NO: 9292767 - DNA, 16 bp, Homo sapiens
gaagcagagggtgttg

SEQ ID NO: 9292768 - DNA, 22 bp, Homo sapiens
gaatgtaatagtcagtagaaca

SEQ ID NO: 9292769 - DNA, 22 bp, Homo sapiens
gaagcagaacccactccccaac

SEQ ID NO: 9292770 - DNA, 22 bp, Homo sapiens
gaagcagaaggtttggacgtgc

SEQ ID NO: 9292771 - DNA, 22 bp, Homo sapiens
attggcagggccagcatctccc

SEQ ID NO: 9292772 - DNA, 22 bp, Homo sapiens
attggcagtgttttctgttcca

SEQ ID NO: 9292773 - DNA, 22 bp, Homo sapiens
attggcagtaagactctttctt

SEQ ID NO: 9292774 - DNA, 22 bp, Homo sapiens
attggcagttggctgtggttca

SEQ ID NO: 9292775 - DNA, 22 bp, Homo sapiens
attggcagttagtgacgaggct

SEQ ID NO: 9292776 - DNA, 22 bp, Homo sapiens
attggcaggaaccgaggagggg

SEQ ID NO: 9292777 - DNA, 22 bp, Homo sapiens
attggtggtgaggacatgccag

SEQ ID NO: 9292778 - DNA, 14 bp, Homo sapiens
gcaggtggatcacc

SEQ ID NO: 9292779 - DNA, 22 bp, Homo sapiens
gcaggtggatcaccacgtcagg

SEQ ID NO: 9292780 - DNA, 22 bp, Homo sapiens
gcaggtggatattgctacttga

SEQ ID NO: 9292781 - DNA, 16 bp, Homo sapiens
gcaggtggatcacctg

SEQ ID NO: 9292782 - DNA, 22 bp, Homo sapiens
gcaggtggatcacctgaggtca

SEQ ID NO: 9292783 - DNA, 14 bp, Homo sapiens
gcaggtggatcact

SEQ ID NO: 9292784 - DNA, 15 bp, Homo sapiens
gcaggtggatcactt

SEQ ID NO: 9292785 - DNA, 22 bp, Homo sapiens
gcagggtacattgggatgggat

SEQ ID NO: 9292786 - DNA, 22 bp, Homo sapiens
gcaggctgtgaggctcagatgg

SEQ ID NO: 9292787 - DNA, 22 bp, Homo sapiens
gcaggctgtctaaagttagagt

SEQ ID NO: 9292788 - DNA, 22 bp, Homo sapiens
gcagggacgccagggacagcaa

SEQ ID NO: 9292789 - DNA, 22 bp, Homo sapiens
gcattattaactggaggaaaag

SEQ ID NO: 9292790 - DNA, 18 bp, Homo sapiens
attgttctgtgacatgtc

SEQ ID NO: 9292791 - DNA, 22 bp, Homo sapiens
attgttctgtagtgacatgtag

SEQ ID NO: 9292792 - DNA, 22 bp, Homo sapiens
attgttctggatatttacattg

SEQ ID NO: 9292793 - DNA, 22 bp, Homo sapiens
attgtacaatgctgaggtttgg

SEQ ID NO: 9292794 - DNA, 22 bp, Homo sapiens
attgtaattttagagaaagtgg

SEQ ID NO: 9292795 - DNA, 22 bp, Homo sapiens
gccactggagacagtggggaag

SEQ ID NO: 9292796 - DNA, 22 bp, Homo sapiens
gccactggacccagggttatca

SEQ ID NO: 9292797 - DNA, 22 bp, Homo sapiens
gcattcatcaaaaatgttcctc

SEQ ID NO: 9292798 - DNA, 22 bp, Homo sapiens
gcattcatcttcatgaaagcac

SEQ ID NO: 9292799 - DNA, 22 bp, Homo sapiens
gcattcatcttcctccatgcag

SEQ ID NO: 9292800 - DNA, 22 bp, Homo sapiens
gcattcatatggaaggaaacta

SEQ ID NO: 9292801 - DNA, 22 bp, Homo sapiens
gcattcatgcctgtgtgagctc

SEQ ID NO: 9292802 - DNA, 22 bp, Homo sapiens
gcattcattcattcattaggta

SEQ ID NO: 9292803 - DNA, 20 bp, Homo sapiens
gccactgggcaccagcaggg

SEQ ID NO: 9292804 - DNA, 20 bp, Homo sapiens
gccactgggcaccagcaggg

SEQ ID NO: 9292805 - DNA, 22 bp, Homo sapiens
gccactggcatctagttggtag

SEQ ID NO: 9292806 - DNA, 22 bp, Homo sapiens
attgtttccccggaattattca

SEQ ID NO: 9292807 - DNA, 22 bp, Homo sapiens
gcacacaggcagtttccagcca

SEQ ID NO: 9292808 - DNA, 22 bp, Homo sapiens
gcaacaggcagtttgctcatgt

SEQ ID NO: 9292809 - DNA, 22 bp, Homo sapiens
gcaaaagtacagccggatttct

SEQ ID NO: 9292810 - DNA, 22 bp, Homo sapiens
gcaaaattaaacttagcatcat

SEQ ID NO: 9292811 - DNA, 22 bp, Homo sapiens
gcacagaggaagcacagactct

SEQ ID NO: 9292812 - DNA, 23 bp, Homo sapiens
gcacagagcagttaggggaagat

SEQ ID NO: 9292813 - DNA, 23 bp, Homo sapiens
gcacagagcagttaggggaagat

SEQ ID NO: 9292814 - DNA, 22 bp, Homo sapiens
gcagatgcagaactcagtgggt

SEQ ID NO: 9292815 - DNA, 22 bp, Homo sapiens
gcagccagggttaattatattt

SEQ ID NO: 9292816 - DNA, 16 bp, Homo sapiens
gcagaggaaaggggag

SEQ ID NO: 9292817 - DNA, 22 bp, Homo sapiens
gcagaggggaagctgaggaatt

SEQ ID NO: 9292818 - DNA, 22 bp, Homo sapiens
attttactactccaattaatga

SEQ ID NO: 9292819 - DNA, 22 bp, Homo sapiens
attttaccttaaagtctatatt

SEQ ID NO: 9292820 - DNA, 22 bp, Homo sapiens
attttactaagtggatatctgt

SEQ ID NO: 9292821 - DNA, 22 bp, Homo sapiens
gcctgcctagaattgcagcttt

SEQ ID NO: 9292822 - DNA, 22 bp, Homo sapiens
atttcttgattccaccagtgaa

SEQ ID NO: 9292823 - DNA, 22 bp, Homo sapiens
gcccagccacagtcactttcat

SEQ ID NO: 9292824 - DNA, 18 bp, Homo sapiens
gccagagggaagcaggtg

SEQ ID NO: 9292825 - DNA, 22 bp, Homo sapiens
gcgtggggtaggtagacatgga

SEQ ID NO: 9292826 - DNA, 22 bp, Homo sapiens
gctaagggaccctttctaatgt

SEQ ID NO: 9292827 - DNA, 22 bp, Homo sapiens
gctaagggataggctgcctcct

SEQ ID NO: 9292828 - DNA, 22 bp, Homo sapiens
gctaaataatcttcttctgaca

SEQ ID NO: 9292829 - DNA, 22 bp, Homo sapiens
gctaagggaggcatgccgtggt

SEQ ID NO: 9292830 - DNA, 22 bp, Homo sapiens
gctccaggcagcatagtggatg

SEQ ID NO: 9292831 - DNA, 22 bp, Homo sapiens
gctctaggttcctagccaagtc

SEQ ID NO: 9292832 - DNA, 22 bp, Homo sapiens
gctctatgaatcacacgagggt

SEQ ID NO: 9292833 - DNA, 22 bp, Homo sapiens
gctctagatcataggtcattat

SEQ ID NO: 9292834 - DNA, 22 bp, Homo sapiens
gctctagcaaggctggcctggg

SEQ ID NO: 9292835 - DNA, 22 bp, Homo sapiens
gctctaggagaggggcagtcca

SEQ ID NO: 9292836 - DNA, 22 bp, Homo sapiens
gctctagctggcgctgacctgg

SEQ ID NO: 9292837 - DNA, 22 bp, Homo sapiens
gctctagaaagaaggatgtggg

SEQ ID NO: 9292838 - DNA, 22 bp, Homo sapiens
gctctagacagaaagaccagtg

SEQ ID NO: 9292839 - DNA, 19 bp, Homo sapiens
gctctgagaggggcatggg

SEQ ID NO: 9292840 - DNA, 22 bp, Homo sapiens
gctctgagaggtgcagcagtaa

SEQ ID NO: 9292841 - DNA, 22 bp, Homo sapiens
gctctgagaggatgctgagcag

SEQ ID NO: 9292842 - DNA, 22 bp, Homo sapiens
gctctgagagctacacagggta

SEQ ID NO: 9292843 - DNA, 22 bp, Homo sapiens
gctctgactgagcttcctgcct

SEQ ID NO: 9292844 - DNA, 22 bp, Homo sapiens
caaatgtgttttttcttctaca

SEQ ID NO: 9292845 - DNA, 22 bp, Homo sapiens
caaatgtgtagagcttttgggg

SEQ ID NO: 9292846 - DNA, 19 bp, Homo sapiens
agtagcagaaagtgcagtg

SEQ ID NO: 9292847 - DNA, 22 bp, Homo sapiens
agtaggataagagcctgtccaa

SEQ ID NO: 9292848 - DNA, 22 bp, Homo sapiens
agtaggatgctttatatgaaag

SEQ ID NO: 9292849 - DNA, 22 bp, Homo sapiens
agtagcttggccctttgttctt

SEQ ID NO: 9292850 - DNA, 22 bp, Homo sapiens
agtagggagaccggaggccgcc

SEQ ID NO: 9292851 - DNA, 22 bp, Homo sapiens
agtagggaatacattggggtaa

SEQ ID NO: 9292852 - DNA, 22 bp, Homo sapiens
ccttccaggtgcaggcaagcct

SEQ ID NO: 9292853 - DNA, 22 bp, Homo sapiens
ccttccagtgactaaggaggaa

SEQ ID NO: 9292854 - DNA, 22 bp, Homo sapiens
ccttctctctgaagaccccaaa

SEQ ID NO: 9292855 - DNA, 22 bp, Homo sapiens
ccttctctactcctgatgcatg

SEQ ID NO: 9292856 - DNA, 22 bp, Homo sapiens
agtaaacataatttacctgtag

SEQ ID NO: 9292857 - DNA, 22 bp, Homo sapiens
agtcacagtttccctgagagag

SEQ ID NO: 9292858 - DNA, 22 bp, Homo sapiens
ctagctcttacactctgaatag

SEQ ID NO: 9292859 - DNA, 22 bp, Homo sapiens
ctaggaggcgggggctgcagta

SEQ ID NO: 9292860 - DNA, 22 bp, Homo sapiens
agtcagcattttcactgagcta

SEQ ID NO: 9292861 - DNA, 22 bp, Homo sapiens
agtcagcagcctggccaggaga

SEQ ID NO: 9292862 - DNA, 22 bp, Homo sapiens
ctagtgaaatttgcaagtaatt

SEQ ID NO: 9292863 - DNA, 22 bp, Homo sapiens
ctattgaggacataaggactct

SEQ ID NO: 9292864 - DNA, 22 bp, Homo sapiens
aggtacagatgaaagtctagtt

SEQ ID NO: 9292865 - DNA, 22 bp, Homo sapiens
agggttttcatttctgagcatt

SEQ ID NO: 9292866 - DNA, 21 bp, Homo sapiens
cctgggagaattgggtgtggc

SEQ ID NO: 9292867 - DNA, 22 bp, Homo sapiens
cctgggaggctgtgggtctgct

SEQ ID NO: 9292868 - DNA, 22 bp, Homo sapiens
aggtcacccgtttgactatcca

SEQ ID NO: 9292869 - DNA, 22 bp, Homo sapiens
aggtcagcatgagtagaaggta

SEQ ID NO: 9292870 - DNA, 23 bp, Homo sapiens
aggtcagcaggcaaggaaatggc

SEQ ID NO: 9292871 - DNA, 21 bp, Homo sapiens
aggtcagcccagctctggaag

SEQ ID NO: 9292872 - DNA, 22 bp, Homo sapiens
aggtcagctgcactggtgtaat

SEQ ID NO: 9292873 - DNA, 22 bp, Homo sapiens
aggtcagctgctgataggcagc

SEQ ID NO: 9292874 - DNA, 22 bp, Homo sapiens
aggtcagctgtgtgtgcatgag

SEQ ID NO: 9292875 - DNA, 22 bp, Homo sapiens
aggtcaggaggttaagagtctt

SEQ ID NO: 9292876 - DNA, 22 bp, Homo sapiens
cctggggtatataggtgaatat

SEQ ID NO: 9292877 - DNA, 20 bp, Homo sapiens
cctggggtacactggcatgt

SEQ ID NO: 9292878 - DNA, 22 bp, Homo sapiens
cctggggtcacttgcagccgca

SEQ ID NO: 9292879 - DNA, 22 bp, Homo sapiens
cctggggtcagggacgctgtgc

SEQ ID NO: 9292880 - DNA, 22 bp, Homo sapiens
aggtgcagctgacaccatgtgg

SEQ ID NO: 9292881 - DNA, 22 bp, Homo sapiens
cctgtgggaggttctgtgagtc

SEQ ID NO: 9292882 - DNA, 22 bp, Homo sapiens
cctgtgggcgcagctggagtca

SEQ ID NO: 9292883 - DNA, 22 bp, Homo sapiens
agtgcagggcctgcccagcagg

SEQ ID NO: 9292884 - DNA, 22 bp, Homo sapiens
agtgccaaggtattaatttata

SEQ ID NO: 9292885 - DNA, 22 bp, Homo sapiens
agtgccccatgggtgcctgggg

SEQ ID NO: 9292886 - DNA, 22 bp, Homo sapiens
agtgccctcgtgcccagggcct

SEQ ID NO: 9292887 - DNA, 21 bp, Homo sapiens
agtgccagtaggtatggagga

SEQ ID NO: 9292888 - DNA, 22 bp, Homo sapiens
agtggaattgctgattgaaata

SEQ ID NO: 9292889 - DNA, 22 bp, Homo sapiens
agtgctttgtggagaatttgta

SEQ ID NO: 9292890 - DNA, 22 bp, Homo sapiens
agtggagaagaggatggtctcc

SEQ ID NO: 9292891 - DNA, 22 bp, Homo sapiens
agtggccaacttatatgaaaaa

SEQ ID NO: 9292892 - DNA, 22 bp, Homo sapiens
agtggccactgacttggaaatc

SEQ ID NO: 9292893 - DNA, 22 bp, Homo sapiens
agtggccacccactgagacagg

SEQ ID NO: 9292894 - DNA, 22 bp, Homo sapiens
agtggagtgagtggcagaagga

SEQ ID NO: 9292895 - DNA, 22 bp, Homo sapiens
agtggatggtattgggaccagg

SEQ ID NO: 9292896 - DNA, 22 bp, Homo sapiens
agtgaaaacactagttcttgcc

SEQ ID NO: 9292897 - DNA, 22 bp, Homo sapiens
agtgaaaacactagttcttgcc

SEQ ID NO: 9292898 - DNA, 22 bp, Homo sapiens
agtgaggctaataggcaatggt

SEQ ID NO: 9292899 - DNA, 22 bp, Homo sapiens
agtgagtgggttacagatggga

SEQ ID NO: 9292900 - DNA, 22 bp, Homo sapiens
agtgaggtaattagagctgctg

SEQ ID NO: 9292901 - DNA, 22 bp, Homo sapiens
agtgaggtcatactggagaggg

SEQ ID NO: 9292902 - DNA, 22 bp, Homo sapiens
agtgaggtggggtcacagggac

SEQ ID NO: 9292903 - DNA, 20 bp, Homo sapiens
agtctaggattttggcagct

SEQ ID NO: 9292904 - DNA, 22 bp, Homo sapiens
agtctagggtggggtccacagg

SEQ ID NO: 9292905 - DNA, 22 bp, Homo sapiens
agtctttatctcgctcctggat

SEQ ID NO: 9292906 - DNA, 21 bp, Homo sapiens
agtggggtctctgtggaggcc

SEQ ID NO: 9292907 - DNA, 22 bp, Homo sapiens
agtggggccgcggtcctgccct

SEQ ID NO: 9292908 - DNA, 22 bp, Homo sapiens
agtgggtactgggcaggcagag

SEQ ID NO: 9292909 - DNA, 22 bp, Homo sapiens
agtgggtaggcctctggtgcct

SEQ ID NO: 9292910 - DNA, 22 bp, Homo sapiens
agtgggtcagagagctccagat

SEQ ID NO: 9292911 - DNA, 20 bp, Homo sapiens
agtgggtgatgaaggaatag

SEQ ID NO: 9292912 - DNA, 22 bp, Homo sapiens
agtgggtgagcttggtctagat

SEQ ID NO: 9292913 - DNA, 23 bp, Homo sapiens
agtggccttccaggttgtgtttc

SEQ ID NO: 9292914 - DNA, 22 bp, Homo sapiens
agtggcgtcctaggaaaggagg

SEQ ID NO: 9292915 - DNA, 22 bp, Homo sapiens
agtggccagtgctgctctgggg

SEQ ID NO: 9292916 - DNA, 22 bp, Homo sapiens
agtggccagtgctgctctgggg

SEQ ID NO: 9292917 - DNA, 22 bp, Homo sapiens
agtggccaggaaaggtccagcc

SEQ ID NO: 9292918 - DNA, 22 bp, Homo sapiens
agtggccatggcaggtgagcat

SEQ ID NO: 9292919 - DNA, 22 bp, Homo sapiens
agtgggtggcgcagaggaggaa

SEQ ID NO: 9292920 - DNA, 19 bp, Homo sapiens
agtggtagatgagcaggag

SEQ ID NO: 9292921 - DNA, 22 bp, Homo sapiens
agtggtagaaaatgcagctcga

SEQ ID NO: 9292922 - DNA, 22 bp, Homo sapiens
agtggtcaaagactagatttca

SEQ ID NO: 9292923 - DNA, 22 bp, Homo sapiens
ctctggagtgggtggccgggag

SEQ ID NO: 9292924 - DNA, 22 bp, Homo sapiens
ctctggagtgtctggccagggt

SEQ ID NO: 9292925 - DNA, 22 bp, Homo sapiens
ctctggagttagtgatctgggc

SEQ ID NO: 9292926 - DNA, 22 bp, Homo sapiens
ctctggagttctcatgaggaac

SEQ ID NO: 9292927 - DNA, 22 bp, Homo sapiens
agtgtcctcctctgggagccag

SEQ ID NO: 9292928 - DNA, 22 bp, Homo sapiens
agtgtcctacagctcctgcctg

SEQ ID NO: 9292929 - DNA, 22 bp, Homo sapiens
agtgtcctcatctgtaaaatga

SEQ ID NO: 9292930 - DNA, 22 bp, Homo sapiens
agtgtcctcaggctttgttcct

SEQ ID NO: 9292931 - DNA, 22 bp, Homo sapiens
agtgtcctagcaagccggtcct

SEQ ID NO: 9292932 - DNA, 19 bp, Homo sapiens
agtgtcctagtcatttgcc

SEQ ID NO: 9292933 - DNA, 19 bp, Homo sapiens
agtgtatttttttctgtag

SEQ ID NO: 9292934 - DNA, 22 bp, Homo sapiens
agtgtatttgagcatctcctta

SEQ ID NO: 9292935 - DNA, 21 bp, Homo sapiens
ctctggagtttgaaggctggg

SEQ ID NO: 9292936 - DNA, 22 bp, Homo sapiens
agtgtacaaaatgatagataaa

SEQ ID NO: 9292937 - DNA, 20 bp, Homo sapiens
agtgtgcatttagagtctgc

SEQ ID NO: 9292938 - DNA, 18 bp, Homo sapiens
agtgttctcgttttataa

SEQ ID NO: 9292939 - DNA, 22 bp, Homo sapiens
agtgtggcaggaatgactagaa

SEQ ID NO: 9292940 - DNA, 22 bp, Homo sapiens
atcacagagctcccttccactg

SEQ ID NO: 9292941 - DNA, 18 bp, Homo sapiens
atcacagagggggagtct

SEQ ID NO: 9292942 - DNA, 22 bp, Homo sapiens
atcacagagattgcttttaaaa

SEQ ID NO: 9292943 - DNA, 22 bp, Homo sapiens
atcacagctagtaagtggagga

SEQ ID NO: 9292944 - DNA, 22 bp, Homo sapiens
atcacaatgtacgttaaaatgt

SEQ ID NO: 9292945 - DNA, 22 bp, Homo sapiens
ctgtaatcccagctacctggga

SEQ ID NO: 9292946 - DNA, 22 bp, Homo sapiens
atcagctgaaaaacaggcagca

SEQ ID NO: 9292947 - DNA, 22 bp, Homo sapiens
atcagagccttatgcttctcat

SEQ ID NO: 9292948 - DNA, 22 bp, Homo sapiens
ctgtctctctaggacactgggg

SEQ ID NO: 9292949 - DNA, 22 bp, Homo sapiens
ctgtctctgataagctcgaggg

SEQ ID NO: 9292950 - DNA, 22 bp, Homo sapiens
ctggtcctaaagccctactcca

SEQ ID NO: 9292951 - DNA, 22 bp, Homo sapiens
ctggtcccagcagagctctgag

SEQ ID NO: 9292952 - DNA, 22 bp, Homo sapiens
ctgggtggcgtctggggccagt

SEQ ID NO: 9292953 - DNA, 22 bp, Homo sapiens
ctggtcatgccaggtttgctgc

SEQ ID NO: 9292954 - DNA, 22 bp, Homo sapiens
atattcactgagcataaagcca

SEQ ID NO: 9292955 - DNA, 23 bp, Homo sapiens
atattcacgccgccagaggtccc

SEQ ID NO: 9292956 - DNA, 22 bp, Homo sapiens
atattcactcctggtgagacta

SEQ ID NO: 9292957 - DNA, 22 bp, Homo sapiens
ctgggaggtgaacagaaaaact

SEQ ID NO: 9292958 - DNA, 22 bp, Homo sapiens
ctgggaggattcattgaggtga

SEQ ID NO: 9292959 - DNA, 22 bp, Homo sapiens
ctgggaggcggaggttgcagtg

SEQ ID NO: 9292960 - DNA, 22 bp, Homo sapiens
ctgggaggatacacaagatcag

SEQ ID NO: 9292961 - DNA, 22 bp, Homo sapiens
ctgggaggacaacttggagctc

SEQ ID NO: 9292962 - DNA, 22 bp, Homo sapiens
ctggggctgtgggagacaaggc

SEQ ID NO: 9292963 - DNA, 19 bp, Homo sapiens
ctggggctttggtactgcc

SEQ ID NO: 9292964 - DNA, 22 bp, Homo sapiens
atattattctagtaacagtgat

SEQ ID NO: 9292965 - DNA, 22 bp, Homo sapiens
cttagatgaagtcacagaaccc

SEQ ID NO: 9292966 - DNA, 22 bp, Homo sapiens
cttagatgaagtcacagaaccc

SEQ ID NO: 9292967 - DNA, 20 bp, Homo sapiens
atccatcagagaaaataaag

SEQ ID NO: 9292968 - DNA, 21 bp, Homo sapiens
atccatccatcttggcctaac

SEQ ID NO: 9292969 - DNA, 22 bp, Homo sapiens
atcatacatgtaactaagtaaa

SEQ ID NO: 9292970 - DNA, 22 bp, Homo sapiens
ctgtttctccacactcttccca

SEQ ID NO: 9292971 - DNA, 22 bp, Homo sapiens
atctccccgagcttacctcctg

SEQ ID NO: 9292972 - DNA, 22 bp, Homo sapiens
cttctgagatgttgttttacag

SEQ ID NO: 9292973 - DNA, 22 bp, Homo sapiens
cttctgagatgttgttttacag

SEQ ID NO: 9292974 - DNA, 23 bp, Homo sapiens
atctctctggtggtcacagtcag

SEQ ID NO: 9292975 - DNA, 22 bp, Homo sapiens
cttctgtgttaaatgagtcttt

SEQ ID NO: 9292976 - DNA, 19 bp, Homo sapiens
cttctgtgatacatcagtc

SEQ ID NO: 9292977 - DNA, 22 bp, Homo sapiens
atcttatttaacacagcaaaac

SEQ ID NO: 9292978 - DNA, 18 bp, Homo sapiens
atctgtcctttctctgcc

SEQ ID NO: 9292979 - DNA, 22 bp, Homo sapiens
atctgtcctctgtctggaggct

SEQ ID NO: 9292980 - DNA, 22 bp, Homo sapiens
atctggttttggctgtgtccct

SEQ ID NO: 9292981 - DNA, 22 bp, Homo sapiens
atctggttttggctgtgtccct

SEQ ID NO: 9292982 - DNA, 21 bp, Homo sapiens
ctggccttcaactgattggat

SEQ ID NO: 9292983 - DNA, 22 bp, Homo sapiens
ctggccttcagactcggactga

SEQ ID NO: 9292984 - DNA, 22 bp, Homo sapiens
ctggcctttaaaatgaccttat

SEQ ID NO: 9292985 - DNA, 22 bp, Homo sapiens
atatacttggagactatcattg

SEQ ID NO: 9292986 - DNA, 22 bp, Homo sapiens
atatacatgggaatatgtggag

SEQ ID NO: 9292987 - DNA, 22 bp, Homo sapiens
atataccctgttcgagtcccag

SEQ ID NO: 9292988 - DNA, 22 bp, Homo sapiens
atatacctcattctttgagtgc

SEQ ID NO: 9292989 - DNA, 22 bp, Homo sapiens
atatacactccactgatacagg

SEQ ID NO: 9292990 - DNA, 22 bp, Homo sapiens
atatacacatgtgtatacattt

SEQ ID NO: 9292991 - DNA, 22 bp, Homo sapiens
ctggcctaggaatggttttccg

SEQ ID NO: 9292992 - DNA, 22 bp, Homo sapiens
ctggcctcagagggtcatggtg

SEQ ID NO: 9292993 - DNA, 22 bp, Homo sapiens
ctggcctcatagccaagctgtg

SEQ ID NO: 9292994 - DNA, 22 bp, Homo sapiens
ctggcctcatagccaagctgtg

SEQ ID NO: 9292995 - DNA, 20 bp, Homo sapiens
ctggccagaacgcctacaca

SEQ ID NO: 9292996 - DNA, 22 bp, Homo sapiens
ctggccagaagcacctttggcg

SEQ ID NO: 9292997 - DNA, 22 bp, Homo sapiens
ctggccagactacacatgtgtg

SEQ ID NO: 9292998 - DNA, 22 bp, Homo sapiens
ctggcaggtttggtgtctggtg

SEQ ID NO: 9292999 - DNA, 22 bp, Homo sapiens
ctggcaggtctcgctgacgtgt

SEQ ID NO: 9293000 - DNA, 20 bp, Homo sapiens
atacacatgcagacagatgc

SEQ ID NO: 9293001 - DNA, 22 bp, Homo sapiens
atacatgtgtgagcgaagatgt

SEQ ID NO: 9293002 - DNA, 22 bp, Homo sapiens
atacatgtgggtctaaacatat

SEQ ID NO: 9293003 - DNA, 22 bp, Homo sapiens
atacatgtacataaatgtagca

SEQ ID NO: 9293004 - DNA, 22 bp, Homo sapiens
ctggcacataattagtgatcct

SEQ ID NO: 9293005 - DNA, 17 bp, Homo sapiens
atacatgtaaagtgctt

SEQ ID NO: 9293006 - DNA, 23 bp, Homo sapiens
agttctcaaaaccagcttgacaa

SEQ ID NO: 9293007 - DNA, 22 bp, Homo sapiens
agttctcatcatgaagcataag

SEQ ID NO: 9293008 - DNA, 22 bp, Homo sapiens
agttctcattgcatgagacaga

SEQ ID NO: 9293009 - DNA, 22 bp, Homo sapiens
agttctcagcttagtatgctgt

SEQ ID NO: 9293010 - DNA, 22 bp, Homo sapiens
agttctcaagacaattacctgt

SEQ ID NO: 9293011 - DNA, 22 bp, Homo sapiens
ataaaaatgagggcggtagcta

SEQ ID NO: 9293012 - DNA, 17 bp, Homo sapiens
agttttgatataatggc

SEQ ID NO: 9293013 - DNA, 22 bp, Homo sapiens
ataaaagatcccttctgagctc

SEQ ID NO: 9293014 - DNA, 22 bp, Homo sapiens
ataaaagaagttttggtacttg

SEQ ID NO: 9293015 - DNA, 22 bp, Homo sapiens
ataaactctgcctcagaagagc

SEQ ID NO: 9293016 - DNA, 22 bp, Homo sapiens
ataaactctattttgaggagat

SEQ ID NO: 9293017 - DNA, 22 bp, Homo sapiens
ataaactcatgccaagaaatga

SEQ ID NO: 9293018 - DNA, 22 bp, Homo sapiens
ataaactcatgctgaaaaccca

SEQ ID NO: 9293019 - DNA, 22 bp, Homo sapiens
ataaagcatactttgtatgact

SEQ ID NO: 9293020 - DNA, 22 bp, Homo sapiens
ctgctacttttgcctgagtaac

SEQ ID NO: 9293021 - DNA, 22 bp, Homo sapiens
ctgctacttccagaagtgtcga

SEQ ID NO: 9293022 - DNA, 22 bp, Homo sapiens
ctgctacttaccagctgtgtaa

SEQ ID NO: 9293023 - DNA, 22 bp, Homo sapiens
ctgcctgggttcaagtcctgtt

SEQ ID NO: 9293024 - DNA, 22 bp, Homo sapiens
ctgcctggaaggagcaagggga

SEQ ID NO: 9293025 - DNA, 22 bp, Homo sapiens
ctgctggggtcagagcactggg

SEQ ID NO: 9293026 - DNA, 21 bp, Homo sapiens
atacacatacacataaatgtg

SEQ ID NO: 9293027 - DNA, 20 bp, Homo sapiens
atacacatattcttgcaact

SEQ ID NO: 9293028 - DNA, 22 bp, Homo sapiens
atacacatatgtgtgtatatgt

SEQ ID NO: 9293029 - DNA, 22 bp, Homo sapiens
atacacatctatttaagagaca

SEQ ID NO: 9293030 - DNA, 22 bp, Homo sapiens
ccatttatagatgtatttggct

SEQ ID NO: 9293031 - DNA, 22 bp, Homo sapiens
aggctggccctactggctgcct

SEQ ID NO: 9293032 - DNA, 22 bp, Homo sapiens
aggctggggaattgaatttgct

SEQ ID NO: 9293033 - DNA, 22 bp, Homo sapiens
ccatttgtggtttatttgctct

SEQ ID NO: 9293034 - DNA, 22 bp, Homo sapiens
aggctgggaaggtaaagttgta

SEQ ID NO: 9293035 - DNA, 22 bp, Homo sapiens
aggctgctcagtagatggagct

SEQ ID NO: 9293036 - DNA, 22 bp, Homo sapiens
aggctgcttcagctgcagggag

SEQ ID NO: 9293037 - DNA, 22 bp, Homo sapiens
aggctgcttccttacgtggctg

SEQ ID NO: 9293038 - DNA, 22 bp, Homo sapiens
ccaggctgggcggggaacctgg

SEQ ID NO: 9293039 - DNA, 22 bp, Homo sapiens
ccaggctgggctacaagttgag

SEQ ID NO: 9293040 - DNA, 22 bp, Homo sapiens
ccaggctgggcggggaacctgg

SEQ ID NO: 9293041 - DNA, 22 bp, Homo sapiens
ccaggctgcttagccttatctt

SEQ ID NO: 9293042 - DNA, 22 bp, Homo sapiens
ccaggctctgcgctggacatgg

SEQ ID NO: 9293043 - DNA, 22 bp, Homo sapiens
ccaggctctgcgctggacatgg

SEQ ID NO: 9293044 - DNA, 22 bp, Homo sapiens
aggctagaggcttctggcttca

SEQ ID NO: 9293045 - DNA, 22 bp, Homo sapiens
aggctacaggagacgccaggag

SEQ ID NO: 9293046 - DNA, 22 bp, Homo sapiens
aggctacaataattcccatgca

SEQ ID NO: 9293047 - DNA, 22 bp, Homo sapiens
aggctaagaggccttcagatac

SEQ ID NO: 9293048 - DNA, 22 bp, Homo sapiens
aggctaagatgactccaccccc

SEQ ID NO: 9293049 - DNA, 22 bp, Homo sapiens
aggctaagagcatttgctgaag

SEQ ID NO: 9293050 - DNA, 22 bp, Homo sapiens
aggctaagaaagattcattgca

SEQ ID NO: 9293051 - DNA, 22 bp, Homo sapiens
aggctaagaaggctttgttcct

SEQ ID NO: 9293052 - DNA, 22 bp, Homo sapiens
aggctaagaccctcctggggcc

SEQ ID NO: 9293053 - DNA, 22 bp, Homo sapiens
aggctaaggagtgtgatgctca

SEQ ID NO: 9293054 - DNA, 22 bp, Homo sapiens
aggctaagatgtggtctgagca

SEQ ID NO: 9293055 - DNA, 22 bp, Homo sapiens
aggctaaggaccaggagggcca

SEQ ID NO: 9293056 - DNA, 22 bp, Homo sapiens
aggctaagggatgactggagtg

SEQ ID NO: 9293057 - DNA, 22 bp, Homo sapiens
aggctaaggtgggaggatcgct

SEQ ID NO: 9293058 - DNA, 22 bp, Homo sapiens
aggctaagtgagtaaaatgtgg

SEQ ID NO: 9293059 - DNA, 22 bp, Homo sapiens
aggctaagtgattagtgacata

SEQ ID NO: 9293060 - DNA, 22 bp, Homo sapiens
aggctaagtgggtgtcagggcc

SEQ ID NO: 9293061 - DNA, 22 bp, Homo sapiens
aggctaagttgattaaattgtt

SEQ ID NO: 9293062 - DNA, 22 bp, Homo sapiens
ccagggcaggagaaagactcac

SEQ ID NO: 9293063 - DNA, 22 bp, Homo sapiens
ccagggctggtgggagatgctg

SEQ ID NO: 9293064 - DNA, 22 bp, Homo sapiens
ccagctcttggtgcacttacat

SEQ ID NO: 9293065 - DNA, 21 bp, Homo sapiens
ccagctctgcctccagttggt

SEQ ID NO: 9293066 - DNA, 22 bp, Homo sapiens
ccagctctgcttgcccagtcag

SEQ ID NO: 9293067 - DNA, 22 bp, Homo sapiens
ccagctcttttggctgagtgag

SEQ ID NO: 9293068 - DNA, 22 bp, Homo sapiens
ccagctgacgatgcctggtctc

SEQ ID NO: 9293069 - DNA, 22 bp, Homo sapiens
ccagctggaacggcagcccagc

SEQ ID NO: 9293070 - DNA, 22 bp, Homo sapiens
ccagctgagaagtgtaaagtga

SEQ ID NO: 9293071 - DNA, 22 bp, Homo sapiens
ccagctggaaacaaatagagtg

SEQ ID NO: 9293072 - DNA, 22 bp, Homo sapiens
ccagctggaagagtgcagaact

SEQ ID NO: 9293073 - DNA, 22 bp, Homo sapiens
ccagctggagctcgcagatagg

SEQ ID NO: 9293074 - DNA, 22 bp, Homo sapiens
ccagctggagccaaggtggact

SEQ ID NO: 9293075 - DNA, 22 bp, Homo sapiens
ccagctggcaggagagtcaggg

SEQ ID NO: 9293076 - DNA, 22 bp, Homo sapiens
ccagctggcactgtggctgccc

SEQ ID NO: 9293077 - DNA, 22 bp, Homo sapiens
ccagctggcccagctgtgctcc

SEQ ID NO: 9293078 - DNA, 22 bp, Homo sapiens
ccagaacacagtggaagaatat

SEQ ID NO: 9293079 - DNA, 22 bp, Homo sapiens
ccagaaatcctctctttcttgc

SEQ ID NO: 9293080 - DNA, 22 bp, Homo sapiens
aggcaggctgctatggagtaga

SEQ ID NO: 9293081 - DNA, 22 bp, Homo sapiens
ccactgggggctgcaggcactc

SEQ ID NO: 9293082 - DNA, 22 bp, Homo sapiens
ccagacagttccttgaggttca

SEQ ID NO: 9293083 - DNA, 22 bp, Homo sapiens
aggccacagtactttgcagacc

SEQ ID NO: 9293084 - DNA, 22 bp, Homo sapiens
aggccagtggttctctgtgtcc

SEQ ID NO: 9293085 - DNA, 22 bp, Homo sapiens
aggccagtgcctttccagggct

SEQ ID NO: 9293086 - DNA, 22 bp, Homo sapiens
aggccagtgtggctggagcaca

SEQ ID NO: 9293087 - DNA, 23 bp, Homo sapiens
aggccagtttttcctgcttgctg

SEQ ID NO: 9293088 - DNA, 22 bp, Homo sapiens
aggccagttgttcagtgggccg

SEQ ID NO: 9293089 - DNA, 22 bp, Homo sapiens
aggccagtgcagctggaacaga

SEQ ID NO: 9293090 - DNA, 22 bp, Homo sapiens
aggccagtgccatcagggtttt

SEQ ID NO: 9293091 - DNA, 22 bp, Homo sapiens
aggccaggatagcatggatcag

SEQ ID NO: 9293092 - DNA, 22 bp, Homo sapiens
aggccatgaggtcatgggagat

SEQ ID NO: 9293093 - DNA, 22 bp, Homo sapiens
aggggagagttaatgtgaatgt

SEQ ID NO: 9293094 - DNA, 22 bp, Homo sapiens
aggggatggagctggaaggcag

SEQ ID NO: 9293095 - DNA, 22 bp, Homo sapiens
cctgaaatgagttctgctcact

SEQ ID NO: 9293096 - DNA, 21 bp, Homo sapiens
cctgaaattctcactagctta

SEQ ID NO: 9293097 - DNA, 22 bp, Homo sapiens
cctgaaatgactccagctgagt

SEQ ID NO: 9293098 - DNA, 22 bp, Homo sapiens
cctgaaatccatagtttacact

SEQ ID NO: 9293099 - DNA, 22 bp, Homo sapiens
cctgaaatttgaagacctgaat

SEQ ID NO: 9293100 - DNA, 22 bp, Homo sapiens
cctgaagatgctgtggcctggt

SEQ ID NO: 9293101 - DNA, 22 bp, Homo sapiens
cctgaagagcactctagagttg

SEQ ID NO: 9293102 - DNA, 22 bp, Homo sapiens
cctgagagtaggtgtctcttta

SEQ ID NO: 9293103 - DNA, 22 bp, Homo sapiens
aggggtgaaggcccgataggag

SEQ ID NO: 9293104 - DNA, 22 bp, Homo sapiens
agggtagggcccggagacagac

SEQ ID NO: 9293105 - DNA, 22 bp, Homo sapiens
agggtagggcccggagacagac

SEQ ID NO: 9293106 - DNA, 22 bp, Homo sapiens
agggtaggaactgagtggaagg

SEQ ID NO: 9293107 - DNA, 22 bp, Homo sapiens
agggtagggtaaatgatgcatc

SEQ ID NO: 9293108 - DNA, 22 bp, Homo sapiens
agggtaggtgtaagatagccct

SEQ ID NO: 9293109 - DNA, 22 bp, Homo sapiens
agggtagggccgtagggccatg

SEQ ID NO: 9293110 - DNA, 22 bp, Homo sapiens
cctcagcttgatttctgcagag

SEQ ID NO: 9293111 - DNA, 22 bp, Homo sapiens
cctcagcttgatttctgcagag

SEQ ID NO: 9293112 - DNA, 22 bp, Homo sapiens
cctcaggaaccacattgctgct

SEQ ID NO: 9293113 - DNA, 22 bp, Homo sapiens
agggcctggaactggagaccac

SEQ ID NO: 9293114 - DNA, 22 bp, Homo sapiens
agggcctggaactgtgggcagg

SEQ ID NO: 9293115 - DNA, 22 bp, Homo sapiens
agggctggcaagggattgaaat

SEQ ID NO: 9293116 - DNA, 22 bp, Homo sapiens
agggctggagccacagctggga

SEQ ID NO: 9293117 - DNA, 22 bp, Homo sapiens
cccaggctggtcctgaactcct

SEQ ID NO: 9293118 - DNA, 22 bp, Homo sapiens
cccaggctgcgtatccacaata

SEQ ID NO: 9293119 - DNA, 22 bp, Homo sapiens
cccaggaggtcgaagctgcagt

SEQ ID NO: 9293120 - DNA, 22 bp, Homo sapiens
aggctggtgcttcctagggcag

SEQ ID NO: 9293121 - DNA, 22 bp, Homo sapiens
ccccttccaggaagcagaatcg

SEQ ID NO: 9293122 - DNA, 22 bp, Homo sapiens
ccctattagtgaccacatcata

SEQ ID NO: 9293123 - DNA, 22 bp, Homo sapiens
cccatgcaccctctaagaagga

SEQ ID NO: 9293124 - DNA, 22 bp, Homo sapiens
ccctccatgagtgtgctgctgg

SEQ ID NO: 9293125 - DNA, 22 bp, Homo sapiens
ccctccattaaaacagacctat

SEQ ID NO: 9293126 - DNA, 20 bp, Homo sapiens
ccctcccagatgcttcccaa

SEQ ID NO: 9293127 - DNA, 22 bp, Homo sapiens
ccctcccaagcactctgacata

SEQ ID NO: 9293128 - DNA, 22 bp, Homo sapiens
ccctcccagatgggcttgaggt

SEQ ID NO: 9293129 - DNA, 22 bp, Homo sapiens
ccctcccaggagtggccagaga

SEQ ID NO: 9293130 - DNA, 22 bp, Homo sapiens
aggaggtgagcggtcatgtggt

SEQ ID NO: 9293131 - DNA, 22 bp, Homo sapiens
aggaggtgacagcctgcatctg

SEQ ID NO: 9293132 - DNA, 22 bp, Homo sapiens
aggaggctggttcaggccatat

SEQ ID NO: 9293133 - DNA, 22 bp, Homo sapiens
catcatgtctgcaggaatgtgt

SEQ ID NO: 9293134 - DNA, 22 bp, Homo sapiens
aggagtggtgcaggacctgcca

SEQ ID NO: 9293135 - DNA, 20 bp, Homo sapiens
catcagaaatcctgacccac

SEQ ID NO: 9293136 - DNA, 22 bp, Homo sapiens
aggaggctgcaaccctgaggcc

SEQ ID NO: 9293137 - DNA, 22 bp, Homo sapiens
aggaggctgcaaccctgaggcc

SEQ ID NO: 9293138 - DNA, 22 bp, Homo sapiens
aggaggctgcaaccctgaggcc

SEQ ID NO: 9293139 - DNA, 22 bp, Homo sapiens
aggaggctgggcacagtggcct

SEQ ID NO: 9293140 - DNA, 22 bp, Homo sapiens
aggaggctgggcacagtggcct

SEQ ID NO: 9293141 - DNA, 22 bp, Homo sapiens
cagttatttcaacagagaggat

SEQ ID NO: 9293142 - DNA, 22 bp, Homo sapiens
cagttattatcttagagagaca

SEQ ID NO: 9293143 - DNA, 17 bp, Homo sapiens
aggagctgggggtggtg

SEQ ID NO: 9293144 - DNA, 22 bp, Homo sapiens
cagtgaggagtccagggcagag

SEQ ID NO: 9293145 - DNA, 22 bp, Homo sapiens
cagtctcttttcagctccatcc

SEQ ID NO: 9293146 - DNA, 22 bp, Homo sapiens
aggacaaaggaccagatctgga

SEQ ID NO: 9293147 - DNA, 22 bp, Homo sapiens
cagtgaggctctgctgagcggt

SEQ ID NO: 9293148 - DNA, 22 bp, Homo sapiens
cagtgagggaagatctcagcac

SEQ ID NO: 9293149 - DNA, 22 bp, Homo sapiens
cagtgagggcattcagtgctgg

SEQ ID NO: 9293150 - DNA, 23 bp, Homo sapiens
cagtggagactcatgcttcctta

SEQ ID NO: 9293151 - DNA, 22 bp, Homo sapiens
aggagctggccactaggatgca

SEQ ID NO: 9293152 - DNA, 22 bp, Homo sapiens
aggagctgggcccaaggatgct

SEQ ID NO: 9293153 - DNA, 22 bp, Homo sapiens
aggagctgggcccaaggatgct

SEQ ID NO: 9293154 - DNA, 22 bp, Homo sapiens
aggagctgggagaaggactaaa

SEQ ID NO: 9293155 - DNA, 22 bp, Homo sapiens
aggcaggcccctgagaatagac

SEQ ID NO: 9293156 - DNA, 22 bp, Homo sapiens
aggcaggcccctgagaatagac

SEQ ID NO: 9293157 - DNA, 23 bp, Homo sapiens
aggcaggcagttcagctgttgtt

SEQ ID NO: 9293158 - DNA, 22 bp, Homo sapiens
aggcaggctctgggtatgtgca

SEQ ID NO: 9293159 - DNA, 22 bp, Homo sapiens
aggcaggctagtcgcttgagcc

SEQ ID NO: 9293160 - DNA, 22 bp, Homo sapiens
aggcaggctcaatgcccagtct

SEQ ID NO: 9293161 - DNA, 22 bp, Homo sapiens
aggcaggcctacacaatgggag

SEQ ID NO: 9293162 - DNA, 22 bp, Homo sapiens
aggcaggcctacacaatgggag

SEQ ID NO: 9293163 - DNA, 18 bp, Homo sapiens
aggcaggcggatcacaag

SEQ ID NO: 9293164 - DNA, 22 bp, Homo sapiens
aggcagctggcagcacccaggg

SEQ ID NO: 9293165 - DNA, 22 bp, Homo sapiens
aggcagctgtgaggactggatt

SEQ ID NO: 9293166 - DNA, 22 bp, Homo sapiens
aggcagctttctgtaggggtgt

SEQ ID NO: 9293167 - DNA, 22 bp, Homo sapiens
aggatctcgcctcctgagctat

SEQ ID NO: 9293168 - DNA, 22 bp, Homo sapiens
aggatcaggccctctagggtag

SEQ ID NO: 9293169 - DNA, 22 bp, Homo sapiens
catgtgtctaatctactaatat

SEQ ID NO: 9293170 - DNA, 22 bp, Homo sapiens
catgtgtcttgctgccctccat

SEQ ID NO: 9293171 - DNA, 22 bp, Homo sapiens
catgtgtctttatggagccaca

SEQ ID NO: 9293172 - DNA, 21 bp, Homo sapiens
catgtgtcttgtgttactgct

SEQ ID NO: 9293173 - DNA, 22 bp, Homo sapiens
catgtccttctcattgcctcat

SEQ ID NO: 9293174 - DNA, 22 bp, Homo sapiens
catgtgtcctagctattctcct

SEQ ID NO: 9293175 - DNA, 22 bp, Homo sapiens
aggcactgattctcagagttac

SEQ ID NO: 9293176 - DNA, 22 bp, Homo sapiens
aggcactgactcaagggagcca

SEQ ID NO: 9293177 - DNA, 23 bp, Homo sapiens
aggcactgaatgtgtcagtgagt

SEQ ID NO: 9293178 - DNA, 22 bp, Homo sapiens
aggcactgaatatccagtaaaa

SEQ ID NO: 9293179 - DNA, 22 bp, Homo sapiens
aggcactgaaggaagcttgcgc

SEQ ID NO: 9293180 - DNA, 22 bp, Homo sapiens
aggaagtcagaatgctggggag

SEQ ID NO: 9293181 - DNA, 22 bp, Homo sapiens
aggaagtcagctgccatgctgt

SEQ ID NO: 9293182 - DNA, 22 bp, Homo sapiens
caggtccctgcgccccggcctc

SEQ ID NO: 9293183 - DNA, 22 bp, Homo sapiens
cagggtttcaccatgttagcag

SEQ ID NO: 9293184 - DNA, 22 bp, Homo sapiens
cagggttggtttctcctcaggc

SEQ ID NO: 9293185 - DNA, 22 bp, Homo sapiens
cagggttgattccttctgaggg

SEQ ID NO: 9293186 - DNA, 17 bp, Homo sapiens
aggaaacattttctttc

SEQ ID NO: 9293187 - DNA, 22 bp, Homo sapiens
aggaaaatcgagtctggaggca

SEQ ID NO: 9293188 - DNA, 22 bp, Homo sapiens
aggaaacagaggtgccacaata

SEQ ID NO: 9293189 - DNA, 22 bp, Homo sapiens
aggaaacaacttggcatgagcc

SEQ ID NO: 9293190 - DNA, 22 bp, Homo sapiens
caggcttgctgctagagcactt

SEQ ID NO: 9293191 - DNA, 22 bp, Homo sapiens
agcttctcaggagtctgaggca

SEQ ID NO: 9293192 - DNA, 22 bp, Homo sapiens
agctttatatttaatgaattct

SEQ ID NO: 9293193 - DNA, 22 bp, Homo sapiens
agctttattaactctccaggtg

SEQ ID NO: 9293194 - DNA, 22 bp, Homo sapiens
agctttatttgtcattcacggc

SEQ ID NO: 9293195 - DNA, 22 bp, Homo sapiens
agctttattcatgatttcaggg

SEQ ID NO: 9293196 - DNA, 22 bp, Homo sapiens
agctttcactgatatgctttga

SEQ ID NO: 9293197 - DNA, 20 bp, Homo sapiens
agcttctgctgcctttcggc

SEQ ID NO: 9293198 - DNA, 22 bp, Homo sapiens
agcttctgttcatcttccaggc

SEQ ID NO: 9293199 - DNA, 22 bp, Homo sapiens
caggaagaccagggctgtggct

SEQ ID NO: 9293200 - DNA, 22 bp, Homo sapiens
agctgaaattcacaaggatcca

SEQ ID NO: 9293201 - DNA, 22 bp, Homo sapiens
agctgaaaattagtgatagttt

SEQ ID NO: 9293202 - DNA, 22 bp, Homo sapiens
agctcttttgctctccaagttt

SEQ ID NO: 9293203 - DNA, 22 bp, Homo sapiens
agctcttttatcatgaggagag

SEQ ID NO: 9293204 - DNA, 22 bp, Homo sapiens
agctctttggcactgagcagca

SEQ ID NO: 9293205 - DNA, 21 bp, Homo sapiens
agctgctttcagctcctagag

SEQ ID NO: 9293206 - DNA, 23 bp, Homo sapiens
agctgggtggcctgcgtgaagct

SEQ ID NO: 9293207 - DNA, 21 bp, Homo sapiens
agctgggtgctaatgacaact

SEQ ID NO: 9293208 - DNA, 22 bp, Homo sapiens
agctgggtgtagggctggacaa

SEQ ID NO: 9293209 - DNA, 22 bp, Homo sapiens
agctgggtggtgctgagccttg

SEQ ID NO: 9293210 - DNA, 22 bp, Homo sapiens
agctgggtgcccgaagccacgt

SEQ ID NO: 9293211 - DNA, 19 bp, Homo sapiens
agctggggcggtgtgtgtt

SEQ ID NO: 9293212 - DNA, 20 bp, Homo sapiens
agctggtgaattaaagactg

SEQ ID NO: 9293213 - DNA, 22 bp, Homo sapiens
agctggtgaacctgaggcacag

SEQ ID NO: 9293214 - DNA, 22 bp, Homo sapiens
agctgggtttctggcaggctta

SEQ ID NO: 9293215 - DNA, 22 bp, Homo sapiens
agctggtatgaacaggatagga

SEQ ID NO: 9293216 - DNA, 19 bp, Homo sapiens
agctgggtgttagtggaga

SEQ ID NO: 9293217 - DNA, 22 bp, Homo sapiens
agctgggttgacaagatggaaa

SEQ ID NO: 9293218 - DNA, 22 bp, Homo sapiens
agctgggcctgagctggaagct

SEQ ID NO: 9293219 - DNA, 22 bp, Homo sapiens
agctgggcagactgcagtggtt

SEQ ID NO: 9293220 - DNA, 23 bp, Homo sapiens
agctgggccaggtggtcagacct

SEQ ID NO: 9293221 - DNA, 22 bp, Homo sapiens
agctggagattctggggacagt

SEQ ID NO: 9293222 - DNA, 19 bp, Homo sapiens
agctggagattggagggca

SEQ ID NO: 9293223 - DNA, 22 bp, Homo sapiens
agctggagcttcaagcaggtaa

SEQ ID NO: 9293224 - DNA, 20 bp, Homo sapiens
agctggagaagggcccttcc

SEQ ID NO: 9293225 - DNA, 22 bp, Homo sapiens
agctggagaaacctgggagggt

SEQ ID NO: 9293226 - DNA, 22 bp, Homo sapiens
agctggagatgcccagcaccgg

SEQ ID NO: 9293227 - DNA, 22 bp, Homo sapiens
agctggagaatgtggatgatcc

SEQ ID NO: 9293228 - DNA, 22 bp, Homo sapiens
agctggagatcatgctgatact

SEQ ID NO: 9293229 - DNA, 18 bp, Homo sapiens
aggaaagaaaggcaggtg

SEQ ID NO: 9293230 - DNA, 22 bp, Homo sapiens
aggaaactgatgttttttacaa

SEQ ID NO: 9293231 - DNA, 19 bp, Homo sapiens
aggaaactgtcttttccag

SEQ ID NO: 9293232 - DNA, 22 bp, Homo sapiens
aggaaactaacttatctttata

SEQ ID NO: 9293233 - DNA, 22 bp, Homo sapiens
aggaaactaattagtagaataa

SEQ ID NO: 9293234 - DNA, 22 bp, Homo sapiens
aggaaactcaaagtgtcaggta

SEQ ID NO: 9293235 - DNA, 21 bp, Homo sapiens
agcttttctgttttatatcta

SEQ ID NO: 9293236 - DNA, 23 bp, Homo sapiens
agcttttaggtggaaatggcact

SEQ ID NO: 9293237 - DNA, 22 bp, Homo sapiens
agctttatggtgcctcacttga

SEQ ID NO: 9293238 - DNA, 22 bp, Homo sapiens
agctttggttgaggggagtgtg

SEQ ID NO: 9293239 - DNA, 21 bp, Homo sapiens
agctgtggcgaggggaacatg

SEQ ID NO: 9293240 - DNA, 22 bp, Homo sapiens
agctgtgggcctgggagagctg

SEQ ID NO: 9293241 - DNA, 22 bp, Homo sapiens
agctgtgggcctgggagagctg

SEQ ID NO: 9293242 - DNA, 22 bp, Homo sapiens
acagccaggtaaaggcatggca

SEQ ID NO: 9293243 - DNA, 22 bp, Homo sapiens
agctgcagctacagtgttggtt

SEQ ID NO: 9293244 - DNA, 22 bp, Homo sapiens
agctgcaggcccatgctcagtc

SEQ ID NO: 9293245 - DNA, 22 bp, Homo sapiens
aggactttaacatattaactgt

SEQ ID NO: 9293246 - DNA, 22 bp, Homo sapiens
aggagacatactataggaatat

SEQ ID NO: 9293247 - DNA, 22 bp, Homo sapiens
aggagactcagagacctggccg

SEQ ID NO: 9293248 - DNA, 22 bp, Homo sapiens
aggaagctagagccaccggact

SEQ ID NO: 9293249 - DNA, 22 bp, Homo sapiens
aggaagctaaccagggagtgag

SEQ ID NO: 9293250 - DNA, 22 bp, Homo sapiens
aggaagcgtgggtctggctgga

SEQ ID NO: 9293251 - DNA, 22 bp, Homo sapiens
aggagctgctttggtgcggttt

SEQ ID NO: 9293252 - DNA, 22 bp, Homo sapiens
aggagctgcagattctgccttg

SEQ ID NO: 9293253 - DNA, 21 bp, Homo sapiens
acatacataccttaccacctt

SEQ ID NO: 9293254 - DNA, 22 bp, Homo sapiens
acatacatatgtttaaatgcat

SEQ ID NO: 9293255 - DNA, 23 bp, Homo sapiens
acatacatggagataaagtgatg

SEQ ID NO: 9293256 - DNA, 23 bp, Homo sapiens
acatacatggagataaagtgatg

SEQ ID NO: 9293257 - DNA, 22 bp, Homo sapiens
acatacacatgaatatattttt

SEQ ID NO: 9293258 - DNA, 22 bp, Homo sapiens
acatacacacatactttctcct

SEQ ID NO: 9293259 - DNA, 22 bp, Homo sapiens
acatacacaagcgtacatgaac

SEQ ID NO: 9293260 - DNA, 22 bp, Homo sapiens
acatacacaagcgtacatgaac

SEQ ID NO: 9293261 - DNA, 23 bp, Homo sapiens
acatacataagcaccacattttg

SEQ ID NO: 9293262 - DNA, 22 bp, Homo sapiens
acatacacatgaatatattttt

SEQ ID NO: 9293263 - DNA, 22 bp, Homo sapiens
acatacacgggaaacctctttt

SEQ ID NO: 9293264 - DNA, 22 bp, Homo sapiens
acatacagacctgcagggcagc

SEQ ID NO: 9293265 - DNA, 17 bp, Homo sapiens
acatacactggtgaaca

SEQ ID NO: 9293266 - DNA, 22 bp, Homo sapiens
aggcacagatttggggaaagca

SEQ ID NO: 9293267 - DNA, 22 bp, Homo sapiens
acataaatttcactgttccgtg

SEQ ID NO: 9293268 - DNA, 20 bp, Homo sapiens
aggatggcaagcaagtgcat

SEQ ID NO: 9293269 - DNA, 22 bp, Homo sapiens
aggcaaaattacaaagttatta

SEQ ID NO: 9293270 - DNA, 22 bp, Homo sapiens
aggcaaagaagttggtcaggag

SEQ ID NO: 9293271 - DNA, 23 bp, Homo sapiens
aggcaaacctataaaataggaat

SEQ ID NO: 9293272 - DNA, 21 bp, Homo sapiens
aggattttgttgaagtttctg

SEQ ID NO: 9293273 - DNA, 22 bp, Homo sapiens
aggaggcttttgcaggtgccac

SEQ ID NO: 9293274 - DNA, 22 bp, Homo sapiens
aggaggctgtggagcactccat

SEQ ID NO: 9293275 - DNA, 21 bp, Homo sapiens
aggcccaggaatatgcatttt

SEQ ID NO: 9293276 - DNA, 22 bp, Homo sapiens
aggcccagcttgaagtgggaag

SEQ ID NO: 9293277 - DNA, 18 bp, Homo sapiens
aggcatggtggtgcgcac

SEQ ID NO: 9293278 - DNA, 22 bp, Homo sapiens
aggcatggcatggggcagatgt

SEQ ID NO: 9293279 - DNA, 22 bp, Homo sapiens
acatacatgggattaaaaaatt

SEQ ID NO: 9293280 - DNA, 19 bp, Homo sapiens
aggcttcaggccacatgct

SEQ ID NO: 9293281 - DNA, 19 bp, Homo sapiens
acattcccatcagcaatgt

SEQ ID NO: 9293282 - DNA, 22 bp, Homo sapiens
acattcctgaatgggcacattt

SEQ ID NO: 9293283 - DNA, 22 bp, Homo sapiens
acattcctcagtgccagttgag

SEQ ID NO: 9293284 - DNA, 22 bp, Homo sapiens
accagtggaattattctgtggt

SEQ ID NO: 9293285 - DNA, 22 bp, Homo sapiens
accagtggatactgcttgcttt

SEQ ID NO: 9293286 - DNA, 22 bp, Homo sapiens
accagtgggtgtcattccctta

SEQ ID NO: 9293287 - DNA, 22 bp, Homo sapiens
accagtggatgaatgctggacc

SEQ ID NO: 9293288 - DNA, 22 bp, Homo sapiens
accagtgggaagtggaaaatga

SEQ ID NO: 9293289 - DNA, 22 bp, Homo sapiens
accagtgtcaccccaaccagga

SEQ ID NO: 9293290 - DNA, 22 bp, Homo sapiens
accaaatgcttggctgctgtga

SEQ ID NO: 9293291 - DNA, 22 bp, Homo sapiens
acccagggtagagtgcagtggc

SEQ ID NO: 9293292 - DNA, 22 bp, Homo sapiens
acccaccctactagcagtgtcc

SEQ ID NO: 9293293 - DNA, 22 bp, Homo sapiens
accctggtgatttgagagagta

SEQ ID NO: 9293294 - DNA, 22 bp, Homo sapiens
accctggtgttgccccgctttt

SEQ ID NO: 9293295 - DNA, 22 bp, Homo sapiens
accccagaatctatgctttaca

SEQ ID NO: 9293296 - DNA, 20 bp, Homo sapiens
accccacagagtccattgca

SEQ ID NO: 9293297 - DNA, 22 bp, Homo sapiens
actaaatatttgagaggtgtag

SEQ ID NO: 9293298 - DNA, 22 bp, Homo sapiens
acctttttgttctgttctcagc

SEQ ID NO: 9293299 - DNA, 22 bp, Homo sapiens
accttttccagcttctagaggc

SEQ ID NO: 9293300 - DNA, 22 bp, Homo sapiens
accttttttcagaactctaaag

SEQ ID NO: 9293301 - DNA, 22 bp, Homo sapiens
aggtgaagttaaaaaccagtct

SEQ ID NO: 9293302 - DNA, 22 bp, Homo sapiens
acctttgagtgtattgtctttc

SEQ ID NO: 9293303 - DNA, 22 bp, Homo sapiens
aggtaggaaagtctccttgtat

SEQ ID NO: 9293304 - DNA, 22 bp, Homo sapiens
aggtaggagttgatggatgttc

SEQ ID NO: 9293305 - DNA, 22 bp, Homo sapiens
actccctctctagtccttgcaa

SEQ ID NO: 9293306 - DNA, 22 bp, Homo sapiens
agtcaccctccaactctccact

SEQ ID NO: 9293307 - DNA, 22 bp, Homo sapiens
actcctgggtgctgaccagcgt

SEQ ID NO: 9293308 - DNA, 22 bp, Homo sapiens
actctctctgatggaactttag

SEQ ID NO: 9293309 - DNA, 22 bp, Homo sapiens
actctctcacacacgcctatat

SEQ ID NO: 9293310 - DNA, 22 bp, Homo sapiens
actctctcacacacgcctatat

SEQ ID NO: 9293311 - DNA, 22 bp, Homo sapiens
actctctcacagcttggctgat

SEQ ID NO: 9293312 - DNA, 22 bp, Homo sapiens
actctctcacagcttggctgat

SEQ ID NO: 9293313 - DNA, 22 bp, Homo sapiens
actctcccttggagcctcaggc

SEQ ID NO: 9293314 - DNA, 22 bp, Homo sapiens
agtatacaaataaatgtgtaat

SEQ ID NO: 9293315 - DNA, 22 bp, Homo sapiens
agtatacagtaatgacatatct

SEQ ID NO: 9293316 - DNA, 22 bp, Homo sapiens
aggtggggaaaccagcgatccc

SEQ ID NO: 9293317 - DNA, 22 bp, Homo sapiens
actgcacttcaccctgggtgac

SEQ ID NO: 9293318 - DNA, 22 bp, Homo sapiens
actgcactccagcctgggtgat

SEQ ID NO: 9293319 - DNA, 22 bp, Homo sapiens
actgcactcctgcctgggtaac

SEQ ID NO: 9293320 - DNA, 22 bp, Homo sapiens
actgcactcctgcctgggtaac

SEQ ID NO: 9293321 - DNA, 22 bp, Homo sapiens
actctgccatcccaggtgctgt

SEQ ID NO: 9293322 - DNA, 22 bp, Homo sapiens
actctgccccgagttctgggaa

SEQ ID NO: 9293323 - DNA, 22 bp, Homo sapiens
actctgcctttcagcagatgaa

SEQ ID NO: 9293324 - DNA, 18 bp, Homo sapiens
actctgcggaggccccag

SEQ ID NO: 9293325 - DNA, 22 bp, Homo sapiens
actgagagtcaagatagcatgg

SEQ ID NO: 9293326 - DNA, 22 bp, Homo sapiens
actgagagcgtgtacaaactta

SEQ ID NO: 9293327 - DNA, 22 bp, Homo sapiens
actgcccatgtgcatcaagtag

SEQ ID NO: 9293328 - DNA, 22 bp, Homo sapiens
actgccaatggtagtttgatgg

SEQ ID NO: 9293329 - DNA, 22 bp, Homo sapiens
actgccaatggtagtttgatgg

SEQ ID NO: 9293330 - DNA, 21 bp, Homo sapiens
actgccaggagagtaggggga

SEQ ID NO: 9293331 - DNA, 21 bp, Homo sapiens
actggccaccactggcagggg

SEQ ID NO: 9293332 - DNA, 22 bp, Homo sapiens
agtgtccttagttagctttggg

SEQ ID NO: 9293333 - DNA, 21 bp, Homo sapiens
agtgtccttgatcttgccttg

SEQ ID NO: 9293334 - DNA, 22 bp, Homo sapiens
agtgtccttgaggttcctagga

SEQ ID NO: 9293335 - DNA, 22 bp, Homo sapiens
agtgtccttgattcctgttgtt

SEQ ID NO: 9293336 - DNA, 22 bp, Homo sapiens
agtgtcctttctgttccagcca

SEQ ID NO: 9293337 - DNA, 22 bp, Homo sapiens
agtgtccttgttattactgctc

SEQ ID NO: 9293338 - DNA, 22 bp, Homo sapiens
actgggcagggaaggagaccga

SEQ ID NO: 9293339 - DNA, 21 bp, Homo sapiens
agtgtccttttactgtgaata

SEQ ID NO: 9293340 - DNA, 22 bp, Homo sapiens
agtgtcctgtgtcccagactgt

SEQ ID NO: 9293341 - DNA, 22 bp, Homo sapiens
agtgtcctggggccctaaggcc

SEQ ID NO: 9293342 - DNA, 22 bp, Homo sapiens
atcccacacccctacaacatat

SEQ ID NO: 9293343 - DNA, 22 bp, Homo sapiens
atctcagggctggagccctgga

SEQ ID NO: 9293344 - DNA, 22 bp, Homo sapiens
agaacagggactggaggcttca

SEQ ID NO: 9293345 - DNA, 22 bp, Homo sapiens
agaacagtcgtggtgagagaaa

SEQ ID NO: 9293346 - DNA, 22 bp, Homo sapiens
atccccacgatatagccaaagc

SEQ ID NO: 9293347 - DNA, 22 bp, Homo sapiens
agaagccaacagggcaggagag

SEQ ID NO: 9293348 - DNA, 22 bp, Homo sapiens
agaagccaattctgtgtgagtc

SEQ ID NO: 9293349 - DNA, 22 bp, Homo sapiens
atctctgtaattacatgatatt

SEQ ID NO: 9293350 - DNA, 22 bp, Homo sapiens
atctcttcccaactccacattc

SEQ ID NO: 9293351 - DNA, 16 bp, Homo sapiens
acttttccaccttttt

SEQ ID NO: 9293352 - DNA, 22 bp, Homo sapiens
acttttcccttggtagagttgc

SEQ ID NO: 9293353 - DNA, 21 bp, Homo sapiens
agaaaaaccagcatgttttca

SEQ ID NO: 9293354 - DNA, 22 bp, Homo sapiens
atattttggggtgatgtgcatc

SEQ ID NO: 9293355 - DNA, 22 bp, Homo sapiens
atatttctccaaatgttttcaa

SEQ ID NO: 9293356 - DNA, 23 bp, Homo sapiens
atcagtcttggtagctgtgccca

SEQ ID NO: 9293357 - DNA, 22 bp, Homo sapiens
agaaagaggatgcagatctcat

SEQ ID NO: 9293358 - DNA, 22 bp, Homo sapiens
agaaagcactctgtcttttacc

SEQ ID NO: 9293359 - DNA, 22 bp, Homo sapiens
agaaagcccacccagaagatgt

SEQ ID NO: 9293360 - DNA, 22 bp, Homo sapiens
agaaagcccaggagaacagatt

SEQ ID NO: 9293361 - DNA, 22 bp, Homo sapiens
agaaagcatctccattgtaggt

SEQ ID NO: 9293362 - DNA, 21 bp, Homo sapiens
ataaagttttacaggaatgca

SEQ ID NO: 9293363 - DNA, 22 bp, Homo sapiens
ataaagtagccactggaaagct

SEQ ID NO: 9293364 - DNA, 22 bp, Homo sapiens
agttttatgcagtgttctgata

SEQ ID NO: 9293365 - DNA, 21 bp, Homo sapiens
actttaatatacatgaggagg

SEQ ID NO: 9293366 - DNA, 21 bp, Homo sapiens
actttaatatacatgaggagg

SEQ ID NO: 9293367 - DNA, 22 bp, Homo sapiens
atacaaaaattagccgggagta

SEQ ID NO: 9293368 - DNA, 22 bp, Homo sapiens
acttctcttcataggtggcaat

SEQ ID NO: 9293369 - DNA, 22 bp, Homo sapiens
atacaaaatatatactggagac

SEQ ID NO: 9293370 - DNA, 22 bp, Homo sapiens
atagatattagcaaaattttat

SEQ ID NO: 9293371 - DNA, 22 bp, Homo sapiens
atagatatttgagttgtttcca

SEQ ID NO: 9293372 - DNA, 20 bp, Homo sapiens
atagatatcatctttagaag

SEQ ID NO: 9293373 - DNA, 22 bp, Homo sapiens
atagatacattgttatatttgt

SEQ ID NO: 9293374 - DNA, 22 bp, Homo sapiens
atagagtgatgtaaggtatgtg

SEQ ID NO: 9293375 - DNA, 22 bp, Homo sapiens
atagagtgatgtaaggtatgtg

SEQ ID NO: 9293376 - DNA, 22 bp, Homo sapiens
atacatcatgctccatatattt

SEQ ID NO: 9293377 - DNA, 22 bp, Homo sapiens
agagaagggtgtagcctgggcc

SEQ ID NO: 9293378 - DNA, 22 bp, Homo sapiens
agagaaaagagttcaggctttg

SEQ ID NO: 9293379 - DNA, 22 bp, Homo sapiens
agagaaaactcattgaggtgtc

SEQ ID NO: 9293380 - DNA, 22 bp, Homo sapiens
agagaaaactcattgaggtgtc

SEQ ID NO: 9293381 - DNA, 22 bp, Homo sapiens
agagacaagggacctctggaga

SEQ ID NO: 9293382 - DNA, 22 bp, Homo sapiens
agagaattctggtgctaacaag

SEQ ID NO: 9293383 - DNA, 22 bp, Homo sapiens
agagagcatggcacagaggggt

SEQ ID NO: 9293384 - DNA, 21 bp, Homo sapiens
agagagaaggccatatggtcc

SEQ ID NO: 9293385 - DNA, 21 bp, Homo sapiens
agagacagagaaagtaacatt

SEQ ID NO: 9293386 - DNA, 19 bp, Homo sapiens
agagaggctgtgtgaggga

SEQ ID NO: 9293387 - DNA, 19 bp, Homo sapiens
agagaggctgtgtgaggga

SEQ ID NO: 9293388 - DNA, 22 bp, Homo sapiens
agagaggctgctggactatatg

SEQ ID NO: 9293389 - DNA, 22 bp, Homo sapiens
agagaggcattcggtgatccca

SEQ ID NO: 9293390 - DNA, 22 bp, Homo sapiens
agagagctctgatgggaggtga

SEQ ID NO: 9293391 - DNA, 22 bp, Homo sapiens
agagctggatggtcaagatggc

SEQ ID NO: 9293392 - DNA, 22 bp, Homo sapiens
agagctggatggtcaagatggc

SEQ ID NO: 9293393 - DNA, 22 bp, Homo sapiens
agagctggctgtgggtgacttt

SEQ ID NO: 9293394 - DNA, 22 bp, Homo sapiens
agagcctgaggccctgagaggg

SEQ ID NO: 9293395 - DNA, 22 bp, Homo sapiens
agagctctttgatttgcttctc

SEQ ID NO: 9293396 - DNA, 22 bp, Homo sapiens
agagattggggatgaatctttc

SEQ ID NO: 9293397 - DNA, 22 bp, Homo sapiens
agagcacagccaccatttacaa

SEQ ID NO: 9293398 - DNA, 22 bp, Homo sapiens
agagaggtttgctggaagattc

SEQ ID NO: 9293399 - DNA, 22 bp, Homo sapiens
agagattgctagctggctttaa

SEQ ID NO: 9293400 - DNA, 22 bp, Homo sapiens
agagcaccaaggtggtttggac

SEQ ID NO: 9293401 - DNA, 20 bp, Homo sapiens
atgaagtcctgccctcagag

SEQ ID NO: 9293402 - DNA, 22 bp, Homo sapiens
atgaagtctagcaagcattgaa

SEQ ID NO: 9293403 - DNA, 22 bp, Homo sapiens
atgaagggtgtccctgtgagca

SEQ ID NO: 9293404 - DNA, 22 bp, Homo sapiens
atgaagtctgcacatgcatgtg

SEQ ID NO: 9293405 - DNA, 22 bp, Homo sapiens
agaatatatgactgcaagacta

SEQ ID NO: 9293406 - DNA, 22 bp, Homo sapiens
atgaagcagttaaggtgcatga

SEQ ID NO: 9293407 - DNA, 22 bp, Homo sapiens
atgaagcagttaaggtgcatga

SEQ ID NO: 9293408 - DNA, 22 bp, Homo sapiens
atctgcttgccctcttaggacc

SEQ ID NO: 9293409 - DNA, 22 bp, Homo sapiens
atctgcttagaattcattgtcc

SEQ ID NO: 9293410 - DNA, 22 bp, Homo sapiens
atctgcttcagtgatatgtgaa

SEQ ID NO: 9293411 - DNA, 22 bp, Homo sapiens
atctgcttgagtttgaagtcag

SEQ ID NO: 9293412 - DNA, 22 bp, Homo sapiens
agacaagaaactgggagtctct

SEQ ID NO: 9293413 - DNA, 22 bp, Homo sapiens
agaatattgaaagttcttgaca

SEQ ID NO: 9293414 - DNA, 22 bp, Homo sapiens
atgaggcacttaaaagtgaaga

SEQ ID NO: 9293415 - DNA, 22 bp, Homo sapiens
atgaggcacgtgttactggcct

SEQ ID NO: 9293416 - DNA, 22 bp, Homo sapiens
atgaggcagaaaaaagtcggag

SEQ ID NO: 9293417 - DNA, 22 bp, Homo sapiens
agacaaatttcctgcaatgaag

SEQ ID NO: 9293418 - DNA, 22 bp, Homo sapiens
atgagggaggggtggtgccgca

SEQ ID NO: 9293419 - DNA, 22 bp, Homo sapiens
atgaggcttaaactgctgcaac

SEQ ID NO: 9293420 - DNA, 22 bp, Homo sapiens
atgcatttgtaaaatataatcg

SEQ ID NO: 9293421 - DNA, 22 bp, Homo sapiens
atgcatttttgagtatgaatga

SEQ ID NO: 9293422 - DNA, 22 bp, Homo sapiens
atgatatagagagtagattaaa

SEQ ID NO: 9293423 - DNA, 22 bp, Homo sapiens
atgatacattgcaaaattttaa

SEQ ID NO: 9293424 - DNA, 22 bp, Homo sapiens
atgatatacttcctagaacagt

SEQ ID NO: 9293425 - DNA, 22 bp, Homo sapiens
atgatacatcttgtttatttca

SEQ ID NO: 9293426 - DNA, 22 bp, Homo sapiens
agacagacatagaaattagtaa

SEQ ID NO: 9293427 - DNA, 18 bp, Homo sapiens
agacagacaggtttgtgc

SEQ ID NO: 9293428 - DNA, 15 bp, Homo sapiens
agacagacagtggga

SEQ ID NO: 9293429 - DNA, 22 bp, Homo sapiens
agacagacaaaattcctgcctg

SEQ ID NO: 9293430 - DNA, 22 bp, Homo sapiens
agacagacacatggtaacagat

SEQ ID NO: 9293431 - DNA, 22 bp, Homo sapiens
agacagacagagaatttaaata

SEQ ID NO: 9293432 - DNA, 22 bp, Homo sapiens
agactggggttctggcaaggag

SEQ ID NO: 9293433 - DNA, 22 bp, Homo sapiens
agactggggttctggcaaggag

SEQ ID NO: 9293434 - DNA, 22 bp, Homo sapiens
agactgggtttgagacttagca

SEQ ID NO: 9293435 - DNA, 22 bp, Homo sapiens
agactgggtttgagacttagca

SEQ ID NO: 9293436 - DNA, 22 bp, Homo sapiens
agacgagggcccccaggacagc

SEQ ID NO: 9293437 - DNA, 22 bp, Homo sapiens
agacctggtaagcaggttgggc

SEQ ID NO: 9293438 - DNA, 22 bp, Homo sapiens
agacctttgctgcttcttatag

SEQ ID NO: 9293439 - DNA, 22 bp, Homo sapiens
attttagtacctcaagtatcca

SEQ ID NO: 9293440 - DNA, 22 bp, Homo sapiens
attttagttttagcatccatgc

SEQ ID NO: 9293441 - DNA, 22 bp, Homo sapiens
attttatctgcttactttcagg

SEQ ID NO: 9293442 - DNA, 22 bp, Homo sapiens
agcaaagctatctctatggaga

SEQ ID NO: 9293443 - DNA, 22 bp, Homo sapiens
agcaacaggaaatagctgatta

SEQ ID NO: 9293444 - DNA, 22 bp, Homo sapiens
caaagatatgacatggaaaatg

SEQ ID NO: 9293445 - DNA, 22 bp, Homo sapiens
caaagcaaggctcagtttgaac

SEQ ID NO: 9293446 - DNA, 22 bp, Homo sapiens
caaaggcaggtcatggccactt

SEQ ID NO: 9293447 - DNA, 22 bp, Homo sapiens
agcaacagtgtatatcataggc

SEQ ID NO: 9293448 - DNA, 22 bp, Homo sapiens
agcaacaggaccatggagccca

SEQ ID NO: 9293449 - DNA, 22 bp, Homo sapiens
agcaacagggtggtcttcagaa

SEQ ID NO: 9293450 - DNA, 22 bp, Homo sapiens
agcaacaggtttattatcttat

SEQ ID NO: 9293451 - DNA, 22 bp, Homo sapiens
agagtggcagcaagtcaggtag

SEQ ID NO: 9293452 - DNA, 22 bp, Homo sapiens
agagtggcagcaagtcaggtag

SEQ ID NO: 9293453 - DNA, 22 bp, Homo sapiens
attggcagttggctgtggttca

SEQ ID NO: 9293454 - DNA, 22 bp, Homo sapiens
agatattaggaggattcataat

SEQ ID NO: 9293455 - DNA, 22 bp, Homo sapiens
agatattaatcgtacataaggt

SEQ ID NO: 9293456 - DNA, 22 bp, Homo sapiens
agatattaccagcagtctatgc

SEQ ID NO: 9293457 - DNA, 22 bp, Homo sapiens
agatcactggttacttaatgaa

SEQ ID NO: 9293458 - DNA, 22 bp, Homo sapiens
agatggctgggagctctgtttg

SEQ ID NO: 9293459 - DNA, 22 bp, Homo sapiens
agagggcagtctcagattggga

SEQ ID NO: 9293460 - DNA, 16 bp, Homo sapiens
agaggctgtaatggaa

SEQ ID NO: 9293461 - DNA, 22 bp, Homo sapiens
agaggctgtcccttgctattcc

SEQ ID NO: 9293462 - DNA, 19 bp, Homo sapiens
agaggctgtcacctgtagc

SEQ ID NO: 9293463 - DNA, 22 bp, Homo sapiens
agaggctgggaagggtccccgg

SEQ ID NO: 9293464 - DNA, 22 bp, Homo sapiens
agaggctgggcaggacccacag

SEQ ID NO: 9293465 - DNA, 22 bp, Homo sapiens
agaggctgggtacgggccacct

SEQ ID NO: 9293466 - DNA, 19 bp, Homo sapiens
agagtattgaatttgccct

SEQ ID NO: 9293467 - DNA, 21 bp, Homo sapiens
agagtctgagtgtgcaagggc

SEQ ID NO: 9293468 - DNA, 19 bp, Homo sapiens
agagtcggggggacatagg

SEQ ID NO: 9293469 - DNA, 22 bp, Homo sapiens
agagtcccagggacactccaga

SEQ ID NO: 9293470 - DNA, 22 bp, Homo sapiens
agaggccactttgcctgtgatg

SEQ ID NO: 9293471 - DNA, 22 bp, Homo sapiens
agaggccagcactgcagggaag

SEQ ID NO: 9293472 - DNA, 18 bp, Homo sapiens
agaggctggacaggggat

SEQ ID NO: 9293473 - DNA, 23 bp, Homo sapiens
agaggctgcagggtattgagaat

SEQ ID NO: 9293474 - DNA, 22 bp, Homo sapiens
agaggctgcaggctggaaatca

SEQ ID NO: 9293475 - DNA, 22 bp, Homo sapiens
agaggctggattgagcatagac

SEQ ID NO: 9293476 - DNA, 22 bp, Homo sapiens
agaggctgcacttgctcatgat

SEQ ID NO: 9293477 - DNA, 22 bp, Homo sapiens
agaggcaccatctggaacagcc

SEQ ID NO: 9293478 - DNA, 23 bp, Homo sapiens
agaggcacagcacttggctggcc

SEQ ID NO: 9293479 - DNA, 22 bp, Homo sapiens
agcaggttaccattgatttcct

SEQ ID NO: 9293480 - DNA, 22 bp, Homo sapiens
agcaggttgtgatacactcaga

SEQ ID NO: 9293481 - DNA, 18 bp, Homo sapiens
agcaggtgtgcagaatgt

SEQ ID NO: 9293482 - DNA, 22 bp, Homo sapiens
agcaggtgttagggatccaatg

SEQ ID NO: 9293483 - DNA, 22 bp, Homo sapiens
agcaggtgtcggcgagggtctt

SEQ ID NO: 9293484 - DNA, 22 bp, Homo sapiens
agcaggtgtttgtatcataagg

SEQ ID NO: 9293485 - DNA, 22 bp, Homo sapiens
agcaggtgttggctgggccatc

SEQ ID NO: 9293486 - DNA, 19 bp, Homo sapiens
agcaggtgggtaagaaaat

SEQ ID NO: 9293487 - DNA, 22 bp, Homo sapiens
agcaggtgggcatgaaagctga

SEQ ID NO: 9293488 - DNA, 22 bp, Homo sapiens
agcagggctggggcacgagcca

SEQ ID NO: 9293489 - DNA, 22 bp, Homo sapiens
agcagggctggatttggcaaga

SEQ ID NO: 9293490 - DNA, 22 bp, Homo sapiens
agcatgaaagcataggacagtc

SEQ ID NO: 9293491 - DNA, 22 bp, Homo sapiens
agcagtgctatggccaggctaa

SEQ ID NO: 9293492 - DNA, 22 bp, Homo sapiens
agcagtgccgcatcttgtgacc

SEQ ID NO: 9293493 - DNA, 22 bp, Homo sapiens
agcagtgcccattctgccccct

SEQ ID NO: 9293494 - DNA, 22 bp, Homo sapiens
agcagtgcttgccttagtgtga

SEQ ID NO: 9293495 - DNA, 21 bp, Homo sapiens
agcagtgctcctgggatgagg

SEQ ID NO: 9293496 - DNA, 22 bp, Homo sapiens
cactgtgtcagagtatgatgat

SEQ ID NO: 9293497 - DNA, 22 bp, Homo sapiens
cactgtgtctggagtgagctgg

SEQ ID NO: 9293498 - DNA, 22 bp, Homo sapiens
agcatggccatctgggccgtcc

SEQ ID NO: 9293499 - DNA, 22 bp, Homo sapiens
agcatggcctcccgggcctggc

SEQ ID NO: 9293500 - DNA, 22 bp, Homo sapiens
agcatggggctccgcaatgaac

SEQ ID NO: 9293501 - DNA, 22 bp, Homo sapiens
agcagggctgcagtgtgtcttt

SEQ ID NO: 9293502 - DNA, 22 bp, Homo sapiens
agcagggctgcggccccaccac

SEQ ID NO: 9293503 - DNA, 22 bp, Homo sapiens
agcagggctctgtggagggtgg

SEQ ID NO: 9293504 - DNA, 22 bp, Homo sapiens
caccagacaggtgtatgcatat

SEQ ID NO: 9293505 - DNA, 22 bp, Homo sapiens
agcagggcaaagtcaggctaac

SEQ ID NO: 9293506 - DNA, 19 bp, Homo sapiens
agcagggagtggttgtggg

SEQ ID NO: 9293507 - DNA, 22 bp, Homo sapiens
agcagggcactggaaggcactg

SEQ ID NO: 9293508 - DNA, 22 bp, Homo sapiens
agcagggcagctgatgcgcacg

SEQ ID NO: 9293509 - DNA, 22 bp, Homo sapiens
agcagggcaggtaaggatcaga

SEQ ID NO: 9293510 - DNA, 22 bp, Homo sapiens
agcagggcagcttttttcagaa

SEQ ID NO: 9293511 - DNA, 22 bp, Homo sapiens
agcagggcagtgatcagaaagg

SEQ ID NO: 9293512 - DNA, 22 bp, Homo sapiens
agcaggaagtagtctgtaagca

SEQ ID NO: 9293513 - DNA, 20 bp, Homo sapiens
agcaggaatgatgctttcat

SEQ ID NO: 9293514 - DNA, 22 bp, Homo sapiens
agcactctggagtaggagtggg

SEQ ID NO: 9293515 - DNA, 22 bp, Homo sapiens
agcactgggaacgcatggggcc

SEQ ID NO: 9293516 - DNA, 22 bp, Homo sapiens
agcactggagtttagtgggatt

SEQ ID NO: 9293517 - DNA, 19 bp, Homo sapiens
caataagtcagtagtgggc

SEQ ID NO: 9293518 - DNA, 16 bp, Homo sapiens
agcagaggtgagtgaa

SEQ ID NO: 9293519 - DNA, 20 bp, Homo sapiens
agcagagtgcccatcccgga

SEQ ID NO: 9293520 - DNA, 22 bp, Homo sapiens
agcactgtgatttataacattt

SEQ ID NO: 9293521 - DNA, 21 bp, Homo sapiens
agcagaggcagaatgtatgca

SEQ ID NO: 9293522 - DNA, 22 bp, Homo sapiens
agcagctcatggagtaggcact

SEQ ID NO: 9293523 - DNA, 22 bp, Homo sapiens
cacagagaggcttgtctccaag

SEQ ID NO: 9293524 - DNA, 21 bp, Homo sapiens
cacagagatattggtgagcct

SEQ ID NO: 9293525 - DNA, 21 bp, Homo sapiens
cacagagatattggtgagcct

SEQ ID NO: 9293526 - DNA, 22 bp, Homo sapiens
cacagagatcggaacagaagta

SEQ ID NO: 9293527 - DNA, 22 bp, Homo sapiens
cacagagatggtctggcaggtg

SEQ ID NO: 9293528 - DNA, 22 bp, Homo sapiens
cacagagatggccagggcacat

SEQ ID NO: 9293529 - DNA, 22 bp, Homo sapiens
cacagagattagaattagacta

SEQ ID NO: 9293530 - DNA, 20 bp, Homo sapiens
cagatgggacgtggaggagt

SEQ ID NO: 9293531 - DNA, 22 bp, Homo sapiens
cagcaacatgtggtagtgtagg

SEQ ID NO: 9293532 - DNA, 22 bp, Homo sapiens
agcctgggtgggggttcggaga

SEQ ID NO: 9293533 - DNA, 21 bp, Homo sapiens
agctccaggctcctggggttc

SEQ ID NO: 9293534 - DNA, 19 bp, Homo sapiens
agctcctgattgtgcctcg

SEQ ID NO: 9293535 - DNA, 23 bp, Homo sapiens
agctccagctgacgtgggcagcc

SEQ ID NO: 9293536 - DNA, 22 bp, Homo sapiens
agctccaggataagacaggtgc

SEQ ID NO: 9293537 - DNA, 22 bp, Homo sapiens
agctccagccgctgatgggttt

SEQ ID NO: 9293538 - DNA, 23 bp, Homo sapiens
agctccagaacatagcacaggaa

SEQ ID NO: 9293539 - DNA, 20 bp, Homo sapiens
agctaggagaaagcatggag

SEQ ID NO: 9293540 - DNA, 20 bp, Homo sapiens
agctaggagaaagcatggag

SEQ ID NO: 9293541 - DNA, 22 bp, Homo sapiens
agctaggacaggtagagatggg

SEQ ID NO: 9293542 - DNA, 22 bp, Homo sapiens
agctaggaaattgaggctgaga

SEQ ID NO: 9293543 - DNA, 22 bp, Homo sapiens
agctctttagagtctcccttct

SEQ ID NO: 9293544 - DNA, 22 bp, Homo sapiens
agctctttatgtggaagaggca

SEQ ID NO: 9293545 - DNA, 22 bp, Homo sapiens
agctctttgagcaaggcagctc

SEQ ID NO: 9293546 - DNA, 22 bp, Homo sapiens
agctctttgctggcagtaggct

SEQ ID NO: 9293547 - DNA, 22 bp, Homo sapiens
agctctttgagaaggcagtgtg

SEQ ID NO: 9293548 - DNA, 22 bp, Homo sapiens
agctctttctacaagcaggcag

SEQ ID NO: 9293549 - DNA, 22 bp, Homo sapiens
cactttatattctaagacggcc

SEQ ID NO: 9293550 - DNA, 22 bp, Homo sapiens
cactttatattctaagacggcc

SEQ ID NO: 9293551 - DNA, 22 bp, Homo sapiens
cactttatgggaagcaaaaatt

SEQ ID NO: 9293552 - DNA, 22 bp, Homo sapiens
cactttatgggaagcaaaaatt

SEQ ID NO: 9293553 - DNA, 22 bp, Homo sapiens
cactttataaaattggtgtgag

SEQ ID NO: 9293554 - DNA, 22 bp, Homo sapiens
cactttatatgcattacctcat

SEQ ID NO: 9293555 - DNA, 22 bp, Homo sapiens
cactttattataaatttgagag

SEQ ID NO: 9293556 - DNA, 19 bp, Homo sapiens
cactttatttctgttttgt

SEQ ID NO: 9293557 - DNA, 22 bp, Homo sapiens
cactttcaagtttcagaggata

SEQ ID NO: 9293558 - DNA, 22 bp, Homo sapiens
agccagctaagggaagcatgat

SEQ ID NO: 9293559 - DNA, 22 bp, Homo sapiens
agccagccagttcactaggaaa

SEQ ID NO: 9293560 - DNA, 22 bp, Homo sapiens
agccctgggcgttactgggatg

SEQ ID NO: 9293561 - DNA, 22 bp, Homo sapiens
agccctgggcagccaaggaagc

SEQ ID NO: 9293562 - DNA, 22 bp, Homo sapiens
agccctggcccggctgtgcttt

SEQ ID NO: 9293563 - DNA, 22 bp, Homo sapiens
agccccagttccctggaagtct

SEQ ID NO: 9293564 - DNA, 22 bp, Homo sapiens
agccccagtccgctgcgggcgg

SEQ ID NO: 9293565 - DNA, 22 bp, Homo sapiens
agccctggattctgaggtccaa

SEQ ID NO: 9293566 - DNA, 22 bp, Homo sapiens
agccctggcagagccaggtagt

SEQ ID NO: 9293567 - DNA, 22 bp, Homo sapiens
agccagtgcaacagcagtgaag

SEQ ID NO: 9293568 - DNA, 22 bp, Homo sapiens
agccagtgcagctggaaattca

SEQ ID NO: 9293569 - DNA, 22 bp, Homo sapiens
agccagtgccagtcatgcctgc

SEQ ID NO: 9293570 - DNA, 22 bp, Homo sapiens
agccagtgggattagagcctct

SEQ ID NO: 9293571 - DNA, 22 bp, Homo sapiens
agccagtggaattcccaggggt

SEQ ID NO: 9293572 - DNA, 22 bp, Homo sapiens
agccagtggtgtaatgccgtct

SEQ ID NO: 9293573 - DNA, 22 bp, Homo sapiens
agccagtgtcgtgtgacatgag

SEQ ID NO: 9293574 - DNA, 22 bp, Homo sapiens
agccagtgttaagtgactggtt

SEQ ID NO: 9293575 - DNA, 22 bp, Homo sapiens
agcccaggttgaggctgcagtg

SEQ ID NO: 9293576 - DNA, 22 bp, Homo sapiens
agccccagtaagggagggcctg

SEQ ID NO: 9293577 - DNA, 22 bp, Homo sapiens
aacactgagggaaaagagatag

SEQ ID NO: 9293578 - DNA, 22 bp, Homo sapiens
aacactgagtatcagagttggg

SEQ ID NO: 9293579 - DNA, 22 bp, Homo sapiens
aacagtttgcctgaaatgtatt

SEQ ID NO: 9293580 - DNA, 22 bp, Homo sapiens
aataaactgctcaattgcatca

SEQ ID NO: 9293581 - DNA, 20 bp, Homo sapiens
aataaactactgagagatgt

SEQ ID NO: 9293582 - DNA, 22 bp, Homo sapiens
aatcacattgaatctgctacct

SEQ ID NO: 9293583 - DNA, 22 bp, Homo sapiens
aactcccactcagcttcttaat

SEQ ID NO: 9293584 - DNA, 22 bp, Homo sapiens
aacatttatggtagtcattgca

SEQ ID NO: 9293585 - DNA, 22 bp, Homo sapiens
aacattcttcaaatatcactct

SEQ ID NO: 9293586 - DNA, 22 bp, Homo sapiens
aacattctgtcaattgatgacc

SEQ ID NO: 9293587 - DNA, 22 bp, Homo sapiens
aagccatcgaactgtacactta

SEQ ID NO: 9293588 - DNA, 22 bp, Homo sapiens
aagctggcaattatcaaaactg

SEQ ID NO: 9293589 - DNA, 18 bp, Homo sapiens
aagctgggaaggagacag

SEQ ID NO: 9293590 - DNA, 18 bp, Homo sapiens
aagctgggaaggagacag

SEQ ID NO: 9293591 - DNA, 20 bp, Homo sapiens
aagctgggtaggagaggagc

SEQ ID NO: 9293592 - DNA, 22 bp, Homo sapiens
aagctggggactcagaccccat

SEQ ID NO: 9293593 - DNA, 22 bp, Homo sapiens
aagctgggagggagcccagagt

SEQ ID NO: 9293594 - DNA, 22 bp, Homo sapiens
aagctgggacttagcgcagata

SEQ ID NO: 9293595 - DNA, 22 bp, Homo sapiens
aaggactgtctaaggcctccaa

SEQ ID NO: 9293596 - DNA, 22 bp, Homo sapiens
aaggacctgattttgagcatct

SEQ ID NO: 9293597 - DNA, 22 bp, Homo sapiens
aaggccactgaagaaatcacaa

SEQ ID NO: 9293598 - DNA, 22 bp, Homo sapiens
aaggccaaagacacctacacag

SEQ ID NO: 9293599 - DNA, 22 bp, Homo sapiens
aagggagacagttgtgtgagga

SEQ ID NO: 9293600 - DNA, 22 bp, Homo sapiens
aagtacaatctttctgtaaagg

SEQ ID NO: 9293601 - DNA, 23 bp, Homo sapiens
aacaataggttttggcagaatag

SEQ ID NO: 9293602 - DNA, 21 bp, Homo sapiens
aagggagataggaatcaggcc

SEQ ID NO: 9293603 - DNA, 22 bp, Homo sapiens
aagatataataactgttgtcat

SEQ ID NO: 9293604 - DNA, 22 bp, Homo sapiens
aagatatagataaaactatgca

SEQ ID NO: 9293605 - DNA, 22 bp, Homo sapiens
acagaagaccaagaaagcttcc

SEQ ID NO: 9293606 - DNA, 22 bp, Homo sapiens
acagaagacagagtgttcatct

SEQ ID NO: 9293607 - DNA, 22 bp, Homo sapiens
acagaagagctggctctgtgct

SEQ ID NO: 9293608 - DNA, 22 bp, Homo sapiens
acagaagagcacatttagtatg

SEQ ID NO: 9293609 - DNA, 22 bp, Homo sapiens
aagcaaaaggttacacttctgg

SEQ ID NO: 9293610 - DNA, 22 bp, Homo sapiens
aagcaaagacagtttgagtgga

SEQ ID NO: 9293611 - DNA, 22 bp, Homo sapiens
acagaggacaactaggcgctca

SEQ ID NO: 9293612 - DNA, 22 bp, Homo sapiens
acagatgaaacccagctagttg

SEQ ID NO: 9293613 - DNA, 22 bp, Homo sapiens
aagaggaggattgatgtgggag

SEQ ID NO: 9293614 - DNA, 22 bp, Homo sapiens
aagaggcagcccgctgaggctg

SEQ ID NO: 9293615 - DNA, 22 bp, Homo sapiens
aagaggtcataccagataaggg

SEQ ID NO: 9293616 - DNA, 22 bp, Homo sapiens
aagaggtggaacagcaattcgt

SEQ ID NO: 9293617 - DNA, 22 bp, Homo sapiens
acacacatgcatgcttgccatt

SEQ ID NO: 9293618 - DNA, 22 bp, Homo sapiens
acacacaggtaaaggagcctgg

SEQ ID NO: 9293619 - DNA, 22 bp, Homo sapiens
acacacaggtaaaggagcctgg

SEQ ID NO: 9293620 - DNA, 22 bp, Homo sapiens
acacacagcgcctaccatgtgc

SEQ ID NO: 9293621 - DNA, 22 bp, Homo sapiens
acacacagagtttatacaggca

SEQ ID NO: 9293622 - DNA, 22 bp, Homo sapiens
acacacagaaggaagccccact

SEQ ID NO: 9293623 - DNA, 22 bp, Homo sapiens
aagagtcgtttcaggacagagg

SEQ ID NO: 9293624 - DNA, 20 bp, Homo sapiens
aagagtctttactgagctaa

SEQ ID NO: 9293625 - DNA, 22 bp, Homo sapiens
aattcacaaaaccagattgctt

SEQ ID NO: 9293626 - DNA, 22 bp, Homo sapiens
aagacaagcatcaaatcaggca

SEQ ID NO: 9293627 - DNA, 22 bp, Homo sapiens
aattcaatctaagaaatgatca

SEQ ID NO: 9293628 - DNA, 22 bp, Homo sapiens
acaagaaccaaagaaggatatt

SEQ ID NO: 9293629 - DNA, 22 bp, Homo sapiens
aactctacttgggactcctctg

SEQ ID NO: 9293630 - DNA, 22 bp, Homo sapiens
aactctagggaggcaggaagca

SEQ ID NO: 9293631 - DNA, 22 bp, Homo sapiens
aatgtcaagtagccaatgcttc

SEQ ID NO: 9293632 - DNA, 22 bp, Homo sapiens
aactttatcggaacaggtactc

SEQ ID NO: 9293633 - DNA, 22 bp, Homo sapiens
aactttattgttaggggctaaa

SEQ ID NO: 9293634 - DNA, 22 bp, Homo sapiens
aactttccatctttatcgtctt

SEQ ID NO: 9293635 - DNA, 22 bp, Homo sapiens
aagcaaagtgctttgcctccag

SEQ ID NO: 9293636 - DNA, 22 bp, Homo sapiens
aagcaaagtgaattttgccaag

SEQ ID NO: 9293637 - DNA, 22 bp, Homo sapiens
aagcaaaggcaggagcttgtga

SEQ ID NO: 9293638 - DNA, 22 bp, Homo sapiens
aagcaaaggaaagctgactttt

SEQ ID NO: 9293639 - DNA, 18 bp, Homo sapiens
aagaggaggagcaggttg

SEQ ID NO: 9293640 - DNA, 22 bp, Homo sapiens
aagaggagacttcagcaacttg

SEQ ID NO: 9293641 - DNA, 22 bp, Homo sapiens
aagaaagtgggtaatatgattt

SEQ ID NO: 9293642 - DNA, 22 bp, Homo sapiens
aagagcccttttcagtctagtt

SEQ ID NO: 9293643 - DNA, 22 bp, Homo sapiens
aagagccagctagtgaagaggc

SEQ ID NO: 9293644 - DNA, 22 bp, Homo sapiens
aagagagagttcctaggcaaaa

SEQ ID NO: 9293645 - DNA, 22 bp, Homo sapiens
aagagagagttcctaggcaaaa

SEQ ID NO: 9293646 - DNA, 22 bp, Homo sapiens
aagacagagactctgcaacagg

SEQ ID NO: 9293647 - DNA, 22 bp, Homo sapiens
aacaaatgtgttttgtaattaa

SEQ ID NO: 9293648 - DNA, 22 bp, Homo sapiens
aacacataggcagagcatgaca

SEQ ID NO: 9293649 - DNA, 21 bp, Homo sapiens
aacacatccagagtatttgac

SEQ ID NO: 9293650 - DNA, 22 bp, Homo sapiens
aacacatatttatatatgcaca

SEQ ID NO: 9293651 - DNA, 22 bp, Homo sapiens
aacagctttgcttctggagaca

SEQ ID NO: 9293652 - DNA, 22 bp, Homo sapiens
aactcactttgtggcttctgaa

SEQ ID NO: 9293653 - DNA, 22 bp, Homo sapiens
aactgagggccctgctgaagca

SEQ ID NO: 9293654 - DNA, 22 bp, Homo sapiens
aactcactttgtggcttctgaa

SEQ ID NO: 9293655 - DNA, 22 bp, Homo sapiens
aaacaaagcatcttgctatgca

SEQ ID NO: 9293656 - DNA, 22 bp, Homo sapiens
aaacacaatgtttctttgttct

SEQ ID NO: 9293657 - DNA, 22 bp, Homo sapiens
aaacaacatggtgggtgtgtag

SEQ ID NO: 9293658 - DNA, 22 bp, Homo sapiens
aaaatagataatgccagggtca

SEQ ID NO: 9293659 - DNA, 22 bp, Homo sapiens
aaaagtctgctctcatttcaga

SEQ ID NO: 9293660 - DNA, 22 bp, Homo sapiens
aaaagtctacaagcttcaacaa

SEQ ID NO: 9293661 - DNA, 22 bp, Homo sapiens
aaaaagacttccaactcaggag

SEQ ID NO: 9293662 - DNA, 22 bp, Homo sapiens
aaaccacagttcagtgcttttg

SEQ ID NO: 9293663 - DNA, 22 bp, Homo sapiens
aaaccacatgccttcaaatgct

SEQ ID NO: 9293664 - DNA, 22 bp, Homo sapiens
aaaccacacttagcagtttcgt

SEQ ID NO: 9293665 - DNA, 22 bp, Homo sapiens
aaacatctggttacctagggtc

SEQ ID NO: 9293666 - DNA, 22 bp, Homo sapiens
aaacttgagccaagggcttggg

SEQ ID NO: 9293667 - DNA, 22 bp, Homo sapiens
aaacttgaaaggtactgttggt

SEQ ID NO: 9293668 - DNA, 23 bp, Homo sapiens
aaacttgctatggctgaaatcat

SEQ ID NO: 9293669 - DNA, 22 bp, Homo sapiens
aaacttgatctgtgaccttgct

SEQ ID NO: 9293670 - DNA, 22 bp, Homo sapiens
aaatgctacacaggaattctca

SEQ ID NO: 9293671 - DNA, 22 bp, Homo sapiens
aaatatgtaaccaaggtgaagt

SEQ ID NO: 9293672 - DNA, 22 bp, Homo sapiens
aaatagaattaactagctactg

SEQ ID NO: 9293673 - DNA, 22 bp, Homo sapiens
aaacactgcagggtttacttga

SEQ ID NO: 9293674 - DNA, 22 bp, Homo sapiens
aaacatcataggcatgcatgat

SEQ ID NO: 9293675 - DNA, 22 bp, Homo sapiens
aaacatctatcagcatttttta

SEQ ID NO: 9293676 - DNA, 22 bp, Homo sapiens
aaaggccttgagctgggtgcca

SEQ ID NO: 9293677 - DNA, 23 bp, Homo sapiens
agactggggcataagaagatggc

SEQ ID NO: 9293678 - DNA, 23 bp, Homo sapiens
agactggggcataagaagatggc

SEQ ID NO: 9293679 - DNA, 22 bp, Homo sapiens
aatgtataaccataggaaattt

SEQ ID NO: 9293680 - DNA, 22 bp, Homo sapiens
agagataccaaataggcagtta

SEQ ID NO: 9293681 - DNA, 22 bp, Homo sapiens
aattcacaattatgttgggaga

SEQ ID NO: 9293682 - DNA, 22 bp, Homo sapiens
agaagtttgttatgtaaacaaa

SEQ ID NO: 9293683 - DNA, 22 bp, Homo sapiens
agaatttagctccttggtcata

SEQ ID NO: 9293684 - DNA, 22 bp, Homo sapiens
aatgtactaataagcaacattt

SEQ ID NO: 9293685 - DNA, 23 bp, Homo sapiens
agacaaaagcctcagtcttaggc

SEQ ID NO: 9293686 - DNA, 22 bp, Homo sapiens
aatgtacactgaaagcctatca

SEQ ID NO: 9293687 - DNA, 22 bp, Homo sapiens
agagggcccatgttgggctgct

SEQ ID NO: 9293688 - DNA, 22 bp, Homo sapiens
agagggccataggtgcatagtt

SEQ ID NO: 9293689 - DNA, 22 bp, Homo sapiens
agaggcttggaggtgcaaggtt

SEQ ID NO: 9293690 - DNA, 22 bp, Homo sapiens
aatttatttcctgccagtacac

SEQ ID NO: 9293691 - DNA, 22 bp, Homo sapiens
aatttattatatcctaggggaa

SEQ ID NO: 9293692 - DNA, 22 bp, Homo sapiens
aatttattcccgtctctgggct

SEQ ID NO: 9293693 - DNA, 22 bp, Homo sapiens
agaggcaacatggggaacagat

SEQ ID NO: 9293694 - DNA, 23 bp, Homo sapiens
agaggccaacttcttgcccctcc

SEQ ID NO: 9293695 - DNA, 22 bp, Homo sapiens
aattcacatgcatgtctgtgca

SEQ ID NO: 9293696 - DNA, 22 bp, Homo sapiens
aattcacaggatcacaggagag

SEQ ID NO: 9293697 - DNA, 20 bp, Homo sapiens
agatgggttaaagctatggg

SEQ ID NO: 9293698 - DNA, 16 bp, Homo sapiens
agatgggtgggtcact

SEQ ID NO: 9293699 - DNA, 22 bp, Homo sapiens
agattacagaagaataagtaga

SEQ ID NO: 9293700 - DNA, 22 bp, Homo sapiens
agatatgtccctgtctaatatt

SEQ ID NO: 9293701 - DNA, 22 bp, Homo sapiens
agatcggctttgcagacctcat

SEQ ID NO: 9293702 - DNA, 22 bp, Homo sapiens
agatatgtttgtatatatttgt

SEQ ID NO: 9293703 - DNA, 22 bp, Homo sapiens
agaggggttatgcttgacattt

SEQ ID NO: 9293704 - DNA, 22 bp, Homo sapiens
acaaaaagctccattactgtcc

SEQ ID NO: 9293705 - DNA, 22 bp, Homo sapiens
aattttgttcttggaaatcagg

SEQ ID NO: 9293706 - DNA, 22 bp, Homo sapiens
agaggtgtggccaggactcaag

SEQ ID NO: 9293707 - DNA, 22 bp, Homo sapiens
agaggtggccatgggcgctgga

SEQ ID NO: 9293708 - DNA, 22 bp, Homo sapiens
agaggtgggagcctggtcacat

SEQ ID NO: 9293709 - DNA, 22 bp, Homo sapiens
agaggtttcttaggggcttcct

SEQ ID NO: 9293710 - DNA, 22 bp, Homo sapiens
agaggttgggtctgaggtgaga

SEQ ID NO: 9293711 - DNA, 22 bp, Homo sapiens
agataatgttctgatccatttc

SEQ ID NO: 9293712 - DNA, 22 bp, Homo sapiens
agagtcttagcctcattagtca

SEQ ID NO: 9293713 - DNA, 19 bp, Homo sapiens
agcagcaactgttgattca

SEQ ID NO: 9293714 - DNA, 22 bp, Homo sapiens
agcagcagctcagttctcagct

SEQ ID NO: 9293715 - DNA, 22 bp, Homo sapiens
agcagcagccgtagccttatta

SEQ ID NO: 9293716 - DNA, 22 bp, Homo sapiens
acacactggcccccagtactga

SEQ ID NO: 9293717 - DNA, 22 bp, Homo sapiens
acacactttaaattaaacctct

SEQ ID NO: 9293718 - DNA, 22 bp, Homo sapiens
acacactgttgctcatccaggc

SEQ ID NO: 9293719 - DNA, 22 bp, Homo sapiens
acacactgtaaggactatcact

SEQ ID NO: 9293720 - DNA, 21 bp, Homo sapiens
acacactctgagtcttctatt

SEQ ID NO: 9293721 - DNA, 22 bp, Homo sapiens
acacactcaattgcataagcac

SEQ ID NO: 9293722 - DNA, 22 bp, Homo sapiens
acacacatggtattgttcagaa

SEQ ID NO: 9293723 - DNA, 21 bp, Homo sapiens
acacactgagttttccactgt

SEQ ID NO: 9293724 - DNA, 22 bp, Homo sapiens
acacacatgcctttcctaagta

SEQ ID NO: 9293725 - DNA, 18 bp, Homo sapiens
agattttgagaaatacaa

SEQ ID NO: 9293726 - DNA, 18 bp, Homo sapiens
acacacacacctgtgtat

SEQ ID NO: 9293727 - DNA, 22 bp, Homo sapiens
agcagctcctgccatgagtgct

SEQ ID NO: 9293728 - DNA, 22 bp, Homo sapiens
agcagctctgtttacctggagg

SEQ ID NO: 9293729 - DNA, 22 bp, Homo sapiens
agcaggagggttttgtagagtc

SEQ ID NO: 9293730 - DNA, 22 bp, Homo sapiens
agcaggccaaggaactttgtgg

SEQ ID NO: 9293731 - DNA, 22 bp, Homo sapiens
agcagggcttgccgcttgtcct

SEQ ID NO: 9293732 - DNA, 22 bp, Homo sapiens
agcagggctttggctggctttc

SEQ ID NO: 9293733 - DNA, 22 bp, Homo sapiens
agcagggctttgcagacttggg

SEQ ID NO: 9293734 - DNA, 22 bp, Homo sapiens
agcagggcttctgtgcctgtgc

SEQ ID NO: 9293735 - DNA, 22 bp, Homo sapiens
agcagggctgtgtaggtaatga

SEQ ID NO: 9293736 - DNA, 22 bp, Homo sapiens
agcagggcctctggcactggtc

SEQ ID NO: 9293737 - DNA, 22 bp, Homo sapiens
agcaggtgacccaagcaggctg

SEQ ID NO: 9293738 - DNA, 22 bp, Homo sapiens
agcaggtgacagggctgtggtg

SEQ ID NO: 9293739 - DNA, 20 bp, Homo sapiens
agcaggtgacggggcctgct

SEQ ID NO: 9293740 - DNA, 22 bp, Homo sapiens
agcaggtgaattcctggatgtg

SEQ ID NO: 9293741 - DNA, 21 bp, Homo sapiens
agcaggtgaacctccagtaca

SEQ ID NO: 9293742 - DNA, 22 bp, Homo sapiens
agcagggctttgtctctgtgaa

SEQ ID NO: 9293743 - DNA, 22 bp, Homo sapiens
agcaggtgagcacagccaggct

SEQ ID NO: 9293744 - DNA, 23 bp, Homo sapiens
agctccagggaacaggcagtagg

SEQ ID NO: 9293745 - DNA, 22 bp, Homo sapiens
agctcaggtcattccagggatg

SEQ ID NO: 9293746 - DNA, 22 bp, Homo sapiens
agctcagttggccactctttca

SEQ ID NO: 9293747 - DNA, 22 bp, Homo sapiens
agctcagggctccaggaccgct

SEQ ID NO: 9293748 - DNA, 22 bp, Homo sapiens
agctcaggccggagctacaggc

SEQ ID NO: 9293749 - DNA, 22 bp, Homo sapiens
agcctgtggatccctgcactgg

SEQ ID NO: 9293750 - DNA, 22 bp, Homo sapiens
agccctggggctggtgcttacc

SEQ ID NO: 9293751 - DNA, 22 bp, Homo sapiens
agcattgtctccaagcaggtct

SEQ ID NO: 9293752 - DNA, 22 bp, Homo sapiens
agcatttaagcttctgcaaagc

SEQ ID NO: 9293753 - DNA, 22 bp, Homo sapiens
agcatttaatcctacatagatc

SEQ ID NO: 9293754 - DNA, 22 bp, Homo sapiens
agcatttaagggtggatacagg

SEQ ID NO: 9293755 - DNA, 22 bp, Homo sapiens
acagaacatggatttttgaagt

SEQ ID NO: 9293756 - DNA, 22 bp, Homo sapiens
acagaacaggctgagaaaaaca

SEQ ID NO: 9293757 - DNA, 22 bp, Homo sapiens
agcccaggtctggcccagcctg

SEQ ID NO: 9293758 - DNA, 21 bp, Homo sapiens
acagacagggccagtgtcccc

SEQ ID NO: 9293759 - DNA, 21 bp, Homo sapiens
acagacagtccagagaaaaga

SEQ ID NO: 9293760 - DNA, 22 bp, Homo sapiens
acagacagtatggtggggctga

SEQ ID NO: 9293761 - DNA, 22 bp, Homo sapiens
acagacagtaaatagtgtggct

SEQ ID NO: 9293762 - DNA, 22 bp, Homo sapiens
acataagtgcacaataaatatt

SEQ ID NO: 9293763 - DNA, 22 bp, Homo sapiens
acataagttatggataaaatgt

SEQ ID NO: 9293764 - DNA, 22 bp, Homo sapiens
acataatgagctctttataaat

SEQ ID NO: 9293765 - DNA, 22 bp, Homo sapiens
acataatggacaataatgcatc

SEQ ID NO: 9293766 - DNA, 22 bp, Homo sapiens
acataatgaaatgcagaaatca

SEQ ID NO: 9293767 - DNA, 22 bp, Homo sapiens
acatacttctttacattccata

SEQ ID NO: 9293768 - DNA, 22 bp, Homo sapiens
acatacttatgctaaaaatata

SEQ ID NO: 9293769 - DNA, 22 bp, Homo sapiens
acatacttaacattaaagtcat

SEQ ID NO: 9293770 - DNA, 22 bp, Homo sapiens
acatacttagagtaaacaagta

SEQ ID NO: 9293771 - DNA, 23 bp, Homo sapiens
acatagaacagaatatatttgtg

SEQ ID NO: 9293772 - DNA, 22 bp, Homo sapiens
aaggccaggacaccaggggact

SEQ ID NO: 9293773 - DNA, 22 bp, Homo sapiens
aaggccagctggagggatgagg

SEQ ID NO: 9293774 - DNA, 22 bp, Homo sapiens
aaggccagcttgtagggctggt

SEQ ID NO: 9293775 - DNA, 22 bp, Homo sapiens
aaggccaggcagggagctgtga

SEQ ID NO: 9293776 - DNA, 22 bp, Homo sapiens
aaggccaggcagggagctgtga

SEQ ID NO: 9293777 - DNA, 22 bp, Homo sapiens
aaggccaggagacttggagtca

SEQ ID NO: 9293778 - DNA, 22 bp, Homo sapiens
acattacagcaagtttacgtta

SEQ ID NO: 9293779 - DNA, 22 bp, Homo sapiens
acatgtgttttcctacttatga

SEQ ID NO: 9293780 - DNA, 22 bp, Homo sapiens
acatgtgttaaaattctcacca

SEQ ID NO: 9293781 - DNA, 22 bp, Homo sapiens
accacatagctttgctttttgt

SEQ ID NO: 9293782 - DNA, 22 bp, Homo sapiens
accacatcgggcggacactggg

SEQ ID NO: 9293783 - DNA, 22 bp, Homo sapiens
accagctgagttctcggatggt

SEQ ID NO: 9293784 - DNA, 22 bp, Homo sapiens
accagctgagtaggggagggcc

SEQ ID NO: 9293785 - DNA, 22 bp, Homo sapiens
aagggcagcttaaattggtagc

SEQ ID NO: 9293786 - DNA, 22 bp, Homo sapiens
aagggcagcctgactcacggtc

SEQ ID NO: 9293787 - DNA, 22 bp, Homo sapiens
aagggcagctgacagatgctta

SEQ ID NO: 9293788 - DNA, 22 bp, Homo sapiens
aagggcagctattatcgtcatc

SEQ ID NO: 9293789 - DNA, 22 bp, Homo sapiens
aaggtttttttccagtatctct

SEQ ID NO: 9293790 - DNA, 22 bp, Homo sapiens
aaggtgtcactgggacaggaaa

SEQ ID NO: 9293791 - DNA, 22 bp, Homo sapiens
accagctggtcagttgaagatt

SEQ ID NO: 9293792 - DNA, 22 bp, Homo sapiens
accagctggtcacctgggcact

SEQ ID NO: 9293793 - DNA, 22 bp, Homo sapiens
acagatgaggaagagtcagcca

SEQ ID NO: 9293794 - DNA, 22 bp, Homo sapiens
acagctggagtgttggtgaggt

SEQ ID NO: 9293795 - DNA, 22 bp, Homo sapiens
acagctggagtgttggtgaggt

SEQ ID NO: 9293796 - DNA, 22 bp, Homo sapiens
acagctggcaggggggcatgaa

SEQ ID NO: 9293797 - DNA, 21 bp, Homo sapiens
acaggagaccgcctggcagtc

SEQ ID NO: 9293798 - DNA, 22 bp, Homo sapiens
acaggccagaggtggggcagcc

SEQ ID NO: 9293799 - DNA, 22 bp, Homo sapiens
acaggccagcctggggtaaggt

SEQ ID NO: 9293800 - DNA, 22 bp, Homo sapiens
acaggcagagaactcagccaga

SEQ ID NO: 9293801 - DNA, 22 bp, Homo sapiens
acaggcagagaactcagccaga

SEQ ID NO: 9293802 - DNA, 22 bp, Homo sapiens
acaggaggagcagctgtgtgcc

SEQ ID NO: 9293803 - DNA, 22 bp, Homo sapiens
acaggctgacttcctgccatgt

SEQ ID NO: 9293804 - DNA, 22 bp, Homo sapiens
acaggcttacaggctgcaagta

SEQ ID NO: 9293805 - DNA, 22 bp, Homo sapiens
acaggcttctcacagaaaaggg

SEQ ID NO: 9293806 - DNA, 22 bp, Homo sapiens
acaggcttttttagaatgacat

SEQ ID NO: 9293807 - DNA, 21 bp, Homo sapiens
acaggctttagaaaatgactc

SEQ ID NO: 9293808 - DNA, 22 bp, Homo sapiens
acaggtagaaattcatctatat

SEQ ID NO: 9293809 - DNA, 22 bp, Homo sapiens
acaggtcctcaagtcagctggg

SEQ ID NO: 9293810 - DNA, 22 bp, Homo sapiens
acaggtgtagaaaacagattat

SEQ ID NO: 9293811 - DNA, 22 bp, Homo sapiens
acaggtgtaggtacatttgcat

SEQ ID NO: 9293812 - DNA, 22 bp, Homo sapiens
acaggtgtatgaatatgttcca

SEQ ID NO: 9293813 - DNA, 22 bp, Homo sapiens
acaggtgtagcaggagcatcaa

SEQ ID NO: 9293814 - DNA, 22 bp, Homo sapiens
acaggtgtgcggaaagctgtga

SEQ ID NO: 9293815 - DNA, 22 bp, Homo sapiens
acaggtgtgagaacatgccttg

SEQ ID NO: 9293816 - DNA, 22 bp, Homo sapiens
acaggtgtgggctgggctctga

SEQ ID NO: 9293817 - DNA, 22 bp, Homo sapiens
acaggtgtctgcaagttactgg

SEQ ID NO: 9293818 - DNA, 22 bp, Homo sapiens
acaggtgtccaacatttacctt

SEQ ID NO: 9293819 - DNA, 22 bp, Homo sapiens
acaggtgtctaaggcagacagc

SEQ ID NO: 9293820 - DNA, 22 bp, Homo sapiens
acaggtgtcctcacagggggtg

SEQ ID NO: 9293821 - DNA, 20 bp, Homo sapiens
acagtgggtggggagcactg

SEQ ID NO: 9293822 - DNA, 18 bp, Homo sapiens
acctgcctgttcttctct

SEQ ID NO: 9293823 - DNA, 22 bp, Homo sapiens
acctgggaaagccgtggaaagg

SEQ ID NO: 9293824 - DNA, 22 bp, Homo sapiens
accttggcagtttctacctttt

SEQ ID NO: 9293825 - DNA, 22 bp, Homo sapiens
accttctgaccagttatcttga

SEQ ID NO: 9293826 - DNA, 22 bp, Homo sapiens
aagtgcaggtctcagctactct

SEQ ID NO: 9293827 - DNA, 22 bp, Homo sapiens
aagtctctttgggtactttatt

SEQ ID NO: 9293828 - DNA, 22 bp, Homo sapiens
aagtctcttttcttcctgtatt

SEQ ID NO: 9293829 - DNA, 22 bp, Homo sapiens
accttgggcaagttggaaactg

SEQ ID NO: 9293830 - DNA, 21 bp, Homo sapiens
acctttaattcaagcatcagg

SEQ ID NO: 9293831 - DNA, 22 bp, Homo sapiens
aataaatgtttgttggatgttt

SEQ ID NO: 9293832 - DNA, 22 bp, Homo sapiens
aataaacttccactgtgttttt

SEQ ID NO: 9293833 - DNA, 22 bp, Homo sapiens
actcatgtcctaggagtaaagc

SEQ ID NO: 9293834 - DNA, 22 bp, Homo sapiens
aagtgggtaactggcctttgtt

SEQ ID NO: 9293835 - DNA, 22 bp, Homo sapiens
aagtgggtacatgatgcacttt

SEQ ID NO: 9293836 - DNA, 22 bp, Homo sapiens
acttatccatgtctatatgttg

SEQ ID NO: 9293837 - DNA, 22 bp, Homo sapiens
acttatactaaagtattatttg

SEQ ID NO: 9293838 - DNA, 22 bp, Homo sapiens
agaaaattactccagagacaag

SEQ ID NO: 9293839 - DNA, 22 bp, Homo sapiens
agaaaattactccagagacaag

SEQ ID NO: 9293840 - DNA, 22 bp, Homo sapiens
aatatgttcaaaatagatcact

SEQ ID NO: 9293841 - DNA, 22 bp, Homo sapiens
gccttattacctgcactttgaa

SEQ ID NO: 9293842 - DNA, 22 bp, Homo sapiens
gcctggtgctatgagggccagc

SEQ ID NO: 9293843 - DNA, 22 bp, Homo sapiens
gcctggggaacttgatcctgtc

SEQ ID NO: 9293844 - DNA, 22 bp, Homo sapiens
gcctggggccagcttgggctga

SEQ ID NO: 9293845 - DNA, 22 bp, Homo sapiens
gcctggggtcccttgttggcac

SEQ ID NO: 9293846 - DNA, 22 bp, Homo sapiens
gcctcaggcctatagctgctgt

SEQ ID NO: 9293847 - DNA, 22 bp, Homo sapiens
gcctcaggccgccctgctgctc

SEQ ID NO: 9293848 - DNA, 22 bp, Homo sapiens
gctcaagccttctgcccacctc

SEQ ID NO: 9293849 - DNA, 22 bp, Homo sapiens
gctcaagagagatgcagttctt

SEQ ID NO: 9293850 - DNA, 22 bp, Homo sapiens
gctcactgcaacctccacctcc

SEQ ID NO: 9293851 - DNA, 22 bp, Homo sapiens
gctcagctgcacctggagagcc

SEQ ID NO: 9293852 - DNA, 22 bp, Homo sapiens
gctcagctgggaccaatgtgtt

SEQ ID NO: 9293853 - DNA, 22 bp, Homo sapiens
gctcagcttgggagcgcccggt

SEQ ID NO: 9293854 - DNA, 21 bp, Homo sapiens
gctcagctgcttggttcctgt

SEQ ID NO: 9293855 - DNA, 22 bp, Homo sapiens
gctcagctggaccatcgtgttt

SEQ ID NO: 9293856 - DNA, 22 bp, Homo sapiens
gctcagctggagagggacgggt

SEQ ID NO: 9293857 - DNA, 17 bp, Homo sapiens
gccttctctgccctcac

SEQ ID NO: 9293858 - DNA, 22 bp, Homo sapiens
gccttttttgttgctctgtcac

SEQ ID NO: 9293859 - DNA, 21 bp, Homo sapiens
gctctcagctgcctgctggtt

SEQ ID NO: 9293860 - DNA, 22 bp, Homo sapiens
gctctcagatgctccagcagcc

SEQ ID NO: 9293861 - DNA, 22 bp, Homo sapiens
gctctcagaagtaacttgtcca

SEQ ID NO: 9293862 - DNA, 22 bp, Homo sapiens
gctctcagaagagccaggctac

SEQ ID NO: 9293863 - DNA, 22 bp, Homo sapiens
gctctatgagtttctcagttta

SEQ ID NO: 9293864 - DNA, 22 bp, Homo sapiens
gctctatgggcacagccagtgt

SEQ ID NO: 9293865 - DNA, 22 bp, Homo sapiens
gctctatggctgctgggagtcc

SEQ ID NO: 9293866 - DNA, 22 bp, Homo sapiens
gctctatgttgaccttcagtgg

SEQ ID NO: 9293867 - DNA, 22 bp, Homo sapiens
gctctatgtcgaaagccagtta

SEQ ID NO: 9293868 - DNA, 22 bp, Homo sapiens
gctcagggaactttttgcaggc

SEQ ID NO: 9293869 - DNA, 22 bp, Homo sapiens
gctctgctggaagttctctgga

SEQ ID NO: 9293870 - DNA, 22 bp, Homo sapiens
gctctgctgcttactagatggt

SEQ ID NO: 9293871 - DNA, 22 bp, Homo sapiens
gctctgctgatccgcagccatc

SEQ ID NO: 9293872 - DNA, 22 bp, Homo sapiens
gctctgctgacagctgggacag

SEQ ID NO: 9293873 - DNA, 16 bp, Homo sapiens
gctctgctgaggccca

SEQ ID NO: 9293874 - DNA, 22 bp, Homo sapiens
gctctgctgagatatctgggag

SEQ ID NO: 9293875 - DNA, 23 bp, Homo sapiens
gctctgctctgtttcatagacag

SEQ ID NO: 9293876 - DNA, 22 bp, Homo sapiens
gctctgctcttgacttaccagg

SEQ ID NO: 9293877 - DNA, 22 bp, Homo sapiens
gctctgctgaagccccttgcat

SEQ ID NO: 9293878 - DNA, 22 bp, Homo sapiens
gctctcagggtgatggcatact

SEQ ID NO: 9293879 - DNA, 22 bp, Homo sapiens
gctctcaggtacaaagctgtgt

SEQ ID NO: 9293880 - DNA, 22 bp, Homo sapiens
gctctgctctaacattcctgac

SEQ ID NO: 9293881 - DNA, 22 bp, Homo sapiens
gctctgctaatattgtagtacc

SEQ ID NO: 9293882 - DNA, 19 bp, Homo sapiens
gctctgctactattaccac

SEQ ID NO: 9293883 - DNA, 22 bp, Homo sapiens
gctctgctccctcaaatgacat

SEQ ID NO: 9293884 - DNA, 22 bp, Homo sapiens
gctgcaggagattttgagagtc

SEQ ID NO: 9293885 - DNA, 23 bp, Homo sapiens
gctgcagctgtggatgttctcag

SEQ ID NO: 9293886 - DNA, 22 bp, Homo sapiens
gctgccagctcactctcctgag

SEQ ID NO: 9293887 - DNA, 23 bp, Homo sapiens
ggacacatttatttcagaattca

SEQ ID NO: 9293888 - DNA, 22 bp, Homo sapiens
ggaagcaggaggctggggtaaa

SEQ ID NO: 9293889 - DNA, 22 bp, Homo sapiens
ggaagcaggaggctggggtaaa

SEQ ID NO: 9293890 - DNA, 22 bp, Homo sapiens
ggaaccttgataataagttgtt

SEQ ID NO: 9293891 - DNA, 22 bp, Homo sapiens
ggaaaggctaacagtcatggaa

SEQ ID NO: 9293892 - DNA, 22 bp, Homo sapiens
ggaaatcaaggggacaaattgt

SEQ ID NO: 9293893 - DNA, 22 bp, Homo sapiens
ggacggggagctggaaagggga

SEQ ID NO: 9293894 - DNA, 21 bp, Homo sapiens
ggactctacacaggccatctt

SEQ ID NO: 9293895 - DNA, 22 bp, Homo sapiens
ggacctttgagggggaattggt

SEQ ID NO: 9293896 - DNA, 22 bp, Homo sapiens
ggagaggcttccagagtcgtgc

SEQ ID NO: 9293897 - DNA, 22 bp, Homo sapiens
ggagaggcttccagagtcgtgc

SEQ ID NO: 9293898 - DNA, 19 bp, Homo sapiens
ggagaggctggagggatgc

SEQ ID NO: 9293899 - DNA, 19 bp, Homo sapiens
ggagaggctggagggatgc

SEQ ID NO: 9293900 - DNA, 22 bp, Homo sapiens
ggagaggcgatgagtcacagcc

SEQ ID NO: 9293901 - DNA, 22 bp, Homo sapiens
ggagaggaaatgccagcacttc

SEQ ID NO: 9293902 - DNA, 22 bp, Homo sapiens
ggagagcttggagtgcgatttt

SEQ ID NO: 9293903 - DNA, 22 bp, Homo sapiens
ggagaggaaatgccagcacttc

SEQ ID NO: 9293904 - DNA, 23 bp, Homo sapiens
ggacactgctataaaggatctgc

SEQ ID NO: 9293905 - DNA, 22 bp, Homo sapiens
ggacagaaaccatatgagtgta

SEQ ID NO: 9293906 - DNA, 19 bp, Homo sapiens
ggacagacgcagagatctg

SEQ ID NO: 9293907 - DNA, 22 bp, Homo sapiens
ggacagacagtgtgagtgaggc

SEQ ID NO: 9293908 - DNA, 22 bp, Homo sapiens
ggacagacaaaaatagtaagca

SEQ ID NO: 9293909 - DNA, 22 bp, Homo sapiens
ggacagactttacagccccggg

SEQ ID NO: 9293910 - DNA, 22 bp, Homo sapiens
ggacagagccctggtggcctaa

SEQ ID NO: 9293911 - DNA, 22 bp, Homo sapiens
ggacagagcagacgagcagcgg

SEQ ID NO: 9293912 - DNA, 21 bp, Homo sapiens
ggacagaggagaaggcaccct

SEQ ID NO: 9293913 - DNA, 22 bp, Homo sapiens
gcttcatttgagaacctctgtg

SEQ ID NO: 9293914 - DNA, 22 bp, Homo sapiens
gctgggagtcgcgtctgtggcc

SEQ ID NO: 9293915 - DNA, 16 bp, Homo sapiens
gctgggagggagaggt

SEQ ID NO: 9293916 - DNA, 16 bp, Homo sapiens
gctgggagggagaggt

SEQ ID NO: 9293917 - DNA, 20 bp, Homo sapiens
gctgggggtgtgctgagtga

SEQ ID NO: 9293918 - DNA, 18 bp, Homo sapiens
gctggggttgagctctcc

SEQ ID NO: 9293919 - DNA, 22 bp, Homo sapiens
gctggggtctgtgaggagggct

SEQ ID NO: 9293920 - DNA, 22 bp, Homo sapiens
gctggggtgtggtggataagct

SEQ ID NO: 9293921 - DNA, 22 bp, Homo sapiens
gctggggtctgtgaggagggct

SEQ ID NO: 9293922 - DNA, 22 bp, Homo sapiens
gctgggtggatcggaggctctg

SEQ ID NO: 9293923 - DNA, 22 bp, Homo sapiens
gctgggtctggctgtgagccgg

SEQ ID NO: 9293924 - DNA, 22 bp, Homo sapiens
gctgggttttcttccgggccta

SEQ ID NO: 9293925 - DNA, 22 bp, Homo sapiens
gctgggacaacaggtgagcacc

SEQ ID NO: 9293926 - DNA, 22 bp, Homo sapiens
gctgggagaggccctgaagtga

SEQ ID NO: 9293927 - DNA, 22 bp, Homo sapiens
gctgggagacagacttggaacc

SEQ ID NO: 9293928 - DNA, 22 bp, Homo sapiens
gctgggaggaatttggggaata

SEQ ID NO: 9293929 - DNA, 22 bp, Homo sapiens
gctggcagaagagctggttcaa

SEQ ID NO: 9293930 - DNA, 19 bp, Homo sapiens
gctggcagaattttgaacc

SEQ ID NO: 9293931 - DNA, 22 bp, Homo sapiens
gctggcagaatttcttcttgct

SEQ ID NO: 9293932 - DNA, 22 bp, Homo sapiens
gctggcagacttcctctggaac

SEQ ID NO: 9293933 - DNA, 22 bp, Homo sapiens
gctggcagactgggggcagaac

SEQ ID NO: 9293934 - DNA, 22 bp, Homo sapiens
gctggcagggacagctgcgtgt

SEQ ID NO: 9293935 - DNA, 22 bp, Homo sapiens
gctggcaggatagaagtctaat

SEQ ID NO: 9293936 - DNA, 22 bp, Homo sapiens
gctggcagagacaagaagacta

SEQ ID NO: 9293937 - DNA, 22 bp, Homo sapiens
gctggcagctggaagttgggct

SEQ ID NO: 9293938 - DNA, 22 bp, Homo sapiens
gctggcagccaagtgaagaggg

SEQ ID NO: 9293939 - DNA, 22 bp, Homo sapiens
gctggcagccaagtgaagaggg

SEQ ID NO: 9293940 - DNA, 22 bp, Homo sapiens
gctggcaggagaaacggggtgc

SEQ ID NO: 9293941 - DNA, 22 bp, Homo sapiens
gctggcaggagaccatacccta

SEQ ID NO: 9293942 - DNA, 22 bp, Homo sapiens
gctggcaggagcctttcccttt

SEQ ID NO: 9293943 - DNA, 22 bp, Homo sapiens
gctggcaggataacttctaagc

SEQ ID NO: 9293944 - DNA, 22 bp, Homo sapiens
gcagctgatggaagtcctattg

SEQ ID NO: 9293945 - DNA, 22 bp, Homo sapiens
gcagcagctgacagtgggtgcc

SEQ ID NO: 9293946 - DNA, 22 bp, Homo sapiens
gcagaggaggacccaggaatta

SEQ ID NO: 9293947 - DNA, 22 bp, Homo sapiens
gcagaggagcaagttgctacag

SEQ ID NO: 9293948 - DNA, 23 bp, Homo sapiens
gcagaggagcaagctggacacca

SEQ ID NO: 9293949 - DNA, 22 bp, Homo sapiens
gcaggctgatgactggagttgg

SEQ ID NO: 9293950 - DNA, 22 bp, Homo sapiens
gcaggctgatgactggagttgg

SEQ ID NO: 9293951 - DNA, 22 bp, Homo sapiens
gcagctggagccagccagacac

SEQ ID NO: 9293952 - DNA, 22 bp, Homo sapiens
gcagctggatttcaagagggag

SEQ ID NO: 9293953 - DNA, 22 bp, Homo sapiens
gcagctggagccagccagacac

SEQ ID NO: 9293954 - DNA, 22 bp, Homo sapiens
gcagctggagcatcttctcatc

SEQ ID NO: 9293955 - DNA, 22 bp, Homo sapiens
gcagctggagaaataccaccct

SEQ ID NO: 9293956 - DNA, 22 bp, Homo sapiens
gcagctggacccacacggctta

SEQ ID NO: 9293957 - DNA, 22 bp, Homo sapiens
gcagctggcccctttccttgtt

SEQ ID NO: 9293958 - DNA, 22 bp, Homo sapiens
gcagctggccctgacacgcaga

SEQ ID NO: 9293959 - DNA, 22 bp, Homo sapiens
gcaggaggatcacttgagccca

SEQ ID NO: 9293960 - DNA, 22 bp, Homo sapiens
gcaggagtgacatggatgtgga

SEQ ID NO: 9293961 - DNA, 22 bp, Homo sapiens
gcaggaggttgagccaggactg

SEQ ID NO: 9293962 - DNA, 22 bp, Homo sapiens
gcactgcctatgcaaatgtact

SEQ ID NO: 9293963 - DNA, 22 bp, Homo sapiens
gcactgccctcttcggggttcc

SEQ ID NO: 9293964 - DNA, 23 bp, Homo sapiens
gcactgccatgtgctctgcaggc

SEQ ID NO: 9293965 - DNA, 22 bp, Homo sapiens
gcactgccatcaatgcatgaca

SEQ ID NO: 9293966 - DNA, 22 bp, Homo sapiens
gcactgccacataatctcagca

SEQ ID NO: 9293967 - DNA, 22 bp, Homo sapiens
gcactgctatttagctccatca

SEQ ID NO: 9293968 - DNA, 16 bp, Homo sapiens
gcactgccttgggccc

SEQ ID NO: 9293969 - DNA, 22 bp, Homo sapiens
gcactgcctcatgctaataaat

SEQ ID NO: 9293970 - DNA, 22 bp, Homo sapiens
gcactgcctgtgttcagggtaa

SEQ ID NO: 9293971 - DNA, 22 bp, Homo sapiens
gcactgcctgtgagccctggtt

SEQ ID NO: 9293972 - DNA, 22 bp, Homo sapiens
gcactctcctggctgccacagt

SEQ ID NO: 9293973 - DNA, 17 bp, Homo sapiens
gcactcccccacctcct

SEQ ID NO: 9293974 - DNA, 22 bp, Homo sapiens
gcactgggagtctgtgggggtt

SEQ ID NO: 9293975 - DNA, 21 bp, Homo sapiens
gcagaggaatggtatacataa

SEQ ID NO: 9293976 - DNA, 22 bp, Homo sapiens
gcagaggacacaggagggcaag

SEQ ID NO: 9293977 - DNA, 22 bp, Homo sapiens
gcagagctccccaagacaccaa

SEQ ID NO: 9293978 - DNA, 22 bp, Homo sapiens
gcagagctctgttcttatctcc

SEQ ID NO: 9293979 - DNA, 22 bp, Homo sapiens
gcagagctgcagcgaggcctgg

SEQ ID NO: 9293980 - DNA, 22 bp, Homo sapiens
gcagaggacagggatttagatt

SEQ ID NO: 9293981 - DNA, 22 bp, Homo sapiens
gcagaggactcaatcaaggtat

SEQ ID NO: 9293982 - DNA, 22 bp, Homo sapiens
gcagaggagcaagctggacacc

SEQ ID NO: 9293983 - DNA, 22 bp, Homo sapiens
gcagaggagatgaagatacttt

SEQ ID NO: 9293984 - DNA, 22 bp, Homo sapiens
gcaagctggctgttagaggatg

SEQ ID NO: 9293985 - DNA, 22 bp, Homo sapiens
gcaagctgctcttatgtggagg

SEQ ID NO: 9293986 - DNA, 22 bp, Homo sapiens
gcacaggatgatgggttgaggg

SEQ ID NO: 9293987 - DNA, 22 bp, Homo sapiens
gcacagctcgagctcaggaggg

SEQ ID NO: 9293988 - DNA, 18 bp, Homo sapiens
gcacagctaggagggtcc

SEQ ID NO: 9293989 - DNA, 22 bp, Homo sapiens
gaggggtcctgccttggctgga

SEQ ID NO: 9293990 - DNA, 22 bp, Homo sapiens
gaggggtcttttgttgtcaggg

SEQ ID NO: 9293991 - DNA, 22 bp, Homo sapiens
gaggggctgggtagggcaaccc

SEQ ID NO: 9293992 - DNA, 22 bp, Homo sapiens
gcaagcaagcaggtagagctga

SEQ ID NO: 9293993 - DNA, 22 bp, Homo sapiens
gcaagacctatctagttgctgt

SEQ ID NO: 9293994 - DNA, 22 bp, Homo sapiens
gcaagatgttaacatagggaga

SEQ ID NO: 9293995 - DNA, 22 bp, Homo sapiens
gcaaatgagttgtaacataaaa

SEQ ID NO: 9293996 - DNA, 22 bp, Homo sapiens
gccaaggaaggcttcctggaag

SEQ ID NO: 9293997 - DNA, 22 bp, Homo sapiens
gcatttgtgtggcggaaggatt

SEQ ID NO: 9293998 - DNA, 22 bp, Homo sapiens
gcattttagaatattggagcaa

SEQ ID NO: 9293999 - DNA, 22 bp, Homo sapiens
gccagagcacaggctggtagta

SEQ ID NO: 9294000 - DNA, 22 bp, Homo sapiens
gcagtcctctcattggcctcct

SEQ ID NO: 9294001 - DNA, 22 bp, Homo sapiens
gcagtatctatgtgatgggttg

SEQ ID NO: 9294002 - DNA, 22 bp, Homo sapiens
gcagtatctatgtgatgggttg

SEQ ID NO: 9294003 - DNA, 22 bp, Homo sapiens
gcagtcagtaaggcagccagaa

SEQ ID NO: 9294004 - DNA, 22 bp, Homo sapiens
gcatgaaatgagcgaatataat

SEQ ID NO: 9294005 - DNA, 22 bp, Homo sapiens
gcatcttcacacaaagccagtg

SEQ ID NO: 9294006 - DNA, 22 bp, Homo sapiens
gcatttcttcctggtgtgagcc

SEQ ID NO: 9294007 - DNA, 22 bp, Homo sapiens
gcatttgaaatcctctgtgacg

SEQ ID NO: 9294008 - DNA, 22 bp, Homo sapiens
gcatttgaaatgcaagaaagtg

SEQ ID NO: 9294009 - DNA, 22 bp, Homo sapiens
gcatttctgtgcatacacatga

SEQ ID NO: 9294010 - DNA, 23 bp, Homo sapiens
gcccagggactgggaatcagtgg

SEQ ID NO: 9294011 - DNA, 22 bp, Homo sapiens
gcccatccatggggtcatggcc

SEQ ID NO: 9294012 - DNA, 22 bp, Homo sapiens
gcccagtggtaaaagcaggcct

SEQ ID NO: 9294013 - DNA, 22 bp, Homo sapiens
gcctcaggactggcatactcat

SEQ ID NO: 9294014 - DNA, 22 bp, Homo sapiens
gccctgagaatgtgtgtgtcta

SEQ ID NO: 9294015 - DNA, 22 bp, Homo sapiens
gccaggagttcagatgcatgtt

SEQ ID NO: 9294016 - DNA, 22 bp, Homo sapiens
gccaggtgggagacagacagca

SEQ ID NO: 9294017 - DNA, 22 bp, Homo sapiens
gccaggtggtctggctccagag

SEQ ID NO: 9294018 - DNA, 22 bp, Homo sapiens
gccagtggcatgcggcagggac

SEQ ID NO: 9294019 - DNA, 22 bp, Homo sapiens
gccagtggaggacccatggaga

SEQ ID NO: 9294020 - DNA, 22 bp, Homo sapiens
gccagtggatgaggacttaact

SEQ ID NO: 9294021 - DNA, 22 bp, Homo sapiens
gccagtggccctctggagaagg

SEQ ID NO: 9294022 - DNA, 22 bp, Homo sapiens
gccagtggcttgccaggcagga

SEQ ID NO: 9294023 - DNA, 20 bp, Homo sapiens
gcccactctaatccactgtc

SEQ ID NO: 9294024 - DNA, 22 bp, Homo sapiens
gccagtggagcacatggtgaag

SEQ ID NO: 9294025 - DNA, 22 bp, Homo sapiens
gccagtggagactgaaacccat

SEQ ID NO: 9294026 - DNA, 22 bp, Homo sapiens
gccaggttgctgacgacgatct

SEQ ID NO: 9294027 - DNA, 22 bp, Homo sapiens
gccaggttgctgacgacgatct

SEQ ID NO: 9294028 - DNA, 22 bp, Homo sapiens
ggctaagggttatacatgaacc

SEQ ID NO: 9294029 - DNA, 23 bp, Homo sapiens
ggctaaggccgccggccctgctc

SEQ ID NO: 9294030 - DNA, 14 bp, Homo sapiens
ggctaaggggacag

SEQ ID NO: 9294031 - DNA, 22 bp, Homo sapiens
ggctaaggaagaaggatcgtta

SEQ ID NO: 9294032 - DNA, 22 bp, Homo sapiens
ggctaaggacgggcaagtccca

SEQ ID NO: 9294033 - DNA, 22 bp, Homo sapiens
ggctaaggaacgcaggcttctc

SEQ ID NO: 9294034 - DNA, 23 bp, Homo sapiens
ggctctgtgctgggcctgcagga

SEQ ID NO: 9294035 - DNA, 22 bp, Homo sapiens
ggctctgtaaagtgacacctgc

SEQ ID NO: 9294036 - DNA, 22 bp, Homo sapiens
ggctctggttgaccatgatggc

SEQ ID NO: 9294037 - DNA, 22 bp, Homo sapiens
ggctctgggtctgtggggagcg

SEQ ID NO: 9294038 - DNA, 22 bp, Homo sapiens
ggctgtgattggtggatgtgaa

SEQ ID NO: 9294039 - DNA, 17 bp, Homo sapiens
ggctgtgccaggtgaga

SEQ ID NO: 9294040 - DNA, 23 bp, Homo sapiens
ggctggtgcccttggccagtcgg

SEQ ID NO: 9294041 - DNA, 22 bp, Homo sapiens
ggctgggtcccagctgggagga

SEQ ID NO: 9294042 - DNA, 19 bp, Homo sapiens
ggctgggtctggcaggttc

SEQ ID NO: 9294043 - DNA, 21 bp, Homo sapiens
ggctgggtcatgcagctggcc

SEQ ID NO: 9294044 - DNA, 22 bp, Homo sapiens
ggctgggtacagggcagtgtgc

SEQ ID NO: 9294045 - DNA, 22 bp, Homo sapiens
ggctggactttctgctgggctc

SEQ ID NO: 9294046 - DNA, 22 bp, Homo sapiens
ggctggactttttgcaggtcat

SEQ ID NO: 9294047 - DNA, 20 bp, Homo sapiens
ggctgctgtgggcagagagg

SEQ ID NO: 9294048 - DNA, 20 bp, Homo sapiens
ggctgctgtgggcagagagg

SEQ ID NO: 9294049 - DNA, 22 bp, Homo sapiens
ggctgagtggaggtagccctgt

SEQ ID NO: 9294050 - DNA, 18 bp, Homo sapiens
ggctgaggttgactagaa

SEQ ID NO: 9294051 - DNA, 22 bp, Homo sapiens
ggctgagggccagggctagtct

SEQ ID NO: 9294052 - DNA, 20 bp, Homo sapiens
gggaagtcccgcctgtcttc

SEQ ID NO: 9294053 - DNA, 22 bp, Homo sapiens
gggaagtgatggagccaggatt

SEQ ID NO: 9294054 - DNA, 21 bp, Homo sapiens
gggagctgacagcagcacggc

SEQ ID NO: 9294055 - DNA, 22 bp, Homo sapiens
gggagctgagggacctctgtgg

SEQ ID NO: 9294056 - DNA, 22 bp, Homo sapiens
gggagctgaggagccccgtcgg

SEQ ID NO: 9294057 - DNA, 22 bp, Homo sapiens
gggagctggagctggaagactc

SEQ ID NO: 9294058 - DNA, 19 bp, Homo sapiens
gggagctgaggtctttggt

SEQ ID NO: 9294059 - DNA, 19 bp, Homo sapiens
gggagctgaggtctttggt

SEQ ID NO: 9294060 - DNA, 22 bp, Homo sapiens
gggagctgagctggaagagaat

SEQ ID NO: 9294061 - DNA, 22 bp, Homo sapiens
gggagctgacctgcaggttccc

SEQ ID NO: 9294062 - DNA, 22 bp, Homo sapiens
gggagctgagctctgagccacg

SEQ ID NO: 9294063 - DNA, 22 bp, Homo sapiens
gggagctgagaaacaacattct

SEQ ID NO: 9294064 - DNA, 22 bp, Homo sapiens
ggctttatattgtttgagcaga

SEQ ID NO: 9294065 - DNA, 22 bp, Homo sapiens
ggctttatgcagggatagaaat

SEQ ID NO: 9294066 - DNA, 22 bp, Homo sapiens
ggctttatattgtttgagcaga

SEQ ID NO: 9294067 - DNA, 22 bp, Homo sapiens
ggctttatcaaatgagaccctg

SEQ ID NO: 9294068 - DNA, 22 bp, Homo sapiens
ggctttatcaaatgagaccctg

SEQ ID NO: 9294069 - DNA, 22 bp, Homo sapiens
ggctttatgcacagcagatggt

SEQ ID NO: 9294070 - DNA, 22 bp, Homo sapiens
ggctttattttgcatgaatgct

SEQ ID NO: 9294071 - DNA, 22 bp, Homo sapiens
ggctttatttcactgtaccata

SEQ ID NO: 9294072 - DNA, 22 bp, Homo sapiens
ggctttatttgcagccattgtt

SEQ ID NO: 9294073 - DNA, 22 bp, Homo sapiens
ggctttattatgtggccatgtg

SEQ ID NO: 9294074 - DNA, 22 bp, Homo sapiens
ggctttatttcactgtaccata

SEQ ID NO: 9294075 - DNA, 22 bp, Homo sapiens
ggctttattaactcatccgtaa

SEQ ID NO: 9294076 - DNA, 22 bp, Homo sapiens
ggctttattaagcagggtaagt

SEQ ID NO: 9294077 - DNA, 22 bp, Homo sapiens
ggctttatgtttttcatgtggt

SEQ ID NO: 9294078 - DNA, 21 bp, Homo sapiens
ggctttatgctcacccagcct

SEQ ID NO: 9294079 - DNA, 22 bp, Homo sapiens
ggctttcaacacaggctttcct

SEQ ID NO: 9294080 - DNA, 22 bp, Homo sapiens
ggctttgcagtcatgttttgct

SEQ ID NO: 9294081 - DNA, 22 bp, Homo sapiens
gggaagggagggcctccagtca

SEQ ID NO: 9294082 - DNA, 22 bp, Homo sapiens
gggaaggccttgtcagcggatt

SEQ ID NO: 9294083 - DNA, 21 bp, Homo sapiens
gggagggatggaaatgatgtt

SEQ ID NO: 9294084 - DNA, 22 bp, Homo sapiens
gggagctggcggattccccagg

SEQ ID NO: 9294085 - DNA, 22 bp, Homo sapiens
gggagctggcctactattagat

SEQ ID NO: 9294086 - DNA, 22 bp, Homo sapiens
gggagctggagttgtgttgcct

SEQ ID NO: 9294087 - DNA, 22 bp, Homo sapiens
gggagctggatcgcgcgcccgg

SEQ ID NO: 9294088 - DNA, 22 bp, Homo sapiens
gggagctggatgattgaggcaa

SEQ ID NO: 9294089 - DNA, 22 bp, Homo sapiens
gggagggaggtgatgcttggct

SEQ ID NO: 9294090 - DNA, 22 bp, Homo sapiens
gggagggatctgctaggcaatg

SEQ ID NO: 9294091 - DNA, 23 bp, Homo sapiens
gggcaggtttttataggcttcag

SEQ ID NO: 9294092 - DNA, 22 bp, Homo sapiens
gggcaggttggcatcccgggca

SEQ ID NO: 9294093 - DNA, 22 bp, Homo sapiens
gggcaggttattggagtaggga

SEQ ID NO: 9294094 - DNA, 18 bp, Homo sapiens
gggcactggggactggag

SEQ ID NO: 9294095 - DNA, 22 bp, Homo sapiens
gggcaggttattggagtaggga

SEQ ID NO: 9294096 - DNA, 22 bp, Homo sapiens
gggcactggccgcccatccctg

SEQ ID NO: 9294097 - DNA, 22 bp, Homo sapiens
gggcactggcgttttgttaaac

SEQ ID NO: 9294098 - DNA, 22 bp, Homo sapiens
gggcactggcagtcggggacgc

SEQ ID NO: 9294099 - DNA, 22 bp, Homo sapiens
gggcagtgaatattggtgggaa

SEQ ID NO: 9294100 - DNA, 19 bp, Homo sapiens
gggcagtggcactagggag

SEQ ID NO: 9294101 - DNA, 21 bp, Homo sapiens
gggcactgaaagggaatagca

SEQ ID NO: 9294102 - DNA, 22 bp, Homo sapiens
gggcactgaacaccctcttcgc

SEQ ID NO: 9294103 - DNA, 22 bp, Homo sapiens
gggcactggaaggctctcaggc

SEQ ID NO: 9294104 - DNA, 22 bp, Homo sapiens
gggcactgctttgctctgtcac

SEQ ID NO: 9294105 - DNA, 22 bp, Homo sapiens
gggcactggcaccaaagacttg

SEQ ID NO: 9294106 - DNA, 22 bp, Homo sapiens
gggcactggaggccaaggagct

SEQ ID NO: 9294107 - DNA, 22 bp, Homo sapiens
gggcactgagaattttccactt

SEQ ID NO: 9294108 - DNA, 22 bp, Homo sapiens
gggcactgagggcccacaggat

SEQ ID NO: 9294109 - DNA, 22 bp, Homo sapiens
gggcactgacagggtcccaact

SEQ ID NO: 9294110 - DNA, 22 bp, Homo sapiens
gggcactgaatgccaagctagg

SEQ ID NO: 9294111 - DNA, 22 bp, Homo sapiens
gggcactgagtggatgatgcag

SEQ ID NO: 9294112 - DNA, 22 bp, Homo sapiens
gggcactgctggaggctccctg

SEQ ID NO: 9294113 - DNA, 22 bp, Homo sapiens
ggatgctgtctaagctgaggac

SEQ ID NO: 9294114 - DNA, 22 bp, Homo sapiens
ggatgcaggagttgaagaagga

SEQ ID NO: 9294115 - DNA, 22 bp, Homo sapiens
ggatgcaggggcagcagagcct

SEQ ID NO: 9294116 - DNA, 22 bp, Homo sapiens
ggagatggtggaagctggtgca

SEQ ID NO: 9294117 - DNA, 22 bp, Homo sapiens
ggagatggtggaagctggtgca

SEQ ID NO: 9294118 - DNA, 22 bp, Homo sapiens
ggagcaaatgccaagtgggagg

SEQ ID NO: 9294119 - DNA, 22 bp, Homo sapiens
ggagatgtagtgtcactggact

SEQ ID NO: 9294120 - DNA, 22 bp, Homo sapiens
ggagatttatagcacacttcag

SEQ ID NO: 9294121 - DNA, 22 bp, Homo sapiens
ggagcaccacaggttgagggga

SEQ ID NO: 9294122 - DNA, 22 bp, Homo sapiens
ggagcaccgttgggaggtgagg

SEQ ID NO: 9294123 - DNA, 22 bp, Homo sapiens
ggagcactataatagagatttt

SEQ ID NO: 9294124 - DNA, 22 bp, Homo sapiens
ggagatggctggcaggtagatg

SEQ ID NO: 9294125 - DNA, 22 bp, Homo sapiens
ggagatggctggcaggtagatg

SEQ ID NO: 9294126 - DNA, 21 bp, Homo sapiens
ggagatgggtatcgcctgggc

SEQ ID NO: 9294127 - DNA, 22 bp, Homo sapiens
ggagatggcaagaagttattag

SEQ ID NO: 9294128 - DNA, 22 bp, Homo sapiens
ggagaggcttggcccagcctgg

SEQ ID NO: 9294129 - DNA, 22 bp, Homo sapiens
ggcagaaggcaattagagactg

SEQ ID NO: 9294130 - DNA, 22 bp, Homo sapiens
ggcagaagataggacagggaat

SEQ ID NO: 9294131 - DNA, 22 bp, Homo sapiens
ggcacttgcttgctgcctttat

SEQ ID NO: 9294132 - DNA, 20 bp, Homo sapiens
ggcactgcaccagttagtag

SEQ ID NO: 9294133 - DNA, 22 bp, Homo sapiens
ggcactgcccaccctcacaggg

SEQ ID NO: 9294134 - DNA, 22 bp, Homo sapiens
ggcactgcaggtaagtgctgtc

SEQ ID NO: 9294135 - DNA, 22 bp, Homo sapiens
ggcactgccccctgcccaggac

SEQ ID NO: 9294136 - DNA, 21 bp, Homo sapiens
ggcactgctgggccatctgct

SEQ ID NO: 9294137 - DNA, 22 bp, Homo sapiens
ggattgcaacaagctagtttag

SEQ ID NO: 9294138 - DNA, 20 bp, Homo sapiens
ggcagcaggagtttcctctt

SEQ ID NO: 9294139 - DNA, 22 bp, Homo sapiens
ggccaggaggcaggggctcaat

SEQ ID NO: 9294140 - DNA, 22 bp, Homo sapiens
ggccctgggccctctagcttgt

SEQ ID NO: 9294141 - DNA, 22 bp, Homo sapiens
ggccctggtcctaggggtggaa

SEQ ID NO: 9294142 - DNA, 22 bp, Homo sapiens
ggccctgggcagaggagtgggc

SEQ ID NO: 9294143 - DNA, 22 bp, Homo sapiens
ggccctgggccctctagcttgt

SEQ ID NO: 9294144 - DNA, 22 bp, Homo sapiens
ggccctgggatgctcagcagtg

SEQ ID NO: 9294145 - DNA, 22 bp, Homo sapiens
ggccctgggatgctcagcagtg

SEQ ID NO: 9294146 - DNA, 22 bp, Homo sapiens
ggccgtgctccaaagtcatcgt

SEQ ID NO: 9294147 - DNA, 21 bp, Homo sapiens
ggccctggttacgcctcctct

SEQ ID NO: 9294148 - DNA, 22 bp, Homo sapiens
ggcctagttttttctggtaggt

SEQ ID NO: 9294149 - DNA, 22 bp, Homo sapiens
ggcctggacacctgaggtctta

SEQ ID NO: 9294150 - DNA, 22 bp, Homo sapiens
ggccagctgggccaccaggtgc

SEQ ID NO: 9294151 - DNA, 22 bp, Homo sapiens
ggccagctgtaagctgctgaat

SEQ ID NO: 9294152 - DNA, 22 bp, Homo sapiens
ggccagcttctctgctgcctgt

SEQ ID NO: 9294153 - DNA, 22 bp, Homo sapiens
ggccagcttattagctcagagg

SEQ ID NO: 9294154 - DNA, 22 bp, Homo sapiens
ggccagctgtggggccgagcct

SEQ ID NO: 9294155 - DNA, 22 bp, Homo sapiens
ggccagctttgagctgcaggaa

SEQ ID NO: 9294156 - DNA, 22 bp, Homo sapiens
ggcaggagctctccagtttgcc

SEQ ID NO: 9294157 - DNA, 17 bp, Homo sapiens
ggcaggtgacagacacc

SEQ ID NO: 9294158 - DNA, 22 bp, Homo sapiens
ggcaggtaggccccctctccag

SEQ ID NO: 9294159 - DNA, 22 bp, Homo sapiens
ggcaggtgacctggcctcccag

SEQ ID NO: 9294160 - DNA, 22 bp, Homo sapiens
ggcaggtgagagctctttgaaa

SEQ ID NO: 9294161 - DNA, 22 bp, Homo sapiens
ggcaggtgacggggatgagtat

SEQ ID NO: 9294162 - DNA, 17 bp, Homo sapiens
ggcagggtgctgggtat

SEQ ID NO: 9294163 - DNA, 22 bp, Homo sapiens
ggcagggtgtggagttgggaca

SEQ ID NO: 9294164 - DNA, 22 bp, Homo sapiens
ggtgggcagctcttggcaggca

SEQ ID NO: 9294165 - DNA, 22 bp, Homo sapiens
gtaaatcatggtcagaataaat

SEQ ID NO: 9294166 - DNA, 17 bp, Homo sapiens
gtaaggcttgcagatgc

SEQ ID NO: 9294167 - DNA, 22 bp, Homo sapiens
gtaagggcctaataggacgcag

SEQ ID NO: 9294168 - DNA, 22 bp, Homo sapiens
gtaatctcagctacttgggagg

SEQ ID NO: 9294169 - DNA, 22 bp, Homo sapiens
gtaggaagctctgaggctagtt

SEQ ID NO: 9294170 - DNA, 19 bp, Homo sapiens
gtcaataaaagttaggggt

SEQ ID NO: 9294171 - DNA, 22 bp, Homo sapiens
gtagccattggcaatgaagcct

SEQ ID NO: 9294172 - DNA, 22 bp, Homo sapiens
gtagcccacctggggagggcga

SEQ ID NO: 9294173 - DNA, 22 bp, Homo sapiens
gtagcccacctggggagggcga

SEQ ID NO: 9294174 - DNA, 22 bp, Homo sapiens
gtagatattaaaaatggcagtg

SEQ ID NO: 9294175 - DNA, 22 bp, Homo sapiens
gtcattcctatccatttgatac

SEQ ID NO: 9294176 - DNA, 22 bp, Homo sapiens
gtcaggtcttggaagataggct

SEQ ID NO: 9294177 - DNA, 21 bp, Homo sapiens
gtcagggattcaagtgctcac

SEQ ID NO: 9294178 - DNA, 22 bp, Homo sapiens
gtcagggatccactgctcttct

SEQ ID NO: 9294179 - DNA, 21 bp, Homo sapiens
gtcagggattcaagtgctcac

SEQ ID NO: 9294180 - DNA, 22 bp, Homo sapiens
gtcctctgcttcatgccctgat

SEQ ID NO: 9294181 - DNA, 22 bp, Homo sapiens
gtcctctgactcagccttggga

SEQ ID NO: 9294182 - DNA, 22 bp, Homo sapiens
gtcctctgactcagccttggga

SEQ ID NO: 9294183 - DNA, 22 bp, Homo sapiens
gtcctctgcccaggtcaaggtt

SEQ ID NO: 9294184 - DNA, 22 bp, Homo sapiens
gtcctctgcccaggtcaaggtt

SEQ ID NO: 9294185 - DNA, 22 bp, Homo sapiens
gtcctctgatttctaggtatat

SEQ ID NO: 9294186 - DNA, 22 bp, Homo sapiens
gtcctctgagggggctgcacgc

SEQ ID NO: 9294187 - DNA, 19 bp, Homo sapiens
gtcctctcaacaacccggg

SEQ ID NO: 9294188 - DNA, 22 bp, Homo sapiens
gtcctctgaagttgtgcaatgc

SEQ ID NO: 9294189 - DNA, 22 bp, Homo sapiens
gtcctctgaaagatgaaccatg

SEQ ID NO: 9294190 - DNA, 22 bp, Homo sapiens
gtcctcaggcttgagtgtttat

SEQ ID NO: 9294191 - DNA, 22 bp, Homo sapiens
gtcctcagatgctgctgaaatg

SEQ ID NO: 9294192 - DNA, 22 bp, Homo sapiens
gtcatttaggtctgtcagaaat

SEQ ID NO: 9294193 - DNA, 22 bp, Homo sapiens
gtcatttatcatcagaagtcat

SEQ ID NO: 9294194 - DNA, 22 bp, Homo sapiens
gtgctgggattacaggtgtgag

SEQ ID NO: 9294195 - DNA, 22 bp, Homo sapiens
gtgctgggggtttctgtaggtc

SEQ ID NO: 9294196 - DNA, 22 bp, Homo sapiens
gtgctggggagataggaagaga

SEQ ID NO: 9294197 - DNA, 22 bp, Homo sapiens
gtgctgggggtttctgtaggtc

SEQ ID NO: 9294198 - DNA, 22 bp, Homo sapiens
gtgctgggtgctgcagacaggt

SEQ ID NO: 9294199 - DNA, 23 bp, Homo sapiens
gtgcttgaaagatgcagaattaa

SEQ ID NO: 9294200 - DNA, 22 bp, Homo sapiens
gtgccctggctcacagtgtctc

SEQ ID NO: 9294201 - DNA, 22 bp, Homo sapiens
gtgccctggatgactttggtct

SEQ ID NO: 9294202 - DNA, 22 bp, Homo sapiens
gtgccctggggtgaacccctgg

SEQ ID NO: 9294203 - DNA, 22 bp, Homo sapiens
gtgccctgggccttcagggcca

SEQ ID NO: 9294204 - DNA, 22 bp, Homo sapiens
gtgccctgtctcttgtctccag

SEQ ID NO: 9294205 - DNA, 22 bp, Homo sapiens
gtgccctgtgaactgtaaggaa

SEQ ID NO: 9294206 - DNA, 22 bp, Homo sapiens
gtgccctgagcttatgcattct

SEQ ID NO: 9294207 - DNA, 22 bp, Homo sapiens
gtgccctggaggggttgaaggg

SEQ ID NO: 9294208 - DNA, 22 bp, Homo sapiens
gtgccctgcatgccccgggtat

SEQ ID NO: 9294209 - DNA, 22 bp, Homo sapiens
gtgccctgatgcaattgtctca

SEQ ID NO: 9294210 - DNA, 22 bp, Homo sapiens
gtgccctgatcgctaggctccc

SEQ ID NO: 9294211 - DNA, 22 bp, Homo sapiens
gtgccctgagtgggtaggagag

SEQ ID NO: 9294212 - DNA, 22 bp, Homo sapiens
gtctcgtcaatggcaggttccc

SEQ ID NO: 9294213 - DNA, 22 bp, Homo sapiens
gtctcctgtcctgcaggatgga

SEQ ID NO: 9294214 - DNA, 22 bp, Homo sapiens
gtctggggtactttcatctgat

SEQ ID NO: 9294215 - DNA, 22 bp, Homo sapiens
gtctctctgctaggcctccagt

SEQ ID NO: 9294216 - DNA, 22 bp, Homo sapiens
gtgatgtcagcaagaataggaa

SEQ ID NO: 9294217 - DNA, 22 bp, Homo sapiens
ggtagggatgggatttggaagt

SEQ ID NO: 9294218 - DNA, 22 bp, Homo sapiens
ggtcagcagtttctttgaattt

SEQ ID NO: 9294219 - DNA, 22 bp, Homo sapiens
ggtagggcaaagtagggcacct

SEQ ID NO: 9294220 - DNA, 22 bp, Homo sapiens
ggtagggaaggctctgcgggga

SEQ ID NO: 9294221 - DNA, 22 bp, Homo sapiens
ggtagggaaggtctcccacatt

SEQ ID NO: 9294222 - DNA, 21 bp, Homo sapiens
ggtagggaaggttcgctggtg

SEQ ID NO: 9294223 - DNA, 22 bp, Homo sapiens
ggtcaggatccaagtctgtgct

SEQ ID NO: 9294224 - DNA, 22 bp, Homo sapiens
ggtcagctctttgggctggtgg

SEQ ID NO: 9294225 - DNA, 22 bp, Homo sapiens
ggtaggcagatcactgtctatg

SEQ ID NO: 9294226 - DNA, 22 bp, Homo sapiens
ggtaggagtgaagacttaagat

SEQ ID NO: 9294227 - DNA, 22 bp, Homo sapiens
ggtaggaagatagagcaaagtt

SEQ ID NO: 9294228 - DNA, 22 bp, Homo sapiens
ggtagcgagaacagaccttaag

SEQ ID NO: 9294229 - DNA, 22 bp, Homo sapiens
ggtagcaagcgcttgccctgcg

SEQ ID NO: 9294230 - DNA, 22 bp, Homo sapiens
ggtcagggttccaggtatcttc

SEQ ID NO: 9294231 - DNA, 22 bp, Homo sapiens
ggtcaggccactcaacccttat

SEQ ID NO: 9294232 - DNA, 22 bp, Homo sapiens
ggtcaggggctgctctacagag

SEQ ID NO: 9294233 - DNA, 22 bp, Homo sapiens
ggtcagggggatctgtgaggta

SEQ ID NO: 9294234 - DNA, 22 bp, Homo sapiens
ggtcagggtataatcaagtgag

SEQ ID NO: 9294235 - DNA, 21 bp, Homo sapiens
ggtcagggggtgcctccaggt

SEQ ID NO: 9294236 - DNA, 22 bp, Homo sapiens
gggtcagggctgcctgggctca

SEQ ID NO: 9294237 - DNA, 22 bp, Homo sapiens
gggtcaggctagcccagacttc

SEQ ID NO: 9294238 - DNA, 23 bp, Homo sapiens
gggtccagagacaggcatgggtg

SEQ ID NO: 9294239 - DNA, 22 bp, Homo sapiens
gggtccagagttgaagaggtta

SEQ ID NO: 9294240 - DNA, 22 bp, Homo sapiens
gggtccagacactccagaggaa

SEQ ID NO: 9294241 - DNA, 19 bp, Homo sapiens
ggtaaaagtgagcttcagg

SEQ ID NO: 9294242 - DNA, 22 bp, Homo sapiens
ggtaaggagctccggcttctgc

SEQ ID NO: 9294243 - DNA, 22 bp, Homo sapiens
ggtaacttagctcatggctgtg

SEQ ID NO: 9294244 - DNA, 22 bp, Homo sapiens
ggtacccagggttgcttcaagt

SEQ ID NO: 9294245 - DNA, 22 bp, Homo sapiens
ggtgccagcctagtgcagtggt

SEQ ID NO: 9294246 - DNA, 22 bp, Homo sapiens
ggtgccagagtggcccaggggc

SEQ ID NO: 9294247 - DNA, 22 bp, Homo sapiens
ggtgccaggctgtagtcagggt

SEQ ID NO: 9294248 - DNA, 22 bp, Homo sapiens
ggtgccagtgggtctcaggata

SEQ ID NO: 9294249 - DNA, 22 bp, Homo sapiens
ggtgccaggctgtagtcagggt

SEQ ID NO: 9294250 - DNA, 22 bp, Homo sapiens
ggtgggatgcctctggagaagt

SEQ ID NO: 9294251 - DNA, 20 bp, Homo sapiens
ggtgcaggtaacgctgtgct

SEQ ID NO: 9294252 - DNA, 22 bp, Homo sapiens
ggtgcagtggtgtggcaaaggg

SEQ ID NO: 9294253 - DNA, 22 bp, Homo sapiens
gggggaagactgggctagtgat

SEQ ID NO: 9294254 - DNA, 22 bp, Homo sapiens
gggggaagactgggctagtgat

SEQ ID NO: 9294255 - DNA, 22 bp, Homo sapiens
ggggcaggagcccttcttcagc

SEQ ID NO: 9294256 - DNA, 22 bp, Homo sapiens
ggggcaggagcccttcttcagc

SEQ ID NO: 9294257 - DNA, 22 bp, Homo sapiens
ggggcaggaggtgttctctttt

SEQ ID NO: 9294258 - DNA, 22 bp, Homo sapiens
gggtcactgtaaggcaataagt

SEQ ID NO: 9294259 - DNA, 22 bp, Homo sapiens
ggggatggaggcgtgtggtcct

SEQ ID NO: 9294260 - DNA, 22 bp, Homo sapiens
ggggcacttggcacctctgcag

SEQ ID NO: 9294261 - DNA, 22 bp, Homo sapiens
ggggcactttactgcctcatct

SEQ ID NO: 9294262 - DNA, 22 bp, Homo sapiens
gggctgggattgcttgctgtga

SEQ ID NO: 9294263 - DNA, 22 bp, Homo sapiens
gggctggggctcaataatttgt

SEQ ID NO: 9294264 - DNA, 22 bp, Homo sapiens
gggctgggcatggtgttccctc

SEQ ID NO: 9294265 - DNA, 22 bp, Homo sapiens
gggctgggatggcttgaagatt

SEQ ID NO: 9294266 - DNA, 22 bp, Homo sapiens
gggctgggaatggctaagtatg

SEQ ID NO: 9294267 - DNA, 20 bp, Homo sapiens
gggcagttcaatgccactct

SEQ ID NO: 9294268 - DNA, 22 bp, Homo sapiens
gggcatgacttttggagtggga

SEQ ID NO: 9294269 - DNA, 22 bp, Homo sapiens
gggctcggcatctgtggactct

SEQ ID NO: 9294270 - DNA, 22 bp, Homo sapiens
gggctctagaggacagcctgct

SEQ ID NO: 9294271 - DNA, 19 bp, Homo sapiens
gggctctactctcagtctt

SEQ ID NO: 9294272 - DNA, 22 bp, Homo sapiens
gggctctaggatggctccagcc

SEQ ID NO: 9294273 - DNA, 22 bp, Homo sapiens
tcagtggggtcgatgtgaggga

SEQ ID NO: 9294274 - DNA, 20 bp, Homo sapiens
tcagtgggaaagtgagagtg

SEQ ID NO: 9294275 - DNA, 22 bp, Homo sapiens
tcagtgggaggccattgaatgg

SEQ ID NO: 9294276 - DNA, 22 bp, Homo sapiens
tcagtgggagcaggagagtgac

SEQ ID NO: 9294277 - DNA, 22 bp, Homo sapiens
tcagtgcttgcctctggaggag

SEQ ID NO: 9294278 - DNA, 22 bp, Homo sapiens
tcagtgcttttgtcacatggtc

SEQ ID NO: 9294279 - DNA, 22 bp, Homo sapiens
tcatccttttgcatgggaaggc

SEQ ID NO: 9294280 - DNA, 22 bp, Homo sapiens
tcaggctgagaaaatctggacc

SEQ ID NO: 9294281 - DNA, 22 bp, Homo sapiens
tcaggctgaggtcatctgcatc

SEQ ID NO: 9294282 - DNA, 22 bp, Homo sapiens
tcagggcaaaagggaaaccatt

SEQ ID NO: 9294283 - DNA, 22 bp, Homo sapiens
tcagggcaagtctcagaaggtt

SEQ ID NO: 9294284 - DNA, 22 bp, Homo sapiens
tcagggcaatgtccctcagaag

SEQ ID NO: 9294285 - DNA, 22 bp, Homo sapiens
tcagggcaagattggttaataa

SEQ ID NO: 9294286 - DNA, 22 bp, Homo sapiens
tcagggcaaagggcagagtttg

SEQ ID NO: 9294287 - DNA, 22 bp, Homo sapiens
tcagggcaccaaaaaagatgcc

SEQ ID NO: 9294288 - DNA, 22 bp, Homo sapiens
tcagggcacattctgcagtggc

SEQ ID NO: 9294289 - DNA, 22 bp, Homo sapiens
tcagggcacaggcctgtgggtt

SEQ ID NO: 9294290 - DNA, 22 bp, Homo sapiens
tcagggcacgtttctgcaatgc

SEQ ID NO: 9294291 - DNA, 22 bp, Homo sapiens
tcagggcactgtcacctgatat

SEQ ID NO: 9294292 - DNA, 22 bp, Homo sapiens
tcagggcagaatccaaagaatt

SEQ ID NO: 9294293 - DNA, 22 bp, Homo sapiens
tcagggcagcctaaggcacctc

SEQ ID NO: 9294294 - DNA, 16 bp, Homo sapiens
tcagggcagaatggca

SEQ ID NO: 9294295 - DNA, 21 bp, Homo sapiens
tcagggcagctgctcttcaga

SEQ ID NO: 9294296 - DNA, 22 bp, Homo sapiens
tcagggttgtggtggaattcag

SEQ ID NO: 9294297 - DNA, 22 bp, Homo sapiens
tcagggttgtgaaggaaagggg

SEQ ID NO: 9294298 - DNA, 22 bp, Homo sapiens
tcaggtggaattaattaagaga

SEQ ID NO: 9294299 - DNA, 22 bp, Homo sapiens
tcagccaggccctaagagattg

SEQ ID NO: 9294300 - DNA, 22 bp, Homo sapiens
tcagccagggggagagaatgga

SEQ ID NO: 9294301 - DNA, 23 bp, Homo sapiens
tcagcctcttaggacttctcacc

SEQ ID NO: 9294302 - DNA, 22 bp, Homo sapiens
tcagcttggacagcttggttga

SEQ ID NO: 9294303 - DNA, 22 bp, Homo sapiens
tcagcctcattttctgctctgt

SEQ ID NO: 9294304 - DNA, 20 bp, Homo sapiens
tcagccattccttacctttc

SEQ ID NO: 9294305 - DNA, 22 bp, Homo sapiens
tcaggcaccccttgagtagggg

SEQ ID NO: 9294306 - DNA, 19 bp, Homo sapiens
tcaggaggtcgacctggca

SEQ ID NO: 9294307 - DNA, 22 bp, Homo sapiens
tcaggagggtgacaggccctgg

SEQ ID NO: 9294308 - DNA, 22 bp, Homo sapiens
tcaggaggtaggacatactggt

SEQ ID NO: 9294309 - DNA, 22 bp, Homo sapiens
tcaggaggtccgcccgggaggg

SEQ ID NO: 9294310 - DNA, 22 bp, Homo sapiens
tcaggcaggaagggaggacttg

SEQ ID NO: 9294311 - DNA, 22 bp, Homo sapiens
tcaggagctcttccctggtgtg

SEQ ID NO: 9294312 - DNA, 22 bp, Homo sapiens
tcaggaggacagataaggatag

SEQ ID NO: 9294313 - DNA, 22 bp, Homo sapiens
tcaggagggctaagactgtagc

SEQ ID NO: 9294314 - DNA, 22 bp, Homo sapiens
tcaggagggagtgtggatagag

SEQ ID NO: 9294315 - DNA, 22 bp, Homo sapiens
tcaggagagtgttcagtggagg

SEQ ID NO: 9294316 - DNA, 22 bp, Homo sapiens
tcaggagcagcatgggtgagag

SEQ ID NO: 9294317 - DNA, 22 bp, Homo sapiens
tcagaagcaggagtgtgcacaa

SEQ ID NO: 9294318 - DNA, 22 bp, Homo sapiens
tcagaagcatgtggggagcctg

SEQ ID NO: 9294319 - DNA, 22 bp, Homo sapiens
tcagaagccaccttttgttggg

SEQ ID NO: 9294320 - DNA, 22 bp, Homo sapiens
tcagaagcatgtggggagcctg

SEQ ID NO: 9294321 - DNA, 22 bp, Homo sapiens
tcagaagcaaacatcactctag

SEQ ID NO: 9294322 - DNA, 22 bp, Homo sapiens
tcagaggaatctgtacttgaaa

SEQ ID NO: 9294323 - DNA, 23 bp, Homo sapiens
tcagagagctgttgagagctgcc

SEQ ID NO: 9294324 - DNA, 22 bp, Homo sapiens
tcagagagctggtgggcagagg

SEQ ID NO: 9294325 - DNA, 22 bp, Homo sapiens
tcagaggagaagttgggaaaat

SEQ ID NO: 9294326 - DNA, 21 bp, Homo sapiens
tcacgtggtcacatgagcttt

SEQ ID NO: 9294327 - DNA, 22 bp, Homo sapiens
tcacgcatggacggtcaacatc

SEQ ID NO: 9294328 - DNA, 22 bp, Homo sapiens
tcaccgaggctggagtgcagtg

SEQ ID NO: 9294329 - DNA, 22 bp, Homo sapiens
tcactgctttgtttacaactat

SEQ ID NO: 9294330 - DNA, 22 bp, Homo sapiens
tcacagagagtgacttgttgct

SEQ ID NO: 9294331 - DNA, 22 bp, Homo sapiens
tcacagagaggttaagcagttg

SEQ ID NO: 9294332 - DNA, 22 bp, Homo sapiens
tcacagagatgaacttttgata

SEQ ID NO: 9294333 - DNA, 22 bp, Homo sapiens
tcacagagagaatattgtgttt

SEQ ID NO: 9294334 - DNA, 19 bp, Homo sapiens
tcacagagttcttacggga

SEQ ID NO: 9294335 - DNA, 20 bp, Homo sapiens
tcacagagtagccttgtctg

SEQ ID NO: 9294336 - DNA, 22 bp, Homo sapiens
tcacagagctcacagtttagca

SEQ ID NO: 9294337 - DNA, 22 bp, Homo sapiens
tcacagagttaaaagtttcttt

SEQ ID NO: 9294338 - DNA, 22 bp, Homo sapiens
tcacagagcacgtatcatgcct

SEQ ID NO: 9294339 - DNA, 22 bp, Homo sapiens
tcacagagcacacaagaattgc

SEQ ID NO: 9294340 - DNA, 23 bp, Homo sapiens
tcacagagcatactgcattttgc

SEQ ID NO: 9294341 - DNA, 21 bp, Homo sapiens
tcacagagccacagaattggt

SEQ ID NO: 9294342 - DNA, 22 bp, Homo sapiens
tcacagcaccaggatctctcca

SEQ ID NO: 9294343 - DNA, 16 bp, Homo sapiens
tcacatacttccttgc

SEQ ID NO: 9294344 - DNA, 22 bp, Homo sapiens
tcaaaagtttcacatagagata

SEQ ID NO: 9294345 - DNA, 22 bp, Homo sapiens
tcaaaagtttcacatagagata

SEQ ID NO: 9294346 - DNA, 22 bp, Homo sapiens
tcacacacatggatagtatttt

SEQ ID NO: 9294347 - DNA, 22 bp, Homo sapiens
tcacacacatttgctgtctgat

SEQ ID NO: 9294348 - DNA, 21 bp, Homo sapiens
tcacacacgtttccaagggca

SEQ ID NO: 9294349 - DNA, 22 bp, Homo sapiens
tcacacacataatctaagatta

SEQ ID NO: 9294350 - DNA, 22 bp, Homo sapiens
tcacacagctcctttccttagt

SEQ ID NO: 9294351 - DNA, 22 bp, Homo sapiens
tcacacagctgacagagccttt

SEQ ID NO: 9294352 - DNA, 22 bp, Homo sapiens
tcaattctagagccttacattg

SEQ ID NO: 9294353 - DNA, 22 bp, Homo sapiens
tcaattctggtcctcaggaact

SEQ ID NO: 9294354 - DNA, 22 bp, Homo sapiens
tccctgtgggatgaggactctg

SEQ ID NO: 9294355 - DNA, 22 bp, Homo sapiens
tccctgtgggcagaggctgcct

SEQ ID NO: 9294356 - DNA, 23 bp, Homo sapiens
tccctgtgtacagcctgcatgag

SEQ ID NO: 9294357 - DNA, 22 bp, Homo sapiens
tcccttctggcagcagtgtgag

SEQ ID NO: 9294358 - DNA, 22 bp, Homo sapiens
tcccttggttaaatatgtagga

SEQ ID NO: 9294359 - DNA, 22 bp, Homo sapiens
tcccttggaaagtagcctcaca

SEQ ID NO: 9294360 - DNA, 21 bp, Homo sapiens
tccctgtgagcagctcttcct

SEQ ID NO: 9294361 - DNA, 22 bp, Homo sapiens
tccctgtggatatctgcagctg

SEQ ID NO: 9294362 - DNA, 22 bp, Homo sapiens
tccctgccctcagtgcacccgg

SEQ ID NO: 9294363 - DNA, 22 bp, Homo sapiens
tccctgccagtcctggtctgaa

SEQ ID NO: 9294364 - DNA, 23 bp, Homo sapiens
tcctccctgacttctacagcaca

SEQ ID NO: 9294365 - DNA, 22 bp, Homo sapiens
tcctccctaactcatgatgagt

SEQ ID NO: 9294366 - DNA, 22 bp, Homo sapiens
tcctccctgcactcagtgaagt

SEQ ID NO: 9294367 - DNA, 22 bp, Homo sapiens
tcctcctgcctttgcttcttgt

SEQ ID NO: 9294368 - DNA, 22 bp, Homo sapiens
tcctcctgctgttagtcttgaa

SEQ ID NO: 9294369 - DNA, 19 bp, Homo sapiens
tcctcagtgacaacctcag

SEQ ID NO: 9294370 - DNA, 22 bp, Homo sapiens
tccacacacatttctatgtgca

SEQ ID NO: 9294371 - DNA, 22 bp, Homo sapiens
tcatgttttagtaaagtgaagg

SEQ ID NO: 9294372 - DNA, 22 bp, Homo sapiens
tcatgttttagctgcaaaatga

SEQ ID NO: 9294373 - DNA, 22 bp, Homo sapiens
tcatgtttttgccatatgactc

SEQ ID NO: 9294374 - DNA, 22 bp, Homo sapiens
tcatgtttgccctaagaaaaag

SEQ ID NO: 9294375 - DNA, 22 bp, Homo sapiens
tcatgtttgttggaaatgtggc

SEQ ID NO: 9294376 - DNA, 20 bp, Homo sapiens
tcatgtgtgtcctacagaga

SEQ ID NO: 9294377 - DNA, 22 bp, Homo sapiens
tcatgtgtctgctgcagctgtt

SEQ ID NO: 9294378 - DNA, 22 bp, Homo sapiens
tcatgtgtgtttcatgtatgga

SEQ ID NO: 9294379 - DNA, 20 bp, Homo sapiens
tcatgtgtgtcctacagaga

SEQ ID NO: 9294380 - DNA, 22 bp, Homo sapiens
tcatgttattgactcataatat

SEQ ID NO: 9294381 - DNA, 22 bp, Homo sapiens
tcatgtgttgcactgaggacct

SEQ ID NO: 9294382 - DNA, 22 bp, Homo sapiens
tcatgtgttaaactccaagata

SEQ ID NO: 9294383 - DNA, 22 bp, Homo sapiens
tcatgtgtctgccagtgtttat

SEQ ID NO: 9294384 - DNA, 22 bp, Homo sapiens
tcatgtgtcctagttcatataa

SEQ ID NO: 9294385 - DNA, 21 bp, Homo sapiens
tcatgtgtaacttttgaccac

SEQ ID NO: 9294386 - DNA, 22 bp, Homo sapiens
tccacgtgagcttcgtgtgcag

SEQ ID NO: 9294387 - DNA, 21 bp, Homo sapiens
tccaccctctctgctcccagt

SEQ ID NO: 9294388 - DNA, 22 bp, Homo sapiens
tccaccctgctttcttatctcc

SEQ ID NO: 9294389 - DNA, 22 bp, Homo sapiens
tccaccctgcttttgtctttga

SEQ ID NO: 9294390 - DNA, 22 bp, Homo sapiens
tccactggtatccacagtgggg

SEQ ID NO: 9294391 - DNA, 23 bp, Homo sapiens
tccaggagcatgctggctggcga

SEQ ID NO: 9294392 - DNA, 22 bp, Homo sapiens
tcccagctcacatatggtaact

SEQ ID NO: 9294393 - DNA, 22 bp, Homo sapiens
tcccagctgtgtggaggagatg

SEQ ID NO: 9294394 - DNA, 22 bp, Homo sapiens
tcccagcctttcttttctgctg

SEQ ID NO: 9294395 - DNA, 22 bp, Homo sapiens
tcccacatatgcaatcctgaat

SEQ ID NO: 9294396 - DNA, 22 bp, Homo sapiens
tccagtggtttgaaaggggtgt

SEQ ID NO: 9294397 - DNA, 22 bp, Homo sapiens
tcccagagtgagccaggggcag

SEQ ID NO: 9294398 - DNA, 22 bp, Homo sapiens
tccagggagcaagtcaggccgg

SEQ ID NO: 9294399 - DNA, 22 bp, Homo sapiens
tccagtctggagccttctggtt

SEQ ID NO: 9294400 - DNA, 22 bp, Homo sapiens
tccagtggcactggagactaga

SEQ ID NO: 9294401 - DNA, 22 bp, Homo sapiens
tccagtggagtgtgggggtgaa

SEQ ID NO: 9294402 - DNA, 15 bp, Homo sapiens
tccagtggaggcact

SEQ ID NO: 9294403 - DNA, 22 bp, Homo sapiens
tccagtggcaccttggccctca

SEQ ID NO: 9294404 - DNA, 22 bp, Homo sapiens
tccagtggaacagatgttgcct

SEQ ID NO: 9294405 - DNA, 22 bp, Homo sapiens
tccagtggaaattgtgttcatt

SEQ ID NO: 9294406 - DNA, 22 bp, Homo sapiens
tccagtggtggtttgaagggca

SEQ ID NO: 9294407 - DNA, 21 bp, Homo sapiens
tccagtggtgtctagaatgtg

SEQ ID NO: 9294408 - DNA, 22 bp, Homo sapiens
tccagtggtggctcccggacct

SEQ ID NO: 9294409 - DNA, 22 bp, Homo sapiens
tccagtggtagtaaagaggtct

SEQ ID NO: 9294410 - DNA, 22 bp, Homo sapiens
tccagtggtacatggagacact

SEQ ID NO: 9294411 - DNA, 22 bp, Homo sapiens
tccagtggctttgctgctttaa

SEQ ID NO: 9294412 - DNA, 22 bp, Homo sapiens
tccagtggcttcctggaaaaaa

SEQ ID NO: 9294413 - DNA, 20 bp, Homo sapiens
tccagtggcctgaatctgga

SEQ ID NO: 9294414 - DNA, 22 bp, Homo sapiens
tccagtggcaggcggtgaggtc

SEQ ID NO: 9294415 - DNA, 22 bp, Homo sapiens
tccagtgggttgctgagggagg

SEQ ID NO: 9294416 - DNA, 22 bp, Homo sapiens
tccagtgggtctggcaagacca

SEQ ID NO: 9294417 - DNA, 21 bp, Homo sapiens
tccagtggggatctctgatat

SEQ ID NO: 9294418 - DNA, 22 bp, Homo sapiens
tccagggagatactggctgcca

SEQ ID NO: 9294419 - DNA, 22 bp, Homo sapiens
tccagggagagccgctgctcca

SEQ ID NO: 9294420 - DNA, 22 bp, Homo sapiens
tccaggaggaggaaggctgcca

SEQ ID NO: 9294421 - DNA, 22 bp, Homo sapiens
tccaggccattgactgcatcct

SEQ ID NO: 9294422 - DNA, 22 bp, Homo sapiens
taagataatccattataatgtt

SEQ ID NO: 9294423 - DNA, 22 bp, Homo sapiens
taactgtaatataaatatgagt

SEQ ID NO: 9294424 - DNA, 22 bp, Homo sapiens
gttttataattgcttcataaga

SEQ ID NO: 9294425 - DNA, 22 bp, Homo sapiens
gttttatttccatgagagaccg

SEQ ID NO: 9294426 - DNA, 22 bp, Homo sapiens
gtttacaaatattttaaatggt

SEQ ID NO: 9294427 - DNA, 22 bp, Homo sapiens
gtttacattgctgtttgtgtct

SEQ ID NO: 9294428 - DNA, 22 bp, Homo sapiens
gtttagaattctaactttaagg

SEQ ID NO: 9294429 - DNA, 22 bp, Homo sapiens
gtttctaattggaactttgagg

SEQ ID NO: 9294430 - DNA, 22 bp, Homo sapiens
gtgcttttccttatttggtgct

SEQ ID NO: 9294431 - DNA, 22 bp, Homo sapiens
gtgtgtcctgttttaaaatagt

SEQ ID NO: 9294432 - DNA, 22 bp, Homo sapiens
gtgtgtcctcttaactattatg

SEQ ID NO: 9294433 - DNA, 22 bp, Homo sapiens
gtgtgtcctcataagatggagg

SEQ ID NO: 9294434 - DNA, 22 bp, Homo sapiens
gtgtgtccttgggcctctgcag

SEQ ID NO: 9294435 - DNA, 22 bp, Homo sapiens
gtgctttagttcttgcaactgg

SEQ ID NO: 9294436 - DNA, 22 bp, Homo sapiens
gtgctttactgtgttgccttta

SEQ ID NO: 9294437 - DNA, 22 bp, Homo sapiens
gtgctttaccttattggtctcg

SEQ ID NO: 9294438 - DNA, 22 bp, Homo sapiens
gtgcttttaattctggtgagta

SEQ ID NO: 9294439 - DNA, 22 bp, Homo sapiens
gtgcttttaacttttgaaagga

SEQ ID NO: 9294440 - DNA, 22 bp, Homo sapiens
gtgctttccatcctccctgctg

SEQ ID NO: 9294441 - DNA, 23 bp, Homo sapiens
gtgtgttcccggagtagctcccg

SEQ ID NO: 9294442 - DNA, 22 bp, Homo sapiens
gttacaaaggtcataaaagtgt

SEQ ID NO: 9294443 - DNA, 22 bp, Homo sapiens
gttaggaacattaatgtgattt

SEQ ID NO: 9294444 - DNA, 22 bp, Homo sapiens
gttaggaagacaggagtgggtt

SEQ ID NO: 9294445 - DNA, 22 bp, Homo sapiens
gttaggaacactggagcctaaa

SEQ ID NO: 9294446 - DNA, 22 bp, Homo sapiens
gttaggaacactggagcctaaa

SEQ ID NO: 9294447 - DNA, 22 bp, Homo sapiens
gttagggagtcaggtggctctt

SEQ ID NO: 9294448 - DNA, 22 bp, Homo sapiens
gttaggaagtggtaaggttctg

SEQ ID NO: 9294449 - DNA, 22 bp, Homo sapiens
gttaggaaggtatagttgtatt

SEQ ID NO: 9294450 - DNA, 22 bp, Homo sapiens
gttaggaatttgttactgtgta

SEQ ID NO: 9294451 - DNA, 22 bp, Homo sapiens
taatgctaacatcatatcactg

SEQ ID NO: 9294452 - DNA, 22 bp, Homo sapiens
taatgaggtgatgactaaggtc

SEQ ID NO: 9294453 - DNA, 22 bp, Homo sapiens
taatgaggaaatagagggaatg

SEQ ID NO: 9294454 - DNA, 22 bp, Homo sapiens
taatgaggcatttgagtcacct

SEQ ID NO: 9294455 - DNA, 22 bp, Homo sapiens
taatgaggcaagagtcatggct

SEQ ID NO: 9294456 - DNA, 22 bp, Homo sapiens
taataacaattgtaggacatga

SEQ ID NO: 9294457 - DNA, 22 bp, Homo sapiens
taataaatgaaagtgctggcat

SEQ ID NO: 9294458 - DNA, 22 bp, Homo sapiens
taagttagcaaggccaaggtaa

SEQ ID NO: 9294459 - DNA, 22 bp, Homo sapiens
taagttagccctattaaattaa

SEQ ID NO: 9294460 - DNA, 22 bp, Homo sapiens
taagttagaggttaggcactta

SEQ ID NO: 9294461 - DNA, 22 bp, Homo sapiens
taagttagatcttaattaaagt

SEQ ID NO: 9294462 - DNA, 22 bp, Homo sapiens
taagttagagcacaattcttac

SEQ ID NO: 9294463 - DNA, 22 bp, Homo sapiens
taagttagtcctttttaaaagt

SEQ ID NO: 9294464 - DNA, 22 bp, Homo sapiens
tacaatatgtggccttttgtga

SEQ ID NO: 9294465 - DNA, 22 bp, Homo sapiens
tacaccattcccaggtggattt

SEQ ID NO: 9294466 - DNA, 22 bp, Homo sapiens
tacacatcactgtatctttcag

SEQ ID NO: 9294467 - DNA, 22 bp, Homo sapiens
tacacatctctgtcagtagtga

SEQ ID NO: 9294468 - DNA, 22 bp, Homo sapiens
tacacatccatgttttgacttt

SEQ ID NO: 9294469 - DNA, 22 bp, Homo sapiens
tacacatcccagactcccagga

SEQ ID NO: 9294470 - DNA, 18 bp, Homo sapiens
tactggtccttttatgat

SEQ ID NO: 9294471 - DNA, 22 bp, Homo sapiens
tacttctagcctgccccttgtg

SEQ ID NO: 9294472 - DNA, 22 bp, Homo sapiens
taccttggggttttgttgctct

SEQ ID NO: 9294473 - DNA, 22 bp, Homo sapiens
taccttgggctattatctttga

SEQ ID NO: 9294474 - DNA, 22 bp, Homo sapiens
tacattccacaagcattgcttt

SEQ ID NO: 9294475 - DNA, 19 bp, Homo sapiens
tacattccacacaatctct

SEQ ID NO: 9294476 - DNA, 22 bp, Homo sapiens
tacctgagcccagtgcagcata

SEQ ID NO: 9294477 - DNA, 22 bp, Homo sapiens
taccttgggttgagttcattct

SEQ ID NO: 9294478 - DNA, 22 bp, Homo sapiens
tacctttaaggagatttgacaa

SEQ ID NO: 9294479 - DNA, 22 bp, Homo sapiens
tactgacacaaagccaatccct

SEQ ID NO: 9294480 - DNA, 22 bp, Homo sapiens
tacatgtgataaattgattaaa

SEQ ID NO: 9294481 - DNA, 22 bp, Homo sapiens
tacatacatattcatacaggtg

SEQ ID NO: 9294482 - DNA, 22 bp, Homo sapiens
tacatacacaaatatactgttt

SEQ ID NO: 9294483 - DNA, 22 bp, Homo sapiens
tacattatcttgttatctttca

SEQ ID NO: 9294484 - DNA, 20 bp, Homo sapiens
tacagcagaaatgttttgct

SEQ ID NO: 9294485 - DNA, 22 bp, Homo sapiens
tacagcagcccaccttcttctg

SEQ ID NO: 9294486 - DNA, 22 bp, Homo sapiens
tacagcagcatcgcagtgacct

SEQ ID NO: 9294487 - DNA, 22 bp, Homo sapiens
tacataattaatctttaagttc

SEQ ID NO: 9294488 - DNA, 22 bp, Homo sapiens
tacagtttttattcatgacaag

SEQ ID NO: 9294489 - DNA, 22 bp, Homo sapiens
tacagtttgttacattgttagt

SEQ ID NO: 9294490 - DNA, 22 bp, Homo sapiens
tagatgtaagcagaagaacagc

SEQ ID NO: 9294491 - DNA, 22 bp, Homo sapiens
tagatgtagccactgctaaaag

SEQ ID NO: 9294492 - DNA, 22 bp, Homo sapiens
tagcatttctggcctctactca

SEQ ID NO: 9294493 - DNA, 23 bp, Homo sapiens
tagccagtcattccagcaaggcc

SEQ ID NO: 9294494 - DNA, 22 bp, Homo sapiens
tagccatcattctcacattctt

SEQ ID NO: 9294495 - DNA, 22 bp, Homo sapiens
tagccatcttcccaccccatct

SEQ ID NO: 9294496 - DNA, 22 bp, Homo sapiens
tagccagtgccatgggactgat

SEQ ID NO: 9294497 - DNA, 22 bp, Homo sapiens
tagccagtgggacggtgctgca

SEQ ID NO: 9294498 - DNA, 22 bp, Homo sapiens
tagccagttgcccagagtagaa

SEQ ID NO: 9294499 - DNA, 22 bp, Homo sapiens
tagccaggcgaggtcagtgtcg

SEQ ID NO: 9294500 - DNA, 22 bp, Homo sapiens
tagaggcaaccagtgttgagaa

SEQ ID NO: 9294501 - DNA, 22 bp, Homo sapiens
tactttctaagacatacaactt

SEQ ID NO: 9294502 - DNA, 22 bp, Homo sapiens
tagaatcagaagatttgactgt

SEQ ID NO: 9294503 - DNA, 22 bp, Homo sapiens
tagaaggtaatgaaatgctgat

SEQ ID NO: 9294504 - DNA, 22 bp, Homo sapiens
tagaaggaggactggcagtgtt

SEQ ID NO: 9294505 - DNA, 20 bp, Homo sapiens
taggtgtctttgccagcttt

SEQ ID NO: 9294506 - DNA, 18 bp, Homo sapiens
taggttacagccagccag

SEQ ID NO: 9294507 - DNA, 22 bp, Homo sapiens
tagtatatctttagtacatagt

SEQ ID NO: 9294508 - DNA, 22 bp, Homo sapiens
tagtgggtagaggccagggacg

SEQ ID NO: 9294509 - DNA, 22 bp, Homo sapiens
tagtgggtggaggccagggatg

SEQ ID NO: 9294510 - DNA, 22 bp, Homo sapiens
tagtgggtgatttgatgaggaa

SEQ ID NO: 9294511 - DNA, 22 bp, Homo sapiens
tagtgggtcttataattttagg

SEQ ID NO: 9294512 - DNA, 22 bp, Homo sapiens
tagtgtatgataaaaaattctt

SEQ ID NO: 9294513 - DNA, 22 bp, Homo sapiens
tagtgggttaactagaagttaa

SEQ ID NO: 9294514 - DNA, 22 bp, Homo sapiens
tagtgggtttatacaatttaaa

SEQ ID NO: 9294515 - DNA, 22 bp, Homo sapiens
tagtcacctttggcacctgcaa

SEQ ID NO: 9294516 - DNA, 22 bp, Homo sapiens
taggaaagcagtagagccagga

SEQ ID NO: 9294517 - DNA, 22 bp, Homo sapiens
taggaaagaaatgagtagtgat

SEQ ID NO: 9294518 - DNA, 22 bp, Homo sapiens
taggaagcctgctgtgcacagc

SEQ ID NO: 9294519 - DNA, 22 bp, Homo sapiens
taggaagcgagcatctaactag

SEQ ID NO: 9294520 - DNA, 22 bp, Homo sapiens
taggaagcctaaattaagtggt

SEQ ID NO: 9294521 - DNA, 22 bp, Homo sapiens
taggaagcccttctgccatagt

SEQ ID NO: 9294522 - DNA, 22 bp, Homo sapiens
taggaagcattatcatcactga

SEQ ID NO: 9294523 - DNA, 22 bp, Homo sapiens
taggaagcatttaaagagatgg

SEQ ID NO: 9294524 - DNA, 22 bp, Homo sapiens
taggaagcacttaaagaatttg

SEQ ID NO: 9294525 - DNA, 22 bp, Homo sapiens
taggaagcactcatttaaagga

SEQ ID NO: 9294526 - DNA, 22 bp, Homo sapiens
taggaagctatgggagatgtga

SEQ ID NO: 9294527 - DNA, 22 bp, Homo sapiens
taggaagctctttgttttgtga

SEQ ID NO: 9294528 - DNA, 22 bp, Homo sapiens
taggaagctgagcagcattcct

SEQ ID NO: 9294529 - DNA, 22 bp, Homo sapiens
taggaagctgatggaactagag

SEQ ID NO: 9294530 - DNA, 22 bp, Homo sapiens
taggaagcttccagaacttaag

SEQ ID NO: 9294531 - DNA, 18 bp, Homo sapiens
taggaagcttaatgtttt

SEQ ID NO: 9294532 - DNA, 22 bp, Homo sapiens
taggacagagttccctgatggc

SEQ ID NO: 9294533 - DNA, 22 bp, Homo sapiens
taggaatggcagcagccggggg

SEQ ID NO: 9294534 - DNA, 22 bp, Homo sapiens
taggctaaagctccggctctgg

SEQ ID NO: 9294535 - DNA, 22 bp, Homo sapiens
taggctaggctgaaggttttgg

SEQ ID NO: 9294536 - DNA, 22 bp, Homo sapiens
taggccttcggtgtgtgcttgg

SEQ ID NO: 9294537 - DNA, 22 bp, Homo sapiens
tatttcaacgtatgaaaagctg

SEQ ID NO: 9294538 - DNA, 22 bp, Homo sapiens
tattgtatcttaccacatgtat

SEQ ID NO: 9294539 - DNA, 22 bp, Homo sapiens
tatttcagacactgatcttgca

SEQ ID NO: 9294540 - DNA, 22 bp, Homo sapiens
tatttcagagttgttttctgtc

SEQ ID NO: 9294541 - DNA, 21 bp, Homo sapiens
tatttcagaagagtctcagag

SEQ ID NO: 9294542 - DNA, 22 bp, Homo sapiens
tatttcagcaagaagaatgtgg

SEQ ID NO: 9294543 - DNA, 22 bp, Homo sapiens
tatttcagccctactacttggc

SEQ ID NO: 9294544 - DNA, 22 bp, Homo sapiens
tatttcagcacatgggataggt

SEQ ID NO: 9294545 - DNA, 19 bp, Homo sapiens
tatttcaggctcagagtct

SEQ ID NO: 9294546 - DNA, 22 bp, Homo sapiens
tatttcagctctttggattatc

SEQ ID NO: 9294547 - DNA, 22 bp, Homo sapiens
tatttcaggctatatttcttgt

SEQ ID NO: 9294548 - DNA, 22 bp, Homo sapiens
tattgtacatttcaaagtagct

SEQ ID NO: 9294549 - DNA, 22 bp, Homo sapiens
tattggtagatggagagagaca

SEQ ID NO: 9294550 - DNA, 22 bp, Homo sapiens
tattggtatctgagacagagtt

SEQ ID NO: 9294551 - DNA, 22 bp, Homo sapiens
tattggtatggtaagaattgaa

SEQ ID NO: 9294552 - DNA, 22 bp, Homo sapiens
tattgcagaagaaatgaatgaa

SEQ ID NO: 9294553 - DNA, 22 bp, Homo sapiens
tatttcagggggtacaagaaga

SEQ ID NO: 9294554 - DNA, 22 bp, Homo sapiens
tatttcagggagaataaatttg

SEQ ID NO: 9294555 - DNA, 22 bp, Homo sapiens
tattgagaaccctcaggaggca

SEQ ID NO: 9294556 - DNA, 22 bp, Homo sapiens
tattgaccagactgacacacat

SEQ ID NO: 9294557 - DNA, 17 bp, Homo sapiens
tattgacctttgtatgt

SEQ ID NO: 9294558 - DNA, 22 bp, Homo sapiens
tattcacattctcaggcctggt

SEQ ID NO: 9294559 - DNA, 22 bp, Homo sapiens
tattcacattctcaggcctggt

SEQ ID NO: 9294560 - DNA, 21 bp, Homo sapiens
tattcagtccattgatgttta

SEQ ID NO: 9294561 - DNA, 22 bp, Homo sapiens
tattcagtggaaaatgtgttga

SEQ ID NO: 9294562 - DNA, 22 bp, Homo sapiens
tattcacaaaatgaggtcctca

SEQ ID NO: 9294563 - DNA, 22 bp, Homo sapiens
tattcacaggcacgaaatattg

SEQ ID NO: 9294564 - DNA, 22 bp, Homo sapiens
tattcacaaaatgaggtcctca

SEQ ID NO: 9294565 - DNA, 22 bp, Homo sapiens
tattcacaaaatgaggtcctca

SEQ ID NO: 9294566 - DNA, 22 bp, Homo sapiens
tattcacagctgccgcactcag

SEQ ID NO: 9294567 - DNA, 22 bp, Homo sapiens
tattcacagctgccgcactcag

SEQ ID NO: 9294568 - DNA, 22 bp, Homo sapiens
tattcacaggctggagtgatgt

SEQ ID NO: 9294569 - DNA, 22 bp, Homo sapiens
tattcacaggctggagtgatgt

SEQ ID NO: 9294570 - DNA, 22 bp, Homo sapiens
tattcacaggttccggagatta

SEQ ID NO: 9294571 - DNA, 22 bp, Homo sapiens
tattcacagttgatttacagtt

SEQ ID NO: 9294572 - DNA, 22 bp, Homo sapiens
tattcacaggttctggggatca

SEQ ID NO: 9294573 - DNA, 22 bp, Homo sapiens
tattcacattaataagtcttca

SEQ ID NO: 9294574 - DNA, 22 bp, Homo sapiens
tattcacatgtacatatgctca

SEQ ID NO: 9294575 - DNA, 22 bp, Homo sapiens
tattcacatgaaaacaaatttt

SEQ ID NO: 9294576 - DNA, 22 bp, Homo sapiens
tattcacatgtacatatgctca

SEQ ID NO: 9294577 - DNA, 22 bp, Homo sapiens
tattcacatgtacatatgctca

SEQ ID NO: 9294578 - DNA, 22 bp, Homo sapiens
tatgttaagtgggataatcaaa

SEQ ID NO: 9294579 - DNA, 22 bp, Homo sapiens
tatgttcatctggtgcatcagt

SEQ ID NO: 9294580 - DNA, 22 bp, Homo sapiens
tatgtttagtatccattttcag

SEQ ID NO: 9294581 - DNA, 22 bp, Homo sapiens
tatgtttacgctggtagaatta

SEQ ID NO: 9294582 - DNA, 22 bp, Homo sapiens
tatacttatgctaaaaaatgtt

SEQ ID NO: 9294583 - DNA, 22 bp, Homo sapiens
tatactttcctgcaactttgat

SEQ ID NO: 9294584 - DNA, 22 bp, Homo sapiens
tatactctgagaaacgtgtcac

SEQ ID NO: 9294585 - DNA, 22 bp, Homo sapiens
tatactgtaggtgcagaaagaa

SEQ ID NO: 9294586 - DNA, 22 bp, Homo sapiens
tatacatgttttacataagtga

SEQ ID NO: 9294587 - DNA, 22 bp, Homo sapiens
tatattaaatgaccagttttaa

SEQ ID NO: 9294588 - DNA, 22 bp, Homo sapiens
tatagatagtcacttgttgcta

SEQ ID NO: 9294589 - DNA, 22 bp, Homo sapiens
tatatgatgccaaataacctgt

SEQ ID NO: 9294590 - DNA, 22 bp, Homo sapiens
tatgcatacaatgagatattcc

SEQ ID NO: 9294591 - DNA, 22 bp, Homo sapiens
tatattcaacaggctaatgtca

SEQ ID NO: 9294592 - DNA, 22 bp, Homo sapiens
tatcaatacatgttatcagtgt

SEQ ID NO: 9294593 - DNA, 22 bp, Homo sapiens
ttatgtacctgaattagtaaag

SEQ ID NO: 9294594 - DNA, 22 bp, Homo sapiens
ttatgtaagtggagtcatatag

SEQ ID NO: 9294595 - DNA, 22 bp, Homo sapiens
cgcaccactgaattccagcctg

SEQ ID NO: 9294596 - DNA, 22 bp, Homo sapiens
cgcaactcagcaacttaactgc

SEQ ID NO: 9294597 - DNA, 22 bp, Homo sapiens
cgaggctagaggcaggctcggc

SEQ ID NO: 9294598 - DNA, 21 bp, Homo sapiens
cgcagagcgaacttgcggcgc

SEQ ID NO: 9294599 - DNA, 21 bp, Homo sapiens
cgcagagcgaacttgcggcgc

SEQ ID NO: 9294600 - DNA, 22 bp, Homo sapiens
ttattcacctctattagactca

SEQ ID NO: 9294601 - DNA, 22 bp, Homo sapiens
ttatttcatgtaaaatttatgt

SEQ ID NO: 9294602 - DNA, 22 bp, Homo sapiens
ttatttcattgatttctaagac

SEQ ID NO: 9294603 - DNA, 22 bp, Homo sapiens
ttatttttaaaagttcacacag

SEQ ID NO: 9294604 - DNA, 22 bp, Homo sapiens
ttattcacatgggctcattcta

SEQ ID NO: 9294605 - DNA, 22 bp, Homo sapiens
ttattattttgtgtacagcaaa

SEQ ID NO: 9294606 - DNA, 22 bp, Homo sapiens
ttattattttgtgtacagcaaa

SEQ ID NO: 9294607 - DNA, 22 bp, Homo sapiens
cctttaatttacaatgttaatt

SEQ ID NO: 9294608 - DNA, 22 bp, Homo sapiens
cctttacagtatggttgtatca

SEQ ID NO: 9294609 - DNA, 21 bp, Homo sapiens
cctttacaattttgcattcct

SEQ ID NO: 9294610 - DNA, 22 bp, Homo sapiens
ccttggctgcttatatgtctgt

SEQ ID NO: 9294611 - DNA, 22 bp, Homo sapiens
ccttggctggaattactctggg

SEQ ID NO: 9294612 - DNA, 22 bp, Homo sapiens
ccttggctgaggagggagctga

SEQ ID NO: 9294613 - DNA, 22 bp, Homo sapiens
ccttggctgtgttgcctgccct

SEQ ID NO: 9294614 - DNA, 22 bp, Homo sapiens
ccttggctgtgctgccctttgc

SEQ ID NO: 9294615 - DNA, 21 bp, Homo sapiens
ccttggctggcatctagcacc

SEQ ID NO: 9294616 - DNA, 22 bp, Homo sapiens
ccttggcttccttccctctaga

SEQ ID NO: 9294617 - DNA, 22 bp, Homo sapiens
ccttggcttaccttctgtgtgg

SEQ ID NO: 9294618 - DNA, 20 bp, Homo sapiens
ccttggcttaataataggga

SEQ ID NO: 9294619 - DNA, 22 bp, Homo sapiens
ccttggcttgcacacggccacc

SEQ ID NO: 9294620 - DNA, 22 bp, Homo sapiens
ccttggcttgtgggctgcagcc

SEQ ID NO: 9294621 - DNA, 19 bp, Homo sapiens
ccttggctttaactatgaa

SEQ ID NO: 9294622 - DNA, 21 bp, Homo sapiens
ccttctcttgcttcagcttca

SEQ ID NO: 9294623 - DNA, 20 bp, Homo sapiens
ccttctctggaattgcctcc

SEQ ID NO: 9294624 - DNA, 22 bp, Homo sapiens
ccttcttctgtgtggcccaaga

SEQ ID NO: 9294625 - DNA, 22 bp, Homo sapiens
tggttcctcaagcgctggcggc

SEQ ID NO: 9294626 - DNA, 22 bp, Homo sapiens
cctgcgtcgtgtgggcagtgac

SEQ ID NO: 9294627 - DNA, 22 bp, Homo sapiens
tgttgcccaggttctctcctgc

SEQ ID NO: 9294628 - DNA, 22 bp, Homo sapiens
tgttggaaggcaagcagcaatt

SEQ ID NO: 9294629 - DNA, 22 bp, Homo sapiens
tgttggaataagtgcttgaagg

SEQ ID NO: 9294630 - DNA, 22 bp, Homo sapiens
tgttggaattaggatacagagg

SEQ ID NO: 9294631 - DNA, 22 bp, Homo sapiens
tgttggaattaggatacagagg

SEQ ID NO: 9294632 - DNA, 22 bp, Homo sapiens
tgtttcttctcacacaaactca

SEQ ID NO: 9294633 - DNA, 22 bp, Homo sapiens
tgtttcttatccaagtggtctg

SEQ ID NO: 9294634 - DNA, 22 bp, Homo sapiens
tgtttataccttggtataacca

SEQ ID NO: 9294635 - DNA, 22 bp, Homo sapiens
ttaaaatgcagattatgactca

SEQ ID NO: 9294636 - DNA, 22 bp, Homo sapiens
tgttttctattacctgagattg

SEQ ID NO: 9294637 - DNA, 22 bp, Homo sapiens
ttaatagatttgattttaaagg

SEQ ID NO: 9294638 - DNA, 21 bp, Homo sapiens
cctgtggattttaaaattgga

SEQ ID NO: 9294639 - DNA, 22 bp, Homo sapiens
cctgtggagttcccatctgaat

SEQ ID NO: 9294640 - DNA, 22 bp, Homo sapiens
cctgtggaggctgctcagctgg

SEQ ID NO: 9294641 - DNA, 20 bp, Homo sapiens
cctgtggagctgcctcctcc

SEQ ID NO: 9294642 - DNA, 22 bp, Homo sapiens
ttaatgaatgtgtgctaacgtt

SEQ ID NO: 9294643 - DNA, 22 bp, Homo sapiens
ttaatgaaaggcagtttggaac

SEQ ID NO: 9294644 - DNA, 22 bp, Homo sapiens
ttaatgaaacattgactatgat

SEQ ID NO: 9294645 - DNA, 22 bp, Homo sapiens
ttctacagttggtggaggtctt

SEQ ID NO: 9294646 - DNA, 22 bp, Homo sapiens
ttctcagtttcactgataacag

SEQ ID NO: 9294647 - DNA, 22 bp, Homo sapiens
ttctatttttgtggaactgtag

SEQ ID NO: 9294648 - DNA, 22 bp, Homo sapiens
ttctccttcctggttttcaggc

SEQ ID NO: 9294649 - DNA, 22 bp, Homo sapiens
ctagtttaaagcagctgaaagg

SEQ ID NO: 9294650 - DNA, 22 bp, Homo sapiens
ctagtttagtcagagccttgct

SEQ ID NO: 9294651 - DNA, 22 bp, Homo sapiens
ctagtttagagtatgcgtgtgt

SEQ ID NO: 9294652 - DNA, 22 bp, Homo sapiens
ctagtttaaagcagctgaaagg

SEQ ID NO: 9294653 - DNA, 22 bp, Homo sapiens
ttccactgattttggttgacct

SEQ ID NO: 9294654 - DNA, 22 bp, Homo sapiens
cgtcctcagaggccatccgaaa

SEQ ID NO: 9294655 - DNA, 22 bp, Homo sapiens
cgtcccctcgttcccactttgg

SEQ ID NO: 9294656 - DNA, 20 bp, Homo sapiens
cgtccccttgagcaggtccc

SEQ ID NO: 9294657 - DNA, 22 bp, Homo sapiens
cggctggtgtcgggcacagcaa

SEQ ID NO: 9294658 - DNA, 22 bp, Homo sapiens
cggctggtgtcgggcacagcaa

SEQ ID NO: 9294659 - DNA, 22 bp, Homo sapiens
cggctgggtagaggtgccgggt

SEQ ID NO: 9294660 - DNA, 22 bp, Homo sapiens
cggctgggttcggctgcaggcc

SEQ ID NO: 9294661 - DNA, 22 bp, Homo sapiens
ttccaaattaaaatgtacaatg

SEQ ID NO: 9294662 - DNA, 22 bp, Homo sapiens
cgggaaggtggaggttgcagtg

SEQ ID NO: 9294663 - DNA, 22 bp, Homo sapiens
ttccacattccttacattcata

SEQ ID NO: 9294664 - DNA, 22 bp, Homo sapiens
ttcagtttcttccctgtgaaat

SEQ ID NO: 9294665 - DNA, 22 bp, Homo sapiens
ttcagtttgaattctgtagaac

SEQ ID NO: 9294666 - DNA, 22 bp, Homo sapiens
ttcagtttcgttatctatgaga

SEQ ID NO: 9294667 - DNA, 22 bp, Homo sapiens
ttcagtttctaaagatgttcct

SEQ ID NO: 9294668 - DNA, 22 bp, Homo sapiens
ttcagtttcaaatcctgtgaag

SEQ ID NO: 9294669 - DNA, 21 bp, Homo sapiens
cgcagctgagaaatatacaga

SEQ ID NO: 9294670 - DNA, 22 bp, Homo sapiens
cgcagctgcaaaggaaacattt

SEQ ID NO: 9294671 - DNA, 22 bp, Homo sapiens
cgcagctgcacggggctgagcc

SEQ ID NO: 9294672 - DNA, 22 bp, Homo sapiens
ctcaggctaagaaggccaagtg

SEQ ID NO: 9294673 - DNA, 22 bp, Homo sapiens
ttgctggagtagaaaacttaac

SEQ ID NO: 9294674 - DNA, 22 bp, Homo sapiens
ttgctggacatgaatcagatat

SEQ ID NO: 9294675 - DNA, 22 bp, Homo sapiens
ttgctgagtctgaattcatact

SEQ ID NO: 9294676 - DNA, 22 bp, Homo sapiens
ttgctgagtctctaggtatgat

SEQ ID NO: 9294677 - DNA, 22 bp, Homo sapiens
ttgctgaggttgttttgaggag

SEQ ID NO: 9294678 - DNA, 22 bp, Homo sapiens
ttgctgagtgaccaataaatat

SEQ ID NO: 9294679 - DNA, 22 bp, Homo sapiens
ttgcactccagcccgagcaaca

SEQ ID NO: 9294680 - DNA, 22 bp, Homo sapiens
ttgatcaaatcagctactgagg

SEQ ID NO: 9294681 - DNA, 22 bp, Homo sapiens
ttgcaaaagccgaggcactcca

SEQ ID NO: 9294682 - DNA, 22 bp, Homo sapiens
ctcagccccaattctccccatt

SEQ ID NO: 9294683 - DNA, 22 bp, Homo sapiens
ctcagcatcatggtatctgggg

SEQ ID NO: 9294684 - DNA, 22 bp, Homo sapiens
ttcttcaggatacgtcatccag

SEQ ID NO: 9294685 - DNA, 22 bp, Homo sapiens
ttcttcagtctaggcctttctt

SEQ ID NO: 9294686 - DNA, 22 bp, Homo sapiens
ttcttcagggaagcttgttaat

SEQ ID NO: 9294687 - DNA, 22 bp, Homo sapiens
ttctgaaagccaattcattgaa

SEQ ID NO: 9294688 - DNA, 22 bp, Homo sapiens
ttcttcattcccttacttccga

SEQ ID NO: 9294689 - DNA, 22 bp, Homo sapiens
ttcttcccagccagcacagccc

SEQ ID NO: 9294690 - DNA, 22 bp, Homo sapiens
ttcttcccttcattccaccacc

SEQ ID NO: 9294691 - DNA, 22 bp, Homo sapiens
ttcttcatgctgttgctgcttg

SEQ ID NO: 9294692 - DNA, 22 bp, Homo sapiens
ttcttcatgctgttgctgcttg

SEQ ID NO: 9294693 - DNA, 22 bp, Homo sapiens
ttcttcagtgcccctctagtag

SEQ ID NO: 9294694 - DNA, 21 bp, Homo sapiens
ttcttcagtttaatataaaat

SEQ ID NO: 9294695 - DNA, 22 bp, Homo sapiens
ttcttcagtttggtaaatgtaa

SEQ ID NO: 9294696 - DNA, 22 bp, Homo sapiens
ttgaataatgtgtatgttgtta

SEQ ID NO: 9294697 - DNA, 22 bp, Homo sapiens
ctcactgcaagctccacctctt

SEQ ID NO: 9294698 - DNA, 22 bp, Homo sapiens
ctcactgcaagctctgcctccc

SEQ ID NO: 9294699 - DNA, 22 bp, Homo sapiens
ctcactgcaagctctgcctcca

SEQ ID NO: 9294700 - DNA, 22 bp, Homo sapiens
ctctagggtgcaggccccagga

SEQ ID NO: 9294701 - DNA, 22 bp, Homo sapiens
ctctacagctgctgcccctggt

SEQ ID NO: 9294702 - DNA, 22 bp, Homo sapiens
ctctagacaacttgctgtgggt

SEQ ID NO: 9294703 - DNA, 22 bp, Homo sapiens
ctctagcttttgataccagtgt

SEQ ID NO: 9294704 - DNA, 22 bp, Homo sapiens
ctctaggccatccagggccatt

SEQ ID NO: 9294705 - DNA, 22 bp, Homo sapiens
ctctagaggcttgaatgggcga

SEQ ID NO: 9294706 - DNA, 22 bp, Homo sapiens
ctctagaggcttgaatgggcga

SEQ ID NO: 9294707 - DNA, 22 bp, Homo sapiens
ctctagagtacgggctggcatg

SEQ ID NO: 9294708 - DNA, 22 bp, Homo sapiens
tttctctcttaaggagtttaaa

SEQ ID NO: 9294709 - DNA, 23 bp, Homo sapiens
tttctctgagaagcagttctcta

SEQ ID NO: 9294710 - DNA, 22 bp, Homo sapiens
tttctctctacagtactttcat

SEQ ID NO: 9294711 - DNA, 22 bp, Homo sapiens
tttctctccccaagtggaattg

SEQ ID NO: 9294712 - DNA, 22 bp, Homo sapiens
tttctctgaggctggcctccct

SEQ ID NO: 9294713 - DNA, 22 bp, Homo sapiens
ctctctggacctcaactatttt

SEQ ID NO: 9294714 - DNA, 22 bp, Homo sapiens
tttctgcaagtgtagataccca

SEQ ID NO: 9294715 - DNA, 22 bp, Homo sapiens
ctctgagggctcgagggacgcg

SEQ ID NO: 9294716 - DNA, 22 bp, Homo sapiens
ctctctggcacttcattgctgt

SEQ ID NO: 9294717 - DNA, 22 bp, Homo sapiens
tttcttgagcccaggaggtgga

SEQ ID NO: 9294718 - DNA, 22 bp, Homo sapiens
ctctgctgctttgccagtggaa

SEQ ID NO: 9294719 - DNA, 22 bp, Homo sapiens
ctctgcttcatccaccactggc

SEQ ID NO: 9294720 - DNA, 22 bp, Homo sapiens
ctctgcttctgagatggaagct

SEQ ID NO: 9294721 - DNA, 19 bp, Homo sapiens
ctctgcttggtccatatgc

SEQ ID NO: 9294722 - DNA, 22 bp, Homo sapiens
ctctgcttgtatcacatttgct

SEQ ID NO: 9294723 - DNA, 22 bp, Homo sapiens
ctctgcttggaacaggggtttg

SEQ ID NO: 9294724 - DNA, 22 bp, Homo sapiens
ctctgcttggaactggacagaa

SEQ ID NO: 9294725 - DNA, 22 bp, Homo sapiens
ctctgctgtgccgccagggcct

SEQ ID NO: 9294726 - DNA, 21 bp, Homo sapiens
ctctgctgtctaccagctgtt

SEQ ID NO: 9294727 - DNA, 22 bp, Homo sapiens
tttcttcttgatttaaacaggg

SEQ ID NO: 9294728 - DNA, 22 bp, Homo sapiens
ctctggaggttgagcccagcaa

SEQ ID NO: 9294729 - DNA, 22 bp, Homo sapiens
ctctggaggcagcaccagccag

SEQ ID NO: 9294730 - DNA, 22 bp, Homo sapiens
ctctggaggccgttggccctta

SEQ ID NO: 9294731 - DNA, 22 bp, Homo sapiens
ctctggagggaggctgagctgg

SEQ ID NO: 9294732 - DNA, 22 bp, Homo sapiens
ctctgcttgtgtcaggcatgct

SEQ ID NO: 9294733 - DNA, 22 bp, Homo sapiens
ctcctgtcagaagcatcctgag

SEQ ID NO: 9294734 - DNA, 22 bp, Homo sapiens
ctcctgtcaataggctcctggc

SEQ ID NO: 9294735 - DNA, 20 bp, Homo sapiens
ctcctgtgcctctctgggcc

SEQ ID NO: 9294736 - DNA, 22 bp, Homo sapiens
tttatatgtattgactttgatg

SEQ ID NO: 9294737 - DNA, 18 bp, Homo sapiens
tttatatggatagagacc

SEQ ID NO: 9294738 - DNA, 22 bp, Homo sapiens
ctccctggcagccgcactcctg

SEQ ID NO: 9294739 - DNA, 22 bp, Homo sapiens
ctccctggctttgtcctgaggc

SEQ ID NO: 9294740 - DNA, 21 bp, Homo sapiens
ctcctcaggaccagccacagg

SEQ ID NO: 9294741 - DNA, 22 bp, Homo sapiens
ctcaggctgtgatgtgatggca

SEQ ID NO: 9294742 - DNA, 22 bp, Homo sapiens
ttgtttacactgcagaattggg

SEQ ID NO: 9294743 - DNA, 22 bp, Homo sapiens
ttgtttaatatcgtgaagtact

SEQ ID NO: 9294744 - DNA, 22 bp, Homo sapiens
ctccccaggttcaggaggtggg

SEQ ID NO: 9294745 - DNA, 22 bp, Homo sapiens
ttgtttaatgcctcatacatct

SEQ ID NO: 9294746 - DNA, 22 bp, Homo sapiens
ctgagaggtaagcagcgcagtg

SEQ ID NO: 9294747 - DNA, 22 bp, Homo sapiens
ctgagagatcaagccacaggat

SEQ ID NO: 9294748 - DNA, 20 bp, Homo sapiens
ctgagatatgaggcctttgg

SEQ ID NO: 9294749 - DNA, 22 bp, Homo sapiens
ctctggagtcctgtatcactcc

SEQ ID NO: 9294750 - DNA, 22 bp, Homo sapiens
ctctggagtgcagcctggtggc

SEQ ID NO: 9294751 - DNA, 22 bp, Homo sapiens
ctgaaggatttagttctttgct

SEQ ID NO: 9294752 - DNA, 18 bp, Homo sapiens
ctgaaggatccaggtgta

SEQ ID NO: 9294753 - DNA, 22 bp, Homo sapiens
ctgaaggacttggtgatagttg

SEQ ID NO: 9294754 - DNA, 22 bp, Homo sapiens
ctgaaggagcatagtcagtttt

SEQ ID NO: 9294755 - DNA, 22 bp, Homo sapiens
ctgaaggaagcaggtggcctgt

SEQ ID NO: 9294756 - DNA, 22 bp, Homo sapiens
ctgaaaaatatgttttggagaa

SEQ ID NO: 9294757 - DNA, 22 bp, Homo sapiens
ctgcagtgcctgccactgagcc

SEQ ID NO: 9294758 - DNA, 22 bp, Homo sapiens
ctgcagtgcaagcccagatgga

SEQ ID NO: 9294759 - DNA, 22 bp, Homo sapiens
ctgccctgctggagatcacagt

SEQ ID NO: 9294760 - DNA, 22 bp, Homo sapiens
ctgccctgctaatgagttccaa

SEQ ID NO: 9294761 - DNA, 22 bp, Homo sapiens
ctgccctgggatggtctgtgcg

SEQ ID NO: 9294762 - DNA, 22 bp, Homo sapiens
ctgccctggccactgtgcccag

SEQ ID NO: 9294763 - DNA, 22 bp, Homo sapiens
ctgccctgcttgatgacagcga

SEQ ID NO: 9294764 - DNA, 22 bp, Homo sapiens
ctgcctctgttgggcatggtct

SEQ ID NO: 9294765 - DNA, 22 bp, Homo sapiens
ctgcctctataggagtccacca

SEQ ID NO: 9294766 - DNA, 22 bp, Homo sapiens
ctgcctctattcactgaggcag

SEQ ID NO: 9294767 - DNA, 20 bp, Homo sapiens
ctgctccacccggctctcag

SEQ ID NO: 9294768 - DNA, 22 bp, Homo sapiens
ctgcctgccttggcctccagga

SEQ ID NO: 9294769 - DNA, 22 bp, Homo sapiens
ctgcctgccacgttcagctgta

SEQ ID NO: 9294770 - DNA, 22 bp, Homo sapiens
ctgcctgcaggacacctcgcta

SEQ ID NO: 9294771 - DNA, 22 bp, Homo sapiens
ctgcctctgttgggcatggtct

SEQ ID NO: 9294772 - DNA, 22 bp, Homo sapiens
ctgctggaatctttaagctgga

SEQ ID NO: 9294773 - DNA, 22 bp, Homo sapiens
ctgctggaagtttgctgtggat

SEQ ID NO: 9294774 - DNA, 22 bp, Homo sapiens
ctgctctctgttcccctggatc

SEQ ID NO: 9294775 - DNA, 22 bp, Homo sapiens
ctgctctgaagccaggattctg

SEQ ID NO: 9294776 - DNA, 22 bp, Homo sapiens
ctgctgagcatttgcagggaca

SEQ ID NO: 9294777 - DNA, 22 bp, Homo sapiens
ctgctgagcatttgcagggaca

SEQ ID NO: 9294778 - DNA, 22 bp, Homo sapiens
ctgctgccggcgagcctccctt

SEQ ID NO: 9294779 - DNA, 22 bp, Homo sapiens
ctgctgagccctggcacaggtg

SEQ ID NO: 9294780 - DNA, 22 bp, Homo sapiens
gaaggccattgcgtcctgggat

SEQ ID NO: 9294781 - DNA, 22 bp, Homo sapiens
gaaggccattagagcctgtgcc

SEQ ID NO: 9294782 - DNA, 22 bp, Homo sapiens
gaaggccagttttgagataggt

SEQ ID NO: 9294783 - DNA, 22 bp, Homo sapiens
gaaggccatttttaggtagaat

SEQ ID NO: 9294784 - DNA, 22 bp, Homo sapiens
gaaggccacggaatggagctgg

SEQ ID NO: 9294785 - DNA, 16 bp, Homo sapiens
gaaggagattcagaaa

SEQ ID NO: 9294786 - DNA, 22 bp, Homo sapiens
gaagccacagagattgtggggg

SEQ ID NO: 9294787 - DNA, 18 bp, Homo sapiens
gaaaggagagacagtagg

SEQ ID NO: 9294788 - DNA, 22 bp, Homo sapiens
gaagccaacattccaagtagaa

SEQ ID NO: 9294789 - DNA, 18 bp, Homo sapiens
gaagcatatttgttcttc

SEQ ID NO: 9294790 - DNA, 22 bp, Homo sapiens
gaagccaagtgcaaatgcctta

SEQ ID NO: 9294791 - DNA, 20 bp, Homo sapiens
gaaaggagtgtccctgtgag

SEQ ID NO: 9294792 - DNA, 22 bp, Homo sapiens
gacagacacaattgatccatga

SEQ ID NO: 9294793 - DNA, 22 bp, Homo sapiens
gacagacaaatgtttttaactt

SEQ ID NO: 9294794 - DNA, 22 bp, Homo sapiens
gacagacactattggtatgcct

SEQ ID NO: 9294795 - DNA, 22 bp, Homo sapiens
gacagacacctggggggttgct

SEQ ID NO: 9294796 - DNA, 22 bp, Homo sapiens
gacagacacagggccatgattg

SEQ ID NO: 9294797 - DNA, 22 bp, Homo sapiens
gacagaaggcatctagggcacg

SEQ ID NO: 9294798 - DNA, 22 bp, Homo sapiens
gacagaaggcatctagggcacg

SEQ ID NO: 9294799 - DNA, 22 bp, Homo sapiens
gacagacagagaatgggcttga

SEQ ID NO: 9294800 - DNA, 22 bp, Homo sapiens
gacagacactgtgtcctcactt

SEQ ID NO: 9294801 - DNA, 22 bp, Homo sapiens
gacagacaggaggcattcaggg

SEQ ID NO: 9294802 - DNA, 22 bp, Homo sapiens
gacagacaggagctcacaggca

SEQ ID NO: 9294803 - DNA, 22 bp, Homo sapiens
gacagacatgggacttcatact

SEQ ID NO: 9294804 - DNA, 22 bp, Homo sapiens
gacagacaggtgtggtaggcac

SEQ ID NO: 9294805 - DNA, 22 bp, Homo sapiens
gacagacaggaggccacctgct

SEQ ID NO: 9294806 - DNA, 22 bp, Homo sapiens
gacagacaggaggccacctgct

SEQ ID NO: 9294807 - DNA, 22 bp, Homo sapiens
gacagacaggggttctcctgga

SEQ ID NO: 9294808 - DNA, 22 bp, Homo sapiens
gaatgacgccctgtggtcactt

SEQ ID NO: 9294809 - DNA, 22 bp, Homo sapiens
gacactgtgctagctgggctta

SEQ ID NO: 9294810 - DNA, 22 bp, Homo sapiens
gacactgttatggtgaggtaag

SEQ ID NO: 9294811 - DNA, 22 bp, Homo sapiens
gacacttcacctttcccagcct

SEQ ID NO: 9294812 - DNA, 22 bp, Homo sapiens
gaagggctcatcaggtggccgc

SEQ ID NO: 9294813 - DNA, 22 bp, Homo sapiens
gactgcctcagtttccctgcag

SEQ ID NO: 9294814 - DNA, 22 bp, Homo sapiens
gagaaagatgaagagtggcgtt

SEQ ID NO: 9294815 - DNA, 22 bp, Homo sapiens
gagaaagacgtaggctgggagg

SEQ ID NO: 9294816 - DNA, 22 bp, Homo sapiens
gagaaagacgtaggctgggagg

SEQ ID NO: 9294817 - DNA, 22 bp, Homo sapiens
gagaaacttggagttattctgg

SEQ ID NO: 9294818 - DNA, 22 bp, Homo sapiens
gagaaacctgtaaggaaggaag

SEQ ID NO: 9294819 - DNA, 22 bp, Homo sapiens
gagaaagattgtccttcagggg

SEQ ID NO: 9294820 - DNA, 22 bp, Homo sapiens
gagaaagatgtaggctgggagg

SEQ ID NO: 9294821 - DNA, 22 bp, Homo sapiens
gagaaagatgtaggctgggagg

SEQ ID NO: 9294822 - DNA, 22 bp, Homo sapiens
gagaaagcttcagaaatggcct

SEQ ID NO: 9294823 - DNA, 22 bp, Homo sapiens
gagaaagctaataggaatccta

SEQ ID NO: 9294824 - DNA, 18 bp, Homo sapiens
gagaaagcagggaatgtt

SEQ ID NO: 9294825 - DNA, 22 bp, Homo sapiens
gagagaaaagggggaattgatt

SEQ ID NO: 9294826 - DNA, 22 bp, Homo sapiens
gagactttaaaaaacattaaga

SEQ ID NO: 9294827 - DNA, 20 bp, Homo sapiens
gagactggatctggagagac

SEQ ID NO: 9294828 - DNA, 20 bp, Homo sapiens
gagactggatctggagagac

SEQ ID NO: 9294829 - DNA, 22 bp, Homo sapiens
gagacctcttggtatcgctagg

SEQ ID NO: 9294830 - DNA, 22 bp, Homo sapiens
gactctttccctgtgacagagt

SEQ ID NO: 9294831 - DNA, 21 bp, Homo sapiens
gactctctagtgctgtccagt

SEQ ID NO: 9294832 - DNA, 22 bp, Homo sapiens
gactctagattcatggtggagt

SEQ ID NO: 9294833 - DNA, 22 bp, Homo sapiens
gactctggtgtcagaagtgccc

SEQ ID NO: 9294834 - DNA, 22 bp, Homo sapiens
gactctgggctgagccagggcc

SEQ ID NO: 9294835 - DNA, 22 bp, Homo sapiens
gaccagctctctgaagaaagag

SEQ ID NO: 9294836 - DNA, 21 bp, Homo sapiens
gacagcaactgtagtcctctt

SEQ ID NO: 9294837 - DNA, 22 bp, Homo sapiens
gacagacatttcctgatccaat

SEQ ID NO: 9294838 - DNA, 22 bp, Homo sapiens
gacagagattgaatcaggaaat

SEQ ID NO: 9294839 - DNA, 22 bp, Homo sapiens
gacagagctgctctagattctg

SEQ ID NO: 9294840 - DNA, 20 bp, Homo sapiens
gagcagtgagccagggaaag

SEQ ID NO: 9294841 - DNA, 22 bp, Homo sapiens
gagcagtgagtgaatgttgcct

SEQ ID NO: 9294842 - DNA, 22 bp, Homo sapiens
gagcagtgggaaggaacagggt

SEQ ID NO: 9294843 - DNA, 20 bp, Homo sapiens
gagcagtggagtttccaggg

SEQ ID NO: 9294844 - DNA, 22 bp, Homo sapiens
gagcatctatgtgctgggtact

SEQ ID NO: 9294845 - DNA, 22 bp, Homo sapiens
gagcatctctatagtgactgtg

SEQ ID NO: 9294846 - DNA, 22 bp, Homo sapiens
gagcatctgatgagattggatt

SEQ ID NO: 9294847 - DNA, 22 bp, Homo sapiens
gagcatctggctagaggagtga

SEQ ID NO: 9294848 - DNA, 22 bp, Homo sapiens
gagcatggatcatgtgctgggt

SEQ ID NO: 9294849 - DNA, 22 bp, Homo sapiens
gagctgctgtgaggggagcttc

SEQ ID NO: 9294850 - DNA, 22 bp, Homo sapiens
gaggagagagggactgtctgca

SEQ ID NO: 9294851 - DNA, 22 bp, Homo sapiens
gagccctgtagcaagtcatgtc

SEQ ID NO: 9294852 - DNA, 22 bp, Homo sapiens
gaggctgcccaactggagtgga

SEQ ID NO: 9294853 - DNA, 22 bp, Homo sapiens
gagggctgctggaaaaatgcag

SEQ ID NO: 9294854 - DNA, 22 bp, Homo sapiens
gaggcagggtgttgattacaga

SEQ ID NO: 9294855 - DNA, 22 bp, Homo sapiens
gaggctcagagaagtcatggta

SEQ ID NO: 9294856 - DNA, 22 bp, Homo sapiens
gaggagagcctgcactttgacc

SEQ ID NO: 9294857 - DNA, 22 bp, Homo sapiens
gaggagcacatgaggctgaggg

SEQ ID NO: 9294858 - DNA, 22 bp, Homo sapiens
gaggcagcttggggctgtgggt

SEQ ID NO: 9294859 - DNA, 22 bp, Homo sapiens
ctgggcacctttgcagcaggct

SEQ ID NO: 9294860 - DNA, 22 bp, Homo sapiens
ctgggcagagctaacacctgag

SEQ ID NO: 9294861 - DNA, 22 bp, Homo sapiens
ctgggcagaattttaggatggc

SEQ ID NO: 9294862 - DNA, 22 bp, Homo sapiens
ctgggcagctgtatcagggagt

SEQ ID NO: 9294863 - DNA, 22 bp, Homo sapiens
ctgggcagctaccaccactgct

SEQ ID NO: 9294864 - DNA, 20 bp, Homo sapiens
ctgcttccaggctcaccccc

SEQ ID NO: 9294865 - DNA, 22 bp, Homo sapiens
ctgcttccatggtctggagact

SEQ ID NO: 9294866 - DNA, 22 bp, Homo sapiens
ctgcttcctccctgtaaaggca

SEQ ID NO: 9294867 - DNA, 22 bp, Homo sapiens
ctgggacacccaaggaaagagc

SEQ ID NO: 9294868 - DNA, 22 bp, Homo sapiens
ctgggacacccaaggaaagagc

SEQ ID NO: 9294869 - DNA, 22 bp, Homo sapiens
ctgggacacgttctattccaaa

SEQ ID NO: 9294870 - DNA, 22 bp, Homo sapiens
ctgggacagagcagcagtgggg

SEQ ID NO: 9294871 - DNA, 22 bp, Homo sapiens
ctgctgtgttgccagtgtcacc

SEQ ID NO: 9294872 - DNA, 22 bp, Homo sapiens
ctgctgtgttcctcctgcatct

SEQ ID NO: 9294873 - DNA, 22 bp, Homo sapiens
ctgggacatattgctagtgttg

SEQ ID NO: 9294874 - DNA, 22 bp, Homo sapiens
ctgggacatattgctagtgttg

SEQ ID NO: 9294875 - DNA, 22 bp, Homo sapiens
ctgggacagttcaggtagggca

SEQ ID NO: 9294876 - DNA, 22 bp, Homo sapiens
ctgggacatagatcagcctttt

SEQ ID NO: 9294877 - DNA, 22 bp, Homo sapiens
ctgggacagctgagacaggaga

SEQ ID NO: 9294878 - DNA, 22 bp, Homo sapiens
ctgggacagctgagacaggaga

SEQ ID NO: 9294879 - DNA, 22 bp, Homo sapiens
ctggggaacgcagcgagcagcg

SEQ ID NO: 9294880 - DNA, 22 bp, Homo sapiens
ctggggaatagagctggagacc

SEQ ID NO: 9294881 - DNA, 20 bp, Homo sapiens
ctggggagcctcgcggtggc

SEQ ID NO: 9294882 - DNA, 22 bp, Homo sapiens
ctgtacaaagtagctgctggga

SEQ ID NO: 9294883 - DNA, 22 bp, Homo sapiens
ctgtcacttaaattcaggctga

SEQ ID NO: 9294884 - DNA, 22 bp, Homo sapiens
ctgtcacctgttcactgcagca

SEQ ID NO: 9294885 - DNA, 22 bp, Homo sapiens
ctgtcactgatgggctcaccag

SEQ ID NO: 9294886 - DNA, 22 bp, Homo sapiens
ctgtattttcatgcctacgtac

SEQ ID NO: 9294887 - DNA, 22 bp, Homo sapiens
ctgtctgtactgagagttctgt

SEQ ID NO: 9294888 - DNA, 17 bp, Homo sapiens
ctgtctgcgcatgaggt

SEQ ID NO: 9294889 - DNA, 22 bp, Homo sapiens
ctgtgctggagatgggccagag

SEQ ID NO: 9294890 - DNA, 22 bp, Homo sapiens
ctgtgctgcagacgcagtagct

SEQ ID NO: 9294891 - DNA, 22 bp, Homo sapiens
ctgtgcttcagagtcagtgctg

SEQ ID NO: 9294892 - DNA, 22 bp, Homo sapiens
ctgtgctctggcatcgctgcaa

SEQ ID NO: 9294893 - DNA, 22 bp, Homo sapiens
cttctaggcttctcagggggca

SEQ ID NO: 9294894 - DNA, 22 bp, Homo sapiens
cttaggaacacttactggtact

SEQ ID NO: 9294895 - DNA, 22 bp, Homo sapiens
cttaggaaagttttctgctgca

SEQ ID NO: 9294896 - DNA, 22 bp, Homo sapiens
cttaggaatatccacagcaggt

SEQ ID NO: 9294897 - DNA, 22 bp, Homo sapiens
cttagccagctaacttaagcac

SEQ ID NO: 9294898 - DNA, 22 bp, Homo sapiens
cttatacaccctcttcccaggc

SEQ ID NO: 9294899 - DNA, 22 bp, Homo sapiens
cttacacagtctggcacttctt

SEQ ID NO: 9294900 - DNA, 22 bp, Homo sapiens
cttaccatgtgagaaacaaaca

SEQ ID NO: 9294901 - DNA, 22 bp, Homo sapiens
cttagcacatatcagaaaatag

SEQ ID NO: 9294902 - DNA, 22 bp, Homo sapiens
cttacaaaggagaggagatagg

SEQ ID NO: 9294903 - DNA, 22 bp, Homo sapiens
cttacaaatacacttaggagag

SEQ ID NO: 9294904 - DNA, 22 bp, Homo sapiens
cttacaaatacacttaggagag

SEQ ID NO: 9294905 - DNA, 22 bp, Homo sapiens
ctgtgctttcgagatgtgatct

SEQ ID NO: 9294906 - DNA, 22 bp, Homo sapiens
ctgtggaaagagcctttggagg

SEQ ID NO: 9294907 - DNA, 22 bp, Homo sapiens
ctgtgctttcaaaagaagggtt

SEQ ID NO: 9294908 - DNA, 22 bp, Homo sapiens
ctgtgcttgacagtgggaagca

SEQ ID NO: 9294909 - DNA, 21 bp, Homo sapiens
ctgtgcttcttcctaagccag

SEQ ID NO: 9294910 - DNA, 22 bp, Homo sapiens
ctgtgcttccaggatggcagct

SEQ ID NO: 9294911 - DNA, 22 bp, Homo sapiens
ctgtttttgtgctgtgtctccc

SEQ ID NO: 9294912 - DNA, 22 bp, Homo sapiens
ctttaattctcaggtgcacata

SEQ ID NO: 9294913 - DNA, 22 bp, Homo sapiens
ctttaattgtagctcccataat

SEQ ID NO: 9294914 - DNA, 22 bp, Homo sapiens
ctttaattgtagctcccataat

SEQ ID NO: 9294915 - DNA, 22 bp, Homo sapiens
ctttaattaggaagtataatga

SEQ ID NO: 9294916 - DNA, 22 bp, Homo sapiens
ctttaattcagatttgaaggga

SEQ ID NO: 9294917 - DNA, 22 bp, Homo sapiens
gaaacagcacgtttggagagat

SEQ ID NO: 9294918 - DNA, 22 bp, Homo sapiens
gaaaatttagaactgaacttct

SEQ ID NO: 9294919 - DNA, 22 bp, Homo sapiens
gaaaatacttcagtgttctggc

SEQ ID NO: 9294920 - DNA, 22 bp, Homo sapiens
cttttctctgcgggtctttcat

SEQ ID NO: 9294921 - DNA, 22 bp, Homo sapiens
cttttctcttacattccactgg

SEQ ID NO: 9294922 - DNA, 22 bp, Homo sapiens
cttttctctgcaccatgtgtga

SEQ ID NO: 9294923 - DNA, 22 bp, Homo sapiens
cttttcttctcacggctgtcag

SEQ ID NO: 9294924 - DNA, 22 bp, Homo sapiens
tgagtctcaggtttcccgtgcc

SEQ ID NO: 9294925 - DNA, 22 bp, Homo sapiens
tgagtctcgaaatgcaggaaag

SEQ ID NO: 9294926 - DNA, 22 bp, Homo sapiens
tgagtctcggtttcccctccaa

SEQ ID NO: 9294927 - DNA, 21 bp, Homo sapiens
tgagtctctcagcttcaggta

SEQ ID NO: 9294928 - DNA, 22 bp, Homo sapiens
tgagtctctgcactaaggagag

SEQ ID NO: 9294929 - DNA, 18 bp, Homo sapiens
tgaggctgagggtagagg

SEQ ID NO: 9294930 - DNA, 22 bp, Homo sapiens
ccatacacacaccaaatttgta

SEQ ID NO: 9294931 - DNA, 17 bp, Homo sapiens
ccatactgacatattga

SEQ ID NO: 9294932 - DNA, 22 bp, Homo sapiens
ccatcacagtccccatcgtgat

SEQ ID NO: 9294933 - DNA, 22 bp, Homo sapiens
ccatccagaaacttccatcccc

SEQ ID NO: 9294934 - DNA, 18 bp, Homo sapiens
tgaggctgaatatggggc

SEQ ID NO: 9294935 - DNA, 22 bp, Homo sapiens
tgaggctgaaactggcgataga

SEQ ID NO: 9294936 - DNA, 20 bp, Homo sapiens
tgaggcccagcagagtcggg

SEQ ID NO: 9294937 - DNA, 22 bp, Homo sapiens
ccagtgcgagcctgtgctggcc

SEQ ID NO: 9294938 - DNA, 22 bp, Homo sapiens
ccagtgcccagctgcccaggca

SEQ ID NO: 9294939 - DNA, 22 bp, Homo sapiens
ccagtggaaatgtggtcaggat

SEQ ID NO: 9294940 - DNA, 22 bp, Homo sapiens
ccagtggacaatttctgaggaa

SEQ ID NO: 9294941 - DNA, 19 bp, Homo sapiens
ccagtcccatacaggagat

SEQ ID NO: 9294942 - DNA, 22 bp, Homo sapiens
ccaggtggaggtgtgaggtcct

SEQ ID NO: 9294943 - DNA, 22 bp, Homo sapiens
ccaggtggacttgatttgaata

SEQ ID NO: 9294944 - DNA, 22 bp, Homo sapiens
ccaggtggccctgccctactct

SEQ ID NO: 9294945 - DNA, 22 bp, Homo sapiens
ccaggtggaggtgtgaggtcct

SEQ ID NO: 9294946 - DNA, 22 bp, Homo sapiens
ccaggtggataaggtttctgga

SEQ ID NO: 9294947 - DNA, 17 bp, Homo sapiens
ccaggtgggaggtgggg

SEQ ID NO: 9294948 - DNA, 22 bp, Homo sapiens
ccaggtgtgtcaccattgccca

SEQ ID NO: 9294949 - DNA, 22 bp, Homo sapiens
ccaggtggcttctgcccgatgt

SEQ ID NO: 9294950 - DNA, 22 bp, Homo sapiens
ccaggtgggaggaaagcagaga

SEQ ID NO: 9294951 - DNA, 22 bp, Homo sapiens
ccaggtgggaggaaagcagaga

SEQ ID NO: 9294952 - DNA, 22 bp, Homo sapiens
tgcactccaggctgggtgacag

SEQ ID NO: 9294953 - DNA, 22 bp, Homo sapiens
tgcagagaagaggacagttcta

SEQ ID NO: 9294954 - DNA, 22 bp, Homo sapiens
tgcagagagatcctcagggttt

SEQ ID NO: 9294955 - DNA, 22 bp, Homo sapiens
tgcagagagacccctgggccag

SEQ ID NO: 9294956 - DNA, 22 bp, Homo sapiens
tgataatattttgaatcataag

SEQ ID NO: 9294957 - DNA, 22 bp, Homo sapiens
tgcaggcaggggatgagcagcc

SEQ ID NO: 9294958 - DNA, 22 bp, Homo sapiens
tgcaggcattggtgagagaagc

SEQ ID NO: 9294959 - DNA, 21 bp, Homo sapiens
tgcaggcaggcagagatgctg

SEQ ID NO: 9294960 - DNA, 22 bp, Homo sapiens
tgcaggcagggccagcgtgagg

SEQ ID NO: 9294961 - DNA, 22 bp, Homo sapiens
tgcagggccttgggtctttctt

SEQ ID NO: 9294962 - DNA, 22 bp, Homo sapiens
tgcagggctaagtcagagcctg

SEQ ID NO: 9294963 - DNA, 22 bp, Homo sapiens
tgcagggccttgttgatgtgct

SEQ ID NO: 9294964 - DNA, 22 bp, Homo sapiens
tgcagggccttgggatgtgtcc

SEQ ID NO: 9294965 - DNA, 22 bp, Homo sapiens
tgcagggccttctagaccatgg

SEQ ID NO: 9294966 - DNA, 20 bp, Homo sapiens
tgcagggcctaaaaagggaa

SEQ ID NO: 9294967 - DNA, 20 bp, Homo sapiens
tgcagctgcaggagggtggg

SEQ ID NO: 9294968 - DNA, 22 bp, Homo sapiens
tgcagctgattaaagggcagac

SEQ ID NO: 9294969 - DNA, 22 bp, Homo sapiens
ccagggcatgggaagaactgaa

SEQ ID NO: 9294970 - DNA, 22 bp, Homo sapiens
ccagggcatcctcacatcgcag

SEQ ID NO: 9294971 - DNA, 22 bp, Homo sapiens
ccagggcatcacatccagtgtt

SEQ ID NO: 9294972 - DNA, 22 bp, Homo sapiens
tgaagtctttcagggctagaat

SEQ ID NO: 9294973 - DNA, 22 bp, Homo sapiens
tgaagtctattctatgccaggt

SEQ ID NO: 9294974 - DNA, 22 bp, Homo sapiens
ccagggatgcagaggttgcagt

SEQ ID NO: 9294975 - DNA, 22 bp, Homo sapiens
ccagggatgccaagctttacca

SEQ ID NO: 9294976 - DNA, 22 bp, Homo sapiens
ccagggcaaatgagatcatagc

SEQ ID NO: 9294977 - DNA, 22 bp, Homo sapiens
ccagggcaacgctgtctcagag

SEQ ID NO: 9294978 - DNA, 22 bp, Homo sapiens
ccagggcaattatttggagggt

SEQ ID NO: 9294979 - DNA, 22 bp, Homo sapiens
ccagggcaataggaacactttt

SEQ ID NO: 9294980 - DNA, 22 bp, Homo sapiens
ccagggcaggggctggagttca

SEQ ID NO: 9294981 - DNA, 22 bp, Homo sapiens
ccagggcagtgggagaaggtgc

SEQ ID NO: 9294982 - DNA, 22 bp, Homo sapiens
ccagggcagggaccacgtgtct

SEQ ID NO: 9294983 - DNA, 22 bp, Homo sapiens
ccagggcacgttgggacagtac

SEQ ID NO: 9294984 - DNA, 22 bp, Homo sapiens
ccaggctgtaagagtgatgttg

SEQ ID NO: 9294985 - DNA, 22 bp, Homo sapiens
ccaggctgtgcttttcataaat

SEQ ID NO: 9294986 - DNA, 22 bp, Homo sapiens
ccaggctgtggtttagatagag

SEQ ID NO: 9294987 - DNA, 22 bp, Homo sapiens
ccaggctgtggtttagatagag

SEQ ID NO: 9294988 - DNA, 22 bp, Homo sapiens
ccaggcctctggctgcttagtc

SEQ ID NO: 9294989 - DNA, 17 bp, Homo sapiens
tcttctcttccagtctt

SEQ ID NO: 9294990 - DNA, 22 bp, Homo sapiens
tcttctctgtggcctggtggtg

SEQ ID NO: 9294991 - DNA, 22 bp, Homo sapiens
tcttctctcctgcttggcagaa

SEQ ID NO: 9294992 - DNA, 22 bp, Homo sapiens
ccaggaggcggaggttgcagtg

SEQ ID NO: 9294993 - DNA, 22 bp, Homo sapiens
ccaggaggctctgactggaccc

SEQ ID NO: 9294994 - DNA, 22 bp, Homo sapiens
ccaggaggctctgcccatccca

SEQ ID NO: 9294995 - DNA, 22 bp, Homo sapiens
ccaggaggcttcgtccgtggag

SEQ ID NO: 9294996 - DNA, 22 bp, Homo sapiens
ccaggaggctcttgtccctggt

SEQ ID NO: 9294997 - DNA, 16 bp, Homo sapiens
ccaggaggctgacacc

SEQ ID NO: 9294998 - DNA, 22 bp, Homo sapiens
tcttaattctgtgtcttcacta

SEQ ID NO: 9294999 - DNA, 20 bp, Homo sapiens
tcttacaatcgttacatcca

SEQ ID NO: 9295000 - DNA, 22 bp, Homo sapiens
tctgttctattggtctatgtgt

SEQ ID NO: 9295001 - DNA, 22 bp, Homo sapiens
ccaggaggcggaggttgcagcg

SEQ ID NO: 9295002 - DNA, 22 bp, Homo sapiens
ccaggagcagggctggctgcac

SEQ ID NO: 9295003 - DNA, 20 bp, Homo sapiens
tctgggagggacaagtctcc

SEQ ID NO: 9295004 - DNA, 22 bp, Homo sapiens
tctgggctctgtcagcacctct

SEQ ID NO: 9295005 - DNA, 22 bp, Homo sapiens
tgcttccttcccgttcttctcc

SEQ ID NO: 9295006 - DNA, 22 bp, Homo sapiens
tgcttcctgaggccgtcttctc

SEQ ID NO: 9295007 - DNA, 22 bp, Homo sapiens
tgcttccctgctctgcacacct

SEQ ID NO: 9295008 - DNA, 22 bp, Homo sapiens
cccagtgtttaggtcccatctc

SEQ ID NO: 9295009 - DNA, 22 bp, Homo sapiens
cccagtgtgcccctcctgcagc

SEQ ID NO: 9295010 - DNA, 22 bp, Homo sapiens
cccagtgtctgggcctgcaggg

SEQ ID NO: 9295011 - DNA, 22 bp, Homo sapiens
cccagtgtgatgaggttgctaa

SEQ ID NO: 9295012 - DNA, 22 bp, Homo sapiens
cccagtgtctccaacatcagat

SEQ ID NO: 9295013 - DNA, 20 bp, Homo sapiens
cccagtgtccagccttgcca

SEQ ID NO: 9295014 - DNA, 22 bp, Homo sapiens
cccagtgtcaccaacaggacac

SEQ ID NO: 9295015 - DNA, 22 bp, Homo sapiens
cccagtggcttttgcccaggtt

SEQ ID NO: 9295016 - DNA, 22 bp, Homo sapiens
cccagtggggaaatagctagct

SEQ ID NO: 9295017 - DNA, 22 bp, Homo sapiens
cccagtgggtcactgcatctca

SEQ ID NO: 9295018 - DNA, 22 bp, Homo sapiens
cccagtggggagcttctgcctt

SEQ ID NO: 9295019 - DNA, 22 bp, Homo sapiens
cccagtggggagctgaggttca

SEQ ID NO: 9295020 - DNA, 22 bp, Homo sapiens
cccagtggtgctggcatctgtg

SEQ ID NO: 9295021 - DNA, 22 bp, Homo sapiens
cccagtggtttgcagaaccaag

SEQ ID NO: 9295022 - DNA, 22 bp, Homo sapiens
tgctgggggctttctggatacc

SEQ ID NO: 9295023 - DNA, 22 bp, Homo sapiens
tgctgggggctttctggatacc

SEQ ID NO: 9295024 - DNA, 22 bp, Homo sapiens
tgctggggctctgaccactcca

SEQ ID NO: 9295025 - DNA, 22 bp, Homo sapiens
tgctgggggtagctctgcgtag

SEQ ID NO: 9295026 - DNA, 22 bp, Homo sapiens
tgctgggggctttctggatacc

SEQ ID NO: 9295027 - DNA, 22 bp, Homo sapiens
tgctgggggctttctggatacc

SEQ ID NO: 9295028 - DNA, 22 bp, Homo sapiens
tgctgggggtgtctcaccaggc

SEQ ID NO: 9295029 - DNA, 18 bp, Homo sapiens
tgctggggtagaatccac

SEQ ID NO: 9295030 - DNA, 22 bp, Homo sapiens
tgctgggggttcagatgagtaa

SEQ ID NO: 9295031 - DNA, 22 bp, Homo sapiens
tgctgggggttcagatgagtaa

SEQ ID NO: 9295032 - DNA, 18 bp, Homo sapiens
tgctggggtagaatccac

SEQ ID NO: 9295033 - DNA, 22 bp, Homo sapiens
ccccagctcagtgcagggacat

SEQ ID NO: 9295034 - DNA, 22 bp, Homo sapiens
tgctctggaatagtcctaggca

SEQ ID NO: 9295035 - DNA, 20 bp, Homo sapiens
tgctctggaaatggtctgag

SEQ ID NO: 9295036 - DNA, 22 bp, Homo sapiens
cccagtggaaggagtagaagac

SEQ ID NO: 9295037 - DNA, 22 bp, Homo sapiens
cccagtggcccagcatgtggtg

SEQ ID NO: 9295038 - DNA, 22 bp, Homo sapiens
cccagtggcaaagcagcttaga

SEQ ID NO: 9295039 - DNA, 22 bp, Homo sapiens
cccagtggagataggagtgtgg

SEQ ID NO: 9295040 - DNA, 22 bp, Homo sapiens
cccagtggctgtccccatgggc

SEQ ID NO: 9295041 - DNA, 22 bp, Homo sapiens
tgcaggtgcgttttcaagcctc

SEQ ID NO: 9295042 - DNA, 22 bp, Homo sapiens
tgcaggtgctacaagaactcac

SEQ ID NO: 9295043 - DNA, 22 bp, Homo sapiens
tgcaggtgctgatacctactcc

SEQ ID NO: 9295044 - DNA, 22 bp, Homo sapiens
tgcaggtgctccgggggtgccc

SEQ ID NO: 9295045 - DNA, 22 bp, Homo sapiens
tgcaggtgccatcgctgctcat

SEQ ID NO: 9295046 - DNA, 22 bp, Homo sapiens
tgcaggtgcctcttgagcttgt

SEQ ID NO: 9295047 - DNA, 22 bp, Homo sapiens
tgcagggctacaggactacaac

SEQ ID NO: 9295048 - DNA, 22 bp, Homo sapiens
tgctacagagcgggggctcagt

SEQ ID NO: 9295049 - DNA, 22 bp, Homo sapiens
tgcaggtgctgtgtcaagagag

SEQ ID NO: 9295050 - DNA, 22 bp, Homo sapiens
ccctgggaagtattccagctat

SEQ ID NO: 9295051 - DNA, 22 bp, Homo sapiens
tggcagggagccaccggtcatg

SEQ ID NO: 9295052 - DNA, 21 bp, Homo sapiens
cccttgcctgcactcctcggc

SEQ ID NO: 9295053 - DNA, 19 bp, Homo sapiens
tggcagggagagtttgaag

SEQ ID NO: 9295054 - DNA, 22 bp, Homo sapiens
tggcagggaatacagatgttta

SEQ ID NO: 9295055 - DNA, 22 bp, Homo sapiens
cccttggaggaagctctaggct

SEQ ID NO: 9295056 - DNA, 22 bp, Homo sapiens
ccctttaattccaacacaggaa

SEQ ID NO: 9295057 - DNA, 20 bp, Homo sapiens
ccctttaagctttagtatgc

SEQ ID NO: 9295058 - DNA, 22 bp, Homo sapiens
ccctttaaggtctgattttcag

SEQ ID NO: 9295059 - DNA, 22 bp, Homo sapiens
ccctttaagtagaatatattat

SEQ ID NO: 9295060 - DNA, 22 bp, Homo sapiens
tggcacagtcctgggtgcctgc

SEQ ID NO: 9295061 - DNA, 22 bp, Homo sapiens
tggcagaagtacacaagcatgc

SEQ ID NO: 9295062 - DNA, 22 bp, Homo sapiens
tggcacttgtcacctgctttca

SEQ ID NO: 9295063 - DNA, 22 bp, Homo sapiens
tggcagagaacacacatgattc

SEQ ID NO: 9295064 - DNA, 23 bp, Homo sapiens
tggagatgccccactccctgtct

SEQ ID NO: 9295065 - DNA, 22 bp, Homo sapiens
tggaggcattttaggttgtcac

SEQ ID NO: 9295066 - DNA, 22 bp, Homo sapiens
tggaggcatgacagtgtctgga

SEQ ID NO: 9295067 - DNA, 22 bp, Homo sapiens
tggaggccaaggcaggcggatc

SEQ ID NO: 9295068 - DNA, 22 bp, Homo sapiens
tggaggccaactttcctcatct

SEQ ID NO: 9295069 - DNA, 22 bp, Homo sapiens
tggaggcagtcacctgaagtca

SEQ ID NO: 9295070 - DNA, 22 bp, Homo sapiens
tggaggcatcagagtgcttggc

SEQ ID NO: 9295071 - DNA, 22 bp, Homo sapiens
tggaggcagtttaagtctgaga

SEQ ID NO: 9295072 - DNA, 22 bp, Homo sapiens
tggagaattctatgttgagggg

SEQ ID NO: 9295073 - DNA, 22 bp, Homo sapiens
tggaaagaaagtaaaggcgtat

SEQ ID NO: 9295074 - DNA, 22 bp, Homo sapiens
tggacatgtccggccagacaat

SEQ ID NO: 9295075 - DNA, 22 bp, Homo sapiens
tggacatgtcttctccaagaaa

SEQ ID NO: 9295076 - DNA, 21 bp, Homo sapiens
tggacattatggagagagtag

SEQ ID NO: 9295077 - DNA, 22 bp, Homo sapiens
tggagatgaacatggtgatgtt

SEQ ID NO: 9295078 - DNA, 22 bp, Homo sapiens
tggagataggctgaggcagggc

SEQ ID NO: 9295079 - DNA, 22 bp, Homo sapiens
tggaaactaagactagagagac

SEQ ID NO: 9295080 - DNA, 22 bp, Homo sapiens
tggaaactaggatggaagaaat

SEQ ID NO: 9295081 - DNA, 22 bp, Homo sapiens
tggaaactatagtcacaataga

SEQ ID NO: 9295082 - DNA, 22 bp, Homo sapiens
cctgcctatgagacgttttgcc

SEQ ID NO: 9295083 - DNA, 22 bp, Homo sapiens
cctgcctcatcaacttgtcgtg

SEQ ID NO: 9295084 - DNA, 22 bp, Homo sapiens
cctgcctcaggactctgcatat

SEQ ID NO: 9295085 - DNA, 22 bp, Homo sapiens
tggtaggaatgattacgacttt

SEQ ID NO: 9295086 - DNA, 22 bp, Homo sapiens
cctgcccagcttcacctcaggc

SEQ ID NO: 9295087 - DNA, 22 bp, Homo sapiens
cctgcctcccagaggtcctcta

SEQ ID NO: 9295088 - DNA, 22 bp, Homo sapiens
tgggtcagtttgggggccagcc

SEQ ID NO: 9295089 - DNA, 22 bp, Homo sapiens
tgggcaggatgcgttgattctt

SEQ ID NO: 9295090 - DNA, 22 bp, Homo sapiens
tgggcaggcaagtgaatacctt

SEQ ID NO: 9295091 - DNA, 22 bp, Homo sapiens
tgggcaggcaagtgaatacctt

SEQ ID NO: 9295092 - DNA, 22 bp, Homo sapiens
tgggcaggataatatctcatgt

SEQ ID NO: 9295093 - DNA, 22 bp, Homo sapiens
tgggcaggagagaagctaaaga

SEQ ID NO: 9295094 - DNA, 22 bp, Homo sapiens
tgggcaggatgcgttgattctt

SEQ ID NO: 9295095 - DNA, 22 bp, Homo sapiens
tgggcaggataatatctcatgt

SEQ ID NO: 9295096 - DNA, 22 bp, Homo sapiens
tgggctcatggcccagcactgg

SEQ ID NO: 9295097 - DNA, 22 bp, Homo sapiens
tgggcctggccctgtggaggag

SEQ ID NO: 9295098 - DNA, 21 bp, Homo sapiens
cctgagtgagacctggcccgt

SEQ ID NO: 9295099 - DNA, 22 bp, Homo sapiens
cctgagtgaattccctcactgt

SEQ ID NO: 9295100 - DNA, 22 bp, Homo sapiens
cctgagtggccaggcagctgtg

SEQ ID NO: 9295101 - DNA, 22 bp, Homo sapiens
cctgatggagccctgctgcatg

SEQ ID NO: 9295102 - DNA, 22 bp, Homo sapiens
tggggagactggccgagatcct

SEQ ID NO: 9295103 - DNA, 21 bp, Homo sapiens
tggccaaaaccatattattaa

SEQ ID NO: 9295104 - DNA, 21 bp, Homo sapiens
tggccaaactggagcatttga

SEQ ID NO: 9295105 - DNA, 22 bp, Homo sapiens
tggccaagccactgctgggtct

SEQ ID NO: 9295106 - DNA, 22 bp, Homo sapiens
tggcagtgtcttgctggggcag

SEQ ID NO: 9295107 - DNA, 22 bp, Homo sapiens
tggcagtgtcttatcaggagtg

SEQ ID NO: 9295108 - DNA, 22 bp, Homo sapiens
tggcagtgtcttatcaggagtg

SEQ ID NO: 9295109 - DNA, 22 bp, Homo sapiens
tggcagtggtaccggctctcag

SEQ ID NO: 9295110 - DNA, 22 bp, Homo sapiens
tggcagtgggaatggacaaaca

SEQ ID NO: 9295111 - DNA, 22 bp, Homo sapiens
tggcagtgggaagctggaagtc

SEQ ID NO: 9295112 - DNA, 19 bp, Homo sapiens
tggcaggtagtgagcagtc

SEQ ID NO: 9295113 - DNA, 22 bp, Homo sapiens
cctccatctccagcttctgcct

SEQ ID NO: 9295114 - DNA, 22 bp, Homo sapiens
cctcccacatcctagctctgct

SEQ ID NO: 9295115 - DNA, 17 bp, Homo sapiens
cctcccacaccgccctg

SEQ ID NO: 9295116 - DNA, 22 bp, Homo sapiens
cctcccacttcttgctgaggtc

SEQ ID NO: 9295117 - DNA, 23 bp, Homo sapiens
cctcccacctatttcactttctt

SEQ ID NO: 9295118 - DNA, 19 bp, Homo sapiens
cctcccacggattccttcc

SEQ ID NO: 9295119 - DNA, 22 bp, Homo sapiens
cctcccaccgtatctcagtggc

SEQ ID NO: 9295120 - DNA, 22 bp, Homo sapiens
cctcccaccatttagagagagc

SEQ ID NO: 9295121 - DNA, 22 bp, Homo sapiens
cctcccacattgaggacatgct

SEQ ID NO: 9295122 - DNA, 22 bp, Homo sapiens
cctcctgggactcattagcacc

SEQ ID NO: 9295123 - DNA, 22 bp, Homo sapiens
cctcctgggagagcacggaggg

SEQ ID NO: 9295124 - DNA, 22 bp, Homo sapiens
cctcctgggctcctgtctgcac

SEQ ID NO: 9295125 - DNA, 22 bp, Homo sapiens
cctcctggcctgtgcagagccc

SEQ ID NO: 9295126 - DNA, 22 bp, Homo sapiens
cctcctggcttttcccattgaa

SEQ ID NO: 9295127 - DNA, 22 bp, Homo sapiens
cctcctgggacaggctggcaca

SEQ ID NO: 9295128 - DNA, 22 bp, Homo sapiens
tgggcactgtgtgtggtaaaat

SEQ ID NO: 9295129 - DNA, 22 bp, Homo sapiens
tgggacagagtgagctttggcc

SEQ ID NO: 9295130 - DNA, 22 bp, Homo sapiens
tgggacaggatgaccagaaggt

SEQ ID NO: 9295131 - DNA, 22 bp, Homo sapiens
tgggacaggaggcctctggaga

SEQ ID NO: 9295132 - DNA, 22 bp, Homo sapiens
tgggacagggaatctgatcccc

SEQ ID NO: 9295133 - DNA, 22 bp, Homo sapiens
cctcctgggttcaagcgattct

SEQ ID NO: 9295134 - DNA, 22 bp, Homo sapiens
cctctccagttttaacgtgacc

SEQ ID NO: 9295135 - DNA, 22 bp, Homo sapiens
tgggaaggcagtcactgtccta

SEQ ID NO: 9295136 - DNA, 22 bp, Homo sapiens
cctctcccgggtgccgctgggc

SEQ ID NO: 9295137 - DNA, 22 bp, Homo sapiens
catttctagggatcataaagta

SEQ ID NO: 9295138 - DNA, 22 bp, Homo sapiens
catttctaccaaatgtgactgg

SEQ ID NO: 9295139 - DNA, 21 bp, Homo sapiens
catttcatgattatagaaatg

SEQ ID NO: 9295140 - DNA, 22 bp, Homo sapiens
catttcattcctttgaaagtgg

SEQ ID NO: 9295141 - DNA, 20 bp, Homo sapiens
catttcattgtgtcttcact

SEQ ID NO: 9295142 - DNA, 22 bp, Homo sapiens
catttcatagttgtcacaataa

SEQ ID NO: 9295143 - DNA, 22 bp, Homo sapiens
catttcatagttgtcacaataa

SEQ ID NO: 9295144 - DNA, 22 bp, Homo sapiens
catttattggcatgtagtaggt

SEQ ID NO: 9295145 - DNA, 22 bp, Homo sapiens
tccataaaccagaaaatcaaga

SEQ ID NO: 9295146 - DNA, 21 bp, Homo sapiens
catttctattgatgagaaaag

SEQ ID NO: 9295147 - DNA, 22 bp, Homo sapiens
cattttactgactcttgaatta

SEQ ID NO: 9295148 - DNA, 22 bp, Homo sapiens
cattttatgtttatggagtgct

SEQ ID NO: 9295149 - DNA, 22 bp, Homo sapiens
tcctgactctggtgtcctctac

SEQ ID NO: 9295150 - DNA, 22 bp, Homo sapiens
ccaaaaagctcagagatatgtt

SEQ ID NO: 9295151 - DNA, 22 bp, Homo sapiens
cattttcatgagtttctgttca

SEQ ID NO: 9295152 - DNA, 22 bp, Homo sapiens
ccacagggcacagacaggaagc

SEQ ID NO: 9295153 - DNA, 22 bp, Homo sapiens
ccaccaggacagccctgagggg

SEQ ID NO: 9295154 - DNA, 22 bp, Homo sapiens
tcctggctcaggcccctggtgc

SEQ ID NO: 9295155 - DNA, 22 bp, Homo sapiens
tcctgccttcatactgctgtat

SEQ ID NO: 9295156 - DNA, 22 bp, Homo sapiens
tcctgccttgcctgggacatca

SEQ ID NO: 9295157 - DNA, 22 bp, Homo sapiens
tcctgccttagagcaaggaaaa

SEQ ID NO: 9295158 - DNA, 21 bp, Homo sapiens
tcctgccttagtccagagcag

SEQ ID NO: 9295159 - DNA, 21 bp, Homo sapiens
tcctgccttagtccagagcag

SEQ ID NO: 9295160 - DNA, 21 bp, Homo sapiens
tctagaagaggttgagaatat

SEQ ID NO: 9295161 - DNA, 22 bp, Homo sapiens
ccaccccaaatgaagacctctc

SEQ ID NO: 9295162 - DNA, 22 bp, Homo sapiens
ccaccctaacaatccttactgt

SEQ ID NO: 9295163 - DNA, 22 bp, Homo sapiens
tcctgtggtcattcttctgccc

SEQ ID NO: 9295164 - DNA, 22 bp, Homo sapiens
tctcagctgcctgccctgctcc

SEQ ID NO: 9295165 - DNA, 22 bp, Homo sapiens
tctcaggaatagagtggcagca

SEQ ID NO: 9295166 - DNA, 22 bp, Homo sapiens
tctcagtgtgttttctctcaga

SEQ ID NO: 9295167 - DNA, 22 bp, Homo sapiens
tctcagtgttatctatctgcct

SEQ ID NO: 9295168 - DNA, 22 bp, Homo sapiens
ccagagcagggcagcagggctc

SEQ ID NO: 9295169 - DNA, 22 bp, Homo sapiens
tctctgtattctgatattcact

SEQ ID NO: 9295170 - DNA, 21 bp, Homo sapiens
tctctgtatccatgggttcca

SEQ ID NO: 9295171 - DNA, 22 bp, Homo sapiens
tctctgtatcccagaaccaaaa

SEQ ID NO: 9295172 - DNA, 22 bp, Homo sapiens
tctctgtagagacagcactgtg

SEQ ID NO: 9295173 - DNA, 22 bp, Homo sapiens
tctctgtagttgggcagctgct

SEQ ID NO: 9295174 - DNA, 22 bp, Homo sapiens
tctctgtagggctgcttgagta

SEQ ID NO: 9295175 - DNA, 22 bp, Homo sapiens
tctctgtacagtacatgccgtg

SEQ ID NO: 9295176 - DNA, 22 bp, Homo sapiens
tctctgtaaaatgtggatgata

SEQ ID NO: 9295177 - DNA, 18 bp, Homo sapiens
ccagagggtgcgtcagct

SEQ ID NO: 9295178 - DNA, 19 bp, Homo sapiens
catggtgaaaccccgtctc

SEQ ID NO: 9295179 - DNA, 20 bp, Homo sapiens
catggtggaggagcagggcc

SEQ ID NO: 9295180 - DNA, 22 bp, Homo sapiens
catggtgatttgcgccttctat

SEQ ID NO: 9295181 - DNA, 18 bp, Homo sapiens
tccagagagggagaagtg

SEQ ID NO: 9295182 - DNA, 22 bp, Homo sapiens
tccaagaggagacactgggatg

SEQ ID NO: 9295183 - DNA, 22 bp, Homo sapiens
tccaagagttcaaggctacagt

SEQ ID NO: 9295184 - DNA, 22 bp, Homo sapiens
tccaagatctacagcagtttag

SEQ ID NO: 9295185 - DNA, 22 bp, Homo sapiens
catgctctagattctctctaat

SEQ ID NO: 9295186 - DNA, 22 bp, Homo sapiens
catgctgggtaaaggtggtgaa

SEQ ID NO: 9295187 - DNA, 22 bp, Homo sapiens
tccaggctgggctgaagggtgc

SEQ ID NO: 9295188 - DNA, 22 bp, Homo sapiens
tccaggcttgagaccaggctct

SEQ ID NO: 9295189 - DNA, 22 bp, Homo sapiens
catgtgggaagaggccagctgg

SEQ ID NO: 9295190 - DNA, 19 bp, Homo sapiens
catgtgtcaatactgtacc

SEQ ID NO: 9295191 - DNA, 22 bp, Homo sapiens
catgtgtcacagccttttattg

SEQ ID NO: 9295192 - DNA, 19 bp, Homo sapiens
catgtgtcaatactgtacc

SEQ ID NO: 9295193 - DNA, 22 bp, Homo sapiens
catgtgtcaaatgatgtagctg

SEQ ID NO: 9295194 - DNA, 22 bp, Homo sapiens
cattaatttaatattcaaagaa

SEQ ID NO: 9295195 - DNA, 22 bp, Homo sapiens
cattacaaccccaaattacaaa

SEQ ID NO: 9295196 - DNA, 22 bp, Homo sapiens
cagtggttttcagctgggagtt

SEQ ID NO: 9295197 - DNA, 22 bp, Homo sapiens
tcaggaggcgtgctggggtaca

SEQ ID NO: 9295198 - DNA, 22 bp, Homo sapiens
tcaggaggctcaagacctggca

SEQ ID NO: 9295199 - DNA, 22 bp, Homo sapiens
tcaggaggcgtctcgctggggc

SEQ ID NO: 9295200 - DNA, 22 bp, Homo sapiens
tcaggaggccaccaggacctgt

SEQ ID NO: 9295201 - DNA, 22 bp, Homo sapiens
tcaggaggccggcaggatttga

SEQ ID NO: 9295202 - DNA, 22 bp, Homo sapiens
tcaggaggccggcaggatttga

SEQ ID NO: 9295203 - DNA, 22 bp, Homo sapiens
tcaggaggcggaggttgcagtg

SEQ ID NO: 9295204 - DNA, 22 bp, Homo sapiens
tcaggctgcctatcagactgtg

SEQ ID NO: 9295205 - DNA, 22 bp, Homo sapiens
tcaggctgcccgttcagggctc

SEQ ID NO: 9295206 - DNA, 22 bp, Homo sapiens
catcaaaattagacattgttga

SEQ ID NO: 9295207 - DNA, 22 bp, Homo sapiens
tcaggcagagctgtggagctct

SEQ ID NO: 9295208 - DNA, 22 bp, Homo sapiens
catcatatatttctacaagtgc

SEQ ID NO: 9295209 - DNA, 22 bp, Homo sapiens
catcatatggaatttaaagtca

SEQ ID NO: 9295210 - DNA, 22 bp, Homo sapiens
catcagtgtggcagttcactgt

SEQ ID NO: 9295211 - DNA, 22 bp, Homo sapiens
tcatcacatgtgtagtcatccc

SEQ ID NO: 9295212 - DNA, 22 bp, Homo sapiens
tcatcacatatgtcatgatttg

SEQ ID NO: 9295213 - DNA, 22 bp, Homo sapiens
tcatcacaattttatgaccctc

SEQ ID NO: 9295214 - DNA, 22 bp, Homo sapiens
tcataattgtatacatttatgg

SEQ ID NO: 9295215 - DNA, 22 bp, Homo sapiens
catctacaggagaatgtcactg

SEQ ID NO: 9295216 - DNA, 17 bp, Homo sapiens
catccgtgagctcggca

SEQ ID NO: 9295217 - DNA, 22 bp, Homo sapiens
taccctctcccggtccagcttt

SEQ ID NO: 9295218 - DNA, 22 bp, Homo sapiens
tacccaggaggaaactgaggct

SEQ ID NO: 9295219 - DNA, 22 bp, Homo sapiens
caggctgcagaggcctttcatg

SEQ ID NO: 9295220 - DNA, 22 bp, Homo sapiens
caggctgcagcagcagtggccc

SEQ ID NO: 9295221 - DNA, 22 bp, Homo sapiens
tagacaggagtcaggctagaat

SEQ ID NO: 9295222 - DNA, 22 bp, Homo sapiens
tagacagggtggcttagaaaca

SEQ ID NO: 9295223 - DNA, 22 bp, Homo sapiens
tagacatattgtatttacttaa

SEQ ID NO: 9295224 - DNA, 22 bp, Homo sapiens
tagacatagtttttatgactta

SEQ ID NO: 9295225 - DNA, 22 bp, Homo sapiens
cagggcataagatgaggctgta

SEQ ID NO: 9295226 - DNA, 22 bp, Homo sapiens
cagggcagttttacttctctct

SEQ ID NO: 9295227 - DNA, 22 bp, Homo sapiens
cagggcagtttgtgcctatgag

SEQ ID NO: 9295228 - DNA, 22 bp, Homo sapiens
cagggcagtaccgccctctggc

SEQ ID NO: 9295229 - DNA, 22 bp, Homo sapiens
cagggcagtgaagaacacacgt

SEQ ID NO: 9295230 - DNA, 22 bp, Homo sapiens
cagggcagtaccgccctctggc

SEQ ID NO: 9295231 - DNA, 22 bp, Homo sapiens
tagcagtgtctaggtaggccat

SEQ ID NO: 9295232 - DNA, 22 bp, Homo sapiens
tagcataatttgtagaaaatca

SEQ ID NO: 9295233 - DNA, 22 bp, Homo sapiens
tagcataacaggtaagagtgag

SEQ ID NO: 9295234 - DNA, 22 bp, Homo sapiens
cagggcaggacagatacattac

SEQ ID NO: 9295235 - DNA, 22 bp, Homo sapiens
cagggatggcctggcgggccac

SEQ ID NO: 9295236 - DNA, 23 bp, Homo sapiens
cagggaggagatactgtgtatct

SEQ ID NO: 9295237 - DNA, 22 bp, Homo sapiens
tacacagaacctggtgtacagt

SEQ ID NO: 9295238 - DNA, 22 bp, Homo sapiens
tacacagactcttcaattcaga

SEQ ID NO: 9295239 - DNA, 22 bp, Homo sapiens
tacacagatatgtgatcaatca

SEQ ID NO: 9295240 - DNA, 22 bp, Homo sapiens
caggccaaagatcccattgaca

SEQ ID NO: 9295241 - DNA, 22 bp, Homo sapiens
caggccaaaattcaggcattct

SEQ ID NO: 9295242 - DNA, 22 bp, Homo sapiens
caggccaactgcatggtgacca

SEQ ID NO: 9295243 - DNA, 22 bp, Homo sapiens
caggccaagcctccccagctcc

SEQ ID NO: 9295244 - DNA, 22 bp, Homo sapiens
caggccaataaatgtgatggcc

SEQ ID NO: 9295245 - DNA, 22 bp, Homo sapiens
caggccaagtcccaagtgcggg

SEQ ID NO: 9295246 - DNA, 22 bp, Homo sapiens
tacacagatttcagtatcatca

SEQ ID NO: 9295247 - DNA, 22 bp, Homo sapiens
caggccctcctgtgatctgcct

SEQ ID NO: 9295248 - DNA, 22 bp, Homo sapiens
caggccaatttcttgtcattta

SEQ ID NO: 9295249 - DNA, 22 bp, Homo sapiens
caggccaatatcacatgctatg

SEQ ID NO: 9295250 - DNA, 22 bp, Homo sapiens
caggccctgccttggcatgtgt

SEQ ID NO: 9295251 - DNA, 22 bp, Homo sapiens
tacactgtgacaatcatgacag

SEQ ID NO: 9295252 - DNA, 22 bp, Homo sapiens
tacagacattcaattttgaccc

SEQ ID NO: 9295253 - DNA, 22 bp, Homo sapiens
tacagacatttactccactcct

SEQ ID NO: 9295254 - DNA, 22 bp, Homo sapiens
tacagagaataataggacaggt

SEQ ID NO: 9295255 - DNA, 22 bp, Homo sapiens
tacagagacccacaagagactg

SEQ ID NO: 9295256 - DNA, 22 bp, Homo sapiens
tacagagactttatggcacaaa

SEQ ID NO: 9295257 - DNA, 20 bp, Homo sapiens
tacagagagctagctctctg

SEQ ID NO: 9295258 - DNA, 22 bp, Homo sapiens
tacagagagctccggacattca

SEQ ID NO: 9295259 - DNA, 22 bp, Homo sapiens
tacagcagggcgctgtgatgaa

SEQ ID NO: 9295260 - DNA, 22 bp, Homo sapiens
tagtgttctaagaacatccatg

SEQ ID NO: 9295261 - DNA, 22 bp, Homo sapiens
tatattcaatgattagtatcag

SEQ ID NO: 9295262 - DNA, 22 bp, Homo sapiens
tatatacaaggtaggtttaggt

SEQ ID NO: 9295263 - DNA, 22 bp, Homo sapiens
cagggctgagtcatatagcctt

SEQ ID NO: 9295264 - DNA, 22 bp, Homo sapiens
tatgtacatcgttgaattcaaa

SEQ ID NO: 9295265 - DNA, 22 bp, Homo sapiens
caggtggggcgccctcaggcag

SEQ ID NO: 9295266 - DNA, 22 bp, Homo sapiens
caggtggggcagctgtgggagc

SEQ ID NO: 9295267 - DNA, 22 bp, Homo sapiens
caggtggggagagtgtggagca

SEQ ID NO: 9295268 - DNA, 22 bp, Homo sapiens
caggtgggcttgggagaacact

SEQ ID NO: 9295269 - DNA, 22 bp, Homo sapiens
caggtgggcgtggcgagaaggc

SEQ ID NO: 9295270 - DNA, 22 bp, Homo sapiens
caggtggcttattagggtcagt

SEQ ID NO: 9295271 - DNA, 22 bp, Homo sapiens
tatgtacatgatttcatttgct

SEQ ID NO: 9295272 - DNA, 22 bp, Homo sapiens
tatgaagaaatctttgaaaatc

SEQ ID NO: 9295273 - DNA, 22 bp, Homo sapiens
tatgaagaagacaaatgacact

SEQ ID NO: 9295274 - DNA, 23 bp, Homo sapiens
tatgaactgcattgctggtgtgt

SEQ ID NO: 9295275 - DNA, 22 bp, Homo sapiens
tatgaactgctcttgtgttttg

SEQ ID NO: 9295276 - DNA, 22 bp, Homo sapiens
tatgaactgtgagtgtgatggg

SEQ ID NO: 9295277 - DNA, 22 bp, Homo sapiens
tatgaagatatatctgatctct

SEQ ID NO: 9295278 - DNA, 22 bp, Homo sapiens
tatgatattctaaattgacacc

SEQ ID NO: 9295279 - DNA, 22 bp, Homo sapiens
tatgaagaagttctgtgaaatg

SEQ ID NO: 9295280 - DNA, 22 bp, Homo sapiens
cagtagaagcttgtttttcaga

SEQ ID NO: 9295281 - DNA, 22 bp, Homo sapiens
tattcccattccacttatcaag

SEQ ID NO: 9295282 - DNA, 22 bp, Homo sapiens
tattcccagcctctttctatct

SEQ ID NO: 9295283 - DNA, 22 bp, Homo sapiens
tcaaaggcaccaaggtcactgc

SEQ ID NO: 9295284 - DNA, 20 bp, Homo sapiens
tcaaaggcaaaggtgggtgt

SEQ ID NO: 9295285 - DNA, 22 bp, Homo sapiens
tcaaattatttaggatagtgct

SEQ ID NO: 9295286 - DNA, 22 bp, Homo sapiens
cagtcccatgagcccagaacat

SEQ ID NO: 9295287 - DNA, 22 bp, Homo sapiens
cagtctggctcagcacaaaggg

SEQ ID NO: 9295288 - DNA, 22 bp, Homo sapiens
cagtctggcacagcacactgaa

SEQ ID NO: 9295289 - DNA, 22 bp, Homo sapiens
cagtctctaaatcaatctgaat

SEQ ID NO: 9295290 - DNA, 22 bp, Homo sapiens
cagtctctcagctttcagctgt

SEQ ID NO: 9295291 - DNA, 23 bp, Homo sapiens
cagtctctccccggacagcaaaa

SEQ ID NO: 9295292 - DNA, 23 bp, Homo sapiens
cagtctctccccggacagcaaaa

SEQ ID NO: 9295293 - DNA, 22 bp, Homo sapiens
cagtctggactcaggcatacct

SEQ ID NO: 9295294 - DNA, 22 bp, Homo sapiens
tcacacatttctcaagtgtagg

SEQ ID NO: 9295295 - DNA, 20 bp, Homo sapiens
tcacacatggtaagctatga

SEQ ID NO: 9295296 - DNA, 22 bp, Homo sapiens
cagtggattaaggagggcagct

SEQ ID NO: 9295297 - DNA, 22 bp, Homo sapiens
cagtggattagccagagctgga

SEQ ID NO: 9295298 - DNA, 22 bp, Homo sapiens
cagtggaggctcaagtgtgctt

SEQ ID NO: 9295299 - DNA, 22 bp, Homo sapiens
cagtggagtgggactggtctga

SEQ ID NO: 9295300 - DNA, 19 bp, Homo sapiens
cagtggagattggaggagg

SEQ ID NO: 9295301 - DNA, 22 bp, Homo sapiens
cagtggcacccacgggctgggc

SEQ ID NO: 9295302 - DNA, 22 bp, Homo sapiens
cagtgggtcctgcgtctgccag

SEQ ID NO: 9295303 - DNA, 22 bp, Homo sapiens
cagtgggtgagaggaaaagctt

SEQ ID NO: 9295304 - DNA, 22 bp, Homo sapiens
cagtgggtgaaagatggctaag

SEQ ID NO: 9295305 - DNA, 22 bp, Homo sapiens
cagtggtttaggtcaaggggag

SEQ ID NO: 9295306 - DNA, 22 bp, Homo sapiens
ttgagggtctggatctgctgct

SEQ ID NO: 9295307 - DNA, 22 bp, Homo sapiens
ttgaggccccatggatgagaac

SEQ ID NO: 9295308 - DNA, 22 bp, Homo sapiens
ttctttctcactctttaggaag

SEQ ID NO: 9295309 - DNA, 22 bp, Homo sapiens
ttctttcttggggaacacactc

SEQ ID NO: 9295310 - DNA, 22 bp, Homo sapiens
ttctgggaggatgggaaatcat

SEQ ID NO: 9295311 - DNA, 22 bp, Homo sapiens
ttctgggagattcatatgaaaa

SEQ ID NO: 9295312 - DNA, 22 bp, Homo sapiens
ttctgggacattgcaggtattc

SEQ ID NO: 9295313 - DNA, 22 bp, Homo sapiens
ttcttcagactccctctttaag

SEQ ID NO: 9295314 - DNA, 22 bp, Homo sapiens
ttcttcagcctaccttgacctc

SEQ ID NO: 9295315 - DNA, 22 bp, Homo sapiens
ttcttcagcccatatcttccag

SEQ ID NO: 9295316 - DNA, 22 bp, Homo sapiens
ttctgggaacaaagtggagtgg

SEQ ID NO: 9295317 - DNA, 22 bp, Homo sapiens
ttctgggacatctggacagttt

SEQ ID NO: 9295318 - DNA, 22 bp, Homo sapiens
ttctgggacatctggacagttt

SEQ ID NO: 9295319 - DNA, 22 bp, Homo sapiens
ttctggaggctccagggaagaa

SEQ ID NO: 9295320 - DNA, 22 bp, Homo sapiens
ttctcttctgttcagtgcccaa

SEQ ID NO: 9295321 - DNA, 22 bp, Homo sapiens
ttctcttcatctcagtaaatgt

SEQ ID NO: 9295322 - DNA, 22 bp, Homo sapiens
ttctcttcccactttctgtatt

SEQ ID NO: 9295323 - DNA, 19 bp, Homo sapiens
ttctctgtgctagactctg

SEQ ID NO: 9295324 - DNA, 22 bp, Homo sapiens
ttctctgtgagggtgctggatt

SEQ ID NO: 9295325 - DNA, 22 bp, Homo sapiens
ttctcttcatctcagtaaatgt

SEQ ID NO: 9295326 - DNA, 22 bp, Homo sapiens
ttctccatttaacttccttatg

SEQ ID NO: 9295327 - DNA, 22 bp, Homo sapiens
ttctgcattggagtctattctt

SEQ ID NO: 9295328 - DNA, 22 bp, Homo sapiens
ttctgcattcaaattatgtgag

SEQ ID NO: 9295329 - DNA, 22 bp, Homo sapiens
ttctgcattgacttttatttcc

SEQ ID NO: 9295330 - DNA, 22 bp, Homo sapiens
ttctgcaccatcttccagctga

SEQ ID NO: 9295331 - DNA, 22 bp, Homo sapiens
ttctgcacagtcactcctggct

SEQ ID NO: 9295332 - DNA, 22 bp, Homo sapiens
ttctgcattcaaattatgtgag

SEQ ID NO: 9295333 - DNA, 22 bp, Homo sapiens
ttctgccatttacaaatttcat

SEQ ID NO: 9295334 - DNA, 22 bp, Homo sapiens
ttctgagctgcaacactaacat

SEQ ID NO: 9295335 - DNA, 20 bp, Homo sapiens
ttctctttgggtccagagaa

SEQ ID NO: 9295336 - DNA, 22 bp, Homo sapiens
ttccctcccccagcctggcagg

SEQ ID NO: 9295337 - DNA, 22 bp, Homo sapiens
ttccctcctatgcccactgaaa

SEQ ID NO: 9295338 - DNA, 22 bp, Homo sapiens
ttccctcctatgcccactgaaa

SEQ ID NO: 9295339 - DNA, 22 bp, Homo sapiens
ttctcagaattgactgggagca

SEQ ID NO: 9295340 - DNA, 22 bp, Homo sapiens
ttctatattgttaaaggttata

SEQ ID NO: 9295341 - DNA, 22 bp, Homo sapiens
ttctatattcgcttcccaaggc

SEQ ID NO: 9295342 - DNA, 22 bp, Homo sapiens
ttctcagacttccagcaccagc

SEQ ID NO: 9295343 - DNA, 22 bp, Homo sapiens
ttctcagaattgactgggagca

SEQ ID NO: 9295344 - DNA, 22 bp, Homo sapiens
ttattttgccacaggtgacctt

SEQ ID NO: 9295345 - DNA, 23 bp, Homo sapiens
ttcaaaactggaaaatcagatgc

SEQ ID NO: 9295346 - DNA, 22 bp, Homo sapiens
ttatgttttaagtgtgtatctt

SEQ ID NO: 9295347 - DNA, 22 bp, Homo sapiens
ttatttgtggcatatgagacga

SEQ ID NO: 9295348 - DNA, 22 bp, Homo sapiens
ttatttaatgtgatctgaagag

SEQ ID NO: 9295349 - DNA, 22 bp, Homo sapiens
ttatttaatgtgatctgaagag

SEQ ID NO: 9295350 - DNA, 22 bp, Homo sapiens
ttagtgtttaaaggtttcagag

SEQ ID NO: 9295351 - DNA, 22 bp, Homo sapiens
ttagtgttagggcctgttacct

SEQ ID NO: 9295352 - DNA, 17 bp, Homo sapiens
ttagtgtatctgttttg

SEQ ID NO: 9295353 - DNA, 22 bp, Homo sapiens
tcctctggcccagctgcctctg

SEQ ID NO: 9295354 - DNA, 22 bp, Homo sapiens
tcctctggccttggaatccttt

SEQ ID NO: 9295355 - DNA, 22 bp, Homo sapiens
tcctctggctctttccctagga

SEQ ID NO: 9295356 - DNA, 22 bp, Homo sapiens
tcctctggatataagcctcacc

SEQ ID NO: 9295357 - DNA, 22 bp, Homo sapiens
tcctctccaggtgagccgaaat

SEQ ID NO: 9295358 - DNA, 22 bp, Homo sapiens
tcctcctgtttctcaggcctgg

SEQ ID NO: 9295359 - DNA, 22 bp, Homo sapiens
tcctcctgtctaccagttcctg

SEQ ID NO: 9295360 - DNA, 22 bp, Homo sapiens
ttagttgctggcagaccctagg

SEQ ID NO: 9295361 - DNA, 22 bp, Homo sapiens
ttagttgctcactacaaggtta

SEQ ID NO: 9295362 - DNA, 22 bp, Homo sapiens
ttagttgcctcagtgggcactt

SEQ ID NO: 9295363 - DNA, 22 bp, Homo sapiens
ttagttgccagtgaggaggatt

SEQ ID NO: 9295364 - DNA, 22 bp, Homo sapiens
ttagttgcatgccagacttggc

SEQ ID NO: 9295365 - DNA, 22 bp, Homo sapiens
ttagttgcaatctattgacgtt

SEQ ID NO: 9295366 - DNA, 22 bp, Homo sapiens
ttagttgatgttctggaggtag

SEQ ID NO: 9295367 - DNA, 22 bp, Homo sapiens
ttcagaataactttttattgaa

SEQ ID NO: 9295368 - DNA, 22 bp, Homo sapiens
ttcatattcaaatactctgctt

SEQ ID NO: 9295369 - DNA, 22 bp, Homo sapiens
ttcagaatgacttatgtaaggc

SEQ ID NO: 9295370 - DNA, 22 bp, Homo sapiens
ttcagaatgtactgatagaaca

SEQ ID NO: 9295371 - DNA, 22 bp, Homo sapiens
ttcagaatgtgaccttatttgg

SEQ ID NO: 9295372 - DNA, 22 bp, Homo sapiens
ttccaacaatgtgttattgttc

SEQ ID NO: 9295373 - DNA, 22 bp, Homo sapiens
ttcccctgtcacagtggttctc

SEQ ID NO: 9295374 - DNA, 22 bp, Homo sapiens
ttccccttgataatgcagtaag

SEQ ID NO: 9295375 - DNA, 22 bp, Homo sapiens
ttccatatttgtgtggcaaaag

SEQ ID NO: 9295376 - DNA, 22 bp, Homo sapiens
ttgtgcctggcttgtattcaca

SEQ ID NO: 9295377 - DNA, 22 bp, Homo sapiens
ttgtgctcctatgagaatctaa

SEQ ID NO: 9295378 - DNA, 22 bp, Homo sapiens
ttgtgctcctgtgagaatctag

SEQ ID NO: 9295379 - DNA, 22 bp, Homo sapiens
ttgttcttacttaagagtgaat

SEQ ID NO: 9295380 - DNA, 22 bp, Homo sapiens
ttgtattctgttacagcaacat

SEQ ID NO: 9295381 - DNA, 20 bp, Homo sapiens
ttgtattccttgaatcaggt

SEQ ID NO: 9295382 - DNA, 22 bp, Homo sapiens
ttgtattcctgggtcaaggaga

SEQ ID NO: 9295383 - DNA, 22 bp, Homo sapiens
ttgtattcttccttagcagtac

SEQ ID NO: 9295384 - DNA, 22 bp, Homo sapiens
ttgtattctttatgacttccct

SEQ ID NO: 9295385 - DNA, 22 bp, Homo sapiens
ttgtattcattgcttacccaat

SEQ ID NO: 9295386 - DNA, 22 bp, Homo sapiens
ttgtattccagccaccacaggc

SEQ ID NO: 9295387 - DNA, 22 bp, Homo sapiens
ttgtattcatttggccatactg

SEQ ID NO: 9295388 - DNA, 23 bp, Homo sapiens
ttgggaaatagttaagacatgag

SEQ ID NO: 9295389 - DNA, 22 bp, Homo sapiens
ttgggaagaaacatgtccatca

SEQ ID NO: 9295390 - DNA, 23 bp, Homo sapiens
ttgggaaatagttaagacatgag

SEQ ID NO: 9295391 - DNA, 22 bp, Homo sapiens
ttggcttccaggggcttttaca

SEQ ID NO: 9295392 - DNA, 22 bp, Homo sapiens
ttgggctgaggagggcgtggcc

SEQ ID NO: 9295393 - DNA, 22 bp, Homo sapiens
ttgggctggcagaggtggtctt

SEQ ID NO: 9295394 - DNA, 22 bp, Homo sapiens
ttggctctaggaaccaaagtga

SEQ ID NO: 9295395 - DNA, 22 bp, Homo sapiens
ttggcctttaaactggactttc

SEQ ID NO: 9295396 - DNA, 19 bp, Homo sapiens
ttggccttgtttcatatct

SEQ ID NO: 9295397 - DNA, 22 bp, Homo sapiens
ttggcctttattctgtacttct

SEQ ID NO: 9295398 - DNA, 22 bp, Homo sapiens
ttggcctttgctgggctgttga

SEQ ID NO: 9295399 - DNA, 22 bp, Homo sapiens
ttggcagattctgaacaaagcc

SEQ ID NO: 9295400 - DNA, 22 bp, Homo sapiens
ttggcagattcatttaataaat

SEQ ID NO: 9295401 - DNA, 22 bp, Homo sapiens
ttggcagatttgtcagtaagct

SEQ ID NO: 9295402 - DNA, 22 bp, Homo sapiens
ttggcagatggattcaacatta

SEQ ID NO: 9295403 - DNA, 22 bp, Homo sapiens
ttggcagatgaacacaactgga

SEQ ID NO: 9295404 - DNA, 22 bp, Homo sapiens
ttggcagatgaacacaactgga

SEQ ID NO: 9295405 - DNA, 22 bp, Homo sapiens
ttggcagatgagaccaggggtt

SEQ ID NO: 9295406 - DNA, 22 bp, Homo sapiens
ttggcagaggtctcgttgtggc

SEQ ID NO: 9295407 - DNA, 22 bp, Homo sapiens
ttggcagaggggtttctggtgg

SEQ ID NO: 9295408 - DNA, 22 bp, Homo sapiens
ttggcagaggggccacctgccc

SEQ ID NO: 9295409 - DNA, 22 bp, Homo sapiens
ttggcagagggaccagcctaca

SEQ ID NO: 9295410 - DNA, 22 bp, Homo sapiens
ttggcagagagtatgctgaaga

SEQ ID NO: 9295411 - DNA, 22 bp, Homo sapiens
ttggcagaggccgaggtgaaga

SEQ ID NO: 9295412 - DNA, 22 bp, Homo sapiens
ttggcagagccccagccttgga

SEQ ID NO: 9295413 - DNA, 22 bp, Homo sapiens
ttggcagagagtatgctgaaga

SEQ ID NO: 9295414 - DNA, 22 bp, Homo sapiens
ttggcagactgttttcaaaagt

SEQ ID NO: 9295415 - DNA, 22 bp, Homo sapiens
ttggcagactgacaatctgttt

SEQ ID NO: 9295416 - DNA, 22 bp, Homo sapiens
ttggcagactgggtcctgggga

SEQ ID NO: 9295417 - DNA, 22 bp, Homo sapiens
ttggccttagcttcttcttaaa

SEQ ID NO: 9295418 - DNA, 17 bp, Homo sapiens
ttggccttctagcctct

SEQ ID NO: 9295419 - DNA, 22 bp, Homo sapiens
ttggccttctcatttgcttatt

SEQ ID NO: 9295420 - DNA, 22 bp, Homo sapiens
ttggccttaacctctctgtgcc

SEQ ID NO: 9295421 - DNA, 22 bp, Homo sapiens
ttggccttgtctggtcttctcc

SEQ ID NO: 9295422 - DNA, 22 bp, Homo sapiens
ttggccttgtacatcatattaa

SEQ ID NO: 9295423 - DNA, 22 bp, Homo sapiens
ttggccttgaacatggtttagg

SEQ ID NO: 9295424 - DNA, 22 bp, Homo sapiens
ttggccttgtcacttcattact

SEQ ID NO: 9295425 - DNA, 22 bp, Homo sapiens
ttggccttctggtgttcatttt

SEQ ID NO: 9295426 - DNA, 22 bp, Homo sapiens
ttggaggcaatgggaaggaggc

SEQ ID NO: 9295427 - DNA, 18 bp, Homo sapiens
ttggaggatgtccatgaa

SEQ ID NO: 9295428 - DNA, 22 bp, Homo sapiens
ttggaagacattaaagagagtg

SEQ ID NO: 9295429 - DNA, 22 bp, Homo sapiens
ttggaagaggaaaatgagccta

SEQ ID NO: 9295430 - DNA, 22 bp, Homo sapiens
ttggaagaccagaggccttgtc

SEQ ID NO: 9295431 - DNA, 22 bp, Homo sapiens
ttggaagagagccacagttaat

SEQ ID NO: 9295432 - DNA, 22 bp, Homo sapiens
ttggcagaaaatgcttcctcag

SEQ ID NO: 9295433 - DNA, 22 bp, Homo sapiens
ttggcagaatgggcagcttgag

SEQ ID NO: 9295434 - DNA, 22 bp, Homo sapiens
ttggcagaaatgtggctgggag

SEQ ID NO: 9295435 - DNA, 22 bp, Homo sapiens
ttggcagaattaaccactgaag

SEQ ID NO: 9295436 - DNA, 23 bp, Homo sapiens
ttgcttctgtgcaattcagtact

SEQ ID NO: 9295437 - DNA, 22 bp, Homo sapiens
ttgcttgatgcttatatacttg

SEQ ID NO: 9295438 - DNA, 22 bp, Homo sapiens
ttgctttaccatttgatctcta

SEQ ID NO: 9295439 - DNA, 22 bp, Homo sapiens
ttgctttaaggtatctggagaa

SEQ ID NO: 9295440 - DNA, 23 bp, Homo sapiens
ttggaacacagtaaatgcacaat

SEQ ID NO: 9295441 - DNA, 22 bp, Homo sapiens
ttgctttatctcttatgcctca

SEQ ID NO: 9295442 - DNA, 22 bp, Homo sapiens
ttgctttatgtgtatgacttga

SEQ ID NO: 9295443 - DNA, 22 bp, Homo sapiens
ttggaacatgccggggtccagg

SEQ ID NO: 9295444 - DNA, 22 bp, Homo sapiens
ttggaacagtgtgaaaaggtta

SEQ ID NO: 9295445 - DNA, 22 bp, Homo sapiens
ttggaacatccaggacagatat

SEQ ID NO: 9295446 - DNA, 20 bp, Homo sapiens
ttggaacagtggatcagcag

SEQ ID NO: 9295447 - DNA, 22 bp, Homo sapiens
ttggaacagagccctaaggaca

SEQ ID NO: 9295448 - DNA, 22 bp, Homo sapiens
ttggaagacagtgaaacagcac

SEQ ID NO: 9295449 - DNA, 22 bp, Homo sapiens
ttggaagacagccgtctttatt

SEQ ID NO: 9295450 - DNA, 22 bp, Homo sapiens
ttggaagacaatgctgattctc

SEQ ID NO: 9295451 - DNA, 22 bp, Homo sapiens
ttggaagaaatatcaatagtgt

SEQ ID NO: 9295452 - DNA, 22 bp, Homo sapiens
ttggaacatgccggggtccagg

SEQ ID NO: 9295453 - DNA, 22 bp, Homo sapiens
ttgccatcccttacctcagtca

SEQ ID NO: 9295454 - DNA, 22 bp, Homo sapiens
ttgccagtttccctggatgtgt

SEQ ID NO: 9295455 - DNA, 22 bp, Homo sapiens
ttgcctgattagtctcagattg

SEQ ID NO: 9295456 - DNA, 22 bp, Homo sapiens
ttgctagataatctcacacact

SEQ ID NO: 9295457 - DNA, 22 bp, Homo sapiens
ttgtttaaaagaaatcatagaa

SEQ ID NO: 9295458 - DNA, 22 bp, Homo sapiens
ttgttgtcattgtagaggattt

SEQ ID NO: 9295459 - DNA, 22 bp, Homo sapiens
ttgttgaattagttgactgtgt

SEQ ID NO: 9295460 - DNA, 21 bp, Homo sapiens
ttgttcttccagaagcaaagt

SEQ ID NO: 9295461 - DNA, 21 bp, Homo sapiens
ttgttcttccagaagcaaagt

SEQ ID NO: 9295462 - DNA, 22 bp, Homo sapiens
ttgttcttggagcaggcagaga

SEQ ID NO: 9295463 - DNA, 22 bp, Homo sapiens
ttgtttaaaatgtagcaagaaa

SEQ ID NO: 9295464 - DNA, 22 bp, Homo sapiens
tttaacagatgtgaaattttca

SEQ ID NO: 9295465 - DNA, 19 bp, Homo sapiens
tttacaagttctttgtatg

SEQ ID NO: 9295466 - DNA, 22 bp, Homo sapiens
tttacactcctggaaatgatat

SEQ ID NO: 9295467 - DNA, 22 bp, Homo sapiens
tttacacttgaggaaactgagg

SEQ ID NO: 9295468 - DNA, 22 bp, Homo sapiens
tttaggaaatacaaggtagcct

SEQ ID NO: 9295469 - DNA, 21 bp, Homo sapiens
tttaggaagtttaaggcaggt

SEQ ID NO: 9295470 - DNA, 22 bp, Homo sapiens
tttatctttaggactttgcaga

SEQ ID NO: 9295471 - DNA, 22 bp, Homo sapiens
tttattggaacacagccatgac

SEQ ID NO: 9295472 - DNA, 22 bp, Homo sapiens
tttattggatatttacaagata

SEQ ID NO: 9295473 - DNA, 22 bp, Homo sapiens
tttattgtgttgaaactgaatt

SEQ ID NO: 9295474 - DNA, 22 bp, Homo sapiens
tttattgccctgtagtacagga

SEQ ID NO: 9295475 - DNA, 22 bp, Homo sapiens
tttatctttggatcttcagaaa

SEQ ID NO: 9295476 - DNA, 22 bp, Homo sapiens
tttcaagcataactgggaagag

SEQ ID NO: 9295477 - DNA, 22 bp, Homo sapiens
tttcacatgtggaatgccaggt

SEQ ID NO: 9295478 - DNA, 22 bp, Homo sapiens
tttcatctatttgctttgtgaa

SEQ ID NO: 9295479 - DNA, 17 bp, Homo sapiens
ttttgttcatcttcaaa

SEQ ID NO: 9295480 - DNA, 22 bp, Homo sapiens
ttttttacagaatcattaatca

SEQ ID NO: 9295481 - DNA, 19 bp, Homo sapiens
ttttccttctatatgtttc

SEQ ID NO: 9295482 - DNA, 18 bp, Homo sapiens
ttttccttccaccttgaa

SEQ ID NO: 9295483 - DNA, 20 bp, Homo sapiens
ttttggtgaattccagaata

SEQ ID NO: 9295484 - DNA, 22 bp, Homo sapiens
ttttcctctgagctttgaataa

SEQ ID NO: 9295485 - DNA, 22 bp, Homo sapiens
ttttcctcacctaactcaaggt

SEQ ID NO: 9295486 - DNA, 22 bp, Homo sapiens
ttttcctcaggaatgctaagct

SEQ ID NO: 9295487 - DNA, 22 bp, Homo sapiens
ttttcccatctacaaagcaggg

SEQ ID NO: 9295488 - DNA, 22 bp, Homo sapiens
tttgtccttgaatcaattcaca

SEQ ID NO: 9295489 - DNA, 22 bp, Homo sapiens
ttttattgtctcccagttctgg

SEQ ID NO: 9295490 - DNA, 22 bp, Homo sapiens
ttttattgtctgtattgcctat

SEQ ID NO: 9295491 - DNA, 22 bp, Homo sapiens
ttttattgtctgtattgcctat

SEQ ID NO: 9295492 - DNA, 22 bp, Homo sapiens
ttttattgtctgtattgcctat

SEQ ID NO: 9295493 - DNA, 22 bp, Homo sapiens
ttttattgtctcccagttctgg

SEQ ID NO: 9295494 - DNA, 22 bp, Homo sapiens
ttttattgtctcccagttctgg

SEQ ID NO: 9295495 - DNA, 22 bp, Homo sapiens
ttttattgtcaatgaagacaga

SEQ ID NO: 9295496 - DNA, 22 bp, Homo sapiens
ttttattgtcaatgaagacaga

SEQ ID NO: 9295497 - DNA, 22 bp, Homo sapiens
ttttattgtcaatgaagacaga

SEQ ID NO: 9295498 - DNA, 22 bp, Homo sapiens
ttttattgtcaatgaagacaga

SEQ ID NO: 9295499 - DNA, 16 bp, Homo sapiens
ttttattgtgacagcc

SEQ ID NO: 9295500 - DNA, 16 bp, Homo sapiens
ttttattgtgacagcc

SEQ ID NO: 9295501 - DNA, 16 bp, Homo sapiens
ttttattgtgacagcc

SEQ ID NO: 9295502 - DNA, 20 bp, Homo sapiens
ttttccactcctcaaaacag

SEQ ID NO: 9295503 - DNA, 22 bp, Homo sapiens
ttttattgggagtcctctactg

SEQ ID NO: 9295504 - DNA, 22 bp, Homo sapiens
ttttattgggagtcctctactg

SEQ ID NO: 9295505 - DNA, 22 bp, Homo sapiens
ttttattgggagtcctctactg

SEQ ID NO: 9295506 - DNA, 22 bp, Homo sapiens
ttttattgggagtcctctactg

SEQ ID NO: 9295507 - DNA, 22 bp, Homo sapiens
ttttattggtaatgataaaagt

SEQ ID NO: 9295508 - DNA, 22 bp, Homo sapiens
ttttattggtaatgataaaagt

SEQ ID NO: 9295509 - DNA, 22 bp, Homo sapiens
ttttattggtaatgataaaagt

SEQ ID NO: 9295510 - DNA, 22 bp, Homo sapiens
ttttattggtaatgataaaagt

SEQ ID NO: 9295511 - DNA, 22 bp, Homo sapiens
tttgggttagaagagctaagga

SEQ ID NO: 9295512 - DNA, 22 bp, Homo sapiens
tttgtcctctccatgtacaata

SEQ ID NO: 9295513 - DNA, 20 bp, Homo sapiens
tttgctgtgggtgtaagaat

SEQ ID NO: 9295514 - DNA, 22 bp, Homo sapiens
tttgctgtgggatatccatgtg

SEQ ID NO: 9295515 - DNA, 22 bp, Homo sapiens
tttctattggcgtcactgttgt

SEQ ID NO: 9295516 - DNA, 20 bp, Homo sapiens
tttctatggggccagcacat

SEQ ID NO: 9295517 - DNA, 22 bp, Homo sapiens
tttctataactggactggattg

SEQ ID NO: 9295518 - DNA, 17 bp, Homo sapiens
tttctagattatcctct

SEQ ID NO: 9295519 - DNA, 22 bp, Homo sapiens
tttctagctgtaggaagctgag

SEQ ID NO: 9295520 - DNA, 22 bp, Homo sapiens
tttctagatgcggggcttgtgc

SEQ ID NO: 9295521 - DNA, 21 bp, Homo sapiens
ttttttcttgcgtgaggcctg

SEQ ID NO: 9295522 - DNA, 22 bp, Homo sapiens
ttttttcctctgtgatggcaaa

SEQ ID NO: 9295523 - DNA, 20 bp, Homo sapiens
cctcaagcagactgacagct

SEQ ID NO: 9295524 - DNA, 22 bp, Homo sapiens
cctcccatggagctctgtccat

SEQ ID NO: 9295525 - DNA, 22 bp, Homo sapiens
cctctctcagcttgctgcaact

SEQ ID NO: 9295526 - DNA, 22 bp, Homo sapiens
cctctccttgcacccgtcccgc

SEQ ID NO: 9295527 - DNA, 22 bp, Homo sapiens
cctctctccaagggaaatccta

SEQ ID NO: 9295528 - DNA, 21 bp, Homo sapiens
cctctctcattgtaatgaagt

SEQ ID NO: 9295529 - DNA, 22 bp, Homo sapiens
agggaggaccaatgtgtggtta

SEQ ID NO: 9295530 - DNA, 18 bp, Homo sapiens
agggccagctgtgagtag

SEQ ID NO: 9295531 - DNA, 22 bp, Homo sapiens
agggccaggaacacctgaaggg

SEQ ID NO: 9295532 - DNA, 22 bp, Homo sapiens
agggagaggttgaaacctcagt

SEQ ID NO: 9295533 - DNA, 22 bp, Homo sapiens
agggagaaggtttagctgtgag

SEQ ID NO: 9295534 - DNA, 22 bp, Homo sapiens
agggaagggcagggtctatgca

SEQ ID NO: 9295535 - DNA, 22 bp, Homo sapiens
agggaaggcttttgacatttcc

SEQ ID NO: 9295536 - DNA, 19 bp, Homo sapiens
agggaaggattctgtcatt

SEQ ID NO: 9295537 - DNA, 22 bp, Homo sapiens
agggaaggaaaagctgtcgctt

SEQ ID NO: 9295538 - DNA, 22 bp, Homo sapiens
agggaaggaaaagctgtcgctt

SEQ ID NO: 9295539 - DNA, 22 bp, Homo sapiens
agggaagaagctggtagtaggt

SEQ ID NO: 9295540 - DNA, 22 bp, Homo sapiens
ccccatcctattcatgtttctg

SEQ ID NO: 9295541 - DNA, 22 bp, Homo sapiens
ccccatcccacctgagtgtcac

SEQ ID NO: 9295542 - DNA, 22 bp, Homo sapiens
ccccagtggaggtgagggtcct

SEQ ID NO: 9295543 - DNA, 22 bp, Homo sapiens
agggagcatgggtgaagcaggc

SEQ ID NO: 9295544 - DNA, 22 bp, Homo sapiens
cccagcctctgtttgctcctct

SEQ ID NO: 9295545 - DNA, 22 bp, Homo sapiens
aggctgtgtttcccctggagct

SEQ ID NO: 9295546 - DNA, 22 bp, Homo sapiens
cccagcatcctcagggagcggg

SEQ ID NO: 9295547 - DNA, 22 bp, Homo sapiens
cccagcatcccagtgggcagca

SEQ ID NO: 9295548 - DNA, 18 bp, Homo sapiens
aggcaggtgctaatattt

SEQ ID NO: 9295549 - DNA, 22 bp, Homo sapiens
aggcaggttggtgagaagactg

SEQ ID NO: 9295550 - DNA, 22 bp, Homo sapiens
aggcaggtttactcttatttgg

SEQ ID NO: 9295551 - DNA, 22 bp, Homo sapiens
aggcaggtttcccggctgtcaa

SEQ ID NO: 9295552 - DNA, 23 bp, Homo sapiens
aggcaggtttgggctcttcttgt

SEQ ID NO: 9295553 - DNA, 22 bp, Homo sapiens
aggcagtggagctggaataggc

SEQ ID NO: 9295554 - DNA, 22 bp, Homo sapiens
aggcagtgcagagtcctcttct

SEQ ID NO: 9295555 - DNA, 22 bp, Homo sapiens
aggcagttggtcattgctcttt

SEQ ID NO: 9295556 - DNA, 22 bp, Homo sapiens
aggcatctgagtttgcaagctt

SEQ ID NO: 9295557 - DNA, 22 bp, Homo sapiens
ccactggagactggtctctgtg

SEQ ID NO: 9295558 - DNA, 22 bp, Homo sapiens
ccactggagaacgtctgatgaa

SEQ ID NO: 9295559 - DNA, 22 bp, Homo sapiens
ccactggattttcttactgtag

SEQ ID NO: 9295560 - DNA, 22 bp, Homo sapiens
aggccccaaagcagtgcaagta

SEQ ID NO: 9295561 - DNA, 22 bp, Homo sapiens
aggccctgaagtcggcccctca

SEQ ID NO: 9295562 - DNA, 22 bp, Homo sapiens
aggccgtgtgagcatgtgtgag

SEQ ID NO: 9295563 - DNA, 22 bp, Homo sapiens
aggcccagtagtgctgccttta

SEQ ID NO: 9295564 - DNA, 22 bp, Homo sapiens
aggcccagtgccattagttttg

SEQ ID NO: 9295565 - DNA, 22 bp, Homo sapiens
aggcccagtcctctgccgtctg

SEQ ID NO: 9295566 - DNA, 22 bp, Homo sapiens
aggcattttgttcaagatgaca

SEQ ID NO: 9295567 - DNA, 22 bp, Homo sapiens
aggccaaagcaagaccctgtaa

SEQ ID NO: 9295568 - DNA, 18 bp, Homo sapiens
aggccaaacttgtaagca

SEQ ID NO: 9295569 - DNA, 22 bp, Homo sapiens
aggccaaaccggatggaaaagg

SEQ ID NO: 9295570 - DNA, 20 bp, Homo sapiens
aggccaaacccagcgcgccc

SEQ ID NO: 9295571 - DNA, 16 bp, Homo sapiens
aggccaaaaaggggca

SEQ ID NO: 9295572 - DNA, 22 bp, Homo sapiens
aggccaaagcacagagctggaa

SEQ ID NO: 9295573 - DNA, 22 bp, Homo sapiens
aggccaaagctcacctgcagct

SEQ ID NO: 9295574 - DNA, 22 bp, Homo sapiens
aggccaaagtgctccttttaga

SEQ ID NO: 9295575 - DNA, 22 bp, Homo sapiens
aggccaaatgtgtataaaacat

SEQ ID NO: 9295576 - DNA, 22 bp, Homo sapiens
aggccaaattgatcatctttag

SEQ ID NO: 9295577 - DNA, 22 bp, Homo sapiens
aggccaagtgctgggacaggtg

SEQ ID NO: 9295578 - DNA, 22 bp, Homo sapiens
aggccaagtgctgggacaggtg

SEQ ID NO: 9295579 - DNA, 22 bp, Homo sapiens
aggccagatgtcgggctagaag

SEQ ID NO: 9295580 - DNA, 22 bp, Homo sapiens
ccaggccctgctcctcacacca

SEQ ID NO: 9295581 - DNA, 22 bp, Homo sapiens
ccaggccctgctcctcacacca

SEQ ID NO: 9295582 - DNA, 22 bp, Homo sapiens
aggcctccagccacatgccagt

SEQ ID NO: 9295583 - DNA, 19 bp, Homo sapiens
aggctctgagctcctggag

SEQ ID NO: 9295584 - DNA, 20 bp, Homo sapiens
aggctctgcatttctgagtg

SEQ ID NO: 9295585 - DNA, 22 bp, Homo sapiens
aggctctgcagtgctggaggac

SEQ ID NO: 9295586 - DNA, 22 bp, Homo sapiens
aggctctgcagtccatcccgtg

SEQ ID NO: 9295587 - DNA, 22 bp, Homo sapiens
aggctctgcagaccccagctgt

SEQ ID NO: 9295588 - DNA, 22 bp, Homo sapiens
aggctgagactgtgcattagtg

SEQ ID NO: 9295589 - DNA, 22 bp, Homo sapiens
aggctctgccaattccttcctc

SEQ ID NO: 9295590 - DNA, 23 bp, Homo sapiens
ccagtgattgcctggaaggaggt

SEQ ID NO: 9295591 - DNA, 22 bp, Homo sapiens
ccagtctgtactttgctctgtt

SEQ ID NO: 9295592 - DNA, 22 bp, Homo sapiens
aggctgagcggggtcccagagc

SEQ ID NO: 9295593 - DNA, 22 bp, Homo sapiens
ccagttgggatttgtcctggtt

SEQ ID NO: 9295594 - DNA, 20 bp, Homo sapiens
ccagtttctttcccagcctc

SEQ ID NO: 9295595 - DNA, 22 bp, Homo sapiens
ccagtttaagacttatctcaat

SEQ ID NO: 9295596 - DNA, 22 bp, Homo sapiens
ccagtgtgcaatctctggctta

SEQ ID NO: 9295597 - DNA, 22 bp, Homo sapiens
aggcagcatttctgcttatcca

SEQ ID NO: 9295598 - DNA, 22 bp, Homo sapiens
catttacatttaaggttaatat

SEQ ID NO: 9295599 - DNA, 22 bp, Homo sapiens
aggcagcagaggttgaggaaag

SEQ ID NO: 9295600 - DNA, 22 bp, Homo sapiens
catttacagcagactgatgaaa

SEQ ID NO: 9295601 - DNA, 22 bp, Homo sapiens
cattccaagtatatacatgata

SEQ ID NO: 9295602 - DNA, 22 bp, Homo sapiens
cattcccatgactcctgctcag

SEQ ID NO: 9295603 - DNA, 22 bp, Homo sapiens
cattcccacgtgttctttgctt

SEQ ID NO: 9295604 - DNA, 22 bp, Homo sapiens
cattcccacgtgttctttgctt

SEQ ID NO: 9295605 - DNA, 22 bp, Homo sapiens
cattcatttgcccagtaagtca

SEQ ID NO: 9295606 - DNA, 22 bp, Homo sapiens
cattcctattatgtccctagtg

SEQ ID NO: 9295607 - DNA, 22 bp, Homo sapiens
cattccgctccccttccttgcg

SEQ ID NO: 9295608 - DNA, 22 bp, Homo sapiens
cattatctcttctatatgctag

SEQ ID NO: 9295609 - DNA, 22 bp, Homo sapiens
aggcacaggaacaggaaaagag

SEQ ID NO: 9295610 - DNA, 22 bp, Homo sapiens
aggcacaggaggtggtaagaag

SEQ ID NO: 9295611 - DNA, 22 bp, Homo sapiens
aggcacaggaggtggtaagaag

SEQ ID NO: 9295612 - DNA, 22 bp, Homo sapiens
catgcctgtaatcccagcactt

SEQ ID NO: 9295613 - DNA, 22 bp, Homo sapiens
catgaaatgttagaattagaca

SEQ ID NO: 9295614 - DNA, 22 bp, Homo sapiens
aggaagctggtgtgaggatgaa

SEQ ID NO: 9295615 - DNA, 22 bp, Homo sapiens
aggaagctgcctgggatgggaa

SEQ ID NO: 9295616 - DNA, 22 bp, Homo sapiens
cagtctcttgcttcattagttg

SEQ ID NO: 9295617 - DNA, 22 bp, Homo sapiens
cagtctctttatccaccaagcc

SEQ ID NO: 9295618 - DNA, 22 bp, Homo sapiens
cagtctctttatccaccaagcc

SEQ ID NO: 9295619 - DNA, 22 bp, Homo sapiens
cagtctctgtcatctcatggga

SEQ ID NO: 9295620 - DNA, 22 bp, Homo sapiens
cagtctctgtcatctcatggga

SEQ ID NO: 9295621 - DNA, 22 bp, Homo sapiens
cagtctctggtgagttgacagt

SEQ ID NO: 9295622 - DNA, 22 bp, Homo sapiens
cagtctctgggaaagaggacag

SEQ ID NO: 9295623 - DNA, 22 bp, Homo sapiens
cagtctctgccacttctaagct

SEQ ID NO: 9295624 - DNA, 22 bp, Homo sapiens
cagtctctctccttgcaggcgt

SEQ ID NO: 9295625 - DNA, 22 bp, Homo sapiens
aggacagcccttgagagcacat

SEQ ID NO: 9295626 - DNA, 22 bp, Homo sapiens
aggagctgtgaatgggaggggt

SEQ ID NO: 9295627 - DNA, 20 bp, Homo sapiens
aggagctgaattagagggtt

SEQ ID NO: 9295628 - DNA, 22 bp, Homo sapiens
aggagagaatgttccaggcttg

SEQ ID NO: 9295629 - DNA, 22 bp, Homo sapiens
aggagagagctgagctttgctg

SEQ ID NO: 9295630 - DNA, 22 bp, Homo sapiens
aggagagaggttttaaatgggg

SEQ ID NO: 9295631 - DNA, 22 bp, Homo sapiens
aggagagagaacacttgggtcc

SEQ ID NO: 9295632 - DNA, 22 bp, Homo sapiens
aggagagaattactgggtgtca

SEQ ID NO: 9295633 - DNA, 22 bp, Homo sapiens
aggagaggctctaactctgtgt

SEQ ID NO: 9295634 - DNA, 22 bp, Homo sapiens
aggagaggcatcaagaaaatcg

SEQ ID NO: 9295635 - DNA, 22 bp, Homo sapiens
aggagaggtctcccttccccag

SEQ ID NO: 9295636 - DNA, 22 bp, Homo sapiens
aggagcctggctggcccacagg

SEQ ID NO: 9295637 - DNA, 22 bp, Homo sapiens
aggagctcaaagatgccaggag

SEQ ID NO: 9295638 - DNA, 22 bp, Homo sapiens
aggagctcattgaagtggatga

SEQ ID NO: 9295639 - DNA, 22 bp, Homo sapiens
cagctctcacacttagcttcta

SEQ ID NO: 9295640 - DNA, 22 bp, Homo sapiens
cagctctcacaccctcctccca

SEQ ID NO: 9295641 - DNA, 22 bp, Homo sapiens
cagctctctaaggtcttgcttt

SEQ ID NO: 9295642 - DNA, 22 bp, Homo sapiens
cagcttctgctcatggaggggt

SEQ ID NO: 9295643 - DNA, 22 bp, Homo sapiens
cagcttctgtcctagaaactgg

SEQ ID NO: 9295644 - DNA, 22 bp, Homo sapiens
agctgaggccacgagtgaaggg

SEQ ID NO: 9295645 - DNA, 22 bp, Homo sapiens
agctgcaggcctctcctgggga

SEQ ID NO: 9295646 - DNA, 22 bp, Homo sapiens
agctgcagtaaagctctccagg

SEQ ID NO: 9295647 - DNA, 22 bp, Homo sapiens
agctgcagtatgaggctggtgg

SEQ ID NO: 9295648 - DNA, 22 bp, Homo sapiens
cagctttttagaatctagggca

SEQ ID NO: 9295649 - DNA, 22 bp, Homo sapiens
cagcttttaggactgtgagaaa

SEQ ID NO: 9295650 - DNA, 22 bp, Homo sapiens
cagcttttgcagacttcttgcc

SEQ ID NO: 9295651 - DNA, 22 bp, Homo sapiens
caggacagagcccagactgtgt

SEQ ID NO: 9295652 - DNA, 22 bp, Homo sapiens
agctggaggataactcacttct

SEQ ID NO: 9295653 - DNA, 23 bp, Homo sapiens
agctggaggctgtctactcccaa

SEQ ID NO: 9295654 - DNA, 22 bp, Homo sapiens
agctggcatactttgctaggaa

SEQ ID NO: 9295655 - DNA, 22 bp, Homo sapiens
caggaggttggtagcagtagat

SEQ ID NO: 9295656 - DNA, 22 bp, Homo sapiens
caggaggttgtaagagcaggcc

SEQ ID NO: 9295657 - DNA, 22 bp, Homo sapiens
caggaggttgtaagagcaggcc

SEQ ID NO: 9295658 - DNA, 22 bp, Homo sapiens
caggaggttgagggtgcagtga

SEQ ID NO: 9295659 - DNA, 22 bp, Homo sapiens
caggaggtacatagattcagat

SEQ ID NO: 9295660 - DNA, 22 bp, Homo sapiens
caggaggtgacttccaggggtt

SEQ ID NO: 9295661 - DNA, 22 bp, Homo sapiens
caggagtccctctggccagcat

SEQ ID NO: 9295662 - DNA, 22 bp, Homo sapiens
agctgggaagactggaagacag

SEQ ID NO: 9295663 - DNA, 22 bp, Homo sapiens
agcttgagttttggatgaagtg

SEQ ID NO: 9295664 - DNA, 22 bp, Homo sapiens
agcttgggtgtgcctgcgagct

SEQ ID NO: 9295665 - DNA, 22 bp, Homo sapiens
agcttacagttcaatgacaaag

SEQ ID NO: 9295666 - DNA, 22 bp, Homo sapiens
agctgtttatgcactcctgcct

SEQ ID NO: 9295667 - DNA, 21 bp, Homo sapiens
agctgtttgaagctatattgg

SEQ ID NO: 9295668 - DNA, 22 bp, Homo sapiens
agctgttttctaatgcatttga

SEQ ID NO: 9295669 - DNA, 22 bp, Homo sapiens
agctgttttcttgccgtcctag

SEQ ID NO: 9295670 - DNA, 22 bp, Homo sapiens
cagggccagccgcagcatccac

SEQ ID NO: 9295671 - DNA, 22 bp, Homo sapiens
cagggccagcccgacgtggtgc

SEQ ID NO: 9295672 - DNA, 22 bp, Homo sapiens
cagggccagcccactagcgagg

SEQ ID NO: 9295673 - DNA, 22 bp, Homo sapiens
cagggccagccatcctgctggg

SEQ ID NO: 9295674 - DNA, 22 bp, Homo sapiens
aggaaagcaatggctgagaaca

SEQ ID NO: 9295675 - DNA, 22 bp, Homo sapiens
aggaaagatggaaggaggataa

SEQ ID NO: 9295676 - DNA, 22 bp, Homo sapiens
aggaaagactggggccccagaa

SEQ ID NO: 9295677 - DNA, 22 bp, Homo sapiens
aggaaagctcccagtagggctc

SEQ ID NO: 9295678 - DNA, 22 bp, Homo sapiens
agctttatataaaagagtacat

SEQ ID NO: 9295679 - DNA, 22 bp, Homo sapiens
agctttatataaaagagtacat

SEQ ID NO: 9295680 - DNA, 22 bp, Homo sapiens
agctttatatgttgtttctcca

SEQ ID NO: 9295681 - DNA, 22 bp, Homo sapiens
agctttatagaaaggatcagtg

SEQ ID NO: 9295682 - DNA, 21 bp, Homo sapiens
agcttgtgtgtatcacagtgt

SEQ ID NO: 9295683 - DNA, 22 bp, Homo sapiens
aggaactggatataatgtgaga

SEQ ID NO: 9295684 - DNA, 22 bp, Homo sapiens
aggaactgatgagcagccaggg

SEQ ID NO: 9295685 - DNA, 22 bp, Homo sapiens
aggaactctgtctccagagttg

SEQ ID NO: 9295686 - DNA, 22 bp, Homo sapiens
aggaagctcggagagggcaaat

SEQ ID NO: 9295687 - DNA, 22 bp, Homo sapiens
aggaactggggctattcaccct

SEQ ID NO: 9295688 - DNA, 22 bp, Homo sapiens
aggaactggtgaagtgtagtga

SEQ ID NO: 9295689 - DNA, 18 bp, Homo sapiens
aggaagcaggaggaaggc

SEQ ID NO: 9295690 - DNA, 22 bp, Homo sapiens
cggggttcatccatgctgtggc

SEQ ID NO: 9295691 - DNA, 22 bp, Homo sapiens
cgggtaggaacaaagagctgca

SEQ ID NO: 9295692 - DNA, 23 bp, Homo sapiens
cgggtaggaacatcaggatgtga

SEQ ID NO: 9295693 - DNA, 22 bp, Homo sapiens
agtatcattttggcattagtat

SEQ ID NO: 9295694 - DNA, 22 bp, Homo sapiens
ctcagagtccccacatctgggt

SEQ ID NO: 9295695 - DNA, 22 bp, Homo sapiens
ctcagctacgctttcaccagct

SEQ ID NO: 9295696 - DNA, 22 bp, Homo sapiens
ctcagctgcagcctggctggca

SEQ ID NO: 9295697 - DNA, 22 bp, Homo sapiens
agtctctaggatcagacaccca

SEQ ID NO: 9295698 - DNA, 22 bp, Homo sapiens
agtctctagtcatttcacctct

SEQ ID NO: 9295699 - DNA, 22 bp, Homo sapiens
agtctctatgttcctgcaatat

SEQ ID NO: 9295700 - DNA, 23 bp, Homo sapiens
agtctctatggcaattcctttac

SEQ ID NO: 9295701 - DNA, 22 bp, Homo sapiens
agtgacaacaagttgactagaa

SEQ ID NO: 9295702 - DNA, 22 bp, Homo sapiens
ctcagtgggaggagtcagttgc

SEQ ID NO: 9295703 - DNA, 22 bp, Homo sapiens
agtggtgctgcgcgcggagctc

SEQ ID NO: 9295704 - DNA, 22 bp, Homo sapiens
agtggtgcccacctgagcctga

SEQ ID NO: 9295705 - DNA, 22 bp, Homo sapiens
agtggtgcaaactggggcagct

SEQ ID NO: 9295706 - DNA, 22 bp, Homo sapiens
agtggtgtcgtgggagtggaag

SEQ ID NO: 9295707 - DNA, 22 bp, Homo sapiens
ctctgtctatcccattctgtgc

SEQ ID NO: 9295708 - DNA, 22 bp, Homo sapiens
ctctgtcctccacctgctttca

SEQ ID NO: 9295709 - DNA, 22 bp, Homo sapiens
ctcttagatatggagaattacc

SEQ ID NO: 9295710 - DNA, 22 bp, Homo sapiens
ctcttgggatttgcaggctcag

SEQ ID NO: 9295711 - DNA, 22 bp, Homo sapiens
ctctgtatgaatcatatggagt

SEQ ID NO: 9295712 - DNA, 22 bp, Homo sapiens
ctctgtatagaaaggaaacatt

SEQ ID NO: 9295713 - DNA, 22 bp, Homo sapiens
ctctgtatagaaaggaaacatt

SEQ ID NO: 9295714 - DNA, 22 bp, Homo sapiens
agtgggaaactggagagacttc

SEQ ID NO: 9295715 - DNA, 22 bp, Homo sapiens
ctctggagaggttcccatggga

SEQ ID NO: 9295716 - DNA, 20 bp, Homo sapiens
ctctctccatctcagtggcc

SEQ ID NO: 9295717 - DNA, 22 bp, Homo sapiens
ctctggaccctcctgctgagag

SEQ ID NO: 9295718 - DNA, 22 bp, Homo sapiens
ctcctgagtagtagcattgtca

SEQ ID NO: 9295719 - DNA, 22 bp, Homo sapiens
agtgctgaggagaggtactcca

SEQ ID NO: 9295720 - DNA, 22 bp, Homo sapiens
ctcctgaggaaaagcttggtca

SEQ ID NO: 9295721 - DNA, 22 bp, Homo sapiens
ctcctgaggacttctattgggt

SEQ ID NO: 9295722 - DNA, 22 bp, Homo sapiens
ctctcccagtcaggctcaggat

SEQ ID NO: 9295723 - DNA, 20 bp, Homo sapiens
ctctcccagcacagcttcct

SEQ ID NO: 9295724 - DNA, 22 bp, Homo sapiens
ctctcctttactgcagagagcg

SEQ ID NO: 9295725 - DNA, 22 bp, Homo sapiens
ctctccccacaccctctgcatg

SEQ ID NO: 9295726 - DNA, 19 bp, Homo sapiens
ctctctccagtggctggct

SEQ ID NO: 9295727 - DNA, 22 bp, Homo sapiens
ctcggcaggtggaggttgtagt

SEQ ID NO: 9295728 - DNA, 22 bp, Homo sapiens
ctctccatctgtgtgacctccc

SEQ ID NO: 9295729 - DNA, 22 bp, Homo sapiens
ccttctctgcaggtagttggct

SEQ ID NO: 9295730 - DNA, 22 bp, Homo sapiens
aggtggcttctggccaggtgtg

SEQ ID NO: 9295731 - DNA, 22 bp, Homo sapiens
aggtggctgtattcagctgtaa

SEQ ID NO: 9295732 - DNA, 22 bp, Homo sapiens
aggtggggctgggaaagattcc

SEQ ID NO: 9295733 - DNA, 22 bp, Homo sapiens
aggtgggggctgtgtccttgac

SEQ ID NO: 9295734 - DNA, 22 bp, Homo sapiens
ccttggctaggcagcggctgtc

SEQ ID NO: 9295735 - DNA, 22 bp, Homo sapiens
ccttggctaaactcaatccagc

SEQ ID NO: 9295736 - DNA, 22 bp, Homo sapiens
ccttggattttgtgcccacgcc

SEQ ID NO: 9295737 - DNA, 22 bp, Homo sapiens
ccttgctcaagctagtgacggg

SEQ ID NO: 9295738 - DNA, 19 bp, Homo sapiens
ccttgcctgtccctgcagc

SEQ ID NO: 9295739 - DNA, 22 bp, Homo sapiens
cctgggagaactgctgggttgg

SEQ ID NO: 9295740 - DNA, 22 bp, Homo sapiens
aggtgcctatctggtctctgca

SEQ ID NO: 9295741 - DNA, 22 bp, Homo sapiens
aggtgcctgggagctccctgag

SEQ ID NO: 9295742 - DNA, 20 bp, Homo sapiens
aggtggctcttcctgggctt

SEQ ID NO: 9295743 - DNA, 22 bp, Homo sapiens
aggtggctctgacagctctggt

SEQ ID NO: 9295744 - DNA, 19 bp, Homo sapiens
aggtgctggtgagggtgtt

SEQ ID NO: 9295745 - DNA, 22 bp, Homo sapiens
aggtgctgttggcagcgggcag

SEQ ID NO: 9295746 - DNA, 22 bp, Homo sapiens
aggtgctgaactggtgaggtct

SEQ ID NO: 9295747 - DNA, 22 bp, Homo sapiens
ccttttaagggagactagagat

SEQ ID NO: 9295748 - DNA, 22 bp, Homo sapiens
aggtggggtgagctgcagacta

SEQ ID NO: 9295749 - DNA, 22 bp, Homo sapiens
aggtggggtgagctgcagacta

SEQ ID NO: 9295750 - DNA, 22 bp, Homo sapiens
aggtggggtgagctgcagacta

SEQ ID NO: 9295751 - DNA, 22 bp, Homo sapiens
aggtggggtgttggatgtttat

SEQ ID NO: 9295752 - DNA, 22 bp, Homo sapiens
ccttttataaagttgtattgaa

SEQ ID NO: 9295753 - DNA, 20 bp, Homo sapiens
cgaggccaaggggctgggcc

SEQ ID NO: 9295754 - DNA, 21 bp, Homo sapiens
cggccaaattcctcctaggga

SEQ ID NO: 9295755 - DNA, 22 bp, Homo sapiens
cggccagtgccgctctcgcctc

SEQ ID NO: 9295756 - DNA, 22 bp, Homo sapiens
cctggcagctccgtggccttcc

SEQ ID NO: 9295757 - DNA, 22 bp, Homo sapiens
cctggcagctaagtgctttgag

SEQ ID NO: 9295758 - DNA, 22 bp, Homo sapiens
cctggcagctcctccccggcgg

SEQ ID NO: 9295759 - DNA, 22 bp, Homo sapiens
cctggctggtggcagcgacaag

SEQ ID NO: 9295760 - DNA, 22 bp, Homo sapiens
cctggcagcccagagcgccgct

SEQ ID NO: 9295761 - DNA, 22 bp, Homo sapiens
cctggcagcctcagccaattct

SEQ ID NO: 9295762 - DNA, 22 bp, Homo sapiens
cctggcagcgtgccgagctgcg

SEQ ID NO: 9295763 - DNA, 22 bp, Homo sapiens
cctggcagcgccgaagctggcc

SEQ ID NO: 9295764 - DNA, 22 bp, Homo sapiens
cctgctcttatagctgtttcca

SEQ ID NO: 9295765 - DNA, 22 bp, Homo sapiens
cctgctctgccaagtcctcttt

SEQ ID NO: 9295766 - DNA, 22 bp, Homo sapiens
cctgctctggtttagtcagtct

SEQ ID NO: 9295767 - DNA, 22 bp, Homo sapiens
cctgctctagactctgggaagg

SEQ ID NO: 9295768 - DNA, 22 bp, Homo sapiens
cctgctctaaatctcatggaac

SEQ ID NO: 9295769 - DNA, 22 bp, Homo sapiens
cctgcctggcttccagaagaga

SEQ ID NO: 9295770 - DNA, 22 bp, Homo sapiens
cctgctctagactctgggaagg

SEQ ID NO: 9295771 - DNA, 22 bp, Homo sapiens
cctgcccaggagtctctctgtg

SEQ ID NO: 9295772 - DNA, 22 bp, Homo sapiens
cctgccaggacattgcttgaag

SEQ ID NO: 9295773 - DNA, 19 bp, Homo sapiens
cctctgccagcccgcctct

SEQ ID NO: 9295774 - DNA, 22 bp, Homo sapiens
cctctgccacctcccacgaggc

SEQ ID NO: 9295775 - DNA, 22 bp, Homo sapiens
cctctctcttgtagtccctgcc

SEQ ID NO: 9295776 - DNA, 22 bp, Homo sapiens
cctctctctgcatctggagggc

SEQ ID NO: 9295777 - DNA, 22 bp, Homo sapiens
cctctctccttcctttgccaaa

SEQ ID NO: 9295778 - DNA, 22 bp, Homo sapiens
cctctctctcctgcacacacac

SEQ ID NO: 9295779 - DNA, 22 bp, Homo sapiens
cctctctccaattttcacctca

SEQ ID NO: 9295780 - DNA, 22 bp, Homo sapiens
cctctctccaattttcacctca

SEQ ID NO: 9295781 - DNA, 23 bp, Homo sapiens
cctctctccctgtttggcaaata

SEQ ID NO: 9295782 - DNA, 22 bp, Homo sapiens
cctctgccacctcccacgaggc

SEQ ID NO: 9295783 - DNA, 22 bp, Homo sapiens
agggtcagagatcggccatgtg

SEQ ID NO: 9295784 - DNA, 21 bp, Homo sapiens
agggtcaggaaccagggtacc

SEQ ID NO: 9295785 - DNA, 19 bp, Homo sapiens
agggtcaggacaaggactt

SEQ ID NO: 9295786 - DNA, 22 bp, Homo sapiens
agggtcagctggctgtcagggg

SEQ ID NO: 9295787 - DNA, 20 bp, Homo sapiens
agggtcagtagcacagagct

SEQ ID NO: 9295788 - DNA, 22 bp, Homo sapiens
agggtcaggagacactggcaac

SEQ ID NO: 9295789 - DNA, 22 bp, Homo sapiens
agttctttatatattagggata

SEQ ID NO: 9295790 - DNA, 22 bp, Homo sapiens
agttggaagacaccctgaaatc

SEQ ID NO: 9295791 - DNA, 22 bp, Homo sapiens
agttggcactgagctgtgattg

SEQ ID NO: 9295792 - DNA, 23 bp, Homo sapiens
agttggcatattcaagcacagtc

SEQ ID NO: 9295793 - DNA, 22 bp, Homo sapiens
agttgggagttatagactctat

SEQ ID NO: 9295794 - DNA, 19 bp, Homo sapiens
agttggggcagggaagaga

SEQ ID NO: 9295795 - DNA, 22 bp, Homo sapiens
ctgaggcaggagagttgcttga

SEQ ID NO: 9295796 - DNA, 22 bp, Homo sapiens
ctgaggcaggagaattgctgga

SEQ ID NO: 9295797 - DNA, 22 bp, Homo sapiens
ctgaggcatgaatgtgggcttt

SEQ ID NO: 9295798 - DNA, 22 bp, Homo sapiens
ctgaggcaggggcagctggaga

SEQ ID NO: 9295799 - DNA, 20 bp, Homo sapiens
ctgaggggtctgacttggac

SEQ ID NO: 9295800 - DNA, 22 bp, Homo sapiens
ctgagggtcaacttgattgtat

SEQ ID NO: 9295801 - DNA, 22 bp, Homo sapiens
ctgaggctttgtgtgcatgcct

SEQ ID NO: 9295802 - DNA, 22 bp, Homo sapiens
agtttaatatccttcaactttc

SEQ ID NO: 9295803 - DNA, 22 bp, Homo sapiens
ctgcagctatattttcccacag

SEQ ID NO: 9295804 - DNA, 20 bp, Homo sapiens
ataaaataactgccacaaga

SEQ ID NO: 9295805 - DNA, 22 bp, Homo sapiens
ataaaagtctgcttatttgggc

SEQ ID NO: 9295806 - DNA, 22 bp, Homo sapiens
ataaatatcactgttgtccctc

SEQ ID NO: 9295807 - DNA, 22 bp, Homo sapiens
ctgccaggactgacgtcttcag

SEQ ID NO: 9295808 - DNA, 22 bp, Homo sapiens
ctggagggctggactaaggaaa

SEQ ID NO: 9295809 - DNA, 22 bp, Homo sapiens
ctggagggctgcagcgaggctg

SEQ ID NO: 9295810 - DNA, 22 bp, Homo sapiens
atactttagagctagattgcct

SEQ ID NO: 9295811 - DNA, 22 bp, Homo sapiens
ctggagggagattcaaaggagg

SEQ ID NO: 9295812 - DNA, 22 bp, Homo sapiens
ctggaggaaaacaactgcagac

SEQ ID NO: 9295813 - DNA, 22 bp, Homo sapiens
ctggagagaccgaaagaggctg

SEQ ID NO: 9295814 - DNA, 22 bp, Homo sapiens
ctgctttaagaatgagtgtaag

SEQ ID NO: 9295815 - DNA, 22 bp, Homo sapiens
ctgctttaactctgggaagcca

SEQ ID NO: 9295816 - DNA, 22 bp, Homo sapiens
ctgctttaagtattcaacaaag

SEQ ID NO: 9295817 - DNA, 22 bp, Homo sapiens
ctgctttaacagatgatggtgt

SEQ ID NO: 9295818 - DNA, 22 bp, Homo sapiens
ctgctttaacaaggctgatcag

SEQ ID NO: 9295819 - DNA, 22 bp, Homo sapiens
ctgctttaaaaccctcagctgg

SEQ ID NO: 9295820 - DNA, 22 bp, Homo sapiens
ctgctttaaaactgatacatga

SEQ ID NO: 9295821 - DNA, 22 bp, Homo sapiens
ctgctttaatttagacaaggca

SEQ ID NO: 9295822 - DNA, 22 bp, Homo sapiens
ctgctttaatgtaagatatacc

SEQ ID NO: 9295823 - DNA, 22 bp, Homo sapiens
ctgctttaatccctgcctggaa

SEQ ID NO: 9295824 - DNA, 22 bp, Homo sapiens
ctgctttaatggaaagtgtttt

SEQ ID NO: 9295825 - DNA, 22 bp, Homo sapiens
ataatatttgcattactgtgat

SEQ ID NO: 9295826 - DNA, 22 bp, Homo sapiens
ctgctctgagaggctcttccta

SEQ ID NO: 9295827 - DNA, 22 bp, Homo sapiens
ctgctctgcaaggcacagtgat

SEQ ID NO: 9295828 - DNA, 22 bp, Homo sapiens
ctgctctgcagcttggactccc

SEQ ID NO: 9295829 - DNA, 22 bp, Homo sapiens
ctgctctgcagcttggactccc

SEQ ID NO: 9295830 - DNA, 22 bp, Homo sapiens
ctgctctgctgatcagtgtctc

SEQ ID NO: 9295831 - DNA, 20 bp, Homo sapiens
ctgctctgctttgcaggtgg

SEQ ID NO: 9295832 - DNA, 22 bp, Homo sapiens
ctgctctggcgtactcggcatc

SEQ ID NO: 9295833 - DNA, 22 bp, Homo sapiens
ctgctctggctgtgtacttcag

SEQ ID NO: 9295834 - DNA, 22 bp, Homo sapiens
ataatacatggttgatcttttc

SEQ ID NO: 9295835 - DNA, 22 bp, Homo sapiens
ctgcccagaatcactcactcga

SEQ ID NO: 9295836 - DNA, 22 bp, Homo sapiens
atatggcaaaggggaattaagg

SEQ ID NO: 9295837 - DNA, 22 bp, Homo sapiens
atatggcagaccaattagaagc

SEQ ID NO: 9295838 - DNA, 22 bp, Homo sapiens
atatgacagcggattcacatat

SEQ ID NO: 9295839 - DNA, 19 bp, Homo sapiens
atatatgtatacaatgtgg

SEQ ID NO: 9295840 - DNA, 20 bp, Homo sapiens
atatttcttaagaactttca

SEQ ID NO: 9295841 - DNA, 22 bp, Homo sapiens
atatttcttgagcacctggtat

SEQ ID NO: 9295842 - DNA, 20 bp, Homo sapiens
ctgggcacctgtctgcagtt

SEQ ID NO: 9295843 - DNA, 22 bp, Homo sapiens
ctgggcacacagtgactctgca

SEQ ID NO: 9295844 - DNA, 22 bp, Homo sapiens
ctgggcacagaccccctgggcc

SEQ ID NO: 9295845 - DNA, 22 bp, Homo sapiens
ctgggcacaagtggccctggat

SEQ ID NO: 9295846 - DNA, 22 bp, Homo sapiens
atatatactttgacacattctg

SEQ ID NO: 9295847 - DNA, 22 bp, Homo sapiens
atataatacaacctgctaagtg

SEQ ID NO: 9295848 - DNA, 20 bp, Homo sapiens
atataataaattttggttac

SEQ ID NO: 9295849 - DNA, 22 bp, Homo sapiens
atataactcttgttcttatagt

SEQ ID NO: 9295850 - DNA, 20 bp, Homo sapiens
atataataaattttggttac

SEQ ID NO: 9295851 - DNA, 22 bp, Homo sapiens
ctgggacacagccttacctggg

SEQ ID NO: 9295852 - DNA, 22 bp, Homo sapiens
ctgggacaagctctgtctagct

SEQ ID NO: 9295853 - DNA, 22 bp, Homo sapiens
atataacatacatacagaaaag

SEQ ID NO: 9295854 - DNA, 23 bp, Homo sapiens
atcccctgccttgggtgagtccc

SEQ ID NO: 9295855 - DNA, 22 bp, Homo sapiens
atcctttataagacttgtattc

SEQ ID NO: 9295856 - DNA, 22 bp, Homo sapiens
atcctttaagttaataaaattc

SEQ ID NO: 9295857 - DNA, 22 bp, Homo sapiens
atcctctgtggattacacctag

SEQ ID NO: 9295858 - DNA, 22 bp, Homo sapiens
atctaattttcactcatttgct

SEQ ID NO: 9295859 - DNA, 22 bp, Homo sapiens
atcatgttgtatgtaatctttt

SEQ ID NO: 9295860 - DNA, 22 bp, Homo sapiens
atcatgttggctctgacaaaaa

SEQ ID NO: 9295861 - DNA, 22 bp, Homo sapiens
ctgtcctctgtcctcagcagga

SEQ ID NO: 9295862 - DNA, 22 bp, Homo sapiens
ctgtcctccagacgacagtccc

SEQ ID NO: 9295863 - DNA, 22 bp, Homo sapiens
ctgtcctccggccacctacagt

SEQ ID NO: 9295864 - DNA, 22 bp, Homo sapiens
ctgtcctccagacgacagtccc

SEQ ID NO: 9295865 - DNA, 22 bp, Homo sapiens
ctgtcctcatctgccccaaggg

SEQ ID NO: 9295866 - DNA, 21 bp, Homo sapiens
ctgtcctcagatgtggacgag

SEQ ID NO: 9295867 - DNA, 22 bp, Homo sapiens
ctgtcctcaccttggcaggggg

SEQ ID NO: 9295868 - DNA, 22 bp, Homo sapiens
atcacatatttaagaaacatgt

SEQ ID NO: 9295869 - DNA, 22 bp, Homo sapiens
ctgggtcccctcagtgacactg

SEQ ID NO: 9295870 - DNA, 22 bp, Homo sapiens
ctgtcctcaacccatccttctc

SEQ ID NO: 9295871 - DNA, 22 bp, Homo sapiens
ctgggtagctgctgctccttca

SEQ ID NO: 9295872 - DNA, 22 bp, Homo sapiens
ctgggtagggcaaggaactggc

SEQ ID NO: 9295873 - DNA, 22 bp, Homo sapiens
ctgggtagaagattcctcagga

SEQ ID NO: 9295874 - DNA, 22 bp, Homo sapiens
atcatgtaccctaaaaatggaa

SEQ ID NO: 9295875 - DNA, 22 bp, Homo sapiens
atcatgtacttgacaaatatgt

SEQ ID NO: 9295876 - DNA, 22 bp, Homo sapiens
atcatgtgtaatttcaagctac

SEQ ID NO: 9295877 - DNA, 22 bp, Homo sapiens
atcatgttcatcgtatttaggc

SEQ ID NO: 9295878 - DNA, 22 bp, Homo sapiens
ctgtgagttcattgtgccacct

SEQ ID NO: 9295879 - DNA, 22 bp, Homo sapiens
ctgtgagttcattgtgccacct

SEQ ID NO: 9295880 - DNA, 22 bp, Homo sapiens
ctgtctctgttgcctgtaggtg

SEQ ID NO: 9295881 - DNA, 22 bp, Homo sapiens
ctgtctctgtcttaactcccag

SEQ ID NO: 9295882 - DNA, 22 bp, Homo sapiens
ctgtctgttttaccttctccag

SEQ ID NO: 9295883 - DNA, 22 bp, Homo sapiens
cagcattgatcccaggctgtgg

SEQ ID NO: 9295884 - DNA, 22 bp, Homo sapiens
cagcatttagaatttgaagtgt

SEQ ID NO: 9295885 - DNA, 22 bp, Homo sapiens
cagcattttccatagaaagaag

SEQ ID NO: 9295886 - DNA, 22 bp, Homo sapiens
gtatttggtctatttggcatcc

SEQ ID NO: 9295887 - DNA, 22 bp, Homo sapiens
cagcattttcttaatgtaggtg

SEQ ID NO: 9295888 - DNA, 22 bp, Homo sapiens
cagccaagaaccacagacccag

SEQ ID NO: 9295889 - DNA, 22 bp, Homo sapiens
gggtgggactgaagtctgaggg

SEQ ID NO: 9295890 - DNA, 22 bp, Homo sapiens
gggtgggagaaatgagtatcta

SEQ ID NO: 9295891 - DNA, 22 bp, Homo sapiens
gggtgggactctttggcctgag

SEQ ID NO: 9295892 - DNA, 22 bp, Homo sapiens
gggtgggaaggctaagggattg

SEQ ID NO: 9295893 - DNA, 22 bp, Homo sapiens
ggtgggacaggtaggagtggct

SEQ ID NO: 9295894 - DNA, 22 bp, Homo sapiens
gggtgggagtctggccctcaaa

SEQ ID NO: 9295895 - DNA, 22 bp, Homo sapiens
ggtggggctaggacctcaggat

SEQ ID NO: 9295896 - DNA, 21 bp, Homo sapiens
gggtgggaggacacagcaggc

SEQ ID NO: 9295897 - DNA, 20 bp, Homo sapiens
gggtgggagagtctgagggt

SEQ ID NO: 9295898 - DNA, 22 bp, Homo sapiens
ggtgggggagacttggtcaaga

SEQ ID NO: 9295899 - DNA, 22 bp, Homo sapiens
ggtggggctcagcaatctgtgt

SEQ ID NO: 9295900 - DNA, 22 bp, Homo sapiens
ggtggggctgcaagcagttcgg

SEQ ID NO: 9295901 - DNA, 22 bp, Homo sapiens
ggtggggctcagcaatctgtgt

SEQ ID NO: 9295902 - DNA, 22 bp, Homo sapiens
ggtggggctgcaagcagttcgg

SEQ ID NO: 9295903 - DNA, 22 bp, Homo sapiens
ggtgggtaaaactgctggcact

SEQ ID NO: 9295904 - DNA, 22 bp, Homo sapiens
ggtgggtatagttagggcctct

SEQ ID NO: 9295905 - DNA, 22 bp, Homo sapiens
cagcaaggactgggcatgtgaa

SEQ ID NO: 9295906 - DNA, 22 bp, Homo sapiens
cagcaaggccattggatgcagt

SEQ ID NO: 9295907 - DNA, 22 bp, Homo sapiens
ggttcccggatctccgagtccc

SEQ ID NO: 9295908 - DNA, 22 bp, Homo sapiens
ggttctaggattaggaggccca

SEQ ID NO: 9295909 - DNA, 22 bp, Homo sapiens
ggttccttctgaggtccctgta

SEQ ID NO: 9295910 - DNA, 22 bp, Homo sapiens
ggttgcaaactcctgggatcaa

SEQ ID NO: 9295911 - DNA, 22 bp, Homo sapiens
cagcaggcccagagtttcatgg

SEQ ID NO: 9295912 - DNA, 22 bp, Homo sapiens
gtatgaaaattgtaaagttctt

SEQ ID NO: 9295913 - DNA, 22 bp, Homo sapiens
cagcagagctgtgtgggaaggg

SEQ ID NO: 9295914 - DNA, 22 bp, Homo sapiens
gtagggataggtgtccagagac

SEQ ID NO: 9295915 - DNA, 22 bp, Homo sapiens
gtagggagcccagagcccagtg

SEQ ID NO: 9295916 - DNA, 22 bp, Homo sapiens
gtagggatggaagccatgaaat

SEQ ID NO: 9295917 - DNA, 22 bp, Homo sapiens
gtagggcaacatgggcactagg

SEQ ID NO: 9295918 - DNA, 20 bp, Homo sapiens
gggaggccagcctcagagaa

SEQ ID NO: 9295919 - DNA, 17 bp, Homo sapiens
cagacaggctgtcaccc

SEQ ID NO: 9295920 - DNA, 22 bp, Homo sapiens
cagacagggacctcgctccaga

SEQ ID NO: 9295921 - DNA, 22 bp, Homo sapiens
cagacaggggtaaccttcctca

SEQ ID NO: 9295922 - DNA, 22 bp, Homo sapiens
cagacagggccctgtgatggta

SEQ ID NO: 9295923 - DNA, 22 bp, Homo sapiens
gggcaatggtcacatagagtga

SEQ ID NO: 9295924 - DNA, 22 bp, Homo sapiens
cagaagttttgctctcttgggt

SEQ ID NO: 9295925 - DNA, 22 bp, Homo sapiens
cagaagtttgaatgagagcctg

SEQ ID NO: 9295926 - DNA, 22 bp, Homo sapiens
cagaagttgccacatgaccctt

SEQ ID NO: 9295927 - DNA, 22 bp, Homo sapiens
cagaagttctttcatataggct

SEQ ID NO: 9295928 - DNA, 22 bp, Homo sapiens
cagaagttagtgtctgccagta

SEQ ID NO: 9295929 - DNA, 22 bp, Homo sapiens
cagaagttagtcttaattataa

SEQ ID NO: 9295930 - DNA, 22 bp, Homo sapiens
cagaagttatgtcaatggtcat

SEQ ID NO: 9295931 - DNA, 22 bp, Homo sapiens
cagacaggaattctggcgtggt

SEQ ID NO: 9295932 - DNA, 22 bp, Homo sapiens
cagacaggagactggatcatgg

SEQ ID NO: 9295933 - DNA, 22 bp, Homo sapiens
cagacaggcaggtgagagctcc

SEQ ID NO: 9295934 - DNA, 22 bp, Homo sapiens
cagacaggcaggtgctgctttg

SEQ ID NO: 9295935 - DNA, 22 bp, Homo sapiens
cagacaggctagccagactcac

SEQ ID NO: 9295936 - DNA, 19 bp, Homo sapiens
gggagcaggaaagctgtgg

SEQ ID NO: 9295937 - DNA, 22 bp, Homo sapiens
ggcttttgctgtgttttccaga

SEQ ID NO: 9295938 - DNA, 22 bp, Homo sapiens
gggacagaaggaagtgagcaca

SEQ ID NO: 9295939 - DNA, 22 bp, Homo sapiens
gggacagacccatgggccaggt

SEQ ID NO: 9295940 - DNA, 22 bp, Homo sapiens
gggacagaaggaagtgagcaca

SEQ ID NO: 9295941 - DNA, 22 bp, Homo sapiens
gggacagaggcaaactagcaga

SEQ ID NO: 9295942 - DNA, 22 bp, Homo sapiens
gggacagacccatgggccaggt

SEQ ID NO: 9295943 - DNA, 22 bp, Homo sapiens
gggactggcacagggctgggag

SEQ ID NO: 9295944 - DNA, 22 bp, Homo sapiens
gggactggatagatgtgggtga

SEQ ID NO: 9295945 - DNA, 19 bp, Homo sapiens
gggactggaggatgtggag

SEQ ID NO: 9295946 - DNA, 22 bp, Homo sapiens
gggactggaactactggtgcag

SEQ ID NO: 9295947 - DNA, 22 bp, Homo sapiens
gggacaatggaggcctctctcc

SEQ ID NO: 9295948 - DNA, 22 bp, Homo sapiens
gggaaggagcctgcttgctaga

SEQ ID NO: 9295949 - DNA, 22 bp, Homo sapiens
gggaaggacattctgggctcag

SEQ ID NO: 9295950 - DNA, 22 bp, Homo sapiens
gggaaggaggtggacctgcccc

SEQ ID NO: 9295951 - DNA, 22 bp, Homo sapiens
gggaaggacacagccatgactg

SEQ ID NO: 9295952 - DNA, 23 bp, Homo sapiens
gggaaaggatatgatcctagggg

SEQ ID NO: 9295953 - DNA, 22 bp, Homo sapiens
ggggaagaatgctctctagaga

SEQ ID NO: 9295954 - DNA, 22 bp, Homo sapiens
cagaggtttgatcgagtaggtc

SEQ ID NO: 9295955 - DNA, 22 bp, Homo sapiens
cagaggctgggacctcaggcat

SEQ ID NO: 9295956 - DNA, 22 bp, Homo sapiens
gggtcgggcaggcgccctcgtc

SEQ ID NO: 9295957 - DNA, 22 bp, Homo sapiens
gggtgctgactggggcctgaaa

SEQ ID NO: 9295958 - DNA, 22 bp, Homo sapiens
gggtgctcctggcggcctcttt

SEQ ID NO: 9295959 - DNA, 22 bp, Homo sapiens
gggtgctcatggataaggcgaa

SEQ ID NO: 9295960 - DNA, 22 bp, Homo sapiens
cagagctgcacattctatgatg

SEQ ID NO: 9295961 - DNA, 22 bp, Homo sapiens
gggctgtgtactatgaggaggg

SEQ ID NO: 9295962 - DNA, 22 bp, Homo sapiens
gggctgtgtactatgaggaggg

SEQ ID NO: 9295963 - DNA, 22 bp, Homo sapiens
ggggaacaccgggcagaggcgc

SEQ ID NO: 9295964 - DNA, 22 bp, Homo sapiens
gggcactgtggggcccatgctg

SEQ ID NO: 9295965 - DNA, 22 bp, Homo sapiens
gggcactgtgttcagagtgcag

SEQ ID NO: 9295966 - DNA, 22 bp, Homo sapiens
gggcactgtgctgggtgcttta

SEQ ID NO: 9295967 - DNA, 22 bp, Homo sapiens
gggcactgtgctaggtgctgag

SEQ ID NO: 9295968 - DNA, 22 bp, Homo sapiens
gggccttgatcccctatatggc

SEQ ID NO: 9295969 - DNA, 23 bp, Homo sapiens
cacaaaggttccattctctcacc

SEQ ID NO: 9295970 - DNA, 23 bp, Homo sapiens
cacaaaggttccattctctcacc

SEQ ID NO: 9295971 - DNA, 22 bp, Homo sapiens
cacaaaggagaatgtcagcata

SEQ ID NO: 9295972 - DNA, 22 bp, Homo sapiens
cacaatgtatatgtatatcaaa

SEQ ID NO: 9295973 - DNA, 21 bp, Homo sapiens
ggaaaattccatacacccacg

SEQ ID NO: 9295974 - DNA, 22 bp, Homo sapiens
cacaactttaggaaccacattc

SEQ ID NO: 9295975 - DNA, 21 bp, Homo sapiens
ggaaaattcagagtgcaattt

SEQ ID NO: 9295976 - DNA, 22 bp, Homo sapiens
cacacatttcagatgctacaat

SEQ ID NO: 9295977 - DNA, 22 bp, Homo sapiens
cacacctgtaataccagctact

SEQ ID NO: 9295978 - DNA, 22 bp, Homo sapiens
cacaatttgttttatcagtatt

SEQ ID NO: 9295979 - DNA, 22 bp, Homo sapiens
cacaatttggtgctaaagaaag

SEQ ID NO: 9295980 - DNA, 22 bp, Homo sapiens
gctgtctgagaacatggtggaa

SEQ ID NO: 9295981 - DNA, 22 bp, Homo sapiens
caaggattaatagaatgaatca

SEQ ID NO: 9295982 - DNA, 22 bp, Homo sapiens
gcttggcatttgctgggagctg

SEQ ID NO: 9295983 - DNA, 22 bp, Homo sapiens
cacaaaagtaggaggcaggcgg

SEQ ID NO: 9295984 - DNA, 22 bp, Homo sapiens
gcttgggaagggccctgtgtac

SEQ ID NO: 9295985 - DNA, 22 bp, Homo sapiens
caaccccactacacgttggaga

SEQ ID NO: 9295986 - DNA, 22 bp, Homo sapiens
caagacaagatctaagcatgct

SEQ ID NO: 9295987 - DNA, 22 bp, Homo sapiens
caagacaagatctaagcatgct

SEQ ID NO: 9295988 - DNA, 22 bp, Homo sapiens
gctgctggcatctagggggtgg

SEQ ID NO: 9295989 - DNA, 22 bp, Homo sapiens
gctgctggcactggagtgagcc

SEQ ID NO: 9295990 - DNA, 22 bp, Homo sapiens
caagagctcaccggagagcatt

SEQ ID NO: 9295991 - DNA, 22 bp, Homo sapiens
gctgctggagctttgcagaagg

SEQ ID NO: 9295992 - DNA, 22 bp, Homo sapiens
gctgccttttgctcctcccacc

SEQ ID NO: 9295993 - DNA, 22 bp, Homo sapiens
gctgctggagagcgagactgtt

SEQ ID NO: 9295994 - DNA, 22 bp, Homo sapiens
caagagctttagaaatgctcat

SEQ ID NO: 9295995 - DNA, 22 bp, Homo sapiens
caagatgaaactacagggagga

SEQ ID NO: 9295996 - DNA, 22 bp, Homo sapiens
caagatgatccctgaaggcagc

SEQ ID NO: 9295997 - DNA, 22 bp, Homo sapiens
caaggaggaagatgcaggggac

SEQ ID NO: 9295998 - DNA, 22 bp, Homo sapiens
caaggagataaaatgttgagct

SEQ ID NO: 9295999 - DNA, 22 bp, Homo sapiens
caaggagagtaattgaatgaga

SEQ ID NO: 9296000 - DNA, 22 bp, Homo sapiens
caaggagaaaacggcttctgaa

SEQ ID NO: 9296001 - DNA, 22 bp, Homo sapiens
caagatgcccctggtagggatc

SEQ ID NO: 9296002 - DNA, 22 bp, Homo sapiens
caacattcaaccaacatttatg

SEQ ID NO: 9296003 - DNA, 22 bp, Homo sapiens
caacatcagtcctcatgagaca

SEQ ID NO: 9296004 - DNA, 22 bp, Homo sapiens
caacatataatatttgagttct

SEQ ID NO: 9296005 - DNA, 22 bp, Homo sapiens
gctgcagtgagccaagatcgtg

SEQ ID NO: 9296006 - DNA, 22 bp, Homo sapiens
gctgcatggagggtgcccagga

SEQ ID NO: 9296007 - DNA, 20 bp, Homo sapiens
gctgaggtggaggaaggaga

SEQ ID NO: 9296008 - DNA, 22 bp, Homo sapiens
gctgaggtggaggaaggagacc

SEQ ID NO: 9296009 - DNA, 22 bp, Homo sapiens
gctgcagcagaagttctcagag

SEQ ID NO: 9296010 - DNA, 22 bp, Homo sapiens
gctgcagccaaattcattgtca

SEQ ID NO: 9296011 - DNA, 22 bp, Homo sapiens
cacagtggtttccgattcagac

SEQ ID NO: 9296012 - DNA, 22 bp, Homo sapiens
cacagtggctttgctggtctcg

SEQ ID NO: 9296013 - DNA, 22 bp, Homo sapiens
cacagtggcaggtgtgggttgt

SEQ ID NO: 9296014 - DNA, 22 bp, Homo sapiens
cacagtggattgggtgatgccc

SEQ ID NO: 9296015 - DNA, 18 bp, Homo sapiens
ggcactgctgttcccctt

SEQ ID NO: 9296016 - DNA, 22 bp, Homo sapiens
ggcactgctgtaggcagtgagg

SEQ ID NO: 9296017 - DNA, 22 bp, Homo sapiens
ggcactgcttcctgagcctgag

SEQ ID NO: 9296018 - DNA, 22 bp, Homo sapiens
ggcacagggggctgaggactag

SEQ ID NO: 9296019 - DNA, 22 bp, Homo sapiens
ggcacagtgattaagagccagt

SEQ ID NO: 9296020 - DNA, 22 bp, Homo sapiens
ggatgttctggggttctcttgt

SEQ ID NO: 9296021 - DNA, 22 bp, Homo sapiens
cacagggaggcggtcactggct

SEQ ID NO: 9296022 - DNA, 22 bp, Homo sapiens
ggatccttaactatcacagtga

SEQ ID NO: 9296023 - DNA, 22 bp, Homo sapiens
ggatgggaacttggtagggcat

SEQ ID NO: 9296024 - DNA, 22 bp, Homo sapiens
cacagcttctgagtgaggattt

SEQ ID NO: 9296025 - DNA, 22 bp, Homo sapiens
cacagcttgggctctgacaata

SEQ ID NO: 9296026 - DNA, 20 bp, Homo sapiens
cacagcttgccttttatgac

SEQ ID NO: 9296027 - DNA, 22 bp, Homo sapiens
ggaggccaaggcaggtggatcg

SEQ ID NO: 9296028 - DNA, 22 bp, Homo sapiens
cacagcttgggctctgacaata

SEQ ID NO: 9296029 - DNA, 22 bp, Homo sapiens
cacactgtcaggtaaataacac

SEQ ID NO: 9296030 - DNA, 22 bp, Homo sapiens
cacagctggtgcactagctctg

SEQ ID NO: 9296031 - DNA, 22 bp, Homo sapiens
cacagcttccattagaatgaga

SEQ ID NO: 9296032 - DNA, 22 bp, Homo sapiens
cacagcttatgccactgattgg

SEQ ID NO: 9296033 - DNA, 22 bp, Homo sapiens
cactgcagccacatagatgacg

SEQ ID NO: 9296034 - DNA, 22 bp, Homo sapiens
ggcctctcagggcagagaccct

SEQ ID NO: 9296035 - DNA, 22 bp, Homo sapiens
ggcctctcatgcccagagccaa

SEQ ID NO: 9296036 - DNA, 22 bp, Homo sapiens
ggctatgggaagatggcagggg

SEQ ID NO: 9296037 - DNA, 22 bp, Homo sapiens
ggctatggaaatggcaggacat

SEQ ID NO: 9296038 - DNA, 22 bp, Homo sapiens
ggctcaagcagtctgcctgcct

SEQ ID NO: 9296039 - DNA, 22 bp, Homo sapiens
cactgcagtcttcatcaaccaa

SEQ ID NO: 9296040 - DNA, 22 bp, Homo sapiens
cactgcccaactgttttccaaa

SEQ ID NO: 9296041 - DNA, 22 bp, Homo sapiens
cactgcccaccaagtggctggt

SEQ ID NO: 9296042 - DNA, 22 bp, Homo sapiens
cactgcccactccttcgtccaa

SEQ ID NO: 9296043 - DNA, 22 bp, Homo sapiens
ggctagggactcctcctcaggg

SEQ ID NO: 9296044 - DNA, 22 bp, Homo sapiens
cacccaggctggaatgcagtgg

SEQ ID NO: 9296045 - DNA, 22 bp, Homo sapiens
cacccaggttggagtgcagtgg

SEQ ID NO: 9296046 - DNA, 22 bp, Homo sapiens
cacccaggctagagtgcagtgg

SEQ ID NO: 9296047 - DNA, 17 bp, Homo sapiens
caccctggctagtctga

SEQ ID NO: 9296048 - DNA, 22 bp, Homo sapiens
caccctagctgtcatttcagtt

SEQ ID NO: 9296049 - DNA, 22 bp, Homo sapiens
cacccacattccatcactctgc

SEQ ID NO: 9296050 - DNA, 22 bp, Homo sapiens
cacccacatggaaattcacagt

SEQ ID NO: 9296051 - DNA, 22 bp, Homo sapiens
ggcagctgacctagcaccatcc

SEQ ID NO: 9296052 - DNA, 22 bp, Homo sapiens
caccaggctggagtgcagtggc

SEQ ID NO: 9296053 - DNA, 22 bp, Homo sapiens
gcgcactgggcgcacgcgtagg

SEQ ID NO: 9296054 - DNA, 22 bp, Homo sapiens
gcgcagctttgtaaagatctgg

SEQ ID NO: 9296055 - DNA, 22 bp, Homo sapiens
caaactttcagttataacatga

SEQ ID NO: 9296056 - DNA, 22 bp, Homo sapiens
gctcaggaaacagcagggcttg

SEQ ID NO: 9296057 - DNA, 22 bp, Homo sapiens
gcctggaggaatgtagctgagg

SEQ ID NO: 9296058 - DNA, 22 bp, Homo sapiens
gcctggagctcatgtgggcatt

SEQ ID NO: 9296059 - DNA, 22 bp, Homo sapiens
gcctggagctactggacactga

SEQ ID NO: 9296060 - DNA, 22 bp, Homo sapiens
gcctggagctctccacttgggg

SEQ ID NO: 9296061 - DNA, 22 bp, Homo sapiens
gcctggagctcggctgagggcg

SEQ ID NO: 9296062 - DNA, 18 bp, Homo sapiens
gcctgcctagagcttgcc

SEQ ID NO: 9296063 - DNA, 18 bp, Homo sapiens
gcctgctctgctctcccc

SEQ ID NO: 9296064 - DNA, 22 bp, Homo sapiens
gcctctcctcttaataccatta

SEQ ID NO: 9296065 - DNA, 22 bp, Homo sapiens
atttattggatgcttacttggg

SEQ ID NO: 9296066 - DNA, 22 bp, Homo sapiens
atttattggatgcttacttggg

SEQ ID NO: 9296067 - DNA, 22 bp, Homo sapiens
atttattgagcctttcctatgt

SEQ ID NO: 9296068 - DNA, 22 bp, Homo sapiens
atttattggtttgcatggtgaa

SEQ ID NO: 9296069 - DNA, 22 bp, Homo sapiens
atttattggatgcttacttggg

SEQ ID NO: 9296070 - DNA, 22 bp, Homo sapiens
atttattgagcctttcctatgt

SEQ ID NO: 9296071 - DNA, 22 bp, Homo sapiens
atttattgagagggaggggaat

SEQ ID NO: 9296072 - DNA, 22 bp, Homo sapiens
atttattgagagggaggggaat

SEQ ID NO: 9296073 - DNA, 22 bp, Homo sapiens
atttattgagacttaacaaccc

SEQ ID NO: 9296074 - DNA, 22 bp, Homo sapiens
atttattgagacttaacaaccc

SEQ ID NO: 9296075 - DNA, 22 bp, Homo sapiens
atttcagcccagtatgagcccc

SEQ ID NO: 9296076 - DNA, 22 bp, Homo sapiens
atttcagtagaaaatcttgatt

SEQ ID NO: 9296077 - DNA, 22 bp, Homo sapiens
attggaaagttcttaagggata

SEQ ID NO: 9296078 - DNA, 22 bp, Homo sapiens
attggaaatacagtagaaaaat

SEQ ID NO: 9296079 - DNA, 22 bp, Homo sapiens
attggaaatactgagagataaa

SEQ ID NO: 9296080 - DNA, 19 bp, Homo sapiens
attggagcagaaaggtggt

SEQ ID NO: 9296081 - DNA, 22 bp, Homo sapiens
attggagccccagaagcaaggt

SEQ ID NO: 9296082 - DNA, 22 bp, Homo sapiens
attggaagtatttcatcaaaag

SEQ ID NO: 9296083 - DNA, 22 bp, Homo sapiens
atttaatttacatttgacagag

SEQ ID NO: 9296084 - DNA, 22 bp, Homo sapiens
attggcagagctttacaggcta

SEQ ID NO: 9296085 - DNA, 22 bp, Homo sapiens
attggcagaaacagcagggcca

SEQ ID NO: 9296086 - DNA, 21 bp, Homo sapiens
attggcagatctctggattgt

SEQ ID NO: 9296087 - DNA, 22 bp, Homo sapiens
attggcagccagacccagttct

SEQ ID NO: 9296088 - DNA, 22 bp, Homo sapiens
atttaatgggtagacattgtta

SEQ ID NO: 9296089 - DNA, 22 bp, Homo sapiens
atttaatttggagagagaaacc

SEQ ID NO: 9296090 - DNA, 22 bp, Homo sapiens
atttaatttggagagagaaacc

SEQ ID NO: 9296091 - DNA, 22 bp, Homo sapiens
atttaattttctcaacagtgct

SEQ ID NO: 9296092 - DNA, 22 bp, Homo sapiens
atttaattttctcaacagtgct

SEQ ID NO: 9296093 - DNA, 17 bp, Homo sapiens
gccaggaggtttgagct

SEQ ID NO: 9296094 - DNA, 20 bp, Homo sapiens
gccaggagggtgtgatgagc

SEQ ID NO: 9296095 - DNA, 22 bp, Homo sapiens
atttagaaattccaaaagtatt

SEQ ID NO: 9296096 - DNA, 22 bp, Homo sapiens
attatttatcctcttggtctat

SEQ ID NO: 9296097 - DNA, 22 bp, Homo sapiens
gcagagctgtctaagtcacttc

SEQ ID NO: 9296098 - DNA, 22 bp, Homo sapiens
gcagagctggtacttgagcctg

SEQ ID NO: 9296099 - DNA, 20 bp, Homo sapiens
gcagagctgttctgtgggga

SEQ ID NO: 9296100 - DNA, 22 bp, Homo sapiens
gcagagctgttaatggagctga

SEQ ID NO: 9296101 - DNA, 22 bp, Homo sapiens
gcagagctgttaatggagctga

SEQ ID NO: 9296102 - DNA, 18 bp, Homo sapiens
gcagagctgggattccca

SEQ ID NO: 9296103 - DNA, 22 bp, Homo sapiens
gcagagctgcagcgaggcctgg

SEQ ID NO: 9296104 - DNA, 23 bp, Homo sapiens
gcagagctgccctattgccttgg

SEQ ID NO: 9296105 - DNA, 22 bp, Homo sapiens
gcagcagggtgccagctttgca

SEQ ID NO: 9296106 - DNA, 22 bp, Homo sapiens
attccttctattctctgtgggt

SEQ ID NO: 9296107 - DNA, 22 bp, Homo sapiens
attcctcatttgttgagaacca

SEQ ID NO: 9296108 - DNA, 22 bp, Homo sapiens
attctattaatatttctaggaa

SEQ ID NO: 9296109 - DNA, 22 bp, Homo sapiens
attctattttttaagaagtagt

SEQ ID NO: 9296110 - DNA, 22 bp, Homo sapiens
attctgtcatttcaagaaaaac

SEQ ID NO: 9296111 - DNA, 22 bp, Homo sapiens
attctgtctttttaaaataata

SEQ ID NO: 9296112 - DNA, 22 bp, Homo sapiens
attctgtcattacaaaaggcag

SEQ ID NO: 9296113 - DNA, 22 bp, Homo sapiens
attcttcactgtttcagaatga

SEQ ID NO: 9296114 - DNA, 22 bp, Homo sapiens
attcttcaccatggataatttg

SEQ ID NO: 9296115 - DNA, 22 bp, Homo sapiens
attcttaattgccatgctgtat

SEQ ID NO: 9296116 - DNA, 22 bp, Homo sapiens
attcttcagaatatctggcact

SEQ ID NO: 9296117 - DNA, 22 bp, Homo sapiens
attattcttgaggtgtttattg

SEQ ID NO: 9296118 - DNA, 22 bp, Homo sapiens
attattcaatcatattaaaagt

SEQ ID NO: 9296119 - DNA, 22 bp, Homo sapiens
attattcaatgttatttcagtg

SEQ ID NO: 9296120 - DNA, 21 bp, Homo sapiens
gcaaggcttttgtgtttccca

SEQ ID NO: 9296121 - DNA, 22 bp, Homo sapiens
gcaaggctttgtgaattttaaa

SEQ ID NO: 9296122 - DNA, 22 bp, Homo sapiens
attaatgagcttctgcactcat

SEQ ID NO: 9296123 - DNA, 22 bp, Homo sapiens
attaatgaaactttggttaagc

SEQ ID NO: 9296124 - DNA, 22 bp, Homo sapiens
gcaaggctgtgcactttgcatt

SEQ ID NO: 9296125 - DNA, 22 bp, Homo sapiens
gcaaggctgctgccacccatct

SEQ ID NO: 9296126 - DNA, 22 bp, Homo sapiens
gcaaggctgagcacatttgcat

SEQ ID NO: 9296127 - DNA, 22 bp, Homo sapiens
attacaaaagaagggagaaggt

SEQ ID NO: 9296128 - DNA, 22 bp, Homo sapiens
attacaagtagactaactttca

SEQ ID NO: 9296129 - DNA, 22 bp, Homo sapiens
atgtgttttggtggatcattca

SEQ ID NO: 9296130 - DNA, 22 bp, Homo sapiens
atgttttatgttccactcaagg

SEQ ID NO: 9296131 - DNA, 22 bp, Homo sapiens
atgttttaccctttgcacaaac

SEQ ID NO: 9296132 - DNA, 22 bp, Homo sapiens
gatgaggctagagacatgtgta

SEQ ID NO: 9296133 - DNA, 18 bp, Homo sapiens
gatgaggctgtctgagaa

SEQ ID NO: 9296134 - DNA, 22 bp, Homo sapiens
gatgaggctgtagagggtggca

SEQ ID NO: 9296135 - DNA, 22 bp, Homo sapiens
atgcatttatgtgtgtacattg

SEQ ID NO: 9296136 - DNA, 22 bp, Homo sapiens
atgatacaagcaaaactaatca

SEQ ID NO: 9296137 - DNA, 15 bp, Homo sapiens
atgaggcatttgggg

SEQ ID NO: 9296138 - DNA, 22 bp, Homo sapiens
atgaggcaggagcggggaccct

SEQ ID NO: 9296139 - DNA, 22 bp, Homo sapiens
atgaggcaggaaaggcgtatct

SEQ ID NO: 9296140 - DNA, 22 bp, Homo sapiens
atgaggcagctggctttctccc

SEQ ID NO: 9296141 - DNA, 22 bp, Homo sapiens
atgaggcagctgctggagaacg

SEQ ID NO: 9296142 - DNA, 22 bp, Homo sapiens
atgaggcagctgacagctgttc

SEQ ID NO: 9296143 - DNA, 22 bp, Homo sapiens
atgaggcaggattaagctatca

SEQ ID NO: 9296144 - DNA, 22 bp, Homo sapiens
atgaggcaggagtgcagtggca

SEQ ID NO: 9296145 - DNA, 22 bp, Homo sapiens
atgaggcaggatattaactttt

SEQ ID NO: 9296146 - DNA, 22 bp, Homo sapiens
atgaggcagtacacacaaagcc

SEQ ID NO: 9296147 - DNA, 22 bp, Homo sapiens
gaaagatatttattggcaacag

SEQ ID NO: 9296148 - DNA, 22 bp, Homo sapiens
atgaggcaggtggaggctgcca

SEQ ID NO: 9296149 - DNA, 22 bp, Homo sapiens
atgaggcagatgttgcatgagg

SEQ ID NO: 9296150 - DNA, 22 bp, Homo sapiens
atgaggcagcacatgggattgt

SEQ ID NO: 9296151 - DNA, 22 bp, Homo sapiens
atgaggcagcccttcccttctc

SEQ ID NO: 9296152 - DNA, 22 bp, Homo sapiens
atgaggcagagggctgtgccag

SEQ ID NO: 9296153 - DNA, 22 bp, Homo sapiens
cttgtttaagccgctgttaagc

SEQ ID NO: 9296154 - DNA, 22 bp, Homo sapiens
atgaaatgtatgagtctgggtt

SEQ ID NO: 9296155 - DNA, 23 bp, Homo sapiens
atgaaatgctggctcagggaggt

SEQ ID NO: 9296156 - DNA, 22 bp, Homo sapiens
atgaaatgaagttggcctggct

SEQ ID NO: 9296157 - DNA, 18 bp, Homo sapiens
cttgctgagggcctcatt

SEQ ID NO: 9296158 - DNA, 22 bp, Homo sapiens
cttgctgagataaatgctgtct

SEQ ID NO: 9296159 - DNA, 22 bp, Homo sapiens
atctacagtgcacaggacagcc

SEQ ID NO: 9296160 - DNA, 22 bp, Homo sapiens
atctacaggctgaggtgggagg

SEQ ID NO: 9296161 - DNA, 22 bp, Homo sapiens
atctacaggattttacagagtt

SEQ ID NO: 9296162 - DNA, 22 bp, Homo sapiens
atctacaggattttacagagtt

SEQ ID NO: 9296163 - DNA, 22 bp, Homo sapiens
atctacaggaagagaaagggcc

SEQ ID NO: 9296164 - DNA, 22 bp, Homo sapiens
atctacagcagtgccaggtagc

SEQ ID NO: 9296165 - DNA, 22 bp, Homo sapiens
atctacagctgtctgcacagta

SEQ ID NO: 9296166 - DNA, 22 bp, Homo sapiens
cttggcatgttcatctgcttgg

SEQ ID NO: 9296167 - DNA, 22 bp, Homo sapiens
cttggcattgtgttgatagaag

SEQ ID NO: 9296168 - DNA, 22 bp, Homo sapiens
cttggcagggtggaggatgcag

SEQ ID NO: 9296169 - DNA, 22 bp, Homo sapiens
cttggcagtttcggaaggatga

SEQ ID NO: 9296170 - DNA, 22 bp, Homo sapiens
cttggcagctacacaggtaaga

SEQ ID NO: 9296171 - DNA, 22 bp, Homo sapiens
cttggcagcttttggaggagcc

SEQ ID NO: 9296172 - DNA, 22 bp, Homo sapiens
cttggcagagggctgggctcag

SEQ ID NO: 9296173 - DNA, 22 bp, Homo sapiens
cttggctctgtgttgatgggac

SEQ ID NO: 9296174 - DNA, 22 bp, Homo sapiens
cttggctccttcacagggagat

SEQ ID NO: 9296175 - DNA, 22 bp, Homo sapiens
cttggctccaatcccagctctg

SEQ ID NO: 9296176 - DNA, 22 bp, Homo sapiens
cttggctcgtacccggggcagg

SEQ ID NO: 9296177 - DNA, 22 bp, Homo sapiens
cttggtgcattactcaatctgt

SEQ ID NO: 9296178 - DNA, 22 bp, Homo sapiens
gagaacacatgcagactgggta

SEQ ID NO: 9296179 - DNA, 20 bp, Homo sapiens
atggaggaagggcaagagaa

SEQ ID NO: 9296180 - DNA, 22 bp, Homo sapiens
atggaagactaacagaaacatg

SEQ ID NO: 9296181 - DNA, 22 bp, Homo sapiens
atggaagttggaaccattcata

SEQ ID NO: 9296182 - DNA, 22 bp, Homo sapiens
atgccactgcgctctagcctgg

SEQ ID NO: 9296183 - DNA, 22 bp, Homo sapiens
atgccactgcgctccagcctgg

SEQ ID NO: 9296184 - DNA, 22 bp, Homo sapiens
atgccactgcacttcagcttgg

SEQ ID NO: 9296185 - DNA, 22 bp, Homo sapiens
gacagcaaagcagagccaaggc

SEQ ID NO: 9296186 - DNA, 22 bp, Homo sapiens
atgccactgcacttcagcttgg

SEQ ID NO: 9296187 - DNA, 22 bp, Homo sapiens
atgccactgcgctccagcctgg

SEQ ID NO: 9296188 - DNA, 22 bp, Homo sapiens
atggccagtctgttggacagca

SEQ ID NO: 9296189 - DNA, 22 bp, Homo sapiens
atggccagtctgactagtttcc

SEQ ID NO: 9296190 - DNA, 22 bp, Homo sapiens
atggccagtctattcatggtta

SEQ ID NO: 9296191 - DNA, 22 bp, Homo sapiens
atggccagattatatggttttt

SEQ ID NO: 9296192 - DNA, 22 bp, Homo sapiens
atggccagcaaggtagggcaat

SEQ ID NO: 9296193 - DNA, 21 bp, Homo sapiens
atggccagatctattaggtgg

SEQ ID NO: 9296194 - DNA, 22 bp, Homo sapiens
atggccagatgaaataatagag

SEQ ID NO: 9296195 - DNA, 22 bp, Homo sapiens
gagaacagagataattttactt

SEQ ID NO: 9296196 - DNA, 22 bp, Homo sapiens
atggcagagggattgaacagct

SEQ ID NO: 9296197 - DNA, 22 bp, Homo sapiens
gagccaggcccgtacttgctgt

SEQ ID NO: 9296198 - DNA, 22 bp, Homo sapiens
gagccagctatgtagcaagagg

SEQ ID NO: 9296199 - DNA, 22 bp, Homo sapiens
gagcagtgactggagcatgaga

SEQ ID NO: 9296200 - DNA, 22 bp, Homo sapiens
atggccagtgttgagatcaggc

SEQ ID NO: 9296201 - DNA, 22 bp, Homo sapiens
atggccagtgtttccctcagtt

SEQ ID NO: 9296202 - DNA, 19 bp, Homo sapiens
atggccagtttagaggttt

SEQ ID NO: 9296203 - DNA, 22 bp, Homo sapiens
atggccagttagaaatcaaaaa

SEQ ID NO: 9296204 - DNA, 20 bp, Homo sapiens
gaggctgcggactgctggac

SEQ ID NO: 9296205 - DNA, 22 bp, Homo sapiens
gaggctgcggggaggagcctgc

SEQ ID NO: 9296206 - DNA, 22 bp, Homo sapiens
gaggctgcggggaggagcctgc

SEQ ID NO: 9296207 - DNA, 22 bp, Homo sapiens
atgtctttattaatatcatgcc

SEQ ID NO: 9296208 - DNA, 22 bp, Homo sapiens
gaggcctgggcaagggggtctg

SEQ ID NO: 9296209 - DNA, 22 bp, Homo sapiens
gaggcctgggcaagggggtctg

SEQ ID NO: 9296210 - DNA, 22 bp, Homo sapiens
atgtgtccacaggtgtgagaga

SEQ ID NO: 9296211 - DNA, 22 bp, Homo sapiens
atgtgtcctctggcaggtttag

SEQ ID NO: 9296212 - DNA, 22 bp, Homo sapiens
atgtgtccattatcagttctgg

SEQ ID NO: 9296213 - DNA, 22 bp, Homo sapiens
atgtgtccaaggccacaatagc

SEQ ID NO: 9296214 - DNA, 22 bp, Homo sapiens
atgtgtcctgctgtgtcacaca

SEQ ID NO: 9296215 - DNA, 22 bp, Homo sapiens
atgtacattttcctaatgtttt

SEQ ID NO: 9296216 - DNA, 22 bp, Homo sapiens
gaggagctcatgaaagcggtgt

SEQ ID NO: 9296217 - DNA, 22 bp, Homo sapiens
gaggagctcatgaaagcggtgt

SEQ ID NO: 9296218 - DNA, 17 bp, Homo sapiens
gaggagctccagtaggt

SEQ ID NO: 9296219 - DNA, 22 bp, Homo sapiens
atgtagaaagttattgtcactg

SEQ ID NO: 9296220 - DNA, 22 bp, Homo sapiens
gaggagctgcagggggagtcta

SEQ ID NO: 9296221 - DNA, 22 bp, Homo sapiens
gaggagctgcagggggagtcta

SEQ ID NO: 9296222 - DNA, 22 bp, Homo sapiens
gaggagctgagccacgtcctgg

SEQ ID NO: 9296223 - DNA, 22 bp, Homo sapiens
gaggagctgaggctgaggcctc

SEQ ID NO: 9296224 - DNA, 22 bp, Homo sapiens
gaggagctctgctccatccttc

SEQ ID NO: 9296225 - DNA, 22 bp, Homo sapiens
gaggccaggggtcagcaattgg

SEQ ID NO: 9296226 - DNA, 22 bp, Homo sapiens
gaggccaggggcctggagatga

SEQ ID NO: 9296227 - DNA, 22 bp, Homo sapiens
gaggccaggggagtcagcgtcc

SEQ ID NO: 9296228 - DNA, 22 bp, Homo sapiens
gaggccagggatgcaatgagag

SEQ ID NO: 9296229 - DNA, 22 bp, Homo sapiens
gaggagctggcagcgtctccgc

SEQ ID NO: 9296230 - DNA, 22 bp, Homo sapiens
gaggagctggctgtcgggaggc

SEQ ID NO: 9296231 - DNA, 22 bp, Homo sapiens
gaggagctgggctgagagggtc

SEQ ID NO: 9296232 - DNA, 22 bp, Homo sapiens
gaggagctgggaccctgtcatc

SEQ ID NO: 9296233 - DNA, 22 bp, Homo sapiens
atggtcaggcaaggagggctgg

SEQ ID NO: 9296234 - DNA, 22 bp, Homo sapiens
gagctgggcctcagaacacagt

SEQ ID NO: 9296235 - DNA, 22 bp, Homo sapiens
gagctgggcctgcgagtgctgc

SEQ ID NO: 9296236 - DNA, 22 bp, Homo sapiens
gagctgggcctgcgagtgctgc

SEQ ID NO: 9296237 - DNA, 22 bp, Homo sapiens
gagctgggctggcttcctccct

SEQ ID NO: 9296238 - DNA, 22 bp, Homo sapiens
gagctggggcagcttaggagtg

SEQ ID NO: 9296239 - DNA, 21 bp, Homo sapiens
gagctgggcgaggctccgggg

SEQ ID NO: 9296240 - DNA, 21 bp, Homo sapiens
gagctgggcgaggctccgggg

SEQ ID NO: 9296241 - DNA, 22 bp, Homo sapiens
gagctgggcgagccggggaagt

SEQ ID NO: 9296242 - DNA, 22 bp, Homo sapiens
cacaggaggaggccagagcgta

SEQ ID NO: 9296243 - DNA, 22 bp, Homo sapiens
agcagcttctttcactcctgga

SEQ ID NO: 9296244 - DNA, 22 bp, Homo sapiens
caatgaacacagcaatttcata

SEQ ID NO: 9296245 - DNA, 22 bp, Homo sapiens
agcagctgtactttcatctgtt

SEQ ID NO: 9296246 - DNA, 22 bp, Homo sapiens
agcagctgtcccttaacatcag

SEQ ID NO: 9296247 - DNA, 22 bp, Homo sapiens
caccagggccccaggctgtgcc

SEQ ID NO: 9296248 - DNA, 21 bp, Homo sapiens
agcaggtgctgttggaggaaa

SEQ ID NO: 9296249 - DNA, 22 bp, Homo sapiens
agcaggtgcgttacttcactct

SEQ ID NO: 9296250 - DNA, 22 bp, Homo sapiens
agcaggtggaaaattcttatca

SEQ ID NO: 9296251 - DNA, 18 bp, Homo sapiens
agcaggtgctgtttcttt

SEQ ID NO: 9296252 - DNA, 22 bp, Homo sapiens
agcaggtggacagaggaagaaa

SEQ ID NO: 9296253 - DNA, 22 bp, Homo sapiens
cactctgcagctgaagggctgg

SEQ ID NO: 9296254 - DNA, 22 bp, Homo sapiens
cactctggggatgcaaggagag

SEQ ID NO: 9296255 - DNA, 22 bp, Homo sapiens
agcataagttggtacagccact

SEQ ID NO: 9296256 - DNA, 22 bp, Homo sapiens
agcagggctcacattagtggat

SEQ ID NO: 9296257 - DNA, 16 bp, Homo sapiens
agcagggcgggaagga

SEQ ID NO: 9296258 - DNA, 22 bp, Homo sapiens
agcagggcctggcactcctggg

SEQ ID NO: 9296259 - DNA, 22 bp, Homo sapiens
agcagggcctgagtgacctaac

SEQ ID NO: 9296260 - DNA, 22 bp, Homo sapiens
agcagggctccatttcactgcc

SEQ ID NO: 9296261 - DNA, 22 bp, Homo sapiens
agcagggctcctgaaagccgcg

SEQ ID NO: 9296262 - DNA, 22 bp, Homo sapiens
agcagggctccatttcactgcc

SEQ ID NO: 9296263 - DNA, 22 bp, Homo sapiens
agcagggctctgccatgggccc

SEQ ID NO: 9296264 - DNA, 22 bp, Homo sapiens
agcagggcagtgcttcagctct

SEQ ID NO: 9296265 - DNA, 22 bp, Homo sapiens
cacatccctggagttacccagt

SEQ ID NO: 9296266 - DNA, 22 bp, Homo sapiens
agcaggtgatgtgagtctggaa

SEQ ID NO: 9296267 - DNA, 22 bp, Homo sapiens
agcaggtgccaggtgtacccgc

SEQ ID NO: 9296268 - DNA, 22 bp, Homo sapiens
agcaggtgcatggcgagcgcgg

SEQ ID NO: 9296269 - DNA, 22 bp, Homo sapiens
agcaggtataggaggtatcctg

SEQ ID NO: 9296270 - DNA, 17 bp, Homo sapiens
agcagaagtcagaggga

SEQ ID NO: 9296271 - DNA, 22 bp, Homo sapiens
attttctatgttgtaattgtta

SEQ ID NO: 9296272 - DNA, 22 bp, Homo sapiens
agcagcagaaagttgatggcag

SEQ ID NO: 9296273 - DNA, 21 bp, Homo sapiens
agcagacacttgtgaccttcc

SEQ ID NO: 9296274 - DNA, 22 bp, Homo sapiens
agcagacaattgcctggatgga

SEQ ID NO: 9296275 - DNA, 22 bp, Homo sapiens
agcagacaattgcctggatgga

SEQ ID NO: 9296276 - DNA, 18 bp, Homo sapiens
agcagaattctagggttc

SEQ ID NO: 9296277 - DNA, 22 bp, Homo sapiens
cagcagaggttttgctccatga

SEQ ID NO: 9296278 - DNA, 22 bp, Homo sapiens
cagcacagtacaaggcacggat

SEQ ID NO: 9296279 - DNA, 22 bp, Homo sapiens
cagaggctaagatgagtgggtg

SEQ ID NO: 9296280 - DNA, 22 bp, Homo sapiens
agctaggataagcagagactgg

SEQ ID NO: 9296281 - DNA, 22 bp, Homo sapiens
agctaggagattttgtgaggct

SEQ ID NO: 9296282 - DNA, 22 bp, Homo sapiens
agcctttatactgtgtaaggca

SEQ ID NO: 9296283 - DNA, 22 bp, Homo sapiens
agccttggtcccgcgtcagcca

SEQ ID NO: 9296284 - DNA, 22 bp, Homo sapiens
agcctttaacacttcacattga

SEQ ID NO: 9296285 - DNA, 22 bp, Homo sapiens
agcctttaactggataaagtgt

SEQ ID NO: 9296286 - DNA, 22 bp, Homo sapiens
agccttggactgaatactttag

SEQ ID NO: 9296287 - DNA, 22 bp, Homo sapiens
agccttgggcaatttggacact

SEQ ID NO: 9296288 - DNA, 22 bp, Homo sapiens
agccttggatgagctttatcat

SEQ ID NO: 9296289 - DNA, 22 bp, Homo sapiens
agccttctctgaaattctgttt

SEQ ID NO: 9296290 - DNA, 22 bp, Homo sapiens
agctcccaggcagtcatgagga

SEQ ID NO: 9296291 - DNA, 22 bp, Homo sapiens
agctccagggaaagagtggatc

SEQ ID NO: 9296292 - DNA, 22 bp, Homo sapiens
cagccagagaaagggcactgcc

SEQ ID NO: 9296293 - DNA, 22 bp, Homo sapiens
cagccagaggctgcgaggggcc

SEQ ID NO: 9296294 - DNA, 22 bp, Homo sapiens
cagccagagaggaaggaatgca

SEQ ID NO: 9296295 - DNA, 22 bp, Homo sapiens
cagccagaggggccagagtcgg

SEQ ID NO: 9296296 - DNA, 22 bp, Homo sapiens
cagccagatcagggcaggggtt

SEQ ID NO: 9296297 - DNA, 22 bp, Homo sapiens
cagccagatcaaactcagatgt

SEQ ID NO: 9296298 - DNA, 22 bp, Homo sapiens
agccagtgacatacgattggga

SEQ ID NO: 9296299 - DNA, 19 bp, Homo sapiens
agccagtgagcctctgggt

SEQ ID NO: 9296300 - DNA, 22 bp, Homo sapiens
agccagtgatgaagactctgga

SEQ ID NO: 9296301 - DNA, 22 bp, Homo sapiens
agccagtgattctgatgtactg

SEQ ID NO: 9296302 - DNA, 22 bp, Homo sapiens
cagacagacctgcaagggcaca

SEQ ID NO: 9296303 - DNA, 22 bp, Homo sapiens
cagacagagtcttcccatcagt

SEQ ID NO: 9296304 - DNA, 22 bp, Homo sapiens
agcccagctttgaaccatatca

SEQ ID NO: 9296305 - DNA, 22 bp, Homo sapiens
cagaagcattgactccttgctc

SEQ ID NO: 9296306 - DNA, 22 bp, Homo sapiens
cagaagcctgcctcagatgcac

SEQ ID NO: 9296307 - DNA, 22 bp, Homo sapiens
cagaagcctgcctcagatgcac

SEQ ID NO: 9296308 - DNA, 22 bp, Homo sapiens
cagaagcctgcctcagatgcac

SEQ ID NO: 9296309 - DNA, 22 bp, Homo sapiens
cagaagaatggtgtctgagctc

SEQ ID NO: 9296310 - DNA, 22 bp, Homo sapiens
cagaagctggtacaaggcctag

SEQ ID NO: 9296311 - DNA, 22 bp, Homo sapiens
cactgaaacaggtattgctggt

SEQ ID NO: 9296312 - DNA, 23 bp, Homo sapiens
cagaaatctgaaatctagaaatg

SEQ ID NO: 9296313 - DNA, 22 bp, Homo sapiens
agaagaatttctctcatgattt

SEQ ID NO: 9296314 - DNA, 22 bp, Homo sapiens
agaagaatacttgatgttcatg

SEQ ID NO: 9296315 - DNA, 22 bp, Homo sapiens
agaaggctaaagaaacagattg

SEQ ID NO: 9296316 - DNA, 22 bp, Homo sapiens
agaaggccaatagggtgcactg

SEQ ID NO: 9296317 - DNA, 22 bp, Homo sapiens
agaatctttctgaatgactgtg

SEQ ID NO: 9296318 - DNA, 22 bp, Homo sapiens
agaatgtaagaatgcaaagatt

SEQ ID NO: 9296319 - DNA, 17 bp, Homo sapiens
agacaggttatagttga

SEQ ID NO: 9296320 - DNA, 21 bp, Homo sapiens
agacaggtcagggagaggtga

SEQ ID NO: 9296321 - DNA, 22 bp, Homo sapiens
agacaggtgttttacaacttcg

SEQ ID NO: 9296322 - DNA, 22 bp, Homo sapiens
agacaggtgctcgcccaagtcc

SEQ ID NO: 9296323 - DNA, 22 bp, Homo sapiens
agacagtgatggacaggcagac

SEQ ID NO: 9296324 - DNA, 22 bp, Homo sapiens
agacagtgcaagaagagcaggc

SEQ ID NO: 9296325 - DNA, 22 bp, Homo sapiens
agacacagtgctgggtgctgag

SEQ ID NO: 9296326 - DNA, 22 bp, Homo sapiens
agacacagtctgtctggaggag

SEQ ID NO: 9296327 - DNA, 22 bp, Homo sapiens
agacacataggaccacactgtg

SEQ ID NO: 9296328 - DNA, 22 bp, Homo sapiens
agacacagtctgtctggaggag

SEQ ID NO: 9296329 - DNA, 22 bp, Homo sapiens
agacacagctgcaggaggtggg

SEQ ID NO: 9296330 - DNA, 23 bp, Homo sapiens
atgtaaacttcagagtcattgcc

SEQ ID NO: 9296331 - DNA, 22 bp, Homo sapiens
agactacatatgccacatgaag

SEQ ID NO: 9296332 - DNA, 22 bp, Homo sapiens
atggcagatggctggagcaggt

SEQ ID NO: 9296333 - DNA, 22 bp, Homo sapiens
atggcagatggctggagcaggt

SEQ ID NO: 9296334 - DNA, 22 bp, Homo sapiens
atgtttgttgaacatctactgc

SEQ ID NO: 9296335 - DNA, 22 bp, Homo sapiens
atgtttgtgtttcccattcagg

SEQ ID NO: 9296336 - DNA, 22 bp, Homo sapiens
attctgtatggaaaagcactat

SEQ ID NO: 9296337 - DNA, 22 bp, Homo sapiens
agagggtgctggagagacattg

SEQ ID NO: 9296338 - DNA, 22 bp, Homo sapiens
agagggtatgagtggggctaaa

SEQ ID NO: 9296339 - DNA, 22 bp, Homo sapiens
agagggtagaagacagggttgc

SEQ ID NO: 9296340 - DNA, 22 bp, Homo sapiens
attcacagttcattagctgtaa

SEQ ID NO: 9296341 - DNA, 22 bp, Homo sapiens
attcagatcatatttatagctt

SEQ ID NO: 9296342 - DNA, 22 bp, Homo sapiens
attcacagttactgctgaacca

SEQ ID NO: 9296343 - DNA, 22 bp, Homo sapiens
attcacagggacaatgggagag

SEQ ID NO: 9296344 - DNA, 22 bp, Homo sapiens
attcacagggctttccgcatgg

SEQ ID NO: 9296345 - DNA, 20 bp, Homo sapiens
attcacaggcacaaaaccct

SEQ ID NO: 9296346 - DNA, 21 bp, Homo sapiens
attcacaggtatcctctccct

SEQ ID NO: 9296347 - DNA, 22 bp, Homo sapiens
attcacagtatggacgaaatga

SEQ ID NO: 9296348 - DNA, 22 bp, Homo sapiens
attcacagggggagaagggtat

SEQ ID NO: 9296349 - DNA, 22 bp, Homo sapiens
attcagcataatcagtagcttg

SEQ ID NO: 9296350 - DNA, 22 bp, Homo sapiens
attcagcagttcctgcttcagt

SEQ ID NO: 9296351 - DNA, 22 bp, Homo sapiens
attcacagaatagttttaccag

SEQ ID NO: 9296352 - DNA, 22 bp, Homo sapiens
attcacagagtggttagtggta

SEQ ID NO: 9296353 - DNA, 22 bp, Homo sapiens
attatacattttgtgtagagat

SEQ ID NO: 9296354 - DNA, 22 bp, Homo sapiens
agatgaagactcaggagcaggt

SEQ ID NO: 9296355 - DNA, 23 bp, Homo sapiens
agatgaaagcttcccatcacagt

SEQ ID NO: 9296356 - DNA, 22 bp, Homo sapiens
atttattgaagcttattacgtt

SEQ ID NO: 9296357 - DNA, 22 bp, Homo sapiens
agatgaaaagataagcagcaat

SEQ ID NO: 9296358 - DNA, 20 bp, Homo sapiens
agatggtgggctggaacacc

SEQ ID NO: 9296359 - DNA, 22 bp, Homo sapiens
agatggtagactatggaacgta

SEQ ID NO: 9296360 - DNA, 22 bp, Homo sapiens
agcaaacagtttctggggatct

SEQ ID NO: 9296361 - DNA, 19 bp, Homo sapiens
attcttctcttcctgctgt

SEQ ID NO: 9296362 - DNA, 23 bp, Homo sapiens
atttaatgctgagttgaatgtta

SEQ ID NO: 9296363 - DNA, 22 bp, Homo sapiens
agagtggcctggcctggggcat

SEQ ID NO: 9296364 - DNA, 22 bp, Homo sapiens
agagtggctctgctgggcacag

SEQ ID NO: 9296365 - DNA, 18 bp, Homo sapiens
atttaatgaactgaaagc

SEQ ID NO: 9296366 - DNA, 18 bp, Homo sapiens
atttaatgaactgaaagc

SEQ ID NO: 9296367 - DNA, 22 bp, Homo sapiens
agaggtagaggttgcagtgagc

SEQ ID NO: 9296368 - DNA, 22 bp, Homo sapiens
agagggtggtgaggcctggttc

SEQ ID NO: 9296369 - DNA, 19 bp, Homo sapiens
attcttctcaaatatccat

SEQ ID NO: 9296370 - DNA, 23 bp, Homo sapiens
attcttcattatcttctagaaaa

SEQ ID NO: 9296371 - DNA, 22 bp, Homo sapiens
attcttcatgttgaagctgtca

SEQ ID NO: 9296372 - DNA, 22 bp, Homo sapiens
atttattgaacactgactatgt

SEQ ID NO: 9296373 - DNA, 22 bp, Homo sapiens
atttattgaacactgactatgt

SEQ ID NO: 9296374 - DNA, 22 bp, Homo sapiens
atttagtgaaacccataaagca

SEQ ID NO: 9296375 - DNA, 22 bp, Homo sapiens
agagtgggacacgggcgctgtc

SEQ ID NO: 9296376 - DNA, 22 bp, Homo sapiens
actggacagaggaaatatggag

SEQ ID NO: 9296377 - DNA, 22 bp, Homo sapiens
agtggctgctggagtggagatg

SEQ ID NO: 9296378 - DNA, 22 bp, Homo sapiens
actggcagaacgtgatgcgggt

SEQ ID NO: 9296379 - DNA, 22 bp, Homo sapiens
actggcagagaccctgatggcc

SEQ ID NO: 9296380 - DNA, 22 bp, Homo sapiens
actggcagaattgaatagttgt

SEQ ID NO: 9296381 - DNA, 22 bp, Homo sapiens
actggcagaactggtgattgtc

SEQ ID NO: 9296382 - DNA, 22 bp, Homo sapiens
actggcagccacaactggcagg

SEQ ID NO: 9296383 - DNA, 22 bp, Homo sapiens
actggcagcagcagcccttggg

SEQ ID NO: 9296384 - DNA, 22 bp, Homo sapiens
actggcagaggatagcactaat

SEQ ID NO: 9296385 - DNA, 22 bp, Homo sapiens
actggcagagggaaaaccattc

SEQ ID NO: 9296386 - DNA, 22 bp, Homo sapiens
actggcagaggttggacaccat

SEQ ID NO: 9296387 - DNA, 22 bp, Homo sapiens
actgcttacaaaaggaaagaat

SEQ ID NO: 9296388 - DNA, 20 bp, Homo sapiens
actgcttctttctctgacct

SEQ ID NO: 9296389 - DNA, 22 bp, Homo sapiens
actgctttagacctagagctct

SEQ ID NO: 9296390 - DNA, 22 bp, Homo sapiens
actgcaacctccacctcctggg

SEQ ID NO: 9296391 - DNA, 22 bp, Homo sapiens
actgcaacacctcctgggttca

SEQ ID NO: 9296392 - DNA, 22 bp, Homo sapiens
agtctgggctgtctgcaggagt

SEQ ID NO: 9296393 - DNA, 22 bp, Homo sapiens
agtctggggtctggtagaacga

SEQ ID NO: 9296394 - DNA, 22 bp, Homo sapiens
agtctgggaactgggaacgttt

SEQ ID NO: 9296395 - DNA, 22 bp, Homo sapiens
agtctcttattccctattgctg

SEQ ID NO: 9296396 - DNA, 22 bp, Homo sapiens
agtctcttgcacattgtattaa

SEQ ID NO: 9296397 - DNA, 22 bp, Homo sapiens
actcttcattcaagtatgcaaa

SEQ ID NO: 9296398 - DNA, 22 bp, Homo sapiens
actgaaatatttagaagtgaag

SEQ ID NO: 9296399 - DNA, 22 bp, Homo sapiens
actgaaatggggacagtcctta

SEQ ID NO: 9296400 - DNA, 22 bp, Homo sapiens
actgaaatgaaatctatcatct

SEQ ID NO: 9296401 - DNA, 19 bp, Homo sapiens
agtctctgaggcctaagtt

SEQ ID NO: 9296402 - DNA, 22 bp, Homo sapiens
actaaatagttttgacagaaca

SEQ ID NO: 9296403 - DNA, 22 bp, Homo sapiens
actaaatagcctctggtagttg

SEQ ID NO: 9296404 - DNA, 22 bp, Homo sapiens
actatacattgaatgttaaggt

SEQ ID NO: 9296405 - DNA, 22 bp, Homo sapiens
actatatgtgaaggtagaattt

SEQ ID NO: 9296406 - DNA, 19 bp, Homo sapiens
actcaagtctaatgaaatc

SEQ ID NO: 9296407 - DNA, 22 bp, Homo sapiens
accttaaaactgacacatggag

SEQ ID NO: 9296408 - DNA, 22 bp, Homo sapiens
accttagctgttaaaactaagt

SEQ ID NO: 9296409 - DNA, 22 bp, Homo sapiens
actaaagctcacagagttgaac

SEQ ID NO: 9296410 - DNA, 22 bp, Homo sapiens
agggctgtcagactgaggaggc

SEQ ID NO: 9296411 - DNA, 22 bp, Homo sapiens
aggtagcaagacacctgctttt

SEQ ID NO: 9296412 - DNA, 22 bp, Homo sapiens
aggtagcatattccagacttgt

SEQ ID NO: 9296413 - DNA, 22 bp, Homo sapiens
acctgccttctcaaggacatga

SEQ ID NO: 9296414 - DNA, 22 bp, Homo sapiens
acctgccttctcaaggacatga

SEQ ID NO: 9296415 - DNA, 21 bp, Homo sapiens
aggtacaggtcttgtgagtct

SEQ ID NO: 9296416 - DNA, 22 bp, Homo sapiens
actggcagtttgagaatgcatt

SEQ ID NO: 9296417 - DNA, 19 bp, Homo sapiens
actggcagtttctgcatgg

SEQ ID NO: 9296418 - DNA, 22 bp, Homo sapiens
actggcagtggcagcagaaaga

SEQ ID NO: 9296419 - DNA, 22 bp, Homo sapiens
actggcagtgtcgtttacatga

SEQ ID NO: 9296420 - DNA, 20 bp, Homo sapiens
actggcagcctgcctgctgt

SEQ ID NO: 9296421 - DNA, 22 bp, Homo sapiens
actggcagctgtaggatgcatg

SEQ ID NO: 9296422 - DNA, 22 bp, Homo sapiens
actggcaggctgctggccggcg

SEQ ID NO: 9296423 - DNA, 19 bp, Homo sapiens
actggcagctgtagtctgt

SEQ ID NO: 9296424 - DNA, 22 bp, Homo sapiens
actggcagtagagggagcgcat

SEQ ID NO: 9296425 - DNA, 22 bp, Homo sapiens
actggcagggggagccccgaga

SEQ ID NO: 9296426 - DNA, 22 bp, Homo sapiens
actggcaggtccatcgcccttt

SEQ ID NO: 9296427 - DNA, 19 bp, Homo sapiens
actggcagggctgcggtgg

SEQ ID NO: 9296428 - DNA, 22 bp, Homo sapiens
actgtaaaatacataagtattg

SEQ ID NO: 9296429 - DNA, 22 bp, Homo sapiens
agtttacccactgttgaaatta

SEQ ID NO: 9296430 - DNA, 22 bp, Homo sapiens
actgtcatgatcgaagatgtca

SEQ ID NO: 9296431 - DNA, 22 bp, Homo sapiens
actgtcatcttgtaagcaatgt

SEQ ID NO: 9296432 - DNA, 22 bp, Homo sapiens
agtttcctcatctgtaaaatga

SEQ ID NO: 9296433 - DNA, 22 bp, Homo sapiens
agtttccaaatattgttttagc

SEQ ID NO: 9296434 - DNA, 23 bp, Homo sapiens
agtttccacccagggtagaaggg

SEQ ID NO: 9296435 - DNA, 22 bp, Homo sapiens
actgttatgggtgtcagcttaa

SEQ ID NO: 9296436 - DNA, 22 bp, Homo sapiens
acttggcaggtcaggggatatt

SEQ ID NO: 9296437 - DNA, 22 bp, Homo sapiens
atatattggtgtcagaaagagt

SEQ ID NO: 9296438 - DNA, 18 bp, Homo sapiens
atatattgacaagaggga

SEQ ID NO: 9296439 - DNA, 22 bp, Homo sapiens
atatacacagagcttatggtga

SEQ ID NO: 9296440 - DNA, 22 bp, Homo sapiens
atatacacatctttttaaatat

SEQ ID NO: 9296441 - DNA, 22 bp, Homo sapiens
atataatagtttcataaaggct

SEQ ID NO: 9296442 - DNA, 22 bp, Homo sapiens
atagtttacaaaaatgatgcat

SEQ ID NO: 9296443 - DNA, 22 bp, Homo sapiens
agaaaatttaaagagacacaca

SEQ ID NO: 9296444 - DNA, 22 bp, Homo sapiens
agaaaatttaaagagacacaca

SEQ ID NO: 9296445 - DNA, 22 bp, Homo sapiens
agaaaatttattcatgttagtt

SEQ ID NO: 9296446 - DNA, 22 bp, Homo sapiens
agaaaataaattgatggtggaa

SEQ ID NO: 9296447 - DNA, 22 bp, Homo sapiens
agaaaattagattttactgtgt

SEQ ID NO: 9296448 - DNA, 22 bp, Homo sapiens
agaaaattagattttactgtgt

SEQ ID NO: 9296449 - DNA, 22 bp, Homo sapiens
atatcttttagagcaagcttgt

SEQ ID NO: 9296450 - DNA, 22 bp, Homo sapiens
atatatttgagaatattcatga

SEQ ID NO: 9296451 - DNA, 22 bp, Homo sapiens
atcagaggttatgtggagggga

SEQ ID NO: 9296452 - DNA, 20 bp, Homo sapiens
agaaacagcacaattctgtt

SEQ ID NO: 9296453 - DNA, 22 bp, Homo sapiens
atccagagacccaaggacagaa

SEQ ID NO: 9296454 - DNA, 22 bp, Homo sapiens
agaagaaatgaggccgttctgc

SEQ ID NO: 9296455 - DNA, 22 bp, Homo sapiens
atccagagtgtaattctccatg

SEQ ID NO: 9296456 - DNA, 22 bp, Homo sapiens
atccagagtggccttctttcca

SEQ ID NO: 9296457 - DNA, 22 bp, Homo sapiens
atccagagttgctgtatatctt

SEQ ID NO: 9296458 - DNA, 22 bp, Homo sapiens
atccagagttatatccaagcag

SEQ ID NO: 9296459 - DNA, 22 bp, Homo sapiens
atccagaggcactgccctttgt

SEQ ID NO: 9296460 - DNA, 22 bp, Homo sapiens
atccagagtaatacagaatgca

SEQ ID NO: 9296461 - DNA, 22 bp, Homo sapiens
atccagagggtagcaggattag

SEQ ID NO: 9296462 - DNA, 22 bp, Homo sapiens
atccagagaggttaggtgacat

SEQ ID NO: 9296463 - DNA, 22 bp, Homo sapiens
atccagagactggggctgggat

SEQ ID NO: 9296464 - DNA, 20 bp, Homo sapiens
atcagcaactgccactcagt

SEQ ID NO: 9296465 - DNA, 22 bp, Homo sapiens
aggcagcatgggccccagctcc

SEQ ID NO: 9296466 - DNA, 19 bp, Homo sapiens
acagtttgggaaatgagca

SEQ ID NO: 9296467 - DNA, 22 bp, Homo sapiens
aggcagctggaggcagagacta

SEQ ID NO: 9296468 - DNA, 22 bp, Homo sapiens
aggcaggcactccggaagtgtc

SEQ ID NO: 9296469 - DNA, 22 bp, Homo sapiens
aggcaggcactccggaagtgtc

SEQ ID NO: 9296470 - DNA, 22 bp, Homo sapiens
aggcaggcaagttcatatgagg

SEQ ID NO: 9296471 - DNA, 22 bp, Homo sapiens
aggcaggcaagttcatatgagg

SEQ ID NO: 9296472 - DNA, 21 bp, Homo sapiens
acagtaaattccctgcaaaga

SEQ ID NO: 9296473 - DNA, 21 bp, Homo sapiens
aggaggaacccgtggctgggc

SEQ ID NO: 9296474 - DNA, 21 bp, Homo sapiens
aggaggaacccgtggctgggc

SEQ ID NO: 9296475 - DNA, 22 bp, Homo sapiens
aggagtgcaaatagtccagaga

SEQ ID NO: 9296476 - DNA, 22 bp, Homo sapiens
acaggtggggaggctgaggttc

SEQ ID NO: 9296477 - DNA, 22 bp, Homo sapiens
acaggtggggcacttggagcct

SEQ ID NO: 9296478 - DNA, 22 bp, Homo sapiens
acaggtggtaaaatggactgtc

SEQ ID NO: 9296479 - DNA, 22 bp, Homo sapiens
acaggtggtagagtggaaagag

SEQ ID NO: 9296480 - DNA, 22 bp, Homo sapiens
acaggtggggcacttggagcct

SEQ ID NO: 9296481 - DNA, 22 bp, Homo sapiens
acaggtggtaaaatggactgtc

SEQ ID NO: 9296482 - DNA, 22 bp, Homo sapiens
acaggtggcttattggctgatt

SEQ ID NO: 9296483 - DNA, 22 bp, Homo sapiens
acaggtggcttccattttctaa

SEQ ID NO: 9296484 - DNA, 22 bp, Homo sapiens
acaggtgggcttaagagtcggc

SEQ ID NO: 9296485 - DNA, 22 bp, Homo sapiens
acaggtggcttattggctgatt

SEQ ID NO: 9296486 - DNA, 22 bp, Homo sapiens
acaggtggccccgagggagtgg

SEQ ID NO: 9296487 - DNA, 22 bp, Homo sapiens
acaggtggtagagtggaaagag

SEQ ID NO: 9296488 - DNA, 22 bp, Homo sapiens
acaggtggtctttgctcctttt

SEQ ID NO: 9296489 - DNA, 22 bp, Homo sapiens
acaggtgtaaaacccaggatgg

SEQ ID NO: 9296490 - DNA, 21 bp, Homo sapiens
aggagctgtgttagctggtcg

SEQ ID NO: 9296491 - DNA, 22 bp, Homo sapiens
acaggtggacacagcagcagtc

SEQ ID NO: 9296492 - DNA, 22 bp, Homo sapiens
acaggtggaaacatggtgttgg

SEQ ID NO: 9296493 - DNA, 22 bp, Homo sapiens
acaggtggcactgctgttactc

SEQ ID NO: 9296494 - DNA, 22 bp, Homo sapiens
acaggtggcagaagcatttact

SEQ ID NO: 9296495 - DNA, 22 bp, Homo sapiens
acaggtggcataggcagtttga

SEQ ID NO: 9296496 - DNA, 22 bp, Homo sapiens
acaggtggccccgagggagtgg

SEQ ID NO: 9296497 - DNA, 22 bp, Homo sapiens
acaggtggaggctttaggaggt

SEQ ID NO: 9296498 - DNA, 22 bp, Homo sapiens
acaggtggaggctttaggaggt

SEQ ID NO: 9296499 - DNA, 22 bp, Homo sapiens
acaggtggagtggttagcaggc

SEQ ID NO: 9296500 - DNA, 22 bp, Homo sapiens
acagggcaacctctgggagact

SEQ ID NO: 9296501 - DNA, 22 bp, Homo sapiens
acagggcacctgaggtaggaag

SEQ ID NO: 9296502 - DNA, 22 bp, Homo sapiens
acagcgagaatgtaaggagccc

SEQ ID NO: 9296503 - DNA, 22 bp, Homo sapiens
agctggggctgcagagaacagg

SEQ ID NO: 9296504 - DNA, 19 bp, Homo sapiens
agctggggcggtgtgtgtt

SEQ ID NO: 9296505 - DNA, 22 bp, Homo sapiens
agctgggtcaataggaaatgta

SEQ ID NO: 9296506 - DNA, 22 bp, Homo sapiens
agctggggttgcacacattttg

SEQ ID NO: 9296507 - DNA, 22 bp, Homo sapiens
agctgggggttggataagggta

SEQ ID NO: 9296508 - DNA, 22 bp, Homo sapiens
agctgggggttggataagggta

SEQ ID NO: 9296509 - DNA, 22 bp, Homo sapiens
agctggggctgtggttgtgatt

SEQ ID NO: 9296510 - DNA, 22 bp, Homo sapiens
agctgggggtagtgagaaataa

SEQ ID NO: 9296511 - DNA, 22 bp, Homo sapiens
agctggggctgtggttgtgatt

SEQ ID NO: 9296512 - DNA, 22 bp, Homo sapiens
agctgctatgacaacaccagcc

SEQ ID NO: 9296513 - DNA, 22 bp, Homo sapiens
acagccttgggttctctggggg

SEQ ID NO: 9296514 - DNA, 22 bp, Homo sapiens
acaggctgctgggctccgtgct

SEQ ID NO: 9296515 - DNA, 22 bp, Homo sapiens
acaggctgcctaccaagtatca

SEQ ID NO: 9296516 - DNA, 22 bp, Homo sapiens
acaggctgcccgctccccacct

SEQ ID NO: 9296517 - DNA, 22 bp, Homo sapiens
acaggctgctgagccatttgct

SEQ ID NO: 9296518 - DNA, 22 bp, Homo sapiens
agctttatgggagcttagataa

SEQ ID NO: 9296519 - DNA, 22 bp, Homo sapiens
agctttatgggagcttagataa

SEQ ID NO: 9296520 - DNA, 22 bp, Homo sapiens
acaggctctggggcaggatggc

SEQ ID NO: 9296521 - DNA, 19 bp, Homo sapiens
aggaatggaattaattctg

SEQ ID NO: 9296522 - DNA, 18 bp, Homo sapiens
acaggctgtgggaatggt

SEQ ID NO: 9296523 - DNA, 22 bp, Homo sapiens
agctttatcagaggagtctcta

SEQ ID NO: 9296524 - DNA, 22 bp, Homo sapiens
agctttatcacaatattggcta

SEQ ID NO: 9296525 - DNA, 22 bp, Homo sapiens
agctttatgcttcctacaagct

SEQ ID NO: 9296526 - DNA, 22 bp, Homo sapiens
agctttatgaggagaccttagt

SEQ ID NO: 9296527 - DNA, 22 bp, Homo sapiens
agctttatgaggagaccttagt

SEQ ID NO: 9296528 - DNA, 22 bp, Homo sapiens
agctttatcagaggagtctcta

SEQ ID NO: 9296529 - DNA, 22 bp, Homo sapiens
agctttatcccttgcccatcga

SEQ ID NO: 9296530 - DNA, 22 bp, Homo sapiens
agctttatcttcacctgggaat

SEQ ID NO: 9296531 - DNA, 22 bp, Homo sapiens
agctttatcttcacctgggaat

SEQ ID NO: 9296532 - DNA, 22 bp, Homo sapiens
agctgggtcttgggccaggaga

SEQ ID NO: 9296533 - DNA, 22 bp, Homo sapiens
agctgggtgaaggcagatggct

SEQ ID NO: 9296534 - DNA, 22 bp, Homo sapiens
aggctatttccactcttctcat

SEQ ID NO: 9296535 - DNA, 22 bp, Homo sapiens
aggctatgacagactcagcctg

SEQ ID NO: 9296536 - DNA, 22 bp, Homo sapiens
aggccttggcagaggccaggct

SEQ ID NO: 9296537 - DNA, 22 bp, Homo sapiens
aggccttggcatgctgccctgc

SEQ ID NO: 9296538 - DNA, 22 bp, Homo sapiens
aggccttgtattaatttgtttt

SEQ ID NO: 9296539 - DNA, 22 bp, Homo sapiens
aggcgcctgcgggatccttgcc

SEQ ID NO: 9296540 - DNA, 22 bp, Homo sapiens
aggcgcctgcgggatccttgcc

SEQ ID NO: 9296541 - DNA, 20 bp, Homo sapiens
aggccttgtttatagtgaga

SEQ ID NO: 9296542 - DNA, 20 bp, Homo sapiens
aggctgagttctatgcactt

SEQ ID NO: 9296543 - DNA, 22 bp, Homo sapiens
aggctgagtttctcattctcgc

SEQ ID NO: 9296544 - DNA, 22 bp, Homo sapiens
aggctgagtgctcccctagatg

SEQ ID NO: 9296545 - DNA, 22 bp, Homo sapiens
aggctgaggctggcagctccag

SEQ ID NO: 9296546 - DNA, 22 bp, Homo sapiens
acatttatataactcactagga

SEQ ID NO: 9296547 - DNA, 22 bp, Homo sapiens
acatttattactcaggttgttg

SEQ ID NO: 9296548 - DNA, 22 bp, Homo sapiens
acatttatatttagtggggaat

SEQ ID NO: 9296549 - DNA, 22 bp, Homo sapiens
acatttattttggcacggcaca

SEQ ID NO: 9296550 - DNA, 22 bp, Homo sapiens
acatttattttcagctgggaaa

SEQ ID NO: 9296551 - DNA, 22 bp, Homo sapiens
aggcaggggagctggaagggta

SEQ ID NO: 9296552 - DNA, 22 bp, Homo sapiens
acatgacttttctcttccagag

SEQ ID NO: 9296553 - DNA, 22 bp, Homo sapiens
aggcagggctgggattagactc

SEQ ID NO: 9296554 - DNA, 22 bp, Homo sapiens
aggcagggctcatttcttaggc

SEQ ID NO: 9296555 - DNA, 22 bp, Homo sapiens
aggcagggaccagttgttttct

SEQ ID NO: 9296556 - DNA, 22 bp, Homo sapiens
aggcaggctggtctgaagagtg

SEQ ID NO: 9296557 - DNA, 22 bp, Homo sapiens
aggcaggctggtctgaagagtg

SEQ ID NO: 9296558 - DNA, 22 bp, Homo sapiens
aggccctgttatgagccactgt

SEQ ID NO: 9296559 - DNA, 22 bp, Homo sapiens
aggccctggtcaggtctggctg

SEQ ID NO: 9296560 - DNA, 22 bp, Homo sapiens
agggagctctgggggcacacgg

SEQ ID NO: 9296561 - DNA, 22 bp, Homo sapiens
agggagctcgatgcctgagtgt

SEQ ID NO: 9296562 - DNA, 22 bp, Homo sapiens
agggagctcacagtccagtaga

SEQ ID NO: 9296563 - DNA, 22 bp, Homo sapiens
accatttaaggaaaatgtatca

SEQ ID NO: 9296564 - DNA, 22 bp, Homo sapiens
accatgttggccaagctggtct

SEQ ID NO: 9296565 - DNA, 22 bp, Homo sapiens
agggcatgaagcagtggacagc

SEQ ID NO: 9296566 - DNA, 23 bp, Homo sapiens
agggcatgaagcagaggacgtgg

SEQ ID NO: 9296567 - DNA, 22 bp, Homo sapiens
agggcatgaaatgggcagaagc

SEQ ID NO: 9296568 - DNA, 22 bp, Homo sapiens
acccacacatctctaattcagt

SEQ ID NO: 9296569 - DNA, 22 bp, Homo sapiens
acccacacctccgtatatcact

SEQ ID NO: 9296570 - DNA, 22 bp, Homo sapiens
agggcctgggaagaggaaccct

SEQ ID NO: 9296571 - DNA, 22 bp, Homo sapiens
accctagttggttgtagaagga

SEQ ID NO: 9296572 - DNA, 23 bp, Homo sapiens
agggagctaaaaggctggagcag

SEQ ID NO: 9296573 - DNA, 17 bp, Homo sapiens
agggacagcagtttagg

SEQ ID NO: 9296574 - DNA, 22 bp, Homo sapiens
aggctggatttatggggacttc

SEQ ID NO: 9296575 - DNA, 19 bp, Homo sapiens
accaaaggagtggggtata

SEQ ID NO: 9296576 - DNA, 22 bp, Homo sapiens
acattttttagagtcccacatt

SEQ ID NO: 9296577 - DNA, 22 bp, Homo sapiens
actgcactccagcctcggggtc

SEQ ID NO: 9296578 - DNA, 22 bp, Homo sapiens
actgcactccaacctgggtgac

SEQ ID NO: 9296579 - DNA, 22 bp, Homo sapiens
actgcactccagcctgggtaac

SEQ ID NO: 9296580 - DNA, 22 bp, Homo sapiens
actgcactccagcctgggtaac

SEQ ID NO: 9296581 - DNA, 22 bp, Homo sapiens
actctcccttatctaactttac

SEQ ID NO: 9296582 - DNA, 22 bp, Homo sapiens
actctccctgctatccacttcc

SEQ ID NO: 9296583 - DNA, 22 bp, Homo sapiens
actctgcttattgctgcaggca

SEQ ID NO: 9296584 - DNA, 22 bp, Homo sapiens
actctgcttgggccatatctgg

SEQ ID NO: 9296585 - DNA, 22 bp, Homo sapiens
actggccatgaacttgggatct

SEQ ID NO: 9296586 - DNA, 22 bp, Homo sapiens
actggccaggcacagctgtggg

SEQ ID NO: 9296587 - DNA, 22 bp, Homo sapiens
actggacagaggaaatatggag

SEQ ID NO: 9296588 - DNA, 22 bp, Homo sapiens
actggaggcccctcccagtgaa

SEQ ID NO: 9296589 - DNA, 22 bp, Homo sapiens
actctcccacgttcgactctaa

SEQ ID NO: 9296590 - DNA, 19 bp, Homo sapiens
actctacagtgtgtacaac

SEQ ID NO: 9296591 - DNA, 20 bp, Homo sapiens
actctacccctgttatcgca

SEQ ID NO: 9296592 - DNA, 20 bp, Homo sapiens
actctaccagggcagcagca

SEQ ID NO: 9296593 - DNA, 22 bp, Homo sapiens
actctaccatgccactccatag

SEQ ID NO: 9296594 - DNA, 23 bp, Homo sapiens
actccccagtctcttcttgccaa

SEQ ID NO: 9296595 - DNA, 22 bp, Homo sapiens
actatacaccaaaatattaagg

SEQ ID NO: 9296596 - DNA, 22 bp, Homo sapiens
aagtctctttacctctccaggc

SEQ ID NO: 9296597 - DNA, 22 bp, Homo sapiens
aagtctcttcctctgccaaaga

SEQ ID NO: 9296598 - DNA, 22 bp, Homo sapiens
aagtctctggtgatgcaggaaa

SEQ ID NO: 9296599 - DNA, 22 bp, Homo sapiens
aagtctctggcaaatgatcttg

SEQ ID NO: 9296600 - DNA, 22 bp, Homo sapiens
aagtctcttagtaatatccaac

SEQ ID NO: 9296601 - DNA, 22 bp, Homo sapiens
aagtctctggttgcttgcatgg

SEQ ID NO: 9296602 - DNA, 22 bp, Homo sapiens
aagtctctcatggctgacagca

SEQ ID NO: 9296603 - DNA, 22 bp, Homo sapiens
aagtctctaagactgtgccatc

SEQ ID NO: 9296604 - DNA, 22 bp, Homo sapiens
aagtctctcacatatctggtcc

SEQ ID NO: 9296605 - DNA, 18 bp, Homo sapiens
aagtctctgaaagctttt

SEQ ID NO: 9296606 - DNA, 22 bp, Homo sapiens
aagtctctctgtgtgggataag

SEQ ID NO: 9296607 - DNA, 22 bp, Homo sapiens
aagtctctgactcacacaatgt

SEQ ID NO: 9296608 - DNA, 22 bp, Homo sapiens
aagtctctgatgtgtgttaggt

SEQ ID NO: 9296609 - DNA, 22 bp, Homo sapiens
aagtctctgatgtgtgttaggt

SEQ ID NO: 9296610 - DNA, 22 bp, Homo sapiens
aagtcgtggcaggcttgcacga

SEQ ID NO: 9296611 - DNA, 20 bp, Homo sapiens
acgtggccaccagtggctta

SEQ ID NO: 9296612 - DNA, 22 bp, Homo sapiens
acgtgcaggatctggttggcga

SEQ ID NO: 9296613 - DNA, 22 bp, Homo sapiens
acgtgcaggatctggttggcga

SEQ ID NO: 9296614 - DNA, 22 bp, Homo sapiens
acggtgctgggtattggggttc

SEQ ID NO: 9296615 - DNA, 22 bp, Homo sapiens
actttatgatacagggaagggt

SEQ ID NO: 9296616 - DNA, 22 bp, Homo sapiens
actttatgctaaactttactct

SEQ ID NO: 9296617 - DNA, 20 bp, Homo sapiens
actttatgagttcaattttg

SEQ ID NO: 9296618 - DNA, 21 bp, Homo sapiens
actttatgacctacccttttt

SEQ ID NO: 9296619 - DNA, 22 bp, Homo sapiens
actttatgtttgatatctatgg

SEQ ID NO: 9296620 - DNA, 22 bp, Homo sapiens
actttatgtgcttgctctttcc

SEQ ID NO: 9296621 - DNA, 23 bp, Homo sapiens
actttattgaccccaggtcagtt

SEQ ID NO: 9296622 - DNA, 23 bp, Homo sapiens
actttattgaccccaggtcagtt

SEQ ID NO: 9296623 - DNA, 22 bp, Homo sapiens
actttatttcctattgcatcca

SEQ ID NO: 9296624 - DNA, 22 bp, Homo sapiens
actttatgacaccctttagtga

SEQ ID NO: 9296625 - DNA, 22 bp, Homo sapiens
aatatagaatcactttccttca

SEQ ID NO: 9296626 - DNA, 22 bp, Homo sapiens
aatagtagtcgccttttgtaag

SEQ ID NO: 9296627 - DNA, 22 bp, Homo sapiens
agaaattctaagcatcaatagc

SEQ ID NO: 9296628 - DNA, 22 bp, Homo sapiens
agaacaatgaggtatggatgga

SEQ ID NO: 9296629 - DNA, 22 bp, Homo sapiens
agaaattcaattctaattagct

SEQ ID NO: 9296630 - DNA, 22 bp, Homo sapiens
agaaattattagtgaatagtct

SEQ ID NO: 9296631 - DNA, 22 bp, Homo sapiens
accctgccgtgggctgcttgtg

SEQ ID NO: 9296632 - DNA, 21 bp, Homo sapiens
accaggcttgtgggagggagc

SEQ ID NO: 9296633 - DNA, 22 bp, Homo sapiens
acatttcttccctttagcagaa

SEQ ID NO: 9296634 - DNA, 22 bp, Homo sapiens
acatttctggagtttctcaaca

SEQ ID NO: 9296635 - DNA, 22 bp, Homo sapiens
aaggctggacctggatgaatct

SEQ ID NO: 9296636 - DNA, 22 bp, Homo sapiens
acattgttctacttctagttag

SEQ ID NO: 9296637 - DNA, 22 bp, Homo sapiens
acattgttgtgcaattatagtt

SEQ ID NO: 9296638 - DNA, 22 bp, Homo sapiens
aaggctatgatctttttcatga

SEQ ID NO: 9296639 - DNA, 20 bp, Homo sapiens
aaggcagagtgggttggagc

SEQ ID NO: 9296640 - DNA, 22 bp, Homo sapiens
aaggccagggatgccagctcgg

SEQ ID NO: 9296641 - DNA, 22 bp, Homo sapiens
aagcattttgccacttgaagtt

SEQ ID NO: 9296642 - DNA, 22 bp, Homo sapiens
aagcattttgccacttgaagtt

SEQ ID NO: 9296643 - DNA, 22 bp, Homo sapiens
aagcatttgtgaaattcagatg

SEQ ID NO: 9296644 - DNA, 22 bp, Homo sapiens
acagccttattgcgagcaaggc

SEQ ID NO: 9296645 - DNA, 22 bp, Homo sapiens
aagccaagagttaactatttgt

SEQ ID NO: 9296646 - DNA, 22 bp, Homo sapiens
acagggaaagggacagcagcag

SEQ ID NO: 9296647 - DNA, 23 bp, Homo sapiens
acagggaaaagtcatcagtgtga

SEQ ID NO: 9296648 - DNA, 22 bp, Homo sapiens
acagggcagaaatgttgcatct

SEQ ID NO: 9296649 - DNA, 22 bp, Homo sapiens
acagggcagagaggcaggcttg

SEQ ID NO: 9296650 - DNA, 22 bp, Homo sapiens
acagggcagagggcagttggta

SEQ ID NO: 9296651 - DNA, 22 bp, Homo sapiens
acagggcagcaactttgtgcct

SEQ ID NO: 9296652 - DNA, 19 bp, Homo sapiens
acagggcagcaataggata

SEQ ID NO: 9296653 - DNA, 22 bp, Homo sapiens
acagggcagagtgaaatgctat

SEQ ID NO: 9296654 - DNA, 22 bp, Homo sapiens
aaggcagaggaaggtctagttt

SEQ ID NO: 9296655 - DNA, 22 bp, Homo sapiens
aaggcagagggctggatcagag

SEQ ID NO: 9296656 - DNA, 22 bp, Homo sapiens
aaggcagagattagcagaatga

SEQ ID NO: 9296657 - DNA, 22 bp, Homo sapiens
aaggaggaatttcagggtgaat

SEQ ID NO: 9296658 - DNA, 22 bp, Homo sapiens
aaggaggacacccaggactggg

SEQ ID NO: 9296659 - DNA, 22 bp, Homo sapiens
aaggaggaatttcagggtgaat

SEQ ID NO: 9296660 - DNA, 22 bp, Homo sapiens
aaggaggagtggggtcctggaa

SEQ ID NO: 9296661 - DNA, 22 bp, Homo sapiens
aaggaggagcggaggcttgttg

SEQ ID NO: 9296662 - DNA, 22 bp, Homo sapiens
aaggaggcaccctgagcctgcc

SEQ ID NO: 9296663 - DNA, 22 bp, Homo sapiens
aaggaggacacccaggactggg

SEQ ID NO: 9296664 - DNA, 22 bp, Homo sapiens
aaggaggcactcgctctcaggg

SEQ ID NO: 9296665 - DNA, 22 bp, Homo sapiens
aaggaggaataaagaggtggtg

SEQ ID NO: 9296666 - DNA, 22 bp, Homo sapiens
aagctggagagttaggtgaata

SEQ ID NO: 9296667 - DNA, 22 bp, Homo sapiens
aaggagagagctttgctggaac

SEQ ID NO: 9296668 - DNA, 22 bp, Homo sapiens
aaggagagtacaggagttggta

SEQ ID NO: 9296669 - DNA, 23 bp, Homo sapiens
acaagatagggataaaaagataa

SEQ ID NO: 9296670 - DNA, 22 bp, Homo sapiens
acaagcgggccacagtgctggt

SEQ ID NO: 9296671 - DNA, 22 bp, Homo sapiens
acaacaatctaccctagcttct

SEQ ID NO: 9296672 - DNA, 22 bp, Homo sapiens
agataacatttattgaatgtaa

SEQ ID NO: 9296673 - DNA, 22 bp, Homo sapiens
agataatgattctgcatttcta

SEQ ID NO: 9296674 - DNA, 22 bp, Homo sapiens
agataatggagggatttgcatt

SEQ ID NO: 9296675 - DNA, 22 bp, Homo sapiens
acaagatagcttagaagattca

SEQ ID NO: 9296676 - DNA, 22 bp, Homo sapiens
acaagagcattgcaggtgtgtt

SEQ ID NO: 9296677 - DNA, 22 bp, Homo sapiens
acaagagacaagaggttcttct

SEQ ID NO: 9296678 - DNA, 22 bp, Homo sapiens
aattgcaaattcagacttaaga

SEQ ID NO: 9296679 - DNA, 22 bp, Homo sapiens
agaggctgaatgatgtcatcat

SEQ ID NO: 9296680 - DNA, 22 bp, Homo sapiens
agaggctctttgagctgggaga

SEQ ID NO: 9296681 - DNA, 22 bp, Homo sapiens
agaggctgagaaaccctcttct

SEQ ID NO: 9296682 - DNA, 22 bp, Homo sapiens
agaggctctggtgcagcatgca

SEQ ID NO: 9296683 - DNA, 22 bp, Homo sapiens
agaggctctggtgggagttggt

SEQ ID NO: 9296684 - DNA, 22 bp, Homo sapiens
agagggggcagcggaccagtga

SEQ ID NO: 9296685 - DNA, 22 bp, Homo sapiens
agagggggaaaatagaggtgtt

SEQ ID NO: 9296686 - DNA, 22 bp, Homo sapiens
acaaagtaagggctaatgagca

SEQ ID NO: 9296687 - DNA, 22 bp, Homo sapiens
acaaagtagtcaaagtagatga

SEQ ID NO: 9296688 - DNA, 22 bp, Homo sapiens
acaaagtaggaagattagctga

SEQ ID NO: 9296689 - DNA, 22 bp, Homo sapiens
agaggcttcctgccacctgaga

SEQ ID NO: 9296690 - DNA, 20 bp, Homo sapiens
agaggcttccttgggaggag

SEQ ID NO: 9296691 - DNA, 22 bp, Homo sapiens
agaggcttctcggatggggcag

SEQ ID NO: 9296692 - DNA, 20 bp, Homo sapiens
agaggcttccttgggaggag

SEQ ID NO: 9296693 - DNA, 22 bp, Homo sapiens
acaaagcttagacctaagagat

SEQ ID NO: 9296694 - DNA, 19 bp, Homo sapiens
acaaagctgtgagcagctt

SEQ ID NO: 9296695 - DNA, 22 bp, Homo sapiens
agaggctgtgcccaccaggcaa

SEQ ID NO: 9296696 - DNA, 22 bp, Homo sapiens
agaggctgatggagtagtgtct

SEQ ID NO: 9296697 - DNA, 22 bp, Homo sapiens
agaggctgttacactcccagat

SEQ ID NO: 9296698 - DNA, 22 bp, Homo sapiens
agaccctatgcaacatttcacc

SEQ ID NO: 9296699 - DNA, 22 bp, Homo sapiens
agagcctggacctgggctctga

SEQ ID NO: 9296700 - DNA, 23 bp, Homo sapiens
aatgggtgcaactatccatgaca

SEQ ID NO: 9296701 - DNA, 22 bp, Homo sapiens
aatggtatcacctcacagaatt

SEQ ID NO: 9296702 - DNA, 22 bp, Homo sapiens
aatgtaaaatatcttgtacttg

SEQ ID NO: 9296703 - DNA, 20 bp, Homo sapiens
agacaatgagtgacagagtt

SEQ ID NO: 9296704 - DNA, 19 bp, Homo sapiens
agacaatggggttggcagt

SEQ ID NO: 9296705 - DNA, 22 bp, Homo sapiens
aatggccagcaacaggagtgaa

SEQ ID NO: 9296706 - DNA, 22 bp, Homo sapiens
aatggccagacagatggctgct

SEQ ID NO: 9296707 - DNA, 22 bp, Homo sapiens
aatggcagaggcaaagatggta

SEQ ID NO: 9296708 - DNA, 22 bp, Homo sapiens
aatggagaggctgtgagtgaga

SEQ ID NO: 9296709 - DNA, 22 bp, Homo sapiens
aatggcaattcagtgaaattat

SEQ ID NO: 9296710 - DNA, 22 bp, Homo sapiens
acagacaagtagttcagacaag

SEQ ID NO: 9296711 - DNA, 22 bp, Homo sapiens
acagacagattttgtctgatgt

SEQ ID NO: 9296712 - DNA, 22 bp, Homo sapiens
acagacagggcacctgcctcct

SEQ ID NO: 9296713 - DNA, 22 bp, Homo sapiens
acagacagacagagaactattc

SEQ ID NO: 9296714 - DNA, 22 bp, Homo sapiens
acagacagaggctccatgagga

SEQ ID NO: 9296715 - DNA, 22 bp, Homo sapiens
acagacagacagattgcatatg

SEQ ID NO: 9296716 - DNA, 22 bp, Homo sapiens
acactttatcaatattcaaaaa

SEQ ID NO: 9296717 - DNA, 22 bp, Homo sapiens
acactttatctcatctcagaca

SEQ ID NO: 9296718 - DNA, 22 bp, Homo sapiens
acagaaacccagaaaacctctc

SEQ ID NO: 9296719 - DNA, 22 bp, Homo sapiens
agccagggtctctcgctctgtt

SEQ ID NO: 9296720 - DNA, 21 bp, Homo sapiens
acagagaaagagcagcctcct

SEQ ID NO: 9296721 - DNA, 22 bp, Homo sapiens
acagagaaagtgggctgaagat

SEQ ID NO: 9296722 - DNA, 22 bp, Homo sapiens
acagagacttggagcaggctga

SEQ ID NO: 9296723 - DNA, 22 bp, Homo sapiens
acagagactgggagcaagaggc

SEQ ID NO: 9296724 - DNA, 22 bp, Homo sapiens
acagagaaagtgggctgaagat

SEQ ID NO: 9296725 - DNA, 22 bp, Homo sapiens
acagagaaagttcctctcaggc

SEQ ID NO: 9296726 - DNA, 22 bp, Homo sapiens
agcctctctttctggtggctaa

SEQ ID NO: 9296727 - DNA, 22 bp, Homo sapiens
agcctctcttatcccttcaaag

SEQ ID NO: 9296728 - DNA, 22 bp, Homo sapiens
agcctctctttattcccagcta

SEQ ID NO: 9296729 - DNA, 22 bp, Homo sapiens
agcctctagaccctggcctgca

SEQ ID NO: 9296730 - DNA, 22 bp, Homo sapiens
agcctctcactgtcaccctccc

SEQ ID NO: 9296731 - DNA, 22 bp, Homo sapiens
agcctctcatgttctcccccag

SEQ ID NO: 9296732 - DNA, 22 bp, Homo sapiens
agcctctccagagcctggcaga

SEQ ID NO: 9296733 - DNA, 22 bp, Homo sapiens
acactctgtaatgtcacactcc

SEQ ID NO: 9296734 - DNA, 22 bp, Homo sapiens
acactcaccctcccactgcctg

SEQ ID NO: 9296735 - DNA, 21 bp, Homo sapiens
acacagaggcatcatcacttt

SEQ ID NO: 9296736 - DNA, 22 bp, Homo sapiens
acacagaggaaagtgtgaaggg

SEQ ID NO: 9296737 - DNA, 22 bp, Homo sapiens
acacagaggcatgacagtggct

SEQ ID NO: 9296738 - DNA, 22 bp, Homo sapiens
acacagaggctccagagataga

SEQ ID NO: 9296739 - DNA, 22 bp, Homo sapiens
acacagagtatttagaaggggt

SEQ ID NO: 9296740 - DNA, 22 bp, Homo sapiens
acacagagtccttactgaggta

SEQ ID NO: 9296741 - DNA, 22 bp, Homo sapiens
acacagagtttgacacatggga

SEQ ID NO: 9296742 - DNA, 22 bp, Homo sapiens
acacagagtttgacacatggga

SEQ ID NO: 9296743 - DNA, 22 bp, Homo sapiens
acacagatgcattacacatcta

SEQ ID NO: 9296744 - DNA, 22 bp, Homo sapiens
agcagctggggcctgtgacgat

SEQ ID NO: 9296745 - DNA, 17 bp, Homo sapiens
agcagctgggttgatct

SEQ ID NO: 9296746 - DNA, 21 bp, Homo sapiens
agcagagccaccattacctgc

SEQ ID NO: 9296747 - DNA, 22 bp, Homo sapiens
agcagagcagatagtattatct

SEQ ID NO: 9296748 - DNA, 19 bp, Homo sapiens
agcagagcaaagtggctga

SEQ ID NO: 9296749 - DNA, 22 bp, Homo sapiens
agcagagtgtgaaggcagggct

SEQ ID NO: 9296750 - DNA, 22 bp, Homo sapiens
aacatgtgtcttgcatttcttg

SEQ ID NO: 9296751 - DNA, 22 bp, Homo sapiens
aacccgggaggcggaggttgtg

SEQ ID NO: 9296752 - DNA, 22 bp, Homo sapiens
aaccctaggtggcagaggttgc

SEQ ID NO: 9296753 - DNA, 22 bp, Homo sapiens
aaccctgggaggcagctcagtt

SEQ ID NO: 9296754 - DNA, 22 bp, Homo sapiens
aatgaacaaatggtgctgcttg

SEQ ID NO: 9296755 - DNA, 22 bp, Homo sapiens
aatgaacaacactgaaggaaga

SEQ ID NO: 9296756 - DNA, 22 bp, Homo sapiens
aacctttatttggtactattct

SEQ ID NO: 9296757 - DNA, 19 bp, Homo sapiens
aacctttagatcattctcc

SEQ ID NO: 9296758 - DNA, 22 bp, Homo sapiens
aatgacagagcactgaacttgg

SEQ ID NO: 9296759 - DNA, 22 bp, Homo sapiens
aatggccagctgggagagttga

SEQ ID NO: 9296760 - DNA, 22 bp, Homo sapiens
aatggccatatcattgcagagc

SEQ ID NO: 9296761 - DNA, 23 bp, Homo sapiens
aagtgggtttagacagtcatttt

SEQ ID NO: 9296762 - DNA, 22 bp, Homo sapiens
aagtgggttggacaaatgaccc

SEQ ID NO: 9296763 - DNA, 20 bp, Homo sapiens
aagtgggtttattctttttc

SEQ ID NO: 9296764 - DNA, 22 bp, Homo sapiens
aagtgggtttgaaatgctttca

SEQ ID NO: 9296765 - DNA, 22 bp, Homo sapiens
aacatgtgagcaggttttttat

SEQ ID NO: 9296766 - DNA, 22 bp, Homo sapiens
aacatgtgtctggctagattgt

SEQ ID NO: 9296767 - DNA, 22 bp, Homo sapiens
aacatctactaagtgccaggca

SEQ ID NO: 9296768 - DNA, 22 bp, Homo sapiens
aacatctcatggactacattct

SEQ ID NO: 9296769 - DNA, 22 bp, Homo sapiens
aacatgaaaagcccagagaggt

SEQ ID NO: 9296770 - DNA, 22 bp, Homo sapiens
aacatctttttgtttgctgaaa

SEQ ID NO: 9296771 - DNA, 22 bp, Homo sapiens
aacagaatagttgatgtacagt

SEQ ID NO: 9296772 - DNA, 22 bp, Homo sapiens
aacagacaactcctgtggctca

SEQ ID NO: 9296773 - DNA, 22 bp, Homo sapiens
aacagacagaaaaatgtgatct

SEQ ID NO: 9296774 - DNA, 22 bp, Homo sapiens
aacagacatatttttaatatgc

SEQ ID NO: 9296775 - DNA, 22 bp, Homo sapiens
aacactttttagtaaagattga

SEQ ID NO: 9296776 - DNA, 22 bp, Homo sapiens
aacacagatcaaaatatttcct

SEQ ID NO: 9296777 - DNA, 22 bp, Homo sapiens
aaatttctgttgttttgagcca

SEQ ID NO: 9296778 - DNA, 21 bp, Homo sapiens
aaattcacctagtaaaacttc

SEQ ID NO: 9296779 - DNA, 22 bp, Homo sapiens
aaggaagagtctagaacaggca

SEQ ID NO: 9296780 - DNA, 22 bp, Homo sapiens
aaggaagactcgcaggtctatg

SEQ ID NO: 9296781 - DNA, 22 bp, Homo sapiens
aagaaaatcagttctggtcagt

SEQ ID NO: 9296782 - DNA, 22 bp, Homo sapiens
aagaaaacaatgacttgccagc

SEQ ID NO: 9296783 - DNA, 22 bp, Homo sapiens
aagaaaatcagttctggtcagt

SEQ ID NO: 9296784 - DNA, 22 bp, Homo sapiens
aatttaaggaggccttcactct

SEQ ID NO: 9296785 - DNA, 22 bp, Homo sapiens
aagaacagattcagcctgaact

SEQ ID NO: 9296786 - DNA, 22 bp, Homo sapiens
aagaaattaatgtgccattact

SEQ ID NO: 9296787 - DNA, 22 bp, Homo sapiens
aattcctctatctttcttcaag

SEQ ID NO: 9296788 - DNA, 22 bp, Homo sapiens
aattctcaggtaaaagttaagt

SEQ ID NO: 9296789 - DNA, 22 bp, Homo sapiens
aattcccaccttctctcttttg

SEQ ID NO: 9296790 - DNA, 21 bp, Homo sapiens
aattcccagaaacagcacaag

SEQ ID NO: 9296791 - DNA, 22 bp, Homo sapiens
aattcccactatatgccaagca

SEQ ID NO: 9296792 - DNA, 22 bp, Homo sapiens
aattcccatttgcagaaaatca

SEQ ID NO: 9296793 - DNA, 22 bp, Homo sapiens
aagaaagataaggtttgcttgg

SEQ ID NO: 9296794 - DNA, 22 bp, Homo sapiens
acacaaaatcaaagtcctaggc

SEQ ID NO: 9296795 - DNA, 22 bp, Homo sapiens
aagagacttgtccgaagttgta

SEQ ID NO: 9296796 - DNA, 22 bp, Homo sapiens
acacaaagttggatgacaaaat

SEQ ID NO: 9296797 - DNA, 22 bp, Homo sapiens
aagagcactaacagagctgata

SEQ ID NO: 9296798 - DNA, 22 bp, Homo sapiens
aagacttgaccaggttgaaggc

SEQ ID NO: 9296799 - DNA, 22 bp, Homo sapiens
aagagaaagcagactttgtcat

SEQ ID NO: 9296800 - DNA, 22 bp, Homo sapiens
aagcagcttaaattagagcctg

SEQ ID NO: 9296801 - DNA, 22 bp, Homo sapiens
acagcagagcctagcttaatct

SEQ ID NO: 9296802 - DNA, 22 bp, Homo sapiens
aagcagctgatttcacagctca

SEQ ID NO: 9296803 - DNA, 22 bp, Homo sapiens
acagcagagacactcaggaggc

SEQ ID NO: 9296804 - DNA, 22 bp, Homo sapiens
acagcagactttctacagctca

SEQ ID NO: 9296805 - DNA, 22 bp, Homo sapiens
aagcacaatttaggactgaaat

SEQ ID NO: 9296806 - DNA, 22 bp, Homo sapiens
aagcacccaatttacagcagtt

SEQ ID NO: 9296807 - DNA, 22 bp, Homo sapiens
aagcaagacagaagttactgcc

SEQ ID NO: 9296808 - DNA, 22 bp, Homo sapiens
aagcaaagagataaccttttgg

SEQ ID NO: 9296809 - DNA, 22 bp, Homo sapiens
acacatgagaaacatcagttgt

SEQ ID NO: 9296810 - DNA, 22 bp, Homo sapiens
acacatcttagactgaaatatg

SEQ ID NO: 9296811 - DNA, 22 bp, Homo sapiens
aagaacagttgggaggtgagcc

SEQ ID NO: 9296812 - DNA, 22 bp, Homo sapiens
aagaacatgaacacaatgttta

SEQ ID NO: 9296813 - DNA, 22 bp, Homo sapiens
aagaacatgagttatgatgatt

SEQ ID NO: 9296814 - DNA, 22 bp, Homo sapiens
aacccgggaggcagaggttgtg

SEQ ID NO: 9296815 - DNA, 22 bp, Homo sapiens
aaagccttggtcatctggttcc

SEQ ID NO: 9296816 - DNA, 22 bp, Homo sapiens
aaagccttgggatttgtgatca

SEQ ID NO: 9296817 - DNA, 22 bp, Homo sapiens
aacatacagtgagcagtggact

SEQ ID NO: 9296818 - DNA, 22 bp, Homo sapiens
aaagcctcccaggttatgagta

SEQ ID NO: 9296819 - DNA, 19 bp, Homo sapiens
aaagcagaggagcatctga

SEQ ID NO: 9296820 - DNA, 22 bp, Homo sapiens
aaagcagattctgatgcagtag

SEQ ID NO: 9296821 - DNA, 22 bp, Homo sapiens
aaagcaaacagaaccccaagct

SEQ ID NO: 9296822 - DNA, 22 bp, Homo sapiens
aaagatttcagaagcctgtgcc

SEQ ID NO: 9296823 - DNA, 22 bp, Homo sapiens
aaatctgagaaatattgtccag

SEQ ID NO: 9296824 - DNA, 22 bp, Homo sapiens
aagcaggcattccagagacaat

SEQ ID NO: 9296825 - DNA, 22 bp, Homo sapiens
aagcccttggcgcacaccgggc

SEQ ID NO: 9296826 - DNA, 22 bp, Homo sapiens
aagatcaagatcagagaacagc

SEQ ID NO: 9296827 - DNA, 22 bp, Homo sapiens
aagcaggagatgggtgcttttc

SEQ ID NO: 9296828 - DNA, 22 bp, Homo sapiens
aaatactgctgctattcctttt

SEQ ID NO: 9296829 - DNA, 22 bp, Homo sapiens
aagaggggtggtctgtgaggat

SEQ ID NO: 9296830 - DNA, 22 bp, Homo sapiens
aaaattctcttgatcttgacag

SEQ ID NO: 9296831 - DNA, 22 bp, Homo sapiens
aaaattcattcctcagactgcc

SEQ ID NO: 9296832 - DNA, 22 bp, Homo sapiens
aaaattctgtcattaaattgtg

SEQ ID NO: 9296833 - DNA, 20 bp, Homo sapiens
aaagagcccttggagcaggc

SEQ ID NO: 9296834 - DNA, 22 bp, Homo sapiens
aaaattggttcctttctgaggc

SEQ ID NO: 9296835 - DNA, 21 bp, Homo sapiens
aaagagcccgctgagaggttc

SEQ ID NO: 9296836 - DNA, 19 bp, Homo sapiens
aaaattgcgtattttgagg

SEQ ID NO: 9296837 - DNA, 22 bp, Homo sapiens
aaaaggaggtcactttattcct

SEQ ID NO: 9296838 - DNA, 22 bp, Homo sapiens
aaaaggaggacatggttacaga

SEQ ID NO: 9296839 - DNA, 18 bp, Homo sapiens
aaaaagtgctcaggccta

SEQ ID NO: 9296840 - DNA, 22 bp, Homo sapiens
aaaaagtctgcaaaggaggttg

SEQ ID NO: 9296841 - DNA, 22 bp, Homo sapiens
aaaaggcagtgcaagagagggt

SEQ ID NO: 9296842 - DNA, 22 bp, Homo sapiens
aaacattccatatataccttgt

SEQ ID NO: 9296843 - DNA, 22 bp, Homo sapiens
aaacattccatttctatgtaag

SEQ ID NO: 9296844 - DNA, 20 bp, Homo sapiens
aaacattcatgtacaagtga

SEQ ID NO: 9296845 - DNA, 22 bp, Homo sapiens
aaacagctgtcattgttttaaa

SEQ ID NO: 9296846 - DNA, 22 bp, Homo sapiens
aaacagagtttggtaaatagcc

SEQ ID NO: 9296847 - DNA, 22 bp, Homo sapiens
aaagactgggactgcagcaggc

SEQ ID NO: 9296848 - DNA, 22 bp, Homo sapiens
aaagactggttggggtgggcag

SEQ ID NO: 9296849 - DNA, 22 bp, Homo sapiens
aaagactgaggggaaagtgatg

SEQ ID NO: 9296850 - DNA, 22 bp, Homo sapiens
aaagactgcaaaaacgcacaga

SEQ ID NO: 9296851 - DNA, 20 bp, Homo sapiens
aaagagaagcctcaccttgt

SEQ ID NO: 9296852 - DNA, 22 bp, Homo sapiens
gtaaatataaatgctagctgcc

SEQ ID NO: 9296853 - DNA, 22 bp, Homo sapiens
gtacacacaatctctggtcagt

SEQ ID NO: 9296854 - DNA, 22 bp, Homo sapiens
ggtgtcctgggcaggcagctga

SEQ ID NO: 9296855 - DNA, 22 bp, Homo sapiens
ggtgtcctgtcagctagagtga

SEQ ID NO: 9296856 - DNA, 22 bp, Homo sapiens
ggtgtcctcatgattttctaga

SEQ ID NO: 9296857 - DNA, 22 bp, Homo sapiens
ggtgtcctcactatagcaagtc

SEQ ID NO: 9296858 - DNA, 22 bp, Homo sapiens
ggtgtcctcggattcagggcag

SEQ ID NO: 9296859 - DNA, 21 bp, Homo sapiens
ggtgtcctgagggataggtag

SEQ ID NO: 9296860 - DNA, 22 bp, Homo sapiens
gtacatttactgatgaaaagta

SEQ ID NO: 9296861 - DNA, 19 bp, Homo sapiens
gtacagtggtaagctatga

SEQ ID NO: 9296862 - DNA, 22 bp, Homo sapiens
gtatggcactatcctctctgat

SEQ ID NO: 9296863 - DNA, 21 bp, Homo sapiens
gtatggcattgattagttact

SEQ ID NO: 9296864 - DNA, 22 bp, Homo sapiens
gtatatattggataaaccagag

SEQ ID NO: 9296865 - DNA, 22 bp, Homo sapiens
gtatataaggtaaagcgattgt

SEQ ID NO: 9296866 - DNA, 22 bp, Homo sapiens
gtatactcatgtctcagaggac

SEQ ID NO: 9296867 - DNA, 22 bp, Homo sapiens
gtatactcaacctgcctagaat

SEQ ID NO: 9296868 - DNA, 22 bp, Homo sapiens
gggtggggccaggcaatttgca

SEQ ID NO: 9296869 - DNA, 22 bp, Homo sapiens
gggtggggtgtatcggatccta

SEQ ID NO: 9296870 - DNA, 22 bp, Homo sapiens
gggtggggcccaggaaatctat

SEQ ID NO: 9296871 - DNA, 21 bp, Homo sapiens
gggtggggttccagccttttc

SEQ ID NO: 9296872 - DNA, 22 bp, Homo sapiens
gggtggggttcaggaatcttca

SEQ ID NO: 9296873 - DNA, 22 bp, Homo sapiens
ggtgagggtaaatataggcaaa

SEQ ID NO: 9296874 - DNA, 22 bp, Homo sapiens
ggtgcaggagcggggtgctcgg

SEQ ID NO: 9296875 - DNA, 22 bp, Homo sapiens
ggtggcagaggtgcatcagccc

SEQ ID NO: 9296876 - DNA, 22 bp, Homo sapiens
ggtgcaggacgaagtgggggtt

SEQ ID NO: 9296877 - DNA, 22 bp, Homo sapiens
ggtgtcctacagggccgcaggc

SEQ ID NO: 9296878 - DNA, 19 bp, Homo sapiens
ggtgtcctagagataagag

SEQ ID NO: 9296879 - DNA, 22 bp, Homo sapiens
ggtgtcctactgcttggttgct

SEQ ID NO: 9296880 - DNA, 22 bp, Homo sapiens
ggtggcataagaacactaaaga

SEQ ID NO: 9296881 - DNA, 22 bp, Homo sapiens
ggtggcatacatttctgtcttg

SEQ ID NO: 9296882 - DNA, 22 bp, Homo sapiens
ggtggccaggccagctctggcc

SEQ ID NO: 9296883 - DNA, 22 bp, Homo sapiens
gtcccatcccccttggcactca

SEQ ID NO: 9296884 - DNA, 22 bp, Homo sapiens
gtcccagggaagaaggcagcac

SEQ ID NO: 9296885 - DNA, 22 bp, Homo sapiens
gtccagtgacaagtagctggcc

SEQ ID NO: 9296886 - DNA, 22 bp, Homo sapiens
gtcagctgcacaggtgggagct

SEQ ID NO: 9296887 - DNA, 22 bp, Homo sapiens
gtcagctgcagtgggcacagcc

SEQ ID NO: 9296888 - DNA, 21 bp, Homo sapiens
gtcagctgtgtgtgaggaccc

SEQ ID NO: 9296889 - DNA, 22 bp, Homo sapiens
gtatgtctatttcaaatagctg

SEQ ID NO: 9296890 - DNA, 22 bp, Homo sapiens
gtcaggatcaaattgaagttat

SEQ ID NO: 9296891 - DNA, 22 bp, Homo sapiens
gtcaggagatagggcaagcttc

SEQ ID NO: 9296892 - DNA, 21 bp, Homo sapiens
gtcaggagccgtcttacattc

SEQ ID NO: 9296893 - DNA, 22 bp, Homo sapiens
gtcaggagagatcaggacagca

SEQ ID NO: 9296894 - DNA, 22 bp, Homo sapiens
gtcaggagagacctgttctcct

SEQ ID NO: 9296895 - DNA, 22 bp, Homo sapiens
gtcaggagaggccatcagcttt

SEQ ID NO: 9296896 - DNA, 22 bp, Homo sapiens
gtcaggactctgacccgtcccg

SEQ ID NO: 9296897 - DNA, 22 bp, Homo sapiens
gtccttggcttcttgttgactg

SEQ ID NO: 9296898 - DNA, 22 bp, Homo sapiens
gtctgaagccagtggtagtccg

SEQ ID NO: 9296899 - DNA, 22 bp, Homo sapiens
gtctctgagctctgagctggct

SEQ ID NO: 9296900 - DNA, 22 bp, Homo sapiens
gtggcagtgggatgctatcagg

SEQ ID NO: 9296901 - DNA, 22 bp, Homo sapiens
gtggcagttttgacatcacaaa

SEQ ID NO: 9296902 - DNA, 22 bp, Homo sapiens
gtggcccaggcttggcgctggc

SEQ ID NO: 9296903 - DNA, 22 bp, Homo sapiens
gtggccaggagagggtgggaca

SEQ ID NO: 9296904 - DNA, 22 bp, Homo sapiens
gtggccaggacattgccaggca

SEQ ID NO: 9296905 - DNA, 22 bp, Homo sapiens
gtggccaggagaccttgggcat

SEQ ID NO: 9296906 - DNA, 22 bp, Homo sapiens
gtggccagctgtcagcaccctt

SEQ ID NO: 9296907 - DNA, 22 bp, Homo sapiens
gtggccagaagactgcaatgct

SEQ ID NO: 9296908 - DNA, 22 bp, Homo sapiens
gtggccagaagttaagtggtta

SEQ ID NO: 9296909 - DNA, 22 bp, Homo sapiens
gtggccagaaccaggagaatga

SEQ ID NO: 9296910 - DNA, 22 bp, Homo sapiens
gtggccagaatcttgaggcctt

SEQ ID NO: 9296911 - DNA, 22 bp, Homo sapiens
gtggccagagattaaatagagt

SEQ ID NO: 9296912 - DNA, 22 bp, Homo sapiens
gtggccagaggatttgttcagt

SEQ ID NO: 9296913 - DNA, 22 bp, Homo sapiens
gtggccagaggtcccatgtgtc

SEQ ID NO: 9296914 - DNA, 18 bp, Homo sapiens
gtggccagcctggtcttg

SEQ ID NO: 9296915 - DNA, 22 bp, Homo sapiens
gtggccagccccatggacagtt

SEQ ID NO: 9296916 - DNA, 22 bp, Homo sapiens
gtggccagagtgtcattttatt

SEQ ID NO: 9296917 - DNA, 22 bp, Homo sapiens
gtggccagcaagtgctgcctct

SEQ ID NO: 9296918 - DNA, 22 bp, Homo sapiens
gtggccagccagggtgctgatg

SEQ ID NO: 9296919 - DNA, 22 bp, Homo sapiens
gtgggagaaattagctctagtt

SEQ ID NO: 9296920 - DNA, 22 bp, Homo sapiens
gtgggagaagatttggtcatct

SEQ ID NO: 9296921 - DNA, 22 bp, Homo sapiens
gtggctctttatgtgttattgg

SEQ ID NO: 9296922 - DNA, 22 bp, Homo sapiens
gtggacaggcaggctgtcgggg

SEQ ID NO: 9296923 - DNA, 22 bp, Homo sapiens
gtggcagagccgtgcaggtagg

SEQ ID NO: 9296924 - DNA, 22 bp, Homo sapiens
gtgacagagttttagatctcat

SEQ ID NO: 9296925 - DNA, 22 bp, Homo sapiens
gtgctacatggtagtgtagtta

SEQ ID NO: 9296926 - DNA, 22 bp, Homo sapiens
gtgctttttataaggcagactg

SEQ ID NO: 9296927 - DNA, 22 bp, Homo sapiens
gtgcggatcggtgtcctccaaa

SEQ ID NO: 9296928 - DNA, 21 bp, Homo sapiens
gtgcggatgccgtcattgtca

SEQ ID NO: 9296929 - DNA, 22 bp, Homo sapiens
gttgtcttagtcagaaatatgc

SEQ ID NO: 9296930 - DNA, 22 bp, Homo sapiens
gttgtacatatgaggataagtt

SEQ ID NO: 9296931 - DNA, 22 bp, Homo sapiens
gttgtacaggcagggaaactga

SEQ ID NO: 9296932 - DNA, 22 bp, Homo sapiens
gttctattctccagttacatat

SEQ ID NO: 9296933 - DNA, 22 bp, Homo sapiens
gttctctctcttgcctgggtgg

SEQ ID NO: 9296934 - DNA, 22 bp, Homo sapiens
gttctctcagcgatagtgatgg

SEQ ID NO: 9296935 - DNA, 22 bp, Homo sapiens
gttctctcagcctttgttatta

SEQ ID NO: 9296936 - DNA, 22 bp, Homo sapiens
gttctctcaaactttgtgtttg

SEQ ID NO: 9296937 - DNA, 22 bp, Homo sapiens
gttcaagaccagcctggccaac

SEQ ID NO: 9296938 - DNA, 22 bp, Homo sapiens
gttcaagaccagcctggccaac

SEQ ID NO: 9296939 - DNA, 22 bp, Homo sapiens
gttattttcattggctcagact

SEQ ID NO: 9296940 - DNA, 22 bp, Homo sapiens
gtgtgtccaggcgggagtcaag

SEQ ID NO: 9296941 - DNA, 23 bp, Homo sapiens
gtgtgtccattcgcactcttagg

SEQ ID NO: 9296942 - DNA, 22 bp, Homo sapiens
gtgtgtccaaggcacggatgac

SEQ ID NO: 9296943 - DNA, 22 bp, Homo sapiens
gtgtgtccacacatacatacat

SEQ ID NO: 9296944 - DNA, 22 bp, Homo sapiens
gtgtgtccaaggccacaatagc

SEQ ID NO: 9296945 - DNA, 22 bp, Homo sapiens
gtgtgtcctcagtagtggcatg

SEQ ID NO: 9296946 - DNA, 22 bp, Homo sapiens
gtgtgtcccttggaacctcagc

SEQ ID NO: 9296947 - DNA, 22 bp, Homo sapiens
gtgtgtccctcctctcctgagt

SEQ ID NO: 9296948 - DNA, 22 bp, Homo sapiens
gtgtgtccctacaacagcttca

SEQ ID NO: 9296949 - DNA, 22 bp, Homo sapiens
gtgtcagtccagaggcagccac

SEQ ID NO: 9296950 - DNA, 22 bp, Homo sapiens
gtgtctcttttcagactcttca

SEQ ID NO: 9296951 - DNA, 22 bp, Homo sapiens
gtgtctctaggacctggtacta

SEQ ID NO: 9296952 - DNA, 22 bp, Homo sapiens
gtgtccttatgcataccagagt

SEQ ID NO: 9296953 - DNA, 22 bp, Homo sapiens
gtgtcctcttattgctcttggc

SEQ ID NO: 9296954 - DNA, 22 bp, Homo sapiens
gtgtgcagaagacacaagacat

SEQ ID NO: 9296955 - DNA, 22 bp, Homo sapiens
gtgtgcagtagagaaagagcag

SEQ ID NO: 9296956 - DNA, 22 bp, Homo sapiens
gtgggcagtggtttgcgcggtc

SEQ ID NO: 9296957 - DNA, 22 bp, Homo sapiens
gtgggcagagcaagggaactca

SEQ ID NO: 9296958 - DNA, 22 bp, Homo sapiens
gtgggcagacatgatagaagga

SEQ ID NO: 9296959 - DNA, 20 bp, Homo sapiens
gtgggcagcaggcatactgg

SEQ ID NO: 9296960 - DNA, 22 bp, Homo sapiens
gtgggcagcaccagggaagtgt

SEQ ID NO: 9296961 - DNA, 20 bp, Homo sapiens
gtgggcagatgtgtgcatgg

SEQ ID NO: 9296962 - DNA, 22 bp, Homo sapiens
gtgggctgcccttgaggtcagc

SEQ ID NO: 9296963 - DNA, 22 bp, Homo sapiens
gtgggccttgcagggtgcaggg

SEQ ID NO: 9296964 - DNA, 22 bp, Homo sapiens
gtgggccttgcagggtgcaggg

SEQ ID NO: 9296965 - DNA, 22 bp, Homo sapiens
gtggggcttcctggggcaagtt

SEQ ID NO: 9296966 - DNA, 22 bp, Homo sapiens
gtgggggcaggcagtgctagga

SEQ ID NO: 9296967 - DNA, 22 bp, Homo sapiens
gtggggctggaagatgggtact

SEQ ID NO: 9296968 - DNA, 22 bp, Homo sapiens
gtggtgtaggtcacagttagga

SEQ ID NO: 9296969 - DNA, 22 bp, Homo sapiens
gtggtgcaggccagcaggggcg

SEQ ID NO: 9296970 - DNA, 22 bp, Homo sapiens
gtggtcatgttaattatgatcc

SEQ ID NO: 9296971 - DNA, 22 bp, Homo sapiens
gtggtcatttgtctgagctcca

SEQ ID NO: 9296972 - DNA, 22 bp, Homo sapiens
gtggtcatctaactaaattttc

SEQ ID NO: 9296973 - DNA, 22 bp, Homo sapiens
gtggtcatctgggtttgtggca

SEQ ID NO: 9296974 - DNA, 22 bp, Homo sapiens
gtggtcatggaaggtcctacct

SEQ ID NO: 9296975 - DNA, 22 bp, Homo sapiens
gtggtcctgagtagctttagaa

SEQ ID NO: 9296976 - DNA, 22 bp, Homo sapiens
gtggtcctcttcttctgtttgg

SEQ ID NO: 9296977 - DNA, 18 bp, Homo sapiens
gtggtctttctgtcttct

SEQ ID NO: 9296978 - DNA, 22 bp, Homo sapiens
gtgtaaaaacatactatttcta

SEQ ID NO: 9296979 - DNA, 22 bp, Homo sapiens
gtgggtggagactgggtgcaag

SEQ ID NO: 9296980 - DNA, 22 bp, Homo sapiens
gtgggtgcggggagccgaggcg

SEQ ID NO: 9296981 - DNA, 22 bp, Homo sapiens
gtgggtgatgtactggaggcca

SEQ ID NO: 9296982 - DNA, 22 bp, Homo sapiens
gtgggtcagcaagccaggagta

SEQ ID NO: 9296983 - DNA, 22 bp, Homo sapiens
gtgggtaattggagggctgcct

SEQ ID NO: 9296984 - DNA, 22 bp, Homo sapiens
gtggtatctgtctcccccactg

SEQ ID NO: 9296985 - DNA, 22 bp, Homo sapiens
gtggtcaggttatcagatcata

SEQ ID NO: 9296986 - DNA, 22 bp, Homo sapiens
gtggtcatcattagtattatta

SEQ ID NO: 9296987 - DNA, 22 bp, Homo sapiens
gtggggtgggctgagttaggcc

SEQ ID NO: 9296988 - DNA, 18 bp, Homo sapiens
gtggggtgttgtgaggat

SEQ ID NO: 9296989 - DNA, 18 bp, Homo sapiens
gtggggtgttgtgaggat

SEQ ID NO: 9296990 - DNA, 22 bp, Homo sapiens
gtggggtagatctttctcagga

SEQ ID NO: 9296991 - DNA, 22 bp, Homo sapiens
gtggggggagctgcaagctgga

SEQ ID NO: 9296992 - DNA, 22 bp, Homo sapiens
gtgggggctggctcgtcctgtg

SEQ ID NO: 9296993 - DNA, 22 bp, Homo sapiens
gttgttttgctgtctgtcttag

SEQ ID NO: 9296994 - DNA, 22 bp, Homo sapiens
gtttaataatgttgaattacta

SEQ ID NO: 9296995 - DNA, 22 bp, Homo sapiens
gtttttctttgtgtgaagacaa

SEQ ID NO: 9296996 - DNA, 22 bp, Homo sapiens
taaaggaggagttaatgagact

SEQ ID NO: 9296997 - DNA, 22 bp, Homo sapiens
taaaggagtgtgatgaaaggga

SEQ ID NO: 9296998 - DNA, 22 bp, Homo sapiens
taaatactttacaggatgtctc

SEQ ID NO: 9296999 - DNA, 22 bp, Homo sapiens
taacactggcttttgctgaggc

SEQ ID NO: 9297000 - DNA, 22 bp, Homo sapiens
taacactgatttgttctcaggg

SEQ ID NO: 9297001 - DNA, 22 bp, Homo sapiens
taacactgccatgctggagtca

SEQ ID NO: 9297002 - DNA, 22 bp, Homo sapiens
taaatgaagaaatggagattgt

SEQ ID NO: 9297003 - DNA, 22 bp, Homo sapiens
taaatgagggctgacatgattg

SEQ ID NO: 9297004 - DNA, 22 bp, Homo sapiens
taacactgaaaatgatgcatgt

SEQ ID NO: 9297005 - DNA, 22 bp, Homo sapiens
taacactgtaaacctagatgtt

SEQ ID NO: 9297006 - DNA, 19 bp, Homo sapiens
ggaaacaggggccagagga

SEQ ID NO: 9297007 - DNA, 22 bp, Homo sapiens
gcttctgggcacctgaacagga

SEQ ID NO: 9297008 - DNA, 22 bp, Homo sapiens
ggaaaacaagagaatgatgttt

SEQ ID NO: 9297009 - DNA, 22 bp, Homo sapiens
ggaaaacagcgattggtatcat

SEQ ID NO: 9297010 - DNA, 22 bp, Homo sapiens
ggaaggggtgtcgcccatggat

SEQ ID NO: 9297011 - DNA, 22 bp, Homo sapiens
ggaagaaatgctcttctatgcg

SEQ ID NO: 9297012 - DNA, 22 bp, Homo sapiens
ggaagaaaatgggcaacaggtg

SEQ ID NO: 9297013 - DNA, 22 bp, Homo sapiens
ggaagaaaggtggacaacaggt

SEQ ID NO: 9297014 - DNA, 22 bp, Homo sapiens
ggaagaaatctggttaagagat

SEQ ID NO: 9297015 - DNA, 22 bp, Homo sapiens
ggaactgggttagggtctcttc

SEQ ID NO: 9297016 - DNA, 22 bp, Homo sapiens
ggaactgggttagggtctcttc

SEQ ID NO: 9297017 - DNA, 22 bp, Homo sapiens
ggaactggagaatgccctcttt

SEQ ID NO: 9297018 - DNA, 22 bp, Homo sapiens
ggaactggagaatgccctcttt

SEQ ID NO: 9297019 - DNA, 18 bp, Homo sapiens
ggaagaaaaggaactcag

SEQ ID NO: 9297020 - DNA, 18 bp, Homo sapiens
ggaagaaaaggaactcag

SEQ ID NO: 9297021 - DNA, 17 bp, Homo sapiens
ggaagaaaaggatcatc

SEQ ID NO: 9297022 - DNA, 17 bp, Homo sapiens
ggaagaaaaggatcatc

SEQ ID NO: 9297023 - DNA, 22 bp, Homo sapiens
gctgggctcatttgtgtgtctg

SEQ ID NO: 9297024 - DNA, 22 bp, Homo sapiens
gcttacaagatcgtgctccagt

SEQ ID NO: 9297025 - DNA, 22 bp, Homo sapiens
gctgggctgagctagacttggc

SEQ ID NO: 9297026 - DNA, 22 bp, Homo sapiens
gctgggctgcgtcggggaagcc

SEQ ID NO: 9297027 - DNA, 22 bp, Homo sapiens
gcttcctgtaggcaggtccaag

SEQ ID NO: 9297028 - DNA, 23 bp, Homo sapiens
gcttctagtcaatttcaccagga

SEQ ID NO: 9297029 - DNA, 22 bp, Homo sapiens
gcttcattactgacagtctgtg

SEQ ID NO: 9297030 - DNA, 22 bp, Homo sapiens
gcttcatgggtgtgcaacctgt

SEQ ID NO: 9297031 - DNA, 22 bp, Homo sapiens
ggagaaggaatattggagtagg

SEQ ID NO: 9297032 - DNA, 22 bp, Homo sapiens
ggagaaggaatattggagtagg

SEQ ID NO: 9297033 - DNA, 22 bp, Homo sapiens
ggaagtctcagcaacagagtta

SEQ ID NO: 9297034 - DNA, 19 bp, Homo sapiens
ggagaagcccaggaatcct

SEQ ID NO: 9297035 - DNA, 22 bp, Homo sapiens
ggagctgaggctgaggcctcac

SEQ ID NO: 9297036 - DNA, 22 bp, Homo sapiens
ggagctgagttcttcagccggg

SEQ ID NO: 9297037 - DNA, 22 bp, Homo sapiens
ggagctgaaccccatcgtgctg

SEQ ID NO: 9297038 - DNA, 22 bp, Homo sapiens
ggagctgaaggggtgggctcag

SEQ ID NO: 9297039 - DNA, 22 bp, Homo sapiens
ggagctctctcagggggtccaa

SEQ ID NO: 9297040 - DNA, 22 bp, Homo sapiens
ggagctcctggcagtgacagag

SEQ ID NO: 9297041 - DNA, 17 bp, Homo sapiens
ggagctccagctactgc

SEQ ID NO: 9297042 - DNA, 22 bp, Homo sapiens
ggaggacaggggctgcagcaca

SEQ ID NO: 9297043 - DNA, 22 bp, Homo sapiens
ggaggacactggctctgccttc

SEQ ID NO: 9297044 - DNA, 22 bp, Homo sapiens
ggaggagcatgagagggtagtg

SEQ ID NO: 9297045 - DNA, 22 bp, Homo sapiens
ggaggaagcacacggcttgtat

SEQ ID NO: 9297046 - DNA, 22 bp, Homo sapiens
ggaggccaccatggagtcactt

SEQ ID NO: 9297047 - DNA, 22 bp, Homo sapiens
ggaggccaattttctaactgca

SEQ ID NO: 9297048 - DNA, 22 bp, Homo sapiens
ggaggccacggtttagcaccga

SEQ ID NO: 9297049 - DNA, 22 bp, Homo sapiens
ggaggccacctgacctgctgtt

SEQ ID NO: 9297050 - DNA, 22 bp, Homo sapiens
ggaggccagcctgaggctgagg

SEQ ID NO: 9297051 - DNA, 22 bp, Homo sapiens
ggaggccagtcctggccgggct

SEQ ID NO: 9297052 - DNA, 22 bp, Homo sapiens
ggaggccatagtttgggagtca

SEQ ID NO: 9297053 - DNA, 22 bp, Homo sapiens
ggaggccatcagggagggcatt

SEQ ID NO: 9297054 - DNA, 22 bp, Homo sapiens
ggaggccatctggctggaggct

SEQ ID NO: 9297055 - DNA, 22 bp, Homo sapiens
ggaggccaggaagagccgccct

SEQ ID NO: 9297056 - DNA, 22 bp, Homo sapiens
ggaggccaggaaggctcggaga

SEQ ID NO: 9297057 - DNA, 22 bp, Homo sapiens
ggaggccaggtgggagtcatct

SEQ ID NO: 9297058 - DNA, 22 bp, Homo sapiens
ggaggccagggtgggtggatcg

SEQ ID NO: 9297059 - DNA, 22 bp, Homo sapiens
ggcagaggaagctggaagtggg

SEQ ID NO: 9297060 - DNA, 22 bp, Homo sapiens
ggcagctgggtgcctaataatg

SEQ ID NO: 9297061 - DNA, 22 bp, Homo sapiens
ggcagctgtctctgagttagca

SEQ ID NO: 9297062 - DNA, 22 bp, Homo sapiens
ggcaggtgctaagagaggtaaa

SEQ ID NO: 9297063 - DNA, 17 bp, Homo sapiens
ggcaggtgcggggccgc

SEQ ID NO: 9297064 - DNA, 22 bp, Homo sapiens
ggcaggtgcgcatgttgcatta

SEQ ID NO: 9297065 - DNA, 20 bp, Homo sapiens
ggcaggtgctcgcttggtct

SEQ ID NO: 9297066 - DNA, 22 bp, Homo sapiens
ggcaggtgctctgtgggcctgg

SEQ ID NO: 9297067 - DNA, 22 bp, Homo sapiens
ggcaggtgctcaaaaatatttg

SEQ ID NO: 9297068 - DNA, 22 bp, Homo sapiens
ggcaggctggctttgttccagg

SEQ ID NO: 9297069 - DNA, 22 bp, Homo sapiens
ggcaggtgagttcattatctgc

SEQ ID NO: 9297070 - DNA, 22 bp, Homo sapiens
ggcaggtgaggcatgtgcctgg

SEQ ID NO: 9297071 - DNA, 22 bp, Homo sapiens
ggcaggctgcttgggtcatgtc

SEQ ID NO: 9297072 - DNA, 22 bp, Homo sapiens
ggcaggcctgagaggcagggct

SEQ ID NO: 9297073 - DNA, 22 bp, Homo sapiens
ggcacagagttggcagagctgc

SEQ ID NO: 9297074 - DNA, 22 bp, Homo sapiens
ggcacagagctttgtcccagtt

SEQ ID NO: 9297075 - DNA, 22 bp, Homo sapiens
ggagtgggcagcactgccctgt

SEQ ID NO: 9297076 - DNA, 22 bp, Homo sapiens
ggagtgggaacaatgacatggt

SEQ ID NO: 9297077 - DNA, 22 bp, Homo sapiens
ggagtggctatttgtgctggtt

SEQ ID NO: 9297078 - DNA, 22 bp, Homo sapiens
ggagtggccacgactgggagat

SEQ ID NO: 9297079 - DNA, 22 bp, Homo sapiens
ggagtggcctctcctgtgcagg

SEQ ID NO: 9297080 - DNA, 22 bp, Homo sapiens
ggcaaggccttgcccagcattc

SEQ ID NO: 9297081 - DNA, 22 bp, Homo sapiens
ggagtggtgtcactgagaggaa

SEQ ID NO: 9297082 - DNA, 22 bp, Homo sapiens
ggagttcactgtgcaggctctg

SEQ ID NO: 9297083 - DNA, 22 bp, Homo sapiens
ggaggggtggtcacctggcagg

SEQ ID NO: 9297084 - DNA, 22 bp, Homo sapiens
ggaggggtggtcgcgaagagca

SEQ ID NO: 9297085 - DNA, 22 bp, Homo sapiens
ggaggggtctctagcgaggaga

SEQ ID NO: 9297086 - DNA, 22 bp, Homo sapiens
ggaggggtctctagcgaggaga

SEQ ID NO: 9297087 - DNA, 22 bp, Homo sapiens
ggaggggtgagaatggctgcct

SEQ ID NO: 9297088 - DNA, 22 bp, Homo sapiens
ggagggggaagaagctaaagac

SEQ ID NO: 9297089 - DNA, 23 bp, Homo sapiens
ggaggtcagtgcctgagggtgag

SEQ ID NO: 9297090 - DNA, 22 bp, Homo sapiens
ggaggccatgggcagaatcttt

SEQ ID NO: 9297091 - DNA, 22 bp, Homo sapiens
ggaggcccagaaggaagcccag

SEQ ID NO: 9297092 - DNA, 22 bp, Homo sapiens
ggaggcccagagaggtgaagtg

SEQ ID NO: 9297093 - DNA, 22 bp, Homo sapiens
ggaggctgctgcctcacgtggg

SEQ ID NO: 9297094 - DNA, 22 bp, Homo sapiens
ggaggctcttgagaggggagta

SEQ ID NO: 9297095 - DNA, 22 bp, Homo sapiens
ggaggctctcctggccttgtct

SEQ ID NO: 9297096 - DNA, 22 bp, Homo sapiens
ggaggctcgctggtcgcacagc

SEQ ID NO: 9297097 - DNA, 22 bp, Homo sapiens
ggagggacccactctagaggtg

SEQ ID NO: 9297098 - DNA, 22 bp, Homo sapiens
ggagggctgagactggggtctg

SEQ ID NO: 9297099 - DNA, 22 bp, Homo sapiens
ggagggctgagactggggtctg

SEQ ID NO: 9297100 - DNA, 22 bp, Homo sapiens
ggagggctccctgggagtggat

SEQ ID NO: 9297101 - DNA, 22 bp, Homo sapiens
ggagggctccctgggagtggat

SEQ ID NO: 9297102 - DNA, 22 bp, Homo sapiens
ggctcagcacagggctggcatc

SEQ ID NO: 9297103 - DNA, 22 bp, Homo sapiens
ggctcagccccgtaacacagca

SEQ ID NO: 9297104 - DNA, 22 bp, Homo sapiens
ggctcagcgcgctgggagggag

SEQ ID NO: 9297105 - DNA, 22 bp, Homo sapiens
ggctcagcttatctgggcaggc

SEQ ID NO: 9297106 - DNA, 20 bp, Homo sapiens
ggccttggcctctttgcagc

SEQ ID NO: 9297107 - DNA, 22 bp, Homo sapiens
ggccttggcctagccctccagg

SEQ ID NO: 9297108 - DNA, 22 bp, Homo sapiens
ggccttggagtcctccactgga

SEQ ID NO: 9297109 - DNA, 22 bp, Homo sapiens
ggccttggatccaagctgcggc

SEQ ID NO: 9297110 - DNA, 22 bp, Homo sapiens
ggccttggattttaccctaaag

SEQ ID NO: 9297111 - DNA, 21 bp, Homo sapiens
ggccttggcgggggccgaatt

SEQ ID NO: 9297112 - DNA, 22 bp, Homo sapiens
ggccttggctcctgcagggagt

SEQ ID NO: 9297113 - DNA, 22 bp, Homo sapiens
ggccttggctcctgcagggagt

SEQ ID NO: 9297114 - DNA, 22 bp, Homo sapiens
ggccttgggaggagggtcagaa

SEQ ID NO: 9297115 - DNA, 22 bp, Homo sapiens
ggctcaggactgcagcgtagag

SEQ ID NO: 9297116 - DNA, 22 bp, Homo sapiens
ggctcagcttggtgcgcagaaa

SEQ ID NO: 9297117 - DNA, 22 bp, Homo sapiens
ggctcatatcccggccatcatt

SEQ ID NO: 9297118 - DNA, 22 bp, Homo sapiens
ggctcaggtttccttcccagct

SEQ ID NO: 9297119 - DNA, 22 bp, Homo sapiens
ggcctgggcctttgtgttttga

SEQ ID NO: 9297120 - DNA, 22 bp, Homo sapiens
ggccctgagctgaagtactgtg

SEQ ID NO: 9297121 - DNA, 22 bp, Homo sapiens
ggcccctggcaccaggctgatt

SEQ ID NO: 9297122 - DNA, 22 bp, Homo sapiens
ggccttggagtcagccttgagc

SEQ ID NO: 9297123 - DNA, 20 bp, Homo sapiens
ggccttggaatagcacagct

SEQ ID NO: 9297124 - DNA, 22 bp, Homo sapiens
ggccttggaaagatacccagct

SEQ ID NO: 9297125 - DNA, 22 bp, Homo sapiens
ggccttgcttgggttatatgcc

SEQ ID NO: 9297126 - DNA, 22 bp, Homo sapiens
ggcccctgcggactgcctagag

SEQ ID NO: 9297127 - DNA, 22 bp, Homo sapiens
ggccccagttcactcctggccg

SEQ ID NO: 9297128 - DNA, 22 bp, Homo sapiens
ggccccaggtctgaacacgctg

SEQ ID NO: 9297129 - DNA, 22 bp, Homo sapiens
ggccccagattctgggctgggt

SEQ ID NO: 9297130 - DNA, 22 bp, Homo sapiens
ggccccaggtagaagatataga

SEQ ID NO: 9297131 - DNA, 22 bp, Homo sapiens
ggcccagcctcagacatgccct

SEQ ID NO: 9297132 - DNA, 22 bp, Homo sapiens
ggccatggggacagagggtgaa

SEQ ID NO: 9297133 - DNA, 22 bp, Homo sapiens
ggccatggtcatgggtgagctt

SEQ ID NO: 9297134 - DNA, 22 bp, Homo sapiens
ggccattgcaacgtcaggagga

SEQ ID NO: 9297135 - DNA, 22 bp, Homo sapiens
ggcccacttgaaatggagctca

SEQ ID NO: 9297136 - DNA, 18 bp, Homo sapiens
ggccagagggagggtccc

SEQ ID NO: 9297137 - DNA, 19 bp, Homo sapiens
ggccatggcgggggtcaca

SEQ ID NO: 9297138 - DNA, 22 bp, Homo sapiens
ggcaggtgctgggagcatctca

SEQ ID NO: 9297139 - DNA, 20 bp, Homo sapiens
ggcaggtgctgtcccctcct

SEQ ID NO: 9297140 - DNA, 22 bp, Homo sapiens
ggcaggtgcttgtcgaaggcct

SEQ ID NO: 9297141 - DNA, 22 bp, Homo sapiens
ggcaggtggaaggtctccattc

SEQ ID NO: 9297142 - DNA, 22 bp, Homo sapiens
ggcaggtggaagttggcagagc

SEQ ID NO: 9297143 - DNA, 22 bp, Homo sapiens
ggccagagaagtcagacccttg

SEQ ID NO: 9297144 - DNA, 21 bp, Homo sapiens
gggaagactgtcaggattcct

SEQ ID NO: 9297145 - DNA, 22 bp, Homo sapiens
gggaagacttagtcggttcaat

SEQ ID NO: 9297146 - DNA, 22 bp, Homo sapiens
gggaactgtttaacaggggttt

SEQ ID NO: 9297147 - DNA, 22 bp, Homo sapiens
gggaacagggcctgagctgggg

SEQ ID NO: 9297148 - DNA, 22 bp, Homo sapiens
gggaacagagtgccagactgac

SEQ ID NO: 9297149 - DNA, 22 bp, Homo sapiens
ggcttctccaggtactgagcat

SEQ ID NO: 9297150 - DNA, 23 bp, Homo sapiens
ggcttcagtgagagtccctgctg

SEQ ID NO: 9297151 - DNA, 22 bp, Homo sapiens
ggctgcaggcagaggctgtctg

SEQ ID NO: 9297152 - DNA, 22 bp, Homo sapiens
ggctgcaggatgcccagccgtg

SEQ ID NO: 9297153 - DNA, 23 bp, Homo sapiens
ggctgctcttttcatgctgtttc

SEQ ID NO: 9297154 - DNA, 22 bp, Homo sapiens
ggctgctgaacaagggaaccct

SEQ ID NO: 9297155 - DNA, 22 bp, Homo sapiens
ggctggcctctacagggaggca

SEQ ID NO: 9297156 - DNA, 22 bp, Homo sapiens
ggctgagttgagaggattactt

SEQ ID NO: 9297157 - DNA, 19 bp, Homo sapiens
ggctctcccttgagagagc

SEQ ID NO: 9297158 - DNA, 22 bp, Homo sapiens
ggctctagagactctagagaaa

SEQ ID NO: 9297159 - DNA, 22 bp, Homo sapiens
ggctctaggcggagtcccgcga

SEQ ID NO: 9297160 - DNA, 22 bp, Homo sapiens
ggctctagagctgtgcacacat

SEQ ID NO: 9297161 - DNA, 22 bp, Homo sapiens
gggccagtagcacctgtgtgga

SEQ ID NO: 9297162 - DNA, 22 bp, Homo sapiens
gggccagtctgactctgctggt

SEQ ID NO: 9297163 - DNA, 22 bp, Homo sapiens
gggcagctcggaagtgggaaag

SEQ ID NO: 9297164 - DNA, 22 bp, Homo sapiens
gggcagctcctgtggaatccac

SEQ ID NO: 9297165 - DNA, 22 bp, Homo sapiens
gggctaagtggatcagtcagga

SEQ ID NO: 9297166 - DNA, 21 bp, Homo sapiens
gggctaagagtgaccaggcag

SEQ ID NO: 9297167 - DNA, 22 bp, Homo sapiens
gggctaagctcgcccagggcca

SEQ ID NO: 9297168 - DNA, 22 bp, Homo sapiens
gggcggggggagctggaatgaa

SEQ ID NO: 9297169 - DNA, 22 bp, Homo sapiens
gggccagtgaacaatgagggaa

SEQ ID NO: 9297170 - DNA, 22 bp, Homo sapiens
gggccagtgagtcgggagagct

SEQ ID NO: 9297171 - DNA, 22 bp, Homo sapiens
gggccagtgggacctgggtctc

SEQ ID NO: 9297172 - DNA, 22 bp, Homo sapiens
gggccagttctccgcctctttt

SEQ ID NO: 9297173 - DNA, 22 bp, Homo sapiens
gggccatgagaggttcatcaac

SEQ ID NO: 9297174 - DNA, 22 bp, Homo sapiens
gggccatgagaggttcatcaac

SEQ ID NO: 9297175 - DNA, 19 bp, Homo sapiens
gggcccagcatggagggtt

SEQ ID NO: 9297176 - DNA, 22 bp, Homo sapiens
gggacgagccccaggctggagg

SEQ ID NO: 9297177 - DNA, 22 bp, Homo sapiens
gggacgacaggctctgtggtag

SEQ ID NO: 9297178 - DNA, 22 bp, Homo sapiens
gggacgagatcttggcagtgtg

SEQ ID NO: 9297179 - DNA, 22 bp, Homo sapiens
gggagaaggaggactgtgctgt

SEQ ID NO: 9297180 - DNA, 18 bp, Homo sapiens
gggaggccccagcaggag

SEQ ID NO: 9297181 - DNA, 17 bp, Homo sapiens
gggaggccttggtttcc

SEQ ID NO: 9297182 - DNA, 20 bp, Homo sapiens
gggaggccccagagtccagg

SEQ ID NO: 9297183 - DNA, 22 bp, Homo sapiens
gggggtaggcagacaaggacat

SEQ ID NO: 9297184 - DNA, 20 bp, Homo sapiens
ggggggcttcagggcctgtg

SEQ ID NO: 9297185 - DNA, 22 bp, Homo sapiens
ggggggctgttctggacaggaa

SEQ ID NO: 9297186 - DNA, 22 bp, Homo sapiens
ggggtaggaagagaaaatagtg

SEQ ID NO: 9297187 - DNA, 22 bp, Homo sapiens
ggggactgaggcactgaaggtg

SEQ ID NO: 9297188 - DNA, 19 bp, Homo sapiens
gggtgaggaagagcgttgc

SEQ ID NO: 9297189 - DNA, 22 bp, Homo sapiens
gggtgggatggcaggagccgct

SEQ ID NO: 9297190 - DNA, 22 bp, Homo sapiens
gggtctggcatgctgagatgga

SEQ ID NO: 9297191 - DNA, 22 bp, Homo sapiens
gggtctctcctccccagctgtg

SEQ ID NO: 9297192 - DNA, 23 bp, Homo sapiens
ggggacagagggcagcccgcatc

SEQ ID NO: 9297193 - DNA, 22 bp, Homo sapiens
ggggaagggagtccaagtgtta

SEQ ID NO: 9297194 - DNA, 22 bp, Homo sapiens
ggggaaggattgagttgaccca

SEQ ID NO: 9297195 - DNA, 23 bp, Homo sapiens
ggggacagttcccactggggtct

SEQ ID NO: 9297196 - DNA, 22 bp, Homo sapiens
ggggacagtcgatctagtgatt

SEQ ID NO: 9297197 - DNA, 22 bp, Homo sapiens
ggggacagttaaagaccaagac

SEQ ID NO: 9297198 - DNA, 22 bp, Homo sapiens
gggctggagcctggcggtggtt

SEQ ID NO: 9297199 - DNA, 22 bp, Homo sapiens
gggctgagacgatggggtcttc

SEQ ID NO: 9297200 - DNA, 22 bp, Homo sapiens
gggctgagaattcagctttcct

SEQ ID NO: 9297201 - DNA, 18 bp, Homo sapiens
gggctaggcaaggaccac

SEQ ID NO: 9297202 - DNA, 22 bp, Homo sapiens
gggctctggtcctgaactgaag

SEQ ID NO: 9297203 - DNA, 22 bp, Homo sapiens
gggctctggtgctattgacgaa

SEQ ID NO: 9297204 - DNA, 22 bp, Homo sapiens
gcaggtgtcctgggctggcagt

SEQ ID NO: 9297205 - DNA, 22 bp, Homo sapiens
gcaggtgtcagtccccaaggtg

SEQ ID NO: 9297206 - DNA, 22 bp, Homo sapiens
gcaggtgtctgactgccttctt

SEQ ID NO: 9297207 - DNA, 22 bp, Homo sapiens
gcaggtgtcttcagcaggatga

SEQ ID NO: 9297208 - DNA, 22 bp, Homo sapiens
gcaggtgtgctgaattacgtga

SEQ ID NO: 9297209 - DNA, 22 bp, Homo sapiens
gcaggtgtgaatgtgaattaag

SEQ ID NO: 9297210 - DNA, 22 bp, Homo sapiens
gcaggtgtcttcatggaactct

SEQ ID NO: 9297211 - DNA, 19 bp, Homo sapiens
gcaggtgtgaatccgtaga

SEQ ID NO: 9297212 - DNA, 22 bp, Homo sapiens
gcagtgggcaacaagagctgga

SEQ ID NO: 9297213 - DNA, 22 bp, Homo sapiens
gcagtgggcctgaggaagggtg

SEQ ID NO: 9297214 - DNA, 22 bp, Homo sapiens
gcagtggggcgctgggagttgg

SEQ ID NO: 9297215 - DNA, 22 bp, Homo sapiens
gcagtggggaatgctggggaga

SEQ ID NO: 9297216 - DNA, 22 bp, Homo sapiens
gcagtggggcaatcatagctca

SEQ ID NO: 9297217 - DNA, 22 bp, Homo sapiens
gcaggtggtcactcatccccag

SEQ ID NO: 9297218 - DNA, 22 bp, Homo sapiens
gcaggtgggggtcggtgcatct

SEQ ID NO: 9297219 - DNA, 22 bp, Homo sapiens
gcaggtggggctgctaccagaa

SEQ ID NO: 9297220 - DNA, 22 bp, Homo sapiens
gcaggtgggggagaagttgtga

SEQ ID NO: 9297221 - DNA, 16 bp, Homo sapiens
gcaggtggggcgcgca

SEQ ID NO: 9297222 - DNA, 22 bp, Homo sapiens
gcaggtggtggcgcgcgccctg

SEQ ID NO: 9297223 - DNA, 22 bp, Homo sapiens
gcaggtggtccccgtggagtgg

SEQ ID NO: 9297224 - DNA, 22 bp, Homo sapiens
gcaggtggtgggggagccgttc

SEQ ID NO: 9297225 - DNA, 22 bp, Homo sapiens
gcaggtggtggggctatgatct

SEQ ID NO: 9297226 - DNA, 23 bp, Homo sapiens
gcaggtggttcgaacagaagttt

SEQ ID NO: 9297227 - DNA, 22 bp, Homo sapiens
gcaggtggttaaggtcccatgt

SEQ ID NO: 9297228 - DNA, 22 bp, Homo sapiens
gcaggtggcagaggtgggatct

SEQ ID NO: 9297229 - DNA, 22 bp, Homo sapiens
gcaggtgggagccgctgcctga

SEQ ID NO: 9297230 - DNA, 22 bp, Homo sapiens
gcaggtggattatcagaagtgc

SEQ ID NO: 9297231 - DNA, 22 bp, Homo sapiens
gcaggtggagcagtagtctggt

SEQ ID NO: 9297232 - DNA, 22 bp, Homo sapiens
gcagggtgccgacttcagggat

SEQ ID NO: 9297233 - DNA, 22 bp, Homo sapiens
gcatgtgtggaggagatgtgct

SEQ ID NO: 9297234 - DNA, 21 bp, Homo sapiens
gcatgtgtgggactggatcct

SEQ ID NO: 9297235 - DNA, 22 bp, Homo sapiens
gcatgtgtgtcactttcctgcc

SEQ ID NO: 9297236 - DNA, 21 bp, Homo sapiens
gcatgtgtggtgtgctccaca

SEQ ID NO: 9297237 - DNA, 22 bp, Homo sapiens
gcatgtgtctccccagtggagg

SEQ ID NO: 9297238 - DNA, 22 bp, Homo sapiens
gcatgtgtccctcagtctgtgc

SEQ ID NO: 9297239 - DNA, 22 bp, Homo sapiens
gcatgtgtgagaccttttagca

SEQ ID NO: 9297240 - DNA, 22 bp, Homo sapiens
gcatgtgtctttatagcagcat

SEQ ID NO: 9297241 - DNA, 15 bp, Homo sapiens
gcatgtgtaataggc

SEQ ID NO: 9297242 - DNA, 22 bp, Homo sapiens
gcatgtgtcatctgcctttcgt

SEQ ID NO: 9297243 - DNA, 22 bp, Homo sapiens
gcatgtgtatggtaggaatatt

SEQ ID NO: 9297244 - DNA, 20 bp, Homo sapiens
gcatgtgtatggaaggggga

SEQ ID NO: 9297245 - DNA, 22 bp, Homo sapiens
gcatggtggccttagggtagcc

SEQ ID NO: 9297246 - DNA, 22 bp, Homo sapiens
gccaatggctcatgagcaggac

SEQ ID NO: 9297247 - DNA, 22 bp, Homo sapiens
gcatgtgttggtttatgcatgt

SEQ ID NO: 9297248 - DNA, 22 bp, Homo sapiens
gcatgtgttcttgaaaggccac

SEQ ID NO: 9297249 - DNA, 22 bp, Homo sapiens
gcatgtgttagagtgtgcatgc

SEQ ID NO: 9297250 - DNA, 22 bp, Homo sapiens
gcatgtgttattttatgtatga

SEQ ID NO: 9297251 - DNA, 22 bp, Homo sapiens
gcatgtgttatttctctgtggg

SEQ ID NO: 9297252 - DNA, 22 bp, Homo sapiens
gccagatgtagatagcaaggta

SEQ ID NO: 9297253 - DNA, 22 bp, Homo sapiens
gccagatgtagatagcaaggta

SEQ ID NO: 9297254 - DNA, 22 bp, Homo sapiens
gccagatgccgtaaagatgggc

SEQ ID NO: 9297255 - DNA, 21 bp, Homo sapiens
gcaggctggtcaaacctcagt

SEQ ID NO: 9297256 - DNA, 22 bp, Homo sapiens
gcaggcttgcccggcctccttc

SEQ ID NO: 9297257 - DNA, 22 bp, Homo sapiens
gcagggaaacaggtgctaagga

SEQ ID NO: 9297258 - DNA, 19 bp, Homo sapiens
gcaggcttgggtctcccca

SEQ ID NO: 9297259 - DNA, 22 bp, Homo sapiens
gcagggcaaacccaggtgttca

SEQ ID NO: 9297260 - DNA, 22 bp, Homo sapiens
gcagggcacacaagaatgataa

SEQ ID NO: 9297261 - DNA, 22 bp, Homo sapiens
gcagggcaatgatcccgagagg

SEQ ID NO: 9297262 - DNA, 22 bp, Homo sapiens
gcagggcacaaggacgcacagg

SEQ ID NO: 9297263 - DNA, 22 bp, Homo sapiens
gcagggcaaatgtggaaaggag

SEQ ID NO: 9297264 - DNA, 20 bp, Homo sapiens
gcagggcaagggatatgaaa

SEQ ID NO: 9297265 - DNA, 22 bp, Homo sapiens
gcagggcagaaggtgctgagga

SEQ ID NO: 9297266 - DNA, 22 bp, Homo sapiens
gcagggcacagacagtgccaag

SEQ ID NO: 9297267 - DNA, 22 bp, Homo sapiens
gcagggcagagggagaatctct

SEQ ID NO: 9297268 - DNA, 22 bp, Homo sapiens
gcagggcagacctccagcctat

SEQ ID NO: 9297269 - DNA, 22 bp, Homo sapiens
gcagggcagccacaggccccct

SEQ ID NO: 9297270 - DNA, 18 bp, Homo sapiens
gcagctgacactggagtt

SEQ ID NO: 9297271 - DNA, 22 bp, Homo sapiens
gcagctgaatgtccattgctgc

SEQ ID NO: 9297272 - DNA, 22 bp, Homo sapiens
gcagctgaaagggatctctaca

SEQ ID NO: 9297273 - DNA, 22 bp, Homo sapiens
gcagctgaagctgcagttccag

SEQ ID NO: 9297274 - DNA, 20 bp, Homo sapiens
gcagctgaaagtatgacacc

SEQ ID NO: 9297275 - DNA, 22 bp, Homo sapiens
gcagagctcatgcctgcacctc

SEQ ID NO: 9297276 - DNA, 22 bp, Homo sapiens
gcagctgacatctggctgggcc

SEQ ID NO: 9297277 - DNA, 22 bp, Homo sapiens
gcagctgagagaagaacagggc

SEQ ID NO: 9297278 - DNA, 22 bp, Homo sapiens
gcagctgagcgtgaggaagagt

SEQ ID NO: 9297279 - DNA, 22 bp, Homo sapiens
gcaggacaggcgttggtccagt

SEQ ID NO: 9297280 - DNA, 22 bp, Homo sapiens
gcaggacagacccaagcagtct

SEQ ID NO: 9297281 - DNA, 19 bp, Homo sapiens
gcaggcacagccctgggtg

SEQ ID NO: 9297282 - DNA, 22 bp, Homo sapiens
gatggtggcaagagccaagtct

SEQ ID NO: 9297283 - DNA, 22 bp, Homo sapiens
gatggtggagtaacattgccta

SEQ ID NO: 9297284 - DNA, 22 bp, Homo sapiens
gatggtgcaggtgaagtgctgg

SEQ ID NO: 9297285 - DNA, 22 bp, Homo sapiens
gatgtgtcctagtacgggtggg

SEQ ID NO: 9297286 - DNA, 22 bp, Homo sapiens
gatgtgtccctttcaactcaga

SEQ ID NO: 9297287 - DNA, 22 bp, Homo sapiens
gatgtgtccccagaggattgaa

SEQ ID NO: 9297288 - DNA, 22 bp, Homo sapiens
gatgtgtgtgccctgggcctgc

SEQ ID NO: 9297289 - DNA, 22 bp, Homo sapiens
gatgtgtctggctcccctgcaa

SEQ ID NO: 9297290 - DNA, 22 bp, Homo sapiens
gatgtgtctccgtttcaaggca

SEQ ID NO: 9297291 - DNA, 22 bp, Homo sapiens
gatgtgtccttttctccatcca

SEQ ID NO: 9297292 - DNA, 20 bp, Homo sapiens
gatgtgtcctcagcagtggt

SEQ ID NO: 9297293 - DNA, 22 bp, Homo sapiens
gatgtgtctccatacaccaccc

SEQ ID NO: 9297294 - DNA, 22 bp, Homo sapiens
gatgtgtctattcaacatgaaa

SEQ ID NO: 9297295 - DNA, 22 bp, Homo sapiens
gatggccttgttttctcccttc

SEQ ID NO: 9297296 - DNA, 22 bp, Homo sapiens
gatggcctgggtccccttccgg

SEQ ID NO: 9297297 - DNA, 18 bp, Homo sapiens
gatggccatttcaatgtt

SEQ ID NO: 9297298 - DNA, 22 bp, Homo sapiens
gatgcctggcacccagcaagga

SEQ ID NO: 9297299 - DNA, 22 bp, Homo sapiens
gatgccctggcctgtccccgca

SEQ ID NO: 9297300 - DNA, 22 bp, Homo sapiens
gatgccctgcatgagtcctgct

SEQ ID NO: 9297301 - DNA, 22 bp, Homo sapiens
gattcacagtttaggctgggct

SEQ ID NO: 9297302 - DNA, 22 bp, Homo sapiens
gattcactcatattttacgttt

SEQ ID NO: 9297303 - DNA, 22 bp, Homo sapiens
gattcactcatattttacgttt

SEQ ID NO: 9297304 - DNA, 22 bp, Homo sapiens
gatgtgtttccaggatttgttt

SEQ ID NO: 9297305 - DNA, 22 bp, Homo sapiens
gatttatttttaatcagcaggg

SEQ ID NO: 9297306 - DNA, 22 bp, Homo sapiens
gatttatttttaatcagcaggg

SEQ ID NO: 9297307 - DNA, 22 bp, Homo sapiens
gatttattgtccctgtcctgct

SEQ ID NO: 9297308 - DNA, 22 bp, Homo sapiens
gatttattggtctttcattggt

SEQ ID NO: 9297309 - DNA, 22 bp, Homo sapiens
gatttattggtctttcattggt

SEQ ID NO: 9297310 - DNA, 22 bp, Homo sapiens
gattggaaatggaaatggtaaa

SEQ ID NO: 9297311 - DNA, 22 bp, Homo sapiens
gcaaacagaaatgcaggacgct

SEQ ID NO: 9297312 - DNA, 22 bp, Homo sapiens
gattttgtcaaattccaaatgt

SEQ ID NO: 9297313 - DNA, 22 bp, Homo sapiens
gatttcttcattcattagatgg

SEQ ID NO: 9297314 - DNA, 22 bp, Homo sapiens
gatttctgtggcttgtacatat

SEQ ID NO: 9297315 - DNA, 22 bp, Homo sapiens
gcactttgtggattgtatttcc

SEQ ID NO: 9297316 - DNA, 22 bp, Homo sapiens
gcactttatagtagaaagagca

SEQ ID NO: 9297317 - DNA, 22 bp, Homo sapiens
gcagaaatatgatgcataaagg

SEQ ID NO: 9297318 - DNA, 22 bp, Homo sapiens
gcagaagcccggtcagcgcacg

SEQ ID NO: 9297319 - DNA, 22 bp, Homo sapiens
gcagaagaccatggtggaaaga

SEQ ID NO: 9297320 - DNA, 22 bp, Homo sapiens
gcagagccaggagagacccttg

SEQ ID NO: 9297321 - DNA, 22 bp, Homo sapiens
gcagagccaggagagacccttg

SEQ ID NO: 9297322 - DNA, 20 bp, Homo sapiens
gcacttggctgctgcttctc

SEQ ID NO: 9297323 - DNA, 19 bp, Homo sapiens
gcaccctgaggtcatggcc

SEQ ID NO: 9297324 - DNA, 16 bp, Homo sapiens
gcacacacatcaatga

SEQ ID NO: 9297325 - DNA, 22 bp, Homo sapiens
gcacacacatgtgagtacatgc

SEQ ID NO: 9297326 - DNA, 22 bp, Homo sapiens
gctgcctgatcatacaccaggg

SEQ ID NO: 9297327 - DNA, 22 bp, Homo sapiens
gctgcctggagctcagcctgcc

SEQ ID NO: 9297328 - DNA, 22 bp, Homo sapiens
gctggagaggggtcactctgag

SEQ ID NO: 9297329 - DNA, 19 bp, Homo sapiens
gctgctctgggtctcatct

SEQ ID NO: 9297330 - DNA, 22 bp, Homo sapiens
gctgctgatgggcagggagtcg

SEQ ID NO: 9297331 - DNA, 22 bp, Homo sapiens
gctgctcttttcagagatgaga

SEQ ID NO: 9297332 - DNA, 22 bp, Homo sapiens
gctgctctacccatgcatctgt

SEQ ID NO: 9297333 - DNA, 22 bp, Homo sapiens
gctgctctcagagctcatgctg

SEQ ID NO: 9297334 - DNA, 22 bp, Homo sapiens
gctggagatgctatgcagaggg

SEQ ID NO: 9297335 - DNA, 22 bp, Homo sapiens
gctggcctcatcactgacttct

SEQ ID NO: 9297336 - DNA, 22 bp, Homo sapiens
gctggccagggctgctcgcgga

SEQ ID NO: 9297337 - DNA, 22 bp, Homo sapiens
gctgggagtgggcaagatgaga

SEQ ID NO: 9297338 - DNA, 22 bp, Homo sapiens
gctggccttgaggtgtctttat

SEQ ID NO: 9297339 - DNA, 22 bp, Homo sapiens
gctgggcaatgccagagaggag

SEQ ID NO: 9297340 - DNA, 22 bp, Homo sapiens
gctgggcaacggaagagagaaa

SEQ ID NO: 9297341 - DNA, 22 bp, Homo sapiens
gctgggcaggcctcgtgagggc

SEQ ID NO: 9297342 - DNA, 22 bp, Homo sapiens
gctgggcagcccctacagagag

SEQ ID NO: 9297343 - DNA, 22 bp, Homo sapiens
gctcactgccattctctagatg

SEQ ID NO: 9297344 - DNA, 22 bp, Homo sapiens
gctccaggagctcacagctcgc

SEQ ID NO: 9297345 - DNA, 22 bp, Homo sapiens
gctccaggaggatgaccttcct

SEQ ID NO: 9297346 - DNA, 22 bp, Homo sapiens
gctccaggagagggaagcagat

SEQ ID NO: 9297347 - DNA, 22 bp, Homo sapiens
gctcttctaaagaatgtacagg

SEQ ID NO: 9297348 - DNA, 22 bp, Homo sapiens
gctcttccatttctcttgaact

SEQ ID NO: 9297349 - DNA, 22 bp, Homo sapiens
gctctgtgtccacagctggaaa

SEQ ID NO: 9297350 - DNA, 22 bp, Homo sapiens
gctgaaatgccttgtaaatatt

SEQ ID NO: 9297351 - DNA, 22 bp, Homo sapiens
gctgaaatgggcactgaaggcc

SEQ ID NO: 9297352 - DNA, 22 bp, Homo sapiens
gctgaaatgccttgtaaatatt

SEQ ID NO: 9297353 - DNA, 18 bp, Homo sapiens
gctgaaattctaaacaaa

SEQ ID NO: 9297354 - DNA, 22 bp, Homo sapiens
gctgaaattcagattcctaggc

SEQ ID NO: 9297355 - DNA, 22 bp, Homo sapiens
gctgaaattagactgcagaagt

SEQ ID NO: 9297356 - DNA, 22 bp, Homo sapiens
gctgaaatgtctttagcagtgt

SEQ ID NO: 9297357 - DNA, 22 bp, Homo sapiens
gctctgagtgatcagctgggaa

SEQ ID NO: 9297358 - DNA, 22 bp, Homo sapiens
gctctgagccgggggcctgtcc

SEQ ID NO: 9297359 - DNA, 23 bp, Homo sapiens
gctctgaggaagttgggcacggg

SEQ ID NO: 9297360 - DNA, 22 bp, Homo sapiens
gcctgtggggctgaggctgcct

SEQ ID NO: 9297361 - DNA, 22 bp, Homo sapiens
gcctgtgtggatgcgccggtgc

SEQ ID NO: 9297362 - DNA, 22 bp, Homo sapiens
gcctggcaggcctgttggggct

SEQ ID NO: 9297363 - DNA, 22 bp, Homo sapiens
gcctggagtagcatggcaagcc

SEQ ID NO: 9297364 - DNA, 22 bp, Homo sapiens
gcctggagtactccttgaagtg

SEQ ID NO: 9297365 - DNA, 22 bp, Homo sapiens
gcctggagggttgaggttttgt

SEQ ID NO: 9297366 - DNA, 22 bp, Homo sapiens
gcctggcaggggcctgggagtg

SEQ ID NO: 9297367 - DNA, 22 bp, Homo sapiens
gcctggcatatagtagttgtgc

SEQ ID NO: 9297368 - DNA, 22 bp, Homo sapiens
gcctgggaaatggtggggtcag

SEQ ID NO: 9297369 - DNA, 23 bp, Homo sapiens
gcctgcctgacctgtgcaaagtc

SEQ ID NO: 9297370 - DNA, 21 bp, Homo sapiens
gcctgcctgcgtgaccctctt

SEQ ID NO: 9297371 - DNA, 22 bp, Homo sapiens
gcctgcctgaaggctgtaccag

SEQ ID NO: 9297372 - DNA, 22 bp, Homo sapiens
gcctgcctcaaaatcccagttc

SEQ ID NO: 9297373 - DNA, 20 bp, Homo sapiens
gcctgcctcagctagctgag

SEQ ID NO: 9297374 - DNA, 23 bp, Homo sapiens
gcctctggagccccagtgctcag

SEQ ID NO: 9297375 - DNA, 20 bp, Homo sapiens
gcctctggagccaaggacca

SEQ ID NO: 9297376 - DNA, 22 bp, Homo sapiens
gcctctggaagaattacatcca

SEQ ID NO: 9297377 - DNA, 22 bp, Homo sapiens
gcctctggaagtgggaaggggt

SEQ ID NO: 9297378 - DNA, 22 bp, Homo sapiens
gcctgcctgctgtcatctgcct

SEQ ID NO: 9297379 - DNA, 19 bp, Homo sapiens
gcctgcctgggtttctgag

SEQ ID NO: 9297380 - DNA, 22 bp, Homo sapiens
gcctgcctggagcttgaggtga

SEQ ID NO: 9297381 - DNA, 22 bp, Homo sapiens
gcctgcctgctgtgtgcaagtt

SEQ ID NO: 9297382 - DNA, 22 bp, Homo sapiens
gcctgcctttgtatgaccctga

SEQ ID NO: 9297383 - DNA, 22 bp, Homo sapiens
gcctgccttcggtgcgcagcgg

SEQ ID NO: 9297384 - DNA, 22 bp, Homo sapiens
gcctgcctgttggctgaggtgc

SEQ ID NO: 9297385 - DNA, 22 bp, Homo sapiens
gcctgcctttgtgaggaagcgg

SEQ ID NO: 9297386 - DNA, 22 bp, Homo sapiens
gcctgccttttggaggcacatt

SEQ ID NO: 9297387 - DNA, 22 bp, Homo sapiens
gcctgctctgagtgtggggggt

SEQ ID NO: 9297388 - DNA, 22 bp, Homo sapiens
gcctggaggggccagggtggta

SEQ ID NO: 9297389 - DNA, 22 bp, Homo sapiens
gcctggagggtccctctctgga

SEQ ID NO: 9297390 - DNA, 22 bp, Homo sapiens
gcctggaggggacagtctctgg

SEQ ID NO: 9297391 - DNA, 22 bp, Homo sapiens
gcctggagggctctagagaggc

SEQ ID NO: 9297392 - DNA, 22 bp, Homo sapiens
gcctggagggatagaatgcaag

SEQ ID NO: 9297393 - DNA, 22 bp, Homo sapiens
gcctggaggcgagaacccaatg

SEQ ID NO: 9297394 - DNA, 20 bp, Homo sapiens
gcctggaggcagagataaag

SEQ ID NO: 9297395 - DNA, 22 bp, Homo sapiens
gcctggagcctcagcaaggagg

SEQ ID NO: 9297396 - DNA, 20 bp, Homo sapiens
gcctggaggcaatgggaaga

SEQ ID NO: 9297397 - DNA, 22 bp, Homo sapiens
gccaggctgtttttattactgt

SEQ ID NO: 9297398 - DNA, 22 bp, Homo sapiens
gccagtgggacccgctgtgggc

SEQ ID NO: 9297399 - DNA, 22 bp, Homo sapiens
gccagtggtcagtgggagggtg

SEQ ID NO: 9297400 - DNA, 22 bp, Homo sapiens
gccagtggtcagctacgcttag

SEQ ID NO: 9297401 - DNA, 22 bp, Homo sapiens
gccagtggtcactgaggaagaa

SEQ ID NO: 9297402 - DNA, 22 bp, Homo sapiens
gccagtgggtagttggagctgg

SEQ ID NO: 9297403 - DNA, 22 bp, Homo sapiens
gccagtggtagaggggaggccg

SEQ ID NO: 9297404 - DNA, 18 bp, Homo sapiens
gccagtgggtccaggtgc

SEQ ID NO: 9297405 - DNA, 22 bp, Homo sapiens
gccagttggccccgggcatgca

SEQ ID NO: 9297406 - DNA, 22 bp, Homo sapiens
gccatcaaataccagcctgaat

SEQ ID NO: 9297407 - DNA, 22 bp, Homo sapiens
gccagtgtgtcttgcaggctcc

SEQ ID NO: 9297408 - DNA, 22 bp, Homo sapiens
gccagtgttattcctggggctg

SEQ ID NO: 9297409 - DNA, 22 bp, Homo sapiens
gccagtggtgagattccctggg

SEQ ID NO: 9297410 - DNA, 22 bp, Homo sapiens
gccaggctggtgtcacaactct

SEQ ID NO: 9297411 - DNA, 22 bp, Homo sapiens
gccaggctgtggggaacttgaa

SEQ ID NO: 9297412 - DNA, 22 bp, Homo sapiens
gccaggctgctggctgctgtcc

SEQ ID NO: 9297413 - DNA, 22 bp, Homo sapiens
gccaggctgctggctgctgtcc

SEQ ID NO: 9297414 - DNA, 22 bp, Homo sapiens
gccaggctgctccagggaggcc

SEQ ID NO: 9297415 - DNA, 22 bp, Homo sapiens
gccaggctcttggttatgtttt

SEQ ID NO: 9297416 - DNA, 22 bp, Homo sapiens
gccaggctgaggctctggaaga

SEQ ID NO: 9297417 - DNA, 22 bp, Homo sapiens
gccatttaggaggtggaaagga

SEQ ID NO: 9297418 - DNA, 22 bp, Homo sapiens
gccatgtgggcagaggaggctg

SEQ ID NO: 9297419 - DNA, 22 bp, Homo sapiens
gccatgggtctgctggctcagc

SEQ ID NO: 9297420 - DNA, 19 bp, Homo sapiens
gccatgggctggcagcaga

SEQ ID NO: 9297421 - DNA, 22 bp, Homo sapiens
gccatcaaggtgaagccctgag

SEQ ID NO: 9297422 - DNA, 22 bp, Homo sapiens
gcccttggcaaattctccttta

SEQ ID NO: 9297423 - DNA, 22 bp, Homo sapiens
gccctctcttctgcagcctcca

SEQ ID NO: 9297424 - DNA, 22 bp, Homo sapiens
gcctcctgttatgccatgtgcc

SEQ ID NO: 9297425 - DNA, 22 bp, Homo sapiens
gccgtgcgtgcgcaggtgctgt

SEQ ID NO: 9297426 - DNA, 22 bp, Homo sapiens
gccggggctggggagagacatg

SEQ ID NO: 9297427 - DNA, 22 bp, Homo sapiens
gccgggaccaaggccacggagc

SEQ ID NO: 9297428 - DNA, 22 bp, Homo sapiens
gccgctggaaggtgagtgacgt

SEQ ID NO: 9297429 - DNA, 22 bp, Homo sapiens
gccgctggaaggtgagtgacgt

SEQ ID NO: 9297430 - DNA, 22 bp, Homo sapiens
gatccagatatttgggctggta

SEQ ID NO: 9297431 - DNA, 22 bp, Homo sapiens
gatgcagggctggcaggagctt

SEQ ID NO: 9297432 - DNA, 22 bp, Homo sapiens
gataccagacagggagggagaa

SEQ ID NO: 9297433 - DNA, 20 bp, Homo sapiens
gatacacagcacagagggcc

SEQ ID NO: 9297434 - DNA, 19 bp, Homo sapiens
gataagtttccaggtaact

SEQ ID NO: 9297435 - DNA, 22 bp, Homo sapiens
gatatacagagcattctttgat

SEQ ID NO: 9297436 - DNA, 22 bp, Homo sapiens
gatatacaatccacagttgatt

SEQ ID NO: 9297437 - DNA, 22 bp, Homo sapiens
gatagataaaactatattttca

SEQ ID NO: 9297438 - DNA, 22 bp, Homo sapiens
gatagagactataatgctcttt

SEQ ID NO: 9297439 - DNA, 22 bp, Homo sapiens
gatatacataggtttctatgca

SEQ ID NO: 9297440 - DNA, 22 bp, Homo sapiens
gagtctctttgccagtcctaag

SEQ ID NO: 9297441 - DNA, 22 bp, Homo sapiens
gagtcgagcagaaagccgtcgg

SEQ ID NO: 9297442 - DNA, 22 bp, Homo sapiens
gagtcgagcagaaagccgtcgg

SEQ ID NO: 9297443 - DNA, 21 bp, Homo sapiens
gagtgggacatgggagtggtt

SEQ ID NO: 9297444 - DNA, 22 bp, Homo sapiens
gagtggctgagtaagaggggag

SEQ ID NO: 9297445 - DNA, 22 bp, Homo sapiens
gagtggccagtggtggcatgtc

SEQ ID NO: 9297446 - DNA, 22 bp, Homo sapiens
gagtgctgtatctgagaaagca

SEQ ID NO: 9297447 - DNA, 22 bp, Homo sapiens
gagtggagatcgtgccactgca

SEQ ID NO: 9297448 - DNA, 22 bp, Homo sapiens
gagtggagcaaaagaggtagat

SEQ ID NO: 9297449 - DNA, 22 bp, Homo sapiens
gagtgcagtatgagaggctgct

SEQ ID NO: 9297450 - DNA, 22 bp, Homo sapiens
gagtttctgattcagtctgtgt

SEQ ID NO: 9297451 - DNA, 22 bp, Homo sapiens
gataaagtagatttgttctaga

SEQ ID NO: 9297452 - DNA, 22 bp, Homo sapiens
gagtgggtccacagaggtgaca

SEQ ID NO: 9297453 - DNA, 22 bp, Homo sapiens
gagtgggtctcatatatctggc

SEQ ID NO: 9297454 - DNA, 22 bp, Homo sapiens
gagtgggtaaaggtgcttggct

SEQ ID NO: 9297455 - DNA, 22 bp, Homo sapiens
gagtgggtaccggagcaggtgc

SEQ ID NO: 9297456 - DNA, 22 bp, Homo sapiens
gagtgggtgagagacttggcac

SEQ ID NO: 9297457 - DNA, 22 bp, Homo sapiens
gagtgggtgagagacttggcac

SEQ ID NO: 9297458 - DNA, 22 bp, Homo sapiens
gagtgggtgaatgtgctcataa

SEQ ID NO: 9297459 - DNA, 22 bp, Homo sapiens
gagtgggtgacagaaggaggta

SEQ ID NO: 9297460 - DNA, 22 bp, Homo sapiens
gaggtcaggctcaagctgggcc

SEQ ID NO: 9297461 - DNA, 22 bp, Homo sapiens
gaggtcagtcagaccagggttt

SEQ ID NO: 9297462 - DNA, 22 bp, Homo sapiens
gaggtcagtcagaccagggttt

SEQ ID NO: 9297463 - DNA, 22 bp, Homo sapiens
gagggtgtctgcgtaactggca

SEQ ID NO: 9297464 - DNA, 19 bp, Homo sapiens
gaggtcagcaagaagtatt

SEQ ID NO: 9297465 - DNA, 22 bp, Homo sapiens
gaggtaggtgtaggaggcctgc

SEQ ID NO: 9297466 - DNA, 22 bp, Homo sapiens
gaggtggtcgaggaggggtacc

SEQ ID NO: 9297467 - DNA, 22 bp, Homo sapiens
gaggtggtggtggaggcatagc

SEQ ID NO: 9297468 - DNA, 22 bp, Homo sapiens
gaggtggttcaggtagagccca

SEQ ID NO: 9297469 - DNA, 22 bp, Homo sapiens
gaggtggtttgtggtgactcat

SEQ ID NO: 9297470 - DNA, 22 bp, Homo sapiens
gaggtgtcagggtagtcatgat

SEQ ID NO: 9297471 - DNA, 22 bp, Homo sapiens
gaggtgtcactattttgcttat

SEQ ID NO: 9297472 - DNA, 22 bp, Homo sapiens
gaggtgtctggcctttgtagga

SEQ ID NO: 9297473 - DNA, 20 bp, Homo sapiens
gagtcacagaagaagctgaa

SEQ ID NO: 9297474 - DNA, 22 bp, Homo sapiens
gaggtgtcccgcagtccccaag

SEQ ID NO: 9297475 - DNA, 22 bp, Homo sapiens
gaggtgtcctagaagtattcag

SEQ ID NO: 9297476 - DNA, 22 bp, Homo sapiens
gaggtgtccctgaccctttgca

SEQ ID NO: 9297477 - DNA, 22 bp, Homo sapiens
gaggtgtcatttagttaatcag

SEQ ID NO: 9297478 - DNA, 22 bp, Homo sapiens
gaggtgtcatgagggcctgctc

SEQ ID NO: 9297479 - DNA, 22 bp, Homo sapiens
gaggtgtcatcaggcagctctg

SEQ ID NO: 9297480 - DNA, 22 bp, Homo sapiens
gaggtgtctgagtggggacctg

SEQ ID NO: 9297481 - DNA, 22 bp, Homo sapiens
gaggtgtctagatctaccagta

SEQ ID NO: 9297482 - DNA, 22 bp, Homo sapiens
gaggtgtctgctgtgttcaaag

SEQ ID NO: 9297483 - DNA, 22 bp, Homo sapiens
gaggtgtcctcagccaactctg

SEQ ID NO: 9297484 - DNA, 22 bp, Homo sapiens
gaggtgtcgtagattattctca

SEQ ID NO: 9297485 - DNA, 22 bp, Homo sapiens
gaggcctgaggctgcctggagc

SEQ ID NO: 9297486 - DNA, 16 bp, Homo sapiens
gagggcagaggcggaa

SEQ ID NO: 9297487 - DNA, 22 bp, Homo sapiens
gagggcagagtctaatgatgca

SEQ ID NO: 9297488 - DNA, 22 bp, Homo sapiens
gagggcagtagcctcgtaccct

SEQ ID NO: 9297489 - DNA, 22 bp, Homo sapiens
gagggcaggggtcttgcacggt

SEQ ID NO: 9297490 - DNA, 22 bp, Homo sapiens
gagggcagtagcctcgtaccct

SEQ ID NO: 9297491 - DNA, 22 bp, Homo sapiens
gagggcagtgaattttgaagct

SEQ ID NO: 9297492 - DNA, 20 bp, Homo sapiens
gagggcaggcacccatttca

SEQ ID NO: 9297493 - DNA, 22 bp, Homo sapiens
gagggcaggggtcttgcacggt

SEQ ID NO: 9297494 - DNA, 22 bp, Homo sapiens
gagggccaatgtgtccctgagc

SEQ ID NO: 9297495 - DNA, 22 bp, Homo sapiens
gagggccaaagagcaagagcct

SEQ ID NO: 9297496 - DNA, 22 bp, Homo sapiens
gagggccaactagcaccacttt

SEQ ID NO: 9297497 - DNA, 22 bp, Homo sapiens
gaggggcaggattattgggatt

SEQ ID NO: 9297498 - DNA, 22 bp, Homo sapiens
gagctgggagttatagcatgtt

SEQ ID NO: 9297499 - DNA, 22 bp, Homo sapiens
gagctgggagttatagcatgtt

SEQ ID NO: 9297500 - DNA, 22 bp, Homo sapiens
gagctgggaggactgggaactt

SEQ ID NO: 9297501 - DNA, 22 bp, Homo sapiens
gagctgggaggactgggaactt

SEQ ID NO: 9297502 - DNA, 18 bp, Homo sapiens
gagctgggagaaggaagg

SEQ ID NO: 9297503 - DNA, 22 bp, Homo sapiens
gagctgggagctgggatttgga

SEQ ID NO: 9297504 - DNA, 22 bp, Homo sapiens
gagctgggacttggaatccaca

SEQ ID NO: 9297505 - DNA, 23 bp, Homo sapiens
gagctgggatacaggcttactgc

SEQ ID NO: 9297506 - DNA, 22 bp, Homo sapiens
gagagtggatggagctgcgaag

SEQ ID NO: 9297507 - DNA, 22 bp, Homo sapiens
gagagtggaaagcaagctgagt

SEQ ID NO: 9297508 - DNA, 22 bp, Homo sapiens
gagctggaagtctgtggtcaga

SEQ ID NO: 9297509 - DNA, 22 bp, Homo sapiens
gagctgcttctgtgtgccgggt

SEQ ID NO: 9297510 - DNA, 22 bp, Homo sapiens
gagctggcaggaggctccccga

SEQ ID NO: 9297511 - DNA, 22 bp, Homo sapiens
gagctgggaagatagcttgagc

SEQ ID NO: 9297512 - DNA, 22 bp, Homo sapiens
gagctgggaagatagcttgagc

SEQ ID NO: 9297513 - DNA, 22 bp, Homo sapiens
gagctgggacatgggtcctctc

SEQ ID NO: 9297514 - DNA, 22 bp, Homo sapiens
gagctggctaatactgacttat

SEQ ID NO: 9297515 - DNA, 22 bp, Homo sapiens
gaggaggcttccgggaggcacg

SEQ ID NO: 9297516 - DNA, 22 bp, Homo sapiens
gaggaggctggcgccgcctgcc

SEQ ID NO: 9297517 - DNA, 22 bp, Homo sapiens
gaggaggctgtttctctgcatt

SEQ ID NO: 9297518 - DNA, 19 bp, Homo sapiens
gaggaggcttcagctttct

SEQ ID NO: 9297519 - DNA, 22 bp, Homo sapiens
gaggcctgaggctgcctggagc

SEQ ID NO: 9297520 - DNA, 22 bp, Homo sapiens
gaggcagctgggctggtggttt

SEQ ID NO: 9297521 - DNA, 22 bp, Homo sapiens
gaggcagctgaaggagtgacag

SEQ ID NO: 9297522 - DNA, 22 bp, Homo sapiens
gaggcagctgggctggtggttt

SEQ ID NO: 9297523 - DNA, 22 bp, Homo sapiens
gaggcagcagaacatggaagag

SEQ ID NO: 9297524 - DNA, 22 bp, Homo sapiens
cttctttccttcctccagtggc

SEQ ID NO: 9297525 - DNA, 19 bp, Homo sapiens
cttgaaatgagactgaagg

SEQ ID NO: 9297526 - DNA, 22 bp, Homo sapiens
cttgaaatccagatttcagagg

SEQ ID NO: 9297527 - DNA, 22 bp, Homo sapiens
cttctcttcctttgtcaactga

SEQ ID NO: 9297528 - DNA, 22 bp, Homo sapiens
cttctctctgcataggcatggg

SEQ ID NO: 9297529 - DNA, 22 bp, Homo sapiens
cttctctcggtgcatccctcac

SEQ ID NO: 9297530 - DNA, 22 bp, Homo sapiens
cttctctcggtgcatccctcac

SEQ ID NO: 9297531 - DNA, 22 bp, Homo sapiens
cttctctccctggcactcagac

SEQ ID NO: 9297532 - DNA, 22 bp, Homo sapiens
cttctcggccgtgtggatgcgc

SEQ ID NO: 9297533 - DNA, 22 bp, Homo sapiens
ctggctggtcctcggggacagc

SEQ ID NO: 9297534 - DNA, 22 bp, Homo sapiens
ctggctctgtgggacctggcct

SEQ ID NO: 9297535 - DNA, 22 bp, Homo sapiens
ctttagatttctatgtatcact

SEQ ID NO: 9297536 - DNA, 22 bp, Homo sapiens
ctttatgaacctgttcagcttg

SEQ ID NO: 9297537 - DNA, 22 bp, Homo sapiens
cttgaatcttctgagtatttgc

SEQ ID NO: 9297538 - DNA, 22 bp, Homo sapiens
cttgggaatgctaacagatgac

SEQ ID NO: 9297539 - DNA, 22 bp, Homo sapiens
gaaataattctgtgtctgaaca

SEQ ID NO: 9297540 - DNA, 22 bp, Homo sapiens
gaaataatttagaaggtattcc

SEQ ID NO: 9297541 - DNA, 22 bp, Homo sapiens
gaacagagttgaaacaaggctg

SEQ ID NO: 9297542 - DNA, 22 bp, Homo sapiens
gaaagttcacacatccacatgg

SEQ ID NO: 9297543 - DNA, 22 bp, Homo sapiens
ctttgttttactcagaggcatg

SEQ ID NO: 9297544 - DNA, 22 bp, Homo sapiens
ctttgttatctgtaaatggtta

SEQ ID NO: 9297545 - DNA, 22 bp, Homo sapiens
ctttgtgtctgttaataattat

SEQ ID NO: 9297546 - DNA, 22 bp, Homo sapiens
gaaaagtaaacactaggggtca

SEQ ID NO: 9297547 - DNA, 22 bp, Homo sapiens
gaaaagctaggccagttcagct

SEQ ID NO: 9297548 - DNA, 22 bp, Homo sapiens
gaaaagagtcctgtgtgaggag

SEQ ID NO: 9297549 - DNA, 22 bp, Homo sapiens
gaaaagagtcctgtgtgaggag

SEQ ID NO: 9297550 - DNA, 22 bp, Homo sapiens
gaaaagagacagggtgggtgat

SEQ ID NO: 9297551 - DNA, 22 bp, Homo sapiens
gaagttcaactgccatgcttgg

SEQ ID NO: 9297552 - DNA, 22 bp, Homo sapiens
gaagttcacatagctggcaggt

SEQ ID NO: 9297553 - DNA, 22 bp, Homo sapiens
gaagttagtgtggatgcaggga

SEQ ID NO: 9297554 - DNA, 22 bp, Homo sapiens
gaagttagtcattgaagcccca

SEQ ID NO: 9297555 - DNA, 22 bp, Homo sapiens
gaattagtgttgaaatcagggc

SEQ ID NO: 9297556 - DNA, 22 bp, Homo sapiens
gaattcattagggaagctatct

SEQ ID NO: 9297557 - DNA, 22 bp, Homo sapiens
gaattgtaagtaccagcatgct

SEQ ID NO: 9297558 - DNA, 22 bp, Homo sapiens
gaattgtactgcaatcagggga

SEQ ID NO: 9297559 - DNA, 22 bp, Homo sapiens
gaattgtacgctttacataggt

SEQ ID NO: 9297560 - DNA, 22 bp, Homo sapiens
gaattgtagagggaacagaagc

SEQ ID NO: 9297561 - DNA, 22 bp, Homo sapiens
gaattgtattgatttttcagag

SEQ ID NO: 9297562 - DNA, 22 bp, Homo sapiens
gacacagatgatcaggtgtgga

SEQ ID NO: 9297563 - DNA, 22 bp, Homo sapiens
gacacagatatctctgagatta

SEQ ID NO: 9297564 - DNA, 22 bp, Homo sapiens
gacacagagggcaccagatatg

SEQ ID NO: 9297565 - DNA, 22 bp, Homo sapiens
gacacagagctcacagtctcct

SEQ ID NO: 9297566 - DNA, 22 bp, Homo sapiens
gacaggaagtctgaaggaggga

SEQ ID NO: 9297567 - DNA, 19 bp, Homo sapiens
gacaggaaggctaccagta

SEQ ID NO: 9297568 - DNA, 19 bp, Homo sapiens
gacaggacgaagggaagtt

SEQ ID NO: 9297569 - DNA, 22 bp, Homo sapiens
gacagctgtgcaggagaagggg

SEQ ID NO: 9297570 - DNA, 22 bp, Homo sapiens
gaagttagagaaggcagccagg

SEQ ID NO: 9297571 - DNA, 22 bp, Homo sapiens
gaaggctatatgactcagccct

SEQ ID NO: 9297572 - DNA, 22 bp, Homo sapiens
gaaggagaggattgtgaggctg

SEQ ID NO: 9297573 - DNA, 22 bp, Homo sapiens
gaaggagagggtcaaggataat

SEQ ID NO: 9297574 - DNA, 22 bp, Homo sapiens
gaaggcccgccctgagcaaggg

SEQ ID NO: 9297575 - DNA, 22 bp, Homo sapiens
gaaggagaccctgaagatgctg

SEQ ID NO: 9297576 - DNA, 22 bp, Homo sapiens
gaaggagagaaaggcaattctg

SEQ ID NO: 9297577 - DNA, 21 bp, Homo sapiens
gaaggagaaagcaagtgctgc

SEQ ID NO: 9297578 - DNA, 19 bp, Homo sapiens
gaaggagagctgagttagg

SEQ ID NO: 9297579 - DNA, 22 bp, Homo sapiens
gaaggagagagacatcgtccct

SEQ ID NO: 9297580 - DNA, 22 bp, Homo sapiens
gagacacacattctggagagaa

SEQ ID NO: 9297581 - DNA, 22 bp, Homo sapiens
gagacacacattctggagagaa

SEQ ID NO: 9297582 - DNA, 22 bp, Homo sapiens
gagaaaatgtcagacttggtcg

SEQ ID NO: 9297583 - DNA, 22 bp, Homo sapiens
gagaaaatgtcagacttggtcg

SEQ ID NO: 9297584 - DNA, 22 bp, Homo sapiens
gagaaaatcttgggtcaagaat

SEQ ID NO: 9297585 - DNA, 22 bp, Homo sapiens
gagaaaatagcatgtgtagtat

SEQ ID NO: 9297586 - DNA, 22 bp, Homo sapiens
gactttatttccttatttgtga

SEQ ID NO: 9297587 - DNA, 22 bp, Homo sapiens
gactttattatagtggcaatag

SEQ ID NO: 9297588 - DNA, 22 bp, Homo sapiens
gactttattcgttaactgttaa

SEQ ID NO: 9297589 - DNA, 22 bp, Homo sapiens
gactttattactaaccctgtga

SEQ ID NO: 9297590 - DNA, 22 bp, Homo sapiens
gactttatgaagagatgaccaa

SEQ ID NO: 9297591 - DNA, 22 bp, Homo sapiens
gactttatcttgtccttcctgc

SEQ ID NO: 9297592 - DNA, 22 bp, Homo sapiens
gactttatcctgcctgaccacg

SEQ ID NO: 9297593 - DNA, 22 bp, Homo sapiens
gactttataaatgagaggcgga

SEQ ID NO: 9297594 - DNA, 22 bp, Homo sapiens
gagacagatctcggctccatgc

SEQ ID NO: 9297595 - DNA, 22 bp, Homo sapiens
gactttaaaatgctagaacagg

SEQ ID NO: 9297596 - DNA, 22 bp, Homo sapiens
gacttgggtgtcggggcagtct

SEQ ID NO: 9297597 - DNA, 22 bp, Homo sapiens
gactggggtaaggtgaggaggt

SEQ ID NO: 9297598 - DNA, 22 bp, Homo sapiens
gactggggtaaggtgaggaggt

SEQ ID NO: 9297599 - DNA, 22 bp, Homo sapiens
gacccagggtttctgcacaggg

SEQ ID NO: 9297600 - DNA, 22 bp, Homo sapiens
gactgtggggggcggacacaag

SEQ ID NO: 9297601 - DNA, 18 bp, Homo sapiens
gacccaggaaagagtcct

SEQ ID NO: 9297602 - DNA, 22 bp, Homo sapiens
gacccaggaagctacttctggt

SEQ ID NO: 9297603 - DNA, 22 bp, Homo sapiens
gaccattagctgctattcagta

SEQ ID NO: 9297604 - DNA, 22 bp, Homo sapiens
gacccagggtatccagagctgc

SEQ ID NO: 9297605 - DNA, 22 bp, Homo sapiens
gacaggcaattaccagcgccca

SEQ ID NO: 9297606 - DNA, 22 bp, Homo sapiens
gacaggcacgaaattgggctgg

SEQ ID NO: 9297607 - DNA, 22 bp, Homo sapiens
gacaggcaggccagggctgtgg

SEQ ID NO: 9297608 - DNA, 22 bp, Homo sapiens
gacaggcatgctttcaggacta

SEQ ID NO: 9297609 - DNA, 22 bp, Homo sapiens
tgtattacaaagaagaggctgg

SEQ ID NO: 9297610 - DNA, 22 bp, Homo sapiens
tgtattcaacttcttaaaaatt

SEQ ID NO: 9297611 - DNA, 22 bp, Homo sapiens
tgtattcagggacatatatgta

SEQ ID NO: 9297612 - DNA, 22 bp, Homo sapiens
cctggcagaatattaaagtgca

SEQ ID NO: 9297613 - DNA, 22 bp, Homo sapiens
cctggcagacagcactgaagct

SEQ ID NO: 9297614 - DNA, 22 bp, Homo sapiens
cctggcagaaagagttacacct

SEQ ID NO: 9297615 - DNA, 21 bp, Homo sapiens
cctggcagaagcctgatatgc

SEQ ID NO: 9297616 - DNA, 22 bp, Homo sapiens
tgtagggaggaagggttggaaa

SEQ ID NO: 9297617 - DNA, 22 bp, Homo sapiens
tgtagggactgaggctggagag

SEQ ID NO: 9297618 - DNA, 22 bp, Homo sapiens
tgtagggacttggcgatcactt

SEQ ID NO: 9297619 - DNA, 22 bp, Homo sapiens
tgtagggagaagagaggcacct

SEQ ID NO: 9297620 - DNA, 22 bp, Homo sapiens
tgtagggaggaaagggctcttg

SEQ ID NO: 9297621 - DNA, 22 bp, Homo sapiens
tgtagggagagggagttgcacc

SEQ ID NO: 9297622 - DNA, 22 bp, Homo sapiens
tgtaggattttcaccagacctt

SEQ ID NO: 9297623 - DNA, 16 bp, Homo sapiens
tgtaggataaccatac

SEQ ID NO: 9297624 - DNA, 22 bp, Homo sapiens
tgtaggatgtaaggcaggcatc

SEQ ID NO: 9297625 - DNA, 22 bp, Homo sapiens
tgtaaagaaagacgcagagtta

SEQ ID NO: 9297626 - DNA, 23 bp, Homo sapiens
tgtaaacatcaccccctggagtt

SEQ ID NO: 9297627 - DNA, 22 bp, Homo sapiens
tgtaaacatatgtatgtatgta

SEQ ID NO: 9297628 - DNA, 22 bp, Homo sapiens
cctggaggtggaggttgcagtg

SEQ ID NO: 9297629 - DNA, 22 bp, Homo sapiens
tgtagtagcattcacgaagtgt

SEQ ID NO: 9297630 - DNA, 22 bp, Homo sapiens
cctggagaggcgctgcagagga

SEQ ID NO: 9297631 - DNA, 22 bp, Homo sapiens
tgtaaacataccagagccaagt

SEQ ID NO: 9297632 - DNA, 22 bp, Homo sapiens
tgtaaacagccccatggagagc

SEQ ID NO: 9297633 - DNA, 22 bp, Homo sapiens
tggtgctgtggaggggcagaag

SEQ ID NO: 9297634 - DNA, 22 bp, Homo sapiens
tggtgctgtggaggggcagaag

SEQ ID NO: 9297635 - DNA, 22 bp, Homo sapiens
tggtgctgtgatacgaggcact

SEQ ID NO: 9297636 - DNA, 22 bp, Homo sapiens
tggtgctgcctcagatgcctta

SEQ ID NO: 9297637 - DNA, 19 bp, Homo sapiens
tggtgctggcctcccatgg

SEQ ID NO: 9297638 - DNA, 22 bp, Homo sapiens
tggtgctgtctactttgtgcag

SEQ ID NO: 9297639 - DNA, 22 bp, Homo sapiens
tggtgctggtgccacgcccctt

SEQ ID NO: 9297640 - DNA, 22 bp, Homo sapiens
tggtgctgccacctcctctgct

SEQ ID NO: 9297641 - DNA, 22 bp, Homo sapiens
tggtgctgccaggctcctgcca

SEQ ID NO: 9297642 - DNA, 22 bp, Homo sapiens
tggtgctgataatggcaggatt

SEQ ID NO: 9297643 - DNA, 22 bp, Homo sapiens
tggtgctgataatggcaggatt

SEQ ID NO: 9297644 - DNA, 22 bp, Homo sapiens
tggtgctgcaggtgggcacagt

SEQ ID NO: 9297645 - DNA, 22 bp, Homo sapiens
tggtggctaccaggtcctgggg

SEQ ID NO: 9297646 - DNA, 22 bp, Homo sapiens
tggtgctgacagttctgagtgc

SEQ ID NO: 9297647 - DNA, 22 bp, Homo sapiens
tggtgctgagatgaagtgctcc

SEQ ID NO: 9297648 - DNA, 22 bp, Homo sapiens
tggtccctaaagatgtctacat

SEQ ID NO: 9297649 - DNA, 22 bp, Homo sapiens
tggtccctgatctaatgtctca

SEQ ID NO: 9297650 - DNA, 22 bp, Homo sapiens
tggtagggacactatgcagaaa

SEQ ID NO: 9297651 - DNA, 22 bp, Homo sapiens
tggtaggagggaaatgcgggtt

SEQ ID NO: 9297652 - DNA, 21 bp, Homo sapiens
tggtaggatccaggaatctgc

SEQ ID NO: 9297653 - DNA, 22 bp, Homo sapiens
tggtaggatagtgacttatatg

SEQ ID NO: 9297654 - DNA, 22 bp, Homo sapiens
cctctgtggccctgactctctt

SEQ ID NO: 9297655 - DNA, 22 bp, Homo sapiens
tggtaggagatatggtctccga

SEQ ID NO: 9297656 - DNA, 22 bp, Homo sapiens
cctctgtgctttgtccagcctc

SEQ ID NO: 9297657 - DNA, 22 bp, Homo sapiens
cctctgtgcctcgtgtcctctg

SEQ ID NO: 9297658 - DNA, 22 bp, Homo sapiens
tgtcctgcaagccctaatgaat

SEQ ID NO: 9297659 - DNA, 22 bp, Homo sapiens
tgtctcagttcccttctctgga

SEQ ID NO: 9297660 - DNA, 22 bp, Homo sapiens
tgtctcagtacactccgatgtt

SEQ ID NO: 9297661 - DNA, 22 bp, Homo sapiens
cctggctcctgcctctgcaggg

SEQ ID NO: 9297662 - DNA, 22 bp, Homo sapiens
cctggctctagaggccactcct

SEQ ID NO: 9297663 - DNA, 22 bp, Homo sapiens
cctggcagttttgcccaggatt

SEQ ID NO: 9297664 - DNA, 22 bp, Homo sapiens
cctggcagtggtgaagaagagg

SEQ ID NO: 9297665 - DNA, 22 bp, Homo sapiens
cctggcagttcatcaaatggca

SEQ ID NO: 9297666 - DNA, 22 bp, Homo sapiens
tgtcctcatcctccagtctgtc

SEQ ID NO: 9297667 - DNA, 22 bp, Homo sapiens
tgtcctccaggacctgcagggc

SEQ ID NO: 9297668 - DNA, 22 bp, Homo sapiens
tgtcctcatcttttccagaaat

SEQ ID NO: 9297669 - DNA, 19 bp, Homo sapiens
tgtccagtgatgtcaagga

SEQ ID NO: 9297670 - DNA, 22 bp, Homo sapiens
tgtccagtgatgccaagatgaa

SEQ ID NO: 9297671 - DNA, 22 bp, Homo sapiens
tgtccatacctttacctgtgta

SEQ ID NO: 9297672 - DNA, 22 bp, Homo sapiens
tgtccagtccttggggtgctgt

SEQ ID NO: 9297673 - DNA, 22 bp, Homo sapiens
cctggcagcattggtagagatt

SEQ ID NO: 9297674 - DNA, 22 bp, Homo sapiens
cctggcagcaggtgggcccgtg

SEQ ID NO: 9297675 - DNA, 22 bp, Homo sapiens
cctggcagctgtttggcttggc

SEQ ID NO: 9297676 - DNA, 18 bp, Homo sapiens
cctggcagccatgcgcgc

SEQ ID NO: 9297677 - DNA, 22 bp, Homo sapiens
cctggcagcagcacatgccttc

SEQ ID NO: 9297678 - DNA, 23 bp, Homo sapiens
cctggcagcaaacgaggaggtta

SEQ ID NO: 9297679 - DNA, 22 bp, Homo sapiens
cctggcagactgtgagggcagg

SEQ ID NO: 9297680 - DNA, 22 bp, Homo sapiens
cctggcaggctggggacagtgc

SEQ ID NO: 9297681 - DNA, 20 bp, Homo sapiens
cctggcaggcgggttactta

SEQ ID NO: 9297682 - DNA, 22 bp, Homo sapiens
cctggcaggactgttgtaagaa

SEQ ID NO: 9297683 - DNA, 22 bp, Homo sapiens
cctggcaggcccctcctggatt

SEQ ID NO: 9297684 - DNA, 22 bp, Homo sapiens
cctggcaggcaagaggaaggga

SEQ ID NO: 9297685 - DNA, 22 bp, Homo sapiens
cctggcagtcaggggagtcctt

SEQ ID NO: 9297686 - DNA, 22 bp, Homo sapiens
cctggcaggtggcgccctcggc

SEQ ID NO: 9297687 - DNA, 22 bp, Homo sapiens
cctggcaggttacaaccagtta

SEQ ID NO: 9297688 - DNA, 22 bp, Homo sapiens
cctggcaggtggaggttgcagt

SEQ ID NO: 9297689 - DNA, 22 bp, Homo sapiens
cctggcaggtagcattgaggag

SEQ ID NO: 9297690 - DNA, 22 bp, Homo sapiens
cctggcagggctgcagtaatgg

SEQ ID NO: 9297691 - DNA, 22 bp, Homo sapiens
tgtgaagatcagggtcctagag

SEQ ID NO: 9297692 - DNA, 22 bp, Homo sapiens
tgtgaagagtagacatgtggtg

SEQ ID NO: 9297693 - DNA, 22 bp, Homo sapiens
tgtgaagctggatcctggagct

SEQ ID NO: 9297694 - DNA, 20 bp, Homo sapiens
tgtgagcagatgctgagtga

SEQ ID NO: 9297695 - DNA, 22 bp, Homo sapiens
cctggctctgaagtccacatca

SEQ ID NO: 9297696 - DNA, 22 bp, Homo sapiens
cctggctcttctgtgtcagccc

SEQ ID NO: 9297697 - DNA, 22 bp, Homo sapiens
tgtctggtgggttgacaggcag

SEQ ID NO: 9297698 - DNA, 22 bp, Homo sapiens
tgtctggtgggttgacaggcag

SEQ ID NO: 9297699 - DNA, 22 bp, Homo sapiens
tgtgctgggagatagagggagg

SEQ ID NO: 9297700 - DNA, 22 bp, Homo sapiens
tgtgctgggaaatggcaggata

SEQ ID NO: 9297701 - DNA, 22 bp, Homo sapiens
tgtgccagtgccttgggtatta

SEQ ID NO: 9297702 - DNA, 22 bp, Homo sapiens
tgtgccagttttgtctaagccc

SEQ ID NO: 9297703 - DNA, 22 bp, Homo sapiens
cctgggagagtctgtggtctcc

SEQ ID NO: 9297704 - DNA, 22 bp, Homo sapiens
cctgggagccaagcctctgtgt

SEQ ID NO: 9297705 - DNA, 21 bp, Homo sapiens
cctgggagatcagctgccttc

SEQ ID NO: 9297706 - DNA, 22 bp, Homo sapiens
tgtgccagcctctggctgtgtc

SEQ ID NO: 9297707 - DNA, 22 bp, Homo sapiens
cctgggtcccagccaggctttg

SEQ ID NO: 9297708 - DNA, 22 bp, Homo sapiens
tgtgttctccaactgtagattt

SEQ ID NO: 9297709 - DNA, 22 bp, Homo sapiens
cctgggagctgtggaaaggctg

SEQ ID NO: 9297710 - DNA, 22 bp, Homo sapiens
tgtggggctccctggcagcctg

SEQ ID NO: 9297711 - DNA, 22 bp, Homo sapiens
tgtggggctgtcaggcaactgg

SEQ ID NO: 9297712 - DNA, 22 bp, Homo sapiens
tgtggggctccctggcagcctg

SEQ ID NO: 9297713 - DNA, 22 bp, Homo sapiens
tgtggggcagctagccggcctg

SEQ ID NO: 9297714 - DNA, 22 bp, Homo sapiens
tgtggggccaaagcccagccac

SEQ ID NO: 9297715 - DNA, 22 bp, Homo sapiens
tgtggggcctcgtgctagctgg

SEQ ID NO: 9297716 - DNA, 22 bp, Homo sapiens
tgtggggcagctagccggcctg

SEQ ID NO: 9297717 - DNA, 22 bp, Homo sapiens
tgtggggcttacaaaggcagat

SEQ ID NO: 9297718 - DNA, 22 bp, Homo sapiens
tgtggggctgtcaggcaactgg

SEQ ID NO: 9297719 - DNA, 22 bp, Homo sapiens
tgtggggctgtggtgttcttct

SEQ ID NO: 9297720 - DNA, 22 bp, Homo sapiens
tgcattatcgtcttgatcctct

SEQ ID NO: 9297721 - DNA, 22 bp, Homo sapiens
tgccaggcctcaggagtctcca

SEQ ID NO: 9297722 - DNA, 22 bp, Homo sapiens
cccaggaggtgtagctgcgtgg

SEQ ID NO: 9297723 - DNA, 22 bp, Homo sapiens
tgccaggcgtggtggtgcgcac

SEQ ID NO: 9297724 - DNA, 21 bp, Homo sapiens
tgccaggcctgagctggggtc

SEQ ID NO: 9297725 - DNA, 19 bp, Homo sapiens
tgcctgctcctggcttcca

SEQ ID NO: 9297726 - DNA, 22 bp, Homo sapiens
cccagcctactctgccatagca

SEQ ID NO: 9297727 - DNA, 22 bp, Homo sapiens
cccagccttccaccctggacta

SEQ ID NO: 9297728 - DNA, 22 bp, Homo sapiens
cccagcctttgcttcctggttc

SEQ ID NO: 9297729 - DNA, 22 bp, Homo sapiens
cccagcctgtgacagccgtcct

SEQ ID NO: 9297730 - DNA, 22 bp, Homo sapiens
tgcagggacaggctctggggat

SEQ ID NO: 9297731 - DNA, 22 bp, Homo sapiens
cccagctgatttttgcagagat

SEQ ID NO: 9297732 - DNA, 17 bp, Homo sapiens
cccagctggcagtgccg

SEQ ID NO: 9297733 - DNA, 22 bp, Homo sapiens
cccagctgtaacgggtctgcac

SEQ ID NO: 9297734 - DNA, 22 bp, Homo sapiens
cccagcttgcccaggactgagg

SEQ ID NO: 9297735 - DNA, 19 bp, Homo sapiens
cccagcttgaccacctgct

SEQ ID NO: 9297736 - DNA, 22 bp, Homo sapiens
cccagcttctgagggggccttg

SEQ ID NO: 9297737 - DNA, 18 bp, Homo sapiens
cccagcttagcgcccctc

SEQ ID NO: 9297738 - DNA, 23 bp, Homo sapiens
cccagctttcccactgccgagag

SEQ ID NO: 9297739 - DNA, 22 bp, Homo sapiens
tgctggagacatagcaggcagc

SEQ ID NO: 9297740 - DNA, 22 bp, Homo sapiens
tgctggagatcattaatgttca

SEQ ID NO: 9297741 - DNA, 22 bp, Homo sapiens
tgctggagcatctgagagcatc

SEQ ID NO: 9297742 - DNA, 22 bp, Homo sapiens
ccccacctgtgcgtctgccgca

SEQ ID NO: 9297743 - DNA, 22 bp, Homo sapiens
cccctctccctcacttatcaat

SEQ ID NO: 9297744 - DNA, 22 bp, Homo sapiens
cccccaaagtttgcacggataa

SEQ ID NO: 9297745 - DNA, 21 bp, Homo sapiens
cccctcatacactctccttgc

SEQ ID NO: 9297746 - DNA, 22 bp, Homo sapiens
cccaggctcctgactcattcta

SEQ ID NO: 9297747 - DNA, 22 bp, Homo sapiens
tgctccagtgcctgccccacag

SEQ ID NO: 9297748 - DNA, 22 bp, Homo sapiens
tgcctgctcttaccactctccc

SEQ ID NO: 9297749 - DNA, 22 bp, Homo sapiens
tgcctgctctgtgccacagttg

SEQ ID NO: 9297750 - DNA, 20 bp, Homo sapiens
cccagggacctgagctccat

SEQ ID NO: 9297751 - DNA, 22 bp, Homo sapiens
cctctgggtatctgtggaagta

SEQ ID NO: 9297752 - DNA, 22 bp, Homo sapiens
cctctgggttagtttagggagc

SEQ ID NO: 9297753 - DNA, 22 bp, Homo sapiens
cctctgaggtgagcccagctgg

SEQ ID NO: 9297754 - DNA, 22 bp, Homo sapiens
cctctcttggccgcagtcttct

SEQ ID NO: 9297755 - DNA, 22 bp, Homo sapiens
cctctgagaggccatctctcct

SEQ ID NO: 9297756 - DNA, 22 bp, Homo sapiens
cctctctgtaagggtccctccc

SEQ ID NO: 9297757 - DNA, 22 bp, Homo sapiens
cctctctgtgtggcctctccat

SEQ ID NO: 9297758 - DNA, 16 bp, Homo sapiens
cctctcttattcctcc

SEQ ID NO: 9297759 - DNA, 22 bp, Homo sapiens
cctctctgtgtggcctctccat

SEQ ID NO: 9297760 - DNA, 20 bp, Homo sapiens
cctctctgcatgctccctga

SEQ ID NO: 9297761 - DNA, 22 bp, Homo sapiens
cctctctcttgtagtccctgcc

SEQ ID NO: 9297762 - DNA, 22 bp, Homo sapiens
cctctcatagtctgtatccttt

SEQ ID NO: 9297763 - DNA, 22 bp, Homo sapiens
cctctcagcgattcctcttgga

SEQ ID NO: 9297764 - DNA, 22 bp, Homo sapiens
tggctcagtttcagtcctggtt

SEQ ID NO: 9297765 - DNA, 22 bp, Homo sapiens
tggctcagtttgggggattgaa

SEQ ID NO: 9297766 - DNA, 22 bp, Homo sapiens
cctcctggtccagcatctcttt

SEQ ID NO: 9297767 - DNA, 22 bp, Homo sapiens
cctcggctgcccagcccagctg

SEQ ID NO: 9297768 - DNA, 22 bp, Homo sapiens
cctccctggtggctctggtcta

SEQ ID NO: 9297769 - DNA, 22 bp, Homo sapiens
cctccctgggtgctgggattgc

SEQ ID NO: 9297770 - DNA, 22 bp, Homo sapiens
cctccctgggtgctgggattgc

SEQ ID NO: 9297771 - DNA, 22 bp, Homo sapiens
cctcccttcagtagagcccaat

SEQ ID NO: 9297772 - DNA, 22 bp, Homo sapiens
cctccctgtctacctgttgtgg

SEQ ID NO: 9297773 - DNA, 22 bp, Homo sapiens
tggctgagggggcagttcagga

SEQ ID NO: 9297774 - DNA, 22 bp, Homo sapiens
cctccagcgcgatccactccgg

SEQ ID NO: 9297775 - DNA, 22 bp, Homo sapiens
cctccaagtttgactcaggaca

SEQ ID NO: 9297776 - DNA, 22 bp, Homo sapiens
cctccactgcttcccagctttg

SEQ ID NO: 9297777 - DNA, 22 bp, Homo sapiens
tggatctcggcaatgcgggact

SEQ ID NO: 9297778 - DNA, 22 bp, Homo sapiens
tggcaagaatattggaccagaa

SEQ ID NO: 9297779 - DNA, 22 bp, Homo sapiens
tggcaagaaactgaggcctgct

SEQ ID NO: 9297780 - DNA, 18 bp, Homo sapiens
tggagctgagggcaatgc

SEQ ID NO: 9297781 - DNA, 22 bp, Homo sapiens
tggcagctggagggcaatggcc

SEQ ID NO: 9297782 - DNA, 22 bp, Homo sapiens
tggcacagggcttggtcgctca

SEQ ID NO: 9297783 - DNA, 22 bp, Homo sapiens
tggcacagggcttggtcgctca

SEQ ID NO: 9297784 - DNA, 22 bp, Homo sapiens
tggcagaggtaattcaaatccc

SEQ ID NO: 9297785 - DNA, 22 bp, Homo sapiens
tggcaagtggcaccggctgtgg

SEQ ID NO: 9297786 - DNA, 22 bp, Homo sapiens
tggcaagttaaaatgtggtctt

SEQ ID NO: 9297787 - DNA, 22 bp, Homo sapiens
tggcacaggaatttagatgcag

SEQ ID NO: 9297788 - DNA, 22 bp, Homo sapiens
cctagtttcttaattttgagaa

SEQ ID NO: 9297789 - DNA, 20 bp, Homo sapiens
cctagttttctgagcgtgac

SEQ ID NO: 9297790 - DNA, 22 bp, Homo sapiens
cctagttttcattcagcagcct

SEQ ID NO: 9297791 - DNA, 22 bp, Homo sapiens
cctagttttggacattcctgca

SEQ ID NO: 9297792 - DNA, 22 bp, Homo sapiens
cctagtttttcacttgtgctgt

SEQ ID NO: 9297793 - DNA, 23 bp, Homo sapiens
tggccaggcataaaggtgggtgg

SEQ ID NO: 9297794 - DNA, 22 bp, Homo sapiens
tggcagctgtgtccaggtagaa

SEQ ID NO: 9297795 - DNA, 22 bp, Homo sapiens
tggccaggaggctgcttctgac

SEQ ID NO: 9297796 - DNA, 22 bp, Homo sapiens
tttgtacatcctaattctgagt

SEQ ID NO: 9297797 - DNA, 22 bp, Homo sapiens
ttttattatctttgaatgggac

SEQ ID NO: 9297798 - DNA, 23 bp, Homo sapiens
ttttattgatatgtagctgttgt

SEQ ID NO: 9297799 - DNA, 23 bp, Homo sapiens
ttttattgatatgtagctgttgt

SEQ ID NO: 9297800 - DNA, 23 bp, Homo sapiens
ttttattgatatgtagctgttgt

SEQ ID NO: 9297801 - DNA, 22 bp, Homo sapiens
ttttattcaaatagttcacact

SEQ ID NO: 9297802 - DNA, 17 bp, Homo sapiens
ctctgggcagcctgggg

SEQ ID NO: 9297803 - DNA, 22 bp, Homo sapiens
ctctgggcaccaaagagcagct

SEQ ID NO: 9297804 - DNA, 22 bp, Homo sapiens
ctctgggcacattttccaggac

SEQ ID NO: 9297805 - DNA, 22 bp, Homo sapiens
ctctgggcaggaccagtggacc

SEQ ID NO: 9297806 - DNA, 22 bp, Homo sapiens
ctctgggagtggccacttctca

SEQ ID NO: 9297807 - DNA, 18 bp, Homo sapiens
ctctgggagaggcataca

SEQ ID NO: 9297808 - DNA, 22 bp, Homo sapiens
ctctgggcaagtttcttcatga

SEQ ID NO: 9297809 - DNA, 21 bp, Homo sapiens
ttttattgatgaatggccact

SEQ ID NO: 9297810 - DNA, 21 bp, Homo sapiens
ttttattgatgaatggccact

SEQ ID NO: 9297811 - DNA, 21 bp, Homo sapiens
ttttattgatgaatggccact

SEQ ID NO: 9297812 - DNA, 22 bp, Homo sapiens
tttttaagagattctccagtct

SEQ ID NO: 9297813 - DNA, 22 bp, Homo sapiens
tttttaagctcctttgatgtca

SEQ ID NO: 9297814 - DNA, 22 bp, Homo sapiens
ctgaagaggacgcagcagcaag

SEQ ID NO: 9297815 - DNA, 22 bp, Homo sapiens
ctgaagatgtctgagatgctca

SEQ ID NO: 9297816 - DNA, 22 bp, Homo sapiens
ctgaaattctgcctctgcacaa

SEQ ID NO: 9297817 - DNA, 22 bp, Homo sapiens
ctgaggcagagaatgagtttgt

SEQ ID NO: 9297818 - DNA, 22 bp, Homo sapiens
ctgagaatgttttctgattgat

SEQ ID NO: 9297819 - DNA, 22 bp, Homo sapiens
ctgagaattactctgatgagta

SEQ ID NO: 9297820 - DNA, 22 bp, Homo sapiens
ctgagacatggtttgactggca

SEQ ID NO: 9297821 - DNA, 22 bp, Homo sapiens
ctgagagaatcatgctgcaggt

SEQ ID NO: 9297822 - DNA, 19 bp, Homo sapiens
ctgaggcaagtggtggtca

SEQ ID NO: 9297823 - DNA, 22 bp, Homo sapiens
ctgaggcactgtcagctgaggc

SEQ ID NO: 9297824 - DNA, 22 bp, Homo sapiens
ctgccaggttggcgctcgctct

SEQ ID NO: 9297825 - DNA, 22 bp, Homo sapiens
ctgcctcatgctgcctgcagcc

SEQ ID NO: 9297826 - DNA, 22 bp, Homo sapiens
ctgctttcttgttgcatcttaa

SEQ ID NO: 9297827 - DNA, 22 bp, Homo sapiens
ctgcttttgagcccagtgctca

SEQ ID NO: 9297828 - DNA, 22 bp, Homo sapiens
ctgctttttctaggaggacaat

SEQ ID NO: 9297829 - DNA, 22 bp, Homo sapiens
ctgctttttgtaggtcccagag

SEQ ID NO: 9297830 - DNA, 22 bp, Homo sapiens
ctgctttaggtggaatgttcta

SEQ ID NO: 9297831 - DNA, 22 bp, Homo sapiens
ctgctttagtgtggtgttagag

SEQ ID NO: 9297832 - DNA, 19 bp, Homo sapiens
ctgctttaggccttaaaag

SEQ ID NO: 9297833 - DNA, 22 bp, Homo sapiens
ctgctttagctagtgctcttag

SEQ ID NO: 9297834 - DNA, 22 bp, Homo sapiens
ctgctttatagggcttccatgt

SEQ ID NO: 9297835 - DNA, 22 bp, Homo sapiens
ctgctttatattgagcttgaaa

SEQ ID NO: 9297836 - DNA, 22 bp, Homo sapiens
ctgctttatctgagacaagtca

SEQ ID NO: 9297837 - DNA, 23 bp, Homo sapiens
ctgctttcccactccatgctctt

SEQ ID NO: 9297838 - DNA, 22 bp, Homo sapiens
ctgctttagacggctttcgctg

SEQ ID NO: 9297839 - DNA, 22 bp, Homo sapiens
ctgctttagacaactgctggga

SEQ ID NO: 9297840 - DNA, 22 bp, Homo sapiens
ctgctttagagctgagcctcag

SEQ ID NO: 9297841 - DNA, 21 bp, Homo sapiens
ctgctttacttcagaggatct

SEQ ID NO: 9297842 - DNA, 22 bp, Homo sapiens
ctgctttaccaaactcttggat

SEQ ID NO: 9297843 - DNA, 22 bp, Homo sapiens
ctgctttactcatagggtttca

SEQ ID NO: 9297844 - DNA, 22 bp, Homo sapiens
ctgcttctaagaacctgcagct

SEQ ID NO: 9297845 - DNA, 19 bp, Homo sapiens
ctgcttccttccctcactg

SEQ ID NO: 9297846 - DNA, 22 bp, Homo sapiens
ctgcttctaagaacctgcagct

SEQ ID NO: 9297847 - DNA, 22 bp, Homo sapiens
ctgcctgggccggccaccctct

SEQ ID NO: 9297848 - DNA, 22 bp, Homo sapiens
ctgcctggcctgatctccacgc

SEQ ID NO: 9297849 - DNA, 22 bp, Homo sapiens
ctgcctggctaaactcaagtcg

SEQ ID NO: 9297850 - DNA, 22 bp, Homo sapiens
ctgcctggagcattctgaaggt

SEQ ID NO: 9297851 - DNA, 22 bp, Homo sapiens
ctgcctggaccggcagccctcc

SEQ ID NO: 9297852 - DNA, 22 bp, Homo sapiens
ctgcctggaatgccagcttctc

SEQ ID NO: 9297853 - DNA, 22 bp, Homo sapiens
ctgcctgctcaccagggctctg

SEQ ID NO: 9297854 - DNA, 22 bp, Homo sapiens
ctgcctggcatggagaagagaa

SEQ ID NO: 9297855 - DNA, 20 bp, Homo sapiens
ctgcctggaggcctctacct

SEQ ID NO: 9297856 - DNA, 22 bp, Homo sapiens
ctggaggtgcctagatgagctc

SEQ ID NO: 9297857 - DNA, 22 bp, Homo sapiens
ctggaggtgggggcaagagtgt

SEQ ID NO: 9297858 - DNA, 22 bp, Homo sapiens
ctggaggggctggcatggtagc

SEQ ID NO: 9297859 - DNA, 22 bp, Homo sapiens
ctggaggggccatccacagtct

SEQ ID NO: 9297860 - DNA, 22 bp, Homo sapiens
ctggaggtcatgtaatatggaa

SEQ ID NO: 9297861 - DNA, 22 bp, Homo sapiens
ctggaggtctacagtggtagct

SEQ ID NO: 9297862 - DNA, 22 bp, Homo sapiens
ctggaggtagatggtggtaatg

SEQ ID NO: 9297863 - DNA, 21 bp, Homo sapiens
ctggagggtagagttgggctg

SEQ ID NO: 9297864 - DNA, 22 bp, Homo sapiens
ctggactttggcccatctgcca

SEQ ID NO: 9297865 - DNA, 22 bp, Homo sapiens
ctggaggcaaagcagaggcatg

SEQ ID NO: 9297866 - DNA, 22 bp, Homo sapiens
ctggaggctgagttgggtctcc

SEQ ID NO: 9297867 - DNA, 22 bp, Homo sapiens
ctggaggcagttgccccagtca

SEQ ID NO: 9297868 - DNA, 22 bp, Homo sapiens
ctggaggccactgtacagattg

SEQ ID NO: 9297869 - DNA, 22 bp, Homo sapiens
ctggaggcacccttagagaggc

SEQ ID NO: 9297870 - DNA, 22 bp, Homo sapiens
ctggccaggcggcccctgcatg

SEQ ID NO: 9297871 - DNA, 22 bp, Homo sapiens
ctggcagtctggtggaaggcct

SEQ ID NO: 9297872 - DNA, 22 bp, Homo sapiens
ctggcagtattaagagaagtga

SEQ ID NO: 9297873 - DNA, 22 bp, Homo sapiens
ctggcagttggcattggcatct

SEQ ID NO: 9297874 - DNA, 22 bp, Homo sapiens
ctggcatgaaatggcatctcat

SEQ ID NO: 9297875 - DNA, 22 bp, Homo sapiens
ctggcagtttgccaggagctcg

SEQ ID NO: 9297876 - DNA, 22 bp, Homo sapiens
ctggcacgcccacgtaggcact

SEQ ID NO: 9297877 - DNA, 22 bp, Homo sapiens
ctggcagattggggtcagcagt

SEQ ID NO: 9297878 - DNA, 22 bp, Homo sapiens
ctggcagatatttgcagacatg

SEQ ID NO: 9297879 - DNA, 22 bp, Homo sapiens
ctggcagatagtaagtgatcaa

SEQ ID NO: 9297880 - DNA, 22 bp, Homo sapiens
ctggcaagaaatatatatctta

SEQ ID NO: 9297881 - DNA, 22 bp, Homo sapiens
ctggcaagaaatatatatctta

SEQ ID NO: 9297882 - DNA, 22 bp, Homo sapiens
ctggcaagaaatatatatctta

SEQ ID NO: 9297883 - DNA, 22 bp, Homo sapiens
ctggatggtcccatgagcagct

SEQ ID NO: 9297884 - DNA, 22 bp, Homo sapiens
ctggcctggggggacacatccc

SEQ ID NO: 9297885 - DNA, 22 bp, Homo sapiens
ctggctctgagcccacctccag

SEQ ID NO: 9297886 - DNA, 22 bp, Homo sapiens
ctggctctctgagatattgagt

SEQ ID NO: 9297887 - DNA, 22 bp, Homo sapiens
ctggctctaagtgtcagctccc

SEQ ID NO: 9297888 - DNA, 22 bp, Homo sapiens
ctggcctctgtgttcaccatag

SEQ ID NO: 9297889 - DNA, 22 bp, Homo sapiens
ctggccctgtggcctaaggact

SEQ ID NO: 9297890 - DNA, 22 bp, Homo sapiens
ctggccagttgtcctggcttgg

SEQ ID NO: 9297891 - DNA, 22 bp, Homo sapiens
ctggccagttgccttcctgggt

SEQ ID NO: 9297892 - DNA, 22 bp, Homo sapiens
ctggccagtgtggctctgatct

SEQ ID NO: 9297893 - DNA, 22 bp, Homo sapiens
ctggccagttactgctattggc

SEQ ID NO: 9297894 - DNA, 17 bp, Homo sapiens
ctggccagtgtacttgg

SEQ ID NO: 9297895 - DNA, 22 bp, Homo sapiens
ctcatcaccacatataacaaag

SEQ ID NO: 9297896 - DNA, 22 bp, Homo sapiens
ttggccagatctgaggatactg

SEQ ID NO: 9297897 - DNA, 22 bp, Homo sapiens
ctcataaagtgagaatatgacc

SEQ ID NO: 9297898 - DNA, 22 bp, Homo sapiens
ttggccagacactacccccctt

SEQ ID NO: 9297899 - DNA, 22 bp, Homo sapiens
ttggccagaatcttcctagtga

SEQ ID NO: 9297900 - DNA, 22 bp, Homo sapiens
ttggccagaggtttctctcatg

SEQ ID NO: 9297901 - DNA, 22 bp, Homo sapiens
ttggccagactgaggtgctggg

SEQ ID NO: 9297902 - DNA, 22 bp, Homo sapiens
ttggccagagaccagagcaggg

SEQ ID NO: 9297903 - DNA, 22 bp, Homo sapiens
ctcatctgataaatcactctta

SEQ ID NO: 9297904 - DNA, 20 bp, Homo sapiens
ctcatctctgagcctcctgg

SEQ ID NO: 9297905 - DNA, 22 bp, Homo sapiens
ttgggatctcaaatccagctat

SEQ ID NO: 9297906 - DNA, 22 bp, Homo sapiens
ttgggcagaggccaggaggatg

SEQ ID NO: 9297907 - DNA, 22 bp, Homo sapiens
ttgggcagatgtttcctgtgga

SEQ ID NO: 9297908 - DNA, 22 bp, Homo sapiens
ttgggcagaggctgtgcagagg

SEQ ID NO: 9297909 - DNA, 22 bp, Homo sapiens
ttgggcagggaaaggacaggca

SEQ ID NO: 9297910 - DNA, 22 bp, Homo sapiens
ttgggcaggaacagatgcttga

SEQ ID NO: 9297911 - DNA, 23 bp, Homo sapiens
ttgggcaggagagtaatgtgatc

SEQ ID NO: 9297912 - DNA, 22 bp, Homo sapiens
ttggaaaagcgttctctgtagc

SEQ ID NO: 9297913 - DNA, 22 bp, Homo sapiens
ttggaaaaacacgatagtggtt

SEQ ID NO: 9297914 - DNA, 22 bp, Homo sapiens
ctcagtttctgacattaaaatc

SEQ ID NO: 9297915 - DNA, 22 bp, Homo sapiens
ctcagtttgtgtgatattgtct

SEQ ID NO: 9297916 - DNA, 22 bp, Homo sapiens
ttgtttcatggggatgtttatt

SEQ ID NO: 9297917 - DNA, 22 bp, Homo sapiens
ttgtttcatgagtgtaaaggga

SEQ ID NO: 9297918 - DNA, 22 bp, Homo sapiens
ttgtttcagctgtatgctatgt

SEQ ID NO: 9297919 - DNA, 22 bp, Homo sapiens
ttgtgtactacagtatgccaca

SEQ ID NO: 9297920 - DNA, 22 bp, Homo sapiens
ttgtattttgttatgctactgc

SEQ ID NO: 9297921 - DNA, 22 bp, Homo sapiens
ttgtgtactgttggttgatatt

SEQ ID NO: 9297922 - DNA, 22 bp, Homo sapiens
ttgttaaagatgcagattccat

SEQ ID NO: 9297923 - DNA, 22 bp, Homo sapiens
ctccaggcccctggccttctgc

SEQ ID NO: 9297924 - DNA, 22 bp, Homo sapiens
ttgggtgggtcaggactcggag

SEQ ID NO: 9297925 - DNA, 22 bp, Homo sapiens
ttgggtaggagaaagaacagat

SEQ ID NO: 9297926 - DNA, 22 bp, Homo sapiens
ttgtatttgattgtcatatcgt

SEQ ID NO: 9297927 - DNA, 22 bp, Homo sapiens
tttaaatttagaagaaacactg

SEQ ID NO: 9297928 - DNA, 22 bp, Homo sapiens
tttagacatagctgaaatcatt

SEQ ID NO: 9297929 - DNA, 22 bp, Homo sapiens
ctcctctttggggatttacaca

SEQ ID NO: 9297930 - DNA, 22 bp, Homo sapiens
ctcctctttagccccagctgga

SEQ ID NO: 9297931 - DNA, 22 bp, Homo sapiens
ctcctctgggtcctggtggcca

SEQ ID NO: 9297932 - DNA, 22 bp, Homo sapiens
ctcctctgtattgattgggact

SEQ ID NO: 9297933 - DNA, 22 bp, Homo sapiens
ctcctctggcttcctggaggca

SEQ ID NO: 9297934 - DNA, 22 bp, Homo sapiens
ctcctcttctgagtaccaggga

SEQ ID NO: 9297935 - DNA, 22 bp, Homo sapiens
ctctccagaatatgccgccgtg

SEQ ID NO: 9297936 - DNA, 22 bp, Homo sapiens
ctctccagcctttagcccacgc

SEQ ID NO: 9297937 - DNA, 22 bp, Homo sapiens
ctctccctatgcctcccaggag

SEQ ID NO: 9297938 - DNA, 22 bp, Homo sapiens
ctctcccccacagcagccttct

SEQ ID NO: 9297939 - DNA, 22 bp, Homo sapiens
ctctcctccaacagccctgccg

SEQ ID NO: 9297940 - DNA, 22 bp, Homo sapiens
ttgactttatgtcaacttgcct

SEQ ID NO: 9297941 - DNA, 19 bp, Homo sapiens
ttgacgttgtggaattaac

SEQ ID NO: 9297942 - DNA, 22 bp, Homo sapiens
ttgaggagcaggatgggaggct

SEQ ID NO: 9297943 - DNA, 22 bp, Homo sapiens
ttcttgtactggagatacatga

SEQ ID NO: 9297944 - DNA, 22 bp, Homo sapiens
ttcttgttctcctcatttagag

SEQ ID NO: 9297945 - DNA, 22 bp, Homo sapiens
ttcttgttctggttctgttagc

SEQ ID NO: 9297946 - DNA, 22 bp, Homo sapiens
ctattcactgtggcagagggag

SEQ ID NO: 9297947 - DNA, 22 bp, Homo sapiens
ttccttctaattttacacctga

SEQ ID NO: 9297948 - DNA, 21 bp, Homo sapiens
ttcatgagataaccagctgta

SEQ ID NO: 9297949 - DNA, 22 bp, Homo sapiens
ttcattcctgagcccatattta

SEQ ID NO: 9297950 - DNA, 22 bp, Homo sapiens
ttcattccttccctaagcaact

SEQ ID NO: 9297951 - DNA, 22 bp, Homo sapiens
ttcattccttctgtaccttgcc

SEQ ID NO: 9297952 - DNA, 22 bp, Homo sapiens
ttcattcccaagagtaaacata

SEQ ID NO: 9297953 - DNA, 20 bp, Homo sapiens
ttcattcattccacaacttc

SEQ ID NO: 9297954 - DNA, 22 bp, Homo sapiens
cggctgctgcctgagtcgctgt

SEQ ID NO: 9297955 - DNA, 23 bp, Homo sapiens
cggctgctcggccgagtcctcgg

SEQ ID NO: 9297956 - DNA, 22 bp, Homo sapiens
ttcacagacattgcagactgaa

SEQ ID NO: 9297957 - DNA, 22 bp, Homo sapiens
ttcacagaccaggaggctgtga

SEQ ID NO: 9297958 - DNA, 22 bp, Homo sapiens
ttcacagactgcagactttttg

SEQ ID NO: 9297959 - DNA, 22 bp, Homo sapiens
cgctgggggaacagcgagggtg

SEQ ID NO: 9297960 - DNA, 22 bp, Homo sapiens
cgctgggggaacagcgagggtg

SEQ ID NO: 9297961 - DNA, 22 bp, Homo sapiens
cgctggggctttttgcttgaga

SEQ ID NO: 9297962 - DNA, 22 bp, Homo sapiens
cgctgggggaacttcagccaat

SEQ ID NO: 9297963 - DNA, 22 bp, Homo sapiens
cggaagacagtccgctctttca

SEQ ID NO: 9297964 - DNA, 22 bp, Homo sapiens
ctaatgtatcatggctctcagc

SEQ ID NO: 9297965 - DNA, 22 bp, Homo sapiens
ctaattgtttgtgttgtcacct

SEQ ID NO: 9297966 - DNA, 22 bp, Homo sapiens
ctaattgtaccagatttctctt

SEQ ID NO: 9297967 - DNA, 22 bp, Homo sapiens
ctacaaaagtaattgtggtttt

SEQ ID NO: 9297968 - DNA, 22 bp, Homo sapiens
ctaatgtaaagcatttgttcag

SEQ ID NO: 9297969 - DNA, 22 bp, Homo sapiens
ctaatgtaatgatatgttgaat

SEQ ID NO: 9297970 - DNA, 22 bp, Homo sapiens
ctaatgtaaaacagacttgcat

SEQ ID NO: 9297971 - DNA, 22 bp, Homo sapiens
ctaagggcttgctggagccagg

SEQ ID NO: 9297972 - DNA, 17 bp, Homo sapiens
ctaagggcccactcttc

SEQ ID NO: 9297973 - DNA, 22 bp, Homo sapiens
ctaagggcttaatgtgtgtcag

SEQ ID NO: 9297974 - DNA, 22 bp, Homo sapiens
ctaagggcacagccaatcatca

SEQ ID NO: 9297975 - DNA, 22 bp, Homo sapiens
ttccaaatgttggacaactgta

SEQ ID NO: 9297976 - DNA, 22 bp, Homo sapiens
ttccatttggagctcgcagcct

SEQ ID NO: 9297977 - DNA, 22 bp, Homo sapiens
ttccatttggcacttcactgag

SEQ ID NO: 9297978 - DNA, 22 bp, Homo sapiens
ttcccacttttacagttgtctg

SEQ ID NO: 9297979 - DNA, 22 bp, Homo sapiens
ttcccacagtgttgaatcctct

SEQ ID NO: 9297980 - DNA, 22 bp, Homo sapiens
ttcccacattctttacattcat

SEQ ID NO: 9297981 - DNA, 22 bp, Homo sapiens
ttcccacagagattacattgaa

SEQ ID NO: 9297982 - DNA, 22 bp, Homo sapiens
taacaatacccattctaattac

SEQ ID NO: 9297983 - DNA, 22 bp, Homo sapiens
taacattccatggatctgcaga

SEQ ID NO: 9297984 - DNA, 22 bp, Homo sapiens
taacattccctttgtgccaagg

SEQ ID NO: 9297985 - DNA, 22 bp, Homo sapiens
taacattcttaacttagaaaca

SEQ ID NO: 9297986 - DNA, 22 bp, Homo sapiens
taacagaaaggggacagaaata

SEQ ID NO: 9297987 - DNA, 22 bp, Homo sapiens
caggatggagagtgaggggtca

SEQ ID NO: 9297988 - DNA, 22 bp, Homo sapiens
caggatggtctcgatctcctga

SEQ ID NO: 9297989 - DNA, 21 bp, Homo sapiens
taacttttgtgcctatcttgt

SEQ ID NO: 9297990 - DNA, 22 bp, Homo sapiens
taactttaggaataggtaatct

SEQ ID NO: 9297991 - DNA, 22 bp, Homo sapiens
taactttagtgtatgaggtaag

SEQ ID NO: 9297992 - DNA, 22 bp, Homo sapiens
taagacacattgagaaacacaa

SEQ ID NO: 9297993 - DNA, 22 bp, Homo sapiens
taagacacattggagtagatga

SEQ ID NO: 9297994 - DNA, 22 bp, Homo sapiens
taagacacatgcgtacaagata

SEQ ID NO: 9297995 - DNA, 22 bp, Homo sapiens
taagacacattcatatctgtct

SEQ ID NO: 9297996 - DNA, 22 bp, Homo sapiens
taagacacagtccgcactctct

SEQ ID NO: 9297997 - DNA, 23 bp, Homo sapiens
taagacacccgactccagagatg

SEQ ID NO: 9297998 - DNA, 22 bp, Homo sapiens
taagacacctctctgcccttca

SEQ ID NO: 9297999 - DNA, 22 bp, Homo sapiens
taagacacgggctgatctaaag

SEQ ID NO: 9298000 - DNA, 22 bp, Homo sapiens
taagacacaaatatcttttaca

SEQ ID NO: 9298001 - DNA, 19 bp, Homo sapiens
taagacacaaatgcaagcc

SEQ ID NO: 9298002 - DNA, 22 bp, Homo sapiens
caggcacaagatcggctagata

SEQ ID NO: 9298003 - DNA, 22 bp, Homo sapiens
caggcacaggggaatgtctttt

SEQ ID NO: 9298004 - DNA, 22 bp, Homo sapiens
caggcaagattagagatgagca

SEQ ID NO: 9298005 - DNA, 22 bp, Homo sapiens
caggcaaggagctggctcaagt

SEQ ID NO: 9298006 - DNA, 22 bp, Homo sapiens
caggcacaaatttctagataag

SEQ ID NO: 9298007 - DNA, 22 bp, Homo sapiens
caggcaagttcatttccaggca

SEQ ID NO: 9298008 - DNA, 22 bp, Homo sapiens
caggcaaggaggcactgaggga

SEQ ID NO: 9298009 - DNA, 22 bp, Homo sapiens
caggatggtgtgagtgtgagga

SEQ ID NO: 9298010 - DNA, 22 bp, Homo sapiens
caggatgttgctcccatgtccc

SEQ ID NO: 9298011 - DNA, 22 bp, Homo sapiens
caggcaacgtccttagagatgc

SEQ ID NO: 9298012 - DNA, 22 bp, Homo sapiens
caggcaagatccagaggctgct

SEQ ID NO: 9298013 - DNA, 22 bp, Homo sapiens
caggcagctctaatggaaagtg

SEQ ID NO: 9298014 - DNA, 22 bp, Homo sapiens
caggcagcaggagccctgctcg

SEQ ID NO: 9298015 - DNA, 22 bp, Homo sapiens
caggcagctgctgggttcagcc

SEQ ID NO: 9298016 - DNA, 22 bp, Homo sapiens
taattgttttcaatgttaatga

SEQ ID NO: 9298017 - DNA, 22 bp, Homo sapiens
taattgtaaagtagtagtacag

SEQ ID NO: 9298018 - DNA, 22 bp, Homo sapiens
taattgtacgatgttaaatcag

SEQ ID NO: 9298019 - DNA, 22 bp, Homo sapiens
taattgtagctttgtaatcagc

SEQ ID NO: 9298020 - DNA, 22 bp, Homo sapiens
taattgtactccctgtgggaaa

SEQ ID NO: 9298021 - DNA, 22 bp, Homo sapiens
taattgtatggagaaggctgca

SEQ ID NO: 9298022 - DNA, 22 bp, Homo sapiens
taattgtaaagtagtagtacag

SEQ ID NO: 9298023 - DNA, 22 bp, Homo sapiens
caggcagggagccactgtataa

SEQ ID NO: 9298024 - DNA, 22 bp, Homo sapiens
tacagtaacatgttgtacaagc

SEQ ID NO: 9298025 - DNA, 22 bp, Homo sapiens
tacaggtggatcactagtatag

SEQ ID NO: 9298026 - DNA, 22 bp, Homo sapiens
tacaggtgctctacagacagga

SEQ ID NO: 9298027 - DNA, 22 bp, Homo sapiens
tacaggtggtaaaaatattgtt

SEQ ID NO: 9298028 - DNA, 22 bp, Homo sapiens
caggccctgggcaggatcagcc

SEQ ID NO: 9298029 - DNA, 22 bp, Homo sapiens
caggccctggcagggctgagtc

SEQ ID NO: 9298030 - DNA, 22 bp, Homo sapiens
tacatgtgatcagaaagtgaaa

SEQ ID NO: 9298031 - DNA, 22 bp, Homo sapiens
tacatgtgcacgtgtgactttg

SEQ ID NO: 9298032 - DNA, 22 bp, Homo sapiens
tacatgtggagataactgaagc

SEQ ID NO: 9298033 - DNA, 22 bp, Homo sapiens
tacatgtgctgggttcttggcc

SEQ ID NO: 9298034 - DNA, 22 bp, Homo sapiens
tacatgtgctatttgttttgta

SEQ ID NO: 9298035 - DNA, 22 bp, Homo sapiens
tacatgtggccagaaatttgag

SEQ ID NO: 9298036 - DNA, 22 bp, Homo sapiens
tacatgtggagttttctagtca

SEQ ID NO: 9298037 - DNA, 22 bp, Homo sapiens
tacatatttgtctttgtactgt

SEQ ID NO: 9298038 - DNA, 22 bp, Homo sapiens
caggaagcatctggctagctaa

SEQ ID NO: 9298039 - DNA, 22 bp, Homo sapiens
caggaagccacaggacaggtag

SEQ ID NO: 9298040 - DNA, 22 bp, Homo sapiens
caggacaaagccctttgagaaa

SEQ ID NO: 9298041 - DNA, 22 bp, Homo sapiens
caggacagtgcaggtccatcct

SEQ ID NO: 9298042 - DNA, 22 bp, Homo sapiens
gttttcttcctgcaattggcat

SEQ ID NO: 9298043 - DNA, 22 bp, Homo sapiens
gttttcctgttgagtagtattc

SEQ ID NO: 9298044 - DNA, 22 bp, Homo sapiens
taaaatcaccaaaagcaggtgg

SEQ ID NO: 9298045 - DNA, 22 bp, Homo sapiens
taaaatagcatgtgcagtgaaa

SEQ ID NO: 9298046 - DNA, 19 bp, Homo sapiens
taaaccctggctttttctg

SEQ ID NO: 9298047 - DNA, 22 bp, Homo sapiens
taaactctgcattcttttaaaa

SEQ ID NO: 9298048 - DNA, 22 bp, Homo sapiens
taaactctcaacagagaaccac

SEQ ID NO: 9298049 - DNA, 22 bp, Homo sapiens
taaactcttctgtagaatcaga

SEQ ID NO: 9298050 - DNA, 22 bp, Homo sapiens
caggagaagtctctagggggtg

SEQ ID NO: 9298051 - DNA, 22 bp, Homo sapiens
caggagaaggtttggagtgcag

SEQ ID NO: 9298052 - DNA, 22 bp, Homo sapiens
caggagatgacagggaagaacc

SEQ ID NO: 9298053 - DNA, 22 bp, Homo sapiens
caggagataaaagagatgcttt

SEQ ID NO: 9298054 - DNA, 22 bp, Homo sapiens
caggagctctcatcgtcagggc

SEQ ID NO: 9298055 - DNA, 22 bp, Homo sapiens
taaatcaagaatatcagcttgt

SEQ ID NO: 9298056 - DNA, 22 bp, Homo sapiens
taaagtcatctttacatctttg

SEQ ID NO: 9298057 - DNA, 22 bp, Homo sapiens
caggagtggtgtgagggactcc

SEQ ID NO: 9298058 - DNA, 22 bp, Homo sapiens
caggagggcccgagactcttcc

SEQ ID NO: 9298059 - DNA, 22 bp, Homo sapiens
caggaggctcctagggctctgt

SEQ ID NO: 9298060 - DNA, 22 bp, Homo sapiens
caggaggctttgggatccaagt

SEQ ID NO: 9298061 - DNA, 22 bp, Homo sapiens
caggaggcccggccacagccca

SEQ ID NO: 9298062 - DNA, 22 bp, Homo sapiens
caggaggcgtcttcagtttgtt

SEQ ID NO: 9298063 - DNA, 22 bp, Homo sapiens
caggaggcagtttcagaagtca

SEQ ID NO: 9298064 - DNA, 22 bp, Homo sapiens
caggaggcatatttaaatccaa

SEQ ID NO: 9298065 - DNA, 22 bp, Homo sapiens
caggaggcatcatggagcggac

SEQ ID NO: 9298066 - DNA, 22 bp, Homo sapiens
caggaggccaactgtgggactt

SEQ ID NO: 9298067 - DNA, 22 bp, Homo sapiens
caggaggcccaaagggcgcaga

SEQ ID NO: 9298068 - DNA, 22 bp, Homo sapiens
caggaggcccacaggcccctgc

SEQ ID NO: 9298069 - DNA, 21 bp, Homo sapiens
taaatgtgagcagggctgggc

SEQ ID NO: 9298070 - DNA, 22 bp, Homo sapiens
caggaggaaatgtgaccctgct

SEQ ID NO: 9298071 - DNA, 20 bp, Homo sapiens
caggaggcaaggtcaaggtc

SEQ ID NO: 9298072 - DNA, 22 bp, Homo sapiens
caggaggaacaagaggttctgg

SEQ ID NO: 9298073 - DNA, 22 bp, Homo sapiens
caggaggaagaactctgcaaca

SEQ ID NO: 9298074 - DNA, 22 bp, Homo sapiens
caggaggcagcgctctcaggac

SEQ ID NO: 9298075 - DNA, 22 bp, Homo sapiens
caggaggcagtgggtgttgtct

SEQ ID NO: 9298076 - DNA, 22 bp, Homo sapiens
caggaggcaggtgcattttgag

SEQ ID NO: 9298077 - DNA, 22 bp, Homo sapiens
caggaggcagaggatgcccagt

SEQ ID NO: 9298078 - DNA, 22 bp, Homo sapiens
caggaggcagaggttgcagcga

SEQ ID NO: 9298079 - DNA, 22 bp, Homo sapiens
caggaggcagaggttgcagtga

SEQ ID NO: 9298080 - DNA, 22 bp, Homo sapiens
gtggggctgcttaggctgcgca

SEQ ID NO: 9298081 - DNA, 22 bp, Homo sapiens
gtgggtggatcacctgaggtca

SEQ ID NO: 9298082 - DNA, 22 bp, Homo sapiens
cagctggccctttggtagcctt

SEQ ID NO: 9298083 - DNA, 22 bp, Homo sapiens
cagctggcgtggagtgattgca

SEQ ID NO: 9298084 - DNA, 22 bp, Homo sapiens
cagctgggtgatcttgggcagg

SEQ ID NO: 9298085 - DNA, 22 bp, Homo sapiens
cagctggggcagccacgtgcgg

SEQ ID NO: 9298086 - DNA, 22 bp, Homo sapiens
cagctggggagagacatggcag

SEQ ID NO: 9298087 - DNA, 22 bp, Homo sapiens
cagctgggctaagagtagaggc

SEQ ID NO: 9298088 - DNA, 22 bp, Homo sapiens
cagctgggagctccattagata

SEQ ID NO: 9298089 - DNA, 22 bp, Homo sapiens
cagctgggcctcctgagccctg

SEQ ID NO: 9298090 - DNA, 22 bp, Homo sapiens
gtgtggaaagagtggcctctca

SEQ ID NO: 9298091 - DNA, 22 bp, Homo sapiens
cagctggctggtcagtgcacaa

SEQ ID NO: 9298092 - DNA, 22 bp, Homo sapiens
gtgggtggggagctctctggag

SEQ ID NO: 9298093 - DNA, 22 bp, Homo sapiens
gtgggacagcggggtgggacag

SEQ ID NO: 9298094 - DNA, 22 bp, Homo sapiens
gtgggcaggccccaaagcaggg

SEQ ID NO: 9298095 - DNA, 22 bp, Homo sapiens
gtgggcaggtaggcaccagcta

SEQ ID NO: 9298096 - DNA, 22 bp, Homo sapiens
gtgggaagaacttcaagtggct

SEQ ID NO: 9298097 - DNA, 22 bp, Homo sapiens
gtgggaagtctctcggaggaag

SEQ ID NO: 9298098 - DNA, 19 bp, Homo sapiens
gtgggacagacattacata

SEQ ID NO: 9298099 - DNA, 22 bp, Homo sapiens
gtggctcacgtctgtcatctca

SEQ ID NO: 9298100 - DNA, 22 bp, Homo sapiens
gtggccttttcaagtagggtat

SEQ ID NO: 9298101 - DNA, 22 bp, Homo sapiens
gtggccttttagaataaactct

SEQ ID NO: 9298102 - DNA, 22 bp, Homo sapiens
gtggctaggcccaacggcagga

SEQ ID NO: 9298103 - DNA, 22 bp, Homo sapiens
gtggcctttcctgaagaaatga

SEQ ID NO: 9298104 - DNA, 22 bp, Homo sapiens
gtggcctttatcttaggtatcc

SEQ ID NO: 9298105 - DNA, 22 bp, Homo sapiens
gtggccttgggcactgaccttg

SEQ ID NO: 9298106 - DNA, 22 bp, Homo sapiens
gtggccttggcttctaccctga

SEQ ID NO: 9298107 - DNA, 22 bp, Homo sapiens
gtggcctttgtccaggcgaaac

SEQ ID NO: 9298108 - DNA, 22 bp, Homo sapiens
gtggcctttcttgggctacaga

SEQ ID NO: 9298109 - DNA, 22 bp, Homo sapiens
gtggccttgctcacatgtccag

SEQ ID NO: 9298110 - DNA, 22 bp, Homo sapiens
gtggccttattatgtacaaaat

SEQ ID NO: 9298111 - DNA, 22 bp, Homo sapiens
gtggccttataagaagagacat

SEQ ID NO: 9298112 - DNA, 20 bp, Homo sapiens
gtggcctgtcctgttgtggg

SEQ ID NO: 9298113 - DNA, 22 bp, Homo sapiens
gtggccttaagaaacaaacaac

SEQ ID NO: 9298114 - DNA, 22 bp, Homo sapiens
gtggccttaggacacgtttatt

SEQ ID NO: 9298115 - DNA, 22 bp, Homo sapiens
cagctgagtttccaagtctgcc

SEQ ID NO: 9298116 - DNA, 22 bp, Homo sapiens
cagctgagttactctgaggtct

SEQ ID NO: 9298117 - DNA, 22 bp, Homo sapiens
cagctgagtgttggcatgttca

SEQ ID NO: 9298118 - DNA, 22 bp, Homo sapiens
cagctgagtctgaggttctttg

SEQ ID NO: 9298119 - DNA, 22 bp, Homo sapiens
cagctgagtggaccctagaggc

SEQ ID NO: 9298120 - DNA, 22 bp, Homo sapiens
cagctgagtgttggcatgttca

SEQ ID NO: 9298121 - DNA, 23 bp, Homo sapiens
cagctgaagcagcctgggctgga

SEQ ID NO: 9298122 - DNA, 22 bp, Homo sapiens
cagctgagctgccagactactg

SEQ ID NO: 9298123 - DNA, 22 bp, Homo sapiens
cagctgagctcccaggccatca

SEQ ID NO: 9298124 - DNA, 22 bp, Homo sapiens
cagctgagcatcactagtctgg

SEQ ID NO: 9298125 - DNA, 22 bp, Homo sapiens
cagctgaggaatactagatgta

SEQ ID NO: 9298126 - DNA, 22 bp, Homo sapiens
cagctgaggtcaaagaagcagg

SEQ ID NO: 9298127 - DNA, 22 bp, Homo sapiens
cagctgaggtcaaagaagcagg

SEQ ID NO: 9298128 - DNA, 22 bp, Homo sapiens
cagctgaggtcaaagaagcagg

SEQ ID NO: 9298129 - DNA, 22 bp, Homo sapiens
cagctgaggtcttttttatgtg

SEQ ID NO: 9298130 - DNA, 22 bp, Homo sapiens
cagctgagtctgaggttctttg

SEQ ID NO: 9298131 - DNA, 22 bp, Homo sapiens
cagctgagtatgcattcaagca

SEQ ID NO: 9298132 - DNA, 22 bp, Homo sapiens
cagctcttttttgcagcagctg

SEQ ID NO: 9298133 - DNA, 22 bp, Homo sapiens
cagctgaacatgtagagcatct

SEQ ID NO: 9298134 - DNA, 22 bp, Homo sapiens
cagctgaaagaaggaagtgtca

SEQ ID NO: 9298135 - DNA, 22 bp, Homo sapiens
cagctgaacatgtagagcatct

SEQ ID NO: 9298136 - DNA, 22 bp, Homo sapiens
gtggcagagcaggagacaggac

SEQ ID NO: 9298137 - DNA, 22 bp, Homo sapiens
cagcccagccttgtctctttat

SEQ ID NO: 9298138 - DNA, 21 bp, Homo sapiens
cagcccagcccattgacagtg

SEQ ID NO: 9298139 - DNA, 22 bp, Homo sapiens
gtggccagtcccgatgcttgtt

SEQ ID NO: 9298140 - DNA, 22 bp, Homo sapiens
gtggccaggtcagggacttgtg

SEQ ID NO: 9298141 - DNA, 22 bp, Homo sapiens
gtggccagggcccacaggatga

SEQ ID NO: 9298142 - DNA, 22 bp, Homo sapiens
gtggccagtgggaatgggctca

SEQ ID NO: 9298143 - DNA, 21 bp, Homo sapiens
gtggccagtgactacttattg

SEQ ID NO: 9298144 - DNA, 22 bp, Homo sapiens
gtggccagtggtgggcgccctg

SEQ ID NO: 9298145 - DNA, 22 bp, Homo sapiens
gtggccatataattttcttgaa

SEQ ID NO: 9298146 - DNA, 22 bp, Homo sapiens
gtggccaggccgactgccaggc

SEQ ID NO: 9298147 - DNA, 22 bp, Homo sapiens
gtggcagtgaaggtcatagcat

SEQ ID NO: 9298148 - DNA, 19 bp, Homo sapiens
gtggccagggcaggggctg

SEQ ID NO: 9298149 - DNA, 22 bp, Homo sapiens
gtggccaggcgtccgcgcggct

SEQ ID NO: 9298150 - DNA, 22 bp, Homo sapiens
gtggcagtcgctgacagataca

SEQ ID NO: 9298151 - DNA, 22 bp, Homo sapiens
gttccccttgtgttgttgccca

SEQ ID NO: 9298152 - DNA, 22 bp, Homo sapiens
gttggcagaaagctttcgatcg

SEQ ID NO: 9298153 - DNA, 22 bp, Homo sapiens
gttggcagagagaagcctagca

SEQ ID NO: 9298154 - DNA, 22 bp, Homo sapiens
gttgggaagcagatggatgagc

SEQ ID NO: 9298155 - DNA, 22 bp, Homo sapiens
gtttcctgaagttatttcatcc

SEQ ID NO: 9298156 - DNA, 22 bp, Homo sapiens
gtttcctgatgtgggagatctt

SEQ ID NO: 9298157 - DNA, 22 bp, Homo sapiens
gtttcctgcgtgtgccactcat

SEQ ID NO: 9298158 - DNA, 22 bp, Homo sapiens
gtttattgataaaagctggaca

SEQ ID NO: 9298159 - DNA, 22 bp, Homo sapiens
gtttattgataaaagctggaca

SEQ ID NO: 9298160 - DNA, 22 bp, Homo sapiens
gtttattgggtattgtggagcc

SEQ ID NO: 9298161 - DNA, 22 bp, Homo sapiens
gtttattgggtattgtggagcc

SEQ ID NO: 9298162 - DNA, 22 bp, Homo sapiens
gtttacatgtaatgtgttattg

SEQ ID NO: 9298163 - DNA, 22 bp, Homo sapiens
gtttacatgtactcattatact

SEQ ID NO: 9298164 - DNA, 22 bp, Homo sapiens
gtttacatgtttttctcttaca

SEQ ID NO: 9298165 - DNA, 22 bp, Homo sapiens
gtgttttatggagtcataacgt

SEQ ID NO: 9298166 - DNA, 22 bp, Homo sapiens
gttacaaatgtaaattctgggg

SEQ ID NO: 9298167 - DNA, 22 bp, Homo sapiens
gttacaaatgccaaagctgaga

SEQ ID NO: 9298168 - DNA, 22 bp, Homo sapiens
cagctgtggagggaggaaatgc

SEQ ID NO: 9298169 - DNA, 22 bp, Homo sapiens
cagctgtgggcctgacgtggca

SEQ ID NO: 9298170 - DNA, 22 bp, Homo sapiens
cagctgtgtaaacacatgtgta

SEQ ID NO: 9298171 - DNA, 22 bp, Homo sapiens
cagcttctaaagtgtgaagcca

SEQ ID NO: 9298172 - DNA, 22 bp, Homo sapiens
cagctgtgtatgagagcatgct

SEQ ID NO: 9298173 - DNA, 22 bp, Homo sapiens
gttcacagaaggccagatggta

SEQ ID NO: 9298174 - DNA, 22 bp, Homo sapiens
cagctttctaccttaggcagtg

SEQ ID NO: 9298175 - DNA, 22 bp, Homo sapiens
gttattagaagtgaaggattgt

SEQ ID NO: 9298176 - DNA, 21 bp, Homo sapiens
gttattgacctccaggctggc

SEQ ID NO: 9298177 - DNA, 22 bp, Homo sapiens
gttattgactctcttgtggctt

SEQ ID NO: 9298178 - DNA, 22 bp, Homo sapiens
gttattgacatgtattaagcac

SEQ ID NO: 9298179 - DNA, 22 bp, Homo sapiens
gttattgaggtggagtctcact

SEQ ID NO: 9298180 - DNA, 22 bp, Homo sapiens
gttattgagacatagagttatg

SEQ ID NO: 9298181 - DNA, 22 bp, Homo sapiens
cagcttctcagaaagctgaggt

SEQ ID NO: 9298182 - DNA, 22 bp, Homo sapiens
cagcttctaccatcaggaaatt

SEQ ID NO: 9298183 - DNA, 22 bp, Homo sapiens
cagcttctgagcaagccagggg

SEQ ID NO: 9298184 - DNA, 22 bp, Homo sapiens
cagcttctgagcaagccagggg

SEQ ID NO: 9298185 - DNA, 21 bp, Homo sapiens
cagcttctgaaggtgtaggaa

SEQ ID NO: 9298186 - DNA, 20 bp, Homo sapiens
cagcttggatgagaggctga

SEQ ID NO: 9298187 - DNA, 22 bp, Homo sapiens
cagcttggaggaggatctaaga

SEQ ID NO: 9298188 - DNA, 22 bp, Homo sapiens
cagcttgggtcaggtgcctgct

SEQ ID NO: 9298189 - DNA, 22 bp, Homo sapiens
cagcttggcttccgctttactg

SEQ ID NO: 9298190 - DNA, 22 bp, Homo sapiens
cagcttgggagtttggttttat

SEQ ID NO: 9298191 - DNA, 22 bp, Homo sapiens
cagcttggcgaatgtaggtatg

SEQ ID NO: 9298192 - DNA, 22 bp, Homo sapiens
ccactgccagctttgtcctccc

SEQ ID NO: 9298193 - DNA, 22 bp, Homo sapiens
ccactgccgatgttccatcttg

SEQ ID NO: 9298194 - DNA, 22 bp, Homo sapiens
ccagaagatggctcaaaccatg

SEQ ID NO: 9298195 - DNA, 16 bp, Homo sapiens
ccacctgcagctctca

SEQ ID NO: 9298196 - DNA, 22 bp, Homo sapiens
ccactgactccaggagctgagg

SEQ ID NO: 9298197 - DNA, 17 bp, Homo sapiens
ccactgactctgacttc

SEQ ID NO: 9298198 - DNA, 22 bp, Homo sapiens
tctcctgggaggacaaggaagg

SEQ ID NO: 9298199 - DNA, 22 bp, Homo sapiens
tctcccacagccgtgcttcaag

SEQ ID NO: 9298200 - DNA, 22 bp, Homo sapiens
ccagacagcagttaaaggacat

SEQ ID NO: 9298201 - DNA, 20 bp, Homo sapiens
ccagacagcacctgcctggt

SEQ ID NO: 9298202 - DNA, 22 bp, Homo sapiens
ccagacaggggctgttcctgct

SEQ ID NO: 9298203 - DNA, 22 bp, Homo sapiens
ccagacaggaacacacatctcc

SEQ ID NO: 9298204 - DNA, 18 bp, Homo sapiens
ccagagctggctcctcgc

SEQ ID NO: 9298205 - DNA, 19 bp, Homo sapiens
tctctctgtacattagata

SEQ ID NO: 9298206 - DNA, 22 bp, Homo sapiens
ccagatggtttgcatgggaggg

SEQ ID NO: 9298207 - DNA, 22 bp, Homo sapiens
ccagatggtatagtagggagag

SEQ ID NO: 9298208 - DNA, 22 bp, Homo sapiens
ccagatggtgcctgtcagaagg

SEQ ID NO: 9298209 - DNA, 22 bp, Homo sapiens
ccagatggtccagagtctagcc

SEQ ID NO: 9298210 - DNA, 22 bp, Homo sapiens
ccagatgggccaggggtttgtt

SEQ ID NO: 9298211 - DNA, 22 bp, Homo sapiens
ccagatgggctttagcaaatga

SEQ ID NO: 9298212 - DNA, 22 bp, Homo sapiens
ccagatgggttacttcaagcaa

SEQ ID NO: 9298213 - DNA, 19 bp, Homo sapiens
ccagatgagcagctgagat

SEQ ID NO: 9298214 - DNA, 22 bp, Homo sapiens
tctctacaaaaattagcatgca

SEQ ID NO: 9298215 - DNA, 21 bp, Homo sapiens
tctctacaaattatgttaggt

SEQ ID NO: 9298216 - DNA, 22 bp, Homo sapiens
tctctacacaggattcacatga

SEQ ID NO: 9298217 - DNA, 21 bp, Homo sapiens
tctctacactttcactaggct

SEQ ID NO: 9298218 - DNA, 19 bp, Homo sapiens
tctctacactacatttcta

SEQ ID NO: 9298219 - DNA, 21 bp, Homo sapiens
tctctacactttcactaggct

SEQ ID NO: 9298220 - DNA, 22 bp, Homo sapiens
tctctacagacactgttgactt

SEQ ID NO: 9298221 - DNA, 22 bp, Homo sapiens
tctctacagaatcttattattg

SEQ ID NO: 9298222 - DNA, 22 bp, Homo sapiens
tctctacagatcctatatagaa

SEQ ID NO: 9298223 - DNA, 22 bp, Homo sapiens
tctctacagattccatggggaa

SEQ ID NO: 9298224 - DNA, 18 bp, Homo sapiens
tctctaccagaagtgacg

SEQ ID NO: 9298225 - DNA, 22 bp, Homo sapiens
tctctacagcacccgcatgcta

SEQ ID NO: 9298226 - DNA, 22 bp, Homo sapiens
tctctacataacctcaatactc

SEQ ID NO: 9298227 - DNA, 19 bp, Homo sapiens
ccagaggactgttaatgaa

SEQ ID NO: 9298228 - DNA, 19 bp, Homo sapiens
ccacaaaattattttagtt

SEQ ID NO: 9298229 - DNA, 22 bp, Homo sapiens
ccacaaaactgtgtgtcaaaga

SEQ ID NO: 9298230 - DNA, 22 bp, Homo sapiens
ccacacagataagtgttttcta

SEQ ID NO: 9298231 - DNA, 22 bp, Homo sapiens
ccaaagtgctggggttacaggc

SEQ ID NO: 9298232 - DNA, 23 bp, Homo sapiens
tcctcccaaatttcagcctcatt

SEQ ID NO: 9298233 - DNA, 22 bp, Homo sapiens
tcctcccacataggacaatggg

SEQ ID NO: 9298234 - DNA, 20 bp, Homo sapiens
ccacagaggacagggctgtg

SEQ ID NO: 9298235 - DNA, 22 bp, Homo sapiens
catttattagttagttcgatgt

SEQ ID NO: 9298236 - DNA, 22 bp, Homo sapiens
catttagtcaaggacacgtggc

SEQ ID NO: 9298237 - DNA, 22 bp, Homo sapiens
catttagttttgcagtagcagg

SEQ ID NO: 9298238 - DNA, 17 bp, Homo sapiens
tccaggcagcaactgag

SEQ ID NO: 9298239 - DNA, 22 bp, Homo sapiens
ccaaagtgctaggattacaggc

SEQ ID NO: 9298240 - DNA, 22 bp, Homo sapiens
ccaaagtgctgggattacaggt

SEQ ID NO: 9298241 - DNA, 22 bp, Homo sapiens
ccaaagtgctgggattacaggc

SEQ ID NO: 9298242 - DNA, 22 bp, Homo sapiens
ccaaagtgctgagattacaggt

SEQ ID NO: 9298243 - DNA, 22 bp, Homo sapiens
ccaaagtgctaggattacaggt

SEQ ID NO: 9298244 - DNA, 23 bp, Homo sapiens
ccaaaagcgagtctgttgttccc

SEQ ID NO: 9298245 - DNA, 22 bp, Homo sapiens
ccaaaagcagctgtctgtgaat

SEQ ID NO: 9298246 - DNA, 21 bp, Homo sapiens
tccctgctttctggcccagtc

SEQ ID NO: 9298247 - DNA, 22 bp, Homo sapiens
tccctgctcagctcacctggca

SEQ ID NO: 9298248 - DNA, 22 bp, Homo sapiens
tccctgcctgacagcacccacc

SEQ ID NO: 9298249 - DNA, 22 bp, Homo sapiens
catttgctgtaatgacaataag

SEQ ID NO: 9298250 - DNA, 22 bp, Homo sapiens
ccagcctggagggcagtggtgg

SEQ ID NO: 9298251 - DNA, 22 bp, Homo sapiens
ccagccttctgagctgcctgga

SEQ ID NO: 9298252 - DNA, 22 bp, Homo sapiens
ccagctctcaaggctccctggg

SEQ ID NO: 9298253 - DNA, 22 bp, Homo sapiens
ccagctctagccccatgtggct

SEQ ID NO: 9298254 - DNA, 22 bp, Homo sapiens
tctcttggaacacttgctctta

SEQ ID NO: 9298255 - DNA, 22 bp, Homo sapiens
tctctcttgtcaccccatctgc

SEQ ID NO: 9298256 - DNA, 22 bp, Homo sapiens
tctgaaatatattttgagtgtt

SEQ ID NO: 9298257 - DNA, 22 bp, Homo sapiens
tctgaaataggcttcttttggt

SEQ ID NO: 9298258 - DNA, 22 bp, Homo sapiens
tctgaaataggagccatgtaga

SEQ ID NO: 9298259 - DNA, 22 bp, Homo sapiens
tctgaaatattggtaatacttt

SEQ ID NO: 9298260 - DNA, 22 bp, Homo sapiens
tctcttggtgatagtctttctt

SEQ ID NO: 9298261 - DNA, 22 bp, Homo sapiens
tctgaaataggaaagcaaatgg

SEQ ID NO: 9298262 - DNA, 22 bp, Homo sapiens
tctgaaatctgtaagcactagc

SEQ ID NO: 9298263 - DNA, 22 bp, Homo sapiens
tctgaaatcctttatcttggct

SEQ ID NO: 9298264 - DNA, 22 bp, Homo sapiens
tctgaaatctaatgctctgtgg

SEQ ID NO: 9298265 - DNA, 19 bp, Homo sapiens
ccagcccacagtgactttc

SEQ ID NO: 9298266 - DNA, 21 bp, Homo sapiens
ccagcccagctgtgtcccagc

SEQ ID NO: 9298267 - DNA, 22 bp, Homo sapiens
ccaggaggcagaagttgcagtg

SEQ ID NO: 9298268 - DNA, 22 bp, Homo sapiens
ccaggaggatggttgttaggtg

SEQ ID NO: 9298269 - DNA, 22 bp, Homo sapiens
ccaggaggcaatatcaagtcca

SEQ ID NO: 9298270 - DNA, 22 bp, Homo sapiens
ccaggaggatgattttaagagg

SEQ ID NO: 9298271 - DNA, 22 bp, Homo sapiens
ccagcttctccttatgtcctca

SEQ ID NO: 9298272 - DNA, 17 bp, Homo sapiens
tctgtctgtggtccact

SEQ ID NO: 9298273 - DNA, 22 bp, Homo sapiens
ccaggaggcggaaggtacagtg

SEQ ID NO: 9298274 - DNA, 22 bp, Homo sapiens
ccaggaggcagaggttgtagtg

SEQ ID NO: 9298275 - DNA, 22 bp, Homo sapiens
ccaggaggcagaggttacagtg

SEQ ID NO: 9298276 - DNA, 22 bp, Homo sapiens
ccagctgggattaagggaaaat

SEQ ID NO: 9298277 - DNA, 22 bp, Homo sapiens
ccagctggtaagtgatggagcc

SEQ ID NO: 9298278 - DNA, 22 bp, Homo sapiens
ccagctggggaagtggggcata

SEQ ID NO: 9298279 - DNA, 22 bp, Homo sapiens
ccagctgggtccctgctggggc

SEQ ID NO: 9298280 - DNA, 22 bp, Homo sapiens
ccagctggtctgtgctcatgtt

SEQ ID NO: 9298281 - DNA, 22 bp, Homo sapiens
ccagctggtgggtctttctctg

SEQ ID NO: 9298282 - DNA, 22 bp, Homo sapiens
ccagctggtgacatccccaacc

SEQ ID NO: 9298283 - DNA, 22 bp, Homo sapiens
ccagctggttaaaatagagaaa

SEQ ID NO: 9298284 - DNA, 22 bp, Homo sapiens
ccagctggtgttccttaggacc

SEQ ID NO: 9298285 - DNA, 22 bp, Homo sapiens
ccagcttcatgggcatgcacca

SEQ ID NO: 9298286 - DNA, 22 bp, Homo sapiens
ccagctggtttatattccccac

SEQ ID NO: 9298287 - DNA, 22 bp, Homo sapiens
tctggaggcaggctgccaggat

SEQ ID NO: 9298288 - DNA, 19 bp, Homo sapiens
tcatgtctctcatctgtga

SEQ ID NO: 9298289 - DNA, 22 bp, Homo sapiens
tcatgtcagtttcttctataaa

SEQ ID NO: 9298290 - DNA, 22 bp, Homo sapiens
tcatgtcccgttgctggctgcc

SEQ ID NO: 9298291 - DNA, 22 bp, Homo sapiens
tcatgtccctattactgtgacc

SEQ ID NO: 9298292 - DNA, 22 bp, Homo sapiens
tcatttcaatgatactactaag

SEQ ID NO: 9298293 - DNA, 22 bp, Homo sapiens
catgatctggtcctactgtggg

SEQ ID NO: 9298294 - DNA, 22 bp, Homo sapiens
catgatctggtcctactgtggg

SEQ ID NO: 9298295 - DNA, 22 bp, Homo sapiens
catgagtgtgccagtctgatat

SEQ ID NO: 9298296 - DNA, 22 bp, Homo sapiens
tcagtttataaattgtatttag

SEQ ID NO: 9298297 - DNA, 22 bp, Homo sapiens
tcaggtgggcagtgggttgagc

SEQ ID NO: 9298298 - DNA, 22 bp, Homo sapiens
tcaggtgggcgttccggtgcgg

SEQ ID NO: 9298299 - DNA, 22 bp, Homo sapiens
tcaggtgggagtagaatgctag

SEQ ID NO: 9298300 - DNA, 22 bp, Homo sapiens
tcaggtgggtctacaattagtt

SEQ ID NO: 9298301 - DNA, 22 bp, Homo sapiens
tcaggtgtaggttgttcagttt

SEQ ID NO: 9298302 - DNA, 22 bp, Homo sapiens
tcaggtggtcctaagtgccatc

SEQ ID NO: 9298303 - DNA, 22 bp, Homo sapiens
tcaggtgggtctacaattagtt

SEQ ID NO: 9298304 - DNA, 22 bp, Homo sapiens
tcaggtgggacctgctaggaca

SEQ ID NO: 9298305 - DNA, 22 bp, Homo sapiens
tcaggtggcttcggggagtggc

SEQ ID NO: 9298306 - DNA, 22 bp, Homo sapiens
tcaggtggcttggagggggacg

SEQ ID NO: 9298307 - DNA, 22 bp, Homo sapiens
tcaggtggctggttgctggcta

SEQ ID NO: 9298308 - DNA, 22 bp, Homo sapiens
tcagtttaagatgactaacaat

SEQ ID NO: 9298309 - DNA, 22 bp, Homo sapiens
tcagttgctagaagggggaacc

SEQ ID NO: 9298310 - DNA, 22 bp, Homo sapiens
catgtcttatgcggaactttca

SEQ ID NO: 9298311 - DNA, 22 bp, Homo sapiens
tccaggcaaaaaccaactacag

SEQ ID NO: 9298312 - DNA, 22 bp, Homo sapiens
tccaggcaagggaggagcatgg

SEQ ID NO: 9298313 - DNA, 22 bp, Homo sapiens
catgtcttaattggagcccaga

SEQ ID NO: 9298314 - DNA, 22 bp, Homo sapiens
catggccagccctgaggttcag

SEQ ID NO: 9298315 - DNA, 22 bp, Homo sapiens
tcattttgcctgccatttgagt

SEQ ID NO: 9298316 - DNA, 22 bp, Homo sapiens
tcagctgagctccagctcatag

SEQ ID NO: 9298317 - DNA, 22 bp, Homo sapiens
tcagctgaagtggagaagcaga

SEQ ID NO: 9298318 - DNA, 22 bp, Homo sapiens
tcagctgagttctagagcactc

SEQ ID NO: 9298319 - DNA, 22 bp, Homo sapiens
catacatttatacacatctatg

SEQ ID NO: 9298320 - DNA, 22 bp, Homo sapiens
catactttttagatctgccttc

SEQ ID NO: 9298321 - DNA, 22 bp, Homo sapiens
cagtttctctcatacatatttg

SEQ ID NO: 9298322 - DNA, 22 bp, Homo sapiens
cagtttcttctattttgaacta

SEQ ID NO: 9298323 - DNA, 22 bp, Homo sapiens
cagtttcttcatctgcagaatc

SEQ ID NO: 9298324 - DNA, 22 bp, Homo sapiens
cagtttcttcatcagttaagca

SEQ ID NO: 9298325 - DNA, 22 bp, Homo sapiens
cagtttcttcaattcagacact

SEQ ID NO: 9298326 - DNA, 22 bp, Homo sapiens
cagtttcttatcttcaaaattg

SEQ ID NO: 9298327 - DNA, 22 bp, Homo sapiens
cagtttctgttttaaatagcag

SEQ ID NO: 9298328 - DNA, 22 bp, Homo sapiens
cagtttcttaagactgagatct

SEQ ID NO: 9298329 - DNA, 22 bp, Homo sapiens
tcagggattgcaaaattcatcc

SEQ ID NO: 9298330 - DNA, 22 bp, Homo sapiens
tcagggcatggctgcacttggc

SEQ ID NO: 9298331 - DNA, 20 bp, Homo sapiens
tcagggcatgggacagcccc

SEQ ID NO: 9298332 - DNA, 22 bp, Homo sapiens
tcagggcattcaagaggcctgg

SEQ ID NO: 9298333 - DNA, 22 bp, Homo sapiens
tcagggcatgtatgtttcttta

SEQ ID NO: 9298334 - DNA, 22 bp, Homo sapiens
catcacagaaataaacatacct

SEQ ID NO: 9298335 - DNA, 23 bp, Homo sapiens
catccaggagctgagtctgactg

SEQ ID NO: 9298336 - DNA, 22 bp, Homo sapiens
catccaggctgaagtgcagtgg

SEQ ID NO: 9298337 - DNA, 22 bp, Homo sapiens
catccagagtccaaggctgggc

SEQ ID NO: 9298338 - DNA, 22 bp, Homo sapiens
catcacaggtcctgatgacatt

SEQ ID NO: 9298339 - DNA, 22 bp, Homo sapiens
catatacacttccacctctgtg

SEQ ID NO: 9298340 - DNA, 22 bp, Homo sapiens
catatacacttccacctctgtg

SEQ ID NO: 9298341 - DNA, 22 bp, Homo sapiens
catataatgtttgaagatgtgg

SEQ ID NO: 9298342 - DNA, 22 bp, Homo sapiens
tcaggaagtgcctaggctggcc

SEQ ID NO: 9298343 - DNA, 22 bp, Homo sapiens
catatcttctgacatgatcagg

SEQ ID NO: 9298344 - DNA, 22 bp, Homo sapiens
catatcttctgacatgatcagg

SEQ ID NO: 9298345 - DNA, 22 bp, Homo sapiens
catatactgcatacatatgtgt

SEQ ID NO: 9298346 - DNA, 22 bp, Homo sapiens
catatactgcatacatatgtgt

SEQ ID NO: 9298347 - DNA, 22 bp, Homo sapiens
catatacttttctatagctttc

SEQ ID NO: 9298348 - DNA, 22 bp, Homo sapiens
tacatgtgttctgtttcaagtt

SEQ ID NO: 9298349 - DNA, 22 bp, Homo sapiens
tacatgtggtagggagggcagt

SEQ ID NO: 9298350 - DNA, 22 bp, Homo sapiens
tacatgtgggttaaaaacactc

SEQ ID NO: 9298351 - DNA, 17 bp, Homo sapiens
tacatgtgtatctgatt

SEQ ID NO: 9298352 - DNA, 22 bp, Homo sapiens
tataatgttttccatggactga

SEQ ID NO: 9298353 - DNA, 22 bp, Homo sapiens
tataatctggttttattaagag

SEQ ID NO: 9298354 - DNA, 22 bp, Homo sapiens
tatctatgtgctctgacctctc

SEQ ID NO: 9298355 - DNA, 22 bp, Homo sapiens
tatacagtcttttgctatattc

SEQ ID NO: 9298356 - DNA, 22 bp, Homo sapiens
cagggtggcacatcacagcatt

SEQ ID NO: 9298357 - DNA, 22 bp, Homo sapiens
tatgtgtcaaaccattcatctg

SEQ ID NO: 9298358 - DNA, 22 bp, Homo sapiens
tatgtgtcctaagcaatcatcc

SEQ ID NO: 9298359 - DNA, 22 bp, Homo sapiens
tatgtgtcccttggtgtagcaa

SEQ ID NO: 9298360 - DNA, 22 bp, Homo sapiens
tatgtgtccctgctactcaaca

SEQ ID NO: 9298361 - DNA, 22 bp, Homo sapiens
tatctcattttattgcaaatgt

SEQ ID NO: 9298362 - DNA, 22 bp, Homo sapiens
tatggcaagatgacatgttctc

SEQ ID NO: 9298363 - DNA, 22 bp, Homo sapiens
tatggcaaaactctttatccaa

SEQ ID NO: 9298364 - DNA, 22 bp, Homo sapiens
tatggcaagagaatcaactgaa

SEQ ID NO: 9298365 - DNA, 22 bp, Homo sapiens
tatggcaatatgtatcaagatc

SEQ ID NO: 9298366 - DNA, 22 bp, Homo sapiens
tatggcaattgtctaagtttta

SEQ ID NO: 9298367 - DNA, 22 bp, Homo sapiens
caggtgaacccagtctaatcat

SEQ ID NO: 9298368 - DNA, 22 bp, Homo sapiens
tatggctaattctttactgacc

SEQ ID NO: 9298369 - DNA, 22 bp, Homo sapiens
tatggctaattctttactgacc

SEQ ID NO: 9298370 - DNA, 22 bp, Homo sapiens
tatggctactacgaataatgct

SEQ ID NO: 9298371 - DNA, 22 bp, Homo sapiens
tcagaagctggtgtcctttgaa

SEQ ID NO: 9298372 - DNA, 22 bp, Homo sapiens
tcactccatagcttaactcttt

SEQ ID NO: 9298373 - DNA, 22 bp, Homo sapiens
tcactcagtttttggcctctgc

SEQ ID NO: 9298374 - DNA, 22 bp, Homo sapiens
tatttagaatgcgtgtacgtgt

SEQ ID NO: 9298375 - DNA, 22 bp, Homo sapiens
tattggagaggtcttgggtaga

SEQ ID NO: 9298376 - DNA, 22 bp, Homo sapiens
tattggaggaaaccaagaagaa

SEQ ID NO: 9298377 - DNA, 22 bp, Homo sapiens
tattggagtactgcgagctgcc

SEQ ID NO: 9298378 - DNA, 22 bp, Homo sapiens
tattggagttggtaagaagtca

SEQ ID NO: 9298379 - DNA, 22 bp, Homo sapiens
cagtgagtaagtagacagctta

SEQ ID NO: 9298380 - DNA, 22 bp, Homo sapiens
cagtgagttgtgctgaggacca

SEQ ID NO: 9298381 - DNA, 22 bp, Homo sapiens
tctttacaatctaagcatagtt

SEQ ID NO: 9298382 - DNA, 22 bp, Homo sapiens
tctttaatgtgattgtaattat

SEQ ID NO: 9298383 - DNA, 22 bp, Homo sapiens
tctttaattgtggaagagcagc

SEQ ID NO: 9298384 - DNA, 22 bp, Homo sapiens
tctttaattgtggaagagcagc

SEQ ID NO: 9298385 - DNA, 22 bp, Homo sapiens
tctttaattcagcatgatgcgg

SEQ ID NO: 9298386 - DNA, 22 bp, Homo sapiens
tctttacatcacaattgtatgg

SEQ ID NO: 9298387 - DNA, 22 bp, Homo sapiens
tcttggctgtaccattgactag

SEQ ID NO: 9298388 - DNA, 22 bp, Homo sapiens
tcttgggatagtgtctcatggc

SEQ ID NO: 9298389 - DNA, 22 bp, Homo sapiens
tcttgggcatgtgtttgatttc

SEQ ID NO: 9298390 - DNA, 22 bp, Homo sapiens
tcttgctgttacagaattaaca

SEQ ID NO: 9298391 - DNA, 22 bp, Homo sapiens
tctttcttaaataggtggattg

SEQ ID NO: 9298392 - DNA, 22 bp, Homo sapiens
tctttcggccatagcgatgatt

SEQ ID NO: 9298393 - DNA, 22 bp, Homo sapiens
tctttcctaggtgatatgcaat

SEQ ID NO: 9298394 - DNA, 22 bp, Homo sapiens
tctttattgctactggtttgtc

SEQ ID NO: 9298395 - DNA, 22 bp, Homo sapiens
tctttatttaagtctgttgtaa

SEQ ID NO: 9298396 - DNA, 22 bp, Homo sapiens
tctttatttaagtctgttgtaa

SEQ ID NO: 9298397 - DNA, 19 bp, Homo sapiens
tctttcatttctagctctg

SEQ ID NO: 9298398 - DNA, 22 bp, Homo sapiens
tctttccaaggactctgtagca

SEQ ID NO: 9298399 - DNA, 22 bp, Homo sapiens
tctttatgagaaaaagattgta

SEQ ID NO: 9298400 - DNA, 21 bp, Homo sapiens
tctttatgacttgcccatttg

SEQ ID NO: 9298401 - DNA, 22 bp, Homo sapiens
tctttatggaaaatgaatggca

SEQ ID NO: 9298402 - DNA, 22 bp, Homo sapiens
tctttatgtaagactgggcttg

SEQ ID NO: 9298403 - DNA, 22 bp, Homo sapiens
tctttatgcacataaagaaact

SEQ ID NO: 9298404 - DNA, 22 bp, Homo sapiens
tctttatgcctacctgggaaga

SEQ ID NO: 9298405 - DNA, 22 bp, Homo sapiens
tctttattgctactggtttgtc

SEQ ID NO: 9298406 - DNA, 22 bp, Homo sapiens
tctttatgttgatttcctcagg

SEQ ID NO: 9298407 - DNA, 22 bp, Homo sapiens
tctttatgtttactccagctga

SEQ ID NO: 9298408 - DNA, 22 bp, Homo sapiens
tctttatgtttgaaagtacaat

SEQ ID NO: 9298409 - DNA, 18 bp, Homo sapiens
tcttccagcttctggagg

SEQ ID NO: 9298410 - DNA, 22 bp, Homo sapiens
tcttctatcctcagcccctgcc

SEQ ID NO: 9298411 - DNA, 22 bp, Homo sapiens
tcttctgttttagattgcatac

SEQ ID NO: 9298412 - DNA, 22 bp, Homo sapiens
tcttcttcctcatttatacata

SEQ ID NO: 9298413 - DNA, 22 bp, Homo sapiens
tcttcttcctccacagggccca

SEQ ID NO: 9298414 - DNA, 22 bp, Homo sapiens
tcttctttatgtcatatgccag

SEQ ID NO: 9298415 - DNA, 21 bp, Homo sapiens
tcttgaaaattgtagcagttt

SEQ ID NO: 9298416 - DNA, 22 bp, Homo sapiens
tcttgaaagcatgagatggaca

SEQ ID NO: 9298417 - DNA, 22 bp, Homo sapiens
tcttctttttgtcccacagaat

SEQ ID NO: 9298418 - DNA, 22 bp, Homo sapiens
tcttctccagttcatcctacca

SEQ ID NO: 9298419 - DNA, 22 bp, Homo sapiens
tcttcacaccgggcagcaggaa

SEQ ID NO: 9298420 - DNA, 22 bp, Homo sapiens
tcttattttttaatgacagaga

SEQ ID NO: 9298421 - DNA, 22 bp, Homo sapiens
tcttattgtgatgatgaagaac

SEQ ID NO: 9298422 - DNA, 22 bp, Homo sapiens
tcttattggataaaaggaaacc

SEQ ID NO: 9298423 - DNA, 20 bp, Homo sapiens
tcttattgtcttgaggagtt

SEQ ID NO: 9298424 - DNA, 22 bp, Homo sapiens
tcttccagaatgcattctcttt

SEQ ID NO: 9298425 - DNA, 22 bp, Homo sapiens
tcttccagatacttcctgactt

SEQ ID NO: 9298426 - DNA, 22 bp, Homo sapiens
tcttcatactcatcacataggt

SEQ ID NO: 9298427 - DNA, 22 bp, Homo sapiens
tctgtgtgaccataagccagct

SEQ ID NO: 9298428 - DNA, 22 bp, Homo sapiens
tctgtttcttggctagcctctt

SEQ ID NO: 9298429 - DNA, 17 bp, Homo sapiens
tctgtttctcctttctt

SEQ ID NO: 9298430 - DNA, 22 bp, Homo sapiens
tctgtgagtactttaacgagag

SEQ ID NO: 9298431 - DNA, 22 bp, Homo sapiens
tctgtctcaagttcttgcactc

SEQ ID NO: 9298432 - DNA, 22 bp, Homo sapiens
tctgtcctctttgaagctgctc

SEQ ID NO: 9298433 - DNA, 18 bp, Homo sapiens
tctgtctctgtccttgct

SEQ ID NO: 9298434 - DNA, 22 bp, Homo sapiens
tctgtccctgagagctcaggag

SEQ ID NO: 9298435 - DNA, 22 bp, Homo sapiens
tctgtacatttgtgttgtgaat

SEQ ID NO: 9298436 - DNA, 22 bp, Homo sapiens
tctgtagtaggttgtagttctt

SEQ ID NO: 9298437 - DNA, 22 bp, Homo sapiens
tctgtatcgtaatcatgtctgg

SEQ ID NO: 9298438 - DNA, 22 bp, Homo sapiens
tctgtaatcccagctactcagg

SEQ ID NO: 9298439 - DNA, 18 bp, Homo sapiens
tctgtaatttttccttga

SEQ ID NO: 9298440 - DNA, 22 bp, Homo sapiens
tctgtacagtaccagatagtaa

SEQ ID NO: 9298441 - DNA, 21 bp, Homo sapiens
tctgtacatcattgagtcccc

SEQ ID NO: 9298442 - DNA, 22 bp, Homo sapiens
tctgggtgtcactcctgcctgc

SEQ ID NO: 9298443 - DNA, 22 bp, Homo sapiens
tctgggtgtggtatcttagcca

SEQ ID NO: 9298444 - DNA, 22 bp, Homo sapiens
tctggggtgcagcctggacata

SEQ ID NO: 9298445 - DNA, 22 bp, Homo sapiens
tctggggtggagccctggagtc

SEQ ID NO: 9298446 - DNA, 22 bp, Homo sapiens
tctggggtgtgacctgagcatg

SEQ ID NO: 9298447 - DNA, 19 bp, Homo sapiens
tctggggtgtggcctggca

SEQ ID NO: 9298448 - DNA, 18 bp, Homo sapiens
tctggggtgtgctgtgta

SEQ ID NO: 9298449 - DNA, 20 bp, Homo sapiens
tctggggtgaagcccaggaa

SEQ ID NO: 9298450 - DNA, 22 bp, Homo sapiens
tctggggtgcagcctaggcatc

SEQ ID NO: 9298451 - DNA, 22 bp, Homo sapiens
tctggggtgaggcctggttatc

SEQ ID NO: 9298452 - DNA, 22 bp, Homo sapiens
tctgggggttaagtgaggacaa

SEQ ID NO: 9298453 - DNA, 22 bp, Homo sapiens
tctggggtcacctggggtgctt

SEQ ID NO: 9298454 - DNA, 22 bp, Homo sapiens
tctggggttaagcccaggaatg

SEQ ID NO: 9298455 - DNA, 22 bp, Homo sapiens
tctggggttgagtctgggtcag

SEQ ID NO: 9298456 - DNA, 22 bp, Homo sapiens
tctggggttttcacgctgtctc

SEQ ID NO: 9298457 - DNA, 22 bp, Homo sapiens
tctggggttggtgcttacacca

SEQ ID NO: 9298458 - DNA, 22 bp, Homo sapiens
tctggggtttgtggttcttctg

SEQ ID NO: 9298459 - DNA, 22 bp, Homo sapiens
tctgcccattcttagagtctag

SEQ ID NO: 9298460 - DNA, 20 bp, Homo sapiens
tctgcactcctgcatgtgcc

SEQ ID NO: 9298461 - DNA, 18 bp, Homo sapiens
tctgcactcctgagagag

SEQ ID NO: 9298462 - DNA, 22 bp, Homo sapiens
tctgcagctttttggtggggtg

SEQ ID NO: 9298463 - DNA, 22 bp, Homo sapiens
tctgccagtttatagacaagcc

SEQ ID NO: 9298464 - DNA, 22 bp, Homo sapiens
tctgaggaaaagaggaggtagc

SEQ ID NO: 9298465 - DNA, 22 bp, Homo sapiens
tctgaggctgcatctatgtgac

SEQ ID NO: 9298466 - DNA, 22 bp, Homo sapiens
tctggagaggggcctagaattt

SEQ ID NO: 9298467 - DNA, 22 bp, Homo sapiens
tctggagataagacagacagat

SEQ ID NO: 9298468 - DNA, 22 bp, Homo sapiens
tctggagaaagttgagtttgtg

SEQ ID NO: 9298469 - DNA, 22 bp, Homo sapiens
tctggagaacttgcaagaggat

SEQ ID NO: 9298470 - DNA, 22 bp, Homo sapiens
tctggagaagcagtgagagtca

SEQ ID NO: 9298471 - DNA, 22 bp, Homo sapiens
tctggagaagcccagggagctg

SEQ ID NO: 9298472 - DNA, 22 bp, Homo sapiens
tctggacaggggcgctttgggg

SEQ ID NO: 9298473 - DNA, 22 bp, Homo sapiens
tctgctggtcaaggctgggtcc

SEQ ID NO: 9298474 - DNA, 22 bp, Homo sapiens
tctgctggaaaaccagggaatt

SEQ ID NO: 9298475 - DNA, 22 bp, Homo sapiens
tctgctctgtggcttcagctaa

SEQ ID NO: 9298476 - DNA, 22 bp, Homo sapiens
tctgctctgtactgcactggcc

SEQ ID NO: 9298477 - DNA, 22 bp, Homo sapiens
tctgctctgtactgcactggcc

SEQ ID NO: 9298478 - DNA, 17 bp, Homo sapiens
tctgctctgccaatcca

SEQ ID NO: 9298479 - DNA, 22 bp, Homo sapiens
tctgctctgagagggccatcag

SEQ ID NO: 9298480 - DNA, 22 bp, Homo sapiens
tctgctctagttgcttcctgcc

SEQ ID NO: 9298481 - DNA, 22 bp, Homo sapiens
tctgctctagttgcttcctgcc

SEQ ID NO: 9298482 - DNA, 22 bp, Homo sapiens
tctggcacttgccagtttctat

SEQ ID NO: 9298483 - DNA, 22 bp, Homo sapiens
tctggcaccactgagtctgcag

SEQ ID NO: 9298484 - DNA, 22 bp, Homo sapiens
tctggcagaaggcagaaattca

SEQ ID NO: 9298485 - DNA, 22 bp, Homo sapiens
tctggcagaagtgctgtcagta

SEQ ID NO: 9298486 - DNA, 22 bp, Homo sapiens
tctggcagagatatccatccca

SEQ ID NO: 9298487 - DNA, 22 bp, Homo sapiens
tctggcagaggaaggaggcctg

SEQ ID NO: 9298488 - DNA, 22 bp, Homo sapiens
tctggcagagtcagtgcacaca

SEQ ID NO: 9298489 - DNA, 22 bp, Homo sapiens
tctggcaggtcaatcattcttt

SEQ ID NO: 9298490 - DNA, 22 bp, Homo sapiens
tctggcagggtgtgtatttaca

SEQ ID NO: 9298491 - DNA, 19 bp, Homo sapiens
tctggcaggtaattaggga

SEQ ID NO: 9298492 - DNA, 22 bp, Homo sapiens
tctggcagatcttcccacgttt

SEQ ID NO: 9298493 - DNA, 22 bp, Homo sapiens
tctggcagagtgataggataag

SEQ ID NO: 9298494 - DNA, 22 bp, Homo sapiens
tctggcagcaagataacaatgg

SEQ ID NO: 9298495 - DNA, 22 bp, Homo sapiens
tctggcagggtcagggcccagg

SEQ ID NO: 9298496 - DNA, 22 bp, Homo sapiens
tctggcagtaataggggagaga

SEQ ID NO: 9298497 - DNA, 22 bp, Homo sapiens
tctggcagtgagcaacttgaca

SEQ ID NO: 9298498 - DNA, 22 bp, Homo sapiens
tctggcagtgaagtcatgaggt

SEQ ID NO: 9298499 - DNA, 20 bp, Homo sapiens
tctggcaggtgaacgagctg

SEQ ID NO: 9298500 - DNA, 22 bp, Homo sapiens
tctggcaggttcccatgttatg

SEQ ID NO: 9298501 - DNA, 22 bp, Homo sapiens
tctggcagtttgagaaaggcta

SEQ ID NO: 9298502 - DNA, 22 bp, Homo sapiens
tctggcagtgatttctgtgatc

SEQ ID NO: 9298503 - DNA, 22 bp, Homo sapiens
tctggcagtggatgagggcagc

SEQ ID NO: 9298504 - DNA, 22 bp, Homo sapiens
tctggcagttgccgcttcagtc

SEQ ID NO: 9298505 - DNA, 22 bp, Homo sapiens
tctggcagttccttgttgatat

SEQ ID NO: 9298506 - DNA, 21 bp, Homo sapiens
tctggcagtggtctttcaaat

SEQ ID NO: 9298507 - DNA, 22 bp, Homo sapiens
tctggagttcctgcaggctgtg

SEQ ID NO: 9298508 - DNA, 22 bp, Homo sapiens
tctggagggcccacatccacaa

SEQ ID NO: 9298509 - DNA, 22 bp, Homo sapiens
tctggagccacaaacctcagct

SEQ ID NO: 9298510 - DNA, 22 bp, Homo sapiens
tctggagatcatgtggggtgga

SEQ ID NO: 9298511 - DNA, 22 bp, Homo sapiens
tctgggaactatatctggtggt

SEQ ID NO: 9298512 - DNA, 22 bp, Homo sapiens
tctgggaaatggctacttgtca

SEQ ID NO: 9298513 - DNA, 22 bp, Homo sapiens
tctgggaacactttgtgagctc

SEQ ID NO: 9298514 - DNA, 22 bp, Homo sapiens
tctgggaacagcctggctgtgt

SEQ ID NO: 9298515 - DNA, 22 bp, Homo sapiens
tctggctgaattagccttgggt

SEQ ID NO: 9298516 - DNA, 22 bp, Homo sapiens
tctgggaggtactgggaggtgt

SEQ ID NO: 9298517 - DNA, 22 bp, Homo sapiens
tctgggagagtcacaggcattg

SEQ ID NO: 9298518 - DNA, 22 bp, Homo sapiens
tctgggagagtagataaaggaa

SEQ ID NO: 9298519 - DNA, 22 bp, Homo sapiens
tctgggagttagaatacatggg

SEQ ID NO: 9298520 - DNA, 22 bp, Homo sapiens
tctgggagtgggtccaaggaat

SEQ ID NO: 9298521 - DNA, 22 bp, Homo sapiens
tctgggagtgaagcaacagatg

SEQ ID NO: 9298522 - DNA, 21 bp, Homo sapiens
tctgggagtgggaaaatggtc

SEQ ID NO: 9298523 - DNA, 22 bp, Homo sapiens
tctgggaatgaggcttgggcaa

SEQ ID NO: 9298524 - DNA, 21 bp, Homo sapiens
tctgggacagggcctgaggag

SEQ ID NO: 9298525 - DNA, 22 bp, Homo sapiens
tctgggagagggaaagaagact

SEQ ID NO: 9298526 - DNA, 22 bp, Homo sapiens
tctgggcaatggatgcactcac

SEQ ID NO: 9298527 - DNA, 21 bp, Homo sapiens
tctgggcagcccagtcctgag

SEQ ID NO: 9298528 - DNA, 22 bp, Homo sapiens
tctgggcagcagcagctagtag

SEQ ID NO: 9298529 - DNA, 22 bp, Homo sapiens
tccttcaggcctcattctcata

SEQ ID NO: 9298530 - DNA, 22 bp, Homo sapiens
tccttcagctactcagtttcca

SEQ ID NO: 9298531 - DNA, 22 bp, Homo sapiens
tccttcagcttatttcttagga

SEQ ID NO: 9298532 - DNA, 22 bp, Homo sapiens
tccttcagctctctatttagat

SEQ ID NO: 9298533 - DNA, 20 bp, Homo sapiens
tccttcagactttggagttg

SEQ ID NO: 9298534 - DNA, 22 bp, Homo sapiens
tccttcagaaaacctcagtctt

SEQ ID NO: 9298535 - DNA, 22 bp, Homo sapiens
tccttctacactgcctctgaga

SEQ ID NO: 9298536 - DNA, 23 bp, Homo sapiens
tccttcctttgagaggctccatc

SEQ ID NO: 9298537 - DNA, 22 bp, Homo sapiens
tccttctcctccttgagtgaca

SEQ ID NO: 9298538 - DNA, 21 bp, Homo sapiens
tccttgctattttcctcagct

SEQ ID NO: 9298539 - DNA, 22 bp, Homo sapiens
tcctttttaagtcgttgtggta

SEQ ID NO: 9298540 - DNA, 22 bp, Homo sapiens
tcctttttatagttagagaaac

SEQ ID NO: 9298541 - DNA, 22 bp, Homo sapiens
tcctttttggtccaaggtgacc

SEQ ID NO: 9298542 - DNA, 22 bp, Homo sapiens
tcgcaccattgcactccagcca

SEQ ID NO: 9298543 - DNA, 22 bp, Homo sapiens
tcgaatggcaaggaaagaggct

SEQ ID NO: 9298544 - DNA, 22 bp, Homo sapiens
tcgtggatgcgcagggcggcct

SEQ ID NO: 9298545 - DNA, 22 bp, Homo sapiens
tcgtggatcaccgcgtctgtgt

SEQ ID NO: 9298546 - DNA, 22 bp, Homo sapiens
tcgcatttgttaaagcatgttg

SEQ ID NO: 9298547 - DNA, 22 bp, Homo sapiens
tcgtctgtgaaattgggataag

SEQ ID NO: 9298548 - DNA, 22 bp, Homo sapiens
tcgcccaggctggaagtgcagt

SEQ ID NO: 9298549 - DNA, 22 bp, Homo sapiens
tctaaagacactttttacaggg

SEQ ID NO: 9298550 - DNA, 22 bp, Homo sapiens
tctaccagggtcacagaggccc

SEQ ID NO: 9298551 - DNA, 22 bp, Homo sapiens
tctaccagggtcacagaggccc

SEQ ID NO: 9298552 - DNA, 22 bp, Homo sapiens
tctagaggccagggacactgct

SEQ ID NO: 9298553 - DNA, 22 bp, Homo sapiens
tctagcagagggaagaggcttt

SEQ ID NO: 9298554 - DNA, 22 bp, Homo sapiens
tctagcaggcaaaagctcggca

SEQ ID NO: 9298555 - DNA, 22 bp, Homo sapiens
tctagcaggtggcggccagcga

SEQ ID NO: 9298556 - DNA, 22 bp, Homo sapiens
tctagctctgcttatcatggct

SEQ ID NO: 9298557 - DNA, 20 bp, Homo sapiens
tctaggcaggcaggctcgtg

SEQ ID NO: 9298558 - DNA, 22 bp, Homo sapiens
tctaggagcatgaagggaaggc

SEQ ID NO: 9298559 - DNA, 17 bp, Homo sapiens
tctaggagagcagagct

SEQ ID NO: 9298560 - DNA, 22 bp, Homo sapiens
tctaggagaaccatcagggagg

SEQ ID NO: 9298561 - DNA, 22 bp, Homo sapiens
tctaattgcaattctcagagat

SEQ ID NO: 9298562 - DNA, 22 bp, Homo sapiens
tctacagctctggagcttttgg

SEQ ID NO: 9298563 - DNA, 22 bp, Homo sapiens
tctacagccattttgagcagtg

SEQ ID NO: 9298564 - DNA, 22 bp, Homo sapiens
tctacagctgaacagtgtctca

SEQ ID NO: 9298565 - DNA, 22 bp, Homo sapiens
tctacagctgctgcttctcatg

SEQ ID NO: 9298566 - DNA, 22 bp, Homo sapiens
tctagggggacagctggctgtg

SEQ ID NO: 9298567 - DNA, 22 bp, Homo sapiens
tctcacagcagagaagggacat

SEQ ID NO: 9298568 - DNA, 22 bp, Homo sapiens
tctcacagaggcttgggctcat

SEQ ID NO: 9298569 - DNA, 22 bp, Homo sapiens
tcctggcttgtcacatctacgt

SEQ ID NO: 9298570 - DNA, 22 bp, Homo sapiens
tcctggcttctgtctccttatt

SEQ ID NO: 9298571 - DNA, 21 bp, Homo sapiens
tcctggctttatgctacctct

SEQ ID NO: 9298572 - DNA, 22 bp, Homo sapiens
tcctggcttttcttggctcatc

SEQ ID NO: 9298573 - DNA, 22 bp, Homo sapiens
tcctggctgccgtcgtcctgcg

SEQ ID NO: 9298574 - DNA, 22 bp, Homo sapiens
tcctggctgtcactcgggttga

SEQ ID NO: 9298575 - DNA, 22 bp, Homo sapiens
tcctggctggaatttctcactc

SEQ ID NO: 9298576 - DNA, 22 bp, Homo sapiens
tcctggctgcaccagtgaccct

SEQ ID NO: 9298577 - DNA, 22 bp, Homo sapiens
tcctggctcttctgagttttct

SEQ ID NO: 9298578 - DNA, 22 bp, Homo sapiens
tcctggctgagttcccaagtcg

SEQ ID NO: 9298579 - DNA, 22 bp, Homo sapiens
tcctggcttccacacctgtcat

SEQ ID NO: 9298580 - DNA, 22 bp, Homo sapiens
tcctggcttcctgctcttgtca

SEQ ID NO: 9298581 - DNA, 22 bp, Homo sapiens
tcctggcttccactcctctgtt

SEQ ID NO: 9298582 - DNA, 22 bp, Homo sapiens
tcctgtgccatctctagagact

SEQ ID NO: 9298583 - DNA, 22 bp, Homo sapiens
tcctgtctgctcacagagctgg

SEQ ID NO: 9298584 - DNA, 22 bp, Homo sapiens
tcctgtggggaaaagcctatct

SEQ ID NO: 9298585 - DNA, 21 bp, Homo sapiens
tcctgtaagcttgggtggctc

SEQ ID NO: 9298586 - DNA, 21 bp, Homo sapiens
tcctgtaagcttgggtggctc

SEQ ID NO: 9298587 - DNA, 22 bp, Homo sapiens
tcctgtcctgaggctccaggcc

SEQ ID NO: 9298588 - DNA, 17 bp, Homo sapiens
tcctggctctgccactg

SEQ ID NO: 9298589 - DNA, 22 bp, Homo sapiens
tcctggctctgctgcctcctag

SEQ ID NO: 9298590 - DNA, 17 bp, Homo sapiens
tcctggctctgccactg

SEQ ID NO: 9298591 - DNA, 23 bp, Homo sapiens
tcctggctctgcacttgctaatg

SEQ ID NO: 9298592 - DNA, 22 bp, Homo sapiens
tcctggctctaagtcctgagtg

SEQ ID NO: 9298593 - DNA, 22 bp, Homo sapiens
tcctggctcctgatctgtcact

SEQ ID NO: 9298594 - DNA, 19 bp, Homo sapiens
tcctggcatttgtaggaaa

SEQ ID NO: 9298595 - DNA, 22 bp, Homo sapiens
tcctggcattgtgcagggtgtg

SEQ ID NO: 9298596 - DNA, 22 bp, Homo sapiens
tcctggcatccgtgggtctgtg

SEQ ID NO: 9298597 - DNA, 18 bp, Homo sapiens
tcctggcagtcagagagg

SEQ ID NO: 9298598 - DNA, 22 bp, Homo sapiens
tcctggcagtgcttgttttgga

SEQ ID NO: 9298599 - DNA, 22 bp, Homo sapiens
tcctggagttgtgcagtgcaca

SEQ ID NO: 9298600 - DNA, 19 bp, Homo sapiens
tcctggcacagtggaacca

SEQ ID NO: 9298601 - DNA, 22 bp, Homo sapiens
tcctggcaaagatgttggtgtt

SEQ ID NO: 9298602 - DNA, 22 bp, Homo sapiens
tcctggagaaactcagagatct

SEQ ID NO: 9298603 - DNA, 22 bp, Homo sapiens
tcctggagaatggacaatgcac

SEQ ID NO: 9298604 - DNA, 22 bp, Homo sapiens
tcctggagggctcacaggcggc

SEQ ID NO: 9298605 - DNA, 22 bp, Homo sapiens
tcctggaggggacagcatgggc

SEQ ID NO: 9298606 - DNA, 22 bp, Homo sapiens
tcctggaggcaaatgaagactc

SEQ ID NO: 9298607 - DNA, 22 bp, Homo sapiens
taagaatattgggaatggatgg

SEQ ID NO: 9298608 - DNA, 22 bp, Homo sapiens
taagaacattttcggaaagata

SEQ ID NO: 9298609 - DNA, 22 bp, Homo sapiens
taagaacagtagaacagtaggt

SEQ ID NO: 9298610 - DNA, 22 bp, Homo sapiens
tctcagaaaaaggagaaactgg

SEQ ID NO: 9298611 - DNA, 22 bp, Homo sapiens
tctcagagcttcagaaagcacc

SEQ ID NO: 9298612 - DNA, 19 bp, Homo sapiens
tctcagagccctagaggcc

SEQ ID NO: 9298613 - DNA, 22 bp, Homo sapiens
tctcagctcagcttccacagag

SEQ ID NO: 9298614 - DNA, 22 bp, Homo sapiens
tctcagctcagcttccacagag

SEQ ID NO: 9298615 - DNA, 22 bp, Homo sapiens
tctcagagtttgaatctggagt

SEQ ID NO: 9298616 - DNA, 22 bp, Homo sapiens
tctcagagggaaacatgagtga

SEQ ID NO: 9298617 - DNA, 22 bp, Homo sapiens
tctcagagttcctctggagtcc

SEQ ID NO: 9298618 - DNA, 22 bp, Homo sapiens
tctcagagtgacaatgagaatt

SEQ ID NO: 9298619 - DNA, 23 bp, Homo sapiens
tctcagtgcacgcaccatgcctg

SEQ ID NO: 9298620 - DNA, 22 bp, Homo sapiens
tctcataattaggtaagtcaga

SEQ ID NO: 9298621 - DNA, 22 bp, Homo sapiens
tctcatctcaaattgtaatccc

SEQ ID NO: 9298622 - DNA, 22 bp, Homo sapiens
tctcatctagactctgcccttg

SEQ ID NO: 9298623 - DNA, 22 bp, Homo sapiens
tctcatctagactctgcccttg

SEQ ID NO: 9298624 - DNA, 21 bp, Homo sapiens
tctcatctcctgacctgtgcc

SEQ ID NO: 9298625 - DNA, 22 bp, Homo sapiens
tctcatctgcgagctctgccag

SEQ ID NO: 9298626 - DNA, 22 bp, Homo sapiens
tctcatcttcattgtctcccat

SEQ ID NO: 9298627 - DNA, 23 bp, Homo sapiens
tctcatttcccttgatctatctt

SEQ ID NO: 9298628 - DNA, 22 bp, Homo sapiens
tctcattcataccctacatgct

SEQ ID NO: 9298629 - DNA, 22 bp, Homo sapiens
tctcatgttttacctgtcctca

SEQ ID NO: 9298630 - DNA, 22 bp, Homo sapiens
tctcattcataccctacatgct

SEQ ID NO: 9298631 - DNA, 22 bp, Homo sapiens
tctcatgttttacctgtcctca

SEQ ID NO: 9298632 - DNA, 22 bp, Homo sapiens
tctcatgtgattcccgtgcatg

SEQ ID NO: 9298633 - DNA, 22 bp, Homo sapiens
tctcatgtattgccctggtgtg

SEQ ID NO: 9298634 - DNA, 22 bp, Homo sapiens
tctcctgctcagaacagcctca

SEQ ID NO: 9298635 - DNA, 22 bp, Homo sapiens
tctcctgctcagaacagcctca

SEQ ID NO: 9298636 - DNA, 22 bp, Homo sapiens
tctcctgctcccaactgctgca

SEQ ID NO: 9298637 - DNA, 22 bp, Homo sapiens
tctcctactcactcaaggcttg

SEQ ID NO: 9298638 - DNA, 22 bp, Homo sapiens
tctcctcccaggctcttccagg

SEQ ID NO: 9298639 - DNA, 23 bp, Homo sapiens
tctcctcctagatacagtcatgg

SEQ ID NO: 9298640 - DNA, 22 bp, Homo sapiens
tctcctctatttctgtatgtat

SEQ ID NO: 9298641 - DNA, 22 bp, Homo sapiens
tctcgctctgtcgcccaggctg

SEQ ID NO: 9298642 - DNA, 22 bp, Homo sapiens
tctcgctgaagaagctgcacat

SEQ ID NO: 9298643 - DNA, 22 bp, Homo sapiens
tctcgctctgtcgcccaggctg

SEQ ID NO: 9298644 - DNA, 22 bp, Homo sapiens
tctctagtctcctttaacctga

SEQ ID NO: 9298645 - DNA, 22 bp, Homo sapiens
tctcctttgaaagttaggactg

SEQ ID NO: 9298646 - DNA, 22 bp, Homo sapiens
tctccttccaacaaaaggtcac

SEQ ID NO: 9298647 - DNA, 22 bp, Homo sapiens
tctcccactgcaagcccaggct

SEQ ID NO: 9298648 - DNA, 22 bp, Homo sapiens
tctcccagaagtcctcagtaca

SEQ ID NO: 9298649 - DNA, 22 bp, Homo sapiens
tctcccactggccttgtatgat

SEQ ID NO: 9298650 - DNA, 22 bp, Homo sapiens
tctccccaaaggactcactctc

SEQ ID NO: 9298651 - DNA, 22 bp, Homo sapiens
tctcccagtggtgcagaaagca

SEQ ID NO: 9298652 - DNA, 22 bp, Homo sapiens
tctccctcattcctgcttccat

SEQ ID NO: 9298653 - DNA, 23 bp, Homo sapiens
tctccctcatgcctaggcctggg

SEQ ID NO: 9298654 - DNA, 22 bp, Homo sapiens
tctcccagaggatcccagtgga

SEQ ID NO: 9298655 - DNA, 22 bp, Homo sapiens
tctcccaggcaggagtgcagtg

SEQ ID NO: 9298656 - DNA, 20 bp, Homo sapiens
tctcccaggctcagggaaga

SEQ ID NO: 9298657 - DNA, 22 bp, Homo sapiens
tctcccaggctgccctgtggac

SEQ ID NO: 9298658 - DNA, 22 bp, Homo sapiens
tctcccagtcctctgtgcttac

SEQ ID NO: 9298659 - DNA, 22 bp, Homo sapiens
tctcccaggctggagtgcagtg

SEQ ID NO: 9298660 - DNA, 22 bp, Homo sapiens
tctcccaggtgggtgcctggag

SEQ ID NO: 9298661 - DNA, 22 bp, Homo sapiens
tctcccaggtcatacacagaga

SEQ ID NO: 9298662 - DNA, 22 bp, Homo sapiens
tctcttcttgtgttttcctgcc

SEQ ID NO: 9298663 - DNA, 22 bp, Homo sapiens
tctcttctttggggtgggctca

SEQ ID NO: 9298664 - DNA, 22 bp, Homo sapiens
tctctttaaaaatagtgaaata

SEQ ID NO: 9298665 - DNA, 22 bp, Homo sapiens
tctctttaaaaatagtgaaata

SEQ ID NO: 9298666 - DNA, 22 bp, Homo sapiens
tctctttaaagactcagagatt

SEQ ID NO: 9298667 - DNA, 22 bp, Homo sapiens
tctctttaaagactcagagatt

SEQ ID NO: 9298668 - DNA, 22 bp, Homo sapiens
tctctttaagtataatcttata

SEQ ID NO: 9298669 - DNA, 22 bp, Homo sapiens
tctctttagtgcttagacgtct

SEQ ID NO: 9298670 - DNA, 22 bp, Homo sapiens
tctctttagtgcttagacgtct

SEQ ID NO: 9298671 - DNA, 22 bp, Homo sapiens
tctctttactttcaccaatttg

SEQ ID NO: 9298672 - DNA, 22 bp, Homo sapiens
tctctttctttgtatgtctatt

SEQ ID NO: 9298673 - DNA, 22 bp, Homo sapiens
tctctttgaccctttagctcca

SEQ ID NO: 9298674 - DNA, 17 bp, Homo sapiens
tctctttccctttctgc

SEQ ID NO: 9298675 - DNA, 17 bp, Homo sapiens
tctctttccctttctgc

SEQ ID NO: 9298676 - DNA, 18 bp, Homo sapiens
tctctttcctcagtggag

SEQ ID NO: 9298677 - DNA, 22 bp, Homo sapiens
tctctttctattgcaccatgct

SEQ ID NO: 9298678 - DNA, 22 bp, Homo sapiens
tctgaaaatgttgactttgttt

SEQ ID NO: 9298679 - DNA, 22 bp, Homo sapiens
tctctttgtctgctcttagttg

SEQ ID NO: 9298680 - DNA, 22 bp, Homo sapiens
tctgaaagtatctggatctttt

SEQ ID NO: 9298681 - DNA, 22 bp, Homo sapiens
tctgaaataaatgcactgttag

SEQ ID NO: 9298682 - DNA, 22 bp, Homo sapiens
tctgaaataaatgcactgttag

SEQ ID NO: 9298683 - DNA, 22 bp, Homo sapiens
tctgaaataactgatgccagat

SEQ ID NO: 9298684 - DNA, 22 bp, Homo sapiens
tctgaaatactgcaggttctct

SEQ ID NO: 9298685 - DNA, 22 bp, Homo sapiens
tctgaaataagggagaagggaa

SEQ ID NO: 9298686 - DNA, 22 bp, Homo sapiens
tctgaaatagaagtgtctttct

SEQ ID NO: 9298687 - DNA, 22 bp, Homo sapiens
tctgaaattttagttatagaaa

SEQ ID NO: 9298688 - DNA, 22 bp, Homo sapiens
tctgaagaactgagtaaacatg

SEQ ID NO: 9298689 - DNA, 22 bp, Homo sapiens
tctgaaatgcaaatttgactga

SEQ ID NO: 9298690 - DNA, 22 bp, Homo sapiens
tctgaaatggggctgaagcact

SEQ ID NO: 9298691 - DNA, 22 bp, Homo sapiens
tctgaaatggcgatggccgttg

SEQ ID NO: 9298692 - DNA, 22 bp, Homo sapiens
tctgaaatgcaggcaatttgct

SEQ ID NO: 9298693 - DNA, 22 bp, Homo sapiens
tctgaaatggcagcgggaatga

SEQ ID NO: 9298694 - DNA, 22 bp, Homo sapiens
tctgaaattttagttatagaaa

SEQ ID NO: 9298695 - DNA, 22 bp, Homo sapiens
tctgaaattccttccagacttt

SEQ ID NO: 9298696 - DNA, 22 bp, Homo sapiens
tctgaaattgttagtaaaaatg

SEQ ID NO: 9298697 - DNA, 22 bp, Homo sapiens
tctgaaatgttctcttgttttg

SEQ ID NO: 9298698 - DNA, 22 bp, Homo sapiens
tctgaaattcacagttgagtca

SEQ ID NO: 9298699 - DNA, 22 bp, Homo sapiens
tctcttctatttgagactattt

SEQ ID NO: 9298700 - DNA, 19 bp, Homo sapiens
tctcttctccctggtttta

SEQ ID NO: 9298701 - DNA, 22 bp, Homo sapiens
tctcttctagcttcttgtggtt

SEQ ID NO: 9298702 - DNA, 22 bp, Homo sapiens
tctcttctagcttcttgtggtt

SEQ ID NO: 9298703 - DNA, 22 bp, Homo sapiens
tctcttctaattttcccgagta

SEQ ID NO: 9298704 - DNA, 22 bp, Homo sapiens
tctcttctaattagggtccatg

SEQ ID NO: 9298705 - DNA, 20 bp, Homo sapiens
tctcttctggggagataaaa

SEQ ID NO: 9298706 - DNA, 22 bp, Homo sapiens
tctcttcttgattttcactgga

SEQ ID NO: 9298707 - DNA, 22 bp, Homo sapiens
tctcttcttgtgttttcctgcc

SEQ ID NO: 9298708 - DNA, 18 bp, Homo sapiens
tctcttcttggcagtcaa

SEQ ID NO: 9298709 - DNA, 22 bp, Homo sapiens
tctcttcttgattttcactgga

SEQ ID NO: 9298710 - DNA, 22 bp, Homo sapiens
tctcttctgaaacctgtcttta

SEQ ID NO: 9298711 - DNA, 22 bp, Homo sapiens
tctcttctgacctagccttgga

SEQ ID NO: 9298712 - DNA, 22 bp, Homo sapiens
tctcttctgaaacctgtcttta

SEQ ID NO: 9298713 - DNA, 22 bp, Homo sapiens
tctcttctctagtgagcaactg

SEQ ID NO: 9298714 - DNA, 22 bp, Homo sapiens
tctcttccagtggctttgattt

SEQ ID NO: 9298715 - DNA, 22 bp, Homo sapiens
tctcttccttgacctattgtaa

SEQ ID NO: 9298716 - DNA, 22 bp, Homo sapiens
tctcttctaacactagaaattc

SEQ ID NO: 9298717 - DNA, 23 bp, Homo sapiens
tctctgtgtgcctcagtttcttc

SEQ ID NO: 9298718 - DNA, 22 bp, Homo sapiens
tctcttcacatgcttgctccaa

SEQ ID NO: 9298719 - DNA, 20 bp, Homo sapiens
tctcttcaggaggtccatgt

SEQ ID NO: 9298720 - DNA, 22 bp, Homo sapiens
tctcttccagtaagagtcttta

SEQ ID NO: 9298721 - DNA, 22 bp, Homo sapiens
tctctgtggcaagcatgctgct

SEQ ID NO: 9298722 - DNA, 21 bp, Homo sapiens
tctctgtggcctaccctctac

SEQ ID NO: 9298723 - DNA, 22 bp, Homo sapiens
tctctgtggagcagtgtgttca

SEQ ID NO: 9298724 - DNA, 22 bp, Homo sapiens
tctctgtggcaactacttagct

SEQ ID NO: 9298725 - DNA, 22 bp, Homo sapiens
tctctgtgcccagtagttctct

SEQ ID NO: 9298726 - DNA, 21 bp, Homo sapiens
tctctgtgtacagtctcaccc

SEQ ID NO: 9298727 - DNA, 22 bp, Homo sapiens
tctctgtgtctcatgttcctat

SEQ ID NO: 9298728 - DNA, 22 bp, Homo sapiens
tctctgtggtatgtcatagcaa

SEQ ID NO: 9298729 - DNA, 22 bp, Homo sapiens
tctctgtgcaggatgctgagtt

SEQ ID NO: 9298730 - DNA, 22 bp, Homo sapiens
tctctgtgagccaggtcctagt

SEQ ID NO: 9298731 - DNA, 22 bp, Homo sapiens
tctctgtgagatttgtattaag

SEQ ID NO: 9298732 - DNA, 22 bp, Homo sapiens
tctctgtgaatggcgtcacctg

SEQ ID NO: 9298733 - DNA, 22 bp, Homo sapiens
tctctgtgacatttctgagcct

SEQ ID NO: 9298734 - DNA, 22 bp, Homo sapiens
tctctgtgagatgccttcctga

SEQ ID NO: 9298735 - DNA, 22 bp, Homo sapiens
tctctgtctcccgtgtgtccgg

SEQ ID NO: 9298736 - DNA, 22 bp, Homo sapiens
tctctgtctgagcctggcagac

SEQ ID NO: 9298737 - DNA, 22 bp, Homo sapiens
tctctgtctttgttgtcttcac

SEQ ID NO: 9298738 - DNA, 22 bp, Homo sapiens
tctctcactggtgcctctgttg

SEQ ID NO: 9298739 - DNA, 22 bp, Homo sapiens
tctctcagaactgcagctgcag

SEQ ID NO: 9298740 - DNA, 22 bp, Homo sapiens
tctctcactggtgcctctgttg

SEQ ID NO: 9298741 - DNA, 22 bp, Homo sapiens
tctctcagggggaaggctgaag

SEQ ID NO: 9298742 - DNA, 22 bp, Homo sapiens
tctctcctgtgttctgatgttt

SEQ ID NO: 9298743 - DNA, 22 bp, Homo sapiens
tctctctcctagtttttagtgg

SEQ ID NO: 9298744 - DNA, 22 bp, Homo sapiens
tctctctcagccattacagaac

SEQ ID NO: 9298745 - DNA, 22 bp, Homo sapiens
tctctctcctagtttttagtgg

SEQ ID NO: 9298746 - DNA, 22 bp, Homo sapiens
tctctccttatcattgtgttta

SEQ ID NO: 9298747 - DNA, 22 bp, Homo sapiens
tctctcttgtcaccccatctgc

SEQ ID NO: 9298748 - DNA, 22 bp, Homo sapiens
tctctggggatgcttattcttg

SEQ ID NO: 9298749 - DNA, 19 bp, Homo sapiens
tctctggggacactttcac

SEQ ID NO: 9298750 - DNA, 22 bp, Homo sapiens
tctctgggcctccctttccaag

SEQ ID NO: 9298751 - DNA, 22 bp, Homo sapiens
tctctgggcctgttttctcatc

SEQ ID NO: 9298752 - DNA, 22 bp, Homo sapiens
tctctgggggtagaactcaggc

SEQ ID NO: 9298753 - DNA, 22 bp, Homo sapiens
tctctggggcctttctacatca

SEQ ID NO: 9298754 - DNA, 22 bp, Homo sapiens
tctctgggtaaagttctctcat

SEQ ID NO: 9298755 - DNA, 22 bp, Homo sapiens
tctctgcttggtgtatgtgagt

SEQ ID NO: 9298756 - DNA, 22 bp, Homo sapiens
tgcagattcaaatgaaatgcaa

SEQ ID NO: 9298757 - DNA, 19 bp, Homo sapiens
tgcagagggtaggaaggcc

SEQ ID NO: 9298758 - DNA, 22 bp, Homo sapiens
tgcagagggaaaaggtgctcct

SEQ ID NO: 9298759 - DNA, 23 bp, Homo sapiens
tgcagagggactgaagccagctt

SEQ ID NO: 9298760 - DNA, 22 bp, Homo sapiens
tgcagagggagtgacggttcac

SEQ ID NO: 9298761 - DNA, 22 bp, Homo sapiens
tgcagagccagtcttgtgcttc

SEQ ID NO: 9298762 - DNA, 20 bp, Homo sapiens
tgcagagctgacattacctg

SEQ ID NO: 9298763 - DNA, 22 bp, Homo sapiens
tgcagagccccagattggagag

SEQ ID NO: 9298764 - DNA, 22 bp, Homo sapiens
tgcagagctcttggcacttcag

SEQ ID NO: 9298765 - DNA, 22 bp, Homo sapiens
tgcagagaaaactcctgggtac

SEQ ID NO: 9298766 - DNA, 22 bp, Homo sapiens
tgcagaggagtcagcctgggca

SEQ ID NO: 9298767 - DNA, 22 bp, Homo sapiens
tgcagaggagctggaaggctgg

SEQ ID NO: 9298768 - DNA, 22 bp, Homo sapiens
tgcagaggcgccgtgggtgggg

SEQ ID NO: 9298769 - DNA, 21 bp, Homo sapiens
tgcagaggcacaaacaagccc

SEQ ID NO: 9298770 - DNA, 22 bp, Homo sapiens
tgcagaggcccagcggttcttc

SEQ ID NO: 9298771 - DNA, 22 bp, Homo sapiens
tgcagaggcatttattgatgta

SEQ ID NO: 9298772 - DNA, 22 bp, Homo sapiens
tgcacgtgggctctctgctctt

SEQ ID NO: 9298773 - DNA, 22 bp, Homo sapiens
tgcagaaattcagaaagcataa

SEQ ID NO: 9298774 - DNA, 22 bp, Homo sapiens
tgcagaaacagtcattaatgta

SEQ ID NO: 9298775 - DNA, 22 bp, Homo sapiens
tgcagaaaccaattcaagtaag

SEQ ID NO: 9298776 - DNA, 22 bp, Homo sapiens
tgcagaaataaagatattatca

SEQ ID NO: 9298777 - DNA, 22 bp, Homo sapiens
tgcagaagtgagtcatgaggaa

SEQ ID NO: 9298778 - DNA, 22 bp, Homo sapiens
tgcagaagctgcaggtcagtgg

SEQ ID NO: 9298779 - DNA, 22 bp, Homo sapiens
tgcaccctctgctatgtgctcc

SEQ ID NO: 9298780 - DNA, 22 bp, Homo sapiens
tgcaccctcatcagtcaaatgg

SEQ ID NO: 9298781 - DNA, 22 bp, Homo sapiens
tgcacaggaggctgtggagaag

SEQ ID NO: 9298782 - DNA, 22 bp, Homo sapiens
tgcacaggtgagactcaggaag

SEQ ID NO: 9298783 - DNA, 22 bp, Homo sapiens
tgcagcccttccttcctctggg

SEQ ID NO: 9298784 - DNA, 22 bp, Homo sapiens
tgcagccttgcctcctcccagc

SEQ ID NO: 9298785 - DNA, 21 bp, Homo sapiens
tgcagctgacactggtatgcc

SEQ ID NO: 9298786 - DNA, 20 bp, Homo sapiens
tgcagctggtttcacaggga

SEQ ID NO: 9298787 - DNA, 22 bp, Homo sapiens
tgcagctgctggcccaggtgct

SEQ ID NO: 9298788 - DNA, 22 bp, Homo sapiens
tgcagctgcttgattcatcttg

SEQ ID NO: 9298789 - DNA, 22 bp, Homo sapiens
tgcaggagctgtgcggtgaggg

SEQ ID NO: 9298790 - DNA, 21 bp, Homo sapiens
tgcaggagtctgtgagtcagg

SEQ ID NO: 9298791 - DNA, 18 bp, Homo sapiens
tgcaggagtgaccccggc

SEQ ID NO: 9298792 - DNA, 23 bp, Homo sapiens
tgcaggctaggaagagagccttc

SEQ ID NO: 9298793 - DNA, 22 bp, Homo sapiens
tgcagctgtaacagaggcctca

SEQ ID NO: 9298794 - DNA, 22 bp, Homo sapiens
tgcaggagcagagatggctgga

SEQ ID NO: 9298795 - DNA, 22 bp, Homo sapiens
tgcaggagcagagatggctgga

SEQ ID NO: 9298796 - DNA, 22 bp, Homo sapiens
tgcaaactattggtagagatgg

SEQ ID NO: 9298797 - DNA, 22 bp, Homo sapiens
tgcaaactgggacactattcaa

SEQ ID NO: 9298798 - DNA, 22 bp, Homo sapiens
tgcaaactgggatactattcaa

SEQ ID NO: 9298799 - DNA, 22 bp, Homo sapiens
tgatttttagctattctgaaga

SEQ ID NO: 9298800 - DNA, 22 bp, Homo sapiens
tgcaagatattatctttgctgc

SEQ ID NO: 9298801 - DNA, 22 bp, Homo sapiens
tgcacacaggtctaggacatgg

SEQ ID NO: 9298802 - DNA, 22 bp, Homo sapiens
tgcaatctcggcactttgggag

SEQ ID NO: 9298803 - DNA, 22 bp, Homo sapiens
tgatacataaaccatcattttg

SEQ ID NO: 9298804 - DNA, 22 bp, Homo sapiens
tgatctaggttggcttcaactg

SEQ ID NO: 9298805 - DNA, 22 bp, Homo sapiens
tgatgcctatgaattgtaatgt

SEQ ID NO: 9298806 - DNA, 22 bp, Homo sapiens
tgatgctgagcctgggactgac

SEQ ID NO: 9298807 - DNA, 23 bp, Homo sapiens
tgattgaaagcctgagaaagctg

SEQ ID NO: 9298808 - DNA, 22 bp, Homo sapiens
tgatgtcctcatgtcaagctcc

SEQ ID NO: 9298809 - DNA, 22 bp, Homo sapiens
tgattcatcagaataggagttt

SEQ ID NO: 9298810 - DNA, 22 bp, Homo sapiens
tgattcaattatctgatgcttt

SEQ ID NO: 9298811 - DNA, 18 bp, Homo sapiens
tgattcaagttgccctcc

SEQ ID NO: 9298812 - DNA, 22 bp, Homo sapiens
tgattcaataggaattgagtag

SEQ ID NO: 9298813 - DNA, 22 bp, Homo sapiens
tgcctgatgcaggagtatcaga

SEQ ID NO: 9298814 - DNA, 22 bp, Homo sapiens
tgcctgcaagagttggggctac

SEQ ID NO: 9298815 - DNA, 22 bp, Homo sapiens
tgcctgccatgcagaaagctga

SEQ ID NO: 9298816 - DNA, 22 bp, Homo sapiens
tgcctgccatgcagaaagctga

SEQ ID NO: 9298817 - DNA, 22 bp, Homo sapiens
tgcctgctttctcctcaactca

SEQ ID NO: 9298818 - DNA, 22 bp, Homo sapiens
tgcctgctgccactgctgttac

SEQ ID NO: 9298819 - DNA, 19 bp, Homo sapiens
tgcctggcaccagctccac

SEQ ID NO: 9298820 - DNA, 23 bp, Homo sapiens
tgcctctgcctccctagtctgca

SEQ ID NO: 9298821 - DNA, 22 bp, Homo sapiens
tgcctctgaggaagattgtgtt

SEQ ID NO: 9298822 - DNA, 22 bp, Homo sapiens
tgcctctctaacccatgcccaa

SEQ ID NO: 9298823 - DNA, 22 bp, Homo sapiens
tgcctctctaacccatgcccaa

SEQ ID NO: 9298824 - DNA, 22 bp, Homo sapiens
tgcctgactgctgccaccacta

SEQ ID NO: 9298825 - DNA, 22 bp, Homo sapiens
tgcctctgtggaaatggtggtc

SEQ ID NO: 9298826 - DNA, 22 bp, Homo sapiens
tgcctctgtgggccttcctggc

SEQ ID NO: 9298827 - DNA, 22 bp, Homo sapiens
tgcctctgtgggccttcctggc

SEQ ID NO: 9298828 - DNA, 22 bp, Homo sapiens
tgccgtggggctgaggctggag

SEQ ID NO: 9298829 - DNA, 22 bp, Homo sapiens
tgcctaggctggagtgtagtgg

SEQ ID NO: 9298830 - DNA, 22 bp, Homo sapiens
tgcctagaactttattctttat

SEQ ID NO: 9298831 - DNA, 22 bp, Homo sapiens
tgcctaggaaacctcatgcttc

SEQ ID NO: 9298832 - DNA, 22 bp, Homo sapiens
tgccctgtgccagacttcctgg

SEQ ID NO: 9298833 - DNA, 22 bp, Homo sapiens
tgccctgtctaagctgtcagta

SEQ ID NO: 9298834 - DNA, 22 bp, Homo sapiens
tgccctgtcgctcactcccacc

SEQ ID NO: 9298835 - DNA, 22 bp, Homo sapiens
tgccctgggacatgcagcggag

SEQ ID NO: 9298836 - DNA, 22 bp, Homo sapiens
tgccctggcttcagctttggct

SEQ ID NO: 9298837 - DNA, 22 bp, Homo sapiens
tgccctgggaacacagatgcca

SEQ ID NO: 9298838 - DNA, 22 bp, Homo sapiens
tgccctgctgtggctctgccca

SEQ ID NO: 9298839 - DNA, 22 bp, Homo sapiens
tgccctggaaccatctacagtc

SEQ ID NO: 9298840 - DNA, 22 bp, Homo sapiens
tgccctggaggggcttacagtc

SEQ ID NO: 9298841 - DNA, 22 bp, Homo sapiens
tgccctggcattgggttggata

SEQ ID NO: 9298842 - DNA, 22 bp, Homo sapiens
tgccctggatgctgcaggtgtg

SEQ ID NO: 9298843 - DNA, 22 bp, Homo sapiens
tgccctgcggctatctagatga

SEQ ID NO: 9298844 - DNA, 22 bp, Homo sapiens
tgcccctctcctgtgatccaag

SEQ ID NO: 9298845 - DNA, 22 bp, Homo sapiens
tgcccaggctggagtacagtgg

SEQ ID NO: 9298846 - DNA, 22 bp, Homo sapiens
tgcccaggctggaatgcagtgg

SEQ ID NO: 9298847 - DNA, 23 bp, Homo sapiens
tgcccagtgggtgcagggggtat

SEQ ID NO: 9298848 - DNA, 22 bp, Homo sapiens
tgccccagactctgctcacctc

SEQ ID NO: 9298849 - DNA, 20 bp, Homo sapiens
tgccccaggcctgcacctgc

SEQ ID NO: 9298850 - DNA, 22 bp, Homo sapiens
tgccatcactgaacttctgaaa

SEQ ID NO: 9298851 - DNA, 22 bp, Homo sapiens
tgccatctcttcctcgtgctgc

SEQ ID NO: 9298852 - DNA, 22 bp, Homo sapiens
tgccaggccctgtgctggatgc

SEQ ID NO: 9298853 - DNA, 22 bp, Homo sapiens
tgccaggcccagctccagagct

SEQ ID NO: 9298854 - DNA, 17 bp, Homo sapiens
tgccagcctgtcccagg

SEQ ID NO: 9298855 - DNA, 22 bp, Homo sapiens
tgccagcctcctgatatcatcc

SEQ ID NO: 9298856 - DNA, 21 bp, Homo sapiens
tgcattctagcagctctgagg

SEQ ID NO: 9298857 - DNA, 22 bp, Homo sapiens
tgcatttaagaaaacatgagtc

SEQ ID NO: 9298858 - DNA, 22 bp, Homo sapiens
tgcatttaactagaatattaat

SEQ ID NO: 9298859 - DNA, 22 bp, Homo sapiens
tgcatttaatagatgctccctg

SEQ ID NO: 9298860 - DNA, 20 bp, Homo sapiens
tgcatttacagtgtggatac

SEQ ID NO: 9298861 - DNA, 21 bp, Homo sapiens
tgcatttaacagaaacaggaa

SEQ ID NO: 9298862 - DNA, 18 bp, Homo sapiens
tgcatttagtacatctag

SEQ ID NO: 9298863 - DNA, 22 bp, Homo sapiens
tgcatttagttatgagaaaaac

SEQ ID NO: 9298864 - DNA, 22 bp, Homo sapiens
tgcatttacggtacaacagcag

SEQ ID NO: 9298865 - DNA, 22 bp, Homo sapiens
tgcatttacctggaggtcattt

SEQ ID NO: 9298866 - DNA, 22 bp, Homo sapiens
tgcatttatttgaattgatcta

SEQ ID NO: 9298867 - DNA, 22 bp, Homo sapiens
tgcatttattaccaggctttca

SEQ ID NO: 9298868 - DNA, 22 bp, Homo sapiens
tgcatttatgtctcccaccagc

SEQ ID NO: 9298869 - DNA, 22 bp, Homo sapiens
tgcatttataaaatgttcgtgg

SEQ ID NO: 9298870 - DNA, 22 bp, Homo sapiens
tgcatttagttttaataaagga

SEQ ID NO: 9298871 - DNA, 22 bp, Homo sapiens
tgcatttatggagttacctcat

SEQ ID NO: 9298872 - DNA, 22 bp, Homo sapiens
tgcatttatggagcaaggcagt

SEQ ID NO: 9298873 - DNA, 22 bp, Homo sapiens
tgcatttcagaagaaaattcgg

SEQ ID NO: 9298874 - DNA, 22 bp, Homo sapiens
tgccaaatgccaccacagctgc

SEQ ID NO: 9298875 - DNA, 22 bp, Homo sapiens
tgccagccagggaagctcaccc

SEQ ID NO: 9298876 - DNA, 22 bp, Homo sapiens
tgcatgtgtcgggcctgtgcta

SEQ ID NO: 9298877 - DNA, 22 bp, Homo sapiens
tgcatgtgtttgccacagtgag

SEQ ID NO: 9298878 - DNA, 23 bp, Homo sapiens
tgcatgtgaattcatacttgttt

SEQ ID NO: 9298879 - DNA, 22 bp, Homo sapiens
tgcatgcacgtatctgcgtgtg

SEQ ID NO: 9298880 - DNA, 22 bp, Homo sapiens
tgcaggctgtaatctgaggcta

SEQ ID NO: 9298881 - DNA, 22 bp, Homo sapiens
tgcaggctgtaatctgaggcta

SEQ ID NO: 9298882 - DNA, 22 bp, Homo sapiens
tgcaggctttagccccatggct

SEQ ID NO: 9298883 - DNA, 22 bp, Homo sapiens
tgcagggccagactgggttgga

SEQ ID NO: 9298884 - DNA, 22 bp, Homo sapiens
tgcagggcatctttgaagtgtg

SEQ ID NO: 9298885 - DNA, 22 bp, Homo sapiens
tgcagggcatagggtccagttt

SEQ ID NO: 9298886 - DNA, 22 bp, Homo sapiens
tgcagggccatggtggcggctg

SEQ ID NO: 9298887 - DNA, 22 bp, Homo sapiens
tgcagggcccctctgcatgagt

SEQ ID NO: 9298888 - DNA, 22 bp, Homo sapiens
tgcagggccgctggaggtcatg

SEQ ID NO: 9298889 - DNA, 22 bp, Homo sapiens
tgcagggctcctggctccaatc

SEQ ID NO: 9298890 - DNA, 22 bp, Homo sapiens
tgcagggctataactccattct

SEQ ID NO: 9298891 - DNA, 22 bp, Homo sapiens
tgcagggcccttggggttgaac

SEQ ID NO: 9298892 - DNA, 22 bp, Homo sapiens
tgcagggccctcattcctgtcc

SEQ ID NO: 9298893 - DNA, 23 bp, Homo sapiens
tgcagggcaagttagagacccca

SEQ ID NO: 9298894 - DNA, 22 bp, Homo sapiens
tgcagggcacacgcacgggtgt

SEQ ID NO: 9298895 - DNA, 22 bp, Homo sapiens
tgcagggcacggtgcgcgtggg

SEQ ID NO: 9298896 - DNA, 22 bp, Homo sapiens
tgcagggcacacgcacgggtgt

SEQ ID NO: 9298897 - DNA, 22 bp, Homo sapiens
tgcagggcagatatgactgtag

SEQ ID NO: 9298898 - DNA, 22 bp, Homo sapiens
tgcagggcagctagggagcttt

SEQ ID NO: 9298899 - DNA, 22 bp, Homo sapiens
tgcagggcagtttgtttcggca

SEQ ID NO: 9298900 - DNA, 22 bp, Homo sapiens
tgcagggcagtggaggttgagt

SEQ ID NO: 9298901 - DNA, 19 bp, Homo sapiens
tgcagggctgcgcctgggg

SEQ ID NO: 9298902 - DNA, 20 bp, Homo sapiens
tgcagggctctgcttctctc

SEQ ID NO: 9298903 - DNA, 20 bp, Homo sapiens
tgcagggctgcctcccagct

SEQ ID NO: 9298904 - DNA, 22 bp, Homo sapiens
tgcagggcttcctcttggagtt

SEQ ID NO: 9298905 - DNA, 22 bp, Homo sapiens
tgcaggtgcagcgatactgtga

SEQ ID NO: 9298906 - DNA, 22 bp, Homo sapiens
tgcaggtggatatctcatcaga

SEQ ID NO: 9298907 - DNA, 22 bp, Homo sapiens
tgcaggtgattctgatgcagtt

SEQ ID NO: 9298908 - DNA, 23 bp, Homo sapiens
tgcaggtgattaatccagtttca

SEQ ID NO: 9298909 - DNA, 22 bp, Homo sapiens
tgcaggtggctccagggactgc

SEQ ID NO: 9298910 - DNA, 22 bp, Homo sapiens
tgcaggtggccatcttcgttct

SEQ ID NO: 9298911 - DNA, 22 bp, Homo sapiens
tgcaggtggattcaatgtggga

SEQ ID NO: 9298912 - DNA, 22 bp, Homo sapiens
tgcaggtggcagcggggcacca

SEQ ID NO: 9298913 - DNA, 22 bp, Homo sapiens
tgcaggtacttgacaacttggg

SEQ ID NO: 9298914 - DNA, 22 bp, Homo sapiens
tgcaggtaggcctgacttccag

SEQ ID NO: 9298915 - DNA, 23 bp, Homo sapiens
tgcaggtagggcccagcagtctt

SEQ ID NO: 9298916 - DNA, 22 bp, Homo sapiens
tgcaggtgacaccactcttcct

SEQ ID NO: 9298917 - DNA, 22 bp, Homo sapiens
tgcaggtgagtgcaggggctca

SEQ ID NO: 9298918 - DNA, 22 bp, Homo sapiens
tgcaggtgaaaattatgaggat

SEQ ID NO: 9298919 - DNA, 22 bp, Homo sapiens
tgcaggtgtgggcaggggagca

SEQ ID NO: 9298920 - DNA, 22 bp, Homo sapiens
tgcaggtgtctgggggcaacag

SEQ ID NO: 9298921 - DNA, 23 bp, Homo sapiens
tgcaggtgtgcagagggctcttg

SEQ ID NO: 9298922 - DNA, 22 bp, Homo sapiens
tgcaggtgtctctgtctagcgt

SEQ ID NO: 9298923 - DNA, 20 bp, Homo sapiens
tgcaggtgttggagaaggta

SEQ ID NO: 9298924 - DNA, 22 bp, Homo sapiens
tgcaggtgtgtgcaagggaggg

SEQ ID NO: 9298925 - DNA, 22 bp, Homo sapiens
tgcaggtgtggttcctcagcca

SEQ ID NO: 9298926 - DNA, 20 bp, Homo sapiens
tgcaggtgtgtccaagcact

SEQ ID NO: 9298927 - DNA, 22 bp, Homo sapiens
tgcaggtggtccttcctctgct

SEQ ID NO: 9298928 - DNA, 22 bp, Homo sapiens
tgcaggtggtttggacactgct

SEQ ID NO: 9298929 - DNA, 20 bp, Homo sapiens
tgcaggtgggcccttctggg

SEQ ID NO: 9298930 - DNA, 22 bp, Homo sapiens
tgcaggtggtacttctttttct

SEQ ID NO: 9298931 - DNA, 22 bp, Homo sapiens
tgcaggtggtccatttgggaac

SEQ ID NO: 9298932 - DNA, 22 bp, Homo sapiens
tgcaggtgtaaattttcaagag

SEQ ID NO: 9298933 - DNA, 22 bp, Homo sapiens
tgcaggtgtagagttgggctcc

SEQ ID NO: 9298934 - DNA, 22 bp, Homo sapiens
tgcaggtgtctccagggcaggt

SEQ ID NO: 9298935 - DNA, 19 bp, Homo sapiens
tctttgtacaagtctctgc

SEQ ID NO: 9298936 - DNA, 21 bp, Homo sapiens
tcttttcctttctgtgtgcaa

SEQ ID NO: 9298937 - DNA, 18 bp, Homo sapiens
tcttttccttccacttcc

SEQ ID NO: 9298938 - DNA, 22 bp, Homo sapiens
tcttttcctcctcttgttggcc

SEQ ID NO: 9298939 - DNA, 22 bp, Homo sapiens
tcttttcctcctcttgttggcc

SEQ ID NO: 9298940 - DNA, 22 bp, Homo sapiens
tcttttccttccctacagatct

SEQ ID NO: 9298941 - DNA, 22 bp, Homo sapiens
tcttttccttgatggttaaata

SEQ ID NO: 9298942 - DNA, 22 bp, Homo sapiens
tgaaacagtctccagacttgga

SEQ ID NO: 9298943 - DNA, 23 bp, Homo sapiens
tgaaacatttagggtagaatttc

SEQ ID NO: 9298944 - DNA, 22 bp, Homo sapiens
tgaaacattgcactgtatgaat

SEQ ID NO: 9298945 - DNA, 22 bp, Homo sapiens
tctttttctgcacacgtgtccc

SEQ ID NO: 9298946 - DNA, 22 bp, Homo sapiens
tctttttatattgacaaaaggt

SEQ ID NO: 9298947 - DNA, 22 bp, Homo sapiens
tgaaaacagaatccttgttttc

SEQ ID NO: 9298948 - DNA, 22 bp, Homo sapiens
tgaaaaaacaagttggcccatt

SEQ ID NO: 9298949 - DNA, 22 bp, Homo sapiens
tgaaaattgttgtacttgataa

SEQ ID NO: 9298950 - DNA, 22 bp, Homo sapiens
tgaaaatttccatcagttatat

SEQ ID NO: 9298951 - DNA, 22 bp, Homo sapiens
tgaaaattaagcagatgaatga

SEQ ID NO: 9298952 - DNA, 22 bp, Homo sapiens
tgaaaattctcaggctcacccc

SEQ ID NO: 9298953 - DNA, 22 bp, Homo sapiens
tgaaaattcatctcatagcaga

SEQ ID NO: 9298954 - DNA, 22 bp, Homo sapiens
tgaagcaggaaacttcttgttt

SEQ ID NO: 9298955 - DNA, 20 bp, Homo sapiens
tgaagcagccttgattctgt

SEQ ID NO: 9298956 - DNA, 22 bp, Homo sapiens
tgaacaaactgcattcttcact

SEQ ID NO: 9298957 - DNA, 22 bp, Homo sapiens
tgaaattcaaaacacatttgtc

SEQ ID NO: 9298958 - DNA, 21 bp, Homo sapiens
tgaacaaagttcttatcgtga

SEQ ID NO: 9298959 - DNA, 22 bp, Homo sapiens
tgaacatgctgttgatggcctg

SEQ ID NO: 9298960 - DNA, 22 bp, Homo sapiens
tgaactttcacaagaatatgct

SEQ ID NO: 9298961 - DNA, 22 bp, Homo sapiens
tgaactctctcaagtgacagaa

SEQ ID NO: 9298962 - DNA, 22 bp, Homo sapiens
tgaaagcactcacttctgctct

SEQ ID NO: 9298963 - DNA, 22 bp, Homo sapiens
tgaaagttattactgatgatgt

SEQ ID NO: 9298964 - DNA, 22 bp, Homo sapiens
tgaaataatatctggatcaatc

SEQ ID NO: 9298965 - DNA, 22 bp, Homo sapiens
tgaaatgcaacagttatttttg

SEQ ID NO: 9298966 - DNA, 22 bp, Homo sapiens
tgaaatgctgtagagactgtat

SEQ ID NO: 9298967 - DNA, 22 bp, Homo sapiens
tgaaatgcttttacaggatatt

SEQ ID NO: 9298968 - DNA, 22 bp, Homo sapiens
tgaaatgtagattaggcattct

SEQ ID NO: 9298969 - DNA, 22 bp, Homo sapiens
tgacatttgagagagatataca

SEQ ID NO: 9298970 - DNA, 22 bp, Homo sapiens
tgacatttgagcatacatgtaa

SEQ ID NO: 9298971 - DNA, 22 bp, Homo sapiens
tgacatttcttgttgatataaa

SEQ ID NO: 9298972 - DNA, 22 bp, Homo sapiens
tgacattttatcaatatcacag

SEQ ID NO: 9298973 - DNA, 22 bp, Homo sapiens
tgacatttttaaaaccactagt

SEQ ID NO: 9298974 - DNA, 22 bp, Homo sapiens
tgacatttaatccctaaatatt

SEQ ID NO: 9298975 - DNA, 22 bp, Homo sapiens
tgacatgttagggaaatgtgat

SEQ ID NO: 9298976 - DNA, 22 bp, Homo sapiens
tgacatgtgtaatcagctccgt

SEQ ID NO: 9298977 - DNA, 22 bp, Homo sapiens
tgacatgtgtctccttccgtct

SEQ ID NO: 9298978 - DNA, 22 bp, Homo sapiens
tgacatgtggctttgacccagg

SEQ ID NO: 9298979 - DNA, 22 bp, Homo sapiens
tgacatgtgctcatcttggcta

SEQ ID NO: 9298980 - DNA, 22 bp, Homo sapiens
tgacatgtatgttgttggcatg

SEQ ID NO: 9298981 - DNA, 22 bp, Homo sapiens
tgacatgtcctgagaagatggc

SEQ ID NO: 9298982 - DNA, 22 bp, Homo sapiens
tgacatgtccaggtggtcctgt

SEQ ID NO: 9298983 - DNA, 22 bp, Homo sapiens
tgacatttatcttctacaatga

SEQ ID NO: 9298984 - DNA, 21 bp, Homo sapiens
tgacatttagtagcattgtca

SEQ ID NO: 9298985 - DNA, 22 bp, Homo sapiens
tgacgtcaactgcaaaggcctt

SEQ ID NO: 9298986 - DNA, 23 bp, Homo sapiens
tgacctcatgatccgcccacctc

SEQ ID NO: 9298987 - DNA, 22 bp, Homo sapiens
tgacctcatgatccgcccacct

SEQ ID NO: 9298988 - DNA, 22 bp, Homo sapiens
tgacctcttgtcggagctccag

SEQ ID NO: 9298989 - DNA, 22 bp, Homo sapiens
tgactttaaaataacaagttta

SEQ ID NO: 9298990 - DNA, 21 bp, Homo sapiens
tgactgaggcttcttcacaca

SEQ ID NO: 9298991 - DNA, 22 bp, Homo sapiens
tgacaggaggcttgaggccagg

SEQ ID NO: 9298992 - DNA, 22 bp, Homo sapiens
tgacaggtgaaatgtccttatt

SEQ ID NO: 9298993 - DNA, 22 bp, Homo sapiens
tgacaggtcatataagcttgca

SEQ ID NO: 9298994 - DNA, 21 bp, Homo sapiens
tgacaggtatttatctggaaa

SEQ ID NO: 9298995 - DNA, 22 bp, Homo sapiens
tgacatgtaagatggaaaagcg

SEQ ID NO: 9298996 - DNA, 22 bp, Homo sapiens
tgacatgtatatcttacgctat

SEQ ID NO: 9298997 - DNA, 22 bp, Homo sapiens
tgacatgtatgtatttgtttat

SEQ ID NO: 9298998 - DNA, 19 bp, Homo sapiens
tgacaggttttatgtgttt

SEQ ID NO: 9298999 - DNA, 21 bp, Homo sapiens
tgacaggtttaggattaaaat

SEQ ID NO: 9299000 - DNA, 22 bp, Homo sapiens
tgacaggttgtgtaggtggcca

SEQ ID NO: 9299001 - DNA, 22 bp, Homo sapiens
tgacaggttcgttagtcatgtt

SEQ ID NO: 9299002 - DNA, 22 bp, Homo sapiens
tgacaggtgctgggggcagtgt

SEQ ID NO: 9299003 - DNA, 22 bp, Homo sapiens
tgacaggtgattgtgaactaag

SEQ ID NO: 9299004 - DNA, 23 bp, Homo sapiens
tgacagaccttcccagacagtca

SEQ ID NO: 9299005 - DNA, 22 bp, Homo sapiens
tgacagaccactgcaactctgt

SEQ ID NO: 9299006 - DNA, 22 bp, Homo sapiens
tgacagaatgtgactctcagat

SEQ ID NO: 9299007 - DNA, 22 bp, Homo sapiens
tgacagacagcttctcatttta

SEQ ID NO: 9299008 - DNA, 22 bp, Homo sapiens
tgacagacacaccttaggaaag

SEQ ID NO: 9299009 - DNA, 17 bp, Homo sapiens
tgacagacatcatgagc

SEQ ID NO: 9299010 - DNA, 22 bp, Homo sapiens
tgacagacatggaagccagagt

SEQ ID NO: 9299011 - DNA, 22 bp, Homo sapiens
tgaaggtacagatattttgtaa

SEQ ID NO: 9299012 - DNA, 22 bp, Homo sapiens
tgaaggtggggcttaggaatct

SEQ ID NO: 9299013 - DNA, 21 bp, Homo sapiens
tgaagcctgaggcatagcccc

SEQ ID NO: 9299014 - DNA, 22 bp, Homo sapiens
tgaagccaatctgccaggcaga

SEQ ID NO: 9299015 - DNA, 22 bp, Homo sapiens
tgacaaagcatgatggtgacag

SEQ ID NO: 9299016 - DNA, 22 bp, Homo sapiens
tgaatgaatcctaacaaagaca

SEQ ID NO: 9299017 - DNA, 22 bp, Homo sapiens
tgaatgaatgaattaatagagt

SEQ ID NO: 9299018 - DNA, 22 bp, Homo sapiens
tgaatgtaggtctaatatccca

SEQ ID NO: 9299019 - DNA, 22 bp, Homo sapiens
tgaggtgtgtccccagggaggt

SEQ ID NO: 9299020 - DNA, 22 bp, Homo sapiens
tgagtagagaattcagctaagg

SEQ ID NO: 9299021 - DNA, 22 bp, Homo sapiens
tgagtagagaattcagctaagg

SEQ ID NO: 9299022 - DNA, 22 bp, Homo sapiens
tgagtctgtatgtccagattta

SEQ ID NO: 9299023 - DNA, 22 bp, Homo sapiens
tgaggtagagattgtgactgta

SEQ ID NO: 9299024 - DNA, 22 bp, Homo sapiens
tgaggggtctaggctgcgcacc

SEQ ID NO: 9299025 - DNA, 22 bp, Homo sapiens
tgaggctggatgggatgcctcc

SEQ ID NO: 9299026 - DNA, 19 bp, Homo sapiens
tgagggacattgggagcag

SEQ ID NO: 9299027 - DNA, 22 bp, Homo sapiens
tgagggactcccggccctgcca

SEQ ID NO: 9299028 - DNA, 22 bp, Homo sapiens
tgagggacttgctagttctctg

SEQ ID NO: 9299029 - DNA, 23 bp, Homo sapiens
tgagggacatggtggcttctgag

SEQ ID NO: 9299030 - DNA, 23 bp, Homo sapiens
tgagggacatggtggcttctgag

SEQ ID NO: 9299031 - DNA, 22 bp, Homo sapiens
tgaggccctctgggctggtcct

SEQ ID NO: 9299032 - DNA, 22 bp, Homo sapiens
tgaggccctagggcatgggaga

SEQ ID NO: 9299033 - DNA, 18 bp, Homo sapiens
tgaggcccgcagaggtgg

SEQ ID NO: 9299034 - DNA, 22 bp, Homo sapiens
tgaggaggtgggcacacagagt

SEQ ID NO: 9299035 - DNA, 22 bp, Homo sapiens
tgaggcactccaggatgctgtt

SEQ ID NO: 9299036 - DNA, 22 bp, Homo sapiens
tgaggcaatccctagggtaagg

SEQ ID NO: 9299037 - DNA, 22 bp, Homo sapiens
tgaggcaatgtccttcatcctt

SEQ ID NO: 9299038 - DNA, 22 bp, Homo sapiens
tgaggcaattggaaattttaac

SEQ ID NO: 9299039 - DNA, 22 bp, Homo sapiens
tgaggcaagggatggccccgtg

SEQ ID NO: 9299040 - DNA, 22 bp, Homo sapiens
tgaggcaaggctgaatgaaggc

SEQ ID NO: 9299041 - DNA, 22 bp, Homo sapiens
tgaggcaagtctcaatctttga

SEQ ID NO: 9299042 - DNA, 21 bp, Homo sapiens
tgaggcaagtccttttatagc

SEQ ID NO: 9299043 - DNA, 22 bp, Homo sapiens
tgaggcaagtactttccctttt

SEQ ID NO: 9299044 - DNA, 19 bp, Homo sapiens
tgaggcaagatggctctgg

SEQ ID NO: 9299045 - DNA, 22 bp, Homo sapiens
tgaggcaagctgggcccatgga

SEQ ID NO: 9299046 - DNA, 19 bp, Homo sapiens
tgaggcaagctttttcttg

SEQ ID NO: 9299047 - DNA, 22 bp, Homo sapiens
tgaggcaaaaacactgattagg

SEQ ID NO: 9299048 - DNA, 22 bp, Homo sapiens
tgaggcaaaagttatgtggtag

SEQ ID NO: 9299049 - DNA, 22 bp, Homo sapiens
tgaggcaaagacaaagcagcat

SEQ ID NO: 9299050 - DNA, 22 bp, Homo sapiens
tgaggcaaagttcaagctgaaa

SEQ ID NO: 9299051 - DNA, 17 bp, Homo sapiens
tgaggcaaccatcacta

SEQ ID NO: 9299052 - DNA, 22 bp, Homo sapiens
tgaggcaacagaaagggccaat

SEQ ID NO: 9299053 - DNA, 22 bp, Homo sapiens
tgaggcaagagtttgattagag

SEQ ID NO: 9299054 - DNA, 22 bp, Homo sapiens
tgagccagtctgtctgggtgaa

SEQ ID NO: 9299055 - DNA, 22 bp, Homo sapiens
tgagctgtactcctccccaggg

SEQ ID NO: 9299056 - DNA, 22 bp, Homo sapiens
tgagcttacgtgggaacagact

SEQ ID NO: 9299057 - DNA, 22 bp, Homo sapiens
tgagctgtaaggctgtcactga

SEQ ID NO: 9299058 - DNA, 22 bp, Homo sapiens
tgagccaggagtttgaggctgt

SEQ ID NO: 9299059 - DNA, 22 bp, Homo sapiens
tgagccaggcccagtggggtca

SEQ ID NO: 9299060 - DNA, 22 bp, Homo sapiens
tgagccagagaggttgaggcta

SEQ ID NO: 9299061 - DNA, 22 bp, Homo sapiens
tgagccagaggaggctgtgtgg

SEQ ID NO: 9299062 - DNA, 22 bp, Homo sapiens
tgagcatagcccttctagtgtt

SEQ ID NO: 9299063 - DNA, 22 bp, Homo sapiens
tgagatatctgttaattttctt

SEQ ID NO: 9299064 - DNA, 22 bp, Homo sapiens
tgagaggaacaggcagtaggtt

SEQ ID NO: 9299065 - DNA, 22 bp, Homo sapiens
tgagaggcagaatggtgcctgc

SEQ ID NO: 9299066 - DNA, 22 bp, Homo sapiens
tgagaggagtgattgtaaaatt

SEQ ID NO: 9299067 - DNA, 22 bp, Homo sapiens
tgagaggccccagctcttggcc

SEQ ID NO: 9299068 - DNA, 22 bp, Homo sapiens
tgagagcacagtgtggtctgga

SEQ ID NO: 9299069 - DNA, 22 bp, Homo sapiens
tgagagagcctgaatctcttac

SEQ ID NO: 9299070 - DNA, 22 bp, Homo sapiens
tgagaagagcaaggaactggtt

SEQ ID NO: 9299071 - DNA, 22 bp, Homo sapiens
tgagaaccatgaaaagctgtca

SEQ ID NO: 9299072 - DNA, 22 bp, Homo sapiens
tgagaaagtgggtgcctagcaa

SEQ ID NO: 9299073 - DNA, 22 bp, Homo sapiens
tgagacagcccttctgcacagg

SEQ ID NO: 9299074 - DNA, 17 bp, Homo sapiens
tgagacagggcaggccc

SEQ ID NO: 9299075 - DNA, 22 bp, Homo sapiens
tgcgatggcgtagacaaatccc

SEQ ID NO: 9299076 - DNA, 22 bp, Homo sapiens
tgccttggttctctacttggag

SEQ ID NO: 9299077 - DNA, 22 bp, Homo sapiens
tgccttggtggcagtctgcggt

SEQ ID NO: 9299078 - DNA, 22 bp, Homo sapiens
tgccttggtttccccatctgta

SEQ ID NO: 9299079 - DNA, 22 bp, Homo sapiens
tgccttggtgcttcttcatgtg

SEQ ID NO: 9299080 - DNA, 22 bp, Homo sapiens
tgccttgggatatatggacact

SEQ ID NO: 9299081 - DNA, 22 bp, Homo sapiens
tgccttgggtcaacctttgagt

SEQ ID NO: 9299082 - DNA, 22 bp, Homo sapiens
tgccttggactctttattccag

SEQ ID NO: 9299083 - DNA, 20 bp, Homo sapiens
tgcctggcctttctctgccc

SEQ ID NO: 9299084 - DNA, 22 bp, Homo sapiens
tgcctgtcttcaggagtgtcac

SEQ ID NO: 9299085 - DNA, 22 bp, Homo sapiens
tgctcactgaactcttgctgtc

SEQ ID NO: 9299086 - DNA, 21 bp, Homo sapiens
tgctcagtctgtctccagctt

SEQ ID NO: 9299087 - DNA, 22 bp, Homo sapiens
tgctcagctggtgccagggtcc

SEQ ID NO: 9299088 - DNA, 22 bp, Homo sapiens
tgctatttttatcttgatcaaa

SEQ ID NO: 9299089 - DNA, 22 bp, Homo sapiens
tgctatttgggggctacatgat

SEQ ID NO: 9299090 - DNA, 22 bp, Homo sapiens
tgctagtgtgtgagatgttcaa

SEQ ID NO: 9299091 - DNA, 22 bp, Homo sapiens
tgctatctctatatccatttat

SEQ ID NO: 9299092 - DNA, 22 bp, Homo sapiens
tgcgttgcgctcctgcagcagg

SEQ ID NO: 9299093 - DNA, 22 bp, Homo sapiens
tgcgggttggtggcatatgcag

SEQ ID NO: 9299094 - DNA, 19 bp, Homo sapiens
tgctgaggatgcaagatcc

SEQ ID NO: 9299095 - DNA, 22 bp, Homo sapiens
tgctgaggaggtggctgtgctt

SEQ ID NO: 9299096 - DNA, 22 bp, Homo sapiens
tgctgaggaggtggctgtgctt

SEQ ID NO: 9299097 - DNA, 22 bp, Homo sapiens
tgctcttcaccattacatcatg

SEQ ID NO: 9299098 - DNA, 22 bp, Homo sapiens
tgctcttcacagtttcagcatc

SEQ ID NO: 9299099 - DNA, 22 bp, Homo sapiens
tgctctgttcagtgtatcttgt

SEQ ID NO: 9299100 - DNA, 22 bp, Homo sapiens
tgctcttattcatctgtagctc

SEQ ID NO: 9299101 - DNA, 22 bp, Homo sapiens
tgctctgtattctatggcagtt

SEQ ID NO: 9299102 - DNA, 22 bp, Homo sapiens
tgctgagtctgaaacagctcag

SEQ ID NO: 9299103 - DNA, 15 bp, Homo sapiens
tgctgagtgcccatt

SEQ ID NO: 9299104 - DNA, 22 bp, Homo sapiens
tgctgagtggcggcctcacttt

SEQ ID NO: 9299105 - DNA, 15 bp, Homo sapiens
tgctgagttctgctg

SEQ ID NO: 9299106 - DNA, 22 bp, Homo sapiens
tgctgagtgggattcctgtgct

SEQ ID NO: 9299107 - DNA, 22 bp, Homo sapiens
tgctgagtcgtattatttttta

SEQ ID NO: 9299108 - DNA, 22 bp, Homo sapiens
tgctgagtatttgtttgaataa

SEQ ID NO: 9299109 - DNA, 22 bp, Homo sapiens
tgctgagtacactaaagaacat

SEQ ID NO: 9299110 - DNA, 22 bp, Homo sapiens
tgctgagtactctcctgtgtag

SEQ ID NO: 9299111 - DNA, 22 bp, Homo sapiens
tgctgaggcagatgtctgtgac

SEQ ID NO: 9299112 - DNA, 20 bp, Homo sapiens
tgctgaggcctgaggcctgg

SEQ ID NO: 9299113 - DNA, 22 bp, Homo sapiens
tgctgaggtcaccttgctgcta

SEQ ID NO: 9299114 - DNA, 22 bp, Homo sapiens
tgctctgggcaacagcctccct

SEQ ID NO: 9299115 - DNA, 22 bp, Homo sapiens
tgctctgggattcagcagcctg

SEQ ID NO: 9299116 - DNA, 22 bp, Homo sapiens
tgctcctggatgaggtactcca

SEQ ID NO: 9299117 - DNA, 22 bp, Homo sapiens
tgctcgccccacatgccctcat

SEQ ID NO: 9299118 - DNA, 22 bp, Homo sapiens
tgctctagcctgtaaaacatga

SEQ ID NO: 9299119 - DNA, 22 bp, Homo sapiens
tgctctagccattgacctagct

SEQ ID NO: 9299120 - DNA, 22 bp, Homo sapiens
tgctctagagctattggcttcc

SEQ ID NO: 9299121 - DNA, 22 bp, Homo sapiens
tgctctagtgggtagagcattg

SEQ ID NO: 9299122 - DNA, 22 bp, Homo sapiens
tgctctagctcataggactcat

SEQ ID NO: 9299123 - DNA, 22 bp, Homo sapiens
tgctgtgaggttgagaaggaag

SEQ ID NO: 9299124 - DNA, 22 bp, Homo sapiens
tgcttagcacaagaataaactg

SEQ ID NO: 9299125 - DNA, 22 bp, Homo sapiens
tgcttacgagctattttcactt

SEQ ID NO: 9299126 - DNA, 22 bp, Homo sapiens
tgcttaatattgtgatgtaata

SEQ ID NO: 9299127 - DNA, 17 bp, Homo sapiens
tgcttcatcccgatcct

SEQ ID NO: 9299128 - DNA, 17 bp, Homo sapiens
tgcttcatcccgatcct

SEQ ID NO: 9299129 - DNA, 22 bp, Homo sapiens
tgcttcatgaggtagtggcagt

SEQ ID NO: 9299130 - DNA, 22 bp, Homo sapiens
tgcttcatgaggctgagagaag

SEQ ID NO: 9299131 - DNA, 22 bp, Homo sapiens
tgcttcattttgacttagccag

SEQ ID NO: 9299132 - DNA, 23 bp, Homo sapiens
tgcttctctgcttgacagttctg

SEQ ID NO: 9299133 - DNA, 22 bp, Homo sapiens
tgcttctcccaaccagggcctg

SEQ ID NO: 9299134 - DNA, 21 bp, Homo sapiens
tgcttctctagatcaactact

SEQ ID NO: 9299135 - DNA, 22 bp, Homo sapiens
tgcttcgaattgggcttctgga

SEQ ID NO: 9299136 - DNA, 22 bp, Homo sapiens
tgcttccctgaaggcacaggag

SEQ ID NO: 9299137 - DNA, 23 bp, Homo sapiens
tgctgggcagagctggtgctgag

SEQ ID NO: 9299138 - DNA, 22 bp, Homo sapiens
tgctgggctagaagctgaggcc

SEQ ID NO: 9299139 - DNA, 21 bp, Homo sapiens
tgctgggctgcaggggatgca

SEQ ID NO: 9299140 - DNA, 23 bp, Homo sapiens
tgctggtgtttttgggaccaggg

SEQ ID NO: 9299141 - DNA, 16 bp, Homo sapiens
tgctggggcgccgtcc

SEQ ID NO: 9299142 - DNA, 22 bp, Homo sapiens
tgctggggcagaagagccaaga

SEQ ID NO: 9299143 - DNA, 22 bp, Homo sapiens
tgctggggcagaagagccaaga

SEQ ID NO: 9299144 - DNA, 22 bp, Homo sapiens
tgctggggatccgtaccaaccc

SEQ ID NO: 9299145 - DNA, 20 bp, Homo sapiens
tgctggggacatacagggtg

SEQ ID NO: 9299146 - DNA, 22 bp, Homo sapiens
tgctggggagtgattgaccatc

SEQ ID NO: 9299147 - DNA, 23 bp, Homo sapiens
tgctggggtagtttgtggcacag

SEQ ID NO: 9299148 - DNA, 23 bp, Homo sapiens
tgctggggtagtttgtggcacag

SEQ ID NO: 9299149 - DNA, 22 bp, Homo sapiens
tgctggggtcatggggcgcccg

SEQ ID NO: 9299150 - DNA, 22 bp, Homo sapiens
tgctggggtctctccggtgccc

SEQ ID NO: 9299151 - DNA, 22 bp, Homo sapiens
tgctggagcggaggtgagccag

SEQ ID NO: 9299152 - DNA, 19 bp, Homo sapiens
tgctggaacatcagtagct

SEQ ID NO: 9299153 - DNA, 23 bp, Homo sapiens
tgctggagtttactcaggccagc

SEQ ID NO: 9299154 - DNA, 17 bp, Homo sapiens
tgctggcaacatacaaa

SEQ ID NO: 9299155 - DNA, 22 bp, Homo sapiens
tgctggcacgtggaccaggaga

SEQ ID NO: 9299156 - DNA, 17 bp, Homo sapiens
tgctggaggcggggtat

SEQ ID NO: 9299157 - DNA, 19 bp, Homo sapiens
tgctggaggttgacagggt

SEQ ID NO: 9299158 - DNA, 19 bp, Homo sapiens
tgctggaggttgacagggt

SEQ ID NO: 9299159 - DNA, 22 bp, Homo sapiens
tgctggaggccgagaagcagca

SEQ ID NO: 9299160 - DNA, 22 bp, Homo sapiens
tgctggaggcctgactgtgttt

SEQ ID NO: 9299161 - DNA, 22 bp, Homo sapiens
tgctggaggagtttactgtggc

SEQ ID NO: 9299162 - DNA, 16 bp, Homo sapiens
tggaggtgtttctagt

SEQ ID NO: 9299163 - DNA, 22 bp, Homo sapiens
tggatgcttaaatcgtttgaat

SEQ ID NO: 9299164 - DNA, 22 bp, Homo sapiens
tggatatccttgttaactttct

SEQ ID NO: 9299165 - DNA, 22 bp, Homo sapiens
tggaggctgtgtgcatgagacc

SEQ ID NO: 9299166 - DNA, 22 bp, Homo sapiens
tggaggtgggagggactgtcct

SEQ ID NO: 9299167 - DNA, 20 bp, Homo sapiens
tggaggtggtctgctgtcct

SEQ ID NO: 9299168 - DNA, 22 bp, Homo sapiens
tggagggcgcttagatggaggg

SEQ ID NO: 9299169 - DNA, 22 bp, Homo sapiens
tggagggctaagctgagggata

SEQ ID NO: 9299170 - DNA, 22 bp, Homo sapiens
tggaggcaggtggaggagtgaa

SEQ ID NO: 9299171 - DNA, 22 bp, Homo sapiens
tggaggcaggagacagggcaaa

SEQ ID NO: 9299172 - DNA, 19 bp, Homo sapiens
tggaggcaagacatggagg

SEQ ID NO: 9299173 - DNA, 22 bp, Homo sapiens
tggaggccgcgtagtctgagca

SEQ ID NO: 9299174 - DNA, 22 bp, Homo sapiens
tggaggccgcaatgcagtttcc

SEQ ID NO: 9299175 - DNA, 22 bp, Homo sapiens
tggaggcccccaggcaacagca

SEQ ID NO: 9299176 - DNA, 19 bp, Homo sapiens
tggaggcctcaggaaaaga

SEQ ID NO: 9299177 - DNA, 22 bp, Homo sapiens
tggaggccggactgagaggcat

SEQ ID NO: 9299178 - DNA, 19 bp, Homo sapiens
tggaggccaggacacaggt

SEQ ID NO: 9299179 - DNA, 22 bp, Homo sapiens
tggaggcccaagattctacagc

SEQ ID NO: 9299180 - DNA, 22 bp, Homo sapiens
tggaggcccacactgggtagat

SEQ ID NO: 9299181 - DNA, 22 bp, Homo sapiens
tggaggaaaaaaccaggcagag

SEQ ID NO: 9299182 - DNA, 22 bp, Homo sapiens
tggaggagaatttatggtcgaa

SEQ ID NO: 9299183 - DNA, 19 bp, Homo sapiens
tggagaggaaatgctgctc

SEQ ID NO: 9299184 - DNA, 22 bp, Homo sapiens
tggagaggtttaaacaaaagtt

SEQ ID NO: 9299185 - DNA, 22 bp, Homo sapiens
tggagaggttgaataacttgtc

SEQ ID NO: 9299186 - DNA, 22 bp, Homo sapiens
tggagcagagttcagcggggag

SEQ ID NO: 9299187 - DNA, 22 bp, Homo sapiens
tggagcagaggctgaggttggg

SEQ ID NO: 9299188 - DNA, 22 bp, Homo sapiens
tggagagaacagtgtctgaaag

SEQ ID NO: 9299189 - DNA, 22 bp, Homo sapiens
tggagaagtcaaagtgaacagg

SEQ ID NO: 9299190 - DNA, 22 bp, Homo sapiens
tggagagaaaaaagacagttct

SEQ ID NO: 9299191 - DNA, 22 bp, Homo sapiens
tggagagaaagttgaatggagg

SEQ ID NO: 9299192 - DNA, 19 bp, Homo sapiens
tggacttgagctgctttga

SEQ ID NO: 9299193 - DNA, 22 bp, Homo sapiens
tggagaggaaagtgcagttttg

SEQ ID NO: 9299194 - DNA, 22 bp, Homo sapiens
tggagagcaagtcgcagacatg

SEQ ID NO: 9299195 - DNA, 22 bp, Homo sapiens
tggagcaggtgccaggtgtgtg

SEQ ID NO: 9299196 - DNA, 22 bp, Homo sapiens
tggagcaggaagtctatggctg

SEQ ID NO: 9299197 - DNA, 22 bp, Homo sapiens
tggagccagcccaggcccctct

SEQ ID NO: 9299198 - DNA, 22 bp, Homo sapiens
tggagctggcttgtggaagttg

SEQ ID NO: 9299199 - DNA, 18 bp, Homo sapiens
tggagccattgccaccat

SEQ ID NO: 9299200 - DNA, 22 bp, Homo sapiens
tggaaacaaagctggatgtagt

SEQ ID NO: 9299201 - DNA, 22 bp, Homo sapiens
tggaaagaggtagaggatctgg

SEQ ID NO: 9299202 - DNA, 22 bp, Homo sapiens
tggaaagaggaagtgcccagca

SEQ ID NO: 9299203 - DNA, 22 bp, Homo sapiens
tggaaacaggagaatatcttct

SEQ ID NO: 9299204 - DNA, 22 bp, Homo sapiens
tggaaacacccacgcatgcata

SEQ ID NO: 9299205 - DNA, 23 bp, Homo sapiens
tggaaatctgggtgaggacagaa

SEQ ID NO: 9299206 - DNA, 19 bp, Homo sapiens
tggaacaaactgcaatgac

SEQ ID NO: 9299207 - DNA, 22 bp, Homo sapiens
tggaaattaacttggtacatat

SEQ ID NO: 9299208 - DNA, 18 bp, Homo sapiens
tggaaattgaaacagaaa

SEQ ID NO: 9299209 - DNA, 23 bp, Homo sapiens
tggaagaaaatggtttggctgtg

SEQ ID NO: 9299210 - DNA, 22 bp, Homo sapiens
tggaagaaaattcaatcgagtt

SEQ ID NO: 9299211 - DNA, 22 bp, Homo sapiens
tgctttaaaatggactgttttg

SEQ ID NO: 9299212 - DNA, 22 bp, Homo sapiens
tgctttataaccatttctgtgg

SEQ ID NO: 9299213 - DNA, 22 bp, Homo sapiens
tgctttattcgacatctggtag

SEQ ID NO: 9299214 - DNA, 22 bp, Homo sapiens
tgctttattcccttctgatgtg

SEQ ID NO: 9299215 - DNA, 22 bp, Homo sapiens
tgctttattcgacatctggtag

SEQ ID NO: 9299216 - DNA, 22 bp, Homo sapiens
tgctttattcagtctctgccat

SEQ ID NO: 9299217 - DNA, 22 bp, Homo sapiens
tgctttattaagagagaaattt

SEQ ID NO: 9299218 - DNA, 22 bp, Homo sapiens
tgctttatgttatcagaagggt

SEQ ID NO: 9299219 - DNA, 22 bp, Homo sapiens
tgctttattaagagagaaattt

SEQ ID NO: 9299220 - DNA, 22 bp, Homo sapiens
tgctttattcccttctgatgtg

SEQ ID NO: 9299221 - DNA, 22 bp, Homo sapiens
tgctttattcagtctctgccat

SEQ ID NO: 9299222 - DNA, 22 bp, Homo sapiens
tgctttattcagggtttacccc

SEQ ID NO: 9299223 - DNA, 22 bp, Homo sapiens
tgctttattcagggtttacccc

SEQ ID NO: 9299224 - DNA, 22 bp, Homo sapiens
tgctttctttagctcctgagtc

SEQ ID NO: 9299225 - DNA, 21 bp, Homo sapiens
tgctttatgggaaaaatgtca

SEQ ID NO: 9299226 - DNA, 22 bp, Homo sapiens
tgctttatggatttgtgtcctg

SEQ ID NO: 9299227 - DNA, 21 bp, Homo sapiens
tgctttatgggaaaaatgtca

SEQ ID NO: 9299228 - DNA, 22 bp, Homo sapiens
tgctttatgtggctgatactca

SEQ ID NO: 9299229 - DNA, 22 bp, Homo sapiens
tgctttatgttatcagaagggt

SEQ ID NO: 9299230 - DNA, 22 bp, Homo sapiens
tgctttatgtggctgatactca

SEQ ID NO: 9299231 - DNA, 20 bp, Homo sapiens
tgctttatgctatactttgt

SEQ ID NO: 9299232 - DNA, 18 bp, Homo sapiens
tgctttatgcttatataa

SEQ ID NO: 9299233 - DNA, 20 bp, Homo sapiens
tgctttatgctatactttgt

SEQ ID NO: 9299234 - DNA, 18 bp, Homo sapiens
tgctttatgcttatataa

SEQ ID NO: 9299235 - DNA, 22 bp, Homo sapiens
tgctttatggagcccatctcat

SEQ ID NO: 9299236 - DNA, 22 bp, Homo sapiens
tgctttatggatttgtgtcctg

SEQ ID NO: 9299237 - DNA, 22 bp, Homo sapiens
tgctttatggagcccatctcat

SEQ ID NO: 9299238 - DNA, 22 bp, Homo sapiens
tgctttatcaaagctatagtga

SEQ ID NO: 9299239 - DNA, 22 bp, Homo sapiens
tgctttatatctctcttcttag

SEQ ID NO: 9299240 - DNA, 22 bp, Homo sapiens
tgctttatcaaagctatagtga

SEQ ID NO: 9299241 - DNA, 22 bp, Homo sapiens
tgctttatctgtgagaacctga

SEQ ID NO: 9299242 - DNA, 22 bp, Homo sapiens
tgctttatctgtgagaacctga

SEQ ID NO: 9299243 - DNA, 22 bp, Homo sapiens
tgctttatctgacttggcgctg

SEQ ID NO: 9299244 - DNA, 22 bp, Homo sapiens
tgctttatctgacttggcgctg

SEQ ID NO: 9299245 - DNA, 22 bp, Homo sapiens
tgctttataacttagtttatgg

SEQ ID NO: 9299246 - DNA, 22 bp, Homo sapiens
tgctttatagacaaggaagtag

SEQ ID NO: 9299247 - DNA, 22 bp, Homo sapiens
tgctttataacttagtttatgg

SEQ ID NO: 9299248 - DNA, 22 bp, Homo sapiens
tgctttataaccatttctgtgg

SEQ ID NO: 9299249 - DNA, 22 bp, Homo sapiens
tgctttataggggattgcaggc

SEQ ID NO: 9299250 - DNA, 22 bp, Homo sapiens
tgctttatatctctcttcttag

SEQ ID NO: 9299251 - DNA, 22 bp, Homo sapiens
tgctttatagacaaggaagtag

SEQ ID NO: 9299252 - DNA, 22 bp, Homo sapiens
tgctttataggggattgcaggc

SEQ ID NO: 9299253 - DNA, 22 bp, Homo sapiens
tggaagagggagctgggtggcc

SEQ ID NO: 9299254 - DNA, 22 bp, Homo sapiens
tggaagaggccagaaagtggga

SEQ ID NO: 9299255 - DNA, 22 bp, Homo sapiens
tggaagactcaaggtggtgaat

SEQ ID NO: 9299256 - DNA, 23 bp, Homo sapiens
tggaagactcctctcttggctgc

SEQ ID NO: 9299257 - DNA, 22 bp, Homo sapiens
tggaagaccagacttcccgaac

SEQ ID NO: 9299258 - DNA, 22 bp, Homo sapiens
tggaagacggaaatctgtagat

SEQ ID NO: 9299259 - DNA, 22 bp, Homo sapiens
tggaagactatcccgtgatttt

SEQ ID NO: 9299260 - DNA, 22 bp, Homo sapiens
tggaagaccacaagcccttaac

SEQ ID NO: 9299261 - DNA, 22 bp, Homo sapiens
tggaagacattttggaccttgg

SEQ ID NO: 9299262 - DNA, 22 bp, Homo sapiens
tggaagacatactgttttctta

SEQ ID NO: 9299263 - DNA, 22 bp, Homo sapiens
tggaagacattattttgtttgt

SEQ ID NO: 9299264 - DNA, 22 bp, Homo sapiens
tggaagacattgctttcctttg

SEQ ID NO: 9299265 - DNA, 22 bp, Homo sapiens
tggaagagcaggcagacaatgc

SEQ ID NO: 9299266 - DNA, 22 bp, Homo sapiens
tggaagcatcacttcttgcctg

SEQ ID NO: 9299267 - DNA, 22 bp, Homo sapiens
tggaagcatagcagcgtgtgtg

SEQ ID NO: 9299268 - DNA, 22 bp, Homo sapiens
tggaagcagtgattcttgtctg

SEQ ID NO: 9299269 - DNA, 22 bp, Homo sapiens
tggaagcacttgggttttgttg

SEQ ID NO: 9299270 - DNA, 19 bp, Homo sapiens
tggaatcagcaagaatatt

SEQ ID NO: 9299271 - DNA, 22 bp, Homo sapiens
tggaaggggagctggaaagggg

SEQ ID NO: 9299272 - DNA, 20 bp, Homo sapiens
tggacacagccctgttgagt

SEQ ID NO: 9299273 - DNA, 22 bp, Homo sapiens
tggacacagtaggagctgcgca

SEQ ID NO: 9299274 - DNA, 23 bp, Homo sapiens
tggacagggtaactggtggtttt

SEQ ID NO: 9299275 - DNA, 21 bp, Homo sapiens
tggaccaggaaggtggtggtg

SEQ ID NO: 9299276 - DNA, 22 bp, Homo sapiens
tggcagcattaattattcaggt

SEQ ID NO: 9299277 - DNA, 22 bp, Homo sapiens
tggcagctacagacagaggtga

SEQ ID NO: 9299278 - DNA, 22 bp, Homo sapiens
tggcagagtcatcacatctgga

SEQ ID NO: 9299279 - DNA, 22 bp, Homo sapiens
tggcagagtctctcctttccag

SEQ ID NO: 9299280 - DNA, 22 bp, Homo sapiens
tggcagagtcatcacatctgga

SEQ ID NO: 9299281 - DNA, 22 bp, Homo sapiens
tggcagagtaggatggccctgt

SEQ ID NO: 9299282 - DNA, 22 bp, Homo sapiens
tggcagagtctgggcttgggca

SEQ ID NO: 9299283 - DNA, 22 bp, Homo sapiens
tggcagagtgcagaagaggcat

SEQ ID NO: 9299284 - DNA, 21 bp, Homo sapiens
tggcagagtgcagtctataca

SEQ ID NO: 9299285 - DNA, 22 bp, Homo sapiens
tggcagagtgcggcatcccctg

SEQ ID NO: 9299286 - DNA, 22 bp, Homo sapiens
tggcagagttcgctgtgccttt

SEQ ID NO: 9299287 - DNA, 22 bp, Homo sapiens
tggcagagttcgctcctattca

SEQ ID NO: 9299288 - DNA, 22 bp, Homo sapiens
tggcagagtggaccatactcaa

SEQ ID NO: 9299289 - DNA, 18 bp, Homo sapiens
tggcagagtgtctgttct

SEQ ID NO: 9299290 - DNA, 22 bp, Homo sapiens
tggcagagttatgggtatttat

SEQ ID NO: 9299291 - DNA, 21 bp, Homo sapiens
tggcagagttgagtagttatg

SEQ ID NO: 9299292 - DNA, 22 bp, Homo sapiens
tggcagagttggaggtggaaga

SEQ ID NO: 9299293 - DNA, 20 bp, Homo sapiens
tggcagagttgtcccaccca

SEQ ID NO: 9299294 - DNA, 22 bp, Homo sapiens
tggcagctgattagatggtgcc

SEQ ID NO: 9299295 - DNA, 22 bp, Homo sapiens
tggcagctgaggggaggctttg

SEQ ID NO: 9299296 - DNA, 22 bp, Homo sapiens
tggcaggaaagtaacagagcac

SEQ ID NO: 9299297 - DNA, 22 bp, Homo sapiens
tggcaggaagacgtggggcacc

SEQ ID NO: 9299298 - DNA, 22 bp, Homo sapiens
tggcagggcctgaatcttatac

SEQ ID NO: 9299299 - DNA, 22 bp, Homo sapiens
tggcagggcctgctcatcatcc

SEQ ID NO: 9299300 - DNA, 22 bp, Homo sapiens
tggcagggcctaccccaatatc

SEQ ID NO: 9299301 - DNA, 22 bp, Homo sapiens
tggcagggagttgcaggatttc

SEQ ID NO: 9299302 - DNA, 22 bp, Homo sapiens
tggcaggggaggtgcttgctta

SEQ ID NO: 9299303 - DNA, 18 bp, Homo sapiens
tggcaggggcagtacgcc

SEQ ID NO: 9299304 - DNA, 22 bp, Homo sapiens
tggcagggtacaccttaacacc

SEQ ID NO: 9299305 - DNA, 18 bp, Homo sapiens
tggcaggggcagtacgcc

SEQ ID NO: 9299306 - DNA, 21 bp, Homo sapiens
tggcaggggtagtagtacagc

SEQ ID NO: 9299307 - DNA, 19 bp, Homo sapiens
tggcagggagtgatattag

SEQ ID NO: 9299308 - DNA, 22 bp, Homo sapiens
tggcagggagttcgttcacaac

SEQ ID NO: 9299309 - DNA, 18 bp, Homo sapiens
tggcagggaggaaatata

SEQ ID NO: 9299310 - DNA, 22 bp, Homo sapiens
tggcacagacagatcaggagtc

SEQ ID NO: 9299311 - DNA, 22 bp, Homo sapiens
tggcacagacagatcaggagtc

SEQ ID NO: 9299312 - DNA, 21 bp, Homo sapiens
tggcacagcaagtgggctcat

SEQ ID NO: 9299313 - DNA, 22 bp, Homo sapiens
tggcacagtgctggatggtgct

SEQ ID NO: 9299314 - DNA, 17 bp, Homo sapiens
tggcacagaggtgctat

SEQ ID NO: 9299315 - DNA, 22 bp, Homo sapiens
tggcaagttcatatggtttaag

SEQ ID NO: 9299316 - DNA, 22 bp, Homo sapiens
tggcaagttggtgggtttagtg

SEQ ID NO: 9299317 - DNA, 23 bp, Homo sapiens
tggcaactagtggtgaagagcct

SEQ ID NO: 9299318 - DNA, 22 bp, Homo sapiens
tggcactcactctcagagtctg

SEQ ID NO: 9299319 - DNA, 22 bp, Homo sapiens
tggcagagaacacacatgattc

SEQ ID NO: 9299320 - DNA, 22 bp, Homo sapiens
tggcactgagcagccgcggcag

SEQ ID NO: 9299321 - DNA, 22 bp, Homo sapiens
tggcactgcactttaagattta

SEQ ID NO: 9299322 - DNA, 22 bp, Homo sapiens
tggcagagaataaatcttgact

SEQ ID NO: 9299323 - DNA, 22 bp, Homo sapiens
tggcagagacaaggccgggcct

SEQ ID NO: 9299324 - DNA, 22 bp, Homo sapiens
tggcagagaacctgggctttgt

SEQ ID NO: 9299325 - DNA, 22 bp, Homo sapiens
tggcagagaacacggctgatct

SEQ ID NO: 9299326 - DNA, 22 bp, Homo sapiens
tggcagagaacacggctgatct

SEQ ID NO: 9299327 - DNA, 22 bp, Homo sapiens
tggcagagactcctcctgggag

SEQ ID NO: 9299328 - DNA, 23 bp, Homo sapiens
tggcagagacccagaatctacat

SEQ ID NO: 9299329 - DNA, 22 bp, Homo sapiens
tggcagagagagtgcagtcgac

SEQ ID NO: 9299330 - DNA, 22 bp, Homo sapiens
tggcagagagactctccttgat

SEQ ID NO: 9299331 - DNA, 22 bp, Homo sapiens
tggcagagagactctccttgat

SEQ ID NO: 9299332 - DNA, 22 bp, Homo sapiens
tggcagagcccagaactgagca

SEQ ID NO: 9299333 - DNA, 22 bp, Homo sapiens
tggcagagcaaaaagatagaat

SEQ ID NO: 9299334 - DNA, 22 bp, Homo sapiens
tggcagagagagtgcagtcgac

SEQ ID NO: 9299335 - DNA, 22 bp, Homo sapiens
tggcagagatgaagagttgttt

SEQ ID NO: 9299336 - DNA, 22 bp, Homo sapiens
tggcagagccttgccaaactcc

SEQ ID NO: 9299337 - DNA, 22 bp, Homo sapiens
tggcagagcccagactccagtc

SEQ ID NO: 9299338 - DNA, 22 bp, Homo sapiens
tggcagagcccagactccagtc

SEQ ID NO: 9299339 - DNA, 16 bp, Homo sapiens
tggcagaggttcagcc

SEQ ID NO: 9299340 - DNA, 22 bp, Homo sapiens
tggcagaggtatattgggagga

SEQ ID NO: 9299341 - DNA, 22 bp, Homo sapiens
tggcagaggaaaaagtcactgg

SEQ ID NO: 9299342 - DNA, 22 bp, Homo sapiens
tggcagagctggctgcggatga

SEQ ID NO: 9299343 - DNA, 17 bp, Homo sapiens
tggccagagcaggcccc

SEQ ID NO: 9299344 - DNA, 22 bp, Homo sapiens
tggccagaacctgcagtaggcc

SEQ ID NO: 9299345 - DNA, 22 bp, Homo sapiens
tggccactcagggatgcaggaa

SEQ ID NO: 9299346 - DNA, 22 bp, Homo sapiens
tggccactcctccctgcaggct

SEQ ID NO: 9299347 - DNA, 22 bp, Homo sapiens
tggccacatgcgtctgtgaggc

SEQ ID NO: 9299348 - DNA, 22 bp, Homo sapiens
tggccagcccttcagccatgcc

SEQ ID NO: 9299349 - DNA, 22 bp, Homo sapiens
tggccagagttgagggggtttc

SEQ ID NO: 9299350 - DNA, 22 bp, Homo sapiens
tggccagcagagttcactctct

SEQ ID NO: 9299351 - DNA, 22 bp, Homo sapiens
tggccagccagaaagaagcctt

SEQ ID NO: 9299352 - DNA, 22 bp, Homo sapiens
tggccagccttgtcatcgcttt

SEQ ID NO: 9299353 - DNA, 22 bp, Homo sapiens
tggccagcctggtgcttgctcc

SEQ ID NO: 9299354 - DNA, 22 bp, Homo sapiens
tggccagtaatagcttctggtg

SEQ ID NO: 9299355 - DNA, 22 bp, Homo sapiens
tggccagtagagctcagatagt

SEQ ID NO: 9299356 - DNA, 22 bp, Homo sapiens
tggccagtagataggcaggcaa

SEQ ID NO: 9299357 - DNA, 22 bp, Homo sapiens
tggcagtggataggggagcggt

SEQ ID NO: 9299358 - DNA, 22 bp, Homo sapiens
tggcagtggctcagagtgcaga

SEQ ID NO: 9299359 - DNA, 22 bp, Homo sapiens
tggcagtggctcagagtgcaga

SEQ ID NO: 9299360 - DNA, 22 bp, Homo sapiens
tggcatctccgacagtcttgat

SEQ ID NO: 9299361 - DNA, 22 bp, Homo sapiens
tggcatggcgtggcatcgtgtg

SEQ ID NO: 9299362 - DNA, 22 bp, Homo sapiens
tggcagtagatccagtctctct

SEQ ID NO: 9299363 - DNA, 16 bp, Homo sapiens
tggcaggtttttatct

SEQ ID NO: 9299364 - DNA, 21 bp, Homo sapiens
tggcaggttcaaaggcctatc

SEQ ID NO: 9299365 - DNA, 22 bp, Homo sapiens
tggcaggttggcctttggttca

SEQ ID NO: 9299366 - DNA, 22 bp, Homo sapiens
tggcaggtttcctcctcatagt

SEQ ID NO: 9299367 - DNA, 22 bp, Homo sapiens
tggcaggtttcgttaaaaatgg

SEQ ID NO: 9299368 - DNA, 18 bp, Homo sapiens
tggcagtgaggtaggcat

SEQ ID NO: 9299369 - DNA, 22 bp, Homo sapiens
tggcagtgatgcggcaggacat

SEQ ID NO: 9299370 - DNA, 22 bp, Homo sapiens
tggcagggtcttgctgtgttgc

SEQ ID NO: 9299371 - DNA, 22 bp, Homo sapiens
tggcagggtgccagttgcgagt

SEQ ID NO: 9299372 - DNA, 22 bp, Homo sapiens
tggcagggtgccagttgcgagt

SEQ ID NO: 9299373 - DNA, 19 bp, Homo sapiens
tggcaggtagtgagcagtc

SEQ ID NO: 9299374 - DNA, 22 bp, Homo sapiens
tggcaggtcatgagtggccacc

SEQ ID NO: 9299375 - DNA, 22 bp, Homo sapiens
tggcagggtggcaacttttggt

SEQ ID NO: 9299376 - DNA, 20 bp, Homo sapiens
tggcaggtggcctcagttcc

SEQ ID NO: 9299377 - DNA, 22 bp, Homo sapiens
tggcaggtggagacagcagagc

SEQ ID NO: 9299378 - DNA, 22 bp, Homo sapiens
tggcaggtggcacagcctggga

SEQ ID NO: 9299379 - DNA, 22 bp, Homo sapiens
tggcaggttaacttacaactgt

SEQ ID NO: 9299380 - DNA, 22 bp, Homo sapiens
tggcaggttatgcgggccacat

SEQ ID NO: 9299381 - DNA, 22 bp, Homo sapiens
tggcaggtggctctggcattct

SEQ ID NO: 9299382 - DNA, 23 bp, Homo sapiens
tggcaggtggttagatgttttgt

SEQ ID NO: 9299383 - DNA, 18 bp, Homo sapiens
tggcaggtccagctgtgg

SEQ ID NO: 9299384 - DNA, 22 bp, Homo sapiens
tggcaggtccactcacagatct

SEQ ID NO: 9299385 - DNA, 22 bp, Homo sapiens
tggcaggtgaagttgttaggga

SEQ ID NO: 9299386 - DNA, 22 bp, Homo sapiens
tggcaggtgcctgtaatctcag

SEQ ID NO: 9299387 - DNA, 22 bp, Homo sapiens
tggcaggtgccatgggctcaga

SEQ ID NO: 9299388 - DNA, 22 bp, Homo sapiens
tggcaggtgcacttttggtttc

SEQ ID NO: 9299389 - DNA, 22 bp, Homo sapiens
tggccctgtgtgcaggctgcac

SEQ ID NO: 9299390 - DNA, 23 bp, Homo sapiens
tggccctgtgcatgctgcttccc

SEQ ID NO: 9299391 - DNA, 22 bp, Homo sapiens
tggcctcaaccgtcctaagcac

SEQ ID NO: 9299392 - DNA, 22 bp, Homo sapiens
tggcccttctgagcacagggcc

SEQ ID NO: 9299393 - DNA, 22 bp, Homo sapiens
tggccctttgggtgcaggggca

SEQ ID NO: 9299394 - DNA, 20 bp, Homo sapiens
tggccctgttttctccaggc

SEQ ID NO: 9299395 - DNA, 22 bp, Homo sapiens
tggcctgactgtcaggctgtat

SEQ ID NO: 9299396 - DNA, 22 bp, Homo sapiens
tggcctctgtgggagctgagca

SEQ ID NO: 9299397 - DNA, 20 bp, Homo sapiens
tggcctctgagatgccacgg

SEQ ID NO: 9299398 - DNA, 22 bp, Homo sapiens
tggcctctgggaaagcagattc

SEQ ID NO: 9299399 - DNA, 22 bp, Homo sapiens
tggcctgccactgccacgccac

SEQ ID NO: 9299400 - DNA, 22 bp, Homo sapiens
tggcctggaacctggcagggac

SEQ ID NO: 9299401 - DNA, 22 bp, Homo sapiens
tggcccagtcagcaggagaggg

SEQ ID NO: 9299402 - DNA, 22 bp, Homo sapiens
tggcccaggaggccagagggca

SEQ ID NO: 9299403 - DNA, 22 bp, Homo sapiens
tggcccagctgcagatggtgga

SEQ ID NO: 9299404 - DNA, 22 bp, Homo sapiens
tggcccagggcacagcagggag

SEQ ID NO: 9299405 - DNA, 22 bp, Homo sapiens
tggcccaggggctcttggtgtt

SEQ ID NO: 9299406 - DNA, 22 bp, Homo sapiens
tggcccaggtctctctgagccc

SEQ ID NO: 9299407 - DNA, 22 bp, Homo sapiens
tggcccagctcagggtgggcgg

SEQ ID NO: 9299408 - DNA, 22 bp, Homo sapiens
tggccagtttgctcaggcagtc

SEQ ID NO: 9299409 - DNA, 22 bp, Homo sapiens
tggccagttgaagacaatgctc

SEQ ID NO: 9299410 - DNA, 22 bp, Homo sapiens
tggccagtgttggctagggaca

SEQ ID NO: 9299411 - DNA, 22 bp, Homo sapiens
tggccagtgtgtgctgccggct

SEQ ID NO: 9299412 - DNA, 22 bp, Homo sapiens
tggccagtgtcggaggccagga

SEQ ID NO: 9299413 - DNA, 22 bp, Homo sapiens
tggccagtggggttgagcagga

SEQ ID NO: 9299414 - DNA, 22 bp, Homo sapiens
tggccagtctgtggaagccagg

SEQ ID NO: 9299415 - DNA, 22 bp, Homo sapiens
tggccagtcttagctgtgcctg

SEQ ID NO: 9299416 - DNA, 22 bp, Homo sapiens
tggccagtgattaatgacgctt

SEQ ID NO: 9299417 - DNA, 22 bp, Homo sapiens
tggccagtggactaagttctga

SEQ ID NO: 9299418 - DNA, 22 bp, Homo sapiens
tggccagtgcctgccagtgcag

SEQ ID NO: 9299419 - DNA, 23 bp, Homo sapiens
tggctctgagaggttcagatgct

SEQ ID NO: 9299420 - DNA, 21 bp, Homo sapiens
tggctctgagcctcatggctg

SEQ ID NO: 9299421 - DNA, 22 bp, Homo sapiens
tggctctgagtctgcccttggc

SEQ ID NO: 9299422 - DNA, 17 bp, Homo sapiens
tggctctgaggctgaat

SEQ ID NO: 9299423 - DNA, 23 bp, Homo sapiens
tggctctgagcttcctggtggcc

SEQ ID NO: 9299424 - DNA, 22 bp, Homo sapiens
tggctctgagctgcaaagctgc

SEQ ID NO: 9299425 - DNA, 22 bp, Homo sapiens
tggctctgagacacaggctctc

SEQ ID NO: 9299426 - DNA, 22 bp, Homo sapiens
tggctctgagacacaggctctc

SEQ ID NO: 9299427 - DNA, 22 bp, Homo sapiens
tggctctgccactaacttggta

SEQ ID NO: 9299428 - DNA, 22 bp, Homo sapiens
tggctctgccacctttccctaa

SEQ ID NO: 9299429 - DNA, 18 bp, Homo sapiens
tggctctgcagccagatg

SEQ ID NO: 9299430 - DNA, 18 bp, Homo sapiens
tggctctgcagccagatg

SEQ ID NO: 9299431 - DNA, 22 bp, Homo sapiens
tggctctgccccatacccctgc

SEQ ID NO: 9299432 - DNA, 18 bp, Homo sapiens
tggctctgccactcaccg

SEQ ID NO: 9299433 - DNA, 22 bp, Homo sapiens
tggctctgccactaacttggta

SEQ ID NO: 9299434 - DNA, 22 bp, Homo sapiens
tggctctgatcagatgtccagt

SEQ ID NO: 9299435 - DNA, 22 bp, Homo sapiens
tggctctgatgggaggtattgg

SEQ ID NO: 9299436 - DNA, 22 bp, Homo sapiens
tggctctgcagcagtgtgcgtg

SEQ ID NO: 9299437 - DNA, 22 bp, Homo sapiens
tggctctgcacctcagtgtacc

SEQ ID NO: 9299438 - DNA, 21 bp, Homo sapiens
tggctctgctcagagcagtcc

SEQ ID NO: 9299439 - DNA, 21 bp, Homo sapiens
tggctctgctcagagcagtcc

SEQ ID NO: 9299440 - DNA, 22 bp, Homo sapiens
tggctctgcgtctgttcgtggg

SEQ ID NO: 9299441 - DNA, 18 bp, Homo sapiens
tggctctggacttgctcc

SEQ ID NO: 9299442 - DNA, 22 bp, Homo sapiens
tggctctggagctcctgggccc

SEQ ID NO: 9299443 - DNA, 22 bp, Homo sapiens
tggctctgctgaacctagtgca

SEQ ID NO: 9299444 - DNA, 22 bp, Homo sapiens
tggctctggagctggcggctga

SEQ ID NO: 9299445 - DNA, 22 bp, Homo sapiens
tggctctggattaatctaggaa

SEQ ID NO: 9299446 - DNA, 22 bp, Homo sapiens
tggctctggccaccgggagggc

SEQ ID NO: 9299447 - DNA, 22 bp, Homo sapiens
tggctctgggaatgggaagatg

SEQ ID NO: 9299448 - DNA, 22 bp, Homo sapiens
tggctctgggcaccgtgtccac

SEQ ID NO: 9299449 - DNA, 22 bp, Homo sapiens
tggctctgggaatctgttgctt

SEQ ID NO: 9299450 - DNA, 22 bp, Homo sapiens
tggctctggcgtgaagcccaga

SEQ ID NO: 9299451 - DNA, 22 bp, Homo sapiens
tggctctgtgcttctagtatct

SEQ ID NO: 9299452 - DNA, 22 bp, Homo sapiens
tggctctgtgaacagacgactg

SEQ ID NO: 9299453 - DNA, 22 bp, Homo sapiens
tggctctggggacagtaagtcc

SEQ ID NO: 9299454 - DNA, 22 bp, Homo sapiens
tggctctgtcgccgtttggaat

SEQ ID NO: 9299455 - DNA, 22 bp, Homo sapiens
tggctctgtggatgttctgacc

SEQ ID NO: 9299456 - DNA, 22 bp, Homo sapiens
tggctctgtggtcttagcatgc

SEQ ID NO: 9299457 - DNA, 23 bp, Homo sapiens
tggctctgtggatccctcaggag

SEQ ID NO: 9299458 - DNA, 22 bp, Homo sapiens
tggctctgttgaggtatggatt

SEQ ID NO: 9299459 - DNA, 22 bp, Homo sapiens
tggctctgttcgccatcaggag

SEQ ID NO: 9299460 - DNA, 22 bp, Homo sapiens
tggctctgttcgccatcaggag

SEQ ID NO: 9299461 - DNA, 22 bp, Homo sapiens
tggctctgttgtaaagaaattt

SEQ ID NO: 9299462 - DNA, 22 bp, Homo sapiens
tggctctgttgctcgcagtttt

SEQ ID NO: 9299463 - DNA, 22 bp, Homo sapiens
tggctctgttgaggtatggatt

SEQ ID NO: 9299464 - DNA, 23 bp, Homo sapiens
tggctctgtgtcacatacaggat

SEQ ID NO: 9299465 - DNA, 22 bp, Homo sapiens
tggctctgtgtctcccagcagc

SEQ ID NO: 9299466 - DNA, 22 bp, Homo sapiens
tggctctgtgtctcccagcagc

SEQ ID NO: 9299467 - DNA, 21 bp, Homo sapiens
tggctctgttcaatatatgga

SEQ ID NO: 9299468 - DNA, 22 bp, Homo sapiens
tggctctgttgtgctgagccag

SEQ ID NO: 9299469 - DNA, 19 bp, Homo sapiens
tggctctgtttctctggag

SEQ ID NO: 9299470 - DNA, 22 bp, Homo sapiens
tggctctgtttgttaactagac

SEQ ID NO: 9299471 - DNA, 22 bp, Homo sapiens
tggctctgttttatgagtacca

SEQ ID NO: 9299472 - DNA, 22 bp, Homo sapiens
tggctgctgtgggtagagggat

SEQ ID NO: 9299473 - DNA, 22 bp, Homo sapiens
tggctgcttgttttagtgaggc

SEQ ID NO: 9299474 - DNA, 22 bp, Homo sapiens
tggctgagttctccaggagtag

SEQ ID NO: 9299475 - DNA, 22 bp, Homo sapiens
tggctcagagccttgagagctg

SEQ ID NO: 9299476 - DNA, 22 bp, Homo sapiens
tggctcagagccttgagagctg

SEQ ID NO: 9299477 - DNA, 22 bp, Homo sapiens
tggctcagataattcaaggggc

SEQ ID NO: 9299478 - DNA, 22 bp, Homo sapiens
tggcggctcaggaggggcagtt

SEQ ID NO: 9299479 - DNA, 22 bp, Homo sapiens
tggcgtctctcataagtatgtg

SEQ ID NO: 9299480 - DNA, 22 bp, Homo sapiens
tggctagtaggtgagtagtgct

SEQ ID NO: 9299481 - DNA, 21 bp, Homo sapiens
tggccttgagagtctccttgc

SEQ ID NO: 9299482 - DNA, 22 bp, Homo sapiens
tggccttgagatgcagcagcca

SEQ ID NO: 9299483 - DNA, 22 bp, Homo sapiens
tggccttgagtggtctccgccc

SEQ ID NO: 9299484 - DNA, 22 bp, Homo sapiens
tggccttgataactggggagag

SEQ ID NO: 9299485 - DNA, 18 bp, Homo sapiens
tggccttgaatcatatca

SEQ ID NO: 9299486 - DNA, 22 bp, Homo sapiens
tggccttgagaatgtccctagg

SEQ ID NO: 9299487 - DNA, 22 bp, Homo sapiens
tggccttgagagatcaaaaggt

SEQ ID NO: 9299488 - DNA, 22 bp, Homo sapiens
tggccttggagaggcacggccc

SEQ ID NO: 9299489 - DNA, 22 bp, Homo sapiens
tggccttggacagagcgctcct

SEQ ID NO: 9299490 - DNA, 22 bp, Homo sapiens
tggccttgcccagcgcctaggt

SEQ ID NO: 9299491 - DNA, 22 bp, Homo sapiens
tggccttgccacatttgtcagc

SEQ ID NO: 9299492 - DNA, 22 bp, Homo sapiens
tggccttgattatgccagtaga

SEQ ID NO: 9299493 - DNA, 22 bp, Homo sapiens
tggcctgtcttgttgtgctaga

SEQ ID NO: 9299494 - DNA, 22 bp, Homo sapiens
tggcctgttgctcctaggggtc

SEQ ID NO: 9299495 - DNA, 22 bp, Homo sapiens
tggccttgaactcatcacgtgg

SEQ ID NO: 9299496 - DNA, 22 bp, Homo sapiens
tggccttgaaccaggtctccac

SEQ ID NO: 9299497 - DNA, 20 bp, Homo sapiens
tggccttggggagctcacac

SEQ ID NO: 9299498 - DNA, 22 bp, Homo sapiens
tggccttgggcaggtggcctgc

SEQ ID NO: 9299499 - DNA, 22 bp, Homo sapiens
tggccttggcagtgagaagagt

SEQ ID NO: 9299500 - DNA, 22 bp, Homo sapiens
tggccttggctgagagatttaa

SEQ ID NO: 9299501 - DNA, 22 bp, Homo sapiens
tggccttggccttttctgctcc

SEQ ID NO: 9299502 - DNA, 22 bp, Homo sapiens
tggccttggccgtgctggggtc

SEQ ID NO: 9299503 - DNA, 22 bp, Homo sapiens
tggccttggtcctctttgcaat

SEQ ID NO: 9299504 - DNA, 22 bp, Homo sapiens
tggccttgggtccttagcatca

SEQ ID NO: 9299505 - DNA, 22 bp, Homo sapiens
tggccttggtcacaatgcaaac

SEQ ID NO: 9299506 - DNA, 15 bp, Homo sapiens
tggccttgtggttgt

SEQ ID NO: 9299507 - DNA, 22 bp, Homo sapiens
tggccttgtctctcagaaccgc

SEQ ID NO: 9299508 - DNA, 22 bp, Homo sapiens
tggccttgtgttttagagaaag

SEQ ID NO: 9299509 - DNA, 22 bp, Homo sapiens
tggccttgtgtttaagcaagaa

SEQ ID NO: 9299510 - DNA, 22 bp, Homo sapiens
tggccttgttctctctcccatc

SEQ ID NO: 9299511 - DNA, 22 bp, Homo sapiens
tggctcagccagccctaggaac

SEQ ID NO: 9299512 - DNA, 22 bp, Homo sapiens
tggctcagtagcagtgtggtca

SEQ ID NO: 9299513 - DNA, 22 bp, Homo sapiens
tggctcaggggtctggctctgt

SEQ ID NO: 9299514 - DNA, 22 bp, Homo sapiens
tggctgggagctggaactgggc

SEQ ID NO: 9299515 - DNA, 22 bp, Homo sapiens
tggctgggcccccacctgcctc

SEQ ID NO: 9299516 - DNA, 22 bp, Homo sapiens
tggctggacagtgggcagtgga

SEQ ID NO: 9299517 - DNA, 22 bp, Homo sapiens
tggctgggccgggccttgtgcc

SEQ ID NO: 9299518 - DNA, 22 bp, Homo sapiens
tggctgggggtgctatagctgc

SEQ ID NO: 9299519 - DNA, 19 bp, Homo sapiens
tggctgggtgccaatggcc

SEQ ID NO: 9299520 - DNA, 22 bp, Homo sapiens
tggctgggtgctatccagtact

SEQ ID NO: 9299521 - DNA, 22 bp, Homo sapiens
tggcttcttagaccagtggcct

SEQ ID NO: 9299522 - DNA, 22 bp, Homo sapiens
tggctttcgctatagagcacgg

SEQ ID NO: 9299523 - DNA, 22 bp, Homo sapiens
tgggaaagactcaggacaggag

SEQ ID NO: 9299524 - DNA, 19 bp, Homo sapiens
tgggaaagtaacatacaaa

SEQ ID NO: 9299525 - DNA, 22 bp, Homo sapiens
tgggaagaggagcactggaatg

SEQ ID NO: 9299526 - DNA, 22 bp, Homo sapiens
tgggaagaggcgggaggctgtt

SEQ ID NO: 9299527 - DNA, 22 bp, Homo sapiens
tgggaaggttagcagtttgtca

SEQ ID NO: 9299528 - DNA, 22 bp, Homo sapiens
tgggacacaaaccagaccagga

SEQ ID NO: 9299529 - DNA, 22 bp, Homo sapiens
tgggacagggaatctgatcccc

SEQ ID NO: 9299530 - DNA, 22 bp, Homo sapiens
tgggacacagaaaaggcaggtt

SEQ ID NO: 9299531 - DNA, 22 bp, Homo sapiens
tgggacaggttggagagaagca

SEQ ID NO: 9299532 - DNA, 22 bp, Homo sapiens
tgggacaggttggagagaagca

SEQ ID NO: 9299533 - DNA, 22 bp, Homo sapiens
tgggactgctcttgctggggtc

SEQ ID NO: 9299534 - DNA, 22 bp, Homo sapiens
tgggactcactcttttggccag

SEQ ID NO: 9299535 - DNA, 21 bp, Homo sapiens
tgggacctatttcaactggat

SEQ ID NO: 9299536 - DNA, 22 bp, Homo sapiens
tgggacctgccctggccccatc

SEQ ID NO: 9299537 - DNA, 23 bp, Homo sapiens
tgggacctgtttgcccacagatg

SEQ ID NO: 9299538 - DNA, 22 bp, Homo sapiens
tgggacagtgaccccagaggtc

SEQ ID NO: 9299539 - DNA, 21 bp, Homo sapiens
tgggacagtgatggctcctcc

SEQ ID NO: 9299540 - DNA, 22 bp, Homo sapiens
tgggacagtgtgccttgctcct

SEQ ID NO: 9299541 - DNA, 22 bp, Homo sapiens
tgggacagttgtcctccactct

SEQ ID NO: 9299542 - DNA, 22 bp, Homo sapiens
tgggaagagttagagacagctg

SEQ ID NO: 9299543 - DNA, 22 bp, Homo sapiens
tgggaagagttagagacagctg

SEQ ID NO: 9299544 - DNA, 22 bp, Homo sapiens
tgggaagatatgagtgaccaac

SEQ ID NO: 9299545 - DNA, 22 bp, Homo sapiens
tgggaagatggagtgacaggca

SEQ ID NO: 9299546 - DNA, 22 bp, Homo sapiens
tgggaagggccgatggagcctc

SEQ ID NO: 9299547 - DNA, 22 bp, Homo sapiens
tgggaagggagagtgtcctgga

SEQ ID NO: 9299548 - DNA, 22 bp, Homo sapiens
tgggaaggcgtggaagtagaag

SEQ ID NO: 9299549 - DNA, 22 bp, Homo sapiens
tgggaagggtcaacagctggaa

SEQ ID NO: 9299550 - DNA, 22 bp, Homo sapiens
tgggaagggtctgaatctgaga

SEQ ID NO: 9299551 - DNA, 21 bp, Homo sapiens
tgggagagggctcagctaccc

SEQ ID NO: 9299552 - DNA, 22 bp, Homo sapiens
tgggagacactggtgggagctt

SEQ ID NO: 9299553 - DNA, 21 bp, Homo sapiens
tgggagaccgccttcctggga

SEQ ID NO: 9299554 - DNA, 22 bp, Homo sapiens
tgggagaaactgtctctcccac

SEQ ID NO: 9299555 - DNA, 22 bp, Homo sapiens
tgggagcaagctggtgctggag

SEQ ID NO: 9299556 - DNA, 22 bp, Homo sapiens
tgggagctcctggagggcagga

SEQ ID NO: 9299557 - DNA, 22 bp, Homo sapiens
tgggaggagccctctgggaagg

SEQ ID NO: 9299558 - DNA, 22 bp, Homo sapiens
tgggaggatcgcttgagcccag

SEQ ID NO: 9299559 - DNA, 22 bp, Homo sapiens
tgggaggatctcttgaggccag

SEQ ID NO: 9299560 - DNA, 22 bp, Homo sapiens
tgggaggaatgtcactgagcca

SEQ ID NO: 9299561 - DNA, 22 bp, Homo sapiens
tgtcacaaaaatcagtaattgc

SEQ ID NO: 9299562 - DNA, 22 bp, Homo sapiens
tgtcaaaaccagcaattttgtt

SEQ ID NO: 9299563 - DNA, 22 bp, Homo sapiens
tgtcaaaaataagagagattgt

SEQ ID NO: 9299564 - DNA, 22 bp, Homo sapiens
tgtatacatgtgttcatgcatg

SEQ ID NO: 9299565 - DNA, 22 bp, Homo sapiens
tgtatatacatacacacatgaa

SEQ ID NO: 9299566 - DNA, 18 bp, Homo sapiens
tgtagaaaagataggaat

SEQ ID NO: 9299567 - DNA, 22 bp, Homo sapiens
tgtagatattaattattccttt

SEQ ID NO: 9299568 - DNA, 22 bp, Homo sapiens
tgtagatagtgatttatgacca

SEQ ID NO: 9299569 - DNA, 22 bp, Homo sapiens
tgtagaggaggaaactgaggct

SEQ ID NO: 9299570 - DNA, 18 bp, Homo sapiens
tgtagagccaggtttgcc

SEQ ID NO: 9299571 - DNA, 22 bp, Homo sapiens
tgtagaggaaagatgaaggccg

SEQ ID NO: 9299572 - DNA, 20 bp, Homo sapiens
tgtcatttatttatcaaatg

SEQ ID NO: 9299573 - DNA, 22 bp, Homo sapiens
tgtcagtggtagacccagaggt

SEQ ID NO: 9299574 - DNA, 22 bp, Homo sapiens
tgtcactgtcaatgtcaactac

SEQ ID NO: 9299575 - DNA, 19 bp, Homo sapiens
tgtcaggggtgtgctgtgc

SEQ ID NO: 9299576 - DNA, 19 bp, Homo sapiens
tgtcctcacagagcataac

SEQ ID NO: 9299577 - DNA, 19 bp, Homo sapiens
tgtcctcacagagcataac

SEQ ID NO: 9299578 - DNA, 22 bp, Homo sapiens
tgtcctcacaggaatgaacttt

SEQ ID NO: 9299579 - DNA, 22 bp, Homo sapiens
tgtcctcacaggaatgaacttt

SEQ ID NO: 9299580 - DNA, 22 bp, Homo sapiens
tgtcctcacacgtagggagtaa

SEQ ID NO: 9299581 - DNA, 22 bp, Homo sapiens
tgtcctcaaggagcttcagtct

SEQ ID NO: 9299582 - DNA, 22 bp, Homo sapiens
tgtcctcagatatgtctactct

SEQ ID NO: 9299583 - DNA, 22 bp, Homo sapiens
tgtcctcagatatgtctactct

SEQ ID NO: 9299584 - DNA, 22 bp, Homo sapiens
tgtcctcacatggtggggagag

SEQ ID NO: 9299585 - DNA, 22 bp, Homo sapiens
tgtcctcaggacctggcacagt

SEQ ID NO: 9299586 - DNA, 22 bp, Homo sapiens
tgtccctggagcttctgtcccc

SEQ ID NO: 9299587 - DNA, 22 bp, Homo sapiens
tgtccctctgaggcttccctgg

SEQ ID NO: 9299588 - DNA, 22 bp, Homo sapiens
tgtcccctttacctccgcagcc

SEQ ID NO: 9299589 - DNA, 22 bp, Homo sapiens
tgtcccctttctttccttcgta

SEQ ID NO: 9299590 - DNA, 22 bp, Homo sapiens
tgtcccctgcccagggatggga

SEQ ID NO: 9299591 - DNA, 20 bp, Homo sapiens
tgtcccctagatcccagctc

SEQ ID NO: 9299592 - DNA, 22 bp, Homo sapiens
tgtccccagcactcactctcca

SEQ ID NO: 9299593 - DNA, 22 bp, Homo sapiens
tggtcaggctgctctgcggcgt

SEQ ID NO: 9299594 - DNA, 22 bp, Homo sapiens
tggtcacccactgggactgcgg

SEQ ID NO: 9299595 - DNA, 17 bp, Homo sapiens
tggtcattttaatttta

SEQ ID NO: 9299596 - DNA, 22 bp, Homo sapiens
tggtcattgctattgtttctca

SEQ ID NO: 9299597 - DNA, 22 bp, Homo sapiens
tggtccagacatttctgaggta

SEQ ID NO: 9299598 - DNA, 22 bp, Homo sapiens
tggtcaggtacctctggctgtc

SEQ ID NO: 9299599 - DNA, 22 bp, Homo sapiens
tggtcagtacctggtcaccata

SEQ ID NO: 9299600 - DNA, 22 bp, Homo sapiens
tggtcagttgatcaggcagcag

SEQ ID NO: 9299601 - DNA, 22 bp, Homo sapiens
tggtcagttgagcagaagggaa

SEQ ID NO: 9299602 - DNA, 22 bp, Homo sapiens
tggtcataacatgattagtagg

SEQ ID NO: 9299603 - DNA, 22 bp, Homo sapiens
tggtcctggaaggtcctgaggg

SEQ ID NO: 9299604 - DNA, 22 bp, Homo sapiens
tggtcctgccccgtgcacagag

SEQ ID NO: 9299605 - DNA, 20 bp, Homo sapiens
tggtccaggacctggtgtcc

SEQ ID NO: 9299606 - DNA, 20 bp, Homo sapiens
tggtccaggacctggtgtcc

SEQ ID NO: 9299607 - DNA, 17 bp, Homo sapiens
tggtccaggtggagcca

SEQ ID NO: 9299608 - DNA, 22 bp, Homo sapiens
tggtctctgcaggccaggctca

SEQ ID NO: 9299609 - DNA, 22 bp, Homo sapiens
tggtgactgggactggatatga

SEQ ID NO: 9299610 - DNA, 22 bp, Homo sapiens
tggtgggggaggctgtctagca

SEQ ID NO: 9299611 - DNA, 22 bp, Homo sapiens
tggtggggtcatcgtcagatgc

SEQ ID NO: 9299612 - DNA, 22 bp, Homo sapiens
tggtggggctttccttctgctt

SEQ ID NO: 9299613 - DNA, 22 bp, Homo sapiens
tggtggggccagacttcagctc

SEQ ID NO: 9299614 - DNA, 22 bp, Homo sapiens
tggtgggcacagtgcccaggct

SEQ ID NO: 9299615 - DNA, 16 bp, Homo sapiens
tggtggggaggacagc

SEQ ID NO: 9299616 - DNA, 22 bp, Homo sapiens
tggtggggattccctccctggc

SEQ ID NO: 9299617 - DNA, 16 bp, Homo sapiens
tggtggggaggacagc

SEQ ID NO: 9299618 - DNA, 19 bp, Homo sapiens
tggtggcaatgtcagctaa

SEQ ID NO: 9299619 - DNA, 23 bp, Homo sapiens
tggtggcagaagtagcagatgac

SEQ ID NO: 9299620 - DNA, 22 bp, Homo sapiens
tggtggcagctgagtgtcaggt

SEQ ID NO: 9299621 - DNA, 22 bp, Homo sapiens
tggtgcaggtgttgatgcagga

SEQ ID NO: 9299622 - DNA, 22 bp, Homo sapiens
tggtgcagtagagctgtctggg

SEQ ID NO: 9299623 - DNA, 22 bp, Homo sapiens
tggtgcagatagtggtgtagta

SEQ ID NO: 9299624 - DNA, 22 bp, Homo sapiens
tggtgcagatgcaggtcactgg

SEQ ID NO: 9299625 - DNA, 22 bp, Homo sapiens
tggtgcaggagttggcagggac

SEQ ID NO: 9299626 - DNA, 22 bp, Homo sapiens
tggtgcagtccaaagggagcag

SEQ ID NO: 9299627 - DNA, 22 bp, Homo sapiens
tggtgcctccagctgcttctcc

SEQ ID NO: 9299628 - DNA, 22 bp, Homo sapiens
tggtgggtcggctgggagagct

SEQ ID NO: 9299629 - DNA, 22 bp, Homo sapiens
tggtggggtcatcgtcagatgc

SEQ ID NO: 9299630 - DNA, 23 bp, Homo sapiens
tggtggggtcttggagacagcac

SEQ ID NO: 9299631 - DNA, 22 bp, Homo sapiens
tggtgtggggataagcactctg

SEQ ID NO: 9299632 - DNA, 22 bp, Homo sapiens
tgtaaattgaaggaaatttgtg

SEQ ID NO: 9299633 - DNA, 22 bp, Homo sapiens
tgtaacagtaagcctgtgagct

SEQ ID NO: 9299634 - DNA, 22 bp, Homo sapiens
tgtaacagtaagcctgtgagct

SEQ ID NO: 9299635 - DNA, 22 bp, Homo sapiens
tgtacaaagttaaacctatata

SEQ ID NO: 9299636 - DNA, 22 bp, Homo sapiens
tgtaagaacaactgtcaaatgt

SEQ ID NO: 9299637 - DNA, 22 bp, Homo sapiens
tgtaagaaaacctgtacaaaga

SEQ ID NO: 9299638 - DNA, 19 bp, Homo sapiens
tgtacaaggattatgcagg

SEQ ID NO: 9299639 - DNA, 22 bp, Homo sapiens
tgtacagaggtgtacatatgat

SEQ ID NO: 9299640 - DNA, 22 bp, Homo sapiens
tggggaagggcaccctggagac

SEQ ID NO: 9299641 - DNA, 22 bp, Homo sapiens
tgggcttggaaagctgctgtgc

SEQ ID NO: 9299642 - DNA, 22 bp, Homo sapiens
tgggctggctgaacttcaacct

SEQ ID NO: 9299643 - DNA, 22 bp, Homo sapiens
tgggctggcgtggagagtttag

SEQ ID NO: 9299644 - DNA, 22 bp, Homo sapiens
tgggctggctgaggcattcact

SEQ ID NO: 9299645 - DNA, 22 bp, Homo sapiens
tgggctggtgagggatcattta

SEQ ID NO: 9299646 - DNA, 19 bp, Homo sapiens
tggggatgctgatgaccaa

SEQ ID NO: 9299647 - DNA, 22 bp, Homo sapiens
tggggaggttcgggaatcttgt

SEQ ID NO: 9299648 - DNA, 22 bp, Homo sapiens
tggggagtgatgcctcggataa

SEQ ID NO: 9299649 - DNA, 22 bp, Homo sapiens
tggggacattcatgcaggttgt

SEQ ID NO: 9299650 - DNA, 22 bp, Homo sapiens
tggggaggaagtcagatttcag

SEQ ID NO: 9299651 - DNA, 22 bp, Homo sapiens
tggggcagcagacctttcttgg

SEQ ID NO: 9299652 - DNA, 22 bp, Homo sapiens
tggggcagagtaggattttggc

SEQ ID NO: 9299653 - DNA, 22 bp, Homo sapiens
tggggctgtccttagtctgaga

SEQ ID NO: 9299654 - DNA, 22 bp, Homo sapiens
tggggctgtccttagtctgaga

SEQ ID NO: 9299655 - DNA, 22 bp, Homo sapiens
tgggggagattgtgcatctcta

SEQ ID NO: 9299656 - DNA, 22 bp, Homo sapiens
tgggggagattagagcttctta

SEQ ID NO: 9299657 - DNA, 22 bp, Homo sapiens
tggggctggggatcttgagcct

SEQ ID NO: 9299658 - DNA, 22 bp, Homo sapiens
tgggggagccttcacagtagct

SEQ ID NO: 9299659 - DNA, 22 bp, Homo sapiens
tgggggtgctgagaagacagga

SEQ ID NO: 9299660 - DNA, 20 bp, Homo sapiens
tggggtctagttggcctggg

SEQ ID NO: 9299661 - DNA, 22 bp, Homo sapiens
tggggtgtgctcagagcagggg

SEQ ID NO: 9299662 - DNA, 22 bp, Homo sapiens
tggggttacctacaagtctgag

SEQ ID NO: 9299663 - DNA, 22 bp, Homo sapiens
tggggtggtgggaaccaagtag

SEQ ID NO: 9299664 - DNA, 22 bp, Homo sapiens
tggggtggaacccttctgctgg

SEQ ID NO: 9299665 - DNA, 22 bp, Homo sapiens
tggggtggatagaaagtgatgt

SEQ ID NO: 9299666 - DNA, 23 bp, Homo sapiens
tggggttgaattgtagctgtgcc

SEQ ID NO: 9299667 - DNA, 22 bp, Homo sapiens
tggggttgaagaaaggatctag

SEQ ID NO: 9299668 - DNA, 22 bp, Homo sapiens
tgggtaaggtactgtagatctg

SEQ ID NO: 9299669 - DNA, 22 bp, Homo sapiens
tgggtaagaattgggggctctg

SEQ ID NO: 9299670 - DNA, 22 bp, Homo sapiens
tggggttgcctcccgccctgga

SEQ ID NO: 9299671 - DNA, 22 bp, Homo sapiens
tgggtagagcaggctggggctt

SEQ ID NO: 9299672 - DNA, 22 bp, Homo sapiens
tgggtagagacacagtctgggg

SEQ ID NO: 9299673 - DNA, 22 bp, Homo sapiens
tgggtagaaacaaggctggact

SEQ ID NO: 9299674 - DNA, 23 bp, Homo sapiens
tgggtagagctgcaaggacactg

SEQ ID NO: 9299675 - DNA, 22 bp, Homo sapiens
tgggtaggccaggaagcagtgt

SEQ ID NO: 9299676 - DNA, 22 bp, Homo sapiens
tgggtaggccaggaagcagtgt

SEQ ID NO: 9299677 - DNA, 22 bp, Homo sapiens
tgggtaggaccagaaatgcact

SEQ ID NO: 9299678 - DNA, 22 bp, Homo sapiens
tgggtaggaccagaaatgcact

SEQ ID NO: 9299679 - DNA, 22 bp, Homo sapiens
tgggtaggaatcgagtgtatgg

SEQ ID NO: 9299680 - DNA, 22 bp, Homo sapiens
tgggtagggagctggaatccta

SEQ ID NO: 9299681 - DNA, 22 bp, Homo sapiens
tgggtagggacttagctggctg

SEQ ID NO: 9299682 - DNA, 22 bp, Homo sapiens
tgggtagggcctgcgcctgtgc

SEQ ID NO: 9299683 - DNA, 22 bp, Homo sapiens
tgggtaggggacgtggaagaaa

SEQ ID NO: 9299684 - DNA, 22 bp, Homo sapiens
tgggtaggggacgtggaagaaa

SEQ ID NO: 9299685 - DNA, 21 bp, Homo sapiens
tgggtgggcagagtctcttca

SEQ ID NO: 9299686 - DNA, 16 bp, Homo sapiens
tgggtgggaggagcgg

SEQ ID NO: 9299687 - DNA, 22 bp, Homo sapiens
tgggtgtgagcccgggagccgc

SEQ ID NO: 9299688 - DNA, 22 bp, Homo sapiens
tgggtgagccacaggagttgtc

SEQ ID NO: 9299689 - DNA, 22 bp, Homo sapiens
tgggtgctgctttagggggtca

SEQ ID NO: 9299690 - DNA, 22 bp, Homo sapiens
tgggtgctctgcgaccgtaggg

SEQ ID NO: 9299691 - DNA, 22 bp, Homo sapiens
tggtatgaccgtggtgcaagca

SEQ ID NO: 9299692 - DNA, 22 bp, Homo sapiens
tggtatgtaaattgtaactcaa

SEQ ID NO: 9299693 - DNA, 22 bp, Homo sapiens
tggtaaaatattacaaggcact

SEQ ID NO: 9299694 - DNA, 22 bp, Homo sapiens
tggtaaaaactgcaattacttt

SEQ ID NO: 9299695 - DNA, 22 bp, Homo sapiens
tggtaagaacccatcagagaag

SEQ ID NO: 9299696 - DNA, 22 bp, Homo sapiens
tggtaagaataggggctttgga

SEQ ID NO: 9299697 - DNA, 22 bp, Homo sapiens
tggtaaaaaccgcaattacatt

SEQ ID NO: 9299698 - DNA, 19 bp, Homo sapiens
tgggttggaagggaatgaa

SEQ ID NO: 9299699 - DNA, 22 bp, Homo sapiens
tgggttagattccgcgaagcag

SEQ ID NO: 9299700 - DNA, 22 bp, Homo sapiens
tgggttaggaaggggtatcacc

SEQ ID NO: 9299701 - DNA, 22 bp, Homo sapiens
tgggttagggcctggtctctga

SEQ ID NO: 9299702 - DNA, 22 bp, Homo sapiens
tgggcagttgctcctcagaccc

SEQ ID NO: 9299703 - DNA, 22 bp, Homo sapiens
tgggcagtgggcctaggtgtga

SEQ ID NO: 9299704 - DNA, 22 bp, Homo sapiens
tgggcaggttgttatttgacat

SEQ ID NO: 9299705 - DNA, 22 bp, Homo sapiens
tgggcaggggccctgcttccgt

SEQ ID NO: 9299706 - DNA, 22 bp, Homo sapiens
tgggcagggtctctgttatcag

SEQ ID NO: 9299707 - DNA, 22 bp, Homo sapiens
tgggcaggtgctattttccatg

SEQ ID NO: 9299708 - DNA, 22 bp, Homo sapiens
tgggcagggtctctgttatcag

SEQ ID NO: 9299709 - DNA, 19 bp, Homo sapiens
tgggcaggttcagtaatgg

SEQ ID NO: 9299710 - DNA, 22 bp, Homo sapiens
tgggcaggtgctattttccatg

SEQ ID NO: 9299711 - DNA, 19 bp, Homo sapiens
tgggcaggttcagtaatgg

SEQ ID NO: 9299712 - DNA, 22 bp, Homo sapiens
tgggcaggttgttatttgacat

SEQ ID NO: 9299713 - DNA, 22 bp, Homo sapiens
tgggccagcactgggtgctcat

SEQ ID NO: 9299714 - DNA, 22 bp, Homo sapiens
tgggccagcactgggtgctcat

SEQ ID NO: 9299715 - DNA, 22 bp, Homo sapiens
tgggccagcaattgctgctcag

SEQ ID NO: 9299716 - DNA, 22 bp, Homo sapiens
tgggcagattaatgcagtggct

SEQ ID NO: 9299717 - DNA, 22 bp, Homo sapiens
tgggcagatctttggtggctag

SEQ ID NO: 9299718 - DNA, 22 bp, Homo sapiens
tgggcagggatctcttttgcaa

SEQ ID NO: 9299719 - DNA, 22 bp, Homo sapiens
tgggcaggggccctgcttccgt

SEQ ID NO: 9299720 - DNA, 22 bp, Homo sapiens
tgggcaggggccctgcttccgt

SEQ ID NO: 9299721 - DNA, 22 bp, Homo sapiens
tgggcagggagctggaaccaca

SEQ ID NO: 9299722 - DNA, 22 bp, Homo sapiens
tgggcagggatctcttttgcaa

SEQ ID NO: 9299723 - DNA, 22 bp, Homo sapiens
tgggcaggagagaagctaaaga

SEQ ID NO: 9299724 - DNA, 22 bp, Homo sapiens
tgggattcaccatgggcttcag

SEQ ID NO: 9299725 - DNA, 22 bp, Homo sapiens
tgggatgtggccatggttctct

SEQ ID NO: 9299726 - DNA, 22 bp, Homo sapiens
tgggcacagagtcccatctgcc

SEQ ID NO: 9299727 - DNA, 22 bp, Homo sapiens
tgggcacaggggtaggaatgag

SEQ ID NO: 9299728 - DNA, 23 bp, Homo sapiens
tgggatggattcaccagtgtgct

SEQ ID NO: 9299729 - DNA, 22 bp, Homo sapiens
tgggatagtagctgagagacaa

SEQ ID NO: 9299730 - DNA, 22 bp, Homo sapiens
tgggctgcaccctcagcctctg

SEQ ID NO: 9299731 - DNA, 22 bp, Homo sapiens
tgggctagcagggaagagagac

SEQ ID NO: 9299732 - DNA, 20 bp, Homo sapiens
tgggcctgagcctgtgggct

SEQ ID NO: 9299733 - DNA, 22 bp, Homo sapiens
tgggccagtccagccccaggga

SEQ ID NO: 9299734 - DNA, 17 bp, Homo sapiens
tgggccagtagaaggga

SEQ ID NO: 9299735 - DNA, 22 bp, Homo sapiens
tgggccaggggcctcttctgat

SEQ ID NO: 9299736 - DNA, 22 bp, Homo sapiens
tgggccaggggcctcttctgat

SEQ ID NO: 9299737 - DNA, 22 bp, Homo sapiens
tgggccaggtctgtgtcagctg

SEQ ID NO: 9299738 - DNA, 22 bp, Homo sapiens
tgggccaggcatgtgatcagca

SEQ ID NO: 9299739 - DNA, 22 bp, Homo sapiens
tgggccaggcatgtgatcagca

SEQ ID NO: 9299740 - DNA, 22 bp, Homo sapiens
tgtgacactggccatctgggtt

SEQ ID NO: 9299741 - DNA, 19 bp, Homo sapiens
tgtgacatcactgggcagc

SEQ ID NO: 9299742 - DNA, 22 bp, Homo sapiens
tgtgagcactatggctaggctc

SEQ ID NO: 9299743 - DNA, 22 bp, Homo sapiens
tgtgagcactggctgggaaagt

SEQ ID NO: 9299744 - DNA, 22 bp, Homo sapiens
tgtgataagttaaattaaacct

SEQ ID NO: 9299745 - DNA, 22 bp, Homo sapiens
tgtgcacattctaggactagta

SEQ ID NO: 9299746 - DNA, 22 bp, Homo sapiens
tgtgcatattactacctactcc

SEQ ID NO: 9299747 - DNA, 19 bp, Homo sapiens
tgtgcccttggcaatggga

SEQ ID NO: 9299748 - DNA, 22 bp, Homo sapiens
tgtggaaaattggaacgttcct

SEQ ID NO: 9299749 - DNA, 22 bp, Homo sapiens
tgtgccttatgaattctttctg

SEQ ID NO: 9299750 - DNA, 22 bp, Homo sapiens
tgtgcctttcatcatgcttttg

SEQ ID NO: 9299751 - DNA, 22 bp, Homo sapiens
tgtgccttctcagtcctgctca

SEQ ID NO: 9299752 - DNA, 22 bp, Homo sapiens
tgtgaaaagcaggctactttct

SEQ ID NO: 9299753 - DNA, 23 bp, Homo sapiens
tgtctggagcctgagcaggtgct

SEQ ID NO: 9299754 - DNA, 22 bp, Homo sapiens
tgtctgtgacctcttaggcaag

SEQ ID NO: 9299755 - DNA, 22 bp, Homo sapiens
tgtctctctgcccccattgctc

SEQ ID NO: 9299756 - DNA, 22 bp, Homo sapiens
tgtctacacaaatcaaagcttc

SEQ ID NO: 9299757 - DNA, 22 bp, Homo sapiens
tgtctctagggcaatgtgaact

SEQ ID NO: 9299758 - DNA, 22 bp, Homo sapiens
ttaaaaaccatcttcctttcct

SEQ ID NO: 9299759 - DNA, 22 bp, Homo sapiens
tgtttttttatatacctgaagt

SEQ ID NO: 9299760 - DNA, 22 bp, Homo sapiens
ttaaaaccatcagctgtaagat

SEQ ID NO: 9299761 - DNA, 18 bp, Homo sapiens
tgtttatttttctcttac

SEQ ID NO: 9299762 - DNA, 18 bp, Homo sapiens
tgtttatttttctcttac

SEQ ID NO: 9299763 - DNA, 22 bp, Homo sapiens
tgtttgctatatcctacttcat

SEQ ID NO: 9299764 - DNA, 22 bp, Homo sapiens
tgtttgctctgactatcttgcg

SEQ ID NO: 9299765 - DNA, 22 bp, Homo sapiens
tgtttgcttacttgtatgctgc

SEQ ID NO: 9299766 - DNA, 22 bp, Homo sapiens
tgtttgtcatcattgtgagaga

SEQ ID NO: 9299767 - DNA, 22 bp, Homo sapiens
tgttttatataagcagagcggt

SEQ ID NO: 9299768 - DNA, 22 bp, Homo sapiens
tgttgactcaacactgtgggca

SEQ ID NO: 9299769 - DNA, 22 bp, Homo sapiens
tgttgactcaacactgtgggca

SEQ ID NO: 9299770 - DNA, 22 bp, Homo sapiens
tgtttaaatagaacatactgca

SEQ ID NO: 9299771 - DNA, 18 bp, Homo sapiens
tgtttattctcctgacag

SEQ ID NO: 9299772 - DNA, 22 bp, Homo sapiens
tgtttatagggtctgtcacttg

SEQ ID NO: 9299773 - DNA, 22 bp, Homo sapiens
tgttaaatgtattatgtgttct

SEQ ID NO: 9299774 - DNA, 22 bp, Homo sapiens
tgttcttgagcctttagaccta

SEQ ID NO: 9299775 - DNA, 22 bp, Homo sapiens
tgttcttgggaatcttacagtt

SEQ ID NO: 9299776 - DNA, 22 bp, Homo sapiens
tgttctttcagttagacacagt

SEQ ID NO: 9299777 - DNA, 22 bp, Homo sapiens
tgttaggagcttcctgggctga

SEQ ID NO: 9299778 - DNA, 22 bp, Homo sapiens
tgttaggactccccagaagctg

SEQ ID NO: 9299779 - DNA, 22 bp, Homo sapiens
tgtgtacacacagatatataca

SEQ ID NO: 9299780 - DNA, 23 bp, Homo sapiens
tgtgtacacaatagatgaggttt

SEQ ID NO: 9299781 - DNA, 22 bp, Homo sapiens
tgtgtacacaagtatatataca

SEQ ID NO: 9299782 - DNA, 22 bp, Homo sapiens
tgtggggactgagtggaggctt

SEQ ID NO: 9299783 - DNA, 22 bp, Homo sapiens
tgtggggacccatgccatgggc

SEQ ID NO: 9299784 - DNA, 22 bp, Homo sapiens
tgtggggaagagtatgacttgg

SEQ ID NO: 9299785 - DNA, 22 bp, Homo sapiens
tgtgggaggattcagaattggg

SEQ ID NO: 9299786 - DNA, 22 bp, Homo sapiens
tgtgggctctaatggcagcaga

SEQ ID NO: 9299787 - DNA, 22 bp, Homo sapiens
tgtgggctgtactgagggcagg

SEQ ID NO: 9299788 - DNA, 22 bp, Homo sapiens
tgtggaagaacactggccaggc

SEQ ID NO: 9299789 - DNA, 22 bp, Homo sapiens
tgtggaagggacactggactgg

SEQ ID NO: 9299790 - DNA, 17 bp, Homo sapiens
tgtggccttctgagctt

SEQ ID NO: 9299791 - DNA, 22 bp, Homo sapiens
tgtgtggattcatctcaaagag

SEQ ID NO: 9299792 - DNA, 22 bp, Homo sapiens
tgtgtggattcatctcaaagag

SEQ ID NO: 9299793 - DNA, 22 bp, Homo sapiens
ttacacaaaaataagatatggc

SEQ ID NO: 9299794 - DNA, 22 bp, Homo sapiens
ttaatgtatggggttgagatga

SEQ ID NO: 9299795 - DNA, 22 bp, Homo sapiens
ttaatacatttcagactgttat

SEQ ID NO: 9299796 - DNA, 22 bp, Homo sapiens
ttaataaagtatgaattggaaa

SEQ ID NO: 9299797 - DNA, 22 bp, Homo sapiens
ttaatacaactgttgtcactgg

SEQ ID NO: 9299798 - DNA, 22 bp, Homo sapiens
ttaatacaagcatatgcacaca

SEQ ID NO: 9299799 - DNA, 22 bp, Homo sapiens
ttaatacaagcatatgcacaca

SEQ ID NO: 9299800 - DNA, 22 bp, Homo sapiens
ttaattaaattcatgagcattg

SEQ ID NO: 9299801 - DNA, 22 bp, Homo sapiens
ttacaaagtgctgcaccatttt

SEQ ID NO: 9299802 - DNA, 22 bp, Homo sapiens
ttatttcattgatttctaagac

SEQ ID NO: 9299803 - DNA, 22 bp, Homo sapiens
ttatttatgttaacagtcgaga

SEQ ID NO: 9299804 - DNA, 22 bp, Homo sapiens
ttattcatcagtgcattaattt

SEQ ID NO: 9299805 - DNA, 22 bp, Homo sapiens
ttatgaaaacaatcagtaggca

SEQ ID NO: 9299806 - DNA, 22 bp, Homo sapiens
ttattattccccaagtcattat

SEQ ID NO: 9299807 - DNA, 22 bp, Homo sapiens
ttatgagatatttatactgctg

SEQ ID NO: 9299808 - DNA, 22 bp, Homo sapiens
ttatgagactgttttacacact

SEQ ID NO: 9299809 - DNA, 22 bp, Homo sapiens
ttatgatttgccacagattggt

SEQ ID NO: 9299810 - DNA, 22 bp, Homo sapiens
ttatatgtttctgtttggaggc

SEQ ID NO: 9299811 - DNA, 22 bp, Homo sapiens
ttagtgatgaagaattactagg

SEQ ID NO: 9299812 - DNA, 22 bp, Homo sapiens
ttagtgattacagatatataaa

SEQ ID NO: 9299813 - DNA, 22 bp, Homo sapiens
ttagatgtgcaggacttttatc

SEQ ID NO: 9299814 - DNA, 22 bp, Homo sapiens
ttagcagatttcatgtacattt

SEQ ID NO: 9299815 - DNA, 22 bp, Homo sapiens
ttaggaagaaggaggcagtatt

SEQ ID NO: 9299816 - DNA, 22 bp, Homo sapiens
ttaggaagaatatatttagagc

SEQ ID NO: 9299817 - DNA, 22 bp, Homo sapiens
ttaggaagagctttcaatcact

SEQ ID NO: 9299818 - DNA, 22 bp, Homo sapiens
ttaggaagatgctttttctggg

SEQ ID NO: 9299819 - DNA, 22 bp, Homo sapiens
ttaggaagcacacagtaaatat

SEQ ID NO: 9299820 - DNA, 22 bp, Homo sapiens
ttaggaagatgctttttctggg

SEQ ID NO: 9299821 - DNA, 22 bp, Homo sapiens
ttaggaagcaggcctaaaattt

SEQ ID NO: 9299822 - DNA, 22 bp, Homo sapiens
ttaggaaggacttggattctgg

SEQ ID NO: 9299823 - DNA, 22 bp, Homo sapiens
ttagatatgtttttgctaatgc

SEQ ID NO: 9299824 - DNA, 22 bp, Homo sapiens
ttagatcattttgaactaattt

SEQ ID NO: 9299825 - DNA, 22 bp, Homo sapiens
ttagaaaggttttgctctgaaa

SEQ ID NO: 9299826 - DNA, 22 bp, Homo sapiens
ttcagcatctacatatttagaa

SEQ ID NO: 9299827 - DNA, 22 bp, Homo sapiens
ttcagcagtcgtccaggaaaag

SEQ ID NO: 9299828 - DNA, 22 bp, Homo sapiens
ttcagcagtgcagacacccagt

SEQ ID NO: 9299829 - DNA, 22 bp, Homo sapiens
ttcactgcaacctccgcctccc

SEQ ID NO: 9299830 - DNA, 22 bp, Homo sapiens
ttcaggaagtgctgcctggtgt

SEQ ID NO: 9299831 - DNA, 22 bp, Homo sapiens
ttcagcatgaaaggatttgagt

SEQ ID NO: 9299832 - DNA, 19 bp, Homo sapiens
ttcagcattatattctagc

SEQ ID NO: 9299833 - DNA, 22 bp, Homo sapiens
ttcagcatgggtgtgataaatg

SEQ ID NO: 9299834 - DNA, 22 bp, Homo sapiens
ttcagcatttctgttgttggct

SEQ ID NO: 9299835 - DNA, 22 bp, Homo sapiens
ttcagcattggtatgaaaaccc

SEQ ID NO: 9299836 - DNA, 22 bp, Homo sapiens
ttatttgtaaaggtccatagta

SEQ ID NO: 9299837 - DNA, 22 bp, Homo sapiens
ttcacattgtgcagattatggt

SEQ ID NO: 9299838 - DNA, 22 bp, Homo sapiens
ttccagaggcctgggcacactc

SEQ ID NO: 9299839 - DNA, 22 bp, Homo sapiens
ttccagaggctctaggggagaa

SEQ ID NO: 9299840 - DNA, 22 bp, Homo sapiens
ttcattacattcaaaaggcatt

SEQ ID NO: 9299841 - DNA, 22 bp, Homo sapiens
ttcattactgaattctcactac

SEQ ID NO: 9299842 - DNA, 22 bp, Homo sapiens
ttcattacttaggcaggcattt

SEQ ID NO: 9299843 - DNA, 22 bp, Homo sapiens
ttcattactgcggtagtcacac

SEQ ID NO: 9299844 - DNA, 22 bp, Homo sapiens
ttcattcatctctaaaatgcct

SEQ ID NO: 9299845 - DNA, 22 bp, Homo sapiens
ttccagcagcgtgggagaagta

SEQ ID NO: 9299846 - DNA, 17 bp, Homo sapiens
ttccagcatgttactaa

SEQ ID NO: 9299847 - DNA, 22 bp, Homo sapiens
ttccagctaactcacatccctt

SEQ ID NO: 9299848 - DNA, 22 bp, Homo sapiens
ttccagccatggtttccctatg

SEQ ID NO: 9299849 - DNA, 22 bp, Homo sapiens
ttccagcccgcgacttgttcag

SEQ ID NO: 9299850 - DNA, 22 bp, Homo sapiens
ttccagaggcttcagggaagaa

SEQ ID NO: 9299851 - DNA, 22 bp, Homo sapiens
ttccagaggcttgaggaaaatt

SEQ ID NO: 9299852 - DNA, 22 bp, Homo sapiens
ttccagagttgggggagtggtt

SEQ ID NO: 9299853 - DNA, 21 bp, Homo sapiens
aaagaaatctcccattggtag

SEQ ID NO: 9299854 - DNA, 22 bp, Homo sapiens
aaagaacaaatgatatatggtt

SEQ ID NO: 9299855 - DNA, 22 bp, Homo sapiens
aaagaaatagatggcatttaaa

SEQ ID NO: 9299856 - DNA, 22 bp, Homo sapiens
aaacttttcctgctcttgtcct

SEQ ID NO: 9299857 - DNA, 22 bp, Homo sapiens
aaactttcatgtatctctttca

SEQ ID NO: 9299858 - DNA, 22 bp, Homo sapiens
aaacttctctccctactttgtg

SEQ ID NO: 9299859 - DNA, 22 bp, Homo sapiens
aaatagttgtttggatcaataa

SEQ ID NO: 9299860 - DNA, 22 bp, Homo sapiens
aaatagttcagcttgtaaaccc

SEQ ID NO: 9299861 - DNA, 22 bp, Homo sapiens
aaagccaggcagccaagccagt

SEQ ID NO: 9299862 - DNA, 22 bp, Homo sapiens
aaacactgaagacctatctggt

SEQ ID NO: 9299863 - DNA, 22 bp, Homo sapiens
aaacattcactctcaattttag

SEQ ID NO: 9299864 - DNA, 22 bp, Homo sapiens
aaacattccatatataccttgt

SEQ ID NO: 9299865 - DNA, 22 bp, Homo sapiens
aaacatgttttctgaatatttt

SEQ ID NO: 9299866 - DNA, 23 bp, Homo sapiens
aaacatgcagcacatgaatgcta

SEQ ID NO: 9299867 - DNA, 22 bp, Homo sapiens
aaacatgcattcaagaaaatct

SEQ ID NO: 9299868 - DNA, 22 bp, Homo sapiens
aaacattgctaaataatgctgc

SEQ ID NO: 9299869 - DNA, 22 bp, Homo sapiens
aaacattgagtgcctttggtat

SEQ ID NO: 9299870 - DNA, 22 bp, Homo sapiens
aaacattgacctcatcctggca

SEQ ID NO: 9299871 - DNA, 22 bp, Homo sapiens
aaacattgagcacttgctattt

SEQ ID NO: 9299872 - DNA, 22 bp, Homo sapiens
aaacattccctaatgtgtccgt

SEQ ID NO: 9299873 - DNA, 22 bp, Homo sapiens
aaactgtaaatactagtaagtg

SEQ ID NO: 9299874 - DNA, 22 bp, Homo sapiens
aaactgtaaacacagcagtaca

SEQ ID NO: 9299875 - DNA, 22 bp, Homo sapiens
aaactgtaaagcaggtgagtag

SEQ ID NO: 9299876 - DNA, 22 bp, Homo sapiens
aaactgtaaagcaggtgagtag

SEQ ID NO: 9299877 - DNA, 22 bp, Homo sapiens
aaactgcaattatgtttgcaga

SEQ ID NO: 9299878 - DNA, 22 bp, Homo sapiens
aaactgtaggagggaaaggaag

SEQ ID NO: 9299879 - DNA, 22 bp, Homo sapiens
aaactgtagtgcttcgatctga

SEQ ID NO: 9299880 - DNA, 22 bp, Homo sapiens
aaactgtaatgcaggatcaaga

SEQ ID NO: 9299881 - DNA, 22 bp, Homo sapiens
aaactgtaagtttgaggggaaa

SEQ ID NO: 9299882 - DNA, 22 bp, Homo sapiens
aaactgtaagtgcctcaaggtc

SEQ ID NO: 9299883 - DNA, 22 bp, Homo sapiens
aaactgtaagtgcctcaaggtc

SEQ ID NO: 9299884 - DNA, 22 bp, Homo sapiens
aaactgtaatgcaggatcaaga

SEQ ID NO: 9299885 - DNA, 22 bp, Homo sapiens
aaactgtaagagaataaactac

SEQ ID NO: 9299886 - DNA, 18 bp, Homo sapiens
aaactgtatttctttcta

SEQ ID NO: 9299887 - DNA, 22 bp, Homo sapiens
aaactgtattccatcctcatca

SEQ ID NO: 9299888 - DNA, 22 bp, Homo sapiens
aaactgtatatttatggcatgt

SEQ ID NO: 9299889 - DNA, 22 bp, Homo sapiens
aaactgtatagggaaaagtaga

SEQ ID NO: 9299890 - DNA, 22 bp, Homo sapiens
aaactgtatgttgagatgacag

SEQ ID NO: 9299891 - DNA, 22 bp, Homo sapiens
aaactgtatatttatggcatgt

SEQ ID NO: 9299892 - DNA, 22 bp, Homo sapiens
aaaaggctaatccagagcaact

SEQ ID NO: 9299893 - DNA, 22 bp, Homo sapiens
aaaaccatgtatctatttcctt

SEQ ID NO: 9299894 - DNA, 22 bp, Homo sapiens
aaaacctgtgaatagttaactc

SEQ ID NO: 9299895 - DNA, 22 bp, Homo sapiens
aaaaccttctagactttatatt

SEQ ID NO: 9299896 - DNA, 21 bp, Homo sapiens
aaaaagctggggcatgcatgc

SEQ ID NO: 9299897 - DNA, 22 bp, Homo sapiens
aaaattactattgttcctgggc

SEQ ID NO: 9299898 - DNA, 21 bp, Homo sapiens
aaaatgtttccttgttggtta

SEQ ID NO: 9299899 - DNA, 22 bp, Homo sapiens
aaaatgtgtttatgcatttcgt

SEQ ID NO: 9299900 - DNA, 22 bp, Homo sapiens
aaaatgtgcagtttttaagctg

SEQ ID NO: 9299901 - DNA, 22 bp, Homo sapiens
aaaaggttttgagtacaaatat

SEQ ID NO: 9299902 - DNA, 19 bp, Homo sapiens
aaaattgcgtattttgagg

SEQ ID NO: 9299903 - DNA, 20 bp, Homo sapiens
aaaattgctctgcagtcccc

SEQ ID NO: 9299904 - DNA, 22 bp, Homo sapiens
aaaattggacgtagctactcca

SEQ ID NO: 9299905 - DNA, 22 bp, Homo sapiens
aaaattggttcctttctgaggc

SEQ ID NO: 9299906 - DNA, 22 bp, Homo sapiens
aaaattgagagtcttgtgcaag

SEQ ID NO: 9299907 - DNA, 22 bp, Homo sapiens
aaaatgtgatctacaaatgcaa

SEQ ID NO: 9299908 - DNA, 22 bp, Homo sapiens
aaaattctcttgatcttgacag

SEQ ID NO: 9299909 - DNA, 22 bp, Homo sapiens
aaacactaataacagtggctgg

SEQ ID NO: 9299910 - DNA, 22 bp, Homo sapiens
aaacaccaagagctagctatta

SEQ ID NO: 9299911 - DNA, 22 bp, Homo sapiens
aaacaccagtcccagtatacac

SEQ ID NO: 9299912 - DNA, 22 bp, Homo sapiens
aaacacatcattcatgtcgtca

SEQ ID NO: 9299913 - DNA, 22 bp, Homo sapiens
aaacaggagttgaccaagtaca

SEQ ID NO: 9299914 - DNA, 22 bp, Homo sapiens
aaacaggctctgcgggatgctc

SEQ ID NO: 9299915 - DNA, 22 bp, Homo sapiens
aaaatatgactgtgctccttaa

SEQ ID NO: 9299916 - DNA, 22 bp, Homo sapiens
aaaatatgtataactcttctgc

SEQ ID NO: 9299917 - DNA, 21 bp, Homo sapiens
aaaatgtgagcgtgatgctta

SEQ ID NO: 9299918 - DNA, 23 bp, Homo sapiens
aaactgcttccaattcctgccat

SEQ ID NO: 9299919 - DNA, 22 bp, Homo sapiens
aaactgctgggcatatatttct

SEQ ID NO: 9299920 - DNA, 22 bp, Homo sapiens
aagaggggtggtctgtgaggat

SEQ ID NO: 9299921 - DNA, 22 bp, Homo sapiens
aagagggctgcaatcttattgc

SEQ ID NO: 9299922 - DNA, 22 bp, Homo sapiens
aagagggagggcaaaggcactg

SEQ ID NO: 9299923 - DNA, 22 bp, Homo sapiens
aagagggaggtgcgggtgcaga

SEQ ID NO: 9299924 - DNA, 22 bp, Homo sapiens
aagaccctacccctggagagga

SEQ ID NO: 9299925 - DNA, 22 bp, Homo sapiens
aagactgatgtccagtcccatg

SEQ ID NO: 9299926 - DNA, 22 bp, Homo sapiens
aagaacatgatggccatgtgca

SEQ ID NO: 9299927 - DNA, 22 bp, Homo sapiens
aagaacatgagttatgatgatt

SEQ ID NO: 9299928 - DNA, 22 bp, Homo sapiens
aagcaggagagcctgggtgagc

SEQ ID NO: 9299929 - DNA, 22 bp, Homo sapiens
aagcaggcatcttggaggtcaa

SEQ ID NO: 9299930 - DNA, 22 bp, Homo sapiens
aagcaggcagggtggagagttt

SEQ ID NO: 9299931 - DNA, 22 bp, Homo sapiens
aagcaggcaaggttgtggggca

SEQ ID NO: 9299932 - DNA, 22 bp, Homo sapiens
aagattctagaggaacttctta

SEQ ID NO: 9299933 - DNA, 22 bp, Homo sapiens
aagcagcatagctcccttagtt

SEQ ID NO: 9299934 - DNA, 22 bp, Homo sapiens
aagcagcatatgacagcatcca

SEQ ID NO: 9299935 - DNA, 22 bp, Homo sapiens
aagattatggcagataacaatt

SEQ ID NO: 9299936 - DNA, 22 bp, Homo sapiens
aagattatttaagacaggaacc

SEQ ID NO: 9299937 - DNA, 22 bp, Homo sapiens
aagatcagctcccgagtctgag

SEQ ID NO: 9299938 - DNA, 22 bp, Homo sapiens
aagatatattttggtgatttca

SEQ ID NO: 9299939 - DNA, 22 bp, Homo sapiens
aagatatattcgacgtgaatga

SEQ ID NO: 9299940 - DNA, 22 bp, Homo sapiens
aagatcaggcgtggaaaacact

SEQ ID NO: 9299941 - DNA, 22 bp, Homo sapiens
aagccctgttaggcactgggga

SEQ ID NO: 9299942 - DNA, 22 bp, Homo sapiens
aagccctgttctttctctcacc

SEQ ID NO: 9299943 - DNA, 22 bp, Homo sapiens
aagccctgttctttctctcacc

SEQ ID NO: 9299944 - DNA, 22 bp, Homo sapiens
aagccctgtcaccctgacttca

SEQ ID NO: 9299945 - DNA, 22 bp, Homo sapiens
aagccctgtaaattgcccttaa

SEQ ID NO: 9299946 - DNA, 22 bp, Homo sapiens
aagcctgagcaacctgctggcg

SEQ ID NO: 9299947 - DNA, 22 bp, Homo sapiens
aaatgcatgtagaataatagag

SEQ ID NO: 9299948 - DNA, 22 bp, Homo sapiens
aaatgcatggctgttttaaagc

SEQ ID NO: 9299949 - DNA, 22 bp, Homo sapiens
aaatgcatggtaaatgattgcc

SEQ ID NO: 9299950 - DNA, 22 bp, Homo sapiens
aagcaggcattccagagacaat

SEQ ID NO: 9299951 - DNA, 22 bp, Homo sapiens
aagcaggccctgggccagggga

SEQ ID NO: 9299952 - DNA, 22 bp, Homo sapiens
aagcaggcgagggcctggagca

SEQ ID NO: 9299953 - DNA, 22 bp, Homo sapiens
aaatctcagcccttattttaga

SEQ ID NO: 9299954 - DNA, 22 bp, Homo sapiens
aaatctctgaacttaataatgc

SEQ ID NO: 9299955 - DNA, 22 bp, Homo sapiens
aaatcttcctgaaatttgttca

SEQ ID NO: 9299956 - DNA, 22 bp, Homo sapiens
aaagatttaagaataatttgtg

SEQ ID NO: 9299957 - DNA, 22 bp, Homo sapiens
aaagattcgagcgatgtataaa

SEQ ID NO: 9299958 - DNA, 22 bp, Homo sapiens
aaagattcgagcgatgtataaa

SEQ ID NO: 9299959 - DNA, 22 bp, Homo sapiens
aaagcaagtctctacaaagtac

SEQ ID NO: 9299960 - DNA, 22 bp, Homo sapiens
aacacattttgcctaggcaata

SEQ ID NO: 9299961 - DNA, 22 bp, Homo sapiens
aacacattggaagccaagaatg

SEQ ID NO: 9299962 - DNA, 22 bp, Homo sapiens
aaagcagcaaatacttttgcac

SEQ ID NO: 9299963 - DNA, 22 bp, Homo sapiens
aaagcagaggttgcagtgagct

SEQ ID NO: 9299964 - DNA, 22 bp, Homo sapiens
aaagcagattctgatgcagtag

SEQ ID NO: 9299965 - DNA, 22 bp, Homo sapiens
aacatacagtgagcagtggact

SEQ ID NO: 9299966 - DNA, 22 bp, Homo sapiens
aacataatgtggccaaagtcac

SEQ ID NO: 9299967 - DNA, 22 bp, Homo sapiens
aaagcctcccaggttatgagta

SEQ ID NO: 9299968 - DNA, 22 bp, Homo sapiens
aaagcctgtctggtcatagcta

SEQ ID NO: 9299969 - DNA, 22 bp, Homo sapiens
aacccactctacctggctccat

SEQ ID NO: 9299970 - DNA, 22 bp, Homo sapiens
aaaggcagagttgttggaggca

SEQ ID NO: 9299971 - DNA, 22 bp, Homo sapiens
aaaggcaggactgcagcatagg

SEQ ID NO: 9299972 - DNA, 18 bp, Homo sapiens
aaaggcagattactggga

SEQ ID NO: 9299973 - DNA, 22 bp, Homo sapiens
aaaggcagtgggtatgtggatc

SEQ ID NO: 9299974 - DNA, 23 bp, Homo sapiens
aaaggcaggcctaggacatattg

SEQ ID NO: 9299975 - DNA, 22 bp, Homo sapiens
aaaggcaggctttcacatctca

SEQ ID NO: 9299976 - DNA, 19 bp, Homo sapiens
aaaggcagtgggtggcgtg

SEQ ID NO: 9299977 - DNA, 22 bp, Homo sapiens
aaaggcagtgtgatactgtggt

SEQ ID NO: 9299978 - DNA, 22 bp, Homo sapiens
aagaacatgaacacaatgttta

SEQ ID NO: 9299979 - DNA, 22 bp, Homo sapiens
aaagtaaagattgggaatgtgt

SEQ ID NO: 9299980 - DNA, 22 bp, Homo sapiens
aaaggttttggtaaggctttaa

SEQ ID NO: 9299981 - DNA, 22 bp, Homo sapiens
aactgtacgataataaatttgt

SEQ ID NO: 9299982 - DNA, 22 bp, Homo sapiens
aactgtaagacaaatgacttct

SEQ ID NO: 9299983 - DNA, 22 bp, Homo sapiens
aactgtaatgaattgttcatga

SEQ ID NO: 9299984 - DNA, 22 bp, Homo sapiens
aagagcaggctgctgtggagta

SEQ ID NO: 9299985 - DNA, 22 bp, Homo sapiens
acacatttacatgtttacgtat

SEQ ID NO: 9299986 - DNA, 22 bp, Homo sapiens
acacatttaaaaaggaacatat

SEQ ID NO: 9299987 - DNA, 22 bp, Homo sapiens
acacattctttaaatgtctgtt

SEQ ID NO: 9299988 - DNA, 22 bp, Homo sapiens
acacatttctaaatttttaccg

SEQ ID NO: 9299989 - DNA, 22 bp, Homo sapiens
acacatttagcaccaggtttat

SEQ ID NO: 9299990 - DNA, 22 bp, Homo sapiens
acacatttatggatcgcagaaa

SEQ ID NO: 9299991 - DNA, 22 bp, Homo sapiens
aagcaaagacagtttgagtgga

SEQ ID NO: 9299992 - DNA, 22 bp, Homo sapiens
aagcaagagttggagtgatgtt

SEQ ID NO: 9299993 - DNA, 22 bp, Homo sapiens
aagcaataatcccaaagtgctg

SEQ ID NO: 9299994 - DNA, 22 bp, Homo sapiens
aagcaataagccagatttggat

SEQ ID NO: 9299995 - DNA, 22 bp, Homo sapiens
aagcaatacaagtggtcattga

SEQ ID NO: 9299996 - DNA, 23 bp, Homo sapiens
aagcaataccaggtgtgggccct

SEQ ID NO: 9299997 - DNA, 22 bp, Homo sapiens
aagcaataaataatttttagta

SEQ ID NO: 9299998 - DNA, 22 bp, Homo sapiens
aagatgcagctttacaataagg

SEQ ID NO: 9299999 - DNA, 22 bp, Homo sapiens
aagcaccaccctcccaacctgt

SEQ ID NO: 9300000 - DNA, 22 bp, Homo sapiens
aagcacactcagatattgactc

SEQ ID NO: 9300001 - DNA, 22 bp, Homo sapiens
aagcacaatttaggactgaaat

SEQ ID NO: 9300002 - DNA, 22 bp, Homo sapiens
aagcacaatttcaccttcttgt

SEQ ID NO: 9300003 - DNA, 22 bp, Homo sapiens
aagcacacagaggcggaaggac

SEQ ID NO: 9300004 - DNA, 22 bp, Homo sapiens
aagcacacagcaaaggggagct

SEQ ID NO: 9300005 - DNA, 22 bp, Homo sapiens
aagcacacctccctggcaggag

SEQ ID NO: 9300006 - DNA, 22 bp, Homo sapiens
aagcacacatctctggctgggt

SEQ ID NO: 9300007 - DNA, 22 bp, Homo sapiens
aagcacaatgaacatcttagat

SEQ ID NO: 9300008 - DNA, 22 bp, Homo sapiens
aagcaatagggtaatctactca

SEQ ID NO: 9300009 - DNA, 22 bp, Homo sapiens
aagcaatagcaacaactttaca

SEQ ID NO: 9300010 - DNA, 22 bp, Homo sapiens
aagcaatatactgatatgatta

SEQ ID NO: 9300011 - DNA, 20 bp, Homo sapiens
aagcaatatagtgcaaatgt

SEQ ID NO: 9300012 - DNA, 22 bp, Homo sapiens
aagcagagccaccagctttgga

SEQ ID NO: 9300013 - DNA, 22 bp, Homo sapiens
acagcaaaagacaagaacttaa

SEQ ID NO: 9300014 - DNA, 22 bp, Homo sapiens
aagcagaggccacagagtgggc

SEQ ID NO: 9300015 - DNA, 22 bp, Homo sapiens
aagcagagggtatggccaggtt

SEQ ID NO: 9300016 - DNA, 22 bp, Homo sapiens
aagcagcttaaattagagcctg

SEQ ID NO: 9300017 - DNA, 22 bp, Homo sapiens
aagcagcttaaattagagcctg

SEQ ID NO: 9300018 - DNA, 22 bp, Homo sapiens
aagcagcttccctggctcctgg

SEQ ID NO: 9300019 - DNA, 22 bp, Homo sapiens
acagcctgctgcctgcttcttg

SEQ ID NO: 9300020 - DNA, 22 bp, Homo sapiens
aagcaggaagctcaggtccttg

SEQ ID NO: 9300021 - DNA, 22 bp, Homo sapiens
aagagaaagcagactttgtcat

SEQ ID NO: 9300022 - DNA, 22 bp, Homo sapiens
aagagaagaaagtgtctacaca

SEQ ID NO: 9300023 - DNA, 22 bp, Homo sapiens
aatttcactgtggagcacattt

SEQ ID NO: 9300024 - DNA, 22 bp, Homo sapiens
aatttgttacacagcaatataa

SEQ ID NO: 9300025 - DNA, 22 bp, Homo sapiens
aagagcagattcctagtggagc

SEQ ID NO: 9300026 - DNA, 22 bp, Homo sapiens
acacaaagctattgagtgtcat

SEQ ID NO: 9300027 - DNA, 22 bp, Homo sapiens
acacaaagctattgagtgtcat

SEQ ID NO: 9300028 - DNA, 22 bp, Homo sapiens
acacaaacagtctatagcacca

SEQ ID NO: 9300029 - DNA, 22 bp, Homo sapiens
acacaaaatcaaagtcctaggc

SEQ ID NO: 9300030 - DNA, 22 bp, Homo sapiens
aattctatgttcttgagtaaga

SEQ ID NO: 9300031 - DNA, 22 bp, Homo sapiens
aattcctttggatcttctggag

SEQ ID NO: 9300032 - DNA, 22 bp, Homo sapiens
aattcctctatctttcttcaag

SEQ ID NO: 9300033 - DNA, 22 bp, Homo sapiens
aagaaattaatgtgccattact

SEQ ID NO: 9300034 - DNA, 22 bp, Homo sapiens
aatttcactggaaaagataatt

SEQ ID NO: 9300035 - DNA, 22 bp, Homo sapiens
aatttcactgataaagactcca

SEQ ID NO: 9300036 - DNA, 22 bp, Homo sapiens
aactttttctgggatggagggt

SEQ ID NO: 9300037 - DNA, 22 bp, Homo sapiens
aactgctttgtgagctttctgg

SEQ ID NO: 9300038 - DNA, 22 bp, Homo sapiens
aactgcttgtagtgacttgcct

SEQ ID NO: 9300039 - DNA, 22 bp, Homo sapiens
aactgcttgatgaagctcccac

SEQ ID NO: 9300040 - DNA, 22 bp, Homo sapiens
aactgcttgagatatgtttgtc

SEQ ID NO: 9300041 - DNA, 22 bp, Homo sapiens
aatggctttgagtattttctgg

SEQ ID NO: 9300042 - DNA, 22 bp, Homo sapiens
aatggctttggtctgggtccca

SEQ ID NO: 9300043 - DNA, 22 bp, Homo sapiens
aactggctgggaacacctagag

SEQ ID NO: 9300044 - DNA, 22 bp, Homo sapiens
aaggaagagaatccttctcaga

SEQ ID NO: 9300045 - DNA, 22 bp, Homo sapiens
aaatgcattctgttttcactag

SEQ ID NO: 9300046 - DNA, 22 bp, Homo sapiens
aaatgcattaagtcagaacaat

SEQ ID NO: 9300047 - DNA, 22 bp, Homo sapiens
aaatgcatgtatgtaatatgct

SEQ ID NO: 9300048 - DNA, 22 bp, Homo sapiens
aaatgcatgtgctatagatgtg

SEQ ID NO: 9300049 - DNA, 22 bp, Homo sapiens
aaatgcatttcactaatgtttc

SEQ ID NO: 9300050 - DNA, 22 bp, Homo sapiens
aaggaagaggcaggttttgctg

SEQ ID NO: 9300051 - DNA, 22 bp, Homo sapiens
aaggaagagcaaagaattatgt

SEQ ID NO: 9300052 - DNA, 22 bp, Homo sapiens
aaggaagatgaggtgctgctta

SEQ ID NO: 9300053 - DNA, 22 bp, Homo sapiens
aaggaagatgaaagtactgcta

SEQ ID NO: 9300054 - DNA, 22 bp, Homo sapiens
aaggctgggtaacctgtccact

SEQ ID NO: 9300055 - DNA, 22 bp, Homo sapiens
aaggctggggtgcagacggcct

SEQ ID NO: 9300056 - DNA, 22 bp, Homo sapiens
aaggctggggtgcagacggcct

SEQ ID NO: 9300057 - DNA, 19 bp, Homo sapiens
aaggctggtaccataggtt

SEQ ID NO: 9300058 - DNA, 19 bp, Homo sapiens
aaggctggtaccataggtt

SEQ ID NO: 9300059 - DNA, 22 bp, Homo sapiens
aaggctgggtaacctgtccact

SEQ ID NO: 9300060 - DNA, 22 bp, Homo sapiens
aaggctgggtttgggatgtgat

SEQ ID NO: 9300061 - DNA, 22 bp, Homo sapiens
aaggctgggtttgggatgtgat

SEQ ID NO: 9300062 - DNA, 22 bp, Homo sapiens
aaggcagcaagaattccaggtt

SEQ ID NO: 9300063 - DNA, 22 bp, Homo sapiens
aaggcagcaagaattccaggtt

SEQ ID NO: 9300064 - DNA, 22 bp, Homo sapiens
aaggcagcaggatttggtgact

SEQ ID NO: 9300065 - DNA, 22 bp, Homo sapiens
aaggcagccagatcctttgggt

SEQ ID NO: 9300066 - DNA, 22 bp, Homo sapiens
aaggcagccatgtgctttgggt

SEQ ID NO: 9300067 - DNA, 22 bp, Homo sapiens
aaggcagccctggctcagcctg

SEQ ID NO: 9300068 - DNA, 22 bp, Homo sapiens
aaatttctggaagtgtcagagt

SEQ ID NO: 9300069 - DNA, 22 bp, Homo sapiens
aaatttctgttgttttgagcca

SEQ ID NO: 9300070 - DNA, 22 bp, Homo sapiens
aaatttcttgaggctctctagc

SEQ ID NO: 9300071 - DNA, 22 bp, Homo sapiens
aaatttgccagatcaattctga

SEQ ID NO: 9300072 - DNA, 22 bp, Homo sapiens
aaatttgccagatcaattctga

SEQ ID NO: 9300073 - DNA, 22 bp, Homo sapiens
aaggctggttccatccctggtg

SEQ ID NO: 9300074 - DNA, 22 bp, Homo sapiens
aaggctggtggattatgaggtc

SEQ ID NO: 9300075 - DNA, 22 bp, Homo sapiens
aaggctggtggattatgaggtc

SEQ ID NO: 9300076 - DNA, 22 bp, Homo sapiens
aaggctggtcagatgtggtgaa

SEQ ID NO: 9300077 - DNA, 22 bp, Homo sapiens
aaggctggtcagatgtggtgaa

SEQ ID NO: 9300078 - DNA, 21 bp, Homo sapiens
aaatttctgcaagcctcaact

SEQ ID NO: 9300079 - DNA, 22 bp, Homo sapiens
aaggctggttccatccctggtg

SEQ ID NO: 9300080 - DNA, 22 bp, Homo sapiens
aacacagatcaaaatatttcct

SEQ ID NO: 9300081 - DNA, 22 bp, Homo sapiens
aacacagctaatttctgtcaat

SEQ ID NO: 9300082 - DNA, 20 bp, Homo sapiens
aacacagataccaaaggttg

SEQ ID NO: 9300083 - DNA, 20 bp, Homo sapiens
aacacagataccaaaggttg

SEQ ID NO: 9300084 - DNA, 22 bp, Homo sapiens
aacacagacatagtgattacag

SEQ ID NO: 9300085 - DNA, 22 bp, Homo sapiens
aacacagagtatttgaagcatt

SEQ ID NO: 9300086 - DNA, 20 bp, Homo sapiens
aacacactggtggcatcagg

SEQ ID NO: 9300087 - DNA, 22 bp, Homo sapiens
aacacagaagtgccaagagcca

SEQ ID NO: 9300088 - DNA, 22 bp, Homo sapiens
aacacagtcagttcctggatca

SEQ ID NO: 9300089 - DNA, 22 bp, Homo sapiens
aacatgaaaacctccacagcaa

SEQ ID NO: 9300090 - DNA, 22 bp, Homo sapiens
aacatgtatcgctttttaatat

SEQ ID NO: 9300091 - DNA, 22 bp, Homo sapiens
aacatgtaaccagcattcatct

SEQ ID NO: 9300092 - DNA, 22 bp, Homo sapiens
aagtgcttggagcatacctgtt

SEQ ID NO: 9300093 - DNA, 22 bp, Homo sapiens
aagtgcttgatcatagttctca

SEQ ID NO: 9300094 - DNA, 22 bp, Homo sapiens
aacatatttggctgatattccc

SEQ ID NO: 9300095 - DNA, 22 bp, Homo sapiens
aactagtcagtgattctcagaa

SEQ ID NO: 9300096 - DNA, 22 bp, Homo sapiens
aatggcttagtgcttcacttct

SEQ ID NO: 9300097 - DNA, 22 bp, Homo sapiens
aatggcttgcaaatgggtccat

SEQ ID NO: 9300098 - DNA, 22 bp, Homo sapiens
aatggcttatgtaatgctgttt

SEQ ID NO: 9300099 - DNA, 20 bp, Homo sapiens
aatggcttatagcatgctac

SEQ ID NO: 9300100 - DNA, 22 bp, Homo sapiens
aatgaacaacactgaaggaaga

SEQ ID NO: 9300101 - DNA, 22 bp, Homo sapiens
aatgacaagacatagtctctga

SEQ ID NO: 9300102 - DNA, 22 bp, Homo sapiens
aatgacatgctttttaattata

SEQ ID NO: 9300103 - DNA, 22 bp, Homo sapiens
aacctcaaactcttgggcttaa

SEQ ID NO: 9300104 - DNA, 22 bp, Homo sapiens
agcagagcccttccatggcctt

SEQ ID NO: 9300105 - DNA, 22 bp, Homo sapiens
agcagatgcaaacttaccttga

SEQ ID NO: 9300106 - DNA, 22 bp, Homo sapiens
agcagatgagcctcatgactgg

SEQ ID NO: 9300107 - DNA, 22 bp, Homo sapiens
agcagatgtgtctctgcactgt

SEQ ID NO: 9300108 - DNA, 22 bp, Homo sapiens
agcagatgttccctggtccctt

SEQ ID NO: 9300109 - DNA, 22 bp, Homo sapiens
agcagcaaagaataggccctct

SEQ ID NO: 9300110 - DNA, 22 bp, Homo sapiens
agcagagcagaatgtgaaggtg

SEQ ID NO: 9300111 - DNA, 19 bp, Homo sapiens
agcagagcaaagtggctga

SEQ ID NO: 9300112 - DNA, 22 bp, Homo sapiens
agcagagcatggtgggaagggc

SEQ ID NO: 9300113 - DNA, 22 bp, Homo sapiens
agcagctgggtccggcggagca

SEQ ID NO: 9300114 - DNA, 22 bp, Homo sapiens
agcagctgggctcagagctggg

SEQ ID NO: 9300115 - DNA, 22 bp, Homo sapiens
acacagaggtggccactctttt

SEQ ID NO: 9300116 - DNA, 22 bp, Homo sapiens
acactgaatatacaatgaatat

SEQ ID NO: 9300117 - DNA, 22 bp, Homo sapiens
acactagtagaatagtgtttgc

SEQ ID NO: 9300118 - DNA, 22 bp, Homo sapiens
acactagtggaaattgatttgt

SEQ ID NO: 9300119 - DNA, 22 bp, Homo sapiens
acactagtctcttcttgacttg

SEQ ID NO: 9300120 - DNA, 22 bp, Homo sapiens
acactagtggaaattgatttgt

SEQ ID NO: 9300121 - DNA, 22 bp, Homo sapiens
acactgattgtagtctgtggtg

SEQ ID NO: 9300122 - DNA, 19 bp, Homo sapiens
acacagggatcagagggtt

SEQ ID NO: 9300123 - DNA, 22 bp, Homo sapiens
acacagggcggaaagcatgaga

SEQ ID NO: 9300124 - DNA, 22 bp, Homo sapiens
acacagggcagagagctggctc

SEQ ID NO: 9300125 - DNA, 17 bp, Homo sapiens
acacagggagagggagc

SEQ ID NO: 9300126 - DNA, 22 bp, Homo sapiens
acacagggatatttcaggtggt

SEQ ID NO: 9300127 - DNA, 22 bp, Homo sapiens
acacaggcatagccatacatgt

SEQ ID NO: 9300128 - DNA, 18 bp, Homo sapiens
acacaggctgacagcacc

SEQ ID NO: 9300129 - DNA, 22 bp, Homo sapiens
agcagctggttcccgagggcgt

SEQ ID NO: 9300130 - DNA, 22 bp, Homo sapiens
agcctctctccagcttggcaga

SEQ ID NO: 9300131 - DNA, 22 bp, Homo sapiens
agcctctccagagcctggcaga

SEQ ID NO: 9300132 - DNA, 22 bp, Homo sapiens
agcctctccagagcctggcaga

SEQ ID NO: 9300133 - DNA, 22 bp, Homo sapiens
agcctctcagagtgctgggatt

SEQ ID NO: 9300134 - DNA, 22 bp, Homo sapiens
agcctctcatgttctcccccag

SEQ ID NO: 9300135 - DNA, 22 bp, Homo sapiens
agcctctctgatgtgacagcta

SEQ ID NO: 9300136 - DNA, 22 bp, Homo sapiens
agcctctctgttagtcactggg

SEQ ID NO: 9300137 - DNA, 22 bp, Homo sapiens
agcctctcttatcccttcaaag

SEQ ID NO: 9300138 - DNA, 22 bp, Homo sapiens
agcctctctgttagtcactggg

SEQ ID NO: 9300139 - DNA, 22 bp, Homo sapiens
agcctctcaaagaaaccctgta

SEQ ID NO: 9300140 - DNA, 22 bp, Homo sapiens
agcctctcactgtcaccctccc

SEQ ID NO: 9300141 - DNA, 22 bp, Homo sapiens
agcctcctgtagccctcaccca

SEQ ID NO: 9300142 - DNA, 22 bp, Homo sapiens
agcctctctttattcccagcta

SEQ ID NO: 9300143 - DNA, 22 bp, Homo sapiens
agcctctctttattcccagcta

SEQ ID NO: 9300144 - DNA, 21 bp, Homo sapiens
acagagccgggcacaaagctg

SEQ ID NO: 9300145 - DNA, 22 bp, Homo sapiens
agctcctgcagactcctgctca

SEQ ID NO: 9300146 - DNA, 22 bp, Homo sapiens
agctcctgcacccagccttgag

SEQ ID NO: 9300147 - DNA, 22 bp, Homo sapiens
acagatgtggagtttgcatgat

SEQ ID NO: 9300148 - DNA, 22 bp, Homo sapiens
acagatggagctactaggtaaa

SEQ ID NO: 9300149 - DNA, 22 bp, Homo sapiens
acagagactcatgaaagatgac

SEQ ID NO: 9300150 - DNA, 22 bp, Homo sapiens
acagagagaggcccgaggctgc

SEQ ID NO: 9300151 - DNA, 22 bp, Homo sapiens
acagactgttggcctactgagc

SEQ ID NO: 9300152 - DNA, 22 bp, Homo sapiens
acagacttgttccctagtgagt

SEQ ID NO: 9300153 - DNA, 19 bp, Homo sapiens
agccagggtgagaaggagc

SEQ ID NO: 9300154 - DNA, 19 bp, Homo sapiens
agccagggtccagacatgt

SEQ ID NO: 9300155 - DNA, 22 bp, Homo sapiens
acagaaaatgccagaagggtgg

SEQ ID NO: 9300156 - DNA, 22 bp, Homo sapiens
acagaaaagtttacttttgctc

SEQ ID NO: 9300157 - DNA, 22 bp, Homo sapiens
acactttatcaatattcaaaaa

SEQ ID NO: 9300158 - DNA, 18 bp, Homo sapiens
acagacacttagtatgag

SEQ ID NO: 9300159 - DNA, 22 bp, Homo sapiens
acagaaagaccttgtaacactt

SEQ ID NO: 9300160 - DNA, 22 bp, Homo sapiens
aatggcaaaaggagttagttga

SEQ ID NO: 9300161 - DNA, 22 bp, Homo sapiens
agacaatatgtatattaagaat

SEQ ID NO: 9300162 - DNA, 22 bp, Homo sapiens
agaagcagactctgaggcaagg

SEQ ID NO: 9300163 - DNA, 20 bp, Homo sapiens
agacaaaatgacttcatgca

SEQ ID NO: 9300164 - DNA, 22 bp, Homo sapiens
aatgtaaaatatcttgtacttg

SEQ ID NO: 9300165 - DNA, 22 bp, Homo sapiens
aatgtgcagatgaataaacaaa

SEQ ID NO: 9300166 - DNA, 22 bp, Homo sapiens
aatgtgattagcctctactgga

SEQ ID NO: 9300167 - DNA, 22 bp, Homo sapiens
aatgtgctttgttcagccattt

SEQ ID NO: 9300168 - DNA, 22 bp, Homo sapiens
aatgtgctccaattgtctactt

SEQ ID NO: 9300169 - DNA, 22 bp, Homo sapiens
aatgtgctggtaactgctttgc

SEQ ID NO: 9300170 - DNA, 23 bp, Homo sapiens
aatgtgctgtattcatttctgga

SEQ ID NO: 9300171 - DNA, 22 bp, Homo sapiens
aatgtggcattgtcattattgg

SEQ ID NO: 9300172 - DNA, 22 bp, Homo sapiens
aattctgctcttaacataatgt

SEQ ID NO: 9300173 - DNA, 22 bp, Homo sapiens
aattctgcataaggtggctctg

SEQ ID NO: 9300174 - DNA, 22 bp, Homo sapiens
aattctgcttcatcagctcttt

SEQ ID NO: 9300175 - DNA, 22 bp, Homo sapiens
agagccaggctcccatggggca

SEQ ID NO: 9300176 - DNA, 22 bp, Homo sapiens
agagccaggctctacctgggtt

SEQ ID NO: 9300177 - DNA, 22 bp, Homo sapiens
agagccaggctctacctgggtt

SEQ ID NO: 9300178 - DNA, 22 bp, Homo sapiens
agagccaggcggctgggcacct

SEQ ID NO: 9300179 - DNA, 21 bp, Homo sapiens
aatgtggtacattacatgcat

SEQ ID NO: 9300180 - DNA, 22 bp, Homo sapiens
agaccctgcattttccagggtt

SEQ ID NO: 9300181 - DNA, 22 bp, Homo sapiens
agagacaggagttctgtttcca

SEQ ID NO: 9300182 - DNA, 22 bp, Homo sapiens
agagacaggaatggcattaaga

SEQ ID NO: 9300183 - DNA, 18 bp, Homo sapiens
agagacagcagcaaaaga

SEQ ID NO: 9300184 - DNA, 23 bp, Homo sapiens
aattaaattgctagatccagggc

SEQ ID NO: 9300185 - DNA, 22 bp, Homo sapiens
agaggctgttacactcccagat

SEQ ID NO: 9300186 - DNA, 22 bp, Homo sapiens
agaggctgttacactcccagat

SEQ ID NO: 9300187 - DNA, 22 bp, Homo sapiens
agaggctgagaaaccctcttct

SEQ ID NO: 9300188 - DNA, 22 bp, Homo sapiens
agaggctgtgcagagggagtgc

SEQ ID NO: 9300189 - DNA, 22 bp, Homo sapiens
agaggctgtgcagagggagtgc

SEQ ID NO: 9300190 - DNA, 22 bp, Homo sapiens
agaggctgtgcccaccaggcaa

SEQ ID NO: 9300191 - DNA, 22 bp, Homo sapiens
agaggctgtgcccaccaggcaa

SEQ ID NO: 9300192 - DNA, 21 bp, Homo sapiens
acaaaggaagtctcttttaag

SEQ ID NO: 9300193 - DNA, 22 bp, Homo sapiens
acaaaggactgaaactggctgt

SEQ ID NO: 9300194 - DNA, 22 bp, Homo sapiens
acaaaggactgaaactggctgt

SEQ ID NO: 9300195 - DNA, 18 bp, Homo sapiens
acaaaggatcatgaggga

SEQ ID NO: 9300196 - DNA, 23 bp, Homo sapiens
agaggcttatgtttatttcttcc

SEQ ID NO: 9300197 - DNA, 22 bp, Homo sapiens
agaggcttctcggatggggcag

SEQ ID NO: 9300198 - DNA, 22 bp, Homo sapiens
acaaagggggactgcagagggt

SEQ ID NO: 9300199 - DNA, 22 bp, Homo sapiens
agagggggaaaatagaggtgtt

SEQ ID NO: 9300200 - DNA, 22 bp, Homo sapiens
agagggggcagcggaccagtga

SEQ ID NO: 9300201 - DNA, 22 bp, Homo sapiens
agagggggtgttccagaagcat

SEQ ID NO: 9300202 - DNA, 22 bp, Homo sapiens
agaggggtgggcacagcgccca

SEQ ID NO: 9300203 - DNA, 22 bp, Homo sapiens
agaggctgaatgatgtcatcat

SEQ ID NO: 9300204 - DNA, 22 bp, Homo sapiens
agaggctctttgagctgggaga

SEQ ID NO: 9300205 - DNA, 22 bp, Homo sapiens
aattgcttatgccaggtgagag

SEQ ID NO: 9300206 - DNA, 22 bp, Homo sapiens
aattgcttatcttgttgaatag

SEQ ID NO: 9300207 - DNA, 22 bp, Homo sapiens
aattgcttcccaagggaggtct

SEQ ID NO: 9300208 - DNA, 22 bp, Homo sapiens
aattgcttcattaacatttagg

SEQ ID NO: 9300209 - DNA, 16 bp, Homo sapiens
aattgcttcttgctgc

SEQ ID NO: 9300210 - DNA, 22 bp, Homo sapiens
aattgcttactgtttttcacct

SEQ ID NO: 9300211 - DNA, 22 bp, Homo sapiens
aattgctagtttgtagcatttg

SEQ ID NO: 9300212 - DNA, 22 bp, Homo sapiens
aattgcttagttgcaactatgc

SEQ ID NO: 9300213 - DNA, 22 bp, Homo sapiens
aattgcttagagaatccaggta

SEQ ID NO: 9300214 - DNA, 22 bp, Homo sapiens
aattgctttacaagccgtttaa

SEQ ID NO: 9300215 - DNA, 22 bp, Homo sapiens
aattgcttgttttcggtcataa

SEQ ID NO: 9300216 - DNA, 22 bp, Homo sapiens
aattgctttgaagaagggagcg

SEQ ID NO: 9300217 - DNA, 22 bp, Homo sapiens
aattgctttagttaccatagtg

SEQ ID NO: 9300218 - DNA, 22 bp, Homo sapiens
aattgcttgtcttcttccctac

SEQ ID NO: 9300219 - DNA, 22 bp, Homo sapiens
aattgcttgtttctttaactga

SEQ ID NO: 9300220 - DNA, 17 bp, Homo sapiens
aattgcttgtactccca

SEQ ID NO: 9300221 - DNA, 22 bp, Homo sapiens
aattgcttgatgactagtaatt

SEQ ID NO: 9300222 - DNA, 22 bp, Homo sapiens
aattgcataaatttcatagcat

SEQ ID NO: 9300223 - DNA, 22 bp, Homo sapiens
aattgcataaaattcaactctg

SEQ ID NO: 9300224 - DNA, 19 bp, Homo sapiens
aattgcctgtctctgccag

SEQ ID NO: 9300225 - DNA, 22 bp, Homo sapiens
aattgctaaagattatgttttc

SEQ ID NO: 9300226 - DNA, 18 bp, Homo sapiens
aattgcatttgtttcctt

SEQ ID NO: 9300227 - DNA, 22 bp, Homo sapiens
acaacctgatcccgaggctgag

SEQ ID NO: 9300228 - DNA, 22 bp, Homo sapiens
acaactagcaggtattaatttt

SEQ ID NO: 9300229 - DNA, 22 bp, Homo sapiens
agataagctgtttttcaagaat

SEQ ID NO: 9300230 - DNA, 17 bp, Homo sapiens
agataagcttcagagct

SEQ ID NO: 9300231 - DNA, 22 bp, Homo sapiens
acaaattgcctagtctagcatc

SEQ ID NO: 9300232 - DNA, 22 bp, Homo sapiens
acaatagacaaagtgaatggct

SEQ ID NO: 9300233 - DNA, 21 bp, Homo sapiens
acaatagaatagagtgtggtg

SEQ ID NO: 9300234 - DNA, 22 bp, Homo sapiens
acaatagaaggaaactgacata

SEQ ID NO: 9300235 - DNA, 22 bp, Homo sapiens
acaagcatgtggtaaaaagacc

SEQ ID NO: 9300236 - DNA, 22 bp, Homo sapiens
acaatcttattagtagtataga

SEQ ID NO: 9300237 - DNA, 17 bp, Homo sapiens
aaggagctgagagatgg

SEQ ID NO: 9300238 - DNA, 22 bp, Homo sapiens
aaggagctgggagggacacatg

SEQ ID NO: 9300239 - DNA, 22 bp, Homo sapiens
aaggagcttgttcgccttcctc

SEQ ID NO: 9300240 - DNA, 22 bp, Homo sapiens
aaggagctatgcataactgatc

SEQ ID NO: 9300241 - DNA, 22 bp, Homo sapiens
aaggagctcccggcagaccagg

SEQ ID NO: 9300242 - DNA, 22 bp, Homo sapiens
aagctggaacatcttgaggaag

SEQ ID NO: 9300243 - DNA, 22 bp, Homo sapiens
aagctggacattgtagggggga

SEQ ID NO: 9300244 - DNA, 22 bp, Homo sapiens
aaggagaatttggcttgtgatg

SEQ ID NO: 9300245 - DNA, 22 bp, Homo sapiens
acagtcttcccttattccactc

SEQ ID NO: 9300246 - DNA, 22 bp, Homo sapiens
acagtcttgagcatcagccaga

SEQ ID NO: 9300247 - DNA, 22 bp, Homo sapiens
acagtgttcttggcgctgagtg

SEQ ID NO: 9300248 - DNA, 22 bp, Homo sapiens
acagtgttcttgatattacagt

SEQ ID NO: 9300249 - DNA, 22 bp, Homo sapiens
acagtgttgaggtgcttgtttc

SEQ ID NO: 9300250 - DNA, 22 bp, Homo sapiens
acagtgttgtatttagtttgat

SEQ ID NO: 9300251 - DNA, 22 bp, Homo sapiens
acagtgtttaaaaatcagatct

SEQ ID NO: 9300252 - DNA, 22 bp, Homo sapiens
acagtgttgtggctcttaatag

SEQ ID NO: 9300253 - DNA, 22 bp, Homo sapiens
acatagaacctggcacatagta

SEQ ID NO: 9300254 - DNA, 22 bp, Homo sapiens
aaggaggcaccctgagcctgcc

SEQ ID NO: 9300255 - DNA, 22 bp, Homo sapiens
acagtgtttatgtacagattgt

SEQ ID NO: 9300256 - DNA, 22 bp, Homo sapiens
acagtgtttaaaataatatgct

SEQ ID NO: 9300257 - DNA, 22 bp, Homo sapiens
acagtgtttaagagatggcatt

SEQ ID NO: 9300258 - DNA, 22 bp, Homo sapiens
acagtgtttcacttaaccgttt

SEQ ID NO: 9300259 - DNA, 22 bp, Homo sapiens
acagtgtttggcaatgcatgca

SEQ ID NO: 9300260 - DNA, 22 bp, Homo sapiens
aaggcagagattagcagaatga

SEQ ID NO: 9300261 - DNA, 22 bp, Homo sapiens
aaggcagaggaaggtctagttt

SEQ ID NO: 9300262 - DNA, 22 bp, Homo sapiens
aaggcagagtctatcttggaag

SEQ ID NO: 9300263 - DNA, 22 bp, Homo sapiens
aaggcagagggctggatcagag

SEQ ID NO: 9300264 - DNA, 22 bp, Homo sapiens
acagggcagagggcagttggta

SEQ ID NO: 9300265 - DNA, 19 bp, Homo sapiens
acagggcagcaataggata

SEQ ID NO: 9300266 - DNA, 22 bp, Homo sapiens
acagggcagagaggcaggcttg

SEQ ID NO: 9300267 - DNA, 22 bp, Homo sapiens
acagggcagaaatgttgcatct

SEQ ID NO: 9300268 - DNA, 22 bp, Homo sapiens
aagctctggggtacacatctgc

SEQ ID NO: 9300269 - DNA, 22 bp, Homo sapiens
aagctcagtgatgcctccaggg

SEQ ID NO: 9300270 - DNA, 22 bp, Homo sapiens
aagctcagtgatgcctccaggg

SEQ ID NO: 9300271 - DNA, 22 bp, Homo sapiens
aagctcaggaaagagtctggtt

SEQ ID NO: 9300272 - DNA, 22 bp, Homo sapiens
aagctcaggctggacctggctt

SEQ ID NO: 9300273 - DNA, 22 bp, Homo sapiens
aagctctgaggtgagcaatcgg

SEQ ID NO: 9300274 - DNA, 22 bp, Homo sapiens
aagctcagagtagctcagcgtc

SEQ ID NO: 9300275 - DNA, 22 bp, Homo sapiens
aagctcagaggtagataatgtt

SEQ ID NO: 9300276 - DNA, 22 bp, Homo sapiens
aagctcagcatgtctcctagaa

SEQ ID NO: 9300277 - DNA, 22 bp, Homo sapiens
aagctcagcatgtctcctagaa

SEQ ID NO: 9300278 - DNA, 22 bp, Homo sapiens
aagctcagagtagctcagcgtc

SEQ ID NO: 9300279 - DNA, 22 bp, Homo sapiens
aagctcagcagccaggccctgt

SEQ ID NO: 9300280 - DNA, 22 bp, Homo sapiens
aagccaacatgattactataat

SEQ ID NO: 9300281 - DNA, 22 bp, Homo sapiens
aagccaagtgctggccatgggc

SEQ ID NO: 9300282 - DNA, 22 bp, Homo sapiens
aagccaaggttttggtcacagc

SEQ ID NO: 9300283 - DNA, 22 bp, Homo sapiens
aagcgccatggttcctgcgcag

SEQ ID NO: 9300284 - DNA, 22 bp, Homo sapiens
aagcgcagacacagagagtgga

SEQ ID NO: 9300285 - DNA, 22 bp, Homo sapiens
aagccttggggctcctctgtat

SEQ ID NO: 9300286 - DNA, 23 bp, Homo sapiens
aagccttgtggaggctctcattt

SEQ ID NO: 9300287 - DNA, 22 bp, Homo sapiens
aagccttgattcactctgtgga

SEQ ID NO: 9300288 - DNA, 22 bp, Homo sapiens
acagccttattgcgagcaaggc

SEQ ID NO: 9300289 - DNA, 19 bp, Homo sapiens
acagcctgttggtggggct

SEQ ID NO: 9300290 - DNA, 22 bp, Homo sapiens
acagcctgtttgatctggtgct

SEQ ID NO: 9300291 - DNA, 21 bp, Homo sapiens
acagccttacctggggtgtga

SEQ ID NO: 9300292 - DNA, 22 bp, Homo sapiens
acagcctgtgtaccagctggga

SEQ ID NO: 9300293 - DNA, 21 bp, Homo sapiens
acagcctgtcatctcatggtc

SEQ ID NO: 9300294 - DNA, 22 bp, Homo sapiens
acagcctggactggctctctgc

SEQ ID NO: 9300295 - DNA, 22 bp, Homo sapiens
aaggcagataagaattcagcaa

SEQ ID NO: 9300296 - DNA, 20 bp, Homo sapiens
aaggcagagtgggttggagc

SEQ ID NO: 9300297 - DNA, 22 bp, Homo sapiens
aaggccttctcttgtgtctgtg

SEQ ID NO: 9300298 - DNA, 22 bp, Homo sapiens
aaggcctgctcagctgtctgtg

SEQ ID NO: 9300299 - DNA, 21 bp, Homo sapiens
aaggcctgcttactgctagtt

SEQ ID NO: 9300300 - DNA, 22 bp, Homo sapiens
aaggcctgggaggcctctcttc

SEQ ID NO: 9300301 - DNA, 22 bp, Homo sapiens
aaggccttctaccaaggctggg

SEQ ID NO: 9300302 - DNA, 22 bp, Homo sapiens
aaggcgctgggctaaggcacca

SEQ ID NO: 9300303 - DNA, 22 bp, Homo sapiens
aaggctccaccctcatggatgc

SEQ ID NO: 9300304 - DNA, 22 bp, Homo sapiens
aaggctccagtgaatgctggca

SEQ ID NO: 9300305 - DNA, 22 bp, Homo sapiens
aaggctccctcttctcgagtgt

SEQ ID NO: 9300306 - DNA, 22 bp, Homo sapiens
aaggctccgtgactggggctga

SEQ ID NO: 9300307 - DNA, 21 bp, Homo sapiens
aaggctcctcctctaggcctc

SEQ ID NO: 9300308 - DNA, 22 bp, Homo sapiens
aaggctcctttgtagttctttt

SEQ ID NO: 9300309 - DNA, 22 bp, Homo sapiens
acatttaaatacctatgtttct

SEQ ID NO: 9300310 - DNA, 22 bp, Homo sapiens
aaggctgcttttaacatgcata

SEQ ID NO: 9300311 - DNA, 22 bp, Homo sapiens
aaggctggacctggatgaatct

SEQ ID NO: 9300312 - DNA, 22 bp, Homo sapiens
aaggctggacctggatgaatct

SEQ ID NO: 9300313 - DNA, 22 bp, Homo sapiens
acatttaaatatgccttatatt

SEQ ID NO: 9300314 - DNA, 21 bp, Homo sapiens
aaggctggagatgcaggtctg

SEQ ID NO: 9300315 - DNA, 19 bp, Homo sapiens
aaggctggagaaggcctct

SEQ ID NO: 9300316 - DNA, 19 bp, Homo sapiens
aaggctggagaaggcctct

SEQ ID NO: 9300317 - DNA, 22 bp, Homo sapiens
aaggctggagatggttggaatg

SEQ ID NO: 9300318 - DNA, 22 bp, Homo sapiens
aaggctggagatggttggaatg

SEQ ID NO: 9300319 - DNA, 21 bp, Homo sapiens
aaggctggagatgcaggtctg

SEQ ID NO: 9300320 - DNA, 22 bp, Homo sapiens
aaggctggcaatatatttgtta

SEQ ID NO: 9300321 - DNA, 22 bp, Homo sapiens
aaggctggcaatatatttgtta

SEQ ID NO: 9300322 - DNA, 22 bp, Homo sapiens
aaggctgggaaacatgcaggcc

SEQ ID NO: 9300323 - DNA, 22 bp, Homo sapiens
acatttctcttgatgtctctat

SEQ ID NO: 9300324 - DNA, 22 bp, Homo sapiens
accaggcttgatgatttgctta

SEQ ID NO: 9300325 - DNA, 21 bp, Homo sapiens
accaggcttgtgggagggagc

SEQ ID NO: 9300326 - DNA, 22 bp, Homo sapiens
aagggctgggtctggttaaccc

SEQ ID NO: 9300327 - DNA, 22 bp, Homo sapiens
aagggctggtctagaaagggag

SEQ ID NO: 9300328 - DNA, 22 bp, Homo sapiens
aagggctggtctagaaagggag

SEQ ID NO: 9300329 - DNA, 22 bp, Homo sapiens
aagggcttaggattttgctgtg

SEQ ID NO: 9300330 - DNA, 22 bp, Homo sapiens
aagggctgttatgtttttatac

SEQ ID NO: 9300331 - DNA, 22 bp, Homo sapiens
aagggctgtagtttgttgatca

SEQ ID NO: 9300332 - DNA, 22 bp, Homo sapiens
aagggctgtagtttgttgatca

SEQ ID NO: 9300333 - DNA, 22 bp, Homo sapiens
aagggctgtagacaagattgct

SEQ ID NO: 9300334 - DNA, 22 bp, Homo sapiens
aagggctgtagacaagattgct

SEQ ID NO: 9300335 - DNA, 22 bp, Homo sapiens
aagggctgtaagccaagtaaag

SEQ ID NO: 9300336 - DNA, 22 bp, Homo sapiens
aagggcttaggattttgctgtg

SEQ ID NO: 9300337 - DNA, 22 bp, Homo sapiens
aagggcttaggattttgctgtg

SEQ ID NO: 9300338 - DNA, 19 bp, Homo sapiens
accaggcttatggtcagtg

SEQ ID NO: 9300339 - DNA, 22 bp, Homo sapiens
accaggcttaatcctttgctat

SEQ ID NO: 9300340 - DNA, 21 bp, Homo sapiens
accaggccaggaggctggcac

SEQ ID NO: 9300341 - DNA, 22 bp, Homo sapiens
acatttgttgccattcatggag

SEQ ID NO: 9300342 - DNA, 22 bp, Homo sapiens
acatttgtttctctagagtagg

SEQ ID NO: 9300343 - DNA, 22 bp, Homo sapiens
acatttgtgggggaacaggata

SEQ ID NO: 9300344 - DNA, 20 bp, Homo sapiens
acatttgtggatctgagaga

SEQ ID NO: 9300345 - DNA, 22 bp, Homo sapiens
acatttgtgcacatgtgcatgg

SEQ ID NO: 9300346 - DNA, 22 bp, Homo sapiens
acatttgtgcacatgtgcatgg

SEQ ID NO: 9300347 - DNA, 22 bp, Homo sapiens
acattttaatatgcttagtgtg

SEQ ID NO: 9300348 - DNA, 22 bp, Homo sapiens
accctgagtcagacagcctgac

SEQ ID NO: 9300349 - DNA, 22 bp, Homo sapiens
acccaggatagagtgctgcagt

SEQ ID NO: 9300350 - DNA, 22 bp, Homo sapiens
acccaggataatctgtgtatct

SEQ ID NO: 9300351 - DNA, 22 bp, Homo sapiens
accccttctcctggctgttcca

SEQ ID NO: 9300352 - DNA, 22 bp, Homo sapiens
accctgagaaagtcacatgcat

SEQ ID NO: 9300353 - DNA, 22 bp, Homo sapiens
accctgagggatgagagttgca

SEQ ID NO: 9300354 - DNA, 22 bp, Homo sapiens
acccaggagccgtgagaggtta

SEQ ID NO: 9300355 - DNA, 22 bp, Homo sapiens
acccaggagctctggggtcctc

SEQ ID NO: 9300356 - DNA, 22 bp, Homo sapiens
acccaggaggcagaggttgcag

SEQ ID NO: 9300357 - DNA, 22 bp, Homo sapiens
acccaggaggcaaggttgcagt

SEQ ID NO: 9300358 - DNA, 22 bp, Homo sapiens
acccaggaggtggaggctgcag

SEQ ID NO: 9300359 - DNA, 22 bp, Homo sapiens
acccaggaggtgacacagggct

SEQ ID NO: 9300360 - DNA, 22 bp, Homo sapiens
agaaattgccagaatgtcaggc

SEQ ID NO: 9300361 - DNA, 22 bp, Homo sapiens
aatgagttctggttcattttat

SEQ ID NO: 9300362 - DNA, 23 bp, Homo sapiens
aatgatttcatgatgatagcagc

SEQ ID NO: 9300363 - DNA, 22 bp, Homo sapiens
aatgattgtcattccaaaaagt

SEQ ID NO: 9300364 - DNA, 22 bp, Homo sapiens
aatgattgcaaacattgagaac

SEQ ID NO: 9300365 - DNA, 22 bp, Homo sapiens
aatgatgtgagtttttattctc

SEQ ID NO: 9300366 - DNA, 22 bp, Homo sapiens
agaagcagaaggaagcagggcc

SEQ ID NO: 9300367 - DNA, 22 bp, Homo sapiens
agaagcagaaggaagcagggcc

SEQ ID NO: 9300368 - DNA, 22 bp, Homo sapiens
aatcagctaaataaactagtca

SEQ ID NO: 9300369 - DNA, 22 bp, Homo sapiens
aatcaggaggaagccttgggca

SEQ ID NO: 9300370 - DNA, 22 bp, Homo sapiens
aatcagtttcttggcaagttta

SEQ ID NO: 9300371 - DNA, 22 bp, Homo sapiens
aatcagttagggtgttaatgag

SEQ ID NO: 9300372 - DNA, 22 bp, Homo sapiens
aatcagttgtccaaagttcaca

SEQ ID NO: 9300373 - DNA, 22 bp, Homo sapiens
aatcataattcaaataagctta

SEQ ID NO: 9300374 - DNA, 22 bp, Homo sapiens
aatcagttaaatattgagtaca

SEQ ID NO: 9300375 - DNA, 22 bp, Homo sapiens
aatatagaatcactttccttca

SEQ ID NO: 9300376 - DNA, 22 bp, Homo sapiens
aatatagatttactcaagagaa

SEQ ID NO: 9300377 - DNA, 22 bp, Homo sapiens
aatactatgtagccaaaataat

SEQ ID NO: 9300378 - DNA, 23 bp, Homo sapiens
actttattgaccccaggtcagtt

SEQ ID NO: 9300379 - DNA, 22 bp, Homo sapiens
actttcttaggctgtataaatg

SEQ ID NO: 9300380 - DNA, 23 bp, Homo sapiens
actttattgaccccaggtcagtt

SEQ ID NO: 9300381 - DNA, 22 bp, Homo sapiens
actttcttctactacttggaga

SEQ ID NO: 9300382 - DNA, 22 bp, Homo sapiens
actttcttatccatgatctcac

SEQ ID NO: 9300383 - DNA, 22 bp, Homo sapiens
actttcttaggctgtataaatg

SEQ ID NO: 9300384 - DNA, 22 bp, Homo sapiens
actttcttcttatgcattaagg

SEQ ID NO: 9300385 - DNA, 22 bp, Homo sapiens
actttcttggtcccatgtttga

SEQ ID NO: 9300386 - DNA, 22 bp, Homo sapiens
acggtgctgggtattggggttc

SEQ ID NO: 9300387 - DNA, 22 bp, Homo sapiens
acgtagaaaccaaatagcatca

SEQ ID NO: 9300388 - DNA, 22 bp, Homo sapiens
acgtgcaggatctggttggcga

SEQ ID NO: 9300389 - DNA, 22 bp, Homo sapiens
acggggctagagaaggtttctt

SEQ ID NO: 9300390 - DNA, 22 bp, Homo sapiens
accgggaagtcctgcactgggc

SEQ ID NO: 9300391 - DNA, 20 bp, Homo sapiens
acgtggccaccagtggctta

SEQ ID NO: 9300392 - DNA, 18 bp, Homo sapiens
acgtgctgtgccttttgc

SEQ ID NO: 9300393 - DNA, 22 bp, Homo sapiens
aagtcgtcgaagatggaggttg

SEQ ID NO: 9300394 - DNA, 22 bp, Homo sapiens
actcactttccattcaagcacc

SEQ ID NO: 9300395 - DNA, 22 bp, Homo sapiens
actatacataaaacatttgggt

SEQ ID NO: 9300396 - DNA, 22 bp, Homo sapiens
actccctccaaatctgcacagt

SEQ ID NO: 9300397 - DNA, 22 bp, Homo sapiens
actcagagaatatctagaagga

SEQ ID NO: 9300398 - DNA, 22 bp, Homo sapiens
actcagagaacattcccagtct

SEQ ID NO: 9300399 - DNA, 22 bp, Homo sapiens
actcagagaactggattagagg

SEQ ID NO: 9300400 - DNA, 22 bp, Homo sapiens
actcagagaaacagcagggtgt

SEQ ID NO: 9300401 - DNA, 22 bp, Homo sapiens
actctccctgagagggaggcat

SEQ ID NO: 9300402 - DNA, 22 bp, Homo sapiens
actctcccacgttcgactctaa

SEQ ID NO: 9300403 - DNA, 22 bp, Homo sapiens
actctcacagtctttgacttgg

SEQ ID NO: 9300404 - DNA, 22 bp, Homo sapiens
actctcactgcttggctcctgc

SEQ ID NO: 9300405 - DNA, 22 bp, Homo sapiens
actctcactagctctgtgacct

SEQ ID NO: 9300406 - DNA, 22 bp, Homo sapiens
actggagctgagagcatgggta

SEQ ID NO: 9300407 - DNA, 22 bp, Homo sapiens
actgctagtgagaaaataacca

SEQ ID NO: 9300408 - DNA, 22 bp, Homo sapiens
actgcgtggggagctgtgacta

SEQ ID NO: 9300409 - DNA, 22 bp, Homo sapiens
aataccatgcagaaataacata

SEQ ID NO: 9300410 - DNA, 22 bp, Homo sapiens
actggctgaggaagttgccact

SEQ ID NO: 9300411 - DNA, 22 bp, Homo sapiens
actggctgaaagtaaagaacac

SEQ ID NO: 9300412 - DNA, 22 bp, Homo sapiens
actggctgaagtttactttttg

SEQ ID NO: 9300413 - DNA, 22 bp, Homo sapiens
actctgctgtttactctctata

SEQ ID NO: 9300414 - DNA, 22 bp, Homo sapiens
actctgctggctgcagggcagc

SEQ ID NO: 9300415 - DNA, 22 bp, Homo sapiens
actgcactccagcctgggtaac

SEQ ID NO: 9300416 - DNA, 22 bp, Homo sapiens
actgcactccaacctgggtgac

SEQ ID NO: 9300417 - DNA, 22 bp, Homo sapiens
actgcactccagcctcggggtc

SEQ ID NO: 9300418 - DNA, 22 bp, Homo sapiens
accaaacaaaattgtgcactgt

SEQ ID NO: 9300419 - DNA, 22 bp, Homo sapiens
acatttgtcttctttcagatta

SEQ ID NO: 9300420 - DNA, 22 bp, Homo sapiens
acatttgtcttcctcctcagtg

SEQ ID NO: 9300421 - DNA, 22 bp, Homo sapiens
acatttgtctggctagaaagtt

SEQ ID NO: 9300422 - DNA, 20 bp, Homo sapiens
acattttggcatactctcaa

SEQ ID NO: 9300423 - DNA, 22 bp, Homo sapiens
acatttgtgattatctagggct

SEQ ID NO: 9300424 - DNA, 22 bp, Homo sapiens
aggctggcaaggcagatgtgtg

SEQ ID NO: 9300425 - DNA, 20 bp, Homo sapiens
aggctggcactcctggccag

SEQ ID NO: 9300426 - DNA, 20 bp, Homo sapiens
aggctggcactcctggccag

SEQ ID NO: 9300427 - DNA, 22 bp, Homo sapiens
aggctggagtgtgcagtggcgc

SEQ ID NO: 9300428 - DNA, 22 bp, Homo sapiens
aggctggcagccacctcagcag

SEQ ID NO: 9300429 - DNA, 22 bp, Homo sapiens
aggctttatttgatctatatgc

SEQ ID NO: 9300430 - DNA, 22 bp, Homo sapiens
aggctttactgcctcaggactc

SEQ ID NO: 9300431 - DNA, 22 bp, Homo sapiens
agggaagcaggaatagctctga

SEQ ID NO: 9300432 - DNA, 22 bp, Homo sapiens
accaggcctagcaagtacatta

SEQ ID NO: 9300433 - DNA, 22 bp, Homo sapiens
accaggccctccagctgcgtgg

SEQ ID NO: 9300434 - DNA, 22 bp, Homo sapiens
accaggcccaccgcatgctcct

SEQ ID NO: 9300435 - DNA, 20 bp, Homo sapiens
accaggcccggtgtctcctc

SEQ ID NO: 9300436 - DNA, 22 bp, Homo sapiens
accaggcccgctgctatggtgg

SEQ ID NO: 9300437 - DNA, 20 bp, Homo sapiens
accaggccccgggccctgca

SEQ ID NO: 9300438 - DNA, 22 bp, Homo sapiens
accaggcccatgtggattacta

SEQ ID NO: 9300439 - DNA, 22 bp, Homo sapiens
acccgggaggcaggagtcatag

SEQ ID NO: 9300440 - DNA, 22 bp, Homo sapiens
accccttttatagaagaacaga

SEQ ID NO: 9300441 - DNA, 22 bp, Homo sapiens
agggcctggggtagcttactgc

SEQ ID NO: 9300442 - DNA, 22 bp, Homo sapiens
agggcctggtgacctgggtcct

SEQ ID NO: 9300443 - DNA, 22 bp, Homo sapiens
agggcctgggtctgtactcctc

SEQ ID NO: 9300444 - DNA, 22 bp, Homo sapiens
agggcctgggaagaggaaccct

SEQ ID NO: 9300445 - DNA, 22 bp, Homo sapiens
acccaggctggagtgcagtagc

SEQ ID NO: 9300446 - DNA, 22 bp, Homo sapiens
agggcctgggccagcacccttt

SEQ ID NO: 9300447 - DNA, 22 bp, Homo sapiens
agggcctgggatgtcctcctag

SEQ ID NO: 9300448 - DNA, 20 bp, Homo sapiens
agggcagcttgaggagccgg

SEQ ID NO: 9300449 - DNA, 22 bp, Homo sapiens
acccaaagcaatattcatcagt

SEQ ID NO: 9300450 - DNA, 22 bp, Homo sapiens
accatttgactctctaaggata

SEQ ID NO: 9300451 - DNA, 22 bp, Homo sapiens
agggcatgaaatgggcagaagc

SEQ ID NO: 9300452 - DNA, 23 bp, Homo sapiens
agggcatgaagcagaggacgtgg

SEQ ID NO: 9300453 - DNA, 22 bp, Homo sapiens
acccaggagcaggctgggcagt

SEQ ID NO: 9300454 - DNA, 20 bp, Homo sapiens
accattaatgtaagctttgt

SEQ ID NO: 9300455 - DNA, 22 bp, Homo sapiens
accatttaaggaaaatgtatca

SEQ ID NO: 9300456 - DNA, 22 bp, Homo sapiens
aggcctgcctggagcctggctg

SEQ ID NO: 9300457 - DNA, 22 bp, Homo sapiens
aggcaggctggtctgaagagtg

SEQ ID NO: 9300458 - DNA, 23 bp, Homo sapiens
aggcaggcagttcagctgttgtt

SEQ ID NO: 9300459 - DNA, 22 bp, Homo sapiens
aggcagggaccagttgttttct

SEQ ID NO: 9300460 - DNA, 22 bp, Homo sapiens
aggcaggcagctgtcaccactc

SEQ ID NO: 9300461 - DNA, 22 bp, Homo sapiens
aggcaggcagggctcactgtct

SEQ ID NO: 9300462 - DNA, 22 bp, Homo sapiens
aggcagggctgggattagactc

SEQ ID NO: 9300463 - DNA, 22 bp, Homo sapiens
aggcagggctcatttcttaggc

SEQ ID NO: 9300464 - DNA, 22 bp, Homo sapiens
aggcagggctgggattagactc

SEQ ID NO: 9300465 - DNA, 22 bp, Homo sapiens
acatgaaagttattctgagttg

SEQ ID NO: 9300466 - DNA, 22 bp, Homo sapiens
acatgaggaaacaagggtatat

SEQ ID NO: 9300467 - DNA, 22 bp, Homo sapiens
acatttattttcagctgggaaa

SEQ ID NO: 9300468 - DNA, 22 bp, Homo sapiens
acatttattttcagctgggaaa

SEQ ID NO: 9300469 - DNA, 22 bp, Homo sapiens
acatttattactcaggttgttg

SEQ ID NO: 9300470 - DNA, 22 bp, Homo sapiens
acatttattactcaggttgttg

SEQ ID NO: 9300471 - DNA, 22 bp, Homo sapiens
acatttattttggcacggcaca

SEQ ID NO: 9300472 - DNA, 22 bp, Homo sapiens
acatttattttggcacggcaca

SEQ ID NO: 9300473 - DNA, 22 bp, Homo sapiens
acatttatatttagtggggaat

SEQ ID NO: 9300474 - DNA, 22 bp, Homo sapiens
acatttatatttagtggggaat

SEQ ID NO: 9300475 - DNA, 22 bp, Homo sapiens
acatttatataactcactagga

SEQ ID NO: 9300476 - DNA, 19 bp, Homo sapiens
acatttagaatgtacttgc

SEQ ID NO: 9300477 - DNA, 22 bp, Homo sapiens
aggctgagggctcctgagggca

SEQ ID NO: 9300478 - DNA, 20 bp, Homo sapiens
aggctgagttctatgcactt

SEQ ID NO: 9300479 - DNA, 22 bp, Homo sapiens
aggctgagtttctcattctcgc

SEQ ID NO: 9300480 - DNA, 22 bp, Homo sapiens
aggctgcaaagtgcttgggtgc

SEQ ID NO: 9300481 - DNA, 19 bp, Homo sapiens
aggctgcaaggtggtgggc

SEQ ID NO: 9300482 - DNA, 22 bp, Homo sapiens
aggcgctgagtaggcaaggagg

SEQ ID NO: 9300483 - DNA, 22 bp, Homo sapiens
aggctagctgattgccttagaa

SEQ ID NO: 9300484 - DNA, 22 bp, Homo sapiens
aggcgcagggtttggacccagg

SEQ ID NO: 9300485 - DNA, 22 bp, Homo sapiens
aggccttaccatagctgtagca

SEQ ID NO: 9300486 - DNA, 22 bp, Homo sapiens
aggccttaccatagctgtagca

SEQ ID NO: 9300487 - DNA, 22 bp, Homo sapiens
aggcctgtttccttgggttgct

SEQ ID NO: 9300488 - DNA, 22 bp, Homo sapiens
aggcctgcctggatcacacaga

SEQ ID NO: 9300489 - DNA, 22 bp, Homo sapiens
aggctatgatattattgagaca

SEQ ID NO: 9300490 - DNA, 22 bp, Homo sapiens
aggctagggtaacagatgtggc

SEQ ID NO: 9300491 - DNA, 22 bp, Homo sapiens
aggctagggtaacagatgtggc

SEQ ID NO: 9300492 - DNA, 22 bp, Homo sapiens
aggctaggccttgccctggaac

SEQ ID NO: 9300493 - DNA, 22 bp, Homo sapiens
aggctagctttggctcagtaaa

SEQ ID NO: 9300494 - DNA, 22 bp, Homo sapiens
aggctaggaatcaagcctttct

SEQ ID NO: 9300495 - DNA, 22 bp, Homo sapiens
aggctagggccatggctggtga

SEQ ID NO: 9300496 - DNA, 22 bp, Homo sapiens
aggctagggccatggctggtga

SEQ ID NO: 9300497 - DNA, 22 bp, Homo sapiens
aggctaggctgatgcctcttcc

SEQ ID NO: 9300498 - DNA, 22 bp, Homo sapiens
aggctagggccatggctggtga

SEQ ID NO: 9300499 - DNA, 22 bp, Homo sapiens
acatttaatgatcctactgtga

SEQ ID NO: 9300500 - DNA, 22 bp, Homo sapiens
acatttaaccctcaggtttctg

SEQ ID NO: 9300501 - DNA, 22 bp, Homo sapiens
acatttaaccaaactgtttaat

SEQ ID NO: 9300502 - DNA, 23 bp, Homo sapiens
acagcttcctggcatggagaacc

SEQ ID NO: 9300503 - DNA, 23 bp, Homo sapiens
acagcttcctactttgctgctgc

SEQ ID NO: 9300504 - DNA, 22 bp, Homo sapiens
acagcttccagtattcttgaaa

SEQ ID NO: 9300505 - DNA, 22 bp, Homo sapiens
acagcttcacccattatccctg

SEQ ID NO: 9300506 - DNA, 22 bp, Homo sapiens
agctttatcttcacctgggaat

SEQ ID NO: 9300507 - DNA, 22 bp, Homo sapiens
agctttatcttcacctgggaat

SEQ ID NO: 9300508 - DNA, 22 bp, Homo sapiens
agctttatcagaggagtctcta

SEQ ID NO: 9300509 - DNA, 22 bp, Homo sapiens
agctttatcagaggagtctcta

SEQ ID NO: 9300510 - DNA, 22 bp, Homo sapiens
agctttatcccttgcccatcga

SEQ ID NO: 9300511 - DNA, 22 bp, Homo sapiens
agctttatgaggagaccttagt

SEQ ID NO: 9300512 - DNA, 22 bp, Homo sapiens
agctttatatttaatgaattct

SEQ ID NO: 9300513 - DNA, 22 bp, Homo sapiens
agctttatcacaatattggcta

SEQ ID NO: 9300514 - DNA, 22 bp, Homo sapiens
acaggcctgatgttatcctatt

SEQ ID NO: 9300515 - DNA, 17 bp, Homo sapiens
acaggcctgcttgcact

SEQ ID NO: 9300516 - DNA, 22 bp, Homo sapiens
acaggcctgagattttgcattt

SEQ ID NO: 9300517 - DNA, 22 bp, Homo sapiens
acaggcctgatgccttggctgg

SEQ ID NO: 9300518 - DNA, 22 bp, Homo sapiens
acaggcctgacacacagagggc

SEQ ID NO: 9300519 - DNA, 18 bp, Homo sapiens
acaggcctcagtcctgca

SEQ ID NO: 9300520 - DNA, 22 bp, Homo sapiens
acaggcctcccatccggagccc

SEQ ID NO: 9300521 - DNA, 22 bp, Homo sapiens
acaggcctcaaatagggtgcct

SEQ ID NO: 9300522 - DNA, 22 bp, Homo sapiens
acaggcctacgaagtcaggtgc

SEQ ID NO: 9300523 - DNA, 18 bp, Homo sapiens
acaggctgtgggaatggt

SEQ ID NO: 9300524 - DNA, 22 bp, Homo sapiens
acaggctctggggcaggatggc

SEQ ID NO: 9300525 - DNA, 21 bp, Homo sapiens
acaggctctggggatgctggg

SEQ ID NO: 9300526 - DNA, 21 bp, Homo sapiens
acaggctctggggatgctggg

SEQ ID NO: 9300527 - DNA, 22 bp, Homo sapiens
agctttatgggagcttagataa

SEQ ID NO: 9300528 - DNA, 22 bp, Homo sapiens
agctttatgcttcctacaagct

SEQ ID NO: 9300529 - DNA, 22 bp, Homo sapiens
agctttatgcttcctacaagct

SEQ ID NO: 9300530 - DNA, 22 bp, Homo sapiens
acaggctggaggaggaccaaga

SEQ ID NO: 9300531 - DNA, 22 bp, Homo sapiens
agctgcccaggttcattgggcc

SEQ ID NO: 9300532 - DNA, 22 bp, Homo sapiens
acagcactggtcccgcaagcct

SEQ ID NO: 9300533 - DNA, 22 bp, Homo sapiens
acagcacttattcagcacagtg

SEQ ID NO: 9300534 - DNA, 22 bp, Homo sapiens
agctgcccaatcctgcagggcg

SEQ ID NO: 9300535 - DNA, 22 bp, Homo sapiens
agctgcccaaggtcacagagct

SEQ ID NO: 9300536 - DNA, 21 bp, Homo sapiens
agctgcccagagtagggaagg

SEQ ID NO: 9300537 - DNA, 22 bp, Homo sapiens
agctgcccagataggaggaggc

SEQ ID NO: 9300538 - DNA, 22 bp, Homo sapiens
agctggggctgtggttgtgatt

SEQ ID NO: 9300539 - DNA, 22 bp, Homo sapiens
agctgggggtagtgagaaataa

SEQ ID NO: 9300540 - DNA, 22 bp, Homo sapiens
agctgggggttggataagggta

SEQ ID NO: 9300541 - DNA, 22 bp, Homo sapiens
agctggggttgcacacattttg

SEQ ID NO: 9300542 - DNA, 22 bp, Homo sapiens
agctgggggttggataagggta

SEQ ID NO: 9300543 - DNA, 22 bp, Homo sapiens
agctggggctgcagagaacagg

SEQ ID NO: 9300544 - DNA, 22 bp, Homo sapiens
agctggggctgcagagaacagg

SEQ ID NO: 9300545 - DNA, 21 bp, Homo sapiens
acagccttgtgatggagacag

SEQ ID NO: 9300546 - DNA, 22 bp, Homo sapiens
acagctcctactgaagccatgt

SEQ ID NO: 9300547 - DNA, 22 bp, Homo sapiens
acagctcttcttcaagcctggc

SEQ ID NO: 9300548 - DNA, 22 bp, Homo sapiens
acagggcaacctctgggagact

SEQ ID NO: 9300549 - DNA, 18 bp, Homo sapiens
acagggagggcgctgggg

SEQ ID NO: 9300550 - DNA, 22 bp, Homo sapiens
acagggcacctgaggtaggaag

SEQ ID NO: 9300551 - DNA, 21 bp, Homo sapiens
aggagctgtgttagctggtcg

SEQ ID NO: 9300552 - DNA, 21 bp, Homo sapiens
aggagctgtgttagctggtcg

SEQ ID NO: 9300553 - DNA, 22 bp, Homo sapiens
aggagctgttttgttcagcaaa

SEQ ID NO: 9300554 - DNA, 22 bp, Homo sapiens
aggagctgttttgttcagcaaa

SEQ ID NO: 9300555 - DNA, 22 bp, Homo sapiens
aggagctggagtccaggcaagt

SEQ ID NO: 9300556 - DNA, 21 bp, Homo sapiens
aggagctgtgtgcttcctttc

SEQ ID NO: 9300557 - DNA, 22 bp, Homo sapiens
aggagctggagtccaggcaagt

SEQ ID NO: 9300558 - DNA, 22 bp, Homo sapiens
acagtgaggacagggactgtgt

SEQ ID NO: 9300559 - DNA, 22 bp, Homo sapiens
acagtgaggaagcagctgtgct

SEQ ID NO: 9300560 - DNA, 22 bp, Homo sapiens
aggagtctgaactggtcccctg

SEQ ID NO: 9300561 - DNA, 22 bp, Homo sapiens
aggagtctgttgaaatgtctat

SEQ ID NO: 9300562 - DNA, 22 bp, Homo sapiens
aggagggtgatccgggctggtc

SEQ ID NO: 9300563 - DNA, 22 bp, Homo sapiens
acagtaaatcaacagaatatct

SEQ ID NO: 9300564 - DNA, 22 bp, Homo sapiens
acagtaaatcaacagaatatct

SEQ ID NO: 9300565 - DNA, 21 bp, Homo sapiens
acagtaaattccctgcaaaga

SEQ ID NO: 9300566 - DNA, 22 bp, Homo sapiens
aggcaggcaagttcatatgagg

SEQ ID NO: 9300567 - DNA, 22 bp, Homo sapiens
aggcaggcactccggaagtgtc

SEQ ID NO: 9300568 - DNA, 22 bp, Homo sapiens
aggcaggcactccggaagtgtc

SEQ ID NO: 9300569 - DNA, 22 bp, Homo sapiens
aggcaggcaaccacctgggaag

SEQ ID NO: 9300570 - DNA, 22 bp, Homo sapiens
aggcagctggaggcagagacta

SEQ ID NO: 9300571 - DNA, 21 bp, Homo sapiens
acagttttaaggagcacatgg

SEQ ID NO: 9300572 - DNA, 22 bp, Homo sapiens
acagtttgccctgacattctcc

SEQ ID NO: 9300573 - DNA, 22 bp, Homo sapiens
aggcagcattcaggggtgatga

SEQ ID NO: 9300574 - DNA, 19 bp, Homo sapiens
aggcagcacccagtccttg

SEQ ID NO: 9300575 - DNA, 22 bp, Homo sapiens
aggcagcatgctctgcttctac

SEQ ID NO: 9300576 - DNA, 22 bp, Homo sapiens
aggcagcatgggcccagagtcc

SEQ ID NO: 9300577 - DNA, 22 bp, Homo sapiens
acagtgttctgaaagttgaggg

SEQ ID NO: 9300578 - DNA, 22 bp, Homo sapiens
acagtgttttagaaaagcttga

SEQ ID NO: 9300579 - DNA, 22 bp, Homo sapiens
acagtgttctgctttttaatcc

SEQ ID NO: 9300580 - DNA, 22 bp, Homo sapiens
acagtgttttgtctggcagggc

SEQ ID NO: 9300581 - DNA, 20 bp, Homo sapiens
acagtgtttttgagtagagc

SEQ ID NO: 9300582 - DNA, 22 bp, Homo sapiens
acagtgttttatgagaattgtt

SEQ ID NO: 9300583 - DNA, 22 bp, Homo sapiens
acagtgttttagaaaagcttga

SEQ ID NO: 9300584 - DNA, 22 bp, Homo sapiens
acagtgttttcttaaggagaaa

SEQ ID NO: 9300585 - DNA, 22 bp, Homo sapiens
acagttattctttatgcaacca

SEQ ID NO: 9300586 - DNA, 22 bp, Homo sapiens
acagttaagcagtatgatcaca

SEQ ID NO: 9300587 - DNA, 22 bp, Homo sapiens
atcatttaaaacaagtctctat

SEQ ID NO: 9300588 - DNA, 22 bp, Homo sapiens
atcatttatgccccaattagat

SEQ ID NO: 9300589 - DNA, 22 bp, Homo sapiens
atcatttacaatgaaagcctga

SEQ ID NO: 9300590 - DNA, 22 bp, Homo sapiens
atcatttagtggggcattggaa

SEQ ID NO: 9300591 - DNA, 22 bp, Homo sapiens
atccagagactggggctgggat

SEQ ID NO: 9300592 - DNA, 22 bp, Homo sapiens
atccagagaggttaggtgacat

SEQ ID NO: 9300593 - DNA, 22 bp, Homo sapiens
agaagaaatgaggccgttctgc

SEQ ID NO: 9300594 - DNA, 22 bp, Homo sapiens
atccagcacttgttcatgtgaa

SEQ ID NO: 9300595 - DNA, 22 bp, Homo sapiens
atccagagacccaaggacagaa

SEQ ID NO: 9300596 - DNA, 22 bp, Homo sapiens
agaaacatcattggaacacaag

SEQ ID NO: 9300597 - DNA, 22 bp, Homo sapiens
atcagaggtgttgaaacatgac

SEQ ID NO: 9300598 - DNA, 20 bp, Homo sapiens
atcactggagaaggaaacct

SEQ ID NO: 9300599 - DNA, 22 bp, Homo sapiens
atcacattgttagcatagactg

SEQ ID NO: 9300600 - DNA, 22 bp, Homo sapiens
atcacattgttagcatagactg

SEQ ID NO: 9300601 - DNA, 21 bp, Homo sapiens
atcacattggctgttattatt

SEQ ID NO: 9300602 - DNA, 22 bp, Homo sapiens
atatatttgagaatattcatga

SEQ ID NO: 9300603 - DNA, 22 bp, Homo sapiens
atatatttgagaatattcatga

SEQ ID NO: 9300604 - DNA, 22 bp, Homo sapiens
atatatttactctcctgttgca

SEQ ID NO: 9300605 - DNA, 22 bp, Homo sapiens
atatatttactctcctgttgca

SEQ ID NO: 9300606 - DNA, 22 bp, Homo sapiens
atatattttgaatagcctctgt

SEQ ID NO: 9300607 - DNA, 22 bp, Homo sapiens
atatattttgaatagcctctgt

SEQ ID NO: 9300608 - DNA, 22 bp, Homo sapiens
agaaaattactccagagacaag

SEQ ID NO: 9300609 - DNA, 22 bp, Homo sapiens
agaaaattagattttactgtgt

SEQ ID NO: 9300610 - DNA, 22 bp, Homo sapiens
agaaaatttattcatgttagtt

SEQ ID NO: 9300611 - DNA, 22 bp, Homo sapiens
agaaaatttattcatgttagtt

SEQ ID NO: 9300612 - DNA, 22 bp, Homo sapiens
agaaaattagattttactgtgt

SEQ ID NO: 9300613 - DNA, 22 bp, Homo sapiens
agaaaatttaaagagacacaca

SEQ ID NO: 9300614 - DNA, 22 bp, Homo sapiens
atatattacaaaagaggaagga

SEQ ID NO: 9300615 - DNA, 22 bp, Homo sapiens
acttgcttgggccatctcgctt

SEQ ID NO: 9300616 - DNA, 22 bp, Homo sapiens
acttgccccagaattgctgctg

SEQ ID NO: 9300617 - DNA, 22 bp, Homo sapiens
acttcagtgtggtataaaacgt

SEQ ID NO: 9300618 - DNA, 22 bp, Homo sapiens
acttcaaacaattaacagagaa

SEQ ID NO: 9300619 - DNA, 22 bp, Homo sapiens
acttcaaaaataagtgagaggt

SEQ ID NO: 9300620 - DNA, 22 bp, Homo sapiens
acttcaaaatgagtttcctggt

SEQ ID NO: 9300621 - DNA, 22 bp, Homo sapiens
acttcaaatgtgacaatgtgaa

SEQ ID NO: 9300622 - DNA, 22 bp, Homo sapiens
acttcaaatctcttgaaagcaa

SEQ ID NO: 9300623 - DNA, 19 bp, Homo sapiens
acttcaaatcttagagaaa

SEQ ID NO: 9300624 - DNA, 22 bp, Homo sapiens
acttcagagaaagagggaattc

SEQ ID NO: 9300625 - DNA, 22 bp, Homo sapiens
acttcagaaaatgttgaatgtt

SEQ ID NO: 9300626 - DNA, 22 bp, Homo sapiens
acttcaaattttcagaagaaat

SEQ ID NO: 9300627 - DNA, 22 bp, Homo sapiens
acttcaaattctgggggaagag

SEQ ID NO: 9300628 - DNA, 22 bp, Homo sapiens
acttcacacagcaaatttatct

SEQ ID NO: 9300629 - DNA, 22 bp, Homo sapiens
actgttagccttccataacaca

SEQ ID NO: 9300630 - DNA, 22 bp, Homo sapiens
actgttagatgctaagcaaatg

SEQ ID NO: 9300631 - DNA, 20 bp, Homo sapiens
actgttagtatacttgtgcc

SEQ ID NO: 9300632 - DNA, 22 bp, Homo sapiens
agtttccaaaaggagacaggga

SEQ ID NO: 9300633 - DNA, 22 bp, Homo sapiens
agtttctaacatatagcattgg

SEQ ID NO: 9300634 - DNA, 22 bp, Homo sapiens
agtttacatgacgtgtatttca

SEQ ID NO: 9300635 - DNA, 22 bp, Homo sapiens
agtttataaaacattgcgtggc

SEQ ID NO: 9300636 - DNA, 22 bp, Homo sapiens
actgtaaaatgagatatgtata

SEQ ID NO: 9300637 - DNA, 20 bp, Homo sapiens
actggcagcctgcctgctgt

SEQ ID NO: 9300638 - DNA, 22 bp, Homo sapiens
actggcagccacaactggcagg

SEQ ID NO: 9300639 - DNA, 22 bp, Homo sapiens
agtttacacttttgattcttat

SEQ ID NO: 9300640 - DNA, 22 bp, Homo sapiens
aggtacagtagacagacagtta

SEQ ID NO: 9300641 - DNA, 18 bp, Homo sapiens
acctgcctgttcttctct

SEQ ID NO: 9300642 - DNA, 22 bp, Homo sapiens
acctgccttctcaaggacatga

SEQ ID NO: 9300643 - DNA, 22 bp, Homo sapiens
acctgctcaactggcttctcgc

SEQ ID NO: 9300644 - DNA, 23 bp, Homo sapiens
acctgctccatgtcaccttcact

SEQ ID NO: 9300645 - DNA, 22 bp, Homo sapiens
acctgctttattcctcctgcct

SEQ ID NO: 9300646 - DNA, 22 bp, Homo sapiens
acctgctgtcttgggggaatgc

SEQ ID NO: 9300647 - DNA, 22 bp, Homo sapiens
acctgctgaggagggggaatta

SEQ ID NO: 9300648 - DNA, 22 bp, Homo sapiens
aggtaccatatgcgggagcaac

SEQ ID NO: 9300649 - DNA, 22 bp, Homo sapiens
aggtagctaaaacaggcttttg

SEQ ID NO: 9300650 - DNA, 22 bp, Homo sapiens
acctggtttgtctcatcaccac

SEQ ID NO: 9300651 - DNA, 22 bp, Homo sapiens
acctggttcctcctcactgctg

SEQ ID NO: 9300652 - DNA, 22 bp, Homo sapiens
agggctgtaccatcaggttcct

SEQ ID NO: 9300653 - DNA, 22 bp, Homo sapiens
agggctgtttttcagtgtgtga

SEQ ID NO: 9300654 - DNA, 22 bp, Homo sapiens
agggctgtgtttgcaccctctg

SEQ ID NO: 9300655 - DNA, 22 bp, Homo sapiens
agggctgtttttggcacctggg

SEQ ID NO: 9300656 - DNA, 22 bp, Homo sapiens
agggcttgttaacatagagatt

SEQ ID NO: 9300657 - DNA, 22 bp, Homo sapiens
agggcttgcagaaatgagaaat

SEQ ID NO: 9300658 - DNA, 22 bp, Homo sapiens
agggtgtgttctcctatgagaa

SEQ ID NO: 9300659 - DNA, 22 bp, Homo sapiens
acctcccagctctgagcttggg

SEQ ID NO: 9300660 - DNA, 22 bp, Homo sapiens
actaaagaagccaaagttttct

SEQ ID NO: 9300661 - DNA, 22 bp, Homo sapiens
actaaaacatagccagtcagtg

SEQ ID NO: 9300662 - DNA, 22 bp, Homo sapiens
actaaaacagtggctagtagac

SEQ ID NO: 9300663 - DNA, 22 bp, Homo sapiens
acgtgtgtttaacaaacctgca

SEQ ID NO: 9300664 - DNA, 22 bp, Homo sapiens
acgtgtgtatgagtgtacatat

SEQ ID NO: 9300665 - DNA, 19 bp, Homo sapiens
accttcagagtggcacaaa

SEQ ID NO: 9300666 - DNA, 21 bp, Homo sapiens
accttcagtgttctcagctgc

SEQ ID NO: 9300667 - DNA, 22 bp, Homo sapiens
accttagctgttaaaactaagt

SEQ ID NO: 9300668 - DNA, 22 bp, Homo sapiens
actcaagtagatattaacaaaa

SEQ ID NO: 9300669 - DNA, 19 bp, Homo sapiens
actcaagtctaatgaaatc

SEQ ID NO: 9300670 - DNA, 22 bp, Homo sapiens
actcaagtagatattaacaaaa

SEQ ID NO: 9300671 - DNA, 22 bp, Homo sapiens
actattcaagtgctcattcaga

SEQ ID NO: 9300672 - DNA, 22 bp, Homo sapiens
actattagcatatcatgaatgg

SEQ ID NO: 9300673 - DNA, 22 bp, Homo sapiens
actatttactcaaatgaggttg

SEQ ID NO: 9300674 - DNA, 22 bp, Homo sapiens
actatatacacattatcttgtt

SEQ ID NO: 9300675 - DNA, 22 bp, Homo sapiens
actaaatacacacatttgttca

SEQ ID NO: 9300676 - DNA, 22 bp, Homo sapiens
actaaagtcatcaaagaacttt

SEQ ID NO: 9300677 - DNA, 21 bp, Homo sapiens
agtctacaactagggaagctg

SEQ ID NO: 9300678 - DNA, 22 bp, Homo sapiens
agtctacaaagggaagcccttt

SEQ ID NO: 9300679 - DNA, 22 bp, Homo sapiens
agtctacaaatcaccttgtcct

SEQ ID NO: 9300680 - DNA, 22 bp, Homo sapiens
agtctacaaagaaaagttattg

SEQ ID NO: 9300681 - DNA, 22 bp, Homo sapiens
actccagggctccaccccagat

SEQ ID NO: 9300682 - DNA, 22 bp, Homo sapiens
actccagggctccaccccagat

SEQ ID NO: 9300683 - DNA, 22 bp, Homo sapiens
actccagggctgaacgaggccc

SEQ ID NO: 9300684 - DNA, 22 bp, Homo sapiens
actccagggctccatcccttgt

SEQ ID NO: 9300685 - DNA, 22 bp, Homo sapiens
actccagggcttctatgatggt

SEQ ID NO: 9300686 - DNA, 22 bp, Homo sapiens
actccagggctgaacgaggccc

SEQ ID NO: 9300687 - DNA, 22 bp, Homo sapiens
agtctctgggcatggttgtgac

SEQ ID NO: 9300688 - DNA, 22 bp, Homo sapiens
agtctctggggaggagtggaaa

SEQ ID NO: 9300689 - DNA, 22 bp, Homo sapiens
agtctacaacgcaagcaacatg

SEQ ID NO: 9300690 - DNA, 22 bp, Homo sapiens
agtctctgcatgcctgctgtgc

SEQ ID NO: 9300691 - DNA, 22 bp, Homo sapiens
actccaggcatctgcttctgct

SEQ ID NO: 9300692 - DNA, 22 bp, Homo sapiens
actccagggaggtgagtgtgcg

SEQ ID NO: 9300693 - DNA, 22 bp, Homo sapiens
actccagggaggtgagtgtgcg

SEQ ID NO: 9300694 - DNA, 19 bp, Homo sapiens
actccagggatgacagaag

SEQ ID NO: 9300695 - DNA, 22 bp, Homo sapiens
actccaggatgtagaatcagag

SEQ ID NO: 9300696 - DNA, 22 bp, Homo sapiens
actccaggaaacttaggggaaa

SEQ ID NO: 9300697 - DNA, 22 bp, Homo sapiens
actccaggaaacttaggggaaa

SEQ ID NO: 9300698 - DNA, 22 bp, Homo sapiens
actgaaggaagcgggcaggggt

SEQ ID NO: 9300699 - DNA, 22 bp, Homo sapiens
actgaagggtaatgtgggagcc

SEQ ID NO: 9300700 - DNA, 22 bp, Homo sapiens
agtctcttcctcatgcatatgt

SEQ ID NO: 9300701 - DNA, 22 bp, Homo sapiens
agtctcttaattttttctaagt

SEQ ID NO: 9300702 - DNA, 22 bp, Homo sapiens
agtctgggaactgggaacgttt

SEQ ID NO: 9300703 - DNA, 22 bp, Homo sapiens
agtctggctttttgatgagctt

SEQ ID NO: 9300704 - DNA, 22 bp, Homo sapiens
agtctgggagaaggtgagatta

SEQ ID NO: 9300705 - DNA, 22 bp, Homo sapiens
agtctgggctgtctgcaggagt

SEQ ID NO: 9300706 - DNA, 22 bp, Homo sapiens
agtctgggctgtctgcaggagt

SEQ ID NO: 9300707 - DNA, 22 bp, Homo sapiens
agtctgggcatttaggatgttg

SEQ ID NO: 9300708 - DNA, 22 bp, Homo sapiens
agtctgggtggctgagctacag

SEQ ID NO: 9300709 - DNA, 22 bp, Homo sapiens
actgcaacacctcctgggttca

SEQ ID NO: 9300710 - DNA, 22 bp, Homo sapiens
actgcaacctccacctcctggg

SEQ ID NO: 9300711 - DNA, 22 bp, Homo sapiens
actgcaacctccacctcctggg

SEQ ID NO: 9300712 - DNA, 22 bp, Homo sapiens
actgcaaagggaagccctttct

SEQ ID NO: 9300713 - DNA, 22 bp, Homo sapiens
actgcaacctccgcctgccagg

SEQ ID NO: 9300714 - DNA, 22 bp, Homo sapiens
actgaagtccacacatgtagga

SEQ ID NO: 9300715 - DNA, 22 bp, Homo sapiens
actgaaggtctcagcaaggatg

SEQ ID NO: 9300716 - DNA, 22 bp, Homo sapiens
actgcttctccaatgaattaga

SEQ ID NO: 9300717 - DNA, 22 bp, Homo sapiens
actgcttcctggatggccagca

SEQ ID NO: 9300718 - DNA, 22 bp, Homo sapiens
actgcttcctgagaaatcaaca

SEQ ID NO: 9300719 - DNA, 20 bp, Homo sapiens
actgcttctttctctgacct

SEQ ID NO: 9300720 - DNA, 22 bp, Homo sapiens
actgcttcactgcgtcttatct

SEQ ID NO: 9300721 - DNA, 20 bp, Homo sapiens
actggcactggtaggtgtgg

SEQ ID NO: 9300722 - DNA, 22 bp, Homo sapiens
actggcactatgttggagaaat

SEQ ID NO: 9300723 - DNA, 19 bp, Homo sapiens
actggcacacaggggctgc

SEQ ID NO: 9300724 - DNA, 22 bp, Homo sapiens
actggcacaagaagagtcgtgg

SEQ ID NO: 9300725 - DNA, 22 bp, Homo sapiens
agtggctgctggagtggagatg

SEQ ID NO: 9300726 - DNA, 22 bp, Homo sapiens
agtggctgccaagagcaatgct

SEQ ID NO: 9300727 - DNA, 22 bp, Homo sapiens
agagtggcttgctcagctagca

SEQ ID NO: 9300728 - DNA, 22 bp, Homo sapiens
atttagagaataagacataaat

SEQ ID NO: 9300729 - DNA, 22 bp, Homo sapiens
atttagtctcccttatcaagga

SEQ ID NO: 9300730 - DNA, 22 bp, Homo sapiens
atttattatgggatttggctca

SEQ ID NO: 9300731 - DNA, 22 bp, Homo sapiens
atttattatgggatttggctca

SEQ ID NO: 9300732 - DNA, 22 bp, Homo sapiens
atttattcctttatggctggag

SEQ ID NO: 9300733 - DNA, 22 bp, Homo sapiens
atttattctccagatggcgaga

SEQ ID NO: 9300734 - DNA, 22 bp, Homo sapiens
atttattctccagatggcgaga

SEQ ID NO: 9300735 - DNA, 22 bp, Homo sapiens
atttattcctttatggctggag

SEQ ID NO: 9300736 - DNA, 22 bp, Homo sapiens
atttattcctgattcctggctt

SEQ ID NO: 9300737 - DNA, 22 bp, Homo sapiens
atttattattgtggttacttct

SEQ ID NO: 9300738 - DNA, 22 bp, Homo sapiens
atttattattgtggttacttct

SEQ ID NO: 9300739 - DNA, 22 bp, Homo sapiens
atttattcctgattcctggctt

SEQ ID NO: 9300740 - DNA, 22 bp, Homo sapiens
agagggttgaacctataaacta

SEQ ID NO: 9300741 - DNA, 22 bp, Homo sapiens
agaggtagaaaataatggagag

SEQ ID NO: 9300742 - DNA, 22 bp, Homo sapiens
agagggtgggcacgtgatggat

SEQ ID NO: 9300743 - DNA, 22 bp, Homo sapiens
agagggtgggcacgtgatggat

SEQ ID NO: 9300744 - DNA, 22 bp, Homo sapiens
agagggtgggcacgtgatggat

SEQ ID NO: 9300745 - DNA, 22 bp, Homo sapiens
attcttcatacagacaagtcct

SEQ ID NO: 9300746 - DNA, 18 bp, Homo sapiens
atttaatgaactgaaagc

SEQ ID NO: 9300747 - DNA, 22 bp, Homo sapiens
atttaatgaggctgggggtgga

SEQ ID NO: 9300748 - DNA, 22 bp, Homo sapiens
atttaagattgcgtattcatgt

SEQ ID NO: 9300749 - DNA, 23 bp, Homo sapiens
atttaatgctgagttgaatgtta

SEQ ID NO: 9300750 - DNA, 22 bp, Homo sapiens
atttaatgggtagacattgtta

SEQ ID NO: 9300751 - DNA, 22 bp, Homo sapiens
agagtggcccgttggcctgaac

SEQ ID NO: 9300752 - DNA, 22 bp, Homo sapiens
agcaaaataaggtaatttattg

SEQ ID NO: 9300753 - DNA, 22 bp, Homo sapiens
agcaaaataaggtaatttattg

SEQ ID NO: 9300754 - DNA, 22 bp, Homo sapiens
atttgcttgttcaccagtactt

SEQ ID NO: 9300755 - DNA, 22 bp, Homo sapiens
atttgctttcagccttaaggat

SEQ ID NO: 9300756 - DNA, 17 bp, Homo sapiens
agcaaaagtatcaaagc

SEQ ID NO: 9300757 - DNA, 22 bp, Homo sapiens
atttgcttcttgcttccagcac

SEQ ID NO: 9300758 - DNA, 22 bp, Homo sapiens
atttgcttgactatggcttgca

SEQ ID NO: 9300759 - DNA, 22 bp, Homo sapiens
atttgcttggtcttctctccgt

SEQ ID NO: 9300760 - DNA, 22 bp, Homo sapiens
atttgcttgtaaatgtatgcct

SEQ ID NO: 9300761 - DNA, 22 bp, Homo sapiens
atttgcttgtcctggtgactgt

SEQ ID NO: 9300762 - DNA, 19 bp, Homo sapiens
atttgcttgtctgctctgc

SEQ ID NO: 9300763 - DNA, 22 bp, Homo sapiens
atttgcttcatagatctgtgga

SEQ ID NO: 9300764 - DNA, 22 bp, Homo sapiens
atttgcttctagtcagttccat

SEQ ID NO: 9300765 - DNA, 22 bp, Homo sapiens
atttgcttcctaatactcatat

SEQ ID NO: 9300766 - DNA, 22 bp, Homo sapiens
agatgtctcactcagttctcat

SEQ ID NO: 9300767 - DNA, 20 bp, Homo sapiens
atttgcttaccttgtttcta

SEQ ID NO: 9300768 - DNA, 20 bp, Homo sapiens
agatggtgaaggccagggag

SEQ ID NO: 9300769 - DNA, 22 bp, Homo sapiens
agatggtgatagagctgggatt

SEQ ID NO: 9300770 - DNA, 22 bp, Homo sapiens
agatggtgtttccccaggtgga

SEQ ID NO: 9300771 - DNA, 22 bp, Homo sapiens
agatggttttgtctttatgatt

SEQ ID NO: 9300772 - DNA, 22 bp, Homo sapiens
agatggttggtccataggccta

SEQ ID NO: 9300773 - DNA, 22 bp, Homo sapiens
atttccagaatagaaggttctc

SEQ ID NO: 9300774 - DNA, 22 bp, Homo sapiens
atttccagaccaggtctcaccc

SEQ ID NO: 9300775 - DNA, 22 bp, Homo sapiens
atttccagactttttccaggaa

SEQ ID NO: 9300776 - DNA, 22 bp, Homo sapiens
atttattgaacactgactatgt

SEQ ID NO: 9300777 - DNA, 22 bp, Homo sapiens
atttcattgaagttaattcttc

SEQ ID NO: 9300778 - DNA, 22 bp, Homo sapiens
attatacattttgtgtagagat

SEQ ID NO: 9300779 - DNA, 22 bp, Homo sapiens
attataaatattttctaggggt

SEQ ID NO: 9300780 - DNA, 22 bp, Homo sapiens
attataaacctttgagggtggg

SEQ ID NO: 9300781 - DNA, 22 bp, Homo sapiens
attataaagaacatgtgtgtgg

SEQ ID NO: 9300782 - DNA, 22 bp, Homo sapiens
attcacaattagaagtagataa

SEQ ID NO: 9300783 - DNA, 22 bp, Homo sapiens
attatagagggttacagttaat

SEQ ID NO: 9300784 - DNA, 22 bp, Homo sapiens
attcagcacatctttgtacagc

SEQ ID NO: 9300785 - DNA, 22 bp, Homo sapiens
attcagcataatcagtagcttg

SEQ ID NO: 9300786 - DNA, 22 bp, Homo sapiens
attcagcaatgagcttggattt

SEQ ID NO: 9300787 - DNA, 22 bp, Homo sapiens
agaggggctcatatcctgtcat

SEQ ID NO: 9300788 - DNA, 22 bp, Homo sapiens
agagggtgctggagagacattg

SEQ ID NO: 9300789 - DNA, 22 bp, Homo sapiens
agagggtgggcacgtgatggat

SEQ ID NO: 9300790 - DNA, 23 bp, Homo sapiens
agagggtgcaacatggggatcta

SEQ ID NO: 9300791 - DNA, 23 bp, Homo sapiens
agagggagatgtttttctcaaga

SEQ ID NO: 9300792 - DNA, 22 bp, Homo sapiens
agagggatcaccctgtttctgg

SEQ ID NO: 9300793 - DNA, 22 bp, Homo sapiens
agagggataatatgtattgtaa

SEQ ID NO: 9300794 - DNA, 21 bp, Homo sapiens
agagggagagtggcccttcca

SEQ ID NO: 9300795 - DNA, 22 bp, Homo sapiens
attagcataagtgttcggtgca

SEQ ID NO: 9300796 - DNA, 22 bp, Homo sapiens
attagcatgccaagcttttaga

SEQ ID NO: 9300797 - DNA, 19 bp, Homo sapiens
attagcatgcttgaggatg

SEQ ID NO: 9300798 - DNA, 22 bp, Homo sapiens
attagcattgctactctcaaga

SEQ ID NO: 9300799 - DNA, 20 bp, Homo sapiens
attagctcaggtgaggtcat

SEQ ID NO: 9300800 - DNA, 22 bp, Homo sapiens
atgtttctgagtgtatatacat

SEQ ID NO: 9300801 - DNA, 23 bp, Homo sapiens
atgtttgcagtaacccatcctgg

SEQ ID NO: 9300802 - DNA, 22 bp, Homo sapiens
atgttacaattcaaaatgctgc

SEQ ID NO: 9300803 - DNA, 22 bp, Homo sapiens
atgttaaataatcccttaaagc

SEQ ID NO: 9300804 - DNA, 22 bp, Homo sapiens
atgttaaatggtttattattaa

SEQ ID NO: 9300805 - DNA, 17 bp, Homo sapiens
atgttaatttcacattt

SEQ ID NO: 9300806 - DNA, 22 bp, Homo sapiens
atgttacaaatcctacaggtag

SEQ ID NO: 9300807 - DNA, 22 bp, Homo sapiens
atgtgtgtacacacgtgactct

SEQ ID NO: 9300808 - DNA, 22 bp, Homo sapiens
atgtgtgtaaacaagtataatt

SEQ ID NO: 9300809 - DNA, 22 bp, Homo sapiens
atggagttctgccagcgctgct

SEQ ID NO: 9300810 - DNA, 22 bp, Homo sapiens
atggagtgggccaattttagtg

SEQ ID NO: 9300811 - DNA, 22 bp, Homo sapiens
atggaggtgccaggtgtgaggg

SEQ ID NO: 9300812 - DNA, 20 bp, Homo sapiens
atggaggtggatgtgactgc

SEQ ID NO: 9300813 - DNA, 21 bp, Homo sapiens
atggagtcaggggaatgggcc

SEQ ID NO: 9300814 - DNA, 22 bp, Homo sapiens
atggctggtagtgaattaatct

SEQ ID NO: 9300815 - DNA, 22 bp, Homo sapiens
atggctgggtcaccatcagggt

SEQ ID NO: 9300816 - DNA, 22 bp, Homo sapiens
atggctgggttcttctataggt

SEQ ID NO: 9300817 - DNA, 22 bp, Homo sapiens
atggctggtctcccatggaaaa

SEQ ID NO: 9300818 - DNA, 22 bp, Homo sapiens
atggctggtgatactggagtga

SEQ ID NO: 9300819 - DNA, 21 bp, Homo sapiens
atggctggtggctcagcctcc

SEQ ID NO: 9300820 - DNA, 22 bp, Homo sapiens
atggctgggcttttagtcagat

SEQ ID NO: 9300821 - DNA, 22 bp, Homo sapiens
atggctgggcttttagtcagat

SEQ ID NO: 9300822 - DNA, 22 bp, Homo sapiens
atggctgggatttcctttgcgt

SEQ ID NO: 9300823 - DNA, 22 bp, Homo sapiens
atggctgggatttcctttgcgt

SEQ ID NO: 9300824 - DNA, 22 bp, Homo sapiens
atggctgggaggagagtatgat

SEQ ID NO: 9300825 - DNA, 22 bp, Homo sapiens
atggctgggatgcttctagcaa

SEQ ID NO: 9300826 - DNA, 22 bp, Homo sapiens
atggctggctttacttgctttg

SEQ ID NO: 9300827 - DNA, 22 bp, Homo sapiens
atggctgggatggggtagagaa

SEQ ID NO: 9300828 - DNA, 22 bp, Homo sapiens
atggctggctgagcctggttat

SEQ ID NO: 9300829 - DNA, 22 bp, Homo sapiens
atggctggcatgtgcataacgg

SEQ ID NO: 9300830 - DNA, 22 bp, Homo sapiens
atggctggcgtcattgtgtggg

SEQ ID NO: 9300831 - DNA, 22 bp, Homo sapiens
agactccaggagggaggctgct

SEQ ID NO: 9300832 - DNA, 22 bp, Homo sapiens
agactccaaatgaaagaggggg

SEQ ID NO: 9300833 - DNA, 22 bp, Homo sapiens
atggaaaagggtctttcatttc

SEQ ID NO: 9300834 - DNA, 20 bp, Homo sapiens
atgtaaaattataaggctga

SEQ ID NO: 9300835 - DNA, 22 bp, Homo sapiens
atgtaaaagattattttcctgt

SEQ ID NO: 9300836 - DNA, 22 bp, Homo sapiens
atgggaggcagacactaagttc

SEQ ID NO: 9300837 - DNA, 22 bp, Homo sapiens
atgggaggatgctcgggtgctc

SEQ ID NO: 9300838 - DNA, 22 bp, Homo sapiens
atgggaggatcacttgaggcca

SEQ ID NO: 9300839 - DNA, 22 bp, Homo sapiens
atggctggtttgagctttagca

SEQ ID NO: 9300840 - DNA, 21 bp, Homo sapiens
atggctggtggctcagcctcc

SEQ ID NO: 9300841 - DNA, 22 bp, Homo sapiens
atgtccagaggtgagtcagagc

SEQ ID NO: 9300842 - DNA, 22 bp, Homo sapiens
atgtccagagtaaagcacattc

SEQ ID NO: 9300843 - DNA, 22 bp, Homo sapiens
atgtccagggcacacagcagtg

SEQ ID NO: 9300844 - DNA, 22 bp, Homo sapiens
atgtccagggggcttgactggt

SEQ ID NO: 9300845 - DNA, 22 bp, Homo sapiens
agacacagtataagcacaacaa

SEQ ID NO: 9300846 - DNA, 22 bp, Homo sapiens
agacacagtataagcacaacaa

SEQ ID NO: 9300847 - DNA, 22 bp, Homo sapiens
agaatgtgttttaacatgggaa

SEQ ID NO: 9300848 - DNA, 22 bp, Homo sapiens
agaatgtgtgattgaagctctt

SEQ ID NO: 9300849 - DNA, 22 bp, Homo sapiens
agaatgtgaagattttgaatta

SEQ ID NO: 9300850 - DNA, 22 bp, Homo sapiens
agaatcaggaagacagcctggc

SEQ ID NO: 9300851 - DNA, 22 bp, Homo sapiens
agaatgatagctagtatttact

SEQ ID NO: 9300852 - DNA, 22 bp, Homo sapiens
agacaatatataattttagttg

SEQ ID NO: 9300853 - DNA, 22 bp, Homo sapiens
agaaggccaatagggtgcactg

SEQ ID NO: 9300854 - DNA, 22 bp, Homo sapiens
agaatacaattgttcagtaata

SEQ ID NO: 9300855 - DNA, 19 bp, Homo sapiens
atctttgggtcctgaaggg

SEQ ID NO: 9300856 - DNA, 22 bp, Homo sapiens
agaatacagtatgcaaaaagat

SEQ ID NO: 9300857 - DNA, 22 bp, Homo sapiens
agaagattatgaattagagcag

SEQ ID NO: 9300858 - DNA, 18 bp, Homo sapiens
agaagcacaagatgtctt

SEQ ID NO: 9300859 - DNA, 22 bp, Homo sapiens
agaagcacacctgacctctagc

SEQ ID NO: 9300860 - DNA, 22 bp, Homo sapiens
agaagcacaccagtagacaggg

SEQ ID NO: 9300861 - DNA, 22 bp, Homo sapiens
agaagcacaggtaaagtgattt

SEQ ID NO: 9300862 - DNA, 22 bp, Homo sapiens
agccacagctccttggtggaga

SEQ ID NO: 9300863 - DNA, 22 bp, Homo sapiens
agccacagcccacaggactctt

SEQ ID NO: 9300864 - DNA, 22 bp, Homo sapiens
agccaagctgatctcctgctga

SEQ ID NO: 9300865 - DNA, 19 bp, Homo sapiens
agccacagaacttgcagga

SEQ ID NO: 9300866 - DNA, 19 bp, Homo sapiens
agccacagaacttgcagga

SEQ ID NO: 9300867 - DNA, 22 bp, Homo sapiens
cagaagctttgtctagtcttga

SEQ ID NO: 9300868 - DNA, 17 bp, Homo sapiens
cagaaggaagcatggca

SEQ ID NO: 9300869 - DNA, 21 bp, Homo sapiens
agccagctatcacacagcatt

SEQ ID NO: 9300870 - DNA, 22 bp, Homo sapiens
agccagctccctcccctgcagg

SEQ ID NO: 9300871 - DNA, 22 bp, Homo sapiens
agccaggatggtctcgatcggc

SEQ ID NO: 9300872 - DNA, 22 bp, Homo sapiens
cagacagacagccgtggccacc

SEQ ID NO: 9300873 - DNA, 22 bp, Homo sapiens
cagaagctgaggagtgaggcaa

SEQ ID NO: 9300874 - DNA, 22 bp, Homo sapiens
cagaagctgcagtgatctggga

SEQ ID NO: 9300875 - DNA, 22 bp, Homo sapiens
cagaagcctaaatagtgcacca

SEQ ID NO: 9300876 - DNA, 22 bp, Homo sapiens
cagaagcattccagcaaatagt

SEQ ID NO: 9300877 - DNA, 22 bp, Homo sapiens
agcccaggaagttgaggcttgc

SEQ ID NO: 9300878 - DNA, 22 bp, Homo sapiens
agcccaggaggtggaggttgca

SEQ ID NO: 9300879 - DNA, 22 bp, Homo sapiens
agcccaggagcctttggagggt

SEQ ID NO: 9300880 - DNA, 22 bp, Homo sapiens
agcccaggagtttgaggctgtg

SEQ ID NO: 9300881 - DNA, 22 bp, Homo sapiens
agcccaggagtttgaggctgtg

SEQ ID NO: 9300882 - DNA, 22 bp, Homo sapiens
cagagctggcggtgagaagaca

SEQ ID NO: 9300883 - DNA, 22 bp, Homo sapiens
cagagctggcggtgagaagaca

SEQ ID NO: 9300884 - DNA, 22 bp, Homo sapiens
agcccctgtttttccagtcaga

SEQ ID NO: 9300885 - DNA, 19 bp, Homo sapiens
agcccccagacagcaggcc

SEQ ID NO: 9300886 - DNA, 22 bp, Homo sapiens
agccagggttagaagatagtca

SEQ ID NO: 9300887 - DNA, 22 bp, Homo sapiens
cagagaggatggattccatagc

SEQ ID NO: 9300888 - DNA, 22 bp, Homo sapiens
cagagatgaggtcgttactcag

SEQ ID NO: 9300889 - DNA, 22 bp, Homo sapiens
cagagatggggccagctgctcc

SEQ ID NO: 9300890 - DNA, 22 bp, Homo sapiens
cagagagtggcagttactgaag

SEQ ID NO: 9300891 - DNA, 22 bp, Homo sapiens
cagagatgtgatccagctgtct

SEQ ID NO: 9300892 - DNA, 22 bp, Homo sapiens
agctccagggaaagagtggatc

SEQ ID NO: 9300893 - DNA, 22 bp, Homo sapiens
agctcccagcagagctggccac

SEQ ID NO: 9300894 - DNA, 22 bp, Homo sapiens
agctcccagagtcctctgccca

SEQ ID NO: 9300895 - DNA, 22 bp, Homo sapiens
agctcccagggctgggcaagtt

SEQ ID NO: 9300896 - DNA, 22 bp, Homo sapiens
agctcccaggcagtcatgagga

SEQ ID NO: 9300897 - DNA, 22 bp, Homo sapiens
agctcccagtctcctctccatg

SEQ ID NO: 9300898 - DNA, 22 bp, Homo sapiens
agctcccattatcttctgaaac

SEQ ID NO: 9300899 - DNA, 22 bp, Homo sapiens
agctccctgagatgccacagca

SEQ ID NO: 9300900 - DNA, 19 bp, Homo sapiens
agctcctcacctctcgcgg

SEQ ID NO: 9300901 - DNA, 20 bp, Homo sapiens
agctcctcatcactggaggt

SEQ ID NO: 9300902 - DNA, 22 bp, Homo sapiens
agctcctctagatctgccactt

SEQ ID NO: 9300903 - DNA, 22 bp, Homo sapiens
cagccctggccccaggtggtct

SEQ ID NO: 9300904 - DNA, 22 bp, Homo sapiens
agctcctgtgtgaagcctccct

SEQ ID NO: 9300905 - DNA, 22 bp, Homo sapiens
cagccctgggtccctgccctgg

SEQ ID NO: 9300906 - DNA, 22 bp, Homo sapiens
cagccctggctagggcgagggc

SEQ ID NO: 9300907 - DNA, 22 bp, Homo sapiens
cagccctggcgcccccagatct

SEQ ID NO: 9300908 - DNA, 22 bp, Homo sapiens
agccttcggccagagggtggcc

SEQ ID NO: 9300909 - DNA, 22 bp, Homo sapiens
agccttctaggatgtcatctgc

SEQ ID NO: 9300910 - DNA, 22 bp, Homo sapiens
agccttctctgattctcctagt

SEQ ID NO: 9300911 - DNA, 22 bp, Homo sapiens
agccttctctgattctcctagt

SEQ ID NO: 9300912 - DNA, 23 bp, Homo sapiens
agccttggaggttgaggctgcag

SEQ ID NO: 9300913 - DNA, 22 bp, Homo sapiens
agccttggtcccgcgtcagcca

SEQ ID NO: 9300914 - DNA, 22 bp, Homo sapiens
agccttgttgctaccagatgcc

SEQ ID NO: 9300915 - DNA, 22 bp, Homo sapiens
agcctttaacacttcacattga

SEQ ID NO: 9300916 - DNA, 22 bp, Homo sapiens
agcctttaaggaaaatgaataa

SEQ ID NO: 9300917 - DNA, 22 bp, Homo sapiens
agcctttacaagcattagctca

SEQ ID NO: 9300918 - DNA, 22 bp, Homo sapiens
cagcaggacccaggaatcctgc

SEQ ID NO: 9300919 - DNA, 22 bp, Homo sapiens
cagcaggagcagtcagactcct

SEQ ID NO: 9300920 - DNA, 22 bp, Homo sapiens
agctaggagattttgtgaggct

SEQ ID NO: 9300921 - DNA, 22 bp, Homo sapiens
agctcacagaaatcctgcagga

SEQ ID NO: 9300922 - DNA, 22 bp, Homo sapiens
cagaggctaagatgagtgggtg

SEQ ID NO: 9300923 - DNA, 22 bp, Homo sapiens
cagaggctagactgtgcttcct

SEQ ID NO: 9300924 - DNA, 22 bp, Homo sapiens
cagaggctaagggtagcttggg

SEQ ID NO: 9300925 - DNA, 22 bp, Homo sapiens
cagaggctaagatgagtgggtg

SEQ ID NO: 9300926 - DNA, 22 bp, Homo sapiens
agccctccatctgtgctcaggc

SEQ ID NO: 9300927 - DNA, 22 bp, Homo sapiens
cagaggctcagatggccctggc

SEQ ID NO: 9300928 - DNA, 22 bp, Homo sapiens
cagaggctagactgtgcttcct

SEQ ID NO: 9300929 - DNA, 22 bp, Homo sapiens
cagcacacagtgactcgcacct

SEQ ID NO: 9300930 - DNA, 22 bp, Homo sapiens
cagcacagagtattttattgat

SEQ ID NO: 9300931 - DNA, 22 bp, Homo sapiens
cagcacagggcttgagaggtgt

SEQ ID NO: 9300932 - DNA, 22 bp, Homo sapiens
cagcacaggtcagttttttaag

SEQ ID NO: 9300933 - DNA, 23 bp, Homo sapiens
agcctcagccggtggcagaagtg

SEQ ID NO: 9300934 - DNA, 22 bp, Homo sapiens
agcctcagcacgcagctctgtg

SEQ ID NO: 9300935 - DNA, 22 bp, Homo sapiens
agcctcagcacgcagctctgtg

SEQ ID NO: 9300936 - DNA, 22 bp, Homo sapiens
cagcacaggaatatggtggaca

SEQ ID NO: 9300937 - DNA, 22 bp, Homo sapiens
cagcacagggacaatagcagat

SEQ ID NO: 9300938 - DNA, 22 bp, Homo sapiens
cagcacaggcctgtctttgtct

SEQ ID NO: 9300939 - DNA, 22 bp, Homo sapiens
cagcagcagccccaggaaggtt

SEQ ID NO: 9300940 - DNA, 22 bp, Homo sapiens
cagcagcaggcgcacggccgtc

SEQ ID NO: 9300941 - DNA, 22 bp, Homo sapiens
cagcagcagtggctgcagaaca

SEQ ID NO: 9300942 - DNA, 22 bp, Homo sapiens
cagcagcagcttagtggtcccc

SEQ ID NO: 9300943 - DNA, 22 bp, Homo sapiens
cagcagcagtgttctagaatct

SEQ ID NO: 9300944 - DNA, 22 bp, Homo sapiens
cagcagcatcaggtctgtggtt

SEQ ID NO: 9300945 - DNA, 22 bp, Homo sapiens
cagcagcatgaattcgagccac

SEQ ID NO: 9300946 - DNA, 22 bp, Homo sapiens
cagcagaggcacgtctgtgaat

SEQ ID NO: 9300947 - DNA, 20 bp, Homo sapiens
cagcagaaatggggtgggaa

SEQ ID NO: 9300948 - DNA, 22 bp, Homo sapiens
agcctccaaatgtcaggtcccg

SEQ ID NO: 9300949 - DNA, 22 bp, Homo sapiens
agcctccagtagctgaagagac

SEQ ID NO: 9300950 - DNA, 22 bp, Homo sapiens
caactccctgtggggtactggg

SEQ ID NO: 9300951 - DNA, 22 bp, Homo sapiens
caaggcaggcagttcacttgag

SEQ ID NO: 9300952 - DNA, 22 bp, Homo sapiens
agcagcacgagtccacaaatcc

SEQ ID NO: 9300953 - DNA, 22 bp, Homo sapiens
caaggcagtccctactccctgc

SEQ ID NO: 9300954 - DNA, 22 bp, Homo sapiens
caaggcagtgggctaggaacct

SEQ ID NO: 9300955 - DNA, 22 bp, Homo sapiens
caaggcagttccccagagggct

SEQ ID NO: 9300956 - DNA, 22 bp, Homo sapiens
caaggcaggccagtttcaaggc

SEQ ID NO: 9300957 - DNA, 22 bp, Homo sapiens
caaggcaggtctgaggaggttg

SEQ ID NO: 9300958 - DNA, 22 bp, Homo sapiens
agcagcatatcagagaaagtca

SEQ ID NO: 9300959 - DNA, 22 bp, Homo sapiens
agcagcagggtgtaattgggca

SEQ ID NO: 9300960 - DNA, 22 bp, Homo sapiens
agcagcatggagaaaccgttca

SEQ ID NO: 9300961 - DNA, 22 bp, Homo sapiens
caatctgttagaaatgcagaca

SEQ ID NO: 9300962 - DNA, 22 bp, Homo sapiens
caatctgtgaaatgggaataat

SEQ ID NO: 9300963 - DNA, 22 bp, Homo sapiens
agcagcatttaagtttcttcta

SEQ ID NO: 9300964 - DNA, 22 bp, Homo sapiens
attttctattctgctggtttag

SEQ ID NO: 9300965 - DNA, 22 bp, Homo sapiens
attttctgagcacgtgacagca

SEQ ID NO: 9300966 - DNA, 22 bp, Homo sapiens
attttctgagtccagaatttac

SEQ ID NO: 9300967 - DNA, 22 bp, Homo sapiens
attttctgtaaaaaggcactaa

SEQ ID NO: 9300968 - DNA, 22 bp, Homo sapiens
agcacaaaaacattcccagagt

SEQ ID NO: 9300969 - DNA, 19 bp, Homo sapiens
agcacagacaagaccagca

SEQ ID NO: 9300970 - DNA, 22 bp, Homo sapiens
attttctggttgaggtttaaca

SEQ ID NO: 9300971 - DNA, 22 bp, Homo sapiens
agcacagagctcggggaatgga

SEQ ID NO: 9300972 - DNA, 22 bp, Homo sapiens
agcacagagctcggggaatgga

SEQ ID NO: 9300973 - DNA, 22 bp, Homo sapiens
agcacagagttgcagagagcgt

SEQ ID NO: 9300974 - DNA, 22 bp, Homo sapiens
agcacagatttgtcaacataga

SEQ ID NO: 9300975 - DNA, 22 bp, Homo sapiens
agcagaagtgccttagcaatca

SEQ ID NO: 9300976 - DNA, 22 bp, Homo sapiens
agcacttaactgacagtactat

SEQ ID NO: 9300977 - DNA, 22 bp, Homo sapiens
caaatgcagtccctttgttgct

SEQ ID NO: 9300978 - DNA, 22 bp, Homo sapiens
caaatgcaggtcagcaggtgtc

SEQ ID NO: 9300979 - DNA, 22 bp, Homo sapiens
caaatgcagattcaggagttct

SEQ ID NO: 9300980 - DNA, 22 bp, Homo sapiens
agcaggtcgccgaagatagctc

SEQ ID NO: 9300981 - DNA, 22 bp, Homo sapiens
agcaggtgcatggcgagcgcgg

SEQ ID NO: 9300982 - DNA, 21 bp, Homo sapiens
agcaggtctacaggttcatag

SEQ ID NO: 9300983 - DNA, 22 bp, Homo sapiens
cacatatttgatgaagctttgt

SEQ ID NO: 9300984 - DNA, 22 bp, Homo sapiens
cacatcaagcatccatgagttt

SEQ ID NO: 9300985 - DNA, 22 bp, Homo sapiens
cacatccttcagctgagcccag

SEQ ID NO: 9300986 - DNA, 22 bp, Homo sapiens
agcagggcctctggcactggtc

SEQ ID NO: 9300987 - DNA, 22 bp, Homo sapiens
agcagggcagtgcttcagctct

SEQ ID NO: 9300988 - DNA, 22 bp, Homo sapiens
agcagggcctctggcactggtc

SEQ ID NO: 9300989 - DNA, 22 bp, Homo sapiens
agcagggctctgccatgggccc

SEQ ID NO: 9300990 - DNA, 22 bp, Homo sapiens
agcagggctcctgaaagccgcg

SEQ ID NO: 9300991 - DNA, 22 bp, Homo sapiens
agcagggctccatttcactgcc

SEQ ID NO: 9300992 - DNA, 22 bp, Homo sapiens
agcagggctccatttcactgcc

SEQ ID NO: 9300993 - DNA, 22 bp, Homo sapiens
agcagggcctggcactcctggg

SEQ ID NO: 9300994 - DNA, 16 bp, Homo sapiens
agcagggcgggaagga

SEQ ID NO: 9300995 - DNA, 22 bp, Homo sapiens
agcataagttggtacagccact

SEQ ID NO: 9300996 - DNA, 21 bp, Homo sapiens
agcaggtgctgttggaggaaa

SEQ ID NO: 9300997 - DNA, 21 bp, Homo sapiens
agcaggtgctgttggaggaaa

SEQ ID NO: 9300998 - DNA, 18 bp, Homo sapiens
agcagctgtgccacactg

SEQ ID NO: 9300999 - DNA, 22 bp, Homo sapiens
agcagctgtggaaaagtaacta

SEQ ID NO: 9301000 - DNA, 22 bp, Homo sapiens
caatgataatggctgtatttat

SEQ ID NO: 9301001 - DNA, 22 bp, Homo sapiens
caatgaaattgagatccagaga

SEQ ID NO: 9301002 - DNA, 22 bp, Homo sapiens
caatgacactctgcacagtgct

SEQ ID NO: 9301003 - DNA, 22 bp, Homo sapiens
cacaggaagctgactgctggca

SEQ ID NO: 9301004 - DNA, 22 bp, Homo sapiens
cacaggagctgtggggcagtgt

SEQ ID NO: 9301005 - DNA, 22 bp, Homo sapiens
cacaggaggaggccagagcgta

SEQ ID NO: 9301006 - DNA, 22 bp, Homo sapiens
agcagctgtggggacaagggta

SEQ ID NO: 9301007 - DNA, 22 bp, Homo sapiens
agcagctgttagaaacaggaag

SEQ ID NO: 9301008 - DNA, 22 bp, Homo sapiens
cacaggaggaggtgcccgggcc

SEQ ID NO: 9301009 - DNA, 22 bp, Homo sapiens
cacaggaggaggtgcccgggcc

SEQ ID NO: 9301010 - DNA, 22 bp, Homo sapiens
cacaggagggagcgggcagcca

SEQ ID NO: 9301011 - DNA, 22 bp, Homo sapiens
cacagggcttctcatggggtgc

SEQ ID NO: 9301012 - DNA, 22 bp, Homo sapiens
cacagggcttctcatggggtgc

SEQ ID NO: 9301013 - DNA, 22 bp, Homo sapiens
cacagggctttgatggctgagt

SEQ ID NO: 9301014 - DNA, 22 bp, Homo sapiens
cacagggccttgtgtgactgca

SEQ ID NO: 9301015 - DNA, 22 bp, Homo sapiens
cacagggctaaatgaagggttg

SEQ ID NO: 9301016 - DNA, 22 bp, Homo sapiens
cacagggcttctcatggggtgc

SEQ ID NO: 9301017 - DNA, 22 bp, Homo sapiens
cacagggcaggtactctcagag

SEQ ID NO: 9301018 - DNA, 22 bp, Homo sapiens
cacaggctgcccgcagctggga

SEQ ID NO: 9301019 - DNA, 22 bp, Homo sapiens
cacaggctgcccgcagctggga

SEQ ID NO: 9301020 - DNA, 22 bp, Homo sapiens
cacaggctgcccgcagctggga

SEQ ID NO: 9301021 - DNA, 22 bp, Homo sapiens
cacagggcctggggcagctgct

SEQ ID NO: 9301022 - DNA, 22 bp, Homo sapiens
cacagggcctggggcagctgct

SEQ ID NO: 9301023 - DNA, 22 bp, Homo sapiens
cacagggccactttcccagtaa

SEQ ID NO: 9301024 - DNA, 22 bp, Homo sapiens
gagctgggcgagccggggaagt

SEQ ID NO: 9301025 - DNA, 22 bp, Homo sapiens
gagctgggctggcttcctccct

SEQ ID NO: 9301026 - DNA, 22 bp, Homo sapiens
gagctgggcctgcgagtgctgc

SEQ ID NO: 9301027 - DNA, 22 bp, Homo sapiens
gagctgggcctgcgagtgctgc

SEQ ID NO: 9301028 - DNA, 22 bp, Homo sapiens
gagctgggcctgcgagtgctgc

SEQ ID NO: 9301029 - DNA, 23 bp, Homo sapiens
atggtccagccagctgcacagga

SEQ ID NO: 9301030 - DNA, 22 bp, Homo sapiens
atggctggaggccgggcttcct

SEQ ID NO: 9301031 - DNA, 22 bp, Homo sapiens
atggctggaagagtcgaagagt

SEQ ID NO: 9301032 - DNA, 22 bp, Homo sapiens
atggctggatagttgaagctct

SEQ ID NO: 9301033 - DNA, 22 bp, Homo sapiens
atggctggatagttgaagctct

SEQ ID NO: 9301034 - DNA, 22 bp, Homo sapiens
atggctggatttgatccatggg

SEQ ID NO: 9301035 - DNA, 22 bp, Homo sapiens
gaggccaccctatgggtcccag

SEQ ID NO: 9301036 - DNA, 22 bp, Homo sapiens
gaggccagggatgcaatgagag

SEQ ID NO: 9301037 - DNA, 22 bp, Homo sapiens
gaggagctgagccacgtcctgg

SEQ ID NO: 9301038 - DNA, 22 bp, Homo sapiens
gaggagctctgctccatccttc

SEQ ID NO: 9301039 - DNA, 22 bp, Homo sapiens
atgtacattttcctaatgtttt

SEQ ID NO: 9301040 - DNA, 22 bp, Homo sapiens
atgtacatttagatcatttctg

SEQ ID NO: 9301041 - DNA, 22 bp, Homo sapiens
atgtacattattcgagtgatgg

SEQ ID NO: 9301042 - DNA, 22 bp, Homo sapiens
gaggctgctgttagccctgggc

SEQ ID NO: 9301043 - DNA, 22 bp, Homo sapiens
atgtgtgtatatatagtcattt

SEQ ID NO: 9301044 - DNA, 22 bp, Homo sapiens
atgtgtgtgcatttctctccct

SEQ ID NO: 9301045 - DNA, 22 bp, Homo sapiens
atgtgtgtgatgggcgccgcca

SEQ ID NO: 9301046 - DNA, 22 bp, Homo sapiens
atgtgtgtatgtgcctatatct

SEQ ID NO: 9301047 - DNA, 22 bp, Homo sapiens
gaggggagcccccatcctccag

SEQ ID NO: 9301048 - DNA, 22 bp, Homo sapiens
gaggcctgggagcctgtcctcc

SEQ ID NO: 9301049 - DNA, 22 bp, Homo sapiens
gaggcctgggttacctactcgt

SEQ ID NO: 9301050 - DNA, 23 bp, Homo sapiens
gaggcctggccctgccacatctc

SEQ ID NO: 9301051 - DNA, 22 bp, Homo sapiens
gaggcctggctctgccctcctg

SEQ ID NO: 9301052 - DNA, 22 bp, Homo sapiens
gaggcctggagccgcctaggcg

SEQ ID NO: 9301053 - DNA, 22 bp, Homo sapiens
gagccaggaggcagagactgca

SEQ ID NO: 9301054 - DNA, 22 bp, Homo sapiens
gagccaggaagaaggccttact

SEQ ID NO: 9301055 - DNA, 22 bp, Homo sapiens
gagagctgtggtttgaccaggc

SEQ ID NO: 9301056 - DNA, 22 bp, Homo sapiens
gagagctttcccattttgctta

SEQ ID NO: 9301057 - DNA, 22 bp, Homo sapiens
atgccactgcacttcagcttgg

SEQ ID NO: 9301058 - DNA, 22 bp, Homo sapiens
gacactgcactcggccgaaagg

SEQ ID NO: 9301059 - DNA, 22 bp, Homo sapiens
atgccactgcgctccagcctgg

SEQ ID NO: 9301060 - DNA, 22 bp, Homo sapiens
atgccactgcgctctagcctgg

SEQ ID NO: 9301061 - DNA, 22 bp, Homo sapiens
atggaaaaggctgatttcatta

SEQ ID NO: 9301062 - DNA, 22 bp, Homo sapiens
atggaatgaaaaacacatgcaa

SEQ ID NO: 9301063 - DNA, 22 bp, Homo sapiens
atggaagcagacaggtaattcc

SEQ ID NO: 9301064 - DNA, 23 bp, Homo sapiens
atggagctggtactagctacctc

SEQ ID NO: 9301065 - DNA, 20 bp, Homo sapiens
atggaggaagggcaagagaa

SEQ ID NO: 9301066 - DNA, 22 bp, Homo sapiens
atggagctaaattgtaatcata

SEQ ID NO: 9301067 - DNA, 22 bp, Homo sapiens
gagaaattttgagtggctttct

SEQ ID NO: 9301068 - DNA, 22 bp, Homo sapiens
gagaaatgcatgcatgtcatca

SEQ ID NO: 9301069 - DNA, 22 bp, Homo sapiens
cttgtaaaatatccagttaagg

SEQ ID NO: 9301070 - DNA, 22 bp, Homo sapiens
cttgtaaactttctaggcctat

SEQ ID NO: 9301071 - DNA, 22 bp, Homo sapiens
cttgtaaacttgagcagggcat

SEQ ID NO: 9301072 - DNA, 22 bp, Homo sapiens
cttgtaaaaggtacattatgct

SEQ ID NO: 9301073 - DNA, 19 bp, Homo sapiens
cttgtaaagggctgtttct

SEQ ID NO: 9301074 - DNA, 22 bp, Homo sapiens
cttgtaaatgcagattctgatt

SEQ ID NO: 9301075 - DNA, 22 bp, Homo sapiens
cttggcagatccaaaaatgaca

SEQ ID NO: 9301076 - DNA, 22 bp, Homo sapiens
cttggcatgcagcaggcactca

SEQ ID NO: 9301077 - DNA, 19 bp, Homo sapiens
cttggcatctgtgaagtga

SEQ ID NO: 9301078 - DNA, 22 bp, Homo sapiens
atctagatggaattgtatatag

SEQ ID NO: 9301079 - DNA, 22 bp, Homo sapiens
atctagaaaaggtgactaaaat

SEQ ID NO: 9301080 - DNA, 22 bp, Homo sapiens
cttgctgagataaatgctgtct

SEQ ID NO: 9301081 - DNA, 22 bp, Homo sapiens
cttgcctttgtcttcaaaggct

SEQ ID NO: 9301082 - DNA, 22 bp, Homo sapiens
cttgcctttgtcttcaaaggct

SEQ ID NO: 9301083 - DNA, 22 bp, Homo sapiens
cttgcctgggactgaggcattt

SEQ ID NO: 9301084 - DNA, 19 bp, Homo sapiens
cttgcctgttcctacagct

SEQ ID NO: 9301085 - DNA, 22 bp, Homo sapiens
cttgcctgctggagcagggctc

SEQ ID NO: 9301086 - DNA, 23 bp, Homo sapiens
cttgcctggcctctctgcccaga

SEQ ID NO: 9301087 - DNA, 22 bp, Homo sapiens
cttgcctgctggagcagggctc

SEQ ID NO: 9301088 - DNA, 20 bp, Homo sapiens
cttgagttcagagctgtcat

SEQ ID NO: 9301089 - DNA, 22 bp, Homo sapiens
cttgagttacagctctccaaga

SEQ ID NO: 9301090 - DNA, 22 bp, Homo sapiens
cttgagttacagctctccaaga

SEQ ID NO: 9301091 - DNA, 23 bp, Homo sapiens
atgaaatgatactttattcactg

SEQ ID NO: 9301092 - DNA, 22 bp, Homo sapiens
atgaaatatcttgaagaaattc

SEQ ID NO: 9301093 - DNA, 22 bp, Homo sapiens
atgaaatgattgaaatctttac

SEQ ID NO: 9301094 - DNA, 22 bp, Homo sapiens
atgaaatgtctggatctttttc

SEQ ID NO: 9301095 - DNA, 22 bp, Homo sapiens
ctttggtgttcattaaacatgg

SEQ ID NO: 9301096 - DNA, 22 bp, Homo sapiens
cttttattttgaattaagggct

SEQ ID NO: 9301097 - DNA, 18 bp, Homo sapiens
cttgttcttctcttggcg

SEQ ID NO: 9301098 - DNA, 22 bp, Homo sapiens
atgaaacagtgtgtatagcaaa

SEQ ID NO: 9301099 - DNA, 23 bp, Homo sapiens
atgaaacatcacaatggtaccat

SEQ ID NO: 9301100 - DNA, 22 bp, Homo sapiens
atgaaataaatacccacacata

SEQ ID NO: 9301101 - DNA, 22 bp, Homo sapiens
atgaaaagcataaacgctgaag

SEQ ID NO: 9301102 - DNA, 22 bp, Homo sapiens
atgaaaacggaccagagctatt

SEQ ID NO: 9301103 - DNA, 22 bp, Homo sapiens
atctttttactaacactgctta

SEQ ID NO: 9301104 - DNA, 22 bp, Homo sapiens
atcttttactacaaatcaggtg

SEQ ID NO: 9301105 - DNA, 22 bp, Homo sapiens
atcttttatgagcgttctgaca

SEQ ID NO: 9301106 - DNA, 22 bp, Homo sapiens
atcttttacattactgcccaga

SEQ ID NO: 9301107 - DNA, 22 bp, Homo sapiens
atctttgtttgtctctgaggtg

SEQ ID NO: 9301108 - DNA, 22 bp, Homo sapiens
atctttgggcaatgatgaggga

SEQ ID NO: 9301109 - DNA, 22 bp, Homo sapiens
atgaagattctatttatcactt

SEQ ID NO: 9301110 - DNA, 22 bp, Homo sapiens
atgaggcaggtggaggctgcca

SEQ ID NO: 9301111 - DNA, 22 bp, Homo sapiens
atgaggcaggagtgcagtggca

SEQ ID NO: 9301112 - DNA, 22 bp, Homo sapiens
gaaagcaatttgtgtaatctgt

SEQ ID NO: 9301113 - DNA, 22 bp, Homo sapiens
gaaagcaatttgtgtaatctgt

SEQ ID NO: 9301114 - DNA, 22 bp, Homo sapiens
gaaagcacagttcatgagacaa

SEQ ID NO: 9301115 - DNA, 22 bp, Homo sapiens
gaaagcacaggctcaggaacag

SEQ ID NO: 9301116 - DNA, 21 bp, Homo sapiens
gaaagcacagaaaggactctt

SEQ ID NO: 9301117 - DNA, 22 bp, Homo sapiens
gaaagcacgatagtagcaaaag

SEQ ID NO: 9301118 - DNA, 22 bp, Homo sapiens
gaaagcacccaagatttccttc

SEQ ID NO: 9301119 - DNA, 22 bp, Homo sapiens
gaaagcacatactataaatcac

SEQ ID NO: 9301120 - DNA, 22 bp, Homo sapiens
gaaagcacagttctgaccatgt

SEQ ID NO: 9301121 - DNA, 22 bp, Homo sapiens
gaaagcagtaaatgggtcccat

SEQ ID NO: 9301122 - DNA, 22 bp, Homo sapiens
gaaagcactgtgagatcttgtt

SEQ ID NO: 9301123 - DNA, 22 bp, Homo sapiens
gaaagcactaaaagagaatcct

SEQ ID NO: 9301124 - DNA, 22 bp, Homo sapiens
atgaggtggtcttcagtaggtc

SEQ ID NO: 9301125 - DNA, 22 bp, Homo sapiens
atgagtaagaccataatttttg

SEQ ID NO: 9301126 - DNA, 22 bp, Homo sapiens
atgagtaaaacagtggtgttgc

SEQ ID NO: 9301127 - DNA, 22 bp, Homo sapiens
atgagtaagataggcaatgtgt

SEQ ID NO: 9301128 - DNA, 22 bp, Homo sapiens
atgcaaaataaggcagaaacat

SEQ ID NO: 9301129 - DNA, 22 bp, Homo sapiens
atgcaaaagtaattgcaatttt

SEQ ID NO: 9301130 - DNA, 22 bp, Homo sapiens
atgcaaaagtagttgcagtttt

SEQ ID NO: 9301131 - DNA, 19 bp, Homo sapiens
atgcaaatagatttggaat

SEQ ID NO: 9301132 - DNA, 22 bp, Homo sapiens
atgcagaacgtttgtgaaactt

SEQ ID NO: 9301133 - DNA, 22 bp, Homo sapiens
atgcagaaggagccatgcttgc

SEQ ID NO: 9301134 - DNA, 22 bp, Homo sapiens
atgcagaatcttgagaaaaatt

SEQ ID NO: 9301135 - DNA, 22 bp, Homo sapiens
atgcagatggtggatggagaaa

SEQ ID NO: 9301136 - DNA, 22 bp, Homo sapiens
atgcagatgttcctactgtgtt

SEQ ID NO: 9301137 - DNA, 22 bp, Homo sapiens
gatgaggcagctcagggggaaa

SEQ ID NO: 9301138 - DNA, 22 bp, Homo sapiens
gatgaggggtcattggctggga

SEQ ID NO: 9301139 - DNA, 22 bp, Homo sapiens
gatgaggcaagccagaggactg

SEQ ID NO: 9301140 - DNA, 22 bp, Homo sapiens
atgtttttaaatagacttacag

SEQ ID NO: 9301141 - DNA, 22 bp, Homo sapiens
attaaaattccaaggtatgcca

SEQ ID NO: 9301142 - DNA, 22 bp, Homo sapiens
atgttttaccctttgcacaaac

SEQ ID NO: 9301143 - DNA, 20 bp, Homo sapiens
atgttttataaaagaacggg

SEQ ID NO: 9301144 - DNA, 22 bp, Homo sapiens
atgttttatgttccactcaagg

SEQ ID NO: 9301145 - DNA, 22 bp, Homo sapiens
atgttttatgttccactcaagg

SEQ ID NO: 9301146 - DNA, 23 bp, Homo sapiens
atgttttatgtctctagctgcca

SEQ ID NO: 9301147 - DNA, 22 bp, Homo sapiens
atgttttatattttgcagcagt

SEQ ID NO: 9301148 - DNA, 22 bp, Homo sapiens
atgttttattaccaacttgtac

SEQ ID NO: 9301149 - DNA, 20 bp, Homo sapiens
atgtttctctgtcgtgattt

SEQ ID NO: 9301150 - DNA, 22 bp, Homo sapiens
atgtgtgtgtttaatcctcaaa

SEQ ID NO: 9301151 - DNA, 22 bp, Homo sapiens
atgtgttaattggagcagcagg

SEQ ID NO: 9301152 - DNA, 22 bp, Homo sapiens
atgtgtgtgtgcgcgcgcagga

SEQ ID NO: 9301153 - DNA, 22 bp, Homo sapiens
atgtgtgtgtatatacacacat

SEQ ID NO: 9301154 - DNA, 22 bp, Homo sapiens
attaatttttctgacagccaca

SEQ ID NO: 9301155 - DNA, 22 bp, Homo sapiens
attacaaaagaagggagaaggt

SEQ ID NO: 9301156 - DNA, 22 bp, Homo sapiens
gcaaggctgagcacatttgcat

SEQ ID NO: 9301157 - DNA, 22 bp, Homo sapiens
gcaactttagaaaaatctataa

SEQ ID NO: 9301158 - DNA, 22 bp, Homo sapiens
attaatgacgcagataataatt

SEQ ID NO: 9301159 - DNA, 22 bp, Homo sapiens
attaatattggttcattagctg

SEQ ID NO: 9301160 - DNA, 22 bp, Homo sapiens
attaatatttgcaccttctgtc

SEQ ID NO: 9301161 - DNA, 22 bp, Homo sapiens
attaattagagaggtgcctgtt

SEQ ID NO: 9301162 - DNA, 22 bp, Homo sapiens
attaattttacctttgtaaaca

SEQ ID NO: 9301163 - DNA, 22 bp, Homo sapiens
attaatttccaggcactgtgct

SEQ ID NO: 9301164 - DNA, 22 bp, Homo sapiens
gatgatattttgactggagaat

SEQ ID NO: 9301165 - DNA, 22 bp, Homo sapiens
attaatatcccccgccgttctg

SEQ ID NO: 9301166 - DNA, 22 bp, Homo sapiens
attaatatacactgttagcatg

SEQ ID NO: 9301167 - DNA, 22 bp, Homo sapiens
attaatatcctgctggctaaat

SEQ ID NO: 9301168 - DNA, 22 bp, Homo sapiens
attaatatgagaaagtggcaga

SEQ ID NO: 9301169 - DNA, 20 bp, Homo sapiens
gcaagtgaaaactatgggtg

SEQ ID NO: 9301170 - DNA, 22 bp, Homo sapiens
gcaagtacaaacgcatcggctg

SEQ ID NO: 9301171 - DNA, 22 bp, Homo sapiens
gcaagtagtgggaaagaagatg

SEQ ID NO: 9301172 - DNA, 22 bp, Homo sapiens
gcaagtaggaagtgtcctcctt

SEQ ID NO: 9301173 - DNA, 22 bp, Homo sapiens
gcaaggtctttcagaaaggaaa

SEQ ID NO: 9301174 - DNA, 22 bp, Homo sapiens
attattcttatgtcatcatggc

SEQ ID NO: 9301175 - DNA, 22 bp, Homo sapiens
attattcttatgtcatcatggc

SEQ ID NO: 9301176 - DNA, 22 bp, Homo sapiens
attattcttaatgcagggatta

SEQ ID NO: 9301177 - DNA, 22 bp, Homo sapiens
attattcttgaggtgtttattg

SEQ ID NO: 9301178 - DNA, 22 bp, Homo sapiens
attattctttgataaatggcag

SEQ ID NO: 9301179 - DNA, 17 bp, Homo sapiens
attattccaactctcca

SEQ ID NO: 9301180 - DNA, 22 bp, Homo sapiens
attattctctggaggaaagatt

SEQ ID NO: 9301181 - DNA, 22 bp, Homo sapiens
attcttcagaatatctggcact

SEQ ID NO: 9301182 - DNA, 22 bp, Homo sapiens
attcttcagcaggggacactat

SEQ ID NO: 9301183 - DNA, 22 bp, Homo sapiens
attgaaattgatgaaattcttg

SEQ ID NO: 9301184 - DNA, 22 bp, Homo sapiens
attgctgggaggatgtgtgttc

SEQ ID NO: 9301185 - DNA, 22 bp, Homo sapiens
attgctgtgatgatgttctgag

SEQ ID NO: 9301186 - DNA, 22 bp, Homo sapiens
attgctgtacacttctagatct

SEQ ID NO: 9301187 - DNA, 22 bp, Homo sapiens
attgcttacagctatttctgta

SEQ ID NO: 9301188 - DNA, 22 bp, Homo sapiens
attgacaagaaagatattttta

SEQ ID NO: 9301189 - DNA, 22 bp, Homo sapiens
attctgttacttggtgatcttc

SEQ ID NO: 9301190 - DNA, 22 bp, Homo sapiens
attcttcacatggataggatct

SEQ ID NO: 9301191 - DNA, 21 bp, Homo sapiens
attctcaggcccatcctcagg

SEQ ID NO: 9301192 - DNA, 22 bp, Homo sapiens
attctagccctggaacggcgac

SEQ ID NO: 9301193 - DNA, 22 bp, Homo sapiens
attcctcattatttactgagga

SEQ ID NO: 9301194 - DNA, 19 bp, Homo sapiens
attcctcaaggacagaaat

SEQ ID NO: 9301195 - DNA, 22 bp, Homo sapiens
attcctcagcaggccttttgtt

SEQ ID NO: 9301196 - DNA, 22 bp, Homo sapiens
attcctacgctgtcctccttct

SEQ ID NO: 9301197 - DNA, 22 bp, Homo sapiens
attcctcaaaggtagcccatta

SEQ ID NO: 9301198 - DNA, 16 bp, Homo sapiens
gcagaggaaaggggag

SEQ ID NO: 9301199 - DNA, 22 bp, Homo sapiens
attccttctaaaacgctgccct

SEQ ID NO: 9301200 - DNA, 22 bp, Homo sapiens
gcagcaggcatggccgccctgg

SEQ ID NO: 9301201 - DNA, 22 bp, Homo sapiens
gcagcaggcttttcataccttg

SEQ ID NO: 9301202 - DNA, 22 bp, Homo sapiens
attcctgataaatgctgctctg

SEQ ID NO: 9301203 - DNA, 22 bp, Homo sapiens
attcctggtggcagaaacatga

SEQ ID NO: 9301204 - DNA, 22 bp, Homo sapiens
attcctgcattggtcaacccat

SEQ ID NO: 9301205 - DNA, 22 bp, Homo sapiens
attcctcatttgttgagaacca

SEQ ID NO: 9301206 - DNA, 20 bp, Homo sapiens
attcctcagccccagcctca

SEQ ID NO: 9301207 - DNA, 22 bp, Homo sapiens
gcagcaggtccgcatcatcatc

SEQ ID NO: 9301208 - DNA, 22 bp, Homo sapiens
gcagcagggtgccagctttgca

SEQ ID NO: 9301209 - DNA, 22 bp, Homo sapiens
gcagcagggagcaggggtgtca

SEQ ID NO: 9301210 - DNA, 22 bp, Homo sapiens
gcagcagggagcaggggtgtca

SEQ ID NO: 9301211 - DNA, 22 bp, Homo sapiens
attctagaatttaaatttgcca

SEQ ID NO: 9301212 - DNA, 22 bp, Homo sapiens
attctactgcaaatcctgacca

SEQ ID NO: 9301213 - DNA, 22 bp, Homo sapiens
gcagagctgcagcgaggcctgg

SEQ ID NO: 9301214 - DNA, 22 bp, Homo sapiens
attcagtgtgaggttttcaagt

SEQ ID NO: 9301215 - DNA, 22 bp, Homo sapiens
atttagaaattccaaaagtatt

SEQ ID NO: 9301216 - DNA, 22 bp, Homo sapiens
atttagaagctaatttttcaga

SEQ ID NO: 9301217 - DNA, 20 bp, Homo sapiens
gccaggagggtgtgatgagc

SEQ ID NO: 9301218 - DNA, 22 bp, Homo sapiens
gccaggaggggagagtgtgtca

SEQ ID NO: 9301219 - DNA, 22 bp, Homo sapiens
atttactagggctgtttaagta

SEQ ID NO: 9301220 - DNA, 22 bp, Homo sapiens
atttactactgctatctagaag

SEQ ID NO: 9301221 - DNA, 22 bp, Homo sapiens
atttacagaaacttaatcatag

SEQ ID NO: 9301222 - DNA, 22 bp, Homo sapiens
atttacagaagcatgtaatagc

SEQ ID NO: 9301223 - DNA, 19 bp, Homo sapiens
gccaggagggctctggctg

SEQ ID NO: 9301224 - DNA, 22 bp, Homo sapiens
atttacacttggtttactagag

SEQ ID NO: 9301225 - DNA, 22 bp, Homo sapiens
atttacacattcataagatttc

SEQ ID NO: 9301226 - DNA, 21 bp, Homo sapiens
atttacaaaacagtcccttcc

SEQ ID NO: 9301227 - DNA, 22 bp, Homo sapiens
atttaattttctcaacagtgct

SEQ ID NO: 9301228 - DNA, 22 bp, Homo sapiens
attggcaatgtcccggctgctg

SEQ ID NO: 9301229 - DNA, 22 bp, Homo sapiens
attggcaaggctgcggtgtctg

SEQ ID NO: 9301230 - DNA, 22 bp, Homo sapiens
atttaattaatcatggtgaatt

SEQ ID NO: 9301231 - DNA, 22 bp, Homo sapiens
atttaatgtcgagctattgtag

SEQ ID NO: 9301232 - DNA, 22 bp, Homo sapiens
attggaagtatttcatcaaaag

SEQ ID NO: 9301233 - DNA, 22 bp, Homo sapiens
attgcttttagtgaaattatat

SEQ ID NO: 9301234 - DNA, 22 bp, Homo sapiens
attgcttttcagacaatgaggc

SEQ ID NO: 9301235 - DNA, 22 bp, Homo sapiens
attgcttttccttaacacatgc

SEQ ID NO: 9301236 - DNA, 22 bp, Homo sapiens
attgcttttgagctagaatttt

SEQ ID NO: 9301237 - DNA, 18 bp, Homo sapiens
attgcttttgtaccaacc

SEQ ID NO: 9301238 - DNA, 22 bp, Homo sapiens
attgcttactaatcatcttcag

SEQ ID NO: 9301239 - DNA, 22 bp, Homo sapiens
attgcttcatgtcctttgccgg

SEQ ID NO: 9301240 - DNA, 22 bp, Homo sapiens
attgcttcaactgttcaatggg

SEQ ID NO: 9301241 - DNA, 22 bp, Homo sapiens
attgcttttaagcaccacctaa

SEQ ID NO: 9301242 - DNA, 22 bp, Homo sapiens
attgctttgtacatgcctagca

SEQ ID NO: 9301243 - DNA, 22 bp, Homo sapiens
attgctttctttggggaactgt

SEQ ID NO: 9301244 - DNA, 22 bp, Homo sapiens
attgctttagaaagaaaaatat

SEQ ID NO: 9301245 - DNA, 22 bp, Homo sapiens
atttcatggcagactttaaccc

SEQ ID NO: 9301246 - DNA, 22 bp, Homo sapiens
atttcatgagttattatagtgg

SEQ ID NO: 9301247 - DNA, 22 bp, Homo sapiens
atttcgttcagtccttactgtg

SEQ ID NO: 9301248 - DNA, 22 bp, Homo sapiens
atttctataggaggacagtatt

SEQ ID NO: 9301249 - DNA, 22 bp, Homo sapiens
atttcatgtgaagaagagataa

SEQ ID NO: 9301250 - DNA, 21 bp, Homo sapiens
atttcatggtgcttttaagaa

SEQ ID NO: 9301251 - DNA, 16 bp, Homo sapiens
atttccttgtgagttt

SEQ ID NO: 9301252 - DNA, 22 bp, Homo sapiens
atttccttcggacagtttgggt

SEQ ID NO: 9301253 - DNA, 22 bp, Homo sapiens
atttattatgggatttggcaca

SEQ ID NO: 9301254 - DNA, 22 bp, Homo sapiens
atttattgagacttaacaaccc

SEQ ID NO: 9301255 - DNA, 22 bp, Homo sapiens
atttattgagagggaggggaat

SEQ ID NO: 9301256 - DNA, 22 bp, Homo sapiens
atttattggatgcttacttggg

SEQ ID NO: 9301257 - DNA, 22 bp, Homo sapiens
atttattggatgcttacttggg

SEQ ID NO: 9301258 - DNA, 22 bp, Homo sapiens
atttattgagcctttcctatgt

SEQ ID NO: 9301259 - DNA, 22 bp, Homo sapiens
atttattgagcctttcctatgt

SEQ ID NO: 9301260 - DNA, 22 bp, Homo sapiens
gccaggcattattccgatccct

SEQ ID NO: 9301261 - DNA, 22 bp, Homo sapiens
gccaggcctgcaagtgctggtg

SEQ ID NO: 9301262 - DNA, 22 bp, Homo sapiens
gccaggccactcccgggtcctg

SEQ ID NO: 9301263 - DNA, 22 bp, Homo sapiens
gccaggccctgggcacttcgtg

SEQ ID NO: 9301264 - DNA, 22 bp, Homo sapiens
gcctctccgagccactgcctct

SEQ ID NO: 9301265 - DNA, 22 bp, Homo sapiens
gcctctctccttggcttgcagt

SEQ ID NO: 9301266 - DNA, 21 bp, Homo sapiens
gcctctccaaatcctgccttc

SEQ ID NO: 9301267 - DNA, 21 bp, Homo sapiens
gcctctccaaatcctgccttc

SEQ ID NO: 9301268 - DNA, 22 bp, Homo sapiens
gcctccagcccacgcaggcctg

SEQ ID NO: 9301269 - DNA, 22 bp, Homo sapiens
gcctccagctggggcatttcag

SEQ ID NO: 9301270 - DNA, 22 bp, Homo sapiens
gcctccagtttttttctgaact

SEQ ID NO: 9301271 - DNA, 21 bp, Homo sapiens
gcctccagccagatggcctcc

SEQ ID NO: 9301272 - DNA, 22 bp, Homo sapiens
gcctccacttttgctggcttct

SEQ ID NO: 9301273 - DNA, 22 bp, Homo sapiens
atttctcagtgtacattatgtt

SEQ ID NO: 9301274 - DNA, 22 bp, Homo sapiens
atttctcagtgaaatgacaggc

SEQ ID NO: 9301275 - DNA, 22 bp, Homo sapiens
atttctcactcacagtccatgt

SEQ ID NO: 9301276 - DNA, 22 bp, Homo sapiens
atttctcagtaatctcagcaat

SEQ ID NO: 9301277 - DNA, 22 bp, Homo sapiens
atttctcagcacttcctatctc

SEQ ID NO: 9301278 - DNA, 22 bp, Homo sapiens
atttctcagcacttcctatctc

SEQ ID NO: 9301279 - DNA, 18 bp, Homo sapiens
gcctgctctgctctcccc

SEQ ID NO: 9301280 - DNA, 18 bp, Homo sapiens
gcctgcctagagcttgcc

SEQ ID NO: 9301281 - DNA, 22 bp, Homo sapiens
gcctctctcgggcttgtagcgg

SEQ ID NO: 9301282 - DNA, 22 bp, Homo sapiens
gcctgctgaacctcatgcagtc

SEQ ID NO: 9301283 - DNA, 22 bp, Homo sapiens
gcctgctctggaatccatgtaa

SEQ ID NO: 9301284 - DNA, 22 bp, Homo sapiens
gcctgctctggaatccatgtaa

SEQ ID NO: 9301285 - DNA, 22 bp, Homo sapiens
gcctgctctggaatccatgtaa

SEQ ID NO: 9301286 - DNA, 22 bp, Homo sapiens
gcctgctggctgtccattgcag

SEQ ID NO: 9301287 - DNA, 22 bp, Homo sapiens
gcctgctggatgtggccaggcc

SEQ ID NO: 9301288 - DNA, 22 bp, Homo sapiens
gcctgctggaggagcctcaggg

SEQ ID NO: 9301289 - DNA, 22 bp, Homo sapiens
gcctgctggacattggccggcc

SEQ ID NO: 9301290 - DNA, 22 bp, Homo sapiens
gcctgctgcatccaggctattg

SEQ ID NO: 9301291 - DNA, 22 bp, Homo sapiens
gcctgctgccaccctggctccg

SEQ ID NO: 9301292 - DNA, 21 bp, Homo sapiens
gcctgctgcctgtggccggtc

SEQ ID NO: 9301293 - DNA, 22 bp, Homo sapiens
gcctggagctcggctgagggcg

SEQ ID NO: 9301294 - DNA, 22 bp, Homo sapiens
gcctggagctctccacttgggg

SEQ ID NO: 9301295 - DNA, 22 bp, Homo sapiens
gcctggctctgagtttctctcc

SEQ ID NO: 9301296 - DNA, 22 bp, Homo sapiens
gcctggctgaggcctctgctaa

SEQ ID NO: 9301297 - DNA, 22 bp, Homo sapiens
gcctggctgaggcctctgctaa

SEQ ID NO: 9301298 - DNA, 22 bp, Homo sapiens
caaactgttctctgtgggattc

SEQ ID NO: 9301299 - DNA, 22 bp, Homo sapiens
gctcaggagctgacagcctcaa

SEQ ID NO: 9301300 - DNA, 22 bp, Homo sapiens
gctcaggagctcttggtggcgc

SEQ ID NO: 9301301 - DNA, 22 bp, Homo sapiens
gcgagtgccgagagggcagggc

SEQ ID NO: 9301302 - DNA, 22 bp, Homo sapiens
gcgagggcacgcggttgaaggc

SEQ ID NO: 9301303 - DNA, 22 bp, Homo sapiens
gcgagggcacgcggttgaaggc

SEQ ID NO: 9301304 - DNA, 22 bp, Homo sapiens
caaaccattaagcatgttgagt

SEQ ID NO: 9301305 - DNA, 22 bp, Homo sapiens
caaacattgcactttctgctat

SEQ ID NO: 9301306 - DNA, 22 bp, Homo sapiens
caaactgtatgaccctaggccg

SEQ ID NO: 9301307 - DNA, 22 bp, Homo sapiens
caaaaccaagaacattcatttc

SEQ ID NO: 9301308 - DNA, 22 bp, Homo sapiens
caaaactatcaggctcaaagct

SEQ ID NO: 9301309 - DNA, 22 bp, Homo sapiens
caaaaccaagaacattcatttc

SEQ ID NO: 9301310 - DNA, 22 bp, Homo sapiens
gcctgggagggcagcagtgtgg

SEQ ID NO: 9301311 - DNA, 22 bp, Homo sapiens
gcctgggagtgcacagtgaggt

SEQ ID NO: 9301312 - DNA, 22 bp, Homo sapiens
gcctgtccactaaacagccaag

SEQ ID NO: 9301313 - DNA, 19 bp, Homo sapiens
gcctgtccagtagcatttt

SEQ ID NO: 9301314 - DNA, 22 bp, Homo sapiens
gcctgtcccgcaccggagcccg

SEQ ID NO: 9301315 - DNA, 22 bp, Homo sapiens
gcctgtccccaggagagtccgg

SEQ ID NO: 9301316 - DNA, 22 bp, Homo sapiens
gcctgtctcttggaacttggta

SEQ ID NO: 9301317 - DNA, 22 bp, Homo sapiens
gcctgtcctgctaatgacacgt

SEQ ID NO: 9301318 - DNA, 22 bp, Homo sapiens
gcctgtcctatacaggcggctg

SEQ ID NO: 9301319 - DNA, 22 bp, Homo sapiens
gcctgtcctcccctgcgctgag

SEQ ID NO: 9301320 - DNA, 20 bp, Homo sapiens
gcctgtcctgagtgtcatgg

SEQ ID NO: 9301321 - DNA, 22 bp, Homo sapiens
gcctgtctacactttctctgca

SEQ ID NO: 9301322 - DNA, 22 bp, Homo sapiens
gcctgtccttgtgaggtcccag

SEQ ID NO: 9301323 - DNA, 22 bp, Homo sapiens
gcctgtcctggatgctctgcaa

SEQ ID NO: 9301324 - DNA, 22 bp, Homo sapiens
ggcagctgagcatggctacctt

SEQ ID NO: 9301325 - DNA, 22 bp, Homo sapiens
ggcagctgagcatggctacctt

SEQ ID NO: 9301326 - DNA, 22 bp, Homo sapiens
ggcagctgattagcatcaagga

SEQ ID NO: 9301327 - DNA, 22 bp, Homo sapiens
ggcagctgattagcatcaagga

SEQ ID NO: 9301328 - DNA, 21 bp, Homo sapiens
ggcagctgaccgcgcggtgca

SEQ ID NO: 9301329 - DNA, 22 bp, Homo sapiens
ggcagctgacctagcaccatcc

SEQ ID NO: 9301330 - DNA, 22 bp, Homo sapiens
ggcagccagagggcagctggat

SEQ ID NO: 9301331 - DNA, 22 bp, Homo sapiens
cacccacatggaaattcacagt

SEQ ID NO: 9301332 - DNA, 22 bp, Homo sapiens
caccataaccaacatgtcagtt

SEQ ID NO: 9301333 - DNA, 22 bp, Homo sapiens
ggcagtgtggcctgagtaagtc

SEQ ID NO: 9301334 - DNA, 22 bp, Homo sapiens
ggcagttctcagccaaggcaat

SEQ ID NO: 9301335 - DNA, 22 bp, Homo sapiens
ggcagttctggatgcattgtca

SEQ ID NO: 9301336 - DNA, 22 bp, Homo sapiens
caccccttgtctttggggtcgt

SEQ ID NO: 9301337 - DNA, 20 bp, Homo sapiens
caccctcccagcacctatgc

SEQ ID NO: 9301338 - DNA, 20 bp, Homo sapiens
caccctcccagcacctatgc

SEQ ID NO: 9301339 - DNA, 22 bp, Homo sapiens
cacccctgtggagcatggtggc

SEQ ID NO: 9301340 - DNA, 18 bp, Homo sapiens
caccctccgcggctgccc

SEQ ID NO: 9301341 - DNA, 22 bp, Homo sapiens
caccctgctctgctgtgcggcc

SEQ ID NO: 9301342 - DNA, 22 bp, Homo sapiens
caccctgctacaaagcctcctg

SEQ ID NO: 9301343 - DNA, 22 bp, Homo sapiens
ggcatagatttctttaggttta

SEQ ID NO: 9301344 - DNA, 22 bp, Homo sapiens
ggctagggactcctcctcaggg

SEQ ID NO: 9301345 - DNA, 22 bp, Homo sapiens
ggctagggactcctcctcaggg

SEQ ID NO: 9301346 - DNA, 22 bp, Homo sapiens
ggctagggagacagagggcatg

SEQ ID NO: 9301347 - DNA, 22 bp, Homo sapiens
ggctagggagacagagggcatg

SEQ ID NO: 9301348 - DNA, 22 bp, Homo sapiens
ggctagggatctagaccaggac

SEQ ID NO: 9301349 - DNA, 22 bp, Homo sapiens
ggctaggggaataatctgtggt

SEQ ID NO: 9301350 - DNA, 22 bp, Homo sapiens
ggctagggagacagagggcatg

SEQ ID NO: 9301351 - DNA, 22 bp, Homo sapiens
ggctagggagacagagggcatg

SEQ ID NO: 9301352 - DNA, 22 bp, Homo sapiens
cactggatttccaggaatactc

SEQ ID NO: 9301353 - DNA, 22 bp, Homo sapiens
ggcctcgcggcttctggtggct

SEQ ID NO: 9301354 - DNA, 22 bp, Homo sapiens
cactgcactccagcttgggtga

SEQ ID NO: 9301355 - DNA, 22 bp, Homo sapiens
ggcctctcatgcccagagccaa

SEQ ID NO: 9301356 - DNA, 22 bp, Homo sapiens
ggcctctcattctccctggtcc

SEQ ID NO: 9301357 - DNA, 22 bp, Homo sapiens
ggcctctcatgtcctgggcttc

SEQ ID NO: 9301358 - DNA, 22 bp, Homo sapiens
ggcctctctagcatccagcctg

SEQ ID NO: 9301359 - DNA, 22 bp, Homo sapiens
cactgcagccacatagatgacg

SEQ ID NO: 9301360 - DNA, 22 bp, Homo sapiens
cactgcagatcagaggctgaga

SEQ ID NO: 9301361 - DNA, 22 bp, Homo sapiens
cactgagccttgccagcttggt

SEQ ID NO: 9301362 - DNA, 22 bp, Homo sapiens
cactgaggactcccacgtaggt

SEQ ID NO: 9301363 - DNA, 22 bp, Homo sapiens
cacagctggtgcactagctctg

SEQ ID NO: 9301364 - DNA, 22 bp, Homo sapiens
cacactgtcaggtaaataacac

SEQ ID NO: 9301365 - DNA, 22 bp, Homo sapiens
cacactgatagcactaagtcag

SEQ ID NO: 9301366 - DNA, 22 bp, Homo sapiens
cacactgacctgaacttagcat

SEQ ID NO: 9301367 - DNA, 22 bp, Homo sapiens
ggaggcgcggctcggctgtgcc

SEQ ID NO: 9301368 - DNA, 22 bp, Homo sapiens
ggaggcggaagttgcagtgagc

SEQ ID NO: 9301369 - DNA, 22 bp, Homo sapiens
ggaggcggacacaggtagtgtt

SEQ ID NO: 9301370 - DNA, 22 bp, Homo sapiens
ggaggcggacacaggtagtgtt

SEQ ID NO: 9301371 - DNA, 22 bp, Homo sapiens
ggaggcggagcttgcagtgagc

SEQ ID NO: 9301372 - DNA, 22 bp, Homo sapiens
ggagggagtttcattcctgccc

SEQ ID NO: 9301373 - DNA, 22 bp, Homo sapiens
ggagggagtttcattcctgccc

SEQ ID NO: 9301374 - DNA, 22 bp, Homo sapiens
ggagggaggttagattcaagct

SEQ ID NO: 9301375 - DNA, 22 bp, Homo sapiens
ggagggaggttagattcaagct

SEQ ID NO: 9301376 - DNA, 22 bp, Homo sapiens
ggagggagtcagctgattagaa

SEQ ID NO: 9301377 - DNA, 22 bp, Homo sapiens
ggagggagcagagaacccaacc

SEQ ID NO: 9301378 - DNA, 22 bp, Homo sapiens
ggaggcggaggctgcagtgagc

SEQ ID NO: 9301379 - DNA, 22 bp, Homo sapiens
ggagggagcatccccttgctga

SEQ ID NO: 9301380 - DNA, 22 bp, Homo sapiens
ggagggagggctagaccaaaga

SEQ ID NO: 9301381 - DNA, 22 bp, Homo sapiens
cacagggcagagacctgggtgc

SEQ ID NO: 9301382 - DNA, 22 bp, Homo sapiens
ggatgtcgaggatggggtagca

SEQ ID NO: 9301383 - DNA, 22 bp, Homo sapiens
ggatggtgacggcggcccgctt

SEQ ID NO: 9301384 - DNA, 19 bp, Homo sapiens
ggatggtggggtgcccatc

SEQ ID NO: 9301385 - DNA, 22 bp, Homo sapiens
ggatgtcgaggatggggtagca

SEQ ID NO: 9301386 - DNA, 22 bp, Homo sapiens
ggcacagtgattaagagccagt

SEQ ID NO: 9301387 - DNA, 22 bp, Homo sapiens
ggcacagggaggccctggtgtg

SEQ ID NO: 9301388 - DNA, 22 bp, Homo sapiens
ggcacacaaaggcagcatttga

SEQ ID NO: 9301389 - DNA, 22 bp, Homo sapiens
cacagggcagagacctgggtgc

SEQ ID NO: 9301390 - DNA, 22 bp, Homo sapiens
cacagggcagagacctgggtgc

SEQ ID NO: 9301391 - DNA, 22 bp, Homo sapiens
ggcagagagttctccacctctc

SEQ ID NO: 9301392 - DNA, 22 bp, Homo sapiens
ggcactgggcaccggctgaggg

SEQ ID NO: 9301393 - DNA, 22 bp, Homo sapiens
cacagtgctcgggttttatgtc

SEQ ID NO: 9301394 - DNA, 22 bp, Homo sapiens
ggcagagccttctggagctcgc

SEQ ID NO: 9301395 - DNA, 22 bp, Homo sapiens
cacagtgtagttaatgtgacat

SEQ ID NO: 9301396 - DNA, 22 bp, Homo sapiens
cacagtgtagactaataataga

SEQ ID NO: 9301397 - DNA, 22 bp, Homo sapiens
cacagtgtctgtgcttcagtgt

SEQ ID NO: 9301398 - DNA, 22 bp, Homo sapiens
cacagtgtgactgaccttcagc

SEQ ID NO: 9301399 - DNA, 22 bp, Homo sapiens
cacagtgtggcaaatttcaact

SEQ ID NO: 9301400 - DNA, 22 bp, Homo sapiens
ggcagccaccctgggaggcaga

SEQ ID NO: 9301401 - DNA, 22 bp, Homo sapiens
ggcagccaccctgggaggcaga

SEQ ID NO: 9301402 - DNA, 22 bp, Homo sapiens
ggcagcatatattcagtgggca

SEQ ID NO: 9301403 - DNA, 19 bp, Homo sapiens
gctgcagaggtgaagaaga

SEQ ID NO: 9301404 - DNA, 22 bp, Homo sapiens
gctgcagagggtcttagagagg

SEQ ID NO: 9301405 - DNA, 22 bp, Homo sapiens
gctgcagagatgggtgcccttt

SEQ ID NO: 9301406 - DNA, 22 bp, Homo sapiens
gctgcagagacagctgccgatg

SEQ ID NO: 9301407 - DNA, 22 bp, Homo sapiens
gctgcagatcccacccattccc

SEQ ID NO: 9301408 - DNA, 22 bp, Homo sapiens
gctgcagacttctcatctcatt

SEQ ID NO: 9301409 - DNA, 18 bp, Homo sapiens
gctcctggagtctgactc

SEQ ID NO: 9301410 - DNA, 22 bp, Homo sapiens
caaagtatattggattgaatgg

SEQ ID NO: 9301411 - DNA, 22 bp, Homo sapiens
caaagtaatttggagatatata

SEQ ID NO: 9301412 - DNA, 18 bp, Homo sapiens
gctcctggaccaggtcac

SEQ ID NO: 9301413 - DNA, 17 bp, Homo sapiens
gctcctgcaggtcagga

SEQ ID NO: 9301414 - DNA, 22 bp, Homo sapiens
gctcctgcaggacccaggagac

SEQ ID NO: 9301415 - DNA, 22 bp, Homo sapiens
gctcctgcagagatgttccatg

SEQ ID NO: 9301416 - DNA, 22 bp, Homo sapiens
gctgccacattttcaggactaa

SEQ ID NO: 9301417 - DNA, 22 bp, Homo sapiens
caacatatgattttgtatataa

SEQ ID NO: 9301418 - DNA, 19 bp, Homo sapiens
caaccatgaactgtggtgt

SEQ ID NO: 9301419 - DNA, 22 bp, Homo sapiens
caacccaaaagcgtttccattt

SEQ ID NO: 9301420 - DNA, 22 bp, Homo sapiens
caagatgggcaccccagcacct

SEQ ID NO: 9301421 - DNA, 22 bp, Homo sapiens
caagatgggtgttgtgatggtt

SEQ ID NO: 9301422 - DNA, 22 bp, Homo sapiens
caaggacactccctgctgggca

SEQ ID NO: 9301423 - DNA, 22 bp, Homo sapiens
caaggagataaaatgttgagct

SEQ ID NO: 9301424 - DNA, 22 bp, Homo sapiens
caagagctcccagacctgggca

SEQ ID NO: 9301425 - DNA, 22 bp, Homo sapiens
caaccccactacacgttggaga

SEQ ID NO: 9301426 - DNA, 22 bp, Homo sapiens
caatttctcgaactctaatcca

SEQ ID NO: 9301427 - DNA, 22 bp, Homo sapiens
gcttctctttctcccctggcgg

SEQ ID NO: 9301428 - DNA, 22 bp, Homo sapiens
gcttctcttaatgcctggcttt

SEQ ID NO: 9301429 - DNA, 22 bp, Homo sapiens
gcttctcctcccgctcccaggc

SEQ ID NO: 9301430 - DNA, 22 bp, Homo sapiens
gcttctccctacagatgtcagt

SEQ ID NO: 9301431 - DNA, 22 bp, Homo sapiens
gcttccagggtgggggatgttt

SEQ ID NO: 9301432 - DNA, 22 bp, Homo sapiens
gcttctccagaccttcatcccc

SEQ ID NO: 9301433 - DNA, 22 bp, Homo sapiens
gcttccaggggctgtgggctga

SEQ ID NO: 9301434 - DNA, 22 bp, Homo sapiens
caaggcaatctcatggcttctt

SEQ ID NO: 9301435 - DNA, 22 bp, Homo sapiens
caaggcagaattcagactcagg

SEQ ID NO: 9301436 - DNA, 20 bp, Homo sapiens
caaggcagaccagagtgagt

SEQ ID NO: 9301437 - DNA, 22 bp, Homo sapiens
caaggcagcccgctgaaccaca

SEQ ID NO: 9301438 - DNA, 22 bp, Homo sapiens
caaggcagcgttcctttctgga

SEQ ID NO: 9301439 - DNA, 22 bp, Homo sapiens
caaggcagctgtagggatttgg

SEQ ID NO: 9301440 - DNA, 22 bp, Homo sapiens
caaggcagctattgtctccata

SEQ ID NO: 9301441 - DNA, 19 bp, Homo sapiens
cacacccatgcttgccaag

SEQ ID NO: 9301442 - DNA, 21 bp, Homo sapiens
ggaaaattcagagtgcaattt

SEQ ID NO: 9301443 - DNA, 22 bp, Homo sapiens
ggaaaatactgattcatgccat

SEQ ID NO: 9301444 - DNA, 20 bp, Homo sapiens
ggaaaagtactcctccttaa

SEQ ID NO: 9301445 - DNA, 22 bp, Homo sapiens
cacaagggctttgtaggctttg

SEQ ID NO: 9301446 - DNA, 21 bp, Homo sapiens
ggaaaattccatacacccacg

SEQ ID NO: 9301447 - DNA, 22 bp, Homo sapiens
ggaaaaggccacagggacacat

SEQ ID NO: 9301448 - DNA, 22 bp, Homo sapiens
cacaaacatcaatcctgttttc

SEQ ID NO: 9301449 - DNA, 22 bp, Homo sapiens
cacaaaatctttctcgattatt

SEQ ID NO: 9301450 - DNA, 22 bp, Homo sapiens
cacaaaatatcaagcactttta

SEQ ID NO: 9301451 - DNA, 21 bp, Homo sapiens
ggaaaactttccttgtctgaa

SEQ ID NO: 9301452 - DNA, 22 bp, Homo sapiens
cacaaagtctgcagctgctgta

SEQ ID NO: 9301453 - DNA, 22 bp, Homo sapiens
gggccttgccatggagcctgag

SEQ ID NO: 9301454 - DNA, 22 bp, Homo sapiens
cagagccctgtgtgccatgtga

SEQ ID NO: 9301455 - DNA, 22 bp, Homo sapiens
cagagccctagtcctgatggcc

SEQ ID NO: 9301456 - DNA, 22 bp, Homo sapiens
cagagcccctcagctctctccc

SEQ ID NO: 9301457 - DNA, 22 bp, Homo sapiens
cagagcccctcgtctccaccac

SEQ ID NO: 9301458 - DNA, 22 bp, Homo sapiens
gggcactgtgctaggtgctgag

SEQ ID NO: 9301459 - DNA, 22 bp, Homo sapiens
gggcactgtgctgggtgcttta

SEQ ID NO: 9301460 - DNA, 22 bp, Homo sapiens
gggcagagaaatggacagttgg

SEQ ID NO: 9301461 - DNA, 22 bp, Homo sapiens
cagagcccagggcctacgtccc

SEQ ID NO: 9301462 - DNA, 22 bp, Homo sapiens
ggggaaagtgaattgtgtagtg

SEQ ID NO: 9301463 - DNA, 22 bp, Homo sapiens
gggctgtgtactatgaggaggg

SEQ ID NO: 9301464 - DNA, 22 bp, Homo sapiens
gggctgtgtactatgaggaggg

SEQ ID NO: 9301465 - DNA, 22 bp, Homo sapiens
ggggaaacatgttgttcagacc

SEQ ID NO: 9301466 - DNA, 22 bp, Homo sapiens
ggggaaactgaggcacagacag

SEQ ID NO: 9301467 - DNA, 23 bp, Homo sapiens
ggggaaagaccatgcttgaggac

SEQ ID NO: 9301468 - DNA, 21 bp, Homo sapiens
gggctttttatttagcactgt

SEQ ID NO: 9301469 - DNA, 22 bp, Homo sapiens
cagagctgcagattgaaggcat

SEQ ID NO: 9301470 - DNA, 22 bp, Homo sapiens
cagagctgctcatggtggccag

SEQ ID NO: 9301471 - DNA, 22 bp, Homo sapiens
cagagctgctcatggtggccag

SEQ ID NO: 9301472 - DNA, 22 bp, Homo sapiens
cagagcctgctcacgtctctgt

SEQ ID NO: 9301473 - DNA, 22 bp, Homo sapiens
gggcgcatcacctgaggtcagg

SEQ ID NO: 9301474 - DNA, 22 bp, Homo sapiens
gggcgcatcacctgaggtcagg

SEQ ID NO: 9301475 - DNA, 22 bp, Homo sapiens
gggcgccgtgggaaacagccgg

SEQ ID NO: 9301476 - DNA, 22 bp, Homo sapiens
gggtgctcctggcggcctcttt

SEQ ID NO: 9301477 - DNA, 22 bp, Homo sapiens
gggtgctgactggggcctgaaa

SEQ ID NO: 9301478 - DNA, 22 bp, Homo sapiens
cagaggctgctctgggtggcat

SEQ ID NO: 9301479 - DNA, 22 bp, Homo sapiens
cagaggctgctctgggtggcat

SEQ ID NO: 9301480 - DNA, 23 bp, Homo sapiens
gggtgctgcctgtagtcatgctg

SEQ ID NO: 9301481 - DNA, 22 bp, Homo sapiens
gggtctaggagacatgggcaag

SEQ ID NO: 9301482 - DNA, 22 bp, Homo sapiens
cagaggctggatggacttgcct

SEQ ID NO: 9301483 - DNA, 22 bp, Homo sapiens
cagaggctgggacctcaggcat

SEQ ID NO: 9301484 - DNA, 22 bp, Homo sapiens
cagaggctgggacctcaggcat

SEQ ID NO: 9301485 - DNA, 22 bp, Homo sapiens
cagaggcttatacctgattagg

SEQ ID NO: 9301486 - DNA, 22 bp, Homo sapiens
cagaggctgtgtaggcagactg

SEQ ID NO: 9301487 - DNA, 22 bp, Homo sapiens
cagaggctgtgtaggcagactg

SEQ ID NO: 9301488 - DNA, 22 bp, Homo sapiens
cagaggtttgatcgagtaggtc

SEQ ID NO: 9301489 - DNA, 22 bp, Homo sapiens
cagaggtgttggtgaatggaga

SEQ ID NO: 9301490 - DNA, 22 bp, Homo sapiens
cagaggttacctagagcaagaa

SEQ ID NO: 9301491 - DNA, 22 bp, Homo sapiens
cagaggtgttggtgaatggaga

SEQ ID NO: 9301492 - DNA, 23 bp, Homo sapiens
cagaggtgtcagtgcccagtgtc

SEQ ID NO: 9301493 - DNA, 22 bp, Homo sapiens
cagaggtgtacagagggaggcc

SEQ ID NO: 9301494 - DNA, 21 bp, Homo sapiens
cagaggtggcctgacctctga

SEQ ID NO: 9301495 - DNA, 22 bp, Homo sapiens
cagaggtggggagtatttcaag

SEQ ID NO: 9301496 - DNA, 20 bp, Homo sapiens
ggggaagaaaaggatgtgat

SEQ ID NO: 9301497 - DNA, 22 bp, Homo sapiens
cagaggcccagtgagagggctg

SEQ ID NO: 9301498 - DNA, 18 bp, Homo sapiens
gggaagccgggaagccgg

SEQ ID NO: 9301499 - DNA, 22 bp, Homo sapiens
gggaaaggatcagtgggaggct

SEQ ID NO: 9301500 - DNA, 22 bp, Homo sapiens
gggaaggaaatcttgcttgtga

SEQ ID NO: 9301501 - DNA, 22 bp, Homo sapiens
gggaaggacattctgggctcag

SEQ ID NO: 9301502 - DNA, 22 bp, Homo sapiens
gggaaggacattctgggctcag

SEQ ID NO: 9301503 - DNA, 22 bp, Homo sapiens
gggaaggaggtggcttgaagtg

SEQ ID NO: 9301504 - DNA, 22 bp, Homo sapiens
gggactggcacagggctgggag

SEQ ID NO: 9301505 - DNA, 22 bp, Homo sapiens
ggcttttgaattccaaggcatt

SEQ ID NO: 9301506 - DNA, 22 bp, Homo sapiens
cagaagtcaccctcagaataac

SEQ ID NO: 9301507 - DNA, 22 bp, Homo sapiens
gggaaactagaagcagggttat

SEQ ID NO: 9301508 - DNA, 22 bp, Homo sapiens
gggaaactcacaggtgcagggg

SEQ ID NO: 9301509 - DNA, 22 bp, Homo sapiens
gggaaaatattaagcaggactt

SEQ ID NO: 9301510 - DNA, 22 bp, Homo sapiens
gggaaaaataatgcacagatat

SEQ ID NO: 9301511 - DNA, 22 bp, Homo sapiens
gggaaactcaggcatttccact

SEQ ID NO: 9301512 - DNA, 21 bp, Homo sapiens
gggaaactctgcttaacagag

SEQ ID NO: 9301513 - DNA, 22 bp, Homo sapiens
gggaaactgaattcaggactct

SEQ ID NO: 9301514 - DNA, 22 bp, Homo sapiens
gggaaactggggactgaatctg

SEQ ID NO: 9301515 - DNA, 22 bp, Homo sapiens
gggaaactgcaactcagagagg

SEQ ID NO: 9301516 - DNA, 22 bp, Homo sapiens
gggaaacttctgctaaaaccag

SEQ ID NO: 9301517 - DNA, 22 bp, Homo sapiens
gggaaactgtccagttctcccc

SEQ ID NO: 9301518 - DNA, 22 bp, Homo sapiens
gggaaactttcacaatgtccag

SEQ ID NO: 9301519 - DNA, 22 bp, Homo sapiens
cagaaggcatagatgaaggcct

SEQ ID NO: 9301520 - DNA, 22 bp, Homo sapiens
cagaaggctggcagattgagat

SEQ ID NO: 9301521 - DNA, 22 bp, Homo sapiens
cagacaggcaggtgctgctttg

SEQ ID NO: 9301522 - DNA, 22 bp, Homo sapiens
cagacaggaattctggcgtggt

SEQ ID NO: 9301523 - DNA, 22 bp, Homo sapiens
cagaagtttgaccttggtgggt

SEQ ID NO: 9301524 - DNA, 22 bp, Homo sapiens
cagaagtgcaatttaaattagg

SEQ ID NO: 9301525 - DNA, 22 bp, Homo sapiens
cagaagtggcatcattcaagag

SEQ ID NO: 9301526 - DNA, 22 bp, Homo sapiens
cagaagtggcctcagagggagt

SEQ ID NO: 9301527 - DNA, 22 bp, Homo sapiens
cagaagtggtattaattagatt

SEQ ID NO: 9301528 - DNA, 22 bp, Homo sapiens
cagaagtggatattagagtaat

SEQ ID NO: 9301529 - DNA, 22 bp, Homo sapiens
cagaagtgaatgtgataaacca

SEQ ID NO: 9301530 - DNA, 22 bp, Homo sapiens
cagaagtgatgttgagctagtc

SEQ ID NO: 9301531 - DNA, 22 bp, Homo sapiens
gggcaatgtgtgttcactatat

SEQ ID NO: 9301532 - DNA, 22 bp, Homo sapiens
gggcaatgtctgtggccactaa

SEQ ID NO: 9301533 - DNA, 22 bp, Homo sapiens
gggcaagtccggtgcccagagc

SEQ ID NO: 9301534 - DNA, 22 bp, Homo sapiens
gggcaagtgtcaagcatgtcat

SEQ ID NO: 9301535 - DNA, 22 bp, Homo sapiens
gggcaaggcagaagagttggag

SEQ ID NO: 9301536 - DNA, 22 bp, Homo sapiens
gggcaagttgagaagaatgcta

SEQ ID NO: 9301537 - DNA, 22 bp, Homo sapiens
gggcaagcagtggctaccagta

SEQ ID NO: 9301538 - DNA, 22 bp, Homo sapiens
gggcaaggcagaagagttggag

SEQ ID NO: 9301539 - DNA, 22 bp, Homo sapiens
cagacagggccctgtgatggta

SEQ ID NO: 9301540 - DNA, 22 bp, Homo sapiens
gggcaagcagtgaggacagcac

SEQ ID NO: 9301541 - DNA, 22 bp, Homo sapiens
cagacagggacctcgctccaga

SEQ ID NO: 9301542 - DNA, 17 bp, Homo sapiens
cagacaggctgtcaccc

SEQ ID NO: 9301543 - DNA, 22 bp, Homo sapiens
gggagggtctgagagctgcacc

SEQ ID NO: 9301544 - DNA, 22 bp, Homo sapiens
gggaggtcagggtgcctgctgg

SEQ ID NO: 9301545 - DNA, 22 bp, Homo sapiens
gggaggtgaaaggtcatgtgtg

SEQ ID NO: 9301546 - DNA, 22 bp, Homo sapiens
cagcagcagacatttgatcttc

SEQ ID NO: 9301547 - DNA, 22 bp, Homo sapiens
cagcagcagagatactggtttc

SEQ ID NO: 9301548 - DNA, 22 bp, Homo sapiens
gtagggagcccagagcccagtg

SEQ ID NO: 9301549 - DNA, 22 bp, Homo sapiens
cagcagcactctgcgggtcccc

SEQ ID NO: 9301550 - DNA, 22 bp, Homo sapiens
cagcagcacctattatagtgtt

SEQ ID NO: 9301551 - DNA, 22 bp, Homo sapiens
cagcagcaaggtgagggtggag

SEQ ID NO: 9301552 - DNA, 22 bp, Homo sapiens
cagcagcaaggtgagggtggag

SEQ ID NO: 9301553 - DNA, 19 bp, Homo sapiens
gtatatttatatggctgta

SEQ ID NO: 9301554 - DNA, 22 bp, Homo sapiens
gtatattttgatcaccctctat

SEQ ID NO: 9301555 - DNA, 22 bp, Homo sapiens
cagcagagctgtgtgggaaggg

SEQ ID NO: 9301556 - DNA, 22 bp, Homo sapiens
cagcagagtaattctcacctct

SEQ ID NO: 9301557 - DNA, 22 bp, Homo sapiens
cagcagagtatggcactcaact

SEQ ID NO: 9301558 - DNA, 22 bp, Homo sapiens
cagcagagtatggcactcaact

SEQ ID NO: 9301559 - DNA, 22 bp, Homo sapiens
cagcagcaacaatagcggtcac

SEQ ID NO: 9301560 - DNA, 22 bp, Homo sapiens
cagcagcaaatctagaagagga

SEQ ID NO: 9301561 - DNA, 22 bp, Homo sapiens
cagcagcaacaacggaagcctt

SEQ ID NO: 9301562 - DNA, 22 bp, Homo sapiens
gtatgcttattccttgttgtga

SEQ ID NO: 9301563 - DNA, 22 bp, Homo sapiens
gtatgcatcgactcaagtctga

SEQ ID NO: 9301564 - DNA, 22 bp, Homo sapiens
cagcaggcaggtgggccaagtc

SEQ ID NO: 9301565 - DNA, 22 bp, Homo sapiens
cagcaggcggcccgcgggcccg

SEQ ID NO: 9301566 - DNA, 22 bp, Homo sapiens
gtatttctttccattatagtca

SEQ ID NO: 9301567 - DNA, 22 bp, Homo sapiens
ggttgcaaactcctgggatcaa

SEQ ID NO: 9301568 - DNA, 22 bp, Homo sapiens
ggttggacactaggtaggagcg

SEQ ID NO: 9301569 - DNA, 20 bp, Homo sapiens
gtaaaatatggtctttgggt

SEQ ID NO: 9301570 - DNA, 22 bp, Homo sapiens
gtaaaatagaataacgtggcta

SEQ ID NO: 9301571 - DNA, 22 bp, Homo sapiens
gtaaaatcatttagttacttaa

SEQ ID NO: 9301572 - DNA, 22 bp, Homo sapiens
gtaaaattctagcatctgaaag

SEQ ID NO: 9301573 - DNA, 22 bp, Homo sapiens
gtaaaatctttcctatttgcct

SEQ ID NO: 9301574 - DNA, 22 bp, Homo sapiens
gtaaaatctttattgctggtga

SEQ ID NO: 9301575 - DNA, 22 bp, Homo sapiens
gtaaaattgcaattacttttgc

SEQ ID NO: 9301576 - DNA, 22 bp, Homo sapiens
gtaaaattgcaattacttttgc

SEQ ID NO: 9301577 - DNA, 22 bp, Homo sapiens
gtaaacaacacaaatcatttga

SEQ ID NO: 9301578 - DNA, 22 bp, Homo sapiens
gtaaacaacacaaatcatttga

SEQ ID NO: 9301579 - DNA, 22 bp, Homo sapiens
gtaaacaaactctcaggccagt

SEQ ID NO: 9301580 - DNA, 22 bp, Homo sapiens
gtaaacaaactctcaggccagt

SEQ ID NO: 9301581 - DNA, 22 bp, Homo sapiens
gtaaacaagtctaccattagaa

SEQ ID NO: 9301582 - DNA, 22 bp, Homo sapiens
gtaaacaatagcattgcctgat

SEQ ID NO: 9301583 - DNA, 22 bp, Homo sapiens
gtaaacaatagcattgcctgat

SEQ ID NO: 9301584 - DNA, 22 bp, Homo sapiens
gtaaacaagtctaccattagaa

SEQ ID NO: 9301585 - DNA, 22 bp, Homo sapiens
ggttccagaccacgggtgttct

SEQ ID NO: 9301586 - DNA, 22 bp, Homo sapiens
ggttccaggcatggcaggatgt

SEQ ID NO: 9301587 - DNA, 22 bp, Homo sapiens
cagcaatcgggtgatatgcaat

SEQ ID NO: 9301588 - DNA, 22 bp, Homo sapiens
cagcaataaggtaagcttctcc

SEQ ID NO: 9301589 - DNA, 22 bp, Homo sapiens
ggtgggtgaaatctaggtgtgt

SEQ ID NO: 9301590 - DNA, 22 bp, Homo sapiens
ggtgggtaaaactgctggcact

SEQ ID NO: 9301591 - DNA, 22 bp, Homo sapiens
ggtggggctcagcaatctgtgt

SEQ ID NO: 9301592 - DNA, 22 bp, Homo sapiens
ggtgggggagacttggtcaaga

SEQ ID NO: 9301593 - DNA, 21 bp, Homo sapiens
ggtggggtacctaaggtagct

SEQ ID NO: 9301594 - DNA, 20 bp, Homo sapiens
gggtgggagagtctgagggt

SEQ ID NO: 9301595 - DNA, 22 bp, Homo sapiens
gggtgggactgaagtctgaggg

SEQ ID NO: 9301596 - DNA, 22 bp, Homo sapiens
gggtgggagaaatgagtatcta

SEQ ID NO: 9301597 - DNA, 22 bp, Homo sapiens
gggtgggagaaatgagtatcta

SEQ ID NO: 9301598 - DNA, 20 bp, Homo sapiens
gggtgggagagtctgagggt

SEQ ID NO: 9301599 - DNA, 22 bp, Homo sapiens
ggtggggctaggacctcaggat

SEQ ID NO: 9301600 - DNA, 22 bp, Homo sapiens
ggtgggacaggtaggagtggct

SEQ ID NO: 9301601 - DNA, 22 bp, Homo sapiens
gggtgggagtctggccctcaaa

SEQ ID NO: 9301602 - DNA, 22 bp, Homo sapiens
gggtgggactctttggcctgag

SEQ ID NO: 9301603 - DNA, 22 bp, Homo sapiens
gggtgggaaggctaagggattg

SEQ ID NO: 9301604 - DNA, 22 bp, Homo sapiens
gggtgggactgaagtctgaggg

SEQ ID NO: 9301605 - DNA, 22 bp, Homo sapiens
gggtgggactctttggcctgag

SEQ ID NO: 9301606 - DNA, 22 bp, Homo sapiens
gggtgggactgaagtctgaggg

SEQ ID NO: 9301607 - DNA, 22 bp, Homo sapiens
cagcattttcttaatgtaggtg

SEQ ID NO: 9301608 - DNA, 22 bp, Homo sapiens
cagccactggtgccaggctgtt

SEQ ID NO: 9301609 - DNA, 22 bp, Homo sapiens
gtatttgctcatacagtgatac

SEQ ID NO: 9301610 - DNA, 22 bp, Homo sapiens
gtatttggaaaccaccagtgcc

SEQ ID NO: 9301611 - DNA, 22 bp, Homo sapiens
cagcatttggtgatcatcttaa

SEQ ID NO: 9301612 - DNA, 22 bp, Homo sapiens
cagcatttggaggagaggcttt

SEQ ID NO: 9301613 - DNA, 22 bp, Homo sapiens
cagcatttggaggagaggcttt

SEQ ID NO: 9301614 - DNA, 22 bp, Homo sapiens
cagcatttagaatttgaagtgt

SEQ ID NO: 9301615 - DNA, 22 bp, Homo sapiens
cagcatttagaatttgaagtgt

SEQ ID NO: 9301616 - DNA, 22 bp, Homo sapiens
cagcatttaatgcagtgcttcc

SEQ ID NO: 9301617 - DNA, 22 bp, Homo sapiens
cagcattgatcccaggctgtgg

SEQ ID NO: 9301618 - DNA, 18 bp, Homo sapiens
cagcattagcagcttcca

SEQ ID NO: 9301619 - DNA, 22 bp, Homo sapiens
cagcccagcactaagtagattt

SEQ ID NO: 9301620 - DNA, 22 bp, Homo sapiens
ctgtcttcccgaggccctggag

SEQ ID NO: 9301621 - DNA, 22 bp, Homo sapiens
atcacattacaaaggactccag

SEQ ID NO: 9301622 - DNA, 22 bp, Homo sapiens
ctgtctttggtcctgtctgtta

SEQ ID NO: 9301623 - DNA, 22 bp, Homo sapiens
atcatgttcatcgtatttaggc

SEQ ID NO: 9301624 - DNA, 22 bp, Homo sapiens
atatttgtatttcgtgtgtgta

SEQ ID NO: 9301625 - DNA, 22 bp, Homo sapiens
ctgggtcacccaaaagggccag

SEQ ID NO: 9301626 - DNA, 22 bp, Homo sapiens
atcacaggtggtaggaaaagaa

SEQ ID NO: 9301627 - DNA, 22 bp, Homo sapiens
atcacaggctatgtgggttttg

SEQ ID NO: 9301628 - DNA, 22 bp, Homo sapiens
ctgtcctcaccttggcaggggg

SEQ ID NO: 9301629 - DNA, 22 bp, Homo sapiens
atcatgttttaattagcaaact

SEQ ID NO: 9301630 - DNA, 22 bp, Homo sapiens
ctgtggagtgcttggctcagtg

SEQ ID NO: 9301631 - DNA, 22 bp, Homo sapiens
atccaagctgactcaagataaa

SEQ ID NO: 9301632 - DNA, 22 bp, Homo sapiens
atccaaagtagattaagtcaca

SEQ ID NO: 9301633 - DNA, 22 bp, Homo sapiens
atcctcagtgtttctgacatct

SEQ ID NO: 9301634 - DNA, 22 bp, Homo sapiens
atcctcagcatctagcatgaag

SEQ ID NO: 9301635 - DNA, 22 bp, Homo sapiens
atcctcagagaacgaacacaat

SEQ ID NO: 9301636 - DNA, 22 bp, Homo sapiens
atcctcagacttcacgttccat

SEQ ID NO: 9301637 - DNA, 22 bp, Homo sapiens
atcctcagacctcagcaaagcc

SEQ ID NO: 9301638 - DNA, 22 bp, Homo sapiens
atccctgaggttcctcctgagc

SEQ ID NO: 9301639 - DNA, 22 bp, Homo sapiens
atccccagggagtgagctgtct

SEQ ID NO: 9301640 - DNA, 22 bp, Homo sapiens
atccctgaatgctcctgactgg

SEQ ID NO: 9301641 - DNA, 22 bp, Homo sapiens
atccctctctgcatgactgtgt

SEQ ID NO: 9301642 - DNA, 22 bp, Homo sapiens
atccccttcacaccctctgcat

SEQ ID NO: 9301643 - DNA, 17 bp, Homo sapiens
atccccagcatctagaa

SEQ ID NO: 9301644 - DNA, 22 bp, Homo sapiens
atccacagtcttagccatcaaa

SEQ ID NO: 9301645 - DNA, 19 bp, Homo sapiens
ctgggacaatgaaagcatc

SEQ ID NO: 9301646 - DNA, 22 bp, Homo sapiens
ctgggaagcttcgagcaggaaa

SEQ ID NO: 9301647 - DNA, 22 bp, Homo sapiens
ctgggaagtagaatcagatgag

SEQ ID NO: 9301648 - DNA, 22 bp, Homo sapiens
ctggcagctgcccgagatgccc

SEQ ID NO: 9301649 - DNA, 22 bp, Homo sapiens
ctggcttctgggccagggcaga

SEQ ID NO: 9301650 - DNA, 22 bp, Homo sapiens
atatatagagctagatgttaaa

SEQ ID NO: 9301651 - DNA, 22 bp, Homo sapiens
atatatatcgagttcatgtctc

SEQ ID NO: 9301652 - DNA, 22 bp, Homo sapiens
ctgggagaggaacctcgagggt

SEQ ID NO: 9301653 - DNA, 22 bp, Homo sapiens
ctgggagagcctttcctgagtc

SEQ ID NO: 9301654 - DNA, 22 bp, Homo sapiens
ctgggcacagaccccctgggcc

SEQ ID NO: 9301655 - DNA, 22 bp, Homo sapiens
ctgggcacagcgttgggctctt

SEQ ID NO: 9301656 - DNA, 23 bp, Homo sapiens
ctgggcacccagtacctaggccc

SEQ ID NO: 9301657 - DNA, 22 bp, Homo sapiens
ctgggcaccaggcatgacaggg

SEQ ID NO: 9301658 - DNA, 22 bp, Homo sapiens
ctgggcacaggggagcagagtc

SEQ ID NO: 9301659 - DNA, 22 bp, Homo sapiens
ctgggcacaggggagcagagtc

SEQ ID NO: 9301660 - DNA, 22 bp, Homo sapiens
atatatatgctgatggctgcca

SEQ ID NO: 9301661 - DNA, 20 bp, Homo sapiens
ctgggcacctgtctgcagtt

SEQ ID NO: 9301662 - DNA, 22 bp, Homo sapiens
atatatatcgagttcatgtctc

SEQ ID NO: 9301663 - DNA, 22 bp, Homo sapiens
atatttgctgagaaggagggag

SEQ ID NO: 9301664 - DNA, 22 bp, Homo sapiens
atatgtttttcacaggtttaag

SEQ ID NO: 9301665 - DNA, 22 bp, Homo sapiens
atatttactgctgtggtgaagg

SEQ ID NO: 9301666 - DNA, 18 bp, Homo sapiens
atatgttaattaggtagg

SEQ ID NO: 9301667 - DNA, 22 bp, Homo sapiens
atatgggggggcgtgcagagga

SEQ ID NO: 9301668 - DNA, 22 bp, Homo sapiens
atatgtatagccagtctttagg

SEQ ID NO: 9301669 - DNA, 22 bp, Homo sapiens
atatgtatgtacgcacatattc

SEQ ID NO: 9301670 - DNA, 22 bp, Homo sapiens
atatgtatgtacgcacatattc

SEQ ID NO: 9301671 - DNA, 22 bp, Homo sapiens
atatatgaagaagtcttgatta

SEQ ID NO: 9301672 - DNA, 22 bp, Homo sapiens
atatatattgcccaggctggtt

SEQ ID NO: 9301673 - DNA, 20 bp, Homo sapiens
atatgcttaatctcactaca

SEQ ID NO: 9301674 - DNA, 22 bp, Homo sapiens
atatgcttacactacaagatga

SEQ ID NO: 9301675 - DNA, 22 bp, Homo sapiens
ctgggcagtggtggcccttccc

SEQ ID NO: 9301676 - DNA, 20 bp, Homo sapiens
atatgctgagtgaaggcaga

SEQ ID NO: 9301677 - DNA, 22 bp, Homo sapiens
atatgcaagcacatagaatact

SEQ ID NO: 9301678 - DNA, 22 bp, Homo sapiens
atatgattccactattgtatgg

SEQ ID NO: 9301679 - DNA, 22 bp, Homo sapiens
ctgggcaggatacttcatggga

SEQ ID NO: 9301680 - DNA, 22 bp, Homo sapiens
ctgcccacttggccaccttcta

SEQ ID NO: 9301681 - DNA, 22 bp, Homo sapiens
ctgcccacttggccaccttcta

SEQ ID NO: 9301682 - DNA, 22 bp, Homo sapiens
ctgcccagaatcactcactcga

SEQ ID NO: 9301683 - DNA, 22 bp, Homo sapiens
ataaatatcactgttgtccctc

SEQ ID NO: 9301684 - DNA, 22 bp, Homo sapiens
ctgcccacagttctctgccatg

SEQ ID NO: 9301685 - DNA, 22 bp, Homo sapiens
ctgcccaccacacctgctcctg

SEQ ID NO: 9301686 - DNA, 21 bp, Homo sapiens
ctgctctggggaccggctgtg

SEQ ID NO: 9301687 - DNA, 22 bp, Homo sapiens
ctgctctggcgtactcggcatc

SEQ ID NO: 9301688 - DNA, 22 bp, Homo sapiens
ctgctctgcagcttggactccc

SEQ ID NO: 9301689 - DNA, 22 bp, Homo sapiens
ctgctctgagaggctcttccta

SEQ ID NO: 9301690 - DNA, 22 bp, Homo sapiens
ataatatttgcattactgtgat

SEQ ID NO: 9301691 - DNA, 22 bp, Homo sapiens
ctgcttgcctggacagcgttag

SEQ ID NO: 9301692 - DNA, 22 bp, Homo sapiens
ctgcttctagcaccaagtccct

SEQ ID NO: 9301693 - DNA, 18 bp, Homo sapiens
ctgcttctgtctgccagt

SEQ ID NO: 9301694 - DNA, 22 bp, Homo sapiens
ctgctttaatggaaagtgtttt

SEQ ID NO: 9301695 - DNA, 22 bp, Homo sapiens
ctgctttaatccctgcctggaa

SEQ ID NO: 9301696 - DNA, 22 bp, Homo sapiens
ctgctttaatgtaagatatacc

SEQ ID NO: 9301697 - DNA, 22 bp, Homo sapiens
ctgctttaatttagacaaggca

SEQ ID NO: 9301698 - DNA, 22 bp, Homo sapiens
ctgctttaaaaccctcagctgg

SEQ ID NO: 9301699 - DNA, 22 bp, Homo sapiens
ctgctttaacaaggctgatcag

SEQ ID NO: 9301700 - DNA, 22 bp, Homo sapiens
ctgctttaaaactgatacatga

SEQ ID NO: 9301701 - DNA, 22 bp, Homo sapiens
ctgctttaagtattcaacaaag

SEQ ID NO: 9301702 - DNA, 22 bp, Homo sapiens
ctgctttaagaatgagtgtaag

SEQ ID NO: 9301703 - DNA, 22 bp, Homo sapiens
ctgctttaactctgggaagcca

SEQ ID NO: 9301704 - DNA, 22 bp, Homo sapiens
ctgctttaacagatgatggtgt

SEQ ID NO: 9301705 - DNA, 22 bp, Homo sapiens
atacaagactcagcacagacgg

SEQ ID NO: 9301706 - DNA, 19 bp, Homo sapiens
atacaagagagcagttgag

SEQ ID NO: 9301707 - DNA, 20 bp, Homo sapiens
atacaagatgagtaatttct

SEQ ID NO: 9301708 - DNA, 22 bp, Homo sapiens
ctggagcatccatgcccagggt

SEQ ID NO: 9301709 - DNA, 22 bp, Homo sapiens
ctggagccagccagggccctct

SEQ ID NO: 9301710 - DNA, 19 bp, Homo sapiens
atacagagcttcctaattt

SEQ ID NO: 9301711 - DNA, 22 bp, Homo sapiens
atacagagcagtaatagaggag

SEQ ID NO: 9301712 - DNA, 22 bp, Homo sapiens
atacagagggtttcatgggcag

SEQ ID NO: 9301713 - DNA, 22 bp, Homo sapiens
atacagagaagggaggcaaaat

SEQ ID NO: 9301714 - DNA, 22 bp, Homo sapiens
atacagagaaggggtagaggat

SEQ ID NO: 9301715 - DNA, 18 bp, Homo sapiens
atacagagacctcaagga

SEQ ID NO: 9301716 - DNA, 22 bp, Homo sapiens
atacagagacacttgagactgg

SEQ ID NO: 9301717 - DNA, 21 bp, Homo sapiens
atacttgaaaatggttactct

SEQ ID NO: 9301718 - DNA, 22 bp, Homo sapiens
atacttatgataaataattgct

SEQ ID NO: 9301719 - DNA, 22 bp, Homo sapiens
ctggcagctctactcagagcct

SEQ ID NO: 9301720 - DNA, 22 bp, Homo sapiens
ctggcagctctgagtcccttct

SEQ ID NO: 9301721 - DNA, 22 bp, Homo sapiens
ctggcagctctactcagagcct

SEQ ID NO: 9301722 - DNA, 22 bp, Homo sapiens
ctggcagcgtgagcagcatcca

SEQ ID NO: 9301723 - DNA, 22 bp, Homo sapiens
atactttagagctagattgcct

SEQ ID NO: 9301724 - DNA, 22 bp, Homo sapiens
atactttctgaccaattaattg

SEQ ID NO: 9301725 - DNA, 22 bp, Homo sapiens
ctggcagcggtttgcagcctgg

SEQ ID NO: 9301726 - DNA, 22 bp, Homo sapiens
ctggagtcttcagcttgctgcc

SEQ ID NO: 9301727 - DNA, 21 bp, Homo sapiens
ctggagtctgggggtggcagt

SEQ ID NO: 9301728 - DNA, 22 bp, Homo sapiens
atacttagttttaatccattag

SEQ ID NO: 9301729 - DNA, 21 bp, Homo sapiens
ctgccaggatagcatgcaggc

SEQ ID NO: 9301730 - DNA, 22 bp, Homo sapiens
ctgccaggcagcagagggagaa

SEQ ID NO: 9301731 - DNA, 22 bp, Homo sapiens
ctgccaggcagggagatggctg

SEQ ID NO: 9301732 - DNA, 22 bp, Homo sapiens
ataaaagtaggaccaacttaca

SEQ ID NO: 9301733 - DNA, 20 bp, Homo sapiens
ataaaataactgccacaaga

SEQ ID NO: 9301734 - DNA, 22 bp, Homo sapiens
ctgcagctcctctctgtgcccc

SEQ ID NO: 9301735 - DNA, 22 bp, Homo sapiens
ctgcagcctcctccagctacgt

SEQ ID NO: 9301736 - DNA, 22 bp, Homo sapiens
ctgcagcctccaccttttgggt

SEQ ID NO: 9301737 - DNA, 22 bp, Homo sapiens
ctgcagagcaagttctctgttg

SEQ ID NO: 9301738 - DNA, 22 bp, Homo sapiens
agtttaaatcatgttttgtaac

SEQ ID NO: 9301739 - DNA, 21 bp, Homo sapiens
agtttgatgcaatttctgaga

SEQ ID NO: 9301740 - DNA, 17 bp, Homo sapiens
ctgcagctggagggcca

SEQ ID NO: 9301741 - DNA, 17 bp, Homo sapiens
ctgcagctggagggcca

SEQ ID NO: 9301742 - DNA, 22 bp, Homo sapiens
ctgaggctttgtgtgcatgcct

SEQ ID NO: 9301743 - DNA, 22 bp, Homo sapiens
ctgagggtcaacttgattgtat

SEQ ID NO: 9301744 - DNA, 20 bp, Homo sapiens
ctgaggggtctgacttggac

SEQ ID NO: 9301745 - DNA, 22 bp, Homo sapiens
agttgtaataacaataccaaaa

SEQ ID NO: 9301746 - DNA, 22 bp, Homo sapiens
ctgaggctggggaagggaagtg

SEQ ID NO: 9301747 - DNA, 18 bp, Homo sapiens
ctgaggcttagagaggtt

SEQ ID NO: 9301748 - DNA, 22 bp, Homo sapiens
ctgaggcttctctagttcagct

SEQ ID NO: 9301749 - DNA, 22 bp, Homo sapiens
ctgaggcttgtcctctcagctt

SEQ ID NO: 9301750 - DNA, 22 bp, Homo sapiens
ctgaggcttggaggggtctggt

SEQ ID NO: 9301751 - DNA, 22 bp, Homo sapiens
ctgaggctgggctgagggtata

SEQ ID NO: 9301752 - DNA, 22 bp, Homo sapiens
ctgaggcaggggcagctggaga

SEQ ID NO: 9301753 - DNA, 22 bp, Homo sapiens
ctgaggcatgaatgtgggcttt

SEQ ID NO: 9301754 - DNA, 22 bp, Homo sapiens
ctgaggcaggatggcctggctg

SEQ ID NO: 9301755 - DNA, 22 bp, Homo sapiens
agttgtaaattcatagcttata

SEQ ID NO: 9301756 - DNA, 22 bp, Homo sapiens
agttgtaacagattctaacata

SEQ ID NO: 9301757 - DNA, 22 bp, Homo sapiens
agttggtgggtgtgagctggac

SEQ ID NO: 9301758 - DNA, 22 bp, Homo sapiens
agttgggtttgtgtcagttgca

SEQ ID NO: 9301759 - DNA, 22 bp, Homo sapiens
agttgtaagagacagatataaa

SEQ ID NO: 9301760 - DNA, 22 bp, Homo sapiens
agttgtaagctctcttgctggg

SEQ ID NO: 9301761 - DNA, 20 bp, Homo sapiens
agttgtaaggaggaacccat

SEQ ID NO: 9301762 - DNA, 22 bp, Homo sapiens
agttgtaagaggcacaaggaag

SEQ ID NO: 9301763 - DNA, 22 bp, Homo sapiens
agttgggaagtatttttagtgg

SEQ ID NO: 9301764 - DNA, 22 bp, Homo sapiens
agttgcttccctattcttagca

SEQ ID NO: 9301765 - DNA, 18 bp, Homo sapiens
agttgcttattctgtgca

SEQ ID NO: 9301766 - DNA, 22 bp, Homo sapiens
agttggagtgaacatgagattg

SEQ ID NO: 9301767 - DNA, 21 bp, Homo sapiens
ctctttgggatctttggaaag

SEQ ID NO: 9301768 - DNA, 22 bp, Homo sapiens
agggtctatctctctgcctttg

SEQ ID NO: 9301769 - DNA, 21 bp, Homo sapiens
agggtcaggaaccagggtacc

SEQ ID NO: 9301770 - DNA, 22 bp, Homo sapiens
agggtcagagatcggccatgtg

SEQ ID NO: 9301771 - DNA, 22 bp, Homo sapiens
agggtcagagatcggccatgtg

SEQ ID NO: 9301772 - DNA, 22 bp, Homo sapiens
cctgccctgctcactgtcggta

SEQ ID NO: 9301773 - DNA, 22 bp, Homo sapiens
agggtcacctgcttgccagggc

SEQ ID NO: 9301774 - DNA, 20 bp, Homo sapiens
agggtcagagagcgtgagtg

SEQ ID NO: 9301775 - DNA, 20 bp, Homo sapiens
agggtcagagagcgtgagtg

SEQ ID NO: 9301776 - DNA, 22 bp, Homo sapiens
agggtgaatctcacaactctta

SEQ ID NO: 9301777 - DNA, 20 bp, Homo sapiens
agggtgagacatgagcctcc

SEQ ID NO: 9301778 - DNA, 22 bp, Homo sapiens
agggtctgtttaccacctcttt

SEQ ID NO: 9301779 - DNA, 22 bp, Homo sapiens
agggtctgtgcaagaacacgcc

SEQ ID NO: 9301780 - DNA, 22 bp, Homo sapiens
agggtctctggagagctgagga

SEQ ID NO: 9301781 - DNA, 22 bp, Homo sapiens
agggtctctgggagtagggcac

SEQ ID NO: 9301782 - DNA, 22 bp, Homo sapiens
cctctgccacctcccacgaggc

SEQ ID NO: 9301783 - DNA, 22 bp, Homo sapiens
cctctctctgcatctggagggc

SEQ ID NO: 9301784 - DNA, 23 bp, Homo sapiens
cctctctccctgtttggcaaata

SEQ ID NO: 9301785 - DNA, 22 bp, Homo sapiens
cctctctccttcctttgccaaa

SEQ ID NO: 9301786 - DNA, 22 bp, Homo sapiens
cctctctccttcctttgccaaa

SEQ ID NO: 9301787 - DNA, 22 bp, Homo sapiens
cctctctccaattttcacctca

SEQ ID NO: 9301788 - DNA, 22 bp, Homo sapiens
cctctctctcctgcacacacac

SEQ ID NO: 9301789 - DNA, 22 bp, Homo sapiens
cctctctctcctgcacacacac

SEQ ID NO: 9301790 - DNA, 22 bp, Homo sapiens
cctctctctgcatctggagggc

SEQ ID NO: 9301791 - DNA, 22 bp, Homo sapiens
cctctgccacctcccacgaggc

SEQ ID NO: 9301792 - DNA, 22 bp, Homo sapiens
cctgcccagcttcacctcaggc

SEQ ID NO: 9301793 - DNA, 22 bp, Homo sapiens
cctgccaggacattgcttgaag

SEQ ID NO: 9301794 - DNA, 22 bp, Homo sapiens
cctgcccaggagtctctctgtg

SEQ ID NO: 9301795 - DNA, 22 bp, Homo sapiens
cctgccctaatccagagactag

SEQ ID NO: 9301796 - DNA, 22 bp, Homo sapiens
cctgccctatgaccagcttcac

SEQ ID NO: 9301797 - DNA, 22 bp, Homo sapiens
cctgctctccatacactttcta

SEQ ID NO: 9301798 - DNA, 22 bp, Homo sapiens
cctgctctgccaagtcctcttt

SEQ ID NO: 9301799 - DNA, 22 bp, Homo sapiens
cctgctctgccaagtcctcttt

SEQ ID NO: 9301800 - DNA, 22 bp, Homo sapiens
cctgctctgccaagtcctcttt

SEQ ID NO: 9301801 - DNA, 22 bp, Homo sapiens
cctgctcttatagctgtttcca

SEQ ID NO: 9301802 - DNA, 22 bp, Homo sapiens
cctgctcttatagctgtttcca

SEQ ID NO: 9301803 - DNA, 22 bp, Homo sapiens
cctgctctggtttagtcagtct

SEQ ID NO: 9301804 - DNA, 22 bp, Homo sapiens
cctgctgaggtcagccacccaa

SEQ ID NO: 9301805 - DNA, 22 bp, Homo sapiens
cctggcagcgccgaagctggcc

SEQ ID NO: 9301806 - DNA, 22 bp, Homo sapiens
cctggcagcccagagcgccgct

SEQ ID NO: 9301807 - DNA, 22 bp, Homo sapiens
cctggaccaaacactggcctgg

SEQ ID NO: 9301808 - DNA, 20 bp, Homo sapiens
cctggctggtggaggaaagg

SEQ ID NO: 9301809 - DNA, 22 bp, Homo sapiens
cctggctggtggcagcgacaag

SEQ ID NO: 9301810 - DNA, 22 bp, Homo sapiens
cctggctggtggcagcgacaag

SEQ ID NO: 9301811 - DNA, 22 bp, Homo sapiens
cctggctggggtagaagtgagg

SEQ ID NO: 9301812 - DNA, 17 bp, Homo sapiens
cctggctgggaatctga

SEQ ID NO: 9301813 - DNA, 22 bp, Homo sapiens
cctggctgggcctgatttctca

SEQ ID NO: 9301814 - DNA, 17 bp, Homo sapiens
cctggctgggaatctga

SEQ ID NO: 9301815 - DNA, 22 bp, Homo sapiens
cctggctggcaagatcgtgaag

SEQ ID NO: 9301816 - DNA, 22 bp, Homo sapiens
cctggctggcaagatcgtgaag

SEQ ID NO: 9301817 - DNA, 23 bp, Homo sapiens
cctggctggattctctgcattca

SEQ ID NO: 9301818 - DNA, 22 bp, Homo sapiens
cctggctggatggagcccctgg

SEQ ID NO: 9301819 - DNA, 22 bp, Homo sapiens
cctggctggactggaccgtggc

SEQ ID NO: 9301820 - DNA, 22 bp, Homo sapiens
cctggctggatggagcccctgg

SEQ ID NO: 9301821 - DNA, 22 bp, Homo sapiens
cctggctggactggaccgtggc

SEQ ID NO: 9301822 - DNA, 22 bp, Homo sapiens
cctggctgctttcactatggag

SEQ ID NO: 9301823 - DNA, 22 bp, Homo sapiens
cctggccagaggcgtgcctgtg

SEQ ID NO: 9301824 - DNA, 22 bp, Homo sapiens
cctggctgcttcctctgccatg

SEQ ID NO: 9301825 - DNA, 22 bp, Homo sapiens
cctggctgcttcctctgccatg

SEQ ID NO: 9301826 - DNA, 19 bp, Homo sapiens
cctggctgctgtgggatgc

SEQ ID NO: 9301827 - DNA, 22 bp, Homo sapiens
cctggcagctccgtggccttcc

SEQ ID NO: 9301828 - DNA, 22 bp, Homo sapiens
cctggcagctcctccccggcgg

SEQ ID NO: 9301829 - DNA, 22 bp, Homo sapiens
cctggcagctaagtgctttgag

SEQ ID NO: 9301830 - DNA, 22 bp, Homo sapiens
cctggcagctccgtggccttcc

SEQ ID NO: 9301831 - DNA, 22 bp, Homo sapiens
cctggcattctctccagagaga

SEQ ID NO: 9301832 - DNA, 17 bp, Homo sapiens
cctggcattgttcctga

SEQ ID NO: 9301833 - DNA, 22 bp, Homo sapiens
cctggccacagggctctgcatt

SEQ ID NO: 9301834 - DNA, 22 bp, Homo sapiens
cctggccactcaggtgtggggc

SEQ ID NO: 9301835 - DNA, 22 bp, Homo sapiens
cctggccacccagccttggcca

SEQ ID NO: 9301836 - DNA, 19 bp, Homo sapiens
cctggccagacttctgccc

SEQ ID NO: 9301837 - DNA, 22 bp, Homo sapiens
cggccaagccggggccccgaag

SEQ ID NO: 9301838 - DNA, 22 bp, Homo sapiens
cggcatgggcgtccccctcact

SEQ ID NO: 9301839 - DNA, 22 bp, Homo sapiens
cggaggggtttgaacagaggag

SEQ ID NO: 9301840 - DNA, 22 bp, Homo sapiens
cggaggggatacattttctgaa

SEQ ID NO: 9301841 - DNA, 22 bp, Homo sapiens
cggagctgcctgccaagcctgc

SEQ ID NO: 9301842 - DNA, 22 bp, Homo sapiens
cggagctgcgccgggacacggg

SEQ ID NO: 9301843 - DNA, 22 bp, Homo sapiens
cggaggcctgccaggagcttct

SEQ ID NO: 9301844 - DNA, 22 bp, Homo sapiens
cggaggcctcagctcatggttt

SEQ ID NO: 9301845 - DNA, 21 bp, Homo sapiens
cggagctgggcagggcatccc

SEQ ID NO: 9301846 - DNA, 22 bp, Homo sapiens
cggagctggcgtctgtgtggac

SEQ ID NO: 9301847 - DNA, 21 bp, Homo sapiens
cgctccaccccacccactggc

SEQ ID NO: 9301848 - DNA, 22 bp, Homo sapiens
cggagcctgcttgttgcagctg

SEQ ID NO: 9301849 - DNA, 22 bp, Homo sapiens
cggctcactgcagctccgcctc

SEQ ID NO: 9301850 - DNA, 22 bp, Homo sapiens
cggctcactgcagctccgcctc

SEQ ID NO: 9301851 - DNA, 22 bp, Homo sapiens
agtatattgctcttaatcatag

SEQ ID NO: 9301852 - DNA, 22 bp, Homo sapiens
agtatattggtgttattcctca

SEQ ID NO: 9301853 - DNA, 22 bp, Homo sapiens
cgaggcagggaagctgcaaaag

SEQ ID NO: 9301854 - DNA, 18 bp, Homo sapiens
cgaggcaggcggatcacg

SEQ ID NO: 9301855 - DNA, 18 bp, Homo sapiens
cgaggcaggcggatcacg

SEQ ID NO: 9301856 - DNA, 22 bp, Homo sapiens
cgaggcagggaagctgcaaaag

SEQ ID NO: 9301857 - DNA, 20 bp, Homo sapiens
cgaggccaaggggctgggcc

SEQ ID NO: 9301858 - DNA, 23 bp, Homo sapiens
cgctcagaggttctgtccttggt

SEQ ID NO: 9301859 - DNA, 22 bp, Homo sapiens
cgctcagactcatgatatgctg

SEQ ID NO: 9301860 - DNA, 22 bp, Homo sapiens
cgaggcagacaaaagttggaag

SEQ ID NO: 9301861 - DNA, 22 bp, Homo sapiens
cgaggcaggcaggcggaggata

SEQ ID NO: 9301862 - DNA, 22 bp, Homo sapiens
cgaggcagaggctgaaacggct

SEQ ID NO: 9301863 - DNA, 22 bp, Homo sapiens
cgagcatgatgacggctgtggc

SEQ ID NO: 9301864 - DNA, 22 bp, Homo sapiens
cgaggaggaaacgcggagaact

SEQ ID NO: 9301865 - DNA, 22 bp, Homo sapiens
aggtggggtgagctgcagacta

SEQ ID NO: 9301866 - DNA, 22 bp, Homo sapiens
aggtggggtgttggatgtttat

SEQ ID NO: 9301867 - DNA, 22 bp, Homo sapiens
aggtgggggctgtgtccttgac

SEQ ID NO: 9301868 - DNA, 22 bp, Homo sapiens
aggtgggggctgtgtccttgac

SEQ ID NO: 9301869 - DNA, 22 bp, Homo sapiens
aggtgctgccccgagaaggatg

SEQ ID NO: 9301870 - DNA, 17 bp, Homo sapiens
aggtgctggagcatcag

SEQ ID NO: 9301871 - DNA, 21 bp, Homo sapiens
aggtgctggcgccccaggaga

SEQ ID NO: 9301872 - DNA, 22 bp, Homo sapiens
aggtgctgttggcagcgggcag

SEQ ID NO: 9301873 - DNA, 22 bp, Homo sapiens
aggtgctgggcagcagtcattg

SEQ ID NO: 9301874 - DNA, 22 bp, Homo sapiens
aggtggcagttgtggaaccatc

SEQ ID NO: 9301875 - DNA, 22 bp, Homo sapiens
aggtgcccatcacctcacagtc

SEQ ID NO: 9301876 - DNA, 22 bp, Homo sapiens
cctgggagaactgctgggttgg

SEQ ID NO: 9301877 - DNA, 22 bp, Homo sapiens
aggtgcaggagctgtgcaggga

SEQ ID NO: 9301878 - DNA, 22 bp, Homo sapiens
aggtgccagctctcaggcagga

SEQ ID NO: 9301879 - DNA, 22 bp, Homo sapiens
aggtgccattgcttgccagttt

SEQ ID NO: 9301880 - DNA, 22 bp, Homo sapiens
ccttggcaaaccagggcagctg

SEQ ID NO: 9301881 - DNA, 22 bp, Homo sapiens
ccttggcaagacagtggagggt

SEQ ID NO: 9301882 - DNA, 22 bp, Homo sapiens
ccttggcaggcacgtcctgcgg

SEQ ID NO: 9301883 - DNA, 22 bp, Homo sapiens
ccttggctgaggagggagctga

SEQ ID NO: 9301884 - DNA, 22 bp, Homo sapiens
ccttggctaggcagcggctgtc

SEQ ID NO: 9301885 - DNA, 22 bp, Homo sapiens
aggtggctggtccaggctgcag

SEQ ID NO: 9301886 - DNA, 22 bp, Homo sapiens
aggtggctgtattcagctgtaa

SEQ ID NO: 9301887 - DNA, 21 bp, Homo sapiens
aggtgggagaccatgtaggtc

SEQ ID NO: 9301888 - DNA, 22 bp, Homo sapiens
aggtgggaacccagcagggccc

SEQ ID NO: 9301889 - DNA, 22 bp, Homo sapiens
aggtggcttctggccaggtgtg

SEQ ID NO: 9301890 - DNA, 22 bp, Homo sapiens
aggtgggaacccagcagggccc

SEQ ID NO: 9301891 - DNA, 22 bp, Homo sapiens
ctctccatctgtgtgacctccc

SEQ ID NO: 9301892 - DNA, 23 bp, Homo sapiens
ctctccaccttcccacccaggga

SEQ ID NO: 9301893 - DNA, 23 bp, Homo sapiens
ctctccaccttcccacccaggga

SEQ ID NO: 9301894 - DNA, 22 bp, Homo sapiens
agtgctgggattgcaggcatga

SEQ ID NO: 9301895 - DNA, 22 bp, Homo sapiens
agtgctgggattgcaggcatga

SEQ ID NO: 9301896 - DNA, 22 bp, Homo sapiens
agtgctggcccatagctgctgg

SEQ ID NO: 9301897 - DNA, 22 bp, Homo sapiens
ctcgggcaccctggttctggtg

SEQ ID NO: 9301898 - DNA, 22 bp, Homo sapiens
agtgctgggattacaggcataa

SEQ ID NO: 9301899 - DNA, 22 bp, Homo sapiens
agtgctgggattacaggcataa

SEQ ID NO: 9301900 - DNA, 22 bp, Homo sapiens
ctctctagaggcccaccttgag

SEQ ID NO: 9301901 - DNA, 22 bp, Homo sapiens
ctctcgccagcggggctgcgct

SEQ ID NO: 9301902 - DNA, 20 bp, Homo sapiens
ctctccttgccgacttggca

SEQ ID NO: 9301903 - DNA, 20 bp, Homo sapiens
ctctcccagcacagcttcct

SEQ ID NO: 9301904 - DNA, 20 bp, Homo sapiens
ctctcccagcacagcttcct

SEQ ID NO: 9301905 - DNA, 22 bp, Homo sapiens
ctctcccagtcaggctcaggat

SEQ ID NO: 9301906 - DNA, 20 bp, Homo sapiens
ctctcccagcacagcttcct

SEQ ID NO: 9301907 - DNA, 20 bp, Homo sapiens
ctctcccagcacagcttcct

SEQ ID NO: 9301908 - DNA, 22 bp, Homo sapiens
ctctcccagtcaggctcaggat

SEQ ID NO: 9301909 - DNA, 22 bp, Homo sapiens
ctctccccacaccctctgcatg

SEQ ID NO: 9301910 - DNA, 22 bp, Homo sapiens
ctctcccagtcaggctcaggat

SEQ ID NO: 9301911 - DNA, 22 bp, Homo sapiens
ctctccccacaccctctgcatg

SEQ ID NO: 9301912 - DNA, 22 bp, Homo sapiens
ctcctgaggacttctattgggt

SEQ ID NO: 9301913 - DNA, 22 bp, Homo sapiens
ctcctgagggatgcttaggctt

SEQ ID NO: 9301914 - DNA, 22 bp, Homo sapiens
ctcctgaggaaaagcttggtca

SEQ ID NO: 9301915 - DNA, 22 bp, Homo sapiens
agtgctggagggaggcaggttc

SEQ ID NO: 9301916 - DNA, 22 bp, Homo sapiens
ctccagagagtccagctctggg

SEQ ID NO: 9301917 - DNA, 22 bp, Homo sapiens
ctcctgagtagtagcattgtca

SEQ ID NO: 9301918 - DNA, 22 bp, Homo sapiens
ctcgcaagtcgctccggttact

SEQ ID NO: 9301919 - DNA, 22 bp, Homo sapiens
ctcggaatggaacaacagcggt

SEQ ID NO: 9301920 - DNA, 18 bp, Homo sapiens
ctcctttccctacacctc

SEQ ID NO: 9301921 - DNA, 20 bp, Homo sapiens
ctctctccatctcagtggcc

SEQ ID NO: 9301922 - DNA, 19 bp, Homo sapiens
ctctctccagtggctggct

SEQ ID NO: 9301923 - DNA, 23 bp, Homo sapiens
ctctggagatcctctgcctgggt

SEQ ID NO: 9301924 - DNA, 22 bp, Homo sapiens
agtggctgttccaggtgaggac

SEQ ID NO: 9301925 - DNA, 22 bp, Homo sapiens
ctctgtacctggcatagcaacc

SEQ ID NO: 9301926 - DNA, 17 bp, Homo sapiens
ctctgtacaggaaagag

SEQ ID NO: 9301927 - DNA, 22 bp, Homo sapiens
agtgggagaatgaataagggcc

SEQ ID NO: 9301928 - DNA, 19 bp, Homo sapiens
ctcttgggtggcagaggcc

SEQ ID NO: 9301929 - DNA, 19 bp, Homo sapiens
ctcttgggtggcagaggcc

SEQ ID NO: 9301930 - DNA, 22 bp, Homo sapiens
ctcttggccagacacagaggca

SEQ ID NO: 9301931 - DNA, 22 bp, Homo sapiens
ctcttggccagacacagaggca

SEQ ID NO: 9301932 - DNA, 22 bp, Homo sapiens
ctcttggtaagacattagaggt

SEQ ID NO: 9301933 - DNA, 22 bp, Homo sapiens
ctctttggcgttggcagagcca

SEQ ID NO: 9301934 - DNA, 22 bp, Homo sapiens
ctcttctttccatccctagcca

SEQ ID NO: 9301935 - DNA, 22 bp, Homo sapiens
ctctgtcctccacctgctttca

SEQ ID NO: 9301936 - DNA, 22 bp, Homo sapiens
agtggtgtctgagtggccaggg

SEQ ID NO: 9301937 - DNA, 18 bp, Homo sapiens
agtggtctgttatatcat

SEQ ID NO: 9301938 - DNA, 22 bp, Homo sapiens
ctccagaaatttggatgcagca

SEQ ID NO: 9301939 - DNA, 22 bp, Homo sapiens
ctccagaactgggagagaataa

SEQ ID NO: 9301940 - DNA, 22 bp, Homo sapiens
ctccagagacacttctcatgat

SEQ ID NO: 9301941 - DNA, 19 bp, Homo sapiens
agtctcagtgtacagaggc

SEQ ID NO: 9301942 - DNA, 22 bp, Homo sapiens
ctcagggaggagcttctgggcc

SEQ ID NO: 9301943 - DNA, 22 bp, Homo sapiens
ctcagggacgttagaggacagg

SEQ ID NO: 9301944 - DNA, 22 bp, Homo sapiens
ctcagggacggcatctcatttc

SEQ ID NO: 9301945 - DNA, 22 bp, Homo sapiens
ctcagggacagtatcatttagg

SEQ ID NO: 9301946 - DNA, 22 bp, Homo sapiens
ctcagctccaggtgtgcatctt

SEQ ID NO: 9301947 - DNA, 22 bp, Homo sapiens
ctcagcctgtgaagagcagagg

SEQ ID NO: 9301948 - DNA, 22 bp, Homo sapiens
ctcagcccggtgctcgtgccac

SEQ ID NO: 9301949 - DNA, 22 bp, Homo sapiens
ctcagcccggtgctcgtgccac

SEQ ID NO: 9301950 - DNA, 22 bp, Homo sapiens
ctcagcacatctttacatttcc

SEQ ID NO: 9301951 - DNA, 22 bp, Homo sapiens
ctcagcacactcccatctaatt

SEQ ID NO: 9301952 - DNA, 22 bp, Homo sapiens
ctcagccccagcccagatagca

SEQ ID NO: 9301953 - DNA, 22 bp, Homo sapiens
ctcagaggtggatgccttgtgg

SEQ ID NO: 9301954 - DNA, 23 bp, Homo sapiens
ctcagaggtgtttttcacttact

SEQ ID NO: 9301955 - DNA, 18 bp, Homo sapiens
ctcagacatgcttctttt

SEQ ID NO: 9301956 - DNA, 22 bp, Homo sapiens
ctcagagggtctcctccagaat

SEQ ID NO: 9301957 - DNA, 22 bp, Homo sapiens
ctcagagggtctcctccagaat

SEQ ID NO: 9301958 - DNA, 22 bp, Homo sapiens
ctcagagggtacaggtgaaccc

SEQ ID NO: 9301959 - DNA, 22 bp, Homo sapiens
ctcagaggggatgcttggagaa

SEQ ID NO: 9301960 - DNA, 22 bp, Homo sapiens
ctcagaggtcaagagcagagct

SEQ ID NO: 9301961 - DNA, 22 bp, Homo sapiens
ctcagaggtcaagagcagagct

SEQ ID NO: 9301962 - DNA, 22 bp, Homo sapiens
ctcagagggttgaaggtgctct

SEQ ID NO: 9301963 - DNA, 22 bp, Homo sapiens
ctcagaagaacaaaggctctac

SEQ ID NO: 9301964 - DNA, 22 bp, Homo sapiens
cgggttcacgccattctcctgc

SEQ ID NO: 9301965 - DNA, 22 bp, Homo sapiens
cggggttcatccatgctgtggc

SEQ ID NO: 9301966 - DNA, 22 bp, Homo sapiens
cggggtgggaatagacctgtct

SEQ ID NO: 9301967 - DNA, 22 bp, Homo sapiens
cggggtgggaatagacctgtct

SEQ ID NO: 9301968 - DNA, 22 bp, Homo sapiens
cggggtggcactctaaatagaa

SEQ ID NO: 9301969 - DNA, 22 bp, Homo sapiens
ctatttatgtccaagtgtttta

SEQ ID NO: 9301970 - DNA, 22 bp, Homo sapiens
aggaactgatgagcagccaggg

SEQ ID NO: 9301971 - DNA, 22 bp, Homo sapiens
aggaacattctcatttcctgcc

SEQ ID NO: 9301972 - DNA, 22 bp, Homo sapiens
cagggccagcgcccaggcccag

SEQ ID NO: 9301973 - DNA, 22 bp, Homo sapiens
aggaaataggaccagacaaagc

SEQ ID NO: 9301974 - DNA, 22 bp, Homo sapiens
aggaaatgccgcggctctcttt

SEQ ID NO: 9301975 - DNA, 22 bp, Homo sapiens
aggaaattgtctttttccttgt

SEQ ID NO: 9301976 - DNA, 22 bp, Homo sapiens
aggaaatgtagtcctcatctcc

SEQ ID NO: 9301977 - DNA, 22 bp, Homo sapiens
aggaaatgtacaaatgaagatg

SEQ ID NO: 9301978 - DNA, 22 bp, Homo sapiens
aggaacaagggagccttttctc

SEQ ID NO: 9301979 - DNA, 22 bp, Homo sapiens
agcttgtagaaggccacgagca

SEQ ID NO: 9301980 - DNA, 22 bp, Homo sapiens
agctttacctgccttggggcac

SEQ ID NO: 9301981 - DNA, 22 bp, Homo sapiens
agctttatataaaagagtacat

SEQ ID NO: 9301982 - DNA, 22 bp, Homo sapiens
agctttatagaaaggatcagtg

SEQ ID NO: 9301983 - DNA, 22 bp, Homo sapiens
agctttatagaaaggatcagtg

SEQ ID NO: 9301984 - DNA, 22 bp, Homo sapiens
agctttatataaaagagtacat

SEQ ID NO: 9301985 - DNA, 17 bp, Homo sapiens
aggaaacattttctttc

SEQ ID NO: 9301986 - DNA, 22 bp, Homo sapiens
aggaaagaagtacattctcatg

SEQ ID NO: 9301987 - DNA, 22 bp, Homo sapiens
cagggccagcccactagcgagg

SEQ ID NO: 9301988 - DNA, 22 bp, Homo sapiens
cagggccagagagggctggctg

SEQ ID NO: 9301989 - DNA, 22 bp, Homo sapiens
cagggccagagagggctggctg

SEQ ID NO: 9301990 - DNA, 22 bp, Homo sapiens
cagggccagagagggctggctg

SEQ ID NO: 9301991 - DNA, 22 bp, Homo sapiens
cagggccactgtagatgaggag

SEQ ID NO: 9301992 - DNA, 22 bp, Homo sapiens
agctgtttatgcactcctgcct

SEQ ID NO: 9301993 - DNA, 23 bp, Homo sapiens
agctgtttcattattacaacacc

SEQ ID NO: 9301994 - DNA, 22 bp, Homo sapiens
agctgtttccataaatgagaca

SEQ ID NO: 9301995 - DNA, 22 bp, Homo sapiens
agctgttgaaaatggtgtccta

SEQ ID NO: 9301996 - DNA, 22 bp, Homo sapiens
agctgttgcagggatcagcacc

SEQ ID NO: 9301997 - DNA, 22 bp, Homo sapiens
agctgttggctggctgagctct

SEQ ID NO: 9301998 - DNA, 22 bp, Homo sapiens
agctgttggagtaaagcactta

SEQ ID NO: 9301999 - DNA, 22 bp, Homo sapiens
agctgtgttaggatgttaataa

SEQ ID NO: 9302000 - DNA, 22 bp, Homo sapiens
agctgggaagactggaagacag

SEQ ID NO: 9302001 - DNA, 22 bp, Homo sapiens
agctggctttgagctgggaggt

SEQ ID NO: 9302002 - DNA, 23 bp, Homo sapiens
agctgggaattttctgaagcttt

SEQ ID NO: 9302003 - DNA, 22 bp, Homo sapiens
caggcctcaggggctcaggctg

SEQ ID NO: 9302004 - DNA, 22 bp, Homo sapiens
caggcctcagagagtggcgggg

SEQ ID NO: 9302005 - DNA, 22 bp, Homo sapiens
caggcctcagagagtggcgggg

SEQ ID NO: 9302006 - DNA, 22 bp, Homo sapiens
caggcctcaccagcggagctgc

SEQ ID NO: 9302007 - DNA, 22 bp, Homo sapiens
caggccggtgattctggatgta

SEQ ID NO: 9302008 - DNA, 22 bp, Homo sapiens
caggcctggctgcagctcgcct

SEQ ID NO: 9302009 - DNA, 22 bp, Homo sapiens
caggcctgggctgggtatcagg

SEQ ID NO: 9302010 - DNA, 22 bp, Homo sapiens
caggcctccactccacgcagac

SEQ ID NO: 9302011 - DNA, 22 bp, Homo sapiens
caggcctggagtgcaatggcac

SEQ ID NO: 9302012 - DNA, 22 bp, Homo sapiens
caggagtcccaggggtgggcca

SEQ ID NO: 9302013 - DNA, 22 bp, Homo sapiens
caggagtccatctggcctggtg

SEQ ID NO: 9302014 - DNA, 22 bp, Homo sapiens
caggagtctctcttgagcccag

SEQ ID NO: 9302015 - DNA, 22 bp, Homo sapiens
agctggctttgagctgggaggt

SEQ ID NO: 9302016 - DNA, 22 bp, Homo sapiens
agctggctttatggttggctaa

SEQ ID NO: 9302017 - DNA, 22 bp, Homo sapiens
agctggcttcacaggcagtgtg

SEQ ID NO: 9302018 - DNA, 22 bp, Homo sapiens
caggaggtgacttccaggggtt

SEQ ID NO: 9302019 - DNA, 22 bp, Homo sapiens
caggaggttgtaagagcaggcc

SEQ ID NO: 9302020 - DNA, 22 bp, Homo sapiens
caggaggttgtaagagcaggcc

SEQ ID NO: 9302021 - DNA, 22 bp, Homo sapiens
agctggccagcacctccaggtc

SEQ ID NO: 9302022 - DNA, 22 bp, Homo sapiens
agctggcagtcatcctagtgag

SEQ ID NO: 9302023 - DNA, 22 bp, Homo sapiens
caggacagagcccagactgtgt

SEQ ID NO: 9302024 - DNA, 22 bp, Homo sapiens
caggacagaccaagatcgtgct

SEQ ID NO: 9302025 - DNA, 19 bp, Homo sapiens
caggacagacttcaaagcc

SEQ ID NO: 9302026 - DNA, 22 bp, Homo sapiens
caggacagaaataaggaatata

SEQ ID NO: 9302027 - DNA, 22 bp, Homo sapiens
caggacacttgttcttctctgc

SEQ ID NO: 9302028 - DNA, 22 bp, Homo sapiens
caggacagacagaatgcctaac

SEQ ID NO: 9302029 - DNA, 22 bp, Homo sapiens
caggacagacagaatgcctaac

SEQ ID NO: 9302030 - DNA, 22 bp, Homo sapiens
caggaaaaatgccaggagtcag

SEQ ID NO: 9302031 - DNA, 22 bp, Homo sapiens
caggaaaaatgccaggagtcag

SEQ ID NO: 9302032 - DNA, 22 bp, Homo sapiens
agctgcctggagtcatttcctg

SEQ ID NO: 9302033 - DNA, 21 bp, Homo sapiens
caggaaaagcggaagtctagc

SEQ ID NO: 9302034 - DNA, 22 bp, Homo sapiens
agctgctcattcccagcacatg

SEQ ID NO: 9302035 - DNA, 22 bp, Homo sapiens
agctgctctttgaaggacactt

SEQ ID NO: 9302036 - DNA, 22 bp, Homo sapiens
cagcttttaggactgtgagaaa

SEQ ID NO: 9302037 - DNA, 22 bp, Homo sapiens
cagctttgccctttgcccaatc

SEQ ID NO: 9302038 - DNA, 21 bp, Homo sapiens
agctgcagccatgtacatggc

SEQ ID NO: 9302039 - DNA, 22 bp, Homo sapiens
agctgaggctctgagagggaag

SEQ ID NO: 9302040 - DNA, 22 bp, Homo sapiens
agctgaggctctgagagggaag

SEQ ID NO: 9302041 - DNA, 22 bp, Homo sapiens
agctgaggctctgagagggaag

SEQ ID NO: 9302042 - DNA, 22 bp, Homo sapiens
agctgaggctctgagagggaag

SEQ ID NO: 9302043 - DNA, 23 bp, Homo sapiens
agctgaggctgtgggtgtcagag

SEQ ID NO: 9302044 - DNA, 22 bp, Homo sapiens
agctgaggccacgagtgaaggg

SEQ ID NO: 9302045 - DNA, 22 bp, Homo sapiens
agctgaggcatggacaggctgc

SEQ ID NO: 9302046 - DNA, 22 bp, Homo sapiens
agctgaggcatggacaggctgc

SEQ ID NO: 9302047 - DNA, 22 bp, Homo sapiens
agctgaggcctgatttcgccgt

SEQ ID NO: 9302048 - DNA, 22 bp, Homo sapiens
agctgaggccacgagtgaaggg

SEQ ID NO: 9302049 - DNA, 22 bp, Homo sapiens
cagcttcttcagtcctggagct

SEQ ID NO: 9302050 - DNA, 22 bp, Homo sapiens
cagctctctaaggtcttgcttt

SEQ ID NO: 9302051 - DNA, 22 bp, Homo sapiens
cagctctcacaccctcctccca

SEQ ID NO: 9302052 - DNA, 22 bp, Homo sapiens
cagctctcacacttagcttcta

SEQ ID NO: 9302053 - DNA, 22 bp, Homo sapiens
cagctctccaccctcctggttc

SEQ ID NO: 9302054 - DNA, 22 bp, Homo sapiens
cagctcctgttggtcttgagga

SEQ ID NO: 9302055 - DNA, 22 bp, Homo sapiens
cagctctcacacttagcttcta

SEQ ID NO: 9302056 - DNA, 22 bp, Homo sapiens
agctctgacattgattctcagc

SEQ ID NO: 9302057 - DNA, 22 bp, Homo sapiens
cagctcctgggccatctcctag

SEQ ID NO: 9302058 - DNA, 22 bp, Homo sapiens
cagctcctgcagctggctccca

SEQ ID NO: 9302059 - DNA, 22 bp, Homo sapiens
agctctggaagccctggtagtt

SEQ ID NO: 9302060 - DNA, 22 bp, Homo sapiens
agctctggaagccctggtagtt

SEQ ID NO: 9302061 - DNA, 22 bp, Homo sapiens
agctctggaactcccggctgct

SEQ ID NO: 9302062 - DNA, 18 bp, Homo sapiens
aggagcctttgcactgga

SEQ ID NO: 9302063 - DNA, 19 bp, Homo sapiens
aggagccttgagcagtgag

SEQ ID NO: 9302064 - DNA, 22 bp, Homo sapiens
aggagcctggctggcccacagg

SEQ ID NO: 9302065 - DNA, 22 bp, Homo sapiens
aggagccatgagcaggaggcaa

SEQ ID NO: 9302066 - DNA, 22 bp, Homo sapiens
aggagagaattactgggtgtca

SEQ ID NO: 9302067 - DNA, 22 bp, Homo sapiens
aggagagagaacacttgggtcc

SEQ ID NO: 9302068 - DNA, 22 bp, Homo sapiens
aggagagagctgagctttgctg

SEQ ID NO: 9302069 - DNA, 20 bp, Homo sapiens
aggagctgaattagagggtt

SEQ ID NO: 9302070 - DNA, 22 bp, Homo sapiens
aggagctgacttgtaaagcatt

SEQ ID NO: 9302071 - DNA, 22 bp, Homo sapiens
aggagctgaagtctctgcactc

SEQ ID NO: 9302072 - DNA, 22 bp, Homo sapiens
aggagctgaagtctctgcactc

SEQ ID NO: 9302073 - DNA, 22 bp, Homo sapiens
aggagctgaaacttctcatatg

SEQ ID NO: 9302074 - DNA, 20 bp, Homo sapiens
aggagctctgtgctgggaag

SEQ ID NO: 9302075 - DNA, 22 bp, Homo sapiens
aggagctgtgaatgggaggggt

SEQ ID NO: 9302076 - DNA, 22 bp, Homo sapiens
aggagctgataaaagggggtca

SEQ ID NO: 9302077 - DNA, 22 bp, Homo sapiens
aggagctgataaaagggggtca

SEQ ID NO: 9302078 - DNA, 22 bp, Homo sapiens
aggagctgagggagcgcccttg

SEQ ID NO: 9302079 - DNA, 22 bp, Homo sapiens
aggagctgagggagcgcccttg

SEQ ID NO: 9302080 - DNA, 22 bp, Homo sapiens
aggagctgagtcagcccgacag

SEQ ID NO: 9302081 - DNA, 22 bp, Homo sapiens
aggaggaggtgggacacagtga

SEQ ID NO: 9302082 - DNA, 22 bp, Homo sapiens
aggaggaggtaagaaaagcata

SEQ ID NO: 9302083 - DNA, 22 bp, Homo sapiens
aggaggcaaaggtctctgataa

SEQ ID NO: 9302084 - DNA, 17 bp, Homo sapiens
aggaggatcagagagta

SEQ ID NO: 9302085 - DNA, 21 bp, Homo sapiens
aggaggagagcttggcctacc

SEQ ID NO: 9302086 - DNA, 22 bp, Homo sapiens
aggaggagcagctttttgtctc

SEQ ID NO: 9302087 - DNA, 22 bp, Homo sapiens
aggagaaaacagtgttttgcct

SEQ ID NO: 9302088 - DNA, 22 bp, Homo sapiens
cagtctctctccttgcaggcgt

SEQ ID NO: 9302089 - DNA, 22 bp, Homo sapiens
aggagaagccaagttgtgagca

SEQ ID NO: 9302090 - DNA, 22 bp, Homo sapiens
cagtctctggcagctgctggcc

SEQ ID NO: 9302091 - DNA, 22 bp, Homo sapiens
cagtctctgggaaagaggacag

SEQ ID NO: 9302092 - DNA, 22 bp, Homo sapiens
aggaaggactccatggtccgtc

SEQ ID NO: 9302093 - DNA, 20 bp, Homo sapiens
aggaaggaagtttgcatgga

SEQ ID NO: 9302094 - DNA, 19 bp, Homo sapiens
aggaaggaacctgagtctg

SEQ ID NO: 9302095 - DNA, 22 bp, Homo sapiens
catgaaatgttagaattagaca

SEQ ID NO: 9302096 - DNA, 22 bp, Homo sapiens
catgaaatgatatttgggtggg

SEQ ID NO: 9302097 - DNA, 22 bp, Homo sapiens
catgaaatgtgttaatctcttg

SEQ ID NO: 9302098 - DNA, 22 bp, Homo sapiens
catgaaattcagcaggtgagta

SEQ ID NO: 9302099 - DNA, 22 bp, Homo sapiens
catgaaatggccaaccttcggc

SEQ ID NO: 9302100 - DNA, 22 bp, Homo sapiens
catgaaatctgagtatgtttcc

SEQ ID NO: 9302101 - DNA, 22 bp, Homo sapiens
catgaaatcacaagctgaggac

SEQ ID NO: 9302102 - DNA, 22 bp, Homo sapiens
catgaaatattagtaactgttt

SEQ ID NO: 9302103 - DNA, 22 bp, Homo sapiens
catgaaatatgctacctgtctt

SEQ ID NO: 9302104 - DNA, 22 bp, Homo sapiens
aggaggcactcactctcagggt

SEQ ID NO: 9302105 - DNA, 22 bp, Homo sapiens
aggaggtggcaactgtcgacag

SEQ ID NO: 9302106 - DNA, 22 bp, Homo sapiens
aggaggtgctgtttgtcctgga

SEQ ID NO: 9302107 - DNA, 22 bp, Homo sapiens
aggaggtgctagagaagatgtt

SEQ ID NO: 9302108 - DNA, 22 bp, Homo sapiens
aggaggtgctagagaagatgtt

SEQ ID NO: 9302109 - DNA, 22 bp, Homo sapiens
aggaggtggctgaacttgaggg

SEQ ID NO: 9302110 - DNA, 22 bp, Homo sapiens
aggaggtggctgaacttgaggg

SEQ ID NO: 9302111 - DNA, 22 bp, Homo sapiens
aggaggtggcctgagcgtgccc

SEQ ID NO: 9302112 - DNA, 22 bp, Homo sapiens
aggaggtggcctgagcgtgccc

SEQ ID NO: 9302113 - DNA, 22 bp, Homo sapiens
catgaggtgataaagctgggat

SEQ ID NO: 9302114 - DNA, 22 bp, Homo sapiens
aggaggtgttgatagaaggttt

SEQ ID NO: 9302115 - DNA, 22 bp, Homo sapiens
catgaggtgataaagctgggat

SEQ ID NO: 9302116 - DNA, 22 bp, Homo sapiens
catgcctgcctggtgggcgtgg

SEQ ID NO: 9302117 - DNA, 22 bp, Homo sapiens
cattatgaagcatcatcttatt

SEQ ID NO: 9302118 - DNA, 22 bp, Homo sapiens
cattatgaatggagtttgaggt

SEQ ID NO: 9302119 - DNA, 22 bp, Homo sapiens
cattatgatggtaattttctct

SEQ ID NO: 9302120 - DNA, 22 bp, Homo sapiens
catggcctctctcctggaatgg

SEQ ID NO: 9302121 - DNA, 23 bp, Homo sapiens
cattcctgatatggccacaagag

SEQ ID NO: 9302122 - DNA, 22 bp, Homo sapiens
cattcctggacaaacatcaaaa

SEQ ID NO: 9302123 - DNA, 21 bp, Homo sapiens
cattcctcccctgacgtcagc

SEQ ID NO: 9302124 - DNA, 22 bp, Homo sapiens
aggcagcagaaaacaaatggtt

SEQ ID NO: 9302125 - DNA, 21 bp, Homo sapiens
cattcctcggctcatagagga

SEQ ID NO: 9302126 - DNA, 19 bp, Homo sapiens
aggcagaggcttggctagc

SEQ ID NO: 9302127 - DNA, 22 bp, Homo sapiens
aggcagcagcttgctggttgcc

SEQ ID NO: 9302128 - DNA, 22 bp, Homo sapiens
catttacagtgagagtttttac

SEQ ID NO: 9302129 - DNA, 22 bp, Homo sapiens
catttacataacagtaacgctg

SEQ ID NO: 9302130 - DNA, 22 bp, Homo sapiens
aggcagcagaggttgaggaaag

SEQ ID NO: 9302131 - DNA, 18 bp, Homo sapiens
aggcagcagcatcttctc

SEQ ID NO: 9302132 - DNA, 22 bp, Homo sapiens
aggcagcagccacaaggcctga

SEQ ID NO: 9302133 - DNA, 19 bp, Homo sapiens
aggcagcattctggggctt

SEQ ID NO: 9302134 - DNA, 22 bp, Homo sapiens
aggcagcatttgaatccaggtc

SEQ ID NO: 9302135 - DNA, 22 bp, Homo sapiens
aggcagccaatcagaggctgac

SEQ ID NO: 9302136 - DNA, 21 bp, Homo sapiens
aggcagccagtcatgctccct

SEQ ID NO: 9302137 - DNA, 22 bp, Homo sapiens
aggcagccagatggcagcctgc

SEQ ID NO: 9302138 - DNA, 22 bp, Homo sapiens
aggcagccagttcaggtttctt

SEQ ID NO: 9302139 - DNA, 22 bp, Homo sapiens
aggcagccagttcaggtttctt

SEQ ID NO: 9302140 - DNA, 22 bp, Homo sapiens
aggcagccacatgagctcctga

SEQ ID NO: 9302141 - DNA, 22 bp, Homo sapiens
aggctgaggcgggaggatcact

SEQ ID NO: 9302142 - DNA, 22 bp, Homo sapiens
ccagttccagtgctcacatcca

SEQ ID NO: 9302143 - DNA, 22 bp, Homo sapiens
ccagtgcaccaagaggcctaga

SEQ ID NO: 9302144 - DNA, 23 bp, Homo sapiens
aggctgagctctcccagcttcag

SEQ ID NO: 9302145 - DNA, 23 bp, Homo sapiens
aggctgagctctcccagcttcag

SEQ ID NO: 9302146 - DNA, 19 bp, Homo sapiens
ccagtgcaaggtaagatag

SEQ ID NO: 9302147 - DNA, 22 bp, Homo sapiens
ccagtctgtgtgccagcctgcg

SEQ ID NO: 9302148 - DNA, 22 bp, Homo sapiens
aggctgagactgtgcattagtg

SEQ ID NO: 9302149 - DNA, 22 bp, Homo sapiens
aggctgagactgtgcattagtg

SEQ ID NO: 9302150 - DNA, 22 bp, Homo sapiens
aggctgagagcaacgtgtcaga

SEQ ID NO: 9302151 - DNA, 22 bp, Homo sapiens
aggctgagagcaacgtgtcaga

SEQ ID NO: 9302152 - DNA, 22 bp, Homo sapiens
aggctgagcaaagggccttacc

SEQ ID NO: 9302153 - DNA, 22 bp, Homo sapiens
aggctctgatgcaagcccaggg

SEQ ID NO: 9302154 - DNA, 22 bp, Homo sapiens
aggctctgcagtgctggaggac

SEQ ID NO: 9302155 - DNA, 22 bp, Homo sapiens
aggctctgatcaggtggctgtg

SEQ ID NO: 9302156 - DNA, 22 bp, Homo sapiens
aggcctccagctgagttttgct

SEQ ID NO: 9302157 - DNA, 22 bp, Homo sapiens
aggcctcatagtagacctgccc

SEQ ID NO: 9302158 - DNA, 22 bp, Homo sapiens
aggcctcatagtagacctgccc

SEQ ID NO: 9302159 - DNA, 22 bp, Homo sapiens
aggcctcacattgggcttcaag

SEQ ID NO: 9302160 - DNA, 22 bp, Homo sapiens
aggcctcagttcttgccaggtg

SEQ ID NO: 9302161 - DNA, 22 bp, Homo sapiens
aggcctcctgcagggatgagtg

SEQ ID NO: 9302162 - DNA, 22 bp, Homo sapiens
ccaggcacttcatcattagggt

SEQ ID NO: 9302163 - DNA, 22 bp, Homo sapiens
ccaggcattgtgagtgggcagg

SEQ ID NO: 9302164 - DNA, 22 bp, Homo sapiens
ccaggccaaattcagtcagcag

SEQ ID NO: 9302165 - DNA, 22 bp, Homo sapiens
ccaggcatggggagagccagat

SEQ ID NO: 9302166 - DNA, 22 bp, Homo sapiens
ccaggcagtggaagctaaaatt

SEQ ID NO: 9302167 - DNA, 22 bp, Homo sapiens
ccaggcatccattgcttcctct

SEQ ID NO: 9302168 - DNA, 22 bp, Homo sapiens
ccaggcatcacgggcatgtggc

SEQ ID NO: 9302169 - DNA, 22 bp, Homo sapiens
ccaggcatcacgggcatgtggc

SEQ ID NO: 9302170 - DNA, 22 bp, Homo sapiens
ccaggcctagcccctgagggta

SEQ ID NO: 9302171 - DNA, 22 bp, Homo sapiens
aggctccacggcaggatgctgt

SEQ ID NO: 9302172 - DNA, 22 bp, Homo sapiens
aggctccataccatctccggag

SEQ ID NO: 9302173 - DNA, 22 bp, Homo sapiens
aggctccagtctgaaccttggg

SEQ ID NO: 9302174 - DNA, 22 bp, Homo sapiens
aggctccatgcaaaggctgttt

SEQ ID NO: 9302175 - DNA, 22 bp, Homo sapiens
aggctccatgctaagcgatatg

SEQ ID NO: 9302176 - DNA, 22 bp, Homo sapiens
aggctccatggttctccctcag

SEQ ID NO: 9302177 - DNA, 22 bp, Homo sapiens
ccaggctctatccctccttctt

SEQ ID NO: 9302178 - DNA, 21 bp, Homo sapiens
aggctcccagaaatgggcatc

SEQ ID NO: 9302179 - DNA, 22 bp, Homo sapiens
aggctccattttcctgcagctg

SEQ ID NO: 9302180 - DNA, 22 bp, Homo sapiens
aggctccattcatgtgaaggca

SEQ ID NO: 9302181 - DNA, 22 bp, Homo sapiens
aggctccattccaggagctaga

SEQ ID NO: 9302182 - DNA, 22 bp, Homo sapiens
aggctccattccaggagctaga

SEQ ID NO: 9302183 - DNA, 22 bp, Homo sapiens
ccaggctctgcaaaatcaggct

SEQ ID NO: 9302184 - DNA, 22 bp, Homo sapiens
ccaggctctgcaaaatcaggct

SEQ ID NO: 9302185 - DNA, 22 bp, Homo sapiens
ccaggctctgcaaaatcaggct

SEQ ID NO: 9302186 - DNA, 15 bp, Homo sapiens
ccaggctctgcactc

SEQ ID NO: 9302187 - DNA, 22 bp, Homo sapiens
ccaggctctgccaggcccttga

SEQ ID NO: 9302188 - DNA, 22 bp, Homo sapiens
ccaggctctgccaggcccttga

SEQ ID NO: 9302189 - DNA, 22 bp, Homo sapiens
ccaggctctgacatagatggga

SEQ ID NO: 9302190 - DNA, 22 bp, Homo sapiens
ccaggctctgacatagatggga

SEQ ID NO: 9302191 - DNA, 22 bp, Homo sapiens
ccaggctctgagaggaatgtga

SEQ ID NO: 9302192 - DNA, 22 bp, Homo sapiens
ccaggctctgagcctcactctt

SEQ ID NO: 9302193 - DNA, 22 bp, Homo sapiens
aggccagatgtcgggctagaag

SEQ ID NO: 9302194 - DNA, 22 bp, Homo sapiens
aggccagcgctgctagctcccg

SEQ ID NO: 9302195 - DNA, 22 bp, Homo sapiens
aggccagctgttactagagcca

SEQ ID NO: 9302196 - DNA, 22 bp, Homo sapiens
aggccaagggcaaagcggagag

SEQ ID NO: 9302197 - DNA, 22 bp, Homo sapiens
aggccaagtagccgctgtccta

SEQ ID NO: 9302198 - DNA, 22 bp, Homo sapiens
aggccaagtagctagcattgaa

SEQ ID NO: 9302199 - DNA, 22 bp, Homo sapiens
aggccaggatagcatggatcag

SEQ ID NO: 9302200 - DNA, 20 bp, Homo sapiens
aggccaggaaatgtagttct

SEQ ID NO: 9302201 - DNA, 22 bp, Homo sapiens
aggcccagttatcctacttgtt

SEQ ID NO: 9302202 - DNA, 22 bp, Homo sapiens
ccactggcaaccccgcctcata

SEQ ID NO: 9302203 - DNA, 22 bp, Homo sapiens
ccactggcagttggctagcctt

SEQ ID NO: 9302204 - DNA, 22 bp, Homo sapiens
ccactgctagagatgcatcccc

SEQ ID NO: 9302205 - DNA, 22 bp, Homo sapiens
aggcattgctggtattggaagt

SEQ ID NO: 9302206 - DNA, 22 bp, Homo sapiens
ccactggcatccagctgccatc

SEQ ID NO: 9302207 - DNA, 22 bp, Homo sapiens
ccactggctgtcagcaggactc

SEQ ID NO: 9302208 - DNA, 22 bp, Homo sapiens
ccactggcttttcctaggtctc

SEQ ID NO: 9302209 - DNA, 22 bp, Homo sapiens
aggcatggcatggggcagatgt

SEQ ID NO: 9302210 - DNA, 22 bp, Homo sapiens
aggcatggcatggggcagatgt

SEQ ID NO: 9302211 - DNA, 22 bp, Homo sapiens
aggcatggcatggggcagatgt

SEQ ID NO: 9302212 - DNA, 22 bp, Homo sapiens
ccactgggcgtttctgtccaat

SEQ ID NO: 9302213 - DNA, 22 bp, Homo sapiens
aggcatctgcctcctctacccc

SEQ ID NO: 9302214 - DNA, 22 bp, Homo sapiens
aggcatcctctctgccttgagg

SEQ ID NO: 9302215 - DNA, 22 bp, Homo sapiens
aggcatgatgtgcagtggcaaa

SEQ ID NO: 9302216 - DNA, 22 bp, Homo sapiens
aggcatgactttggctgaagaa

SEQ ID NO: 9302217 - DNA, 21 bp, Homo sapiens
aggcatgagccctgcatggac

SEQ ID NO: 9302218 - DNA, 22 bp, Homo sapiens
aggcatccatggtggtcgctga

SEQ ID NO: 9302219 - DNA, 23 bp, Homo sapiens
aggcagtgggggccactttgctt

SEQ ID NO: 9302220 - DNA, 22 bp, Homo sapiens
aggcagtgagcagggtgtcatg

SEQ ID NO: 9302221 - DNA, 22 bp, Homo sapiens
aggcagtgagcagggtgtcatg

SEQ ID NO: 9302222 - DNA, 22 bp, Homo sapiens
aggcagtggatgtcaggaatgg

SEQ ID NO: 9302223 - DNA, 22 bp, Homo sapiens
aggcagtggctgagaccagggg

SEQ ID NO: 9302224 - DNA, 22 bp, Homo sapiens
aggcagtggctgagaccagggg

SEQ ID NO: 9302225 - DNA, 22 bp, Homo sapiens
aggcagtggctgagaccagggg

SEQ ID NO: 9302226 - DNA, 22 bp, Homo sapiens
aggcagtggagctggaataggc

SEQ ID NO: 9302227 - DNA, 23 bp, Homo sapiens
aggcaggtttgggctcttcttgt

SEQ ID NO: 9302228 - DNA, 22 bp, Homo sapiens
aggcaggtttcccggctgtcaa

SEQ ID NO: 9302229 - DNA, 22 bp, Homo sapiens
aggcaggtttactcttatttgg

SEQ ID NO: 9302230 - DNA, 22 bp, Homo sapiens
aggcaggtttcccggctgtcaa

SEQ ID NO: 9302231 - DNA, 23 bp, Homo sapiens
aggcaggtttgggctcttcttgt

SEQ ID NO: 9302232 - DNA, 22 bp, Homo sapiens
aggcaggttggtgagaagactg

SEQ ID NO: 9302233 - DNA, 18 bp, Homo sapiens
aggcaggtgctaatattt

SEQ ID NO: 9302234 - DNA, 22 bp, Homo sapiens
aggcagcccacaggacacagga

SEQ ID NO: 9302235 - DNA, 22 bp, Homo sapiens
aggcagcctatggggagctcag

SEQ ID NO: 9302236 - DNA, 22 bp, Homo sapiens
aggcagccatccaggaggctca

SEQ ID NO: 9302237 - DNA, 22 bp, Homo sapiens
aggcagccatctgcaggaagga

SEQ ID NO: 9302238 - DNA, 22 bp, Homo sapiens
aggcagccattaccaagggcat

SEQ ID NO: 9302239 - DNA, 22 bp, Homo sapiens
aggcagcccacaggacacagga

SEQ ID NO: 9302240 - DNA, 22 bp, Homo sapiens
aggcagccatctgcaggaagga

SEQ ID NO: 9302241 - DNA, 22 bp, Homo sapiens
cccagcagtacccaagcccttg

SEQ ID NO: 9302242 - DNA, 22 bp, Homo sapiens
cccagcagtggttctcaaactt

SEQ ID NO: 9302243 - DNA, 22 bp, Homo sapiens
ccatcctgtctgtggcctcagg

SEQ ID NO: 9302244 - DNA, 22 bp, Homo sapiens
ccatctccactgtccctgtcaa

SEQ ID NO: 9302245 - DNA, 22 bp, Homo sapiens
ccatccttggctcgctctctgt

SEQ ID NO: 9302246 - DNA, 22 bp, Homo sapiens
ccatctccagtttattcttcct

SEQ ID NO: 9302247 - DNA, 22 bp, Homo sapiens
ccatctgtatctgacaaattct

SEQ ID NO: 9302248 - DNA, 22 bp, Homo sapiens
aggctgtgtttcccctggagct

SEQ ID NO: 9302249 - DNA, 22 bp, Homo sapiens
aggctgttgcatgccacagata

SEQ ID NO: 9302250 - DNA, 22 bp, Homo sapiens
aggctgttgagccccagcaagt

SEQ ID NO: 9302251 - DNA, 20 bp, Homo sapiens
aggctgttgacggctgcctc

SEQ ID NO: 9302252 - DNA, 22 bp, Homo sapiens
aggctgtgtttaagtggtaatg

SEQ ID NO: 9302253 - DNA, 22 bp, Homo sapiens
aggctgtgtggtcatggtggct

SEQ ID NO: 9302254 - DNA, 19 bp, Homo sapiens
cccagctctcgtggtgtgc

SEQ ID NO: 9302255 - DNA, 22 bp, Homo sapiens
cccagctctcgcacttactagc

SEQ ID NO: 9302256 - DNA, 22 bp, Homo sapiens
aggctgtggtgggctttgagcc

SEQ ID NO: 9302257 - DNA, 22 bp, Homo sapiens
cccagcctctgtttgctcctct

SEQ ID NO: 9302258 - DNA, 22 bp, Homo sapiens
cccagcctgatctcggccagct

SEQ ID NO: 9302259 - DNA, 22 bp, Homo sapiens
cccagcctctgggctcacccaa

SEQ ID NO: 9302260 - DNA, 22 bp, Homo sapiens
cccagcctctgggttctgccgg

SEQ ID NO: 9302261 - DNA, 22 bp, Homo sapiens
cccagcctctggattctgccct

SEQ ID NO: 9302262 - DNA, 18 bp, Homo sapiens
cccagcctctcctttcta

SEQ ID NO: 9302263 - DNA, 18 bp, Homo sapiens
cccagcctctcctttcta

SEQ ID NO: 9302264 - DNA, 22 bp, Homo sapiens
ccccatgaagtagggtctctga

SEQ ID NO: 9302265 - DNA, 22 bp, Homo sapiens
ccccatgaagtagggtctctga

SEQ ID NO: 9302266 - DNA, 22 bp, Homo sapiens
ccccagcacttggagtggggag

SEQ ID NO: 9302267 - DNA, 22 bp, Homo sapiens
aggcttcaaggttcttggcagg

SEQ ID NO: 9302268 - DNA, 22 bp, Homo sapiens
aggcttcaaggacctgagggaa

SEQ ID NO: 9302269 - DNA, 22 bp, Homo sapiens
aggcttcaaggacctgagggaa

SEQ ID NO: 9302270 - DNA, 22 bp, Homo sapiens
aggcttcaaggacctgagggaa

SEQ ID NO: 9302271 - DNA, 22 bp, Homo sapiens
aggcttcaaggacagcagccac

SEQ ID NO: 9302272 - DNA, 22 bp, Homo sapiens
aggcttcaaggacagcagccac

SEQ ID NO: 9302273 - DNA, 18 bp, Homo sapiens
aggcttacagcagcaggc

SEQ ID NO: 9302274 - DNA, 20 bp, Homo sapiens
aggcttcaaccatacacctt

SEQ ID NO: 9302275 - DNA, 20 bp, Homo sapiens
aggcttcaaccatacacctt

SEQ ID NO: 9302276 - DNA, 22 bp, Homo sapiens
agggaaggaaaagctgtcgctt

SEQ ID NO: 9302277 - DNA, 22 bp, Homo sapiens
agggaaggcttttgacatttcc

SEQ ID NO: 9302278 - DNA, 19 bp, Homo sapiens
agggaaggattctgtcatt

SEQ ID NO: 9302279 - DNA, 22 bp, Homo sapiens
aggcttcaaggacctgagggaa

SEQ ID NO: 9302280 - DNA, 19 bp, Homo sapiens
agggaaggattctgtcatt

SEQ ID NO: 9302281 - DNA, 22 bp, Homo sapiens
agggaagggcagggtctatgca

SEQ ID NO: 9302282 - DNA, 22 bp, Homo sapiens
agggaatgctccgtataaatct

SEQ ID NO: 9302283 - DNA, 19 bp, Homo sapiens
agggaatccggctgaggga

SEQ ID NO: 9302284 - DNA, 19 bp, Homo sapiens
agggaatccggctgaggga

SEQ ID NO: 9302285 - DNA, 22 bp, Homo sapiens
agggagaggttgaaacctcagt

SEQ ID NO: 9302286 - DNA, 22 bp, Homo sapiens
agggagagtagatatcaggtgt

SEQ ID NO: 9302287 - DNA, 22 bp, Homo sapiens
agggccagctgatgagaatgag

SEQ ID NO: 9302288 - DNA, 22 bp, Homo sapiens
agggccagctgatgagaatgag

SEQ ID NO: 9302289 - DNA, 22 bp, Homo sapiens
agggccagctgcagaattagca

SEQ ID NO: 9302290 - DNA, 22 bp, Homo sapiens
agggccaggctcccatgtcagg

SEQ ID NO: 9302291 - DNA, 21 bp, Homo sapiens
ccctgggatgggcttggactt

SEQ ID NO: 9302292 - DNA, 22 bp, Homo sapiens
ccctgggcagtctgcacttcag

SEQ ID NO: 9302293 - DNA, 22 bp, Homo sapiens
ccctgggcaccaggcctggtaa

SEQ ID NO: 9302294 - DNA, 22 bp, Homo sapiens
ccctgggattgccttggccttg

SEQ ID NO: 9302295 - DNA, 22 bp, Homo sapiens
ccctgggcaagccctattttcc

SEQ ID NO: 9302296 - DNA, 22 bp, Homo sapiens
ccctgggctcagagcaggtagc

SEQ ID NO: 9302297 - DNA, 22 bp, Homo sapiens
ccctgggctcagagcaggtagc

SEQ ID NO: 9302298 - DNA, 22 bp, Homo sapiens
agggcagcctgagtgctggccc

SEQ ID NO: 9302299 - DNA, 22 bp, Homo sapiens
agggcagctctcacctctggcc

SEQ ID NO: 9302300 - DNA, 22 bp, Homo sapiens
agggcagctgtgagccactgtg

SEQ ID NO: 9302301 - DNA, 22 bp, Homo sapiens
agggcagctggaaggtggcttc

SEQ ID NO: 9302302 - DNA, 21 bp, Homo sapiens
cctctctcattgtaatgaagt

SEQ ID NO: 9302303 - DNA, 22 bp, Homo sapiens
cctctctccaagggaaatccta

SEQ ID NO: 9302304 - DNA, 22 bp, Homo sapiens
cctctctccaagggaaatccta

SEQ ID NO: 9302305 - DNA, 22 bp, Homo sapiens
cctctctccaattttcacctca

SEQ ID NO: 9302306 - DNA, 22 bp, Homo sapiens
cctctcggcagcccatcttgtc

SEQ ID NO: 9302307 - DNA, 22 bp, Homo sapiens
cctctctcagcttgctgcaact

SEQ ID NO: 9302308 - DNA, 22 bp, Homo sapiens
cctctctcagcttgctgcaact

SEQ ID NO: 9302309 - DNA, 22 bp, Homo sapiens
cctcgagcagcgacccctccac

SEQ ID NO: 9302310 - DNA, 22 bp, Homo sapiens
cctctccttgcacccgtcccgc

SEQ ID NO: 9302311 - DNA, 22 bp, Homo sapiens
cctcccagtgcctccagagcag

SEQ ID NO: 9302312 - DNA, 22 bp, Homo sapiens
cctcccagtgccggggccggct

SEQ ID NO: 9302313 - DNA, 22 bp, Homo sapiens
cctcccatggagctctgtccat

SEQ ID NO: 9302314 - DNA, 22 bp, Homo sapiens
cctccaggctgaatatctagaa

SEQ ID NO: 9302315 - DNA, 22 bp, Homo sapiens
cctcccaggcattgccattttc

SEQ ID NO: 9302316 - DNA, 22 bp, Homo sapiens
cctccaggccttgcaggttaac

SEQ ID NO: 9302317 - DNA, 22 bp, Homo sapiens
cctccaggataagtcagggcct

SEQ ID NO: 9302318 - DNA, 22 bp, Homo sapiens
cctccaggataagtcagggcct

SEQ ID NO: 9302319 - DNA, 22 bp, Homo sapiens
cctccaggataagtcagggcct

SEQ ID NO: 9302320 - DNA, 20 bp, Homo sapiens
cctccaggcacacccatgtg

SEQ ID NO: 9302321 - DNA, 22 bp, Homo sapiens
cctcagtgagatgctcagcgaa

SEQ ID NO: 9302322 - DNA, 22 bp, Homo sapiens
cctccaggaggaaatggaacac

SEQ ID NO: 9302323 - DNA, 21 bp, Homo sapiens
cctccaggagcagagccctga

SEQ ID NO: 9302324 - DNA, 21 bp, Homo sapiens
cctccaggagcagagccctga

SEQ ID NO: 9302325 - DNA, 22 bp, Homo sapiens
cctccaggaacttgagagacac

SEQ ID NO: 9302326 - DNA, 23 bp, Homo sapiens
cctcagagaggcagagccacatg

SEQ ID NO: 9302327 - DNA, 22 bp, Homo sapiens
cctcagagactgcatcttccct

SEQ ID NO: 9302328 - DNA, 22 bp, Homo sapiens
cctcagagacagtaactggaat

SEQ ID NO: 9302329 - DNA, 22 bp, Homo sapiens
cctcagagcagcacccagatga

SEQ ID NO: 9302330 - DNA, 22 bp, Homo sapiens
cctcagagccatgcctgagttc

SEQ ID NO: 9302331 - DNA, 22 bp, Homo sapiens
cctcagagcctccagaaggaat

SEQ ID NO: 9302332 - DNA, 21 bp, Homo sapiens
cctcagagacagatacgggtg

SEQ ID NO: 9302333 - DNA, 22 bp, Homo sapiens
cctcagagaaatgtctattcaa

SEQ ID NO: 9302334 - DNA, 22 bp, Homo sapiens
cctcagagaaaggtatggctga

SEQ ID NO: 9302335 - DNA, 22 bp, Homo sapiens
cccttagctccaaggggtttgg

SEQ ID NO: 9302336 - DNA, 22 bp, Homo sapiens
cccttagctggtgagcccagcg

SEQ ID NO: 9302337 - DNA, 22 bp, Homo sapiens
cccttagctcaatttcttgccc

SEQ ID NO: 9302338 - DNA, 22 bp, Homo sapiens
cccttagctcacaagctaaagc

SEQ ID NO: 9302339 - DNA, 23 bp, Homo sapiens
cccttcagcgagggcattaaggt

SEQ ID NO: 9302340 - DNA, 22 bp, Homo sapiens
cccttagccaggaaatcgacct

SEQ ID NO: 9302341 - DNA, 18 bp, Homo sapiens
cccttagcctttcctctc

SEQ ID NO: 9302342 - DNA, 22 bp, Homo sapiens
cagtgagtccaagatggctgaa

SEQ ID NO: 9302343 - DNA, 22 bp, Homo sapiens
cagtgaggtgcccagcctgccc

SEQ ID NO: 9302344 - DNA, 20 bp, Homo sapiens
cagtgaggaggtgctggggg

SEQ ID NO: 9302345 - DNA, 22 bp, Homo sapiens
cagtgagggcccccttccaggt

SEQ ID NO: 9302346 - DNA, 22 bp, Homo sapiens
cagtgaggaagctgtctggacc

SEQ ID NO: 9302347 - DNA, 22 bp, Homo sapiens
cagtgaggaagctgtctggacc

SEQ ID NO: 9302348 - DNA, 22 bp, Homo sapiens
cagtgatgaatgaaccacaggt

SEQ ID NO: 9302349 - DNA, 20 bp, Homo sapiens
cagtgcaactgaagaactga

SEQ ID NO: 9302350 - DNA, 22 bp, Homo sapiens
cagtgcaatgttaaataggaaa

SEQ ID NO: 9302351 - DNA, 22 bp, Homo sapiens
cagtgcagacgtggagggggca

SEQ ID NO: 9302352 - DNA, 20 bp, Homo sapiens
tatttacaacttagagcctc

SEQ ID NO: 9302353 - DNA, 22 bp, Homo sapiens
tatttactgtatttgaagttga

SEQ ID NO: 9302354 - DNA, 22 bp, Homo sapiens
tatttagatgcatttggattgc

SEQ ID NO: 9302355 - DNA, 22 bp, Homo sapiens
tatttagaatgcgtgtacgtgt

SEQ ID NO: 9302356 - DNA, 22 bp, Homo sapiens
tatttagtgatagaagcaagga

SEQ ID NO: 9302357 - DNA, 22 bp, Homo sapiens
cagtcctggggaccaggctgag

SEQ ID NO: 9302358 - DNA, 22 bp, Homo sapiens
tcactcagtttttggcctctgc

SEQ ID NO: 9302359 - DNA, 22 bp, Homo sapiens
tcactcagctagcttcaggagc

SEQ ID NO: 9302360 - DNA, 22 bp, Homo sapiens
tcacttcccagacggggtggca

SEQ ID NO: 9302361 - DNA, 22 bp, Homo sapiens
tcactcagagatagcctcattt

SEQ ID NO: 9302362 - DNA, 22 bp, Homo sapiens
cagtgcagaggccagggaggat

SEQ ID NO: 9302363 - DNA, 22 bp, Homo sapiens
cagtgcagaggccagggaggat

SEQ ID NO: 9302364 - DNA, 22 bp, Homo sapiens
tcaccataggaacacagtcaga

SEQ ID NO: 9302365 - DNA, 22 bp, Homo sapiens
tcacattcttccctgacttctt

SEQ ID NO: 9302366 - DNA, 22 bp, Homo sapiens
cagtgctgttaataaacacaaa

SEQ ID NO: 9302367 - DNA, 22 bp, Homo sapiens
caggtctgttttcaaggtcagt

SEQ ID NO: 9302368 - DNA, 22 bp, Homo sapiens
caggtctggtgagagaacagtt

SEQ ID NO: 9302369 - DNA, 22 bp, Homo sapiens
caggtctgtattaacagagggt

SEQ ID NO: 9302370 - DNA, 18 bp, Homo sapiens
caggtctgtctgcctccc

SEQ ID NO: 9302371 - DNA, 22 bp, Homo sapiens
caggtctgtttccatcagtgct

SEQ ID NO: 9302372 - DNA, 22 bp, Homo sapiens
tatctctttattgacaataaaa

SEQ ID NO: 9302373 - DNA, 21 bp, Homo sapiens
tatctgctttttaaggctcac

SEQ ID NO: 9302374 - DNA, 23 bp, Homo sapiens
tattcctggtaagcctgtcactg

SEQ ID NO: 9302375 - DNA, 22 bp, Homo sapiens
tattcctgggttccagcccaga

SEQ ID NO: 9302376 - DNA, 22 bp, Homo sapiens
tattcctgggccccattccaga

SEQ ID NO: 9302377 - DNA, 18 bp, Homo sapiens
tattcctgattcatcttt

SEQ ID NO: 9302378 - DNA, 22 bp, Homo sapiens
tattcctgggctgtcctttgga

SEQ ID NO: 9302379 - DNA, 18 bp, Homo sapiens
tattcctgagtcatccct

SEQ ID NO: 9302380 - DNA, 18 bp, Homo sapiens
tattcctgattcatcttt

SEQ ID NO: 9302381 - DNA, 22 bp, Homo sapiens
tattcctcctttctgctcagcc

SEQ ID NO: 9302382 - DNA, 22 bp, Homo sapiens
tattgcttaaaaaatatgtgag

SEQ ID NO: 9302383 - DNA, 22 bp, Homo sapiens
tattgcttataatttgttgcaa

SEQ ID NO: 9302384 - DNA, 22 bp, Homo sapiens
tattgcttcagcttcctgggct

SEQ ID NO: 9302385 - DNA, 22 bp, Homo sapiens
tattgcttattcttgagagtca

SEQ ID NO: 9302386 - DNA, 22 bp, Homo sapiens
tattgcttggggtacaaggtat

SEQ ID NO: 9302387 - DNA, 21 bp, Homo sapiens
tattgcttgtaggtcatcctg

SEQ ID NO: 9302388 - DNA, 22 bp, Homo sapiens
tattgcttcataattgttgcca

SEQ ID NO: 9302389 - DNA, 22 bp, Homo sapiens
tattgctttcagttgctttgag

SEQ ID NO: 9302390 - DNA, 22 bp, Homo sapiens
tattgctttgtgtcataagcaa

SEQ ID NO: 9302391 - DNA, 22 bp, Homo sapiens
tattgctttctcagacgtttag

SEQ ID NO: 9302392 - DNA, 22 bp, Homo sapiens
tattgcttttatttctatggac

SEQ ID NO: 9302393 - DNA, 22 bp, Homo sapiens
tattcctggtccctaccacaga

SEQ ID NO: 9302394 - DNA, 22 bp, Homo sapiens
tattgctggaaaatggtgtgat

SEQ ID NO: 9302395 - DNA, 22 bp, Homo sapiens
tattgctgcctcgtccaggctg

SEQ ID NO: 9302396 - DNA, 22 bp, Homo sapiens
tattgctgatgctgaagggaag

SEQ ID NO: 9302397 - DNA, 22 bp, Homo sapiens
tattgctgccattttccaatgt

SEQ ID NO: 9302398 - DNA, 22 bp, Homo sapiens
tattgctgaggattgaggcttg

SEQ ID NO: 9302399 - DNA, 22 bp, Homo sapiens
tattgctgacttgttcagtgtt

SEQ ID NO: 9302400 - DNA, 22 bp, Homo sapiens
caggtctggcatcagctgtgtg

SEQ ID NO: 9302401 - DNA, 22 bp, Homo sapiens
caggtctgagtcacatgttcat

SEQ ID NO: 9302402 - DNA, 17 bp, Homo sapiens
caggtctgaggccaggc

SEQ ID NO: 9302403 - DNA, 22 bp, Homo sapiens
caggtctgaagagtcacatgcc

SEQ ID NO: 9302404 - DNA, 22 bp, Homo sapiens
caggtctctcccaagctacaat

SEQ ID NO: 9302405 - DNA, 22 bp, Homo sapiens
caggtctcgggttcagcagtga

SEQ ID NO: 9302406 - DNA, 22 bp, Homo sapiens
caggtctcgggttcagcagtga

SEQ ID NO: 9302407 - DNA, 22 bp, Homo sapiens
caggtccagaaaccaaaggatt

SEQ ID NO: 9302408 - DNA, 22 bp, Homo sapiens
caggtccacggcgcccaggggt

SEQ ID NO: 9302409 - DNA, 22 bp, Homo sapiens
caggtccaccatgcctcaagcc

SEQ ID NO: 9302410 - DNA, 22 bp, Homo sapiens
caggtctccagctcagggtcca

SEQ ID NO: 9302411 - DNA, 20 bp, Homo sapiens
caggtccagcacgtgcacgg

SEQ ID NO: 9302412 - DNA, 22 bp, Homo sapiens
caggtcgccagcaggaacgtca

SEQ ID NO: 9302413 - DNA, 22 bp, Homo sapiens
tataatctcctgagttaggtag

SEQ ID NO: 9302414 - DNA, 22 bp, Homo sapiens
tacatgtgggttaaaaacactc

SEQ ID NO: 9302415 - DNA, 22 bp, Homo sapiens
tagttttagtcccattttacag

SEQ ID NO: 9302416 - DNA, 20 bp, Homo sapiens
catatatacctagaagtgga

SEQ ID NO: 9302417 - DNA, 22 bp, Homo sapiens
catatattatggactgcagaat

SEQ ID NO: 9302418 - DNA, 22 bp, Homo sapiens
catatattctggttttcactgg

SEQ ID NO: 9302419 - DNA, 22 bp, Homo sapiens
catatcttctgacatgatcagg

SEQ ID NO: 9302420 - DNA, 22 bp, Homo sapiens
catataatgtttgaagatgtgg

SEQ ID NO: 9302421 - DNA, 22 bp, Homo sapiens
catagacaaagatcagaagagt

SEQ ID NO: 9302422 - DNA, 22 bp, Homo sapiens
catcacagtttgtcagaaatca

SEQ ID NO: 9302423 - DNA, 22 bp, Homo sapiens
catccagagtccaaggctgggc

SEQ ID NO: 9302424 - DNA, 22 bp, Homo sapiens
catccaggcaccacaaccagct

SEQ ID NO: 9302425 - DNA, 23 bp, Homo sapiens
catccaggagctgagtctgactg

SEQ ID NO: 9302426 - DNA, 22 bp, Homo sapiens
catccagctcctgggggccacc

SEQ ID NO: 9302427 - DNA, 23 bp, Homo sapiens
catccaggagctgagtctgactg

SEQ ID NO: 9302428 - DNA, 22 bp, Homo sapiens
catccagggcagccatggcctg

SEQ ID NO: 9302429 - DNA, 22 bp, Homo sapiens
tcagggcattcaagaggcctgg

SEQ ID NO: 9302430 - DNA, 20 bp, Homo sapiens
tcagggcatgggacagcccc

SEQ ID NO: 9302431 - DNA, 20 bp, Homo sapiens
tcagggcatgggacagcccc

SEQ ID NO: 9302432 - DNA, 22 bp, Homo sapiens
catatgtatttctcataattag

SEQ ID NO: 9302433 - DNA, 22 bp, Homo sapiens
cagtttggtacatagttcaaaa

SEQ ID NO: 9302434 - DNA, 22 bp, Homo sapiens
cagtttggtacttttctagcaa

SEQ ID NO: 9302435 - DNA, 22 bp, Homo sapiens
catacttttgccctgacattct

SEQ ID NO: 9302436 - DNA, 22 bp, Homo sapiens
catacatttatacacatctatg

SEQ ID NO: 9302437 - DNA, 22 bp, Homo sapiens
catacattgaatttgcacgtgt

SEQ ID NO: 9302438 - DNA, 22 bp, Homo sapiens
tcagccctacattaggtaagcc

SEQ ID NO: 9302439 - DNA, 22 bp, Homo sapiens
tcagcccagttttatcatctgt

SEQ ID NO: 9302440 - DNA, 22 bp, Homo sapiens
tcattttgcagagctgaggaac

SEQ ID NO: 9302441 - DNA, 22 bp, Homo sapiens
tcattttggggtttgtcatctt

SEQ ID NO: 9302442 - DNA, 22 bp, Homo sapiens
tcattttgtgccttatgaccgc

SEQ ID NO: 9302443 - DNA, 22 bp, Homo sapiens
catggctgcattggaatgggtt

SEQ ID NO: 9302444 - DNA, 19 bp, Homo sapiens
catggctgctgcttgggag

SEQ ID NO: 9302445 - DNA, 22 bp, Homo sapiens
catggctgcgagaagagtgggt

SEQ ID NO: 9302446 - DNA, 22 bp, Homo sapiens
catggctggccagtgggagtgg

SEQ ID NO: 9302447 - DNA, 22 bp, Homo sapiens
catggcttgtaataaatttata

SEQ ID NO: 9302448 - DNA, 22 bp, Homo sapiens
catggctttgttcatataattt

SEQ ID NO: 9302449 - DNA, 22 bp, Homo sapiens
catggcttctgatcaaggaact

SEQ ID NO: 9302450 - DNA, 22 bp, Homo sapiens
tccagcccacacctgaagctgg

SEQ ID NO: 9302451 - DNA, 22 bp, Homo sapiens
tccaggcaaagtgctgggctgc

SEQ ID NO: 9302452 - DNA, 22 bp, Homo sapiens
tccaggcaaagtgctgggctgc

SEQ ID NO: 9302453 - DNA, 22 bp, Homo sapiens
tccaggcaaaaaccaactacag

SEQ ID NO: 9302454 - DNA, 22 bp, Homo sapiens
tccaggcaaagggactagcagg

SEQ ID NO: 9302455 - DNA, 22 bp, Homo sapiens
tccaggcaaagccttgtagacg

SEQ ID NO: 9302456 - DNA, 22 bp, Homo sapiens
catgtcttggcttaggcacaga

SEQ ID NO: 9302457 - DNA, 22 bp, Homo sapiens
catctttcagtttataagtctg

SEQ ID NO: 9302458 - DNA, 22 bp, Homo sapiens
catctttcttagaactttcagt

SEQ ID NO: 9302459 - DNA, 22 bp, Homo sapiens
catctttgagacagcattaccc

SEQ ID NO: 9302460 - DNA, 22 bp, Homo sapiens
catctttaatttgtgacaacta

SEQ ID NO: 9302461 - DNA, 22 bp, Homo sapiens
catccctgacttctaggtgaca

SEQ ID NO: 9302462 - DNA, 22 bp, Homo sapiens
catctttaaaatgggaacaaca

SEQ ID NO: 9302463 - DNA, 22 bp, Homo sapiens
catctttaacaatttacaatgt

SEQ ID NO: 9302464 - DNA, 22 bp, Homo sapiens
catgagttcatctgcttctctt

SEQ ID NO: 9302465 - DNA, 22 bp, Homo sapiens
catgagtgtcatctcagcagct

SEQ ID NO: 9302466 - DNA, 22 bp, Homo sapiens
catgatggttcttacaaaggtg

SEQ ID NO: 9302467 - DNA, 22 bp, Homo sapiens
catgatataaagtagtagataa

SEQ ID NO: 9302468 - DNA, 22 bp, Homo sapiens
tcatttgttctcattctctact

SEQ ID NO: 9302469 - DNA, 22 bp, Homo sapiens
tcatttgttgctgttacctgag

SEQ ID NO: 9302470 - DNA, 22 bp, Homo sapiens
tctggcttctcctagagcaatg

SEQ ID NO: 9302471 - DNA, 22 bp, Homo sapiens
tctggcttctatgaatgtcctt

SEQ ID NO: 9302472 - DNA, 22 bp, Homo sapiens
tctggcttcaagtcccagctct

SEQ ID NO: 9302473 - DNA, 22 bp, Homo sapiens
tctggctgttttagatgagctc

SEQ ID NO: 9302474 - DNA, 22 bp, Homo sapiens
tctggctgttaggcctgacctt

SEQ ID NO: 9302475 - DNA, 22 bp, Homo sapiens
tctggctgttgttaggttcctg

SEQ ID NO: 9302476 - DNA, 22 bp, Homo sapiens
tctggctgttgttaggttcctg

SEQ ID NO: 9302477 - DNA, 22 bp, Homo sapiens
ccagctgtcagtgtgaaaataa

SEQ ID NO: 9302478 - DNA, 22 bp, Homo sapiens
tctggctttattccttcactga

SEQ ID NO: 9302479 - DNA, 22 bp, Homo sapiens
tctggcttgtgtccttccttgc

SEQ ID NO: 9302480 - DNA, 22 bp, Homo sapiens
ccagctggtttatattccccac

SEQ ID NO: 9302481 - DNA, 22 bp, Homo sapiens
tctggcttgtgtccttccttgc

SEQ ID NO: 9302482 - DNA, 22 bp, Homo sapiens
tctggcttgtctcagggtctga

SEQ ID NO: 9302483 - DNA, 22 bp, Homo sapiens
tctggcttgaacaattaggtaa

SEQ ID NO: 9302484 - DNA, 22 bp, Homo sapiens
tctggcttggcgctgccctctg

SEQ ID NO: 9302485 - DNA, 22 bp, Homo sapiens
tctggcttgctggcttggtccc

SEQ ID NO: 9302486 - DNA, 22 bp, Homo sapiens
ccagcttcatgggcatgcacca

SEQ ID NO: 9302487 - DNA, 22 bp, Homo sapiens
ccagctgtttctgatgctaggc

SEQ ID NO: 9302488 - DNA, 22 bp, Homo sapiens
ccagctggtgttccttaggacc

SEQ ID NO: 9302489 - DNA, 22 bp, Homo sapiens
ccagctggtgacatccccaacc

SEQ ID NO: 9302490 - DNA, 22 bp, Homo sapiens
ccagctggtgggtctttctctg

SEQ ID NO: 9302491 - DNA, 22 bp, Homo sapiens
ccagctggtctgtgctcatgtt

SEQ ID NO: 9302492 - DNA, 22 bp, Homo sapiens
ccagctggtctgtgctcatgtt

SEQ ID NO: 9302493 - DNA, 22 bp, Homo sapiens
ccagctgggattaagggaaaat

SEQ ID NO: 9302494 - DNA, 22 bp, Homo sapiens
ccagctgggtccctgctggggc

SEQ ID NO: 9302495 - DNA, 22 bp, Homo sapiens
ccagctggggaagtggggcata

SEQ ID NO: 9302496 - DNA, 22 bp, Homo sapiens
ccagctgggtccctgctggggc

SEQ ID NO: 9302497 - DNA, 22 bp, Homo sapiens
tctgccttggcaaccacagctt

SEQ ID NO: 9302498 - DNA, 22 bp, Homo sapiens
tctgcctctttcaggcctggca

SEQ ID NO: 9302499 - DNA, 22 bp, Homo sapiens
tctgccttggcaaccacagctt

SEQ ID NO: 9302500 - DNA, 22 bp, Homo sapiens
tctgccttgttgcaggcgctat

SEQ ID NO: 9302501 - DNA, 22 bp, Homo sapiens
tctgcgccctgtcgcctgctcc

SEQ ID NO: 9302502 - DNA, 22 bp, Homo sapiens
tctgcgtccatctgcctgcttg

SEQ ID NO: 9302503 - DNA, 22 bp, Homo sapiens
tctgcgttattgaaaagcagcc

SEQ ID NO: 9302504 - DNA, 22 bp, Homo sapiens
tctgtctggtccaggaagatgt

SEQ ID NO: 9302505 - DNA, 22 bp, Homo sapiens
tctgtcttagcatctttgctca

SEQ ID NO: 9302506 - DNA, 22 bp, Homo sapiens
tctgtcttagccatctcaggct

SEQ ID NO: 9302507 - DNA, 22 bp, Homo sapiens
ccagcttctccttatgtcctca

SEQ ID NO: 9302508 - DNA, 22 bp, Homo sapiens
ccagcttcggcaagcagacttt

SEQ ID NO: 9302509 - DNA, 22 bp, Homo sapiens
ccaggaacaaagccccatccac

SEQ ID NO: 9302510 - DNA, 22 bp, Homo sapiens
ccaggaggcaatatcaagtcca

SEQ ID NO: 9302511 - DNA, 22 bp, Homo sapiens
ccagcccaaacaagccgccttc

SEQ ID NO: 9302512 - DNA, 22 bp, Homo sapiens
tctgaggcatacccaggccccc

SEQ ID NO: 9302513 - DNA, 22 bp, Homo sapiens
tctgaggcataacctgttctgc

SEQ ID NO: 9302514 - DNA, 22 bp, Homo sapiens
tctgaggcataacctgttctgc

SEQ ID NO: 9302515 - DNA, 22 bp, Homo sapiens
tctcttgtaatttaaaaaatct

SEQ ID NO: 9302516 - DNA, 22 bp, Homo sapiens
tctcttggtgatagtctttctt

SEQ ID NO: 9302517 - DNA, 22 bp, Homo sapiens
tctcttgtaatttaaaaaatct

SEQ ID NO: 9302518 - DNA, 22 bp, Homo sapiens
tctcttggtgacttaaaatgtt

SEQ ID NO: 9302519 - DNA, 22 bp, Homo sapiens
tctctcttgaagtattagctag

SEQ ID NO: 9302520 - DNA, 23 bp, Homo sapiens
tctctcttagctatgcttatggc

SEQ ID NO: 9302521 - DNA, 22 bp, Homo sapiens
tctctcttcaacccttaactag

SEQ ID NO: 9302522 - DNA, 22 bp, Homo sapiens
tctcttggaaagcttgcccact

SEQ ID NO: 9302523 - DNA, 22 bp, Homo sapiens
tctcttggaacacttgctctta

SEQ ID NO: 9302524 - DNA, 18 bp, Homo sapiens
tctcttgcatcttctgta

SEQ ID NO: 9302525 - DNA, 22 bp, Homo sapiens
tctcttgggaggaaagagagaa

SEQ ID NO: 9302526 - DNA, 22 bp, Homo sapiens
tctcttggacatgtggctctgc

SEQ ID NO: 9302527 - DNA, 22 bp, Homo sapiens
tctcttaataagtaaatactga

SEQ ID NO: 9302528 - DNA, 22 bp, Homo sapiens
tctcttgaagattgaagacaaa

SEQ ID NO: 9302529 - DNA, 22 bp, Homo sapiens
tctcttgactgctaaaattaga

SEQ ID NO: 9302530 - DNA, 22 bp, Homo sapiens
tctcttgatatattacatagag

SEQ ID NO: 9302531 - DNA, 22 bp, Homo sapiens
ccagctctagccccatgtggct

SEQ ID NO: 9302532 - DNA, 22 bp, Homo sapiens
ccagctctcaaggctccctggg

SEQ ID NO: 9302533 - DNA, 22 bp, Homo sapiens
ccagctctcaaggctccctggg

SEQ ID NO: 9302534 - DNA, 22 bp, Homo sapiens
ccagctctcaaggctccctggg

SEQ ID NO: 9302535 - DNA, 22 bp, Homo sapiens
tctgccaccttcatcctccact

SEQ ID NO: 9302536 - DNA, 20 bp, Homo sapiens
tctgccacgtctggtgactg

SEQ ID NO: 9302537 - DNA, 22 bp, Homo sapiens
ccagctctaaacggctctgtgg

SEQ ID NO: 9302538 - DNA, 22 bp, Homo sapiens
ccagctctaaacggctctgtgg

SEQ ID NO: 9302539 - DNA, 22 bp, Homo sapiens
ccagctccttctgtctgtggag

SEQ ID NO: 9302540 - DNA, 22 bp, Homo sapiens
ccagctcctgggtcttagtcag

SEQ ID NO: 9302541 - DNA, 22 bp, Homo sapiens
ccagctcctcttcccagtgtca

SEQ ID NO: 9302542 - DNA, 22 bp, Homo sapiens
ccagctcctgagcatggtttcc

SEQ ID NO: 9302543 - DNA, 22 bp, Homo sapiens
ccagctcctcttgtctctagca

SEQ ID NO: 9302544 - DNA, 21 bp, Homo sapiens
ccagctccaggaccttggatc

SEQ ID NO: 9302545 - DNA, 23 bp, Homo sapiens
ccagctccgtgagcctcgggctc

SEQ ID NO: 9302546 - DNA, 22 bp, Homo sapiens
ccagctccaggactgggagctg

SEQ ID NO: 9302547 - DNA, 22 bp, Homo sapiens
tctgcctcgctaacagcagcca

SEQ ID NO: 9302548 - DNA, 19 bp, Homo sapiens
tctgcctctggtcaggctc

SEQ ID NO: 9302549 - DNA, 22 bp, Homo sapiens
tctgcctcctgcttgtcccgac

SEQ ID NO: 9302550 - DNA, 22 bp, Homo sapiens
tctgcctcctgcttgtcccgac

SEQ ID NO: 9302551 - DNA, 22 bp, Homo sapiens
tctgcctatgctgtacctttgt

SEQ ID NO: 9302552 - DNA, 20 bp, Homo sapiens
tctgccactgcactctgccc

SEQ ID NO: 9302553 - DNA, 22 bp, Homo sapiens
tctgccagaagttctgagagta

SEQ ID NO: 9302554 - DNA, 22 bp, Homo sapiens
ccagccttcacctgctctggtc

SEQ ID NO: 9302555 - DNA, 22 bp, Homo sapiens
ccagccttccagccaatggctg

SEQ ID NO: 9302556 - DNA, 22 bp, Homo sapiens
ccagcctggggaggcagcttct

SEQ ID NO: 9302557 - DNA, 22 bp, Homo sapiens
ccagcctgggtgttagaagaca

SEQ ID NO: 9302558 - DNA, 22 bp, Homo sapiens
ccagccttgggggatccaggac

SEQ ID NO: 9302559 - DNA, 19 bp, Homo sapiens
ccagcctttccagtgattg

SEQ ID NO: 9302560 - DNA, 22 bp, Homo sapiens
ccagccttgcaccgagccagcc

SEQ ID NO: 9302561 - DNA, 22 bp, Homo sapiens
ccagccttggctttcctagccc

SEQ ID NO: 9302562 - DNA, 22 bp, Homo sapiens
ccagccttgaatcagttgctgc

SEQ ID NO: 9302563 - DNA, 22 bp, Homo sapiens
ccagccttgactgccccagcac

SEQ ID NO: 9302564 - DNA, 22 bp, Homo sapiens
ccagccttctgagctgcctgga

SEQ ID NO: 9302565 - DNA, 22 bp, Homo sapiens
ccagccttctgggactctcatc

SEQ ID NO: 9302566 - DNA, 22 bp, Homo sapiens
ccagctccagcatagccaccat

SEQ ID NO: 9302567 - DNA, 22 bp, Homo sapiens
ccagctccactgtcagatgaga

SEQ ID NO: 9302568 - DNA, 22 bp, Homo sapiens
ccagctccaagtttgggcatca

SEQ ID NO: 9302569 - DNA, 22 bp, Homo sapiens
ccagctcaagcactgtgtgaag

SEQ ID NO: 9302570 - DNA, 22 bp, Homo sapiens
ccagctcaagcactgtgtgaag

SEQ ID NO: 9302571 - DNA, 22 bp, Homo sapiens
ccagcctggactgggtcttgtg

SEQ ID NO: 9302572 - DNA, 22 bp, Homo sapiens
tctgagtttataggttttccag

SEQ ID NO: 9302573 - DNA, 20 bp, Homo sapiens
tctgataactggttgtgatt

SEQ ID NO: 9302574 - DNA, 22 bp, Homo sapiens
tctgagtgagtgtaggcctgac

SEQ ID NO: 9302575 - DNA, 22 bp, Homo sapiens
tctgagtgatgttgagtcagaa

SEQ ID NO: 9302576 - DNA, 22 bp, Homo sapiens
tccctgcctgacagcacccacc

SEQ ID NO: 9302577 - DNA, 22 bp, Homo sapiens
catttgattactaaagataatt

SEQ ID NO: 9302578 - DNA, 22 bp, Homo sapiens
catttgcaaaccaacaagatga

SEQ ID NO: 9302579 - DNA, 22 bp, Homo sapiens
catttgattcctttactcttat

SEQ ID NO: 9302580 - DNA, 23 bp, Homo sapiens
catttgatcctcacaataaatgg

SEQ ID NO: 9302581 - DNA, 22 bp, Homo sapiens
catttgatcctcacaacaatct

SEQ ID NO: 9302582 - DNA, 20 bp, Homo sapiens
tccctgccttttactgctgg

SEQ ID NO: 9302583 - DNA, 22 bp, Homo sapiens
tccctgctgcactcacacctac

SEQ ID NO: 9302584 - DNA, 22 bp, Homo sapiens
tccctgcttgctctcagccctt

SEQ ID NO: 9302585 - DNA, 22 bp, Homo sapiens
catttacacttctaaccacaag

SEQ ID NO: 9302586 - DNA, 20 bp, Homo sapiens
tccaggcagacagctatggg

SEQ ID NO: 9302587 - DNA, 22 bp, Homo sapiens
tccaggcacgaggccctgtgca

SEQ ID NO: 9302588 - DNA, 22 bp, Homo sapiens
tccaggcacagagttggtcagt

SEQ ID NO: 9302589 - DNA, 22 bp, Homo sapiens
catttagaagtcttagaactat

SEQ ID NO: 9302590 - DNA, 22 bp, Homo sapiens
tcccagggattaggacatggat

SEQ ID NO: 9302591 - DNA, 22 bp, Homo sapiens
catttatataaaatgtccagaa

SEQ ID NO: 9302592 - DNA, 22 bp, Homo sapiens
catttatgaagcactttagagt

SEQ ID NO: 9302593 - DNA, 22 bp, Homo sapiens
tcccagggcttttctcatgctt

SEQ ID NO: 9302594 - DNA, 22 bp, Homo sapiens
tcccagggtcagtggtgaggcc

SEQ ID NO: 9302595 - DNA, 22 bp, Homo sapiens
ccacagagtccgcatttgaggc

SEQ ID NO: 9302596 - DNA, 20 bp, Homo sapiens
tcctgccacacctcagttgc

SEQ ID NO: 9302597 - DNA, 17 bp, Homo sapiens
tcctgccacctgtcagg

SEQ ID NO: 9302598 - DNA, 22 bp, Homo sapiens
tcctgcagtgtgtctcctgcac

SEQ ID NO: 9302599 - DNA, 20 bp, Homo sapiens
tcctgcagttcctaggaggg

SEQ ID NO: 9302600 - DNA, 22 bp, Homo sapiens
tcctgccaaaatatccctacct

SEQ ID NO: 9302601 - DNA, 20 bp, Homo sapiens
tcctgcagttcctaggaggg

SEQ ID NO: 9302602 - DNA, 22 bp, Homo sapiens
tcctgccaggagtgctggccct

SEQ ID NO: 9302603 - DNA, 22 bp, Homo sapiens
tcctgccatcccacccggctca

SEQ ID NO: 9302604 - DNA, 22 bp, Homo sapiens
tcctgccagcccacagactcat

SEQ ID NO: 9302605 - DNA, 23 bp, Homo sapiens
tcctgccagatgactcctttctt

SEQ ID NO: 9302606 - DNA, 17 bp, Homo sapiens
ccacagcctggcacttg

SEQ ID NO: 9302607 - DNA, 22 bp, Homo sapiens
ccacagctctagctccctccca

SEQ ID NO: 9302608 - DNA, 22 bp, Homo sapiens
tcctcccacataggacaatggg

SEQ ID NO: 9302609 - DNA, 22 bp, Homo sapiens
tcctcccaacttttccatctca

SEQ ID NO: 9302610 - DNA, 22 bp, Homo sapiens
tcctcccaacttttccatctca

SEQ ID NO: 9302611 - DNA, 22 bp, Homo sapiens
ccaagggaaggatgtatatgat

SEQ ID NO: 9302612 - DNA, 22 bp, Homo sapiens
tcctccccaaagcccagcctgg

SEQ ID NO: 9302613 - DNA, 23 bp, Homo sapiens
tcctcccaaatttcagcctcatt

SEQ ID NO: 9302614 - DNA, 22 bp, Homo sapiens
ccacacagataagtgttttcta

SEQ ID NO: 9302615 - DNA, 22 bp, Homo sapiens
ccacacagggggatgagttatt

SEQ ID NO: 9302616 - DNA, 22 bp, Homo sapiens
tctctaagataggaatacagtt

SEQ ID NO: 9302617 - DNA, 22 bp, Homo sapiens
ccagaggagcatggccttgaga

SEQ ID NO: 9302618 - DNA, 22 bp, Homo sapiens
ccagatgggctttagcaaatga

SEQ ID NO: 9302619 - DNA, 22 bp, Homo sapiens
ccagatggtccagagtctagcc

SEQ ID NO: 9302620 - DNA, 22 bp, Homo sapiens
ccagatggtgcctgtcagaagg

SEQ ID NO: 9302621 - DNA, 22 bp, Homo sapiens
ccagaggtgctgggagaggtct

SEQ ID NO: 9302622 - DNA, 22 bp, Homo sapiens
ccagaggtgccacagaaagagc

SEQ ID NO: 9302623 - DNA, 22 bp, Homo sapiens
ccagaggtgctctttggaagtg

SEQ ID NO: 9302624 - DNA, 22 bp, Homo sapiens
ccagagcttcggggcggctgta

SEQ ID NO: 9302625 - DNA, 18 bp, Homo sapiens
ccagagctggctcctcgc

SEQ ID NO: 9302626 - DNA, 20 bp, Homo sapiens
ccagagctgatggctgcccg

SEQ ID NO: 9302627 - DNA, 22 bp, Homo sapiens
ccagacagcagttaaaggacat

SEQ ID NO: 9302628 - DNA, 20 bp, Homo sapiens
ccagacagcacctgcctggt

SEQ ID NO: 9302629 - DNA, 22 bp, Homo sapiens
tctcccacagccgtgcttcaag

SEQ ID NO: 9302630 - DNA, 19 bp, Homo sapiens
tctccagttgctttcaggg

SEQ ID NO: 9302631 - DNA, 22 bp, Homo sapiens
tctccatctgtcattcttgtcc

SEQ ID NO: 9302632 - DNA, 22 bp, Homo sapiens
tctccagtatctttccaatgaa

SEQ ID NO: 9302633 - DNA, 23 bp, Homo sapiens
ccactctcccaccatatctgtat

SEQ ID NO: 9302634 - DNA, 22 bp, Homo sapiens
tcctggtgcctggagctctcca

SEQ ID NO: 9302635 - DNA, 22 bp, Homo sapiens
tcctggtgatcaaaattcattt

SEQ ID NO: 9302636 - DNA, 20 bp, Homo sapiens
tcctggtggatactgcttaa

SEQ ID NO: 9302637 - DNA, 22 bp, Homo sapiens
ccagaaggcggagattgcagtg

SEQ ID NO: 9302638 - DNA, 22 bp, Homo sapiens
ccagaagggctattgcagtgac

SEQ ID NO: 9302639 - DNA, 22 bp, Homo sapiens
ccactgccgatgttccatcttg

SEQ ID NO: 9302640 - DNA, 22 bp, Homo sapiens
ccactgccatgggctaggcatg

SEQ ID NO: 9302641 - DNA, 22 bp, Homo sapiens
ccactgcccaccccgacgtcta

SEQ ID NO: 9302642 - DNA, 22 bp, Homo sapiens
ccactgccatgggctaggcatg

SEQ ID NO: 9302643 - DNA, 22 bp, Homo sapiens
ccactgccagctttgtcctccc

SEQ ID NO: 9302644 - DNA, 22 bp, Homo sapiens
ccactgccagctttgtcctccc

SEQ ID NO: 9302645 - DNA, 22 bp, Homo sapiens
ccactgcctctccagggccatc

SEQ ID NO: 9302646 - DNA, 22 bp, Homo sapiens
ccactgcctatttgcagggccc

SEQ ID NO: 9302647 - DNA, 22 bp, Homo sapiens
ccagaaaaggagctgcaggatg

SEQ ID NO: 9302648 - DNA, 22 bp, Homo sapiens
ccactgcactccagccttggca

SEQ ID NO: 9302649 - DNA, 22 bp, Homo sapiens
ccactgagtgagcagagcaggg

SEQ ID NO: 9302650 - DNA, 22 bp, Homo sapiens
ccactgcacttcagcctgggtg

SEQ ID NO: 9302651 - DNA, 22 bp, Homo sapiens
ccactgaggaggtgaggacaga

SEQ ID NO: 9302652 - DNA, 22 bp, Homo sapiens
cagcttgggtcaggtgcctgct

SEQ ID NO: 9302653 - DNA, 22 bp, Homo sapiens
cagcttgggggcgctggcctca

SEQ ID NO: 9302654 - DNA, 22 bp, Homo sapiens
gttattcttttatagcaataca

SEQ ID NO: 9302655 - DNA, 22 bp, Homo sapiens
gttattctttgtatggtacatc

SEQ ID NO: 9302656 - DNA, 22 bp, Homo sapiens
gttattctgcacacctttaaaa

SEQ ID NO: 9302657 - DNA, 22 bp, Homo sapiens
gttattctcttggcctaattat

SEQ ID NO: 9302658 - DNA, 22 bp, Homo sapiens
gttattctgccaaacttccaca

SEQ ID NO: 9302659 - DNA, 18 bp, Homo sapiens
gttattctctctgcagta

SEQ ID NO: 9302660 - DNA, 22 bp, Homo sapiens
gttattcttggtggccctgctg

SEQ ID NO: 9302661 - DNA, 22 bp, Homo sapiens
gttattctgcgatgcaatcctg

SEQ ID NO: 9302662 - DNA, 22 bp, Homo sapiens
gttattctaccactatgtacag

SEQ ID NO: 9302663 - DNA, 22 bp, Homo sapiens
gttattctattaatgtgattgt

SEQ ID NO: 9302664 - DNA, 22 bp, Homo sapiens
gttattctagtgctcagccatt

SEQ ID NO: 9302665 - DNA, 22 bp, Homo sapiens
gttattctacagtcattgaagt

SEQ ID NO: 9302666 - DNA, 22 bp, Homo sapiens
gttattatttctctccttgcta

SEQ ID NO: 9302667 - DNA, 22 bp, Homo sapiens
gttattatcttgaggaatctgt

SEQ ID NO: 9302668 - DNA, 22 bp, Homo sapiens
gttattcccttgccagaggctt

SEQ ID NO: 9302669 - DNA, 22 bp, Homo sapiens
gttattccttaactgcatgaac

SEQ ID NO: 9302670 - DNA, 23 bp, Homo sapiens
gttaccttacttctgtgatcttc

SEQ ID NO: 9302671 - DNA, 22 bp, Homo sapiens
cagctttccccgtgcctcagcc

SEQ ID NO: 9302672 - DNA, 22 bp, Homo sapiens
cagctttattgaggtataattg

SEQ ID NO: 9302673 - DNA, 22 bp, Homo sapiens
caggaaaatggaatcacctgta

SEQ ID NO: 9302674 - DNA, 22 bp, Homo sapiens
caggaaaatctgcccacacaag

SEQ ID NO: 9302675 - DNA, 22 bp, Homo sapiens
cagctttgattcactgcctagt

SEQ ID NO: 9302676 - DNA, 22 bp, Homo sapiens
cagctttagagaaaacatattt

SEQ ID NO: 9302677 - DNA, 22 bp, Homo sapiens
cagctttaccaatatttggaaa

SEQ ID NO: 9302678 - DNA, 20 bp, Homo sapiens
cagctttagatctttgatta

SEQ ID NO: 9302679 - DNA, 22 bp, Homo sapiens
gttcacagaaggccagatggta

SEQ ID NO: 9302680 - DNA, 22 bp, Homo sapiens
gttcacaatttttactgattgg

SEQ ID NO: 9302681 - DNA, 22 bp, Homo sapiens
gttcacaagagttacagacaga

SEQ ID NO: 9302682 - DNA, 22 bp, Homo sapiens
caggaaaatgtcaatggaaagc

SEQ ID NO: 9302683 - DNA, 22 bp, Homo sapiens
cagcttattcagtaagcacata

SEQ ID NO: 9302684 - DNA, 22 bp, Homo sapiens
cagcttcagcgtgacaccagtg

SEQ ID NO: 9302685 - DNA, 22 bp, Homo sapiens
cagcttcagcgtgacaccagtg

SEQ ID NO: 9302686 - DNA, 22 bp, Homo sapiens
cagcttcagaccctgggctgca

SEQ ID NO: 9302687 - DNA, 22 bp, Homo sapiens
cagcttcagaagaagccgtgag

SEQ ID NO: 9302688 - DNA, 22 bp, Homo sapiens
cagcttcaactgcacagtcaac

SEQ ID NO: 9302689 - DNA, 22 bp, Homo sapiens
cagcttcaataatggctgatgg

SEQ ID NO: 9302690 - DNA, 22 bp, Homo sapiens
cagcttcaccagggccatggtt

SEQ ID NO: 9302691 - DNA, 22 bp, Homo sapiens
cagcttccgaccgggggctgca

SEQ ID NO: 9302692 - DNA, 22 bp, Homo sapiens
cagcttcattgcctgatgtctt

SEQ ID NO: 9302693 - DNA, 22 bp, Homo sapiens
cagcttcatgtccaggtactgt

SEQ ID NO: 9302694 - DNA, 22 bp, Homo sapiens
cagcttcccagctcactcataa

SEQ ID NO: 9302695 - DNA, 22 bp, Homo sapiens
cagcttccatctccactgccct

SEQ ID NO: 9302696 - DNA, 22 bp, Homo sapiens
cagctgtgctgattgctcagta

SEQ ID NO: 9302697 - DNA, 22 bp, Homo sapiens
gtgttttattggtgcagtcaga

SEQ ID NO: 9302698 - DNA, 22 bp, Homo sapiens
gttaaaagaacaactcggaggt

SEQ ID NO: 9302699 - DNA, 22 bp, Homo sapiens
gttacaaatgccaaagctgaga

SEQ ID NO: 9302700 - DNA, 22 bp, Homo sapiens
gttacaaatgccaaagctgaga

SEQ ID NO: 9302701 - DNA, 22 bp, Homo sapiens
gttacactctccaggcacttgg

SEQ ID NO: 9302702 - DNA, 22 bp, Homo sapiens
gttacaaatgtaaattctgggg

SEQ ID NO: 9302703 - DNA, 22 bp, Homo sapiens
gtgttttatcagacaaagtata

SEQ ID NO: 9302704 - DNA, 22 bp, Homo sapiens
gtgttttatcagacaaagtata

SEQ ID NO: 9302705 - DNA, 22 bp, Homo sapiens
gtgtttggtcagacgtccgggg

SEQ ID NO: 9302706 - DNA, 22 bp, Homo sapiens
gtgtgtgtatatatacacacac

SEQ ID NO: 9302707 - DNA, 22 bp, Homo sapiens
gtgtgtgtactctgtatataaa

SEQ ID NO: 9302708 - DNA, 22 bp, Homo sapiens
gtgtgtggggccttcgggtcct

SEQ ID NO: 9302709 - DNA, 22 bp, Homo sapiens
gtgtgtggaatgctcatttatt

SEQ ID NO: 9302710 - DNA, 22 bp, Homo sapiens
gtttacatgtactcattatact

SEQ ID NO: 9302711 - DNA, 22 bp, Homo sapiens
gtttacatgtttttctcttaca

SEQ ID NO: 9302712 - DNA, 22 bp, Homo sapiens
gtttattattcaacttcatgtt

SEQ ID NO: 9302713 - DNA, 22 bp, Homo sapiens
gtttattattcaacttcatgtt

SEQ ID NO: 9302714 - DNA, 22 bp, Homo sapiens
gtttattgggtattgtggagcc

SEQ ID NO: 9302715 - DNA, 22 bp, Homo sapiens
gtttattcttcagcaacatctg

SEQ ID NO: 9302716 - DNA, 22 bp, Homo sapiens
gtttattcttcagcaacatctg

SEQ ID NO: 9302717 - DNA, 22 bp, Homo sapiens
gtttattccagcaatctgctta

SEQ ID NO: 9302718 - DNA, 22 bp, Homo sapiens
gtttattccagcaatctgctta

SEQ ID NO: 9302719 - DNA, 22 bp, Homo sapiens
gtttattgataaaagctggaca

SEQ ID NO: 9302720 - DNA, 22 bp, Homo sapiens
gtttgctgccctctcctgtccg

SEQ ID NO: 9302721 - DNA, 22 bp, Homo sapiens
caggaagattagaccaagagct

SEQ ID NO: 9302722 - DNA, 22 bp, Homo sapiens
gtttacaacatgccaactgggc

SEQ ID NO: 9302723 - DNA, 21 bp, Homo sapiens
gtttacaaggctttgctcctg

SEQ ID NO: 9302724 - DNA, 22 bp, Homo sapiens
gtttacaacatcttgtccttca

SEQ ID NO: 9302725 - DNA, 19 bp, Homo sapiens
caggaacatggagggaggg

SEQ ID NO: 9302726 - DNA, 22 bp, Homo sapiens
caggaacacaatgagtctcaaa

SEQ ID NO: 9302727 - DNA, 22 bp, Homo sapiens
caggaacaatgtaagtctcatt

SEQ ID NO: 9302728 - DNA, 22 bp, Homo sapiens
gttggccattaattggaggaca

SEQ ID NO: 9302729 - DNA, 22 bp, Homo sapiens
gttggagtgcagcttgtgcgat

SEQ ID NO: 9302730 - DNA, 22 bp, Homo sapiens
caggaaaggtgtgtcatgatgg

SEQ ID NO: 9302731 - DNA, 22 bp, Homo sapiens
caggaaattctttttaacagaa

SEQ ID NO: 9302732 - DNA, 22 bp, Homo sapiens
caggaaattgcaacagtctgag

SEQ ID NO: 9302733 - DNA, 22 bp, Homo sapiens
gttcctcagttgtaaaaaatgt

SEQ ID NO: 9302734 - DNA, 22 bp, Homo sapiens
gttcctcatccagtcatgacta

SEQ ID NO: 9302735 - DNA, 22 bp, Homo sapiens
gttcctcatgagtaccccttaa

SEQ ID NO: 9302736 - DNA, 22 bp, Homo sapiens
gttcctgatgctttgaaattca

SEQ ID NO: 9302737 - DNA, 22 bp, Homo sapiens
gttcctcaaaaaggagagcccc

SEQ ID NO: 9302738 - DNA, 22 bp, Homo sapiens
gttcctcagcccttacttagcc

SEQ ID NO: 9302739 - DNA, 22 bp, Homo sapiens
gttcctcacgtggacagatgat

SEQ ID NO: 9302740 - DNA, 22 bp, Homo sapiens
gttcttaagaccacaataaaaa

SEQ ID NO: 9302741 - DNA, 22 bp, Homo sapiens
gttgctgaaagccctgactggc

SEQ ID NO: 9302742 - DNA, 22 bp, Homo sapiens
gttgctgaaattaatattggag

SEQ ID NO: 9302743 - DNA, 22 bp, Homo sapiens
gttgctttacagctggtgacag

SEQ ID NO: 9302744 - DNA, 20 bp, Homo sapiens
gttgctttagtctggtttgg

SEQ ID NO: 9302745 - DNA, 22 bp, Homo sapiens
gttgcttttctccatcacatgg

SEQ ID NO: 9302746 - DNA, 22 bp, Homo sapiens
gttgcttttttgataggtggaa

SEQ ID NO: 9302747 - DNA, 22 bp, Homo sapiens
gttgctgattaacactttgagt

SEQ ID NO: 9302748 - DNA, 22 bp, Homo sapiens
gttgctgatggcaagattccag

SEQ ID NO: 9302749 - DNA, 22 bp, Homo sapiens
gttgctgaaggcatgccagaga

SEQ ID NO: 9302750 - DNA, 22 bp, Homo sapiens
gtggcagtcggaagtcaggaga

SEQ ID NO: 9302751 - DNA, 22 bp, Homo sapiens
gtggcagtcatcaaggacagat

SEQ ID NO: 9302752 - DNA, 22 bp, Homo sapiens
gtggcagtgaggcaggagcagt

SEQ ID NO: 9302753 - DNA, 22 bp, Homo sapiens
gtggccaggccgactgccaggc

SEQ ID NO: 9302754 - DNA, 22 bp, Homo sapiens
gtggccagtgggaatgggctca

SEQ ID NO: 9302755 - DNA, 22 bp, Homo sapiens
gtggccaggtcagggacttgtg

SEQ ID NO: 9302756 - DNA, 22 bp, Homo sapiens
gtggccagtcccgatgcttgtt

SEQ ID NO: 9302757 - DNA, 22 bp, Homo sapiens
cagctctggcagagcccaaccc

SEQ ID NO: 9302758 - DNA, 22 bp, Homo sapiens
cagctctgtgcaggcctgggga

SEQ ID NO: 9302759 - DNA, 22 bp, Homo sapiens
gtggcactgatagtttcactct

SEQ ID NO: 9302760 - DNA, 22 bp, Homo sapiens
gtggcagaaactggcagaggag

SEQ ID NO: 9302761 - DNA, 22 bp, Homo sapiens
gtggcagagcaggagacaggac

SEQ ID NO: 9302762 - DNA, 22 bp, Homo sapiens
gtggcagagaacaaggagaggt

SEQ ID NO: 9302763 - DNA, 22 bp, Homo sapiens
gtggcagaagagtaggatgggc

SEQ ID NO: 9302764 - DNA, 17 bp, Homo sapiens
cagctcttcctccctct

SEQ ID NO: 9302765 - DNA, 22 bp, Homo sapiens
cagctcttcctaccctagttgg

SEQ ID NO: 9302766 - DNA, 22 bp, Homo sapiens
cagctcttcctagccatgccac

SEQ ID NO: 9302767 - DNA, 22 bp, Homo sapiens
cagctcttattttctctcctaa

SEQ ID NO: 9302768 - DNA, 22 bp, Homo sapiens
cagctctgttcatagatggtgc

SEQ ID NO: 9302769 - DNA, 22 bp, Homo sapiens
cagctgagtatgcattcaagca

SEQ ID NO: 9302770 - DNA, 22 bp, Homo sapiens
cagctgaggtcaaagaagcagg

SEQ ID NO: 9302771 - DNA, 22 bp, Homo sapiens
cagctgaggaatactagatgta

SEQ ID NO: 9302772 - DNA, 22 bp, Homo sapiens
cagctgagcatcactagtctgg

SEQ ID NO: 9302773 - DNA, 22 bp, Homo sapiens
cagctgagctcccaggccatca

SEQ ID NO: 9302774 - DNA, 22 bp, Homo sapiens
cagctgagttactctgaggtct

SEQ ID NO: 9302775 - DNA, 22 bp, Homo sapiens
gtggctaaaagatatgctgtga

SEQ ID NO: 9302776 - DNA, 15 bp, Homo sapiens
gtggctaatggggca

SEQ ID NO: 9302777 - DNA, 22 bp, Homo sapiens
gtggctaggcccaacggcagga

SEQ ID NO: 9302778 - DNA, 22 bp, Homo sapiens
gtggctagggacacagattgct

SEQ ID NO: 9302779 - DNA, 22 bp, Homo sapiens
gtgggaagtctctcggaggaag

SEQ ID NO: 9302780 - DNA, 22 bp, Homo sapiens
gtgggaagaacttcaagtggct

SEQ ID NO: 9302781 - DNA, 22 bp, Homo sapiens
gtgggtggggagctctctggag

SEQ ID NO: 9302782 - DNA, 22 bp, Homo sapiens
gtgggtggggagctctctggag

SEQ ID NO: 9302783 - DNA, 22 bp, Homo sapiens
gtgggtggatggctcacctcca

SEQ ID NO: 9302784 - DNA, 22 bp, Homo sapiens
gtgtgaaaatgtgcacaatatg

SEQ ID NO: 9302785 - DNA, 22 bp, Homo sapiens
gtgtctttattcctctatgttt

SEQ ID NO: 9302786 - DNA, 22 bp, Homo sapiens
gtgtctggaacgggtggtactc

SEQ ID NO: 9302787 - DNA, 22 bp, Homo sapiens
gtgtatgtgtttatagggaggt

SEQ ID NO: 9302788 - DNA, 22 bp, Homo sapiens
cagctggctgcggtgaggggac

SEQ ID NO: 9302789 - DNA, 22 bp, Homo sapiens
gtgtgcctttcacacactggga

SEQ ID NO: 9302790 - DNA, 22 bp, Homo sapiens
cagctgggtgatcttgggcagg

SEQ ID NO: 9302791 - DNA, 22 bp, Homo sapiens
cagctggctccacctctgggct

SEQ ID NO: 9302792 - DNA, 22 bp, Homo sapiens
cagctggcgcctggggaccaga

SEQ ID NO: 9302793 - DNA, 22 bp, Homo sapiens
gtgggtggatcacctgaggtca

SEQ ID NO: 9302794 - DNA, 22 bp, Homo sapiens
gtgggtggatcatgaggtcagg

SEQ ID NO: 9302795 - DNA, 22 bp, Homo sapiens
gtgggtggaggcgtcgagggca

SEQ ID NO: 9302796 - DNA, 22 bp, Homo sapiens
cagctgcttctcctccagagct

SEQ ID NO: 9302797 - DNA, 22 bp, Homo sapiens
cagctgctgcccttggctgcag

SEQ ID NO: 9302798 - DNA, 22 bp, Homo sapiens
cagctgctgatggcctgacaga

SEQ ID NO: 9302799 - DNA, 22 bp, Homo sapiens
cagctgctgagaagcctccctt

SEQ ID NO: 9302800 - DNA, 22 bp, Homo sapiens
gtggggctcccatctcctggct

SEQ ID NO: 9302801 - DNA, 22 bp, Homo sapiens
gtggggcagtggcctgggagca

SEQ ID NO: 9302802 - DNA, 22 bp, Homo sapiens
gtggggagggagatgctgaagt

SEQ ID NO: 9302803 - DNA, 22 bp, Homo sapiens
gtggggagtgttctgtgattgg

SEQ ID NO: 9302804 - DNA, 22 bp, Homo sapiens
gtggggctaaaaactgtgcagt

SEQ ID NO: 9302805 - DNA, 22 bp, Homo sapiens
cagctgccacaggactttctga

SEQ ID NO: 9302806 - DNA, 22 bp, Homo sapiens
caggaggcagaggttgcagtga

SEQ ID NO: 9302807 - DNA, 22 bp, Homo sapiens
caggaggcagaggatgcccagt

SEQ ID NO: 9302808 - DNA, 22 bp, Homo sapiens
caggaggcagaggttgcagcga

SEQ ID NO: 9302809 - DNA, 22 bp, Homo sapiens
caggaggcagaggatgcccagt

SEQ ID NO: 9302810 - DNA, 22 bp, Homo sapiens
caggaggcagcgctctcaggac

SEQ ID NO: 9302811 - DNA, 22 bp, Homo sapiens
caggaggcagcgctctcaggac

SEQ ID NO: 9302812 - DNA, 20 bp, Homo sapiens
caggaggcaaggtcaaggtc

SEQ ID NO: 9302813 - DNA, 22 bp, Homo sapiens
caggagctggatctccttgcgg

SEQ ID NO: 9302814 - DNA, 22 bp, Homo sapiens
caggagcttctgcccatggcca

SEQ ID NO: 9302815 - DNA, 22 bp, Homo sapiens
caggagcttctgcccatggcca

SEQ ID NO: 9302816 - DNA, 22 bp, Homo sapiens
caggagctgggtctggaagcag

SEQ ID NO: 9302817 - DNA, 22 bp, Homo sapiens
caggaggcccacaggcccctgc

SEQ ID NO: 9302818 - DNA, 22 bp, Homo sapiens
caggaggcccacaggcccctgc

SEQ ID NO: 9302819 - DNA, 22 bp, Homo sapiens
caggaggcccggccacagccca

SEQ ID NO: 9302820 - DNA, 22 bp, Homo sapiens
caggaggcccaaagggcgcaga

SEQ ID NO: 9302821 - DNA, 22 bp, Homo sapiens
caggaggccaactgtgggactt

SEQ ID NO: 9302822 - DNA, 22 bp, Homo sapiens
caggaggcccggccacagccca

SEQ ID NO: 9302823 - DNA, 22 bp, Homo sapiens
caggaggcgtcttcagtttgtt

SEQ ID NO: 9302824 - DNA, 22 bp, Homo sapiens
caggaggctttgggatccaagt

SEQ ID NO: 9302825 - DNA, 22 bp, Homo sapiens
caggaggctcctagggctctgt

SEQ ID NO: 9302826 - DNA, 22 bp, Homo sapiens
caggagggcccgagactcttcc

SEQ ID NO: 9302827 - DNA, 22 bp, Homo sapiens
caggagtttggtgatttcttgc

SEQ ID NO: 9302828 - DNA, 22 bp, Homo sapiens
taaagtcatctttacatctttg

SEQ ID NO: 9302829 - DNA, 22 bp, Homo sapiens
taaagcatgtactgtgtgctag

SEQ ID NO: 9302830 - DNA, 22 bp, Homo sapiens
taaagccacgctggaaatcagg

SEQ ID NO: 9302831 - DNA, 22 bp, Homo sapiens
taaagcatttttgaaattatga

SEQ ID NO: 9302832 - DNA, 22 bp, Homo sapiens
taaagctacacattattaatcc

SEQ ID NO: 9302833 - DNA, 22 bp, Homo sapiens
taaatgctttctatgaaagagg

SEQ ID NO: 9302834 - DNA, 22 bp, Homo sapiens
caggagctcagatgacatctca

SEQ ID NO: 9302835 - DNA, 22 bp, Homo sapiens
caggagctctcatcgtcagggc

SEQ ID NO: 9302836 - DNA, 22 bp, Homo sapiens
caggagctcttaaggatgtgat

SEQ ID NO: 9302837 - DNA, 22 bp, Homo sapiens
taaagcataatgaatatctaga

SEQ ID NO: 9302838 - DNA, 22 bp, Homo sapiens
taaagcagtggttctcaaactt

SEQ ID NO: 9302839 - DNA, 22 bp, Homo sapiens
caggagctcaagaccaccctgg

SEQ ID NO: 9302840 - DNA, 22 bp, Homo sapiens
caggagccctggtgggtggaca

SEQ ID NO: 9302841 - DNA, 22 bp, Homo sapiens
caggagccctggtgggtggaca

SEQ ID NO: 9302842 - DNA, 22 bp, Homo sapiens
caggagagatatgagtccccac

SEQ ID NO: 9302843 - DNA, 22 bp, Homo sapiens
caggagagcccgggtccgggct

SEQ ID NO: 9302844 - DNA, 22 bp, Homo sapiens
caggaccccatattcactgaac

SEQ ID NO: 9302845 - DNA, 22 bp, Homo sapiens
caggacagttggcatctgctgc

SEQ ID NO: 9302846 - DNA, 19 bp, Homo sapiens
caggacagtttgccaagaa

SEQ ID NO: 9302847 - DNA, 23 bp, Homo sapiens
caggacatgggaggaagtatggc

SEQ ID NO: 9302848 - DNA, 22 bp, Homo sapiens
caggacattgatccattggcac

SEQ ID NO: 9302849 - DNA, 22 bp, Homo sapiens
caggacagtttgctttgccctg

SEQ ID NO: 9302850 - DNA, 22 bp, Homo sapiens
caggacagtgcaggtccatcct

SEQ ID NO: 9302851 - DNA, 22 bp, Homo sapiens
taaactctgcattcttttaaaa

SEQ ID NO: 9302852 - DNA, 22 bp, Homo sapiens
taaactacagtggtaatgtctc

SEQ ID NO: 9302853 - DNA, 22 bp, Homo sapiens
taaactacttccatctagagat

SEQ ID NO: 9302854 - DNA, 22 bp, Homo sapiens
taaaccatgcagacagctccat

SEQ ID NO: 9302855 - DNA, 22 bp, Homo sapiens
taaaccaagtgtccatattagt

SEQ ID NO: 9302856 - DNA, 22 bp, Homo sapiens
taaacatttgttattcttgttt

SEQ ID NO: 9302857 - DNA, 22 bp, Homo sapiens
taaaaatcttatgaatggcaag

SEQ ID NO: 9302858 - DNA, 22 bp, Homo sapiens
gttttcctgagcccagagatgc

SEQ ID NO: 9302859 - DNA, 22 bp, Homo sapiens
gttttctgattagcaaatctga

SEQ ID NO: 9302860 - DNA, 22 bp, Homo sapiens
gttttctgcctgaaggtgacca

SEQ ID NO: 9302861 - DNA, 22 bp, Homo sapiens
gttttctgccggtggtgggctc

SEQ ID NO: 9302862 - DNA, 19 bp, Homo sapiens
gttttctgatcttgccccc

SEQ ID NO: 9302863 - DNA, 22 bp, Homo sapiens
gttttctggcagttattcctta

SEQ ID NO: 9302864 - DNA, 22 bp, Homo sapiens
taaaaaacattactctgtcctg

SEQ ID NO: 9302865 - DNA, 22 bp, Homo sapiens
gttttctgtttcttaacggcat

SEQ ID NO: 9302866 - DNA, 22 bp, Homo sapiens
caggacaggccctgtggggtct

SEQ ID NO: 9302867 - DNA, 22 bp, Homo sapiens
caggacaggtgttctagatcag

SEQ ID NO: 9302868 - DNA, 22 bp, Homo sapiens
caggacagtataggctttagga

SEQ ID NO: 9302869 - DNA, 22 bp, Homo sapiens
caggacaggagtggggtcaaag

SEQ ID NO: 9302870 - DNA, 22 bp, Homo sapiens
caggacactacagatgggaggg

SEQ ID NO: 9302871 - DNA, 22 bp, Homo sapiens
caggacagctcaacacctcctc

SEQ ID NO: 9302872 - DNA, 22 bp, Homo sapiens
caggacagctgggccaccacca

SEQ ID NO: 9302873 - DNA, 22 bp, Homo sapiens
caggaatgttgcatgtgatctt

SEQ ID NO: 9302874 - DNA, 22 bp, Homo sapiens
caggaatgtttgtgctccttta

SEQ ID NO: 9302875 - DNA, 22 bp, Homo sapiens
caggaatgtccttgtcatttca

SEQ ID NO: 9302876 - DNA, 22 bp, Homo sapiens
caggaatgtgagggttccctgc

SEQ ID NO: 9302877 - DNA, 22 bp, Homo sapiens
caggaatgtcccatccccttca

SEQ ID NO: 9302878 - DNA, 22 bp, Homo sapiens
caggaatgccaaccagtgcatg

SEQ ID NO: 9302879 - DNA, 22 bp, Homo sapiens
caggaatgatctgctgagtgat

SEQ ID NO: 9302880 - DNA, 22 bp, Homo sapiens
caggaatgcattctagaatggc

SEQ ID NO: 9302881 - DNA, 22 bp, Homo sapiens
caggaatgatattcgaggagat

SEQ ID NO: 9302882 - DNA, 19 bp, Homo sapiens
caggaatgaggtaatggct

SEQ ID NO: 9302883 - DNA, 22 bp, Homo sapiens
caggaatgagttctggtgctct

SEQ ID NO: 9302884 - DNA, 22 bp, Homo sapiens
caggaatgaggtcgtaagtgtc

SEQ ID NO: 9302885 - DNA, 22 bp, Homo sapiens
caggaatggttgggactatgtt

SEQ ID NO: 9302886 - DNA, 22 bp, Homo sapiens
caggaatggttaatctaaagtg

SEQ ID NO: 9302887 - DNA, 22 bp, Homo sapiens
caggaatgggtgacagtcagct

SEQ ID NO: 9302888 - DNA, 22 bp, Homo sapiens
caggaatgtagcagcgatggaa

SEQ ID NO: 9302889 - DNA, 22 bp, Homo sapiens
caggaatgtatgatacagtggt

SEQ ID NO: 9302890 - DNA, 22 bp, Homo sapiens
caggaatgccttcttcagccat

SEQ ID NO: 9302891 - DNA, 22 bp, Homo sapiens
caggaatggaggcatttatgaa

SEQ ID NO: 9302892 - DNA, 18 bp, Homo sapiens
caggaatggatgggattt

SEQ ID NO: 9302893 - DNA, 22 bp, Homo sapiens
gtttggctatttattctcagtg

SEQ ID NO: 9302894 - DNA, 22 bp, Homo sapiens
gtttggctctgggtgcctgtgc

SEQ ID NO: 9302895 - DNA, 22 bp, Homo sapiens
gtttggctttctctctatcctg

SEQ ID NO: 9302896 - DNA, 22 bp, Homo sapiens
caggaatgactgcagatggggc

SEQ ID NO: 9302897 - DNA, 22 bp, Homo sapiens
caggaatgacccaacagtttca

SEQ ID NO: 9302898 - DNA, 22 bp, Homo sapiens
caggaatgaaaggtcagggttg

SEQ ID NO: 9302899 - DNA, 22 bp, Homo sapiens
tacatattgtccatagttgctt

SEQ ID NO: 9302900 - DNA, 22 bp, Homo sapiens
tacatatttgtctttgtactgt

SEQ ID NO: 9302901 - DNA, 22 bp, Homo sapiens
tacatattcaacgttcagtatt

SEQ ID NO: 9302902 - DNA, 22 bp, Homo sapiens
caggcagggagccactgtataa

SEQ ID NO: 9302903 - DNA, 22 bp, Homo sapiens
caggcagggagccactgtataa

SEQ ID NO: 9302904 - DNA, 22 bp, Homo sapiens
tacaaatgagttgtatgaacca

SEQ ID NO: 9302905 - DNA, 22 bp, Homo sapiens
tacaaatgagttgtatgaacca

SEQ ID NO: 9302906 - DNA, 22 bp, Homo sapiens
tacaaatgggttaaaatatagt

SEQ ID NO: 9302907 - DNA, 22 bp, Homo sapiens
tacaaatgcctgacacacagat

SEQ ID NO: 9302908 - DNA, 22 bp, Homo sapiens
tacaatagggaggtttagggga

SEQ ID NO: 9302909 - DNA, 22 bp, Homo sapiens
tacagggctgagtgagacatgg

SEQ ID NO: 9302910 - DNA, 22 bp, Homo sapiens
tacagggcatgtgcagacacat

SEQ ID NO: 9302911 - DNA, 22 bp, Homo sapiens
taattgctttatcctgttagaa

SEQ ID NO: 9302912 - DNA, 22 bp, Homo sapiens
taattgcttgtaaagccctgaa

SEQ ID NO: 9302913 - DNA, 22 bp, Homo sapiens
caggcagagcaactggtccaga

SEQ ID NO: 9302914 - DNA, 22 bp, Homo sapiens
taatttacagagatacagtcag

SEQ ID NO: 9302915 - DNA, 22 bp, Homo sapiens
caggcagactttgagaatgatg

SEQ ID NO: 9302916 - DNA, 22 bp, Homo sapiens
caggcagacatttttgacatag

SEQ ID NO: 9302917 - DNA, 22 bp, Homo sapiens
caggcagagaactcatccgtga

SEQ ID NO: 9302918 - DNA, 22 bp, Homo sapiens
caggcagagaggagcatttaat

SEQ ID NO: 9302919 - DNA, 22 bp, Homo sapiens
caggcagagaccctctcctaaa

SEQ ID NO: 9302920 - DNA, 22 bp, Homo sapiens
caggcagagacgtcagtgtagg

SEQ ID NO: 9302921 - DNA, 22 bp, Homo sapiens
caggcagaatgaccgacctcgc

SEQ ID NO: 9302922 - DNA, 22 bp, Homo sapiens
caggcagaatgagattacttca

SEQ ID NO: 9302923 - DNA, 17 bp, Homo sapiens
caggcagacatgtaagc

SEQ ID NO: 9302924 - DNA, 22 bp, Homo sapiens
caggcagaaggaagtaccaggc

SEQ ID NO: 9302925 - DNA, 22 bp, Homo sapiens
caggcagaagaagtggaaggac

SEQ ID NO: 9302926 - DNA, 22 bp, Homo sapiens
caggcagctgggtcaccgtccc

SEQ ID NO: 9302927 - DNA, 22 bp, Homo sapiens
caggcagctgcgacaagagagc

SEQ ID NO: 9302928 - DNA, 22 bp, Homo sapiens
caggcagctgaggactttgcta

SEQ ID NO: 9302929 - DNA, 22 bp, Homo sapiens
caggcaggctgctttttgttca

SEQ ID NO: 9302930 - DNA, 23 bp, Homo sapiens
caggcaggatgaggactacactc

SEQ ID NO: 9302931 - DNA, 22 bp, Homo sapiens
caggcaggagccagggattcca

SEQ ID NO: 9302932 - DNA, 22 bp, Homo sapiens
caggcaggagaggaggatttct

SEQ ID NO: 9302933 - DNA, 22 bp, Homo sapiens
caggcaggagacatttggttgg

SEQ ID NO: 9302934 - DNA, 22 bp, Homo sapiens
caggcagctctgcttttcctaa

SEQ ID NO: 9302935 - DNA, 22 bp, Homo sapiens
caggcagctgactgtcagatat

SEQ ID NO: 9302936 - DNA, 22 bp, Homo sapiens
caggcagctgactgtcagatat

SEQ ID NO: 9302937 - DNA, 22 bp, Homo sapiens
caggcagccctgcaccaagtgt

SEQ ID NO: 9302938 - DNA, 22 bp, Homo sapiens
caggcagccaggggacctgtcc

SEQ ID NO: 9302939 - DNA, 22 bp, Homo sapiens
caggcagctcgatgccttgttg

SEQ ID NO: 9302940 - DNA, 22 bp, Homo sapiens
caggatggtgtgagtgtgagga

SEQ ID NO: 9302941 - DNA, 22 bp, Homo sapiens
caggcaaggaggcactgaggga

SEQ ID NO: 9302942 - DNA, 22 bp, Homo sapiens
caggcaaggagctggctcaagt

SEQ ID NO: 9302943 - DNA, 22 bp, Homo sapiens
caggcaagattagagatgagca

SEQ ID NO: 9302944 - DNA, 22 bp, Homo sapiens
caggcacaggggaatgtctttt

SEQ ID NO: 9302945 - DNA, 22 bp, Homo sapiens
caggcacagctaagactggcca

SEQ ID NO: 9302946 - DNA, 22 bp, Homo sapiens
caggcacagagagaataccttt

SEQ ID NO: 9302947 - DNA, 22 bp, Homo sapiens
caggcacaagatcggctagata

SEQ ID NO: 9302948 - DNA, 22 bp, Homo sapiens
caggcacactgtctacactgag

SEQ ID NO: 9302949 - DNA, 22 bp, Homo sapiens
taagacacaaatatcttttaca

SEQ ID NO: 9302950 - DNA, 19 bp, Homo sapiens
taagacacaaatgcaagcc

SEQ ID NO: 9302951 - DNA, 22 bp, Homo sapiens
caggcaccaacttcctggggag

SEQ ID NO: 9302952 - DNA, 22 bp, Homo sapiens
caggcacatgggagctcatcat

SEQ ID NO: 9302953 - DNA, 22 bp, Homo sapiens
caggcacatgggagctcatcat

SEQ ID NO: 9302954 - DNA, 22 bp, Homo sapiens
caggcacagtgttgctgttcaa

SEQ ID NO: 9302955 - DNA, 22 bp, Homo sapiens
caggcacagtggggtcctctct

SEQ ID NO: 9302956 - DNA, 22 bp, Homo sapiens
taagacacgggctgatctaaag

SEQ ID NO: 9302957 - DNA, 23 bp, Homo sapiens
taagacacccgactccagagatg

SEQ ID NO: 9302958 - DNA, 22 bp, Homo sapiens
taagacacctctctgcccttca

SEQ ID NO: 9302959 - DNA, 22 bp, Homo sapiens
taagacacagtccgcactctct

SEQ ID NO: 9302960 - DNA, 22 bp, Homo sapiens
taagacacatgcgtacaagata

SEQ ID NO: 9302961 - DNA, 22 bp, Homo sapiens
taagacacattggagtagatga

SEQ ID NO: 9302962 - DNA, 22 bp, Homo sapiens
taagacacattgagaaacacaa

SEQ ID NO: 9302963 - DNA, 22 bp, Homo sapiens
taagacacattcatatctgtct

SEQ ID NO: 9302964 - DNA, 22 bp, Homo sapiens
taagcaaaagtcgagtgtgagc

SEQ ID NO: 9302965 - DNA, 22 bp, Homo sapiens
taagcaaaggattttgatcttt

SEQ ID NO: 9302966 - DNA, 22 bp, Homo sapiens
taagatgtgacaggcctggaat

SEQ ID NO: 9302967 - DNA, 22 bp, Homo sapiens
taagcaaatagctagatcagag

SEQ ID NO: 9302968 - DNA, 22 bp, Homo sapiens
taaggcacacagttgctgcatg

SEQ ID NO: 9302969 - DNA, 22 bp, Homo sapiens
taaggcagaaatatgagcaggg

SEQ ID NO: 9302970 - DNA, 22 bp, Homo sapiens
taaggcacctgtccaggctggg

SEQ ID NO: 9302971 - DNA, 22 bp, Homo sapiens
taaggcacgcataagagggggc

SEQ ID NO: 9302972 - DNA, 22 bp, Homo sapiens
taaggcagccgctcagagaggt

SEQ ID NO: 9302973 - DNA, 22 bp, Homo sapiens
caggcagaaattttgtttcatt

SEQ ID NO: 9302974 - DNA, 22 bp, Homo sapiens
caggcagaaagtattctgtgta

SEQ ID NO: 9302975 - DNA, 22 bp, Homo sapiens
taaggcagatgtggaatcaatt

SEQ ID NO: 9302976 - DNA, 22 bp, Homo sapiens
taaggcagaggtaccactaggc

SEQ ID NO: 9302977 - DNA, 22 bp, Homo sapiens
taaggcagaaatatgagcaggg

SEQ ID NO: 9302978 - DNA, 19 bp, Homo sapiens
taaggcagcagtgacaggc

SEQ ID NO: 9302979 - DNA, 19 bp, Homo sapiens
taaggcagcagtgacaggc

SEQ ID NO: 9302980 - DNA, 22 bp, Homo sapiens
taaggcagcataattaggccac

SEQ ID NO: 9302981 - DNA, 22 bp, Homo sapiens
taaggcagccgctcagagaggt

SEQ ID NO: 9302982 - DNA, 22 bp, Homo sapiens
taactttcttcatatgtgaacc

SEQ ID NO: 9302983 - DNA, 22 bp, Homo sapiens
taacatttaaatttttcacata

SEQ ID NO: 9302984 - DNA, 22 bp, Homo sapiens
caggatggtctcgatctcctga

SEQ ID NO: 9302985 - DNA, 22 bp, Homo sapiens
caggatgccatctgctgctgct

SEQ ID NO: 9302986 - DNA, 22 bp, Homo sapiens
caggatgcagtgggacccaggg

SEQ ID NO: 9302987 - DNA, 22 bp, Homo sapiens
caggatcctggctgcatggacg

SEQ ID NO: 9302988 - DNA, 22 bp, Homo sapiens
caggatcatgctgaatctggca

SEQ ID NO: 9302989 - DNA, 22 bp, Homo sapiens
taacagaaatagaaatgagagt

SEQ ID NO: 9302990 - DNA, 22 bp, Homo sapiens
taacattcttaacttagaaaca

SEQ ID NO: 9302991 - DNA, 22 bp, Homo sapiens
taacattccctttgtgccaagg

SEQ ID NO: 9302992 - DNA, 22 bp, Homo sapiens
taacattcctcaaagttttcag

SEQ ID NO: 9302993 - DNA, 22 bp, Homo sapiens
taacattccatggatctgcaga

SEQ ID NO: 9302994 - DNA, 22 bp, Homo sapiens
taacattcttaacttagaaaca

SEQ ID NO: 9302995 - DNA, 22 bp, Homo sapiens
taacaatacccattctaattac

SEQ ID NO: 9302996 - DNA, 22 bp, Homo sapiens
ttcccttcctcactctacttgt

SEQ ID NO: 9302997 - DNA, 21 bp, Homo sapiens
ttcccttctggttttgagaga

SEQ ID NO: 9302998 - DNA, 22 bp, Homo sapiens
ctaaggcaccgaggcaggagcg

SEQ ID NO: 9302999 - DNA, 22 bp, Homo sapiens
ttccaaatgttggacaactgta

SEQ ID NO: 9303000 - DNA, 22 bp, Homo sapiens
ttccaggcaaaggaagcagctt

SEQ ID NO: 9303001 - DNA, 22 bp, Homo sapiens
ctaaggcaggtccattccagga

SEQ ID NO: 9303002 - DNA, 22 bp, Homo sapiens
ctaagggcttgctggagccagg

SEQ ID NO: 9303003 - DNA, 22 bp, Homo sapiens
ctaatgaagctgctttctatga

SEQ ID NO: 9303004 - DNA, 20 bp, Homo sapiens
ctaattacagattttggaca

SEQ ID NO: 9303005 - DNA, 22 bp, Homo sapiens
ttccttcccctagctgagaaac

SEQ ID NO: 9303006 - DNA, 22 bp, Homo sapiens
ctacaaagctcttctacaggca

SEQ ID NO: 9303007 - DNA, 22 bp, Homo sapiens
ctacaaagaatttctctagctc

SEQ ID NO: 9303008 - DNA, 23 bp, Homo sapiens
ctacaaagtatgagaagacccct

SEQ ID NO: 9303009 - DNA, 22 bp, Homo sapiens
ctacaaagtaccacagactggg

SEQ ID NO: 9303010 - DNA, 22 bp, Homo sapiens
ctacaaagaaagctgaggggaa

SEQ ID NO: 9303011 - DNA, 22 bp, Homo sapiens
ctacaaagaaagtatactggac

SEQ ID NO: 9303012 - DNA, 22 bp, Homo sapiens
ctacaaaagtaattgtggtttt

SEQ ID NO: 9303013 - DNA, 20 bp, Homo sapiens
ttcctggggaatgatagaag

SEQ ID NO: 9303014 - DNA, 22 bp, Homo sapiens
ttcctggggacttaccgtcatt

SEQ ID NO: 9303015 - DNA, 22 bp, Homo sapiens
ttccttcagttcagggaaccct

SEQ ID NO: 9303016 - DNA, 22 bp, Homo sapiens
ttccttcagcaagtcctgagca

SEQ ID NO: 9303017 - DNA, 22 bp, Homo sapiens
ctacaaatatgttaaggtgttt

SEQ ID NO: 9303018 - DNA, 22 bp, Homo sapiens
ctacaaatccacaaggcacttt

SEQ ID NO: 9303019 - DNA, 22 bp, Homo sapiens
ctacaaatataaaacacagata

SEQ ID NO: 9303020 - DNA, 21 bp, Homo sapiens
cggaaactcggctctggttcc

SEQ ID NO: 9303021 - DNA, 22 bp, Homo sapiens
cgctgggggaacttcagccaat

SEQ ID NO: 9303022 - DNA, 22 bp, Homo sapiens
cggcaggtgtgctcactctgcc

SEQ ID NO: 9303023 - DNA, 22 bp, Homo sapiens
cgctggggctttttgcttgaga

SEQ ID NO: 9303024 - DNA, 22 bp, Homo sapiens
cgctgggggaacagcgagggtg

SEQ ID NO: 9303025 - DNA, 22 bp, Homo sapiens
cgctgggcatggtgccttattt

SEQ ID NO: 9303026 - DNA, 22 bp, Homo sapiens
cctgggtggttccggcaaggag

SEQ ID NO: 9303027 - DNA, 22 bp, Homo sapiens
cctgggtggctgcctgcctttc

SEQ ID NO: 9303028 - DNA, 22 bp, Homo sapiens
cctgggtggcagaggttgcagt

SEQ ID NO: 9303029 - DNA, 22 bp, Homo sapiens
cctgggtgcccggcccttctct

SEQ ID NO: 9303030 - DNA, 22 bp, Homo sapiens
ttcacatataatgtctttaaaa

SEQ ID NO: 9303031 - DNA, 22 bp, Homo sapiens
ttcacataatctgcagcaagcg

SEQ ID NO: 9303032 - DNA, 22 bp, Homo sapiens
ttcacataatcctccagtggca

SEQ ID NO: 9303033 - DNA, 22 bp, Homo sapiens
ttcacataatgatacaaagctt

SEQ ID NO: 9303034 - DNA, 22 bp, Homo sapiens
ttcacataaaagctccaaagaa

SEQ ID NO: 9303035 - DNA, 21 bp, Homo sapiens
cggctcagtgcctgctccttc

SEQ ID NO: 9303036 - DNA, 22 bp, Homo sapiens
cggctggaagctggacaggccg

SEQ ID NO: 9303037 - DNA, 22 bp, Homo sapiens
cggctggggctgtccccatgac

SEQ ID NO: 9303038 - DNA, 22 bp, Homo sapiens
ttcacttaacatcatatcatga

SEQ ID NO: 9303039 - DNA, 22 bp, Homo sapiens
ttcattctgggctctaaggaac

SEQ ID NO: 9303040 - DNA, 22 bp, Homo sapiens
ttcattcttcagagctgcgctt

SEQ ID NO: 9303041 - DNA, 22 bp, Homo sapiens
ttccttctaattttacacctga

SEQ ID NO: 9303042 - DNA, 22 bp, Homo sapiens
ttccttctaatattctgcctgt

SEQ ID NO: 9303043 - DNA, 22 bp, Homo sapiens
ctaggcagactgagctctaggg

SEQ ID NO: 9303044 - DNA, 22 bp, Homo sapiens
ctagggaatgagagactggatc

SEQ ID NO: 9303045 - DNA, 17 bp, Homo sapiens
ctaggcttggcagctcg

SEQ ID NO: 9303046 - DNA, 22 bp, Homo sapiens
ctaggctgtaaagagctaggag

SEQ ID NO: 9303047 - DNA, 22 bp, Homo sapiens
ctaggctggagtgcattggcgt

SEQ ID NO: 9303048 - DNA, 22 bp, Homo sapiens
ctaggctgcacctaggatggct

SEQ ID NO: 9303049 - DNA, 22 bp, Homo sapiens
ctaggctgcagatgcatggaat

SEQ ID NO: 9303050 - DNA, 22 bp, Homo sapiens
ctaggctggagtgcagtggcac

SEQ ID NO: 9303051 - DNA, 22 bp, Homo sapiens
ctaggctggagtgcagtggcat

SEQ ID NO: 9303052 - DNA, 22 bp, Homo sapiens
ctaggcagggtgctgtgccatg

SEQ ID NO: 9303053 - DNA, 22 bp, Homo sapiens
ctaggctgagctgggctgagct

SEQ ID NO: 9303054 - DNA, 22 bp, Homo sapiens
ctaggctgagctgggctgagct

SEQ ID NO: 9303055 - DNA, 22 bp, Homo sapiens
ctatttatgtgctattttgtat

SEQ ID NO: 9303056 - DNA, 22 bp, Homo sapiens
ctatttattgtgggtatccagg

SEQ ID NO: 9303057 - DNA, 22 bp, Homo sapiens
ctatttattgtgggtatccagg

SEQ ID NO: 9303058 - DNA, 22 bp, Homo sapiens
ctagggctagacagacgcatgt

SEQ ID NO: 9303059 - DNA, 22 bp, Homo sapiens
ctagggcagggagtgtttgcgc

SEQ ID NO: 9303060 - DNA, 22 bp, Homo sapiens
ctatttgagaggtgaaggaatt

SEQ ID NO: 9303061 - DNA, 22 bp, Homo sapiens
ctatttctaaacctataagtga

SEQ ID NO: 9303062 - DNA, 22 bp, Homo sapiens
ttctgtacttcaggggctctgt

SEQ ID NO: 9303063 - DNA, 22 bp, Homo sapiens
ttctgtaccctcgcgattctcc

SEQ ID NO: 9303064 - DNA, 22 bp, Homo sapiens
ttctgtactctttgagaagaat

SEQ ID NO: 9303065 - DNA, 22 bp, Homo sapiens
ttcttgtatgtatgcaaaatca

SEQ ID NO: 9303066 - DNA, 22 bp, Homo sapiens
ttcttgtaatttggagaaatga

SEQ ID NO: 9303067 - DNA, 22 bp, Homo sapiens
ttcttgtatataaaaatcattt

SEQ ID NO: 9303068 - DNA, 22 bp, Homo sapiens
ttcttgtactggagatacatga

SEQ ID NO: 9303069 - DNA, 22 bp, Homo sapiens
ctattttaacttgattacctct

SEQ ID NO: 9303070 - DNA, 20 bp, Homo sapiens
ctcagcagattcttctagaa

SEQ ID NO: 9303071 - DNA, 22 bp, Homo sapiens
ctattttctgtctctatagagt

SEQ ID NO: 9303072 - DNA, 22 bp, Homo sapiens
ctcagcaccccgacaggacatt

SEQ ID NO: 9303073 - DNA, 22 bp, Homo sapiens
ctcagagggaggactgggctgg

SEQ ID NO: 9303074 - DNA, 22 bp, Homo sapiens
ctcagagggaggactgggctgg

SEQ ID NO: 9303075 - DNA, 22 bp, Homo sapiens
ctcagcactttggaaggctgat

SEQ ID NO: 9303076 - DNA, 22 bp, Homo sapiens
ctcagcactgacccaggagatg

SEQ ID NO: 9303077 - DNA, 19 bp, Homo sapiens
ctcagcacttttacacagg

SEQ ID NO: 9303078 - DNA, 22 bp, Homo sapiens
ttgaggagtagaagctttgaat

SEQ ID NO: 9303079 - DNA, 22 bp, Homo sapiens
ttgataaaatgatgaaatcact

SEQ ID NO: 9303080 - DNA, 22 bp, Homo sapiens
ttgacgtcctcgatggggaact

SEQ ID NO: 9303081 - DNA, 22 bp, Homo sapiens
ttgactcatacctgcctgaccc

SEQ ID NO: 9303082 - DNA, 22 bp, Homo sapiens
ttgactttaaagctttgtctct

SEQ ID NO: 9303083 - DNA, 22 bp, Homo sapiens
ttgactttatgtgtatgtttac

SEQ ID NO: 9303084 - DNA, 22 bp, Homo sapiens
ttgagctgtatacctatgactg

SEQ ID NO: 9303085 - DNA, 22 bp, Homo sapiens
ttgagctctcctcatcaccctg

SEQ ID NO: 9303086 - DNA, 22 bp, Homo sapiens
ctctcctccaacagccctgccg

SEQ ID NO: 9303087 - DNA, 22 bp, Homo sapiens
ctctcctcagaacaggccctct

SEQ ID NO: 9303088 - DNA, 22 bp, Homo sapiens
ctctcccttgggtgggctttgg

SEQ ID NO: 9303089 - DNA, 22 bp, Homo sapiens
ctctcctacatttcattcacaa

SEQ ID NO: 9303090 - DNA, 22 bp, Homo sapiens
ctctccctatgcctcccaggag

SEQ ID NO: 9303091 - DNA, 22 bp, Homo sapiens
ctctccctatgcctcccaggag

SEQ ID NO: 9303092 - DNA, 19 bp, Homo sapiens
ctctccagctccagtagct

SEQ ID NO: 9303093 - DNA, 22 bp, Homo sapiens
ctctccaggactttggcccaat

SEQ ID NO: 9303094 - DNA, 22 bp, Homo sapiens
ctctccaggactttggcccaat

SEQ ID NO: 9303095 - DNA, 22 bp, Homo sapiens
ctctccaggactttggcccaat

SEQ ID NO: 9303096 - DNA, 22 bp, Homo sapiens
ctctccaggagagcactttgag

SEQ ID NO: 9303097 - DNA, 22 bp, Homo sapiens
ctctccagcctttagcccacgc

SEQ ID NO: 9303098 - DNA, 19 bp, Homo sapiens
ctctccagctccagtagct

SEQ ID NO: 9303099 - DNA, 22 bp, Homo sapiens
ctctccagatctgctgagccag

SEQ ID NO: 9303100 - DNA, 22 bp, Homo sapiens
ctctccagatctgctgagccag

SEQ ID NO: 9303101 - DNA, 22 bp, Homo sapiens
ctctccactgtcctttgctggt

SEQ ID NO: 9303102 - DNA, 22 bp, Homo sapiens
ctctccactcagcgtcatgtcc

SEQ ID NO: 9303103 - DNA, 19 bp, Homo sapiens
ctctcactcgccacatcct

SEQ ID NO: 9303104 - DNA, 22 bp, Homo sapiens
ctctcagaagtagcacgtgggc

SEQ ID NO: 9303105 - DNA, 22 bp, Homo sapiens
ctcctgggctgggaactcagcc

SEQ ID NO: 9303106 - DNA, 18 bp, Homo sapiens
ctcctgggctgcagatgc

SEQ ID NO: 9303107 - DNA, 22 bp, Homo sapiens
ctcctgggctgggaactcagcc

SEQ ID NO: 9303108 - DNA, 22 bp, Homo sapiens
ctcctgggctgtcggcgctctg

SEQ ID NO: 9303109 - DNA, 22 bp, Homo sapiens
ctcctgggagtcttcctggatg

SEQ ID NO: 9303110 - DNA, 22 bp, Homo sapiens
ctcctgggagctgtggcagagc

SEQ ID NO: 9303111 - DNA, 22 bp, Homo sapiens
ctcctgggaggatgcggacccg

SEQ ID NO: 9303112 - DNA, 22 bp, Homo sapiens
ctcctgggagctgtggcagagc

SEQ ID NO: 9303113 - DNA, 22 bp, Homo sapiens
ctcctgggagcagggatggatg

SEQ ID NO: 9303114 - DNA, 22 bp, Homo sapiens
ctcctgggatgactctttcttt

SEQ ID NO: 9303115 - DNA, 21 bp, Homo sapiens
ctcctgggctaagatatagtg

SEQ ID NO: 9303116 - DNA, 22 bp, Homo sapiens
ctcctgggatgactctttcttt

SEQ ID NO: 9303117 - DNA, 22 bp, Homo sapiens
ctcctgggctatgtctgcttgg

SEQ ID NO: 9303118 - DNA, 22 bp, Homo sapiens
ctcctgggctatgtctgcttgg

SEQ ID NO: 9303119 - DNA, 22 bp, Homo sapiens
ctcctgggctcatatcattcag

SEQ ID NO: 9303120 - DNA, 22 bp, Homo sapiens
ctcctgggctcaagtgatcctc

SEQ ID NO: 9303121 - DNA, 22 bp, Homo sapiens
ctcctctgtctggccctgagcc

SEQ ID NO: 9303122 - DNA, 22 bp, Homo sapiens
ctcctctttagccccagctgga

SEQ ID NO: 9303123 - DNA, 22 bp, Homo sapiens
ctcctgaattgtccctcacagc

SEQ ID NO: 9303124 - DNA, 22 bp, Homo sapiens
ctcctgagaaataagcaagtaa

SEQ ID NO: 9303125 - DNA, 22 bp, Homo sapiens
ctcctctggaaattcctctgcc

SEQ ID NO: 9303126 - DNA, 16 bp, Homo sapiens
ctcctctccttcagga

SEQ ID NO: 9303127 - DNA, 17 bp, Homo sapiens
ctcctctctgggttact

SEQ ID NO: 9303128 - DNA, 22 bp, Homo sapiens
ctcctcccaattgccaagtgct

SEQ ID NO: 9303129 - DNA, 22 bp, Homo sapiens
ctcctctccatcagcgccaccc

SEQ ID NO: 9303130 - DNA, 22 bp, Homo sapiens
ctcctctccatcagcgccaccc

SEQ ID NO: 9303131 - DNA, 22 bp, Homo sapiens
tttaaaaccaaagaaagcctct

SEQ ID NO: 9303132 - DNA, 22 bp, Homo sapiens
tttaaaaaactagtctgagtct

SEQ ID NO: 9303133 - DNA, 22 bp, Homo sapiens
tttaaaaaactagtctgagtct

SEQ ID NO: 9303134 - DNA, 22 bp, Homo sapiens
tttaaaaaactagtctgagtct

SEQ ID NO: 9303135 - DNA, 22 bp, Homo sapiens
tttacacatacctctttaaagt

SEQ ID NO: 9303136 - DNA, 22 bp, Homo sapiens
tttacattgcattaggtattat

SEQ ID NO: 9303137 - DNA, 22 bp, Homo sapiens
tttacatgtccttcaagagcag

SEQ ID NO: 9303138 - DNA, 22 bp, Homo sapiens
tttacatggaatattgtcttgt

SEQ ID NO: 9303139 - DNA, 22 bp, Homo sapiens
tttacatgtaatgttatacaaa

SEQ ID NO: 9303140 - DNA, 22 bp, Homo sapiens
ctccagggggcatccacacagc

SEQ ID NO: 9303141 - DNA, 22 bp, Homo sapiens
ctccagggttccccgatccact

SEQ ID NO: 9303142 - DNA, 22 bp, Homo sapiens
ctccagggaggagcacgggttc

SEQ ID NO: 9303143 - DNA, 22 bp, Homo sapiens
ctccagggaggtctgcaggact

SEQ ID NO: 9303144 - DNA, 22 bp, Homo sapiens
ctccagggaggtctgcaggact

SEQ ID NO: 9303145 - DNA, 22 bp, Homo sapiens
ctccagggatgagacagagtag

SEQ ID NO: 9303146 - DNA, 20 bp, Homo sapiens
ctccaggggaagagccttcc

SEQ ID NO: 9303147 - DNA, 20 bp, Homo sapiens
ctccaggggaagagccttcc

SEQ ID NO: 9303148 - DNA, 22 bp, Homo sapiens
ctccagggctaccaggttttag

SEQ ID NO: 9303149 - DNA, 22 bp, Homo sapiens
ctccagggcagcatggcagtgg

SEQ ID NO: 9303150 - DNA, 22 bp, Homo sapiens
ctccagggcagcatggcagtgg

SEQ ID NO: 9303151 - DNA, 22 bp, Homo sapiens
ctccaggggccagaagcctggc

SEQ ID NO: 9303152 - DNA, 22 bp, Homo sapiens
ttgggtgggtcaggactcggag

SEQ ID NO: 9303153 - DNA, 22 bp, Homo sapiens
ttgggtgttgtgtcaaggaagg

SEQ ID NO: 9303154 - DNA, 22 bp, Homo sapiens
ttgggttttcccttgaaactga

SEQ ID NO: 9303155 - DNA, 22 bp, Homo sapiens
ctccaggcccctggccttctgc

SEQ ID NO: 9303156 - DNA, 22 bp, Homo sapiens
ctccaggcccctggccttctgc

SEQ ID NO: 9303157 - DNA, 22 bp, Homo sapiens
ttggtattttacaatgtcagtg

SEQ ID NO: 9303158 - DNA, 21 bp, Homo sapiens
ttggtagatgcagcaccagta

SEQ ID NO: 9303159 - DNA, 22 bp, Homo sapiens
ctccagggagctgtggaggttt

SEQ ID NO: 9303160 - DNA, 22 bp, Homo sapiens
ctccagggagctgtggaggttt

SEQ ID NO: 9303161 - DNA, 22 bp, Homo sapiens
ctccaggcgccgcttttgcagt

SEQ ID NO: 9303162 - DNA, 22 bp, Homo sapiens
ctccagggagctgcgggagcca

SEQ ID NO: 9303163 - DNA, 22 bp, Homo sapiens
ctccagggagctgcgggagcca

SEQ ID NO: 9303164 - DNA, 22 bp, Homo sapiens
ttgttaaaggcaaaacaagcac

SEQ ID NO: 9303165 - DNA, 22 bp, Homo sapiens
ttgttaaatggatgcagaataa

SEQ ID NO: 9303166 - DNA, 22 bp, Homo sapiens
ttgttaacggaaaactgttttc

SEQ ID NO: 9303167 - DNA, 22 bp, Homo sapiens
ctccagggttccccgatccact

SEQ ID NO: 9303168 - DNA, 22 bp, Homo sapiens
ttgttaaaatgcatattctggt

SEQ ID NO: 9303169 - DNA, 22 bp, Homo sapiens
ttgttaaaatattggagaaagg

SEQ ID NO: 9303170 - DNA, 22 bp, Homo sapiens
ctccagtgccctccttgggggc

SEQ ID NO: 9303171 - DNA, 22 bp, Homo sapiens
ctccagtgcacccagaggattt

SEQ ID NO: 9303172 - DNA, 22 bp, Homo sapiens
ctccaggttgacttcagtcaat

SEQ ID NO: 9303173 - DNA, 22 bp, Homo sapiens
ctccaggttacttagcctagct

SEQ ID NO: 9303174 - DNA, 22 bp, Homo sapiens
ctccaggtgcagaaggactcag

SEQ ID NO: 9303175 - DNA, 22 bp, Homo sapiens
ctccaggtagttatttcaagaa

SEQ ID NO: 9303176 - DNA, 22 bp, Homo sapiens
ctcagttttgaaaaggtaagct

SEQ ID NO: 9303177 - DNA, 22 bp, Homo sapiens
ctcagtgctttggatcctggat

SEQ ID NO: 9303178 - DNA, 22 bp, Homo sapiens
ttgatattctgagaagctgaag

SEQ ID NO: 9303179 - DNA, 22 bp, Homo sapiens
ttgatattagagtatttgtttg

SEQ ID NO: 9303180 - DNA, 22 bp, Homo sapiens
ttgcttttgtgtgctctctgga

SEQ ID NO: 9303181 - DNA, 22 bp, Homo sapiens
ttggccaaaggaaagactactg

SEQ ID NO: 9303182 - DNA, 22 bp, Homo sapiens
ttgcttttccctgtctctgatt

SEQ ID NO: 9303183 - DNA, 22 bp, Homo sapiens
ttgctttgtggtggttcttcca

SEQ ID NO: 9303184 - DNA, 22 bp, Homo sapiens
ttgctttgtggtggttcttcca

SEQ ID NO: 9303185 - DNA, 22 bp, Homo sapiens
ttgggattacaggtgtaagcca

SEQ ID NO: 9303186 - DNA, 20 bp, Homo sapiens
ctcatctctgagcctcctgg

SEQ ID NO: 9303187 - DNA, 22 bp, Homo sapiens
ctcatctgataaatcactctta

SEQ ID NO: 9303188 - DNA, 22 bp, Homo sapiens
ctcatctgctcttattatctta

SEQ ID NO: 9303189 - DNA, 22 bp, Homo sapiens
ctcatctgactgtaaggtaatg

SEQ ID NO: 9303190 - DNA, 22 bp, Homo sapiens
ttggccagagaccagagcaggg

SEQ ID NO: 9303191 - DNA, 22 bp, Homo sapiens
ttggccaatttagaacgtgttg

SEQ ID NO: 9303192 - DNA, 22 bp, Homo sapiens
ttggccaagatacgagcacata

SEQ ID NO: 9303193 - DNA, 22 bp, Homo sapiens
ttggccaaccagaacggaggtc

SEQ ID NO: 9303194 - DNA, 22 bp, Homo sapiens
ttggccaaccagaacggaggtc

SEQ ID NO: 9303195 - DNA, 22 bp, Homo sapiens
ttggccaaataatcttgcagat

SEQ ID NO: 9303196 - DNA, 22 bp, Homo sapiens
ttggccaacagcgacagggcca

SEQ ID NO: 9303197 - DNA, 22 bp, Homo sapiens
ttggccaagggctctttaggct

SEQ ID NO: 9303198 - DNA, 22 bp, Homo sapiens
ttggccaagggatcgaggttgg

SEQ ID NO: 9303199 - DNA, 22 bp, Homo sapiens
ttggccaattccagaggatcat

SEQ ID NO: 9303200 - DNA, 22 bp, Homo sapiens
ttggccagatctgaggatactg

SEQ ID NO: 9303201 - DNA, 22 bp, Homo sapiens
ctcatattgctggtggtctaag

SEQ ID NO: 9303202 - DNA, 22 bp, Homo sapiens
ctcatattcagtcactgatgca

SEQ ID NO: 9303203 - DNA, 22 bp, Homo sapiens
ctggccataggttctcagtgtg

SEQ ID NO: 9303204 - DNA, 22 bp, Homo sapiens
ctggccatctcctgccagcggt

SEQ ID NO: 9303205 - DNA, 22 bp, Homo sapiens
ctggccatatccaccagatgga

SEQ ID NO: 9303206 - DNA, 22 bp, Homo sapiens
ctggccctgtggaggcaggaac

SEQ ID NO: 9303207 - DNA, 22 bp, Homo sapiens
ctggcctgagaatgctaccctt

SEQ ID NO: 9303208 - DNA, 22 bp, Homo sapiens
ctggcctgaggccgccttcaga

SEQ ID NO: 9303209 - DNA, 22 bp, Homo sapiens
ctggcctgagcacagcggctgc

SEQ ID NO: 9303210 - DNA, 22 bp, Homo sapiens
ctggcctgagaatgctaccctt

SEQ ID NO: 9303211 - DNA, 22 bp, Homo sapiens
ctggcctggagcctctgggtgg

SEQ ID NO: 9303212 - DNA, 22 bp, Homo sapiens
ctggcctgatctcatgctgtcc

SEQ ID NO: 9303213 - DNA, 22 bp, Homo sapiens
ctggcctgaggtcggctgtagg

SEQ ID NO: 9303214 - DNA, 22 bp, Homo sapiens
ctggctctaagtgtcagctccc

SEQ ID NO: 9303215 - DNA, 22 bp, Homo sapiens
ctggctcctgtttaaccagctg

SEQ ID NO: 9303216 - DNA, 22 bp, Homo sapiens
ctggctctcgctgggagtactt

SEQ ID NO: 9303217 - DNA, 22 bp, Homo sapiens
ctggctctcaggctggtcccca

SEQ ID NO: 9303218 - DNA, 22 bp, Homo sapiens
ctggctctgagcccacctccag

SEQ ID NO: 9303219 - DNA, 22 bp, Homo sapiens
ctggctctgaccgcgctggcct

SEQ ID NO: 9303220 - DNA, 22 bp, Homo sapiens
ctggctctgagtggtatcttga

SEQ ID NO: 9303221 - DNA, 22 bp, Homo sapiens
ctggctctgtgggacctggcct

SEQ ID NO: 9303222 - DNA, 22 bp, Homo sapiens
ctggctctgtggcttccttcat

SEQ ID NO: 9303223 - DNA, 22 bp, Homo sapiens
ctggctctgggctaagctccca

SEQ ID NO: 9303224 - DNA, 22 bp, Homo sapiens
ctggctctgtcaccctttctcc

SEQ ID NO: 9303225 - DNA, 23 bp, Homo sapiens
ctggctctgtaggtggcatcctt

SEQ ID NO: 9303226 - DNA, 22 bp, Homo sapiens
ctggcctggggcctcagctgct

SEQ ID NO: 9303227 - DNA, 22 bp, Homo sapiens
ctggcctgggagctgctagcgt

SEQ ID NO: 9303228 - DNA, 22 bp, Homo sapiens
ctggcctggcgcagtggctcac

SEQ ID NO: 9303229 - DNA, 23 bp, Homo sapiens
ctggctccgaagactccaggatc

SEQ ID NO: 9303230 - DNA, 22 bp, Homo sapiens
ctggctccaggtcatgcactca

SEQ ID NO: 9303231 - DNA, 22 bp, Homo sapiens
ctggatggtcccatgagcagct

SEQ ID NO: 9303232 - DNA, 22 bp, Homo sapiens
ctggatggaaggaggatagtat

SEQ ID NO: 9303233 - DNA, 22 bp, Homo sapiens
ctggatggtcccatgagcagct

SEQ ID NO: 9303234 - DNA, 22 bp, Homo sapiens
ctggatgcttcctctctgctag

SEQ ID NO: 9303235 - DNA, 22 bp, Homo sapiens
ctggatgcaactgcttctctca

SEQ ID NO: 9303236 - DNA, 22 bp, Homo sapiens
ctggcaagaaatatatatctta

SEQ ID NO: 9303237 - DNA, 22 bp, Homo sapiens
ctggatttaattaactgttgct

SEQ ID NO: 9303238 - DNA, 22 bp, Homo sapiens
ctggcagatagccacgcctgtc

SEQ ID NO: 9303239 - DNA, 22 bp, Homo sapiens
ctggcagaggatggggacccag

SEQ ID NO: 9303240 - DNA, 22 bp, Homo sapiens
ctggcagagtctgctgtctgca

SEQ ID NO: 9303241 - DNA, 22 bp, Homo sapiens
ctggcagagttgggtctcaaat

SEQ ID NO: 9303242 - DNA, 22 bp, Homo sapiens
ctggcagcagcttctggatcga

SEQ ID NO: 9303243 - DNA, 22 bp, Homo sapiens
ctggcactgtgtctgcggaggg

SEQ ID NO: 9303244 - DNA, 22 bp, Homo sapiens
ctggcaccaggcatgctgggag

SEQ ID NO: 9303245 - DNA, 22 bp, Homo sapiens
ctggcacctccagctcatggcc

SEQ ID NO: 9303246 - DNA, 22 bp, Homo sapiens
ctggcaccccacactgtccacg

SEQ ID NO: 9303247 - DNA, 22 bp, Homo sapiens
ctggcatcatttagcacagtgt

SEQ ID NO: 9303248 - DNA, 22 bp, Homo sapiens
ctggcatctagtgcgttgaggt

SEQ ID NO: 9303249 - DNA, 22 bp, Homo sapiens
ctggcagtttgccaggagctcg

SEQ ID NO: 9303250 - DNA, 22 bp, Homo sapiens
ctggcatctagtgcgttgaggt

SEQ ID NO: 9303251 - DNA, 22 bp, Homo sapiens
ctggcagtctggtggaaggcct

SEQ ID NO: 9303252 - DNA, 22 bp, Homo sapiens
ctggcagtgacattgcaggtgc

SEQ ID NO: 9303253 - DNA, 22 bp, Homo sapiens
ctggcagggctctttgggtgct

SEQ ID NO: 9303254 - DNA, 22 bp, Homo sapiens
ctggcagcatggagcctgtgct

SEQ ID NO: 9303255 - DNA, 22 bp, Homo sapiens
ctggccaggcggcccctgcatg

SEQ ID NO: 9303256 - DNA, 22 bp, Homo sapiens
ctggccacatgtgtgctgagca

SEQ ID NO: 9303257 - DNA, 22 bp, Homo sapiens
ctggcatgccttgggtgcctct

SEQ ID NO: 9303258 - DNA, 22 bp, Homo sapiens
ctggaggcacccttagagaggc

SEQ ID NO: 9303259 - DNA, 21 bp, Homo sapiens
ctggaggcaggtggtgccagg

SEQ ID NO: 9303260 - DNA, 22 bp, Homo sapiens
ctggaggctgagttgggtctcc

SEQ ID NO: 9303261 - DNA, 22 bp, Homo sapiens
ctggaggcaaagcagaggcatg

SEQ ID NO: 9303262 - DNA, 22 bp, Homo sapiens
ctggactcactatggcttcaga

SEQ ID NO: 9303263 - DNA, 21 bp, Homo sapiens
ctggagggtagagttgggctg

SEQ ID NO: 9303264 - DNA, 22 bp, Homo sapiens
ctggagggtgagcctcatctct

SEQ ID NO: 9303265 - DNA, 18 bp, Homo sapiens
ctggagtcacagtgggga

SEQ ID NO: 9303266 - DNA, 22 bp, Homo sapiens
ctggagtcactcatgtagctgc

SEQ ID NO: 9303267 - DNA, 22 bp, Homo sapiens
ctggagtcagcaaggacgaggc

SEQ ID NO: 9303268 - DNA, 22 bp, Homo sapiens
ctggagttcttgttttgcctac

SEQ ID NO: 9303269 - DNA, 22 bp, Homo sapiens
ctggagtctcttctgtagctac

SEQ ID NO: 9303270 - DNA, 22 bp, Homo sapiens
ctgcctggagcattctgaaggt

SEQ ID NO: 9303271 - DNA, 17 bp, Homo sapiens
ctgcctggagtcccatc

SEQ ID NO: 9303272 - DNA, 17 bp, Homo sapiens
ctgcctggagtcccatc

SEQ ID NO: 9303273 - DNA, 22 bp, Homo sapiens
ctgcctggaccggcagccctcc

SEQ ID NO: 9303274 - DNA, 22 bp, Homo sapiens
ctgcctggcatggagaagagaa

SEQ ID NO: 9303275 - DNA, 22 bp, Homo sapiens
ctgcctggccacaacccagggt

SEQ ID NO: 9303276 - DNA, 23 bp, Homo sapiens
ctgcttccttgcttcattgctgg

SEQ ID NO: 9303277 - DNA, 19 bp, Homo sapiens
ctgcttccttccctcactg

SEQ ID NO: 9303278 - DNA, 22 bp, Homo sapiens
ctgcttctaagaacctgcagct

SEQ ID NO: 9303279 - DNA, 22 bp, Homo sapiens
ctgcttctaagaacctgcagct

SEQ ID NO: 9303280 - DNA, 22 bp, Homo sapiens
ctgctttactcatagggtttca

SEQ ID NO: 9303281 - DNA, 22 bp, Homo sapiens
ctgctttaccaaactcttggat

SEQ ID NO: 9303282 - DNA, 21 bp, Homo sapiens
ctgctttacttcagaggatct

SEQ ID NO: 9303283 - DNA, 22 bp, Homo sapiens
ctgctttagagctgagcctcag

SEQ ID NO: 9303284 - DNA, 22 bp, Homo sapiens
ctgctttagacggctttcgctg

SEQ ID NO: 9303285 - DNA, 22 bp, Homo sapiens
ctgctttagacaactgctggga

SEQ ID NO: 9303286 - DNA, 23 bp, Homo sapiens
ctgctttcccactccatgctctt

SEQ ID NO: 9303287 - DNA, 22 bp, Homo sapiens
ctgctttatctgagacaagtca

SEQ ID NO: 9303288 - DNA, 22 bp, Homo sapiens
ctgctttatattgagcttgaaa

SEQ ID NO: 9303289 - DNA, 22 bp, Homo sapiens
ctgctttatagggcttccatgt

SEQ ID NO: 9303290 - DNA, 22 bp, Homo sapiens
ctgctttagctagtgctcttag

SEQ ID NO: 9303291 - DNA, 19 bp, Homo sapiens
ctgctttaggccttaaaag

SEQ ID NO: 9303292 - DNA, 22 bp, Homo sapiens
ctgctttagtgtggtgttagag

SEQ ID NO: 9303293 - DNA, 22 bp, Homo sapiens
ctgctttaggtggaatgttcta

SEQ ID NO: 9303294 - DNA, 22 bp, Homo sapiens
ctgctttctgcaccccaggtcg

SEQ ID NO: 9303295 - DNA, 22 bp, Homo sapiens
ctgctttcttgttgcatcttaa

SEQ ID NO: 9303296 - DNA, 22 bp, Homo sapiens
ctgcctccaggctcaccttgac

SEQ ID NO: 9303297 - DNA, 22 bp, Homo sapiens
ctgcctcacattggctgtgtga

SEQ ID NO: 9303298 - DNA, 22 bp, Homo sapiens
ctgcctctataggagtccacca

SEQ ID NO: 9303299 - DNA, 22 bp, Homo sapiens
ctgccaggtaaactgcaggaat

SEQ ID NO: 9303300 - DNA, 22 bp, Homo sapiens
ctgccatcctcaccagagcagc

SEQ ID NO: 9303301 - DNA, 22 bp, Homo sapiens
ctgcagaggggttgaagggtcc

SEQ ID NO: 9303302 - DNA, 22 bp, Homo sapiens
ctgcagaggtcttgctgatggt

SEQ ID NO: 9303303 - DNA, 22 bp, Homo sapiens
ctgcagcagaataatctgctca

SEQ ID NO: 9303304 - DNA, 22 bp, Homo sapiens
ctgcagcaagagaagtgctgac

SEQ ID NO: 9303305 - DNA, 22 bp, Homo sapiens
ctgccaggctgtcccaggtccg

SEQ ID NO: 9303306 - DNA, 22 bp, Homo sapiens
ctgcagcagtactcagcagcca

SEQ ID NO: 9303307 - DNA, 22 bp, Homo sapiens
ctgccaggcctccgctgtcccc

SEQ ID NO: 9303308 - DNA, 22 bp, Homo sapiens
ctgccagctctctggaggctct

SEQ ID NO: 9303309 - DNA, 22 bp, Homo sapiens
ctgaggcactgtcagctgaggc

SEQ ID NO: 9303310 - DNA, 22 bp, Homo sapiens
ctgaggcacccatcttctcctg

SEQ ID NO: 9303311 - DNA, 22 bp, Homo sapiens
ctgaggcacctacagtctcggg

SEQ ID NO: 9303312 - DNA, 19 bp, Homo sapiens
ctgaggcaagtggtggtca

SEQ ID NO: 9303313 - DNA, 22 bp, Homo sapiens
ctgaggaggggcctgagtgaga

SEQ ID NO: 9303314 - DNA, 22 bp, Homo sapiens
ctgaggacattgatgaggcaat

SEQ ID NO: 9303315 - DNA, 22 bp, Homo sapiens
ctgaggagaaatgggatggttc

SEQ ID NO: 9303316 - DNA, 22 bp, Homo sapiens
ctgaggaggctaatttgaggat

SEQ ID NO: 9303317 - DNA, 22 bp, Homo sapiens
ctgaggaggctaatttgaggat

SEQ ID NO: 9303318 - DNA, 22 bp, Homo sapiens
ctgaggagaaagatggtccaag

SEQ ID NO: 9303319 - DNA, 22 bp, Homo sapiens
ctgagagaatcatgctgcaggt

SEQ ID NO: 9303320 - DNA, 22 bp, Homo sapiens
ctgatggagactccactgtgat

SEQ ID NO: 9303321 - DNA, 22 bp, Homo sapiens
ctgatgatagtgatttattgag

SEQ ID NO: 9303322 - DNA, 22 bp, Homo sapiens
ctgatgatagtgatttattgag

SEQ ID NO: 9303323 - DNA, 22 bp, Homo sapiens
ctgatgcaggtggtttaaaaac

SEQ ID NO: 9303324 - DNA, 22 bp, Homo sapiens
ctgattgagaaggaaggggatc

SEQ ID NO: 9303325 - DNA, 22 bp, Homo sapiens
ctgattccagagtctgtgttct

SEQ ID NO: 9303326 - DNA, 22 bp, Homo sapiens
ctgcagaacaattcctgctgtt

SEQ ID NO: 9303327 - DNA, 22 bp, Homo sapiens
ctgcagaatggggccaagtgga

SEQ ID NO: 9303328 - DNA, 22 bp, Homo sapiens
ctgcagaaacctttcctgattt

SEQ ID NO: 9303329 - DNA, 20 bp, Homo sapiens
ctgaacacagaataagcaca

SEQ ID NO: 9303330 - DNA, 22 bp, Homo sapiens
ctgaagatgctggagcatgggt

SEQ ID NO: 9303331 - DNA, 22 bp, Homo sapiens
ctgaagaggttgttgaggaata

SEQ ID NO: 9303332 - DNA, 22 bp, Homo sapiens
ttttgttttcttagaaacctgg

SEQ ID NO: 9303333 - DNA, 22 bp, Homo sapiens
ctcttttagagatgaaaattgg

SEQ ID NO: 9303334 - DNA, 23 bp, Homo sapiens
ttttattgatatgtagctgttgt

SEQ ID NO: 9303335 - DNA, 21 bp, Homo sapiens
ctctggtcctgtctggcaggc

SEQ ID NO: 9303336 - DNA, 22 bp, Homo sapiens
ctctggtctcctgtagctacag

SEQ ID NO: 9303337 - DNA, 22 bp, Homo sapiens
ctctgggcaagtttcttcatga

SEQ ID NO: 9303338 - DNA, 22 bp, Homo sapiens
ctctgggcaaagatgcctcatc

SEQ ID NO: 9303339 - DNA, 22 bp, Homo sapiens
ctctgggccaccgctggtgtat

SEQ ID NO: 9303340 - DNA, 22 bp, Homo sapiens
ctctgggcaccaaagagcagct

SEQ ID NO: 9303341 - DNA, 22 bp, Homo sapiens
ctctgggcactgtatgggttct

SEQ ID NO: 9303342 - DNA, 22 bp, Homo sapiens
ttttagttgtagttggtgagga

SEQ ID NO: 9303343 - DNA, 22 bp, Homo sapiens
ttttattatctttgaatgggac

SEQ ID NO: 9303344 - DNA, 22 bp, Homo sapiens
ttttattcaaatagttcacact

SEQ ID NO: 9303345 - DNA, 22 bp, Homo sapiens
ttttattcatagggatggagag

SEQ ID NO: 9303346 - DNA, 22 bp, Homo sapiens
ttttattcaaatagttcacact

SEQ ID NO: 9303347 - DNA, 22 bp, Homo sapiens
ttttattcatagggatggagag

SEQ ID NO: 9303348 - DNA, 22 bp, Homo sapiens
ttttattctaagtatgatggga

SEQ ID NO: 9303349 - DNA, 22 bp, Homo sapiens
ttttattctaagtatgatggga

SEQ ID NO: 9303350 - DNA, 22 bp, Homo sapiens
ttttattctcagctccagagag

SEQ ID NO: 9303351 - DNA, 22 bp, Homo sapiens
ttttattctcagctccagagag

SEQ ID NO: 9303352 - DNA, 22 bp, Homo sapiens
ttttattctcaagacaatggga

SEQ ID NO: 9303353 - DNA, 22 bp, Homo sapiens
ttttattctcaagacaatggga

SEQ ID NO: 9303354 - DNA, 22 bp, Homo sapiens
ttttattatctttgaatgggac

SEQ ID NO: 9303355 - DNA, 22 bp, Homo sapiens
ttttagttgctcaggtattctc

SEQ ID NO: 9303356 - DNA, 22 bp, Homo sapiens
ctctgggccatgctactgctct

SEQ ID NO: 9303357 - DNA, 23 bp, Homo sapiens
ctctcctgaaggacaagctgccg

SEQ ID NO: 9303358 - DNA, 22 bp, Homo sapiens
ctctcctgggctgaccgtccga

SEQ ID NO: 9303359 - DNA, 19 bp, Homo sapiens
tttgtgaagaaaatgatgc

SEQ ID NO: 9303360 - DNA, 22 bp, Homo sapiens
tttgtctttcccctcctcattg

SEQ ID NO: 9303361 - DNA, 22 bp, Homo sapiens
tttgtgaataggttggcttcca

SEQ ID NO: 9303362 - DNA, 22 bp, Homo sapiens
ctctggctggcacctgatctga

SEQ ID NO: 9303363 - DNA, 19 bp, Homo sapiens
ctctggctcctgggctgcc

SEQ ID NO: 9303364 - DNA, 22 bp, Homo sapiens
ctctggctgcggggcgcgtgga

SEQ ID NO: 9303365 - DNA, 22 bp, Homo sapiens
ctctggctggcattgctggact

SEQ ID NO: 9303366 - DNA, 22 bp, Homo sapiens
ctctggctgtttgcagctcaag

SEQ ID NO: 9303367 - DNA, 22 bp, Homo sapiens
tggccaggaggctgcttctgac

SEQ ID NO: 9303368 - DNA, 22 bp, Homo sapiens
tggcagcttgaatgcagtcttt

SEQ ID NO: 9303369 - DNA, 22 bp, Homo sapiens
tggccacaaagagaacgaggtc

SEQ ID NO: 9303370 - DNA, 21 bp, Homo sapiens
tggccagctggagtctccaca

SEQ ID NO: 9303371 - DNA, 22 bp, Homo sapiens
tggcagctgtgtccaggtagaa

SEQ ID NO: 9303372 - DNA, 22 bp, Homo sapiens
tggcagcttgaatgcagtcttt

SEQ ID NO: 9303373 - DNA, 22 bp, Homo sapiens
tggcagctgtctgtggggtctc

SEQ ID NO: 9303374 - DNA, 23 bp, Homo sapiens
tggccaggcataaaggtgggtgg

SEQ ID NO: 9303375 - DNA, 20 bp, Homo sapiens
cctagggcaagtgggtgggc

SEQ ID NO: 9303376 - DNA, 22 bp, Homo sapiens
tggcagaggtaattcaaatccc

SEQ ID NO: 9303377 - DNA, 22 bp, Homo sapiens
tggcacagtcctgggtgcctgc

SEQ ID NO: 9303378 - DNA, 22 bp, Homo sapiens
tggcagctggatcccaaggcag

SEQ ID NO: 9303379 - DNA, 22 bp, Homo sapiens
tggcagcacggcatccactctc

SEQ ID NO: 9303380 - DNA, 22 bp, Homo sapiens
tggcagatgagccgcgctccaa

SEQ ID NO: 9303381 - DNA, 22 bp, Homo sapiens
tggcagatggcctggaaccaaa

SEQ ID NO: 9303382 - DNA, 22 bp, Homo sapiens
tggcagatgtatatcacagctt

SEQ ID NO: 9303383 - DNA, 22 bp, Homo sapiens
tggcagattttctctggaggag

SEQ ID NO: 9303384 - DNA, 22 bp, Homo sapiens
tggcagatttaacattggaact

SEQ ID NO: 9303385 - DNA, 22 bp, Homo sapiens
tggagctgagcacctccagggc

SEQ ID NO: 9303386 - DNA, 22 bp, Homo sapiens
tggagctgagagttaataagga

SEQ ID NO: 9303387 - DNA, 22 bp, Homo sapiens
ccctggctctgcctcagagccc

SEQ ID NO: 9303388 - DNA, 17 bp, Homo sapiens
ccctggctctaggtgga

SEQ ID NO: 9303389 - DNA, 22 bp, Homo sapiens
ccctggctatttttacgcaagg

SEQ ID NO: 9303390 - DNA, 22 bp, Homo sapiens
tggatctgattaggggagccag

SEQ ID NO: 9303391 - DNA, 22 bp, Homo sapiens
tggatctgaacgcttgggtgca

SEQ ID NO: 9303392 - DNA, 22 bp, Homo sapiens
tggatctggttccctgagcctt

SEQ ID NO: 9303393 - DNA, 21 bp, Homo sapiens
tggatctgtgatctggggcac

SEQ ID NO: 9303394 - DNA, 22 bp, Homo sapiens
ccctccagggagccatgctggg

SEQ ID NO: 9303395 - DNA, 22 bp, Homo sapiens
ccctccagagcttgacctgctg

SEQ ID NO: 9303396 - DNA, 22 bp, Homo sapiens
tggagctgactcacaccagcta

SEQ ID NO: 9303397 - DNA, 22 bp, Homo sapiens
tggagctgagaagtggagctct

SEQ ID NO: 9303398 - DNA, 22 bp, Homo sapiens
tggagctgagagccaggctggc

SEQ ID NO: 9303399 - DNA, 22 bp, Homo sapiens
ccctggagcatctctgctgtct

SEQ ID NO: 9303400 - DNA, 20 bp, Homo sapiens
ccctggagagaagctccacg

SEQ ID NO: 9303401 - DNA, 22 bp, Homo sapiens
cctccactctggcctctcaggt

SEQ ID NO: 9303402 - DNA, 22 bp, Homo sapiens
cctccctgtctacctgttgtgg

SEQ ID NO: 9303403 - DNA, 22 bp, Homo sapiens
cctccctggtggctctggtcta

SEQ ID NO: 9303404 - DNA, 22 bp, Homo sapiens
cctcccttcagtagagcccaat

SEQ ID NO: 9303405 - DNA, 22 bp, Homo sapiens
cctcccttttggtgtctgcata

SEQ ID NO: 9303406 - DNA, 22 bp, Homo sapiens
cctccctggtggctctggtcta

SEQ ID NO: 9303407 - DNA, 22 bp, Homo sapiens
cctcgggctgaggctcccaggc

SEQ ID NO: 9303408 - DNA, 22 bp, Homo sapiens
cctcctccttatggtggcccag

SEQ ID NO: 9303409 - DNA, 22 bp, Homo sapiens
tggctcagtttcagtcctggtt

SEQ ID NO: 9303410 - DNA, 21 bp, Homo sapiens
tggctcagttgctgggcacag

SEQ ID NO: 9303411 - DNA, 22 bp, Homo sapiens
tggcccgaagatccgagggtca

SEQ ID NO: 9303412 - DNA, 22 bp, Homo sapiens
tggcccgcagcacgcgcaccat

SEQ ID NO: 9303413 - DNA, 22 bp, Homo sapiens
cctctcagtattgaactttata

SEQ ID NO: 9303414 - DNA, 22 bp, Homo sapiens
cctctcagccggactgtcaggc

SEQ ID NO: 9303415 - DNA, 22 bp, Homo sapiens
cctctcagcgattcctcttgga

SEQ ID NO: 9303416 - DNA, 23 bp, Homo sapiens
cctctccagacactgggccttgt

SEQ ID NO: 9303417 - DNA, 22 bp, Homo sapiens
cctctacttaccactcagccag

SEQ ID NO: 9303418 - DNA, 22 bp, Homo sapiens
cctctaggatgtggctggagga

SEQ ID NO: 9303419 - DNA, 22 bp, Homo sapiens
cctctcagccggactgtcaggc

SEQ ID NO: 9303420 - DNA, 22 bp, Homo sapiens
tggctgcctagtccctcagcct

SEQ ID NO: 9303421 - DNA, 22 bp, Homo sapiens
tggctgccctcatgggcctgat

SEQ ID NO: 9303422 - DNA, 22 bp, Homo sapiens
tggctgccgactggctcttggc

SEQ ID NO: 9303423 - DNA, 22 bp, Homo sapiens
tggctgcctgatcgagcaggtg

SEQ ID NO: 9303424 - DNA, 21 bp, Homo sapiens
tggctgcctggctctgtggtt

SEQ ID NO: 9303425 - DNA, 22 bp, Homo sapiens
tggctgcctcagtgtccctgca

SEQ ID NO: 9303426 - DNA, 22 bp, Homo sapiens
tggctgcctagtgtctgagcag

SEQ ID NO: 9303427 - DNA, 22 bp, Homo sapiens
cctctctcttgtagtccctgcc

SEQ ID NO: 9303428 - DNA, 20 bp, Homo sapiens
cctctctgaagaggtcatct

SEQ ID NO: 9303429 - DNA, 20 bp, Homo sapiens
cctctctgcatgctccctga

SEQ ID NO: 9303430 - DNA, 20 bp, Homo sapiens
cctctctgcatgctccctga

SEQ ID NO: 9303431 - DNA, 20 bp, Homo sapiens
cctctctgcatgctccctga

SEQ ID NO: 9303432 - DNA, 22 bp, Homo sapiens
tggctgccttccctgctggagg

SEQ ID NO: 9303433 - DNA, 22 bp, Homo sapiens
cctctcctggctgtaggacctc

SEQ ID NO: 9303434 - DNA, 22 bp, Homo sapiens
cctctctcttgtagtccctgcc

SEQ ID NO: 9303435 - DNA, 22 bp, Homo sapiens
cctctctgtgtggcctctccat

SEQ ID NO: 9303436 - DNA, 22 bp, Homo sapiens
cctctctgtgtggcctctccat

SEQ ID NO: 9303437 - DNA, 22 bp, Homo sapiens
cctctctgtcacaccagtggcc

SEQ ID NO: 9303438 - DNA, 22 bp, Homo sapiens
cctctctgtcacaccagtggcc

SEQ ID NO: 9303439 - DNA, 22 bp, Homo sapiens
cctctctgtcacaccagtggcc

SEQ ID NO: 9303440 - DNA, 22 bp, Homo sapiens
cctctctgtaagggtccctccc

SEQ ID NO: 9303441 - DNA, 22 bp, Homo sapiens
cctctctgtaagggtccctccc

SEQ ID NO: 9303442 - DNA, 22 bp, Homo sapiens
cctctctgtagcagcccccagt

SEQ ID NO: 9303443 - DNA, 20 bp, Homo sapiens
cctctctgccctgcaaggcc

SEQ ID NO: 9303444 - DNA, 22 bp, Homo sapiens
cctctcttggccgcagtcttct

SEQ ID NO: 9303445 - DNA, 22 bp, Homo sapiens
cctctctttcctacaccttgga

SEQ ID NO: 9303446 - DNA, 22 bp, Homo sapiens
cctctcttggccgcagtcttct

SEQ ID NO: 9303447 - DNA, 23 bp, Homo sapiens
cctctctttttaggtggtgtttg

SEQ ID NO: 9303448 - DNA, 22 bp, Homo sapiens
cctctgggctggaaaattaatg

SEQ ID NO: 9303449 - DNA, 22 bp, Homo sapiens
cctctgggggcttccttaccct

SEQ ID NO: 9303450 - DNA, 22 bp, Homo sapiens
cctctgggctgcctgcacgggt

SEQ ID NO: 9303451 - DNA, 22 bp, Homo sapiens
cctctgggttagtttagggagc

SEQ ID NO: 9303452 - DNA, 22 bp, Homo sapiens
cctctggggtgagtgggccact

SEQ ID NO: 9303453 - DNA, 22 bp, Homo sapiens
cctctgggggtcctcagagtct

SEQ ID NO: 9303454 - DNA, 22 bp, Homo sapiens
tgctcccagctgtaggaatgtt

SEQ ID NO: 9303455 - DNA, 22 bp, Homo sapiens
tgctcccagctcctgcagcaac

SEQ ID NO: 9303456 - DNA, 22 bp, Homo sapiens
tgctctggagtggcttgtgcac

SEQ ID NO: 9303457 - DNA, 22 bp, Homo sapiens
cccagggaggtagcaggagaaa

SEQ ID NO: 9303458 - DNA, 22 bp, Homo sapiens
tgctgaatggtaaagaagtata

SEQ ID NO: 9303459 - DNA, 22 bp, Homo sapiens
tgctgaatgggtgattttggag

SEQ ID NO: 9303460 - DNA, 22 bp, Homo sapiens
tgctgaatgggatatgttgagc

SEQ ID NO: 9303461 - DNA, 22 bp, Homo sapiens
tgctgaatgctgcatgccgtat

SEQ ID NO: 9303462 - DNA, 22 bp, Homo sapiens
tgctgaattccagggccccact

SEQ ID NO: 9303463 - DNA, 22 bp, Homo sapiens
tgctgaattctaccatccattt

SEQ ID NO: 9303464 - DNA, 22 bp, Homo sapiens
tgctgaattaaactctatgtgg

SEQ ID NO: 9303465 - DNA, 22 bp, Homo sapiens
tgctgaatgtgctcccttttaa

SEQ ID NO: 9303466 - DNA, 22 bp, Homo sapiens
tgctgaatttacatttttgtag

SEQ ID NO: 9303467 - DNA, 22 bp, Homo sapiens
tgctgaattggtagtactgttg

SEQ ID NO: 9303468 - DNA, 22 bp, Homo sapiens
tgctgaattctcattccctgga

SEQ ID NO: 9303469 - DNA, 22 bp, Homo sapiens
tgctgacactattctaaaaagc

SEQ ID NO: 9303470 - DNA, 22 bp, Homo sapiens
tgctgaatcatatggtaattct

SEQ ID NO: 9303471 - DNA, 22 bp, Homo sapiens
tgctgaatcaaaacaaaggttt

SEQ ID NO: 9303472 - DNA, 22 bp, Homo sapiens
tgctgaatatagagcaagaagt

SEQ ID NO: 9303473 - DNA, 22 bp, Homo sapiens
tgctgaataataagattactca

SEQ ID NO: 9303474 - DNA, 21 bp, Homo sapiens
tgctgaatctgccatattttc

SEQ ID NO: 9303475 - DNA, 22 bp, Homo sapiens
tgctgaatgaatggatggttgc

SEQ ID NO: 9303476 - DNA, 22 bp, Homo sapiens
tgctgaatcccaccctccagtg

SEQ ID NO: 9303477 - DNA, 22 bp, Homo sapiens
tgctgaataagacgtggcttgt

SEQ ID NO: 9303478 - DNA, 22 bp, Homo sapiens
tgctgaataaataaagtctatt

SEQ ID NO: 9303479 - DNA, 22 bp, Homo sapiens
tgctgaataaagatatattttc

SEQ ID NO: 9303480 - DNA, 22 bp, Homo sapiens
tgctgagacaacaggaaacaag

SEQ ID NO: 9303481 - DNA, 22 bp, Homo sapiens
tgctgagagccagggctggcat

SEQ ID NO: 9303482 - DNA, 22 bp, Homo sapiens
tgctgagaggaaagaatgcaca

SEQ ID NO: 9303483 - DNA, 22 bp, Homo sapiens
tgctgagaagagggccgaccca

SEQ ID NO: 9303484 - DNA, 22 bp, Homo sapiens
tgcctgctctgtgccacagttg

SEQ ID NO: 9303485 - DNA, 22 bp, Homo sapiens
tgcctgctcttaccactctccc

SEQ ID NO: 9303486 - DNA, 16 bp, Homo sapiens
tgcctgctctgatctc

SEQ ID NO: 9303487 - DNA, 22 bp, Homo sapiens
tgcctgctcttaccactctccc

SEQ ID NO: 9303488 - DNA, 22 bp, Homo sapiens
tgcctgctcttgagacttacaa

SEQ ID NO: 9303489 - DNA, 22 bp, Homo sapiens
tgcctgctctttattttatgat

SEQ ID NO: 9303490 - DNA, 22 bp, Homo sapiens
tgcctgggacatgctgtggact

SEQ ID NO: 9303491 - DNA, 22 bp, Homo sapiens
tgctccagtgcctgccccacag

SEQ ID NO: 9303492 - DNA, 22 bp, Homo sapiens
tgctcccaaacctgacaggctc

SEQ ID NO: 9303493 - DNA, 23 bp, Homo sapiens
tgctccaggtacagaactccagg

SEQ ID NO: 9303494 - DNA, 22 bp, Homo sapiens
tgctccagggctgccagaccct

SEQ ID NO: 9303495 - DNA, 22 bp, Homo sapiens
tgctccagggctgccagaccct

SEQ ID NO: 9303496 - DNA, 22 bp, Homo sapiens
tgctccagtgagctggccatcc

SEQ ID NO: 9303497 - DNA, 22 bp, Homo sapiens
tgctccagtgagctggccatcc

SEQ ID NO: 9303498 - DNA, 22 bp, Homo sapiens
tgctccaggtgtgcctctcatg

SEQ ID NO: 9303499 - DNA, 22 bp, Homo sapiens
cccaggctcctgactcattcta

SEQ ID NO: 9303500 - DNA, 22 bp, Homo sapiens
cccaggctcctgactcattcta

SEQ ID NO: 9303501 - DNA, 21 bp, Homo sapiens
cccaggctgaattaaaaatat

SEQ ID NO: 9303502 - DNA, 22 bp, Homo sapiens
cccaggctcttatgtgacttgc

SEQ ID NO: 9303503 - DNA, 22 bp, Homo sapiens
cccctcaggtacccgtgcagca

SEQ ID NO: 9303504 - DNA, 22 bp, Homo sapiens
ccccctgcgcccggcacgtcat

SEQ ID NO: 9303505 - DNA, 22 bp, Homo sapiens
cccctaggaggcgatggtggaa

SEQ ID NO: 9303506 - DNA, 22 bp, Homo sapiens
cccccaggctctgacacaggag

SEQ ID NO: 9303507 - DNA, 22 bp, Homo sapiens
cccccaggggctccgcctcgtg

SEQ ID NO: 9303508 - DNA, 22 bp, Homo sapiens
ccccaggcctgttggatggcgc

SEQ ID NO: 9303509 - DNA, 22 bp, Homo sapiens
cccccaccgtgttcctgctcgg

SEQ ID NO: 9303510 - DNA, 22 bp, Homo sapiens
cccccaccgtgttcctgctcgg

SEQ ID NO: 9303511 - DNA, 22 bp, Homo sapiens
cccccacctgaggacagtctta

SEQ ID NO: 9303512 - DNA, 22 bp, Homo sapiens
cccctctccctcacttatcaat

SEQ ID NO: 9303513 - DNA, 22 bp, Homo sapiens
cccctcctggccacactgtcag

SEQ ID NO: 9303514 - DNA, 20 bp, Homo sapiens
ccctaggaacgcagcaggag

SEQ ID NO: 9303515 - DNA, 20 bp, Homo sapiens
ccctaggaacgcagcaggag

SEQ ID NO: 9303516 - DNA, 22 bp, Homo sapiens
cccctcctgcagcacctttctt

SEQ ID NO: 9303517 - DNA, 22 bp, Homo sapiens
tgctgcagctttgtcacatgca

SEQ ID NO: 9303518 - DNA, 22 bp, Homo sapiens
ccccagcagcacctggggcagt

SEQ ID NO: 9303519 - DNA, 22 bp, Homo sapiens
tgctggagagccttggccaagg

SEQ ID NO: 9303520 - DNA, 22 bp, Homo sapiens
cccaggaaagagactgctgggt

SEQ ID NO: 9303521 - DNA, 22 bp, Homo sapiens
cccagctgtggcagaggccggg

SEQ ID NO: 9303522 - DNA, 20 bp, Homo sapiens
tgcattaagtggcattgagc

SEQ ID NO: 9303523 - DNA, 22 bp, Homo sapiens
tgcattaaaatgtgcctctctt

SEQ ID NO: 9303524 - DNA, 22 bp, Homo sapiens
tgcattaaaaccatcgaccatc

SEQ ID NO: 9303525 - DNA, 17 bp, Homo sapiens
cccagctggcagtgccg

SEQ ID NO: 9303526 - DNA, 22 bp, Homo sapiens
cccagctccgagctccgagccg

SEQ ID NO: 9303527 - DNA, 22 bp, Homo sapiens
cccagcgagtttgccggtgaac

SEQ ID NO: 9303528 - DNA, 22 bp, Homo sapiens
cccagcctggtgcactgtgggg

SEQ ID NO: 9303529 - DNA, 22 bp, Homo sapiens
cccagcctttgcttcctggttc

SEQ ID NO: 9303530 - DNA, 22 bp, Homo sapiens
cccagccttccaccctggacta

SEQ ID NO: 9303531 - DNA, 22 bp, Homo sapiens
cccagcctactctgccatagca

SEQ ID NO: 9303532 - DNA, 22 bp, Homo sapiens
cccagcctggtgcactgtgggg

SEQ ID NO: 9303533 - DNA, 22 bp, Homo sapiens
tctgtggcagttctggttcatc

SEQ ID NO: 9303534 - DNA, 19 bp, Homo sapiens
tgcctgctcctggcttcca

SEQ ID NO: 9303535 - DNA, 22 bp, Homo sapiens
cccaggcagcctgcagggaagg

SEQ ID NO: 9303536 - DNA, 22 bp, Homo sapiens
cccaggcactcttggtcatttt

SEQ ID NO: 9303537 - DNA, 22 bp, Homo sapiens
cccaggaggtggaggttgcagt

SEQ ID NO: 9303538 - DNA, 22 bp, Homo sapiens
cccaggaggtggaggttgcagc

SEQ ID NO: 9303539 - DNA, 22 bp, Homo sapiens
cccaggaggtggaggctgcagt

SEQ ID NO: 9303540 - DNA, 22 bp, Homo sapiens
tgcattatcgtcttgatcctct

SEQ ID NO: 9303541 - DNA, 22 bp, Homo sapiens
tgcattatttgcatgtgcctgt

SEQ ID NO: 9303542 - DNA, 22 bp, Homo sapiens
tgcattatgcttgtgctgtata

SEQ ID NO: 9303543 - DNA, 22 bp, Homo sapiens
tgccaagaggtccaggtgggaa

SEQ ID NO: 9303544 - DNA, 22 bp, Homo sapiens
tgccacaccaacatctttcagc

SEQ ID NO: 9303545 - DNA, 22 bp, Homo sapiens
tgtggggctgtcaggcaactgg

SEQ ID NO: 9303546 - DNA, 22 bp, Homo sapiens
tgtggggcttacaaaggcagat

SEQ ID NO: 9303547 - DNA, 22 bp, Homo sapiens
tgtgtgggcatgcttttaattt

SEQ ID NO: 9303548 - DNA, 21 bp, Homo sapiens
tgtgtgggcatatctgctgca

SEQ ID NO: 9303549 - DNA, 22 bp, Homo sapiens
tgtggggccaaagcccagccac

SEQ ID NO: 9303550 - DNA, 22 bp, Homo sapiens
tgtggggcagctagccggcctg

SEQ ID NO: 9303551 - DNA, 22 bp, Homo sapiens
tgtggggcctcgtgctagctgg

SEQ ID NO: 9303552 - DNA, 22 bp, Homo sapiens
tgtggggctccctggcagcctg

SEQ ID NO: 9303553 - DNA, 23 bp, Homo sapiens
cctgggcattggctgcagcttct

SEQ ID NO: 9303554 - DNA, 22 bp, Homo sapiens
cctgggcatctcatgcacctgc

SEQ ID NO: 9303555 - DNA, 22 bp, Homo sapiens
cctgggcattctttgagttctc

SEQ ID NO: 9303556 - DNA, 22 bp, Homo sapiens
cctgggaggcagaggttgcagt

SEQ ID NO: 9303557 - DNA, 22 bp, Homo sapiens
cctgggaggcggaggttgcagg

SEQ ID NO: 9303558 - DNA, 22 bp, Homo sapiens
cctgggcaatatagtgaggccc

SEQ ID NO: 9303559 - DNA, 22 bp, Homo sapiens
cctgggaggcggaggttgcagt

SEQ ID NO: 9303560 - DNA, 22 bp, Homo sapiens
cctgggcatcaacaagcagaga

SEQ ID NO: 9303561 - DNA, 22 bp, Homo sapiens
cctgggagctgtggaaaggctg

SEQ ID NO: 9303562 - DNA, 17 bp, Homo sapiens
tgtggctttgactggga

SEQ ID NO: 9303563 - DNA, 17 bp, Homo sapiens
cctgggaggagttatga

SEQ ID NO: 9303564 - DNA, 22 bp, Homo sapiens
tgtgcttttctctgctcctgga

SEQ ID NO: 9303565 - DNA, 22 bp, Homo sapiens
tgtgttctccaactgtagattt

SEQ ID NO: 9303566 - DNA, 22 bp, Homo sapiens
tgtgttcatttaactgttcttt

SEQ ID NO: 9303567 - DNA, 22 bp, Homo sapiens
tgtgttcattagcattgccttg

SEQ ID NO: 9303568 - DNA, 22 bp, Homo sapiens
tgtgttcatttctctctgctgt

SEQ ID NO: 9303569 - DNA, 22 bp, Homo sapiens
tgtgttcagtatgacattcaca

SEQ ID NO: 9303570 - DNA, 22 bp, Homo sapiens
tgtgttcagaatttgctgcttt

SEQ ID NO: 9303571 - DNA, 22 bp, Homo sapiens
tgtgttcagcaggcaccttctt

SEQ ID NO: 9303572 - DNA, 22 bp, Homo sapiens
tgtgttcaatgacttcatcttt

SEQ ID NO: 9303573 - DNA, 22 bp, Homo sapiens
tgtgttcaatccctagtctcag

SEQ ID NO: 9303574 - DNA, 22 bp, Homo sapiens
cctggggacctgcctcagccct

SEQ ID NO: 9303575 - DNA, 22 bp, Homo sapiens
cctggggacctgcctcagccct

SEQ ID NO: 9303576 - DNA, 22 bp, Homo sapiens
cctgggtgaaatagtcctcaag

SEQ ID NO: 9303577 - DNA, 22 bp, Homo sapiens
cctgggtgaaatctctcctgca

SEQ ID NO: 9303578 - DNA, 22 bp, Homo sapiens
cctgggtgatgtgctgccctcg

SEQ ID NO: 9303579 - DNA, 22 bp, Homo sapiens
tgtgtgggtggtaaggaaggcc

SEQ ID NO: 9303580 - DNA, 19 bp, Homo sapiens
cctgggcctccatcacccc

SEQ ID NO: 9303581 - DNA, 22 bp, Homo sapiens
cctgggcctgaaaacatttctc

SEQ ID NO: 9303582 - DNA, 22 bp, Homo sapiens
cctggggaagtcacttctcttt

SEQ ID NO: 9303583 - DNA, 22 bp, Homo sapiens
cctgggctttggaacagtactt

SEQ ID NO: 9303584 - DNA, 22 bp, Homo sapiens
cctgggctcaagcgatcttgtc

SEQ ID NO: 9303585 - DNA, 22 bp, Homo sapiens
cctgggcttccacgagcagagg

SEQ ID NO: 9303586 - DNA, 22 bp, Homo sapiens
cctgggcttccacgagcagagg

SEQ ID NO: 9303587 - DNA, 22 bp, Homo sapiens
cctgggctttgctggcaaggcc

SEQ ID NO: 9303588 - DNA, 22 bp, Homo sapiens
cctgggctttgctggcaaggcc

SEQ ID NO: 9303589 - DNA, 20 bp, Homo sapiens
cctgggctcaaagcatcctc

SEQ ID NO: 9303590 - DNA, 22 bp, Homo sapiens
cctgggagccgactgactgtgc

SEQ ID NO: 9303591 - DNA, 22 bp, Homo sapiens
cctgggagagtctgtggtctcc

SEQ ID NO: 9303592 - DNA, 22 bp, Homo sapiens
cctgggagagccatctgtggcc

SEQ ID NO: 9303593 - DNA, 22 bp, Homo sapiens
cctgggagagccatctgtggcc

SEQ ID NO: 9303594 - DNA, 20 bp, Homo sapiens
cctggctttgcatctgtgat

SEQ ID NO: 9303595 - DNA, 22 bp, Homo sapiens
cctggcttttgttcccggcgtc

SEQ ID NO: 9303596 - DNA, 20 bp, Homo sapiens
cctggctttgcagcatgaga

SEQ ID NO: 9303597 - DNA, 22 bp, Homo sapiens
cctggctttagctgccttccct

SEQ ID NO: 9303598 - DNA, 22 bp, Homo sapiens
cctggcttctctgcattgttct

SEQ ID NO: 9303599 - DNA, 22 bp, Homo sapiens
cctggcttctataccaccaggt

SEQ ID NO: 9303600 - DNA, 22 bp, Homo sapiens
cctggcttccttcatgacctgg

SEQ ID NO: 9303601 - DNA, 22 bp, Homo sapiens
cctggctgtttatttcggggct

SEQ ID NO: 9303602 - DNA, 22 bp, Homo sapiens
cctggctgtgtgaccttggcaa

SEQ ID NO: 9303603 - DNA, 22 bp, Homo sapiens
cctggctgtggcggtgctctca

SEQ ID NO: 9303604 - DNA, 22 bp, Homo sapiens
cctggctgtggcggtgctctca

SEQ ID NO: 9303605 - DNA, 23 bp, Homo sapiens
cctggctgtggatttgggcctgc

SEQ ID NO: 9303606 - DNA, 22 bp, Homo sapiens
cctggcttcagcattgccctct

SEQ ID NO: 9303607 - DNA, 22 bp, Homo sapiens
cctggcttagaggttgcctttc

SEQ ID NO: 9303608 - DNA, 22 bp, Homo sapiens
cctggctgtgtgaccttggcaa

SEQ ID NO: 9303609 - DNA, 22 bp, Homo sapiens
cctggctgtttgagcggggaat

SEQ ID NO: 9303610 - DNA, 23 bp, Homo sapiens
cctggcttcattctcttagggtg

SEQ ID NO: 9303611 - DNA, 22 bp, Homo sapiens
cctggcttccatatggcacata

SEQ ID NO: 9303612 - DNA, 22 bp, Homo sapiens
cctggcttcagcattgccctct

SEQ ID NO: 9303613 - DNA, 18 bp, Homo sapiens
cctggcttccatcttggt

SEQ ID NO: 9303614 - DNA, 22 bp, Homo sapiens
cctggctgcccatggaccctct

SEQ ID NO: 9303615 - DNA, 22 bp, Homo sapiens
cctggctgcccatggaccctct

SEQ ID NO: 9303616 - DNA, 22 bp, Homo sapiens
cctggctgccgagtgtgcagcg

SEQ ID NO: 9303617 - DNA, 22 bp, Homo sapiens
cctggctgccttgtgttgatct

SEQ ID NO: 9303618 - DNA, 22 bp, Homo sapiens
cctggctgccgagtgtgcagcg

SEQ ID NO: 9303619 - DNA, 20 bp, Homo sapiens
cctggctgcattcaggacgg

SEQ ID NO: 9303620 - DNA, 20 bp, Homo sapiens
cctggctgcattcaggacgg

SEQ ID NO: 9303621 - DNA, 22 bp, Homo sapiens
cctggctgcattttgctggatg

SEQ ID NO: 9303622 - DNA, 22 bp, Homo sapiens
cctggctgcattttgctggatg

SEQ ID NO: 9303623 - DNA, 22 bp, Homo sapiens
cctggctgctctgatgagcgcc

SEQ ID NO: 9303624 - DNA, 22 bp, Homo sapiens
cctggctgctatagcagcatgt

SEQ ID NO: 9303625 - DNA, 22 bp, Homo sapiens
cctggctgctatagcagcatgt

SEQ ID NO: 9303626 - DNA, 22 bp, Homo sapiens
cctggctggttgtctgattcta

SEQ ID NO: 9303627 - DNA, 22 bp, Homo sapiens
cctggctgctgtcactgaccat

SEQ ID NO: 9303628 - DNA, 22 bp, Homo sapiens
cctggctgtcgttttgtgaaat

SEQ ID NO: 9303629 - DNA, 19 bp, Homo sapiens
cctggctgtgaagcctgca

SEQ ID NO: 9303630 - DNA, 22 bp, Homo sapiens
cctggctgtgcatgtttctatg

SEQ ID NO: 9303631 - DNA, 23 bp, Homo sapiens
cctggctgtggatttgggcctgc

SEQ ID NO: 9303632 - DNA, 22 bp, Homo sapiens
cctggctgtgcattgccggccc

SEQ ID NO: 9303633 - DNA, 22 bp, Homo sapiens
cctggctgtgcattgccggccc

SEQ ID NO: 9303634 - DNA, 22 bp, Homo sapiens
cctggctgtgcatgtttctatg

SEQ ID NO: 9303635 - DNA, 22 bp, Homo sapiens
tgtctggtgggttgacaggcag

SEQ ID NO: 9303636 - DNA, 22 bp, Homo sapiens
tgtctttagccagcagtcttct

SEQ ID NO: 9303637 - DNA, 22 bp, Homo sapiens
tgtctttagccagcagtcttct

SEQ ID NO: 9303638 - DNA, 22 bp, Homo sapiens
tgtctttagccacttgcctctt

SEQ ID NO: 9303639 - DNA, 22 bp, Homo sapiens
tgtctttagagtcacaaaacca

SEQ ID NO: 9303640 - DNA, 22 bp, Homo sapiens
tgtctttagaaagaagcagaca

SEQ ID NO: 9303641 - DNA, 22 bp, Homo sapiens
tgtctttagacctctctggcct

SEQ ID NO: 9303642 - DNA, 22 bp, Homo sapiens
cctggctcttctgtgtcagccc

SEQ ID NO: 9303643 - DNA, 22 bp, Homo sapiens
cctggctgaacaaagtccctcc

SEQ ID NO: 9303644 - DNA, 22 bp, Homo sapiens
cctggctgaaccaatgaagtgg

SEQ ID NO: 9303645 - DNA, 22 bp, Homo sapiens
cctggctgacagcttaattcca

SEQ ID NO: 9303646 - DNA, 22 bp, Homo sapiens
cctggctgaacaaagtccctcc

SEQ ID NO: 9303647 - DNA, 23 bp, Homo sapiens
cctggctgacctgaaggtgtagt

SEQ ID NO: 9303648 - DNA, 23 bp, Homo sapiens
cctggctgacctgaaggtgtagt

SEQ ID NO: 9303649 - DNA, 22 bp, Homo sapiens
cctggctctgaagtccacatca

SEQ ID NO: 9303650 - DNA, 22 bp, Homo sapiens
cctggctcttcgggagtttgtt

SEQ ID NO: 9303651 - DNA, 22 bp, Homo sapiens
cctggctgagggacctcgggta

SEQ ID NO: 9303652 - DNA, 22 bp, Homo sapiens
cctggctgagggacctcgggta

SEQ ID NO: 9303653 - DNA, 22 bp, Homo sapiens
cctggctgagcctccaggaaga

SEQ ID NO: 9303654 - DNA, 22 bp, Homo sapiens
cctggctgaggggccaaggacc

SEQ ID NO: 9303655 - DNA, 22 bp, Homo sapiens
tgtctgggggttctgaaagctg

SEQ ID NO: 9303656 - DNA, 21 bp, Homo sapiens
cctggctgcacagttgctggt

SEQ ID NO: 9303657 - DNA, 21 bp, Homo sapiens
cctggctgcacagttgctggt

SEQ ID NO: 9303658 - DNA, 22 bp, Homo sapiens
tgtgaggaacaggactagagca

SEQ ID NO: 9303659 - DNA, 22 bp, Homo sapiens
tgtgaggaacccggaatgtggg

SEQ ID NO: 9303660 - DNA, 22 bp, Homo sapiens
tgtgaggacattggaggactca

SEQ ID NO: 9303661 - DNA, 22 bp, Homo sapiens
tgtgaggacctcagcagagtct

SEQ ID NO: 9303662 - DNA, 20 bp, Homo sapiens
tgtgaggagcatggccgctg

SEQ ID NO: 9303663 - DNA, 22 bp, Homo sapiens
tgtgaggagaggcccagctccc

SEQ ID NO: 9303664 - DNA, 22 bp, Homo sapiens
tgtgaggaggcggccagaagag

SEQ ID NO: 9303665 - DNA, 22 bp, Homo sapiens
tgtgaggagggtcaaactgagt

SEQ ID NO: 9303666 - DNA, 22 bp, Homo sapiens
tgtgaggagtaggctgagggtg

SEQ ID NO: 9303667 - DNA, 22 bp, Homo sapiens
cctggctgcagtttttgcagaa

SEQ ID NO: 9303668 - DNA, 22 bp, Homo sapiens
tgtgaggattaaatgcatagtg

SEQ ID NO: 9303669 - DNA, 22 bp, Homo sapiens
tgtgaggatgttaaggggatga

SEQ ID NO: 9303670 - DNA, 22 bp, Homo sapiens
tgtgaggatgtgagcgtgaacc

SEQ ID NO: 9303671 - DNA, 22 bp, Homo sapiens
tgtgaggatgttaaggggatga

SEQ ID NO: 9303672 - DNA, 22 bp, Homo sapiens
tgtgaggatggagttctacagg

SEQ ID NO: 9303673 - DNA, 22 bp, Homo sapiens
tgtgaggatgtaaccagaagtc

SEQ ID NO: 9303674 - DNA, 22 bp, Homo sapiens
tgtgaggataaaaaggaaggag

SEQ ID NO: 9303675 - DNA, 22 bp, Homo sapiens
tgtgaggataaaaaggaaggag

SEQ ID NO: 9303676 - DNA, 22 bp, Homo sapiens
tgtctttagttttactgtctgg

SEQ ID NO: 9303677 - DNA, 22 bp, Homo sapiens
tgtctttatatatttggaaaat

SEQ ID NO: 9303678 - DNA, 22 bp, Homo sapiens
tgtctttatgcacactgacttg

SEQ ID NO: 9303679 - DNA, 22 bp, Homo sapiens
cctggcaggtggcgccctcggc

SEQ ID NO: 9303680 - DNA, 22 bp, Homo sapiens
cctggcagtcaggggagtcctt

SEQ ID NO: 9303681 - DNA, 22 bp, Homo sapiens
cctggcaggcaagaggaaggga

SEQ ID NO: 9303682 - DNA, 22 bp, Homo sapiens
cctggcaggcccctcctggatt

SEQ ID NO: 9303683 - DNA, 20 bp, Homo sapiens
cctggcaggcgggttactta

SEQ ID NO: 9303684 - DNA, 22 bp, Homo sapiens
cctggcaggctggggacagtgc

SEQ ID NO: 9303685 - DNA, 22 bp, Homo sapiens
cctggcagactgtgagggcagg

SEQ ID NO: 9303686 - DNA, 23 bp, Homo sapiens
cctggcagcaaacgaggaggtta

SEQ ID NO: 9303687 - DNA, 23 bp, Homo sapiens
cctggcagcaaacgaggaggtta

SEQ ID NO: 9303688 - DNA, 22 bp, Homo sapiens
cctggcagctgtttggcttggc

SEQ ID NO: 9303689 - DNA, 22 bp, Homo sapiens
cctggccatttgaacttcagac

SEQ ID NO: 9303690 - DNA, 22 bp, Homo sapiens
cctggcagttcatcaaatggca

SEQ ID NO: 9303691 - DNA, 22 bp, Homo sapiens
cctggcagtggtgaagaagagg

SEQ ID NO: 9303692 - DNA, 22 bp, Homo sapiens
cctggccagcgccggctgctcg

SEQ ID NO: 9303693 - DNA, 22 bp, Homo sapiens
cctggccagccagggctggggt

SEQ ID NO: 9303694 - DNA, 22 bp, Homo sapiens
cctggcatgaggagcatgaggt

SEQ ID NO: 9303695 - DNA, 22 bp, Homo sapiens
cctggcatgtcctcctggcatg

SEQ ID NO: 9303696 - DNA, 22 bp, Homo sapiens
cctggcatccggaacctggaaa

SEQ ID NO: 9303697 - DNA, 22 bp, Homo sapiens
cctggcatctgagcctggcctg

SEQ ID NO: 9303698 - DNA, 22 bp, Homo sapiens
cctggccagggtctgggctgct

SEQ ID NO: 9303699 - DNA, 22 bp, Homo sapiens
cctggccagtttccaggccctg

SEQ ID NO: 9303700 - DNA, 22 bp, Homo sapiens
cctggccatagggcccaggaaa

SEQ ID NO: 9303701 - DNA, 22 bp, Homo sapiens
cctggccaggcatggagtcaca

SEQ ID NO: 9303702 - DNA, 22 bp, Homo sapiens
cctggccaggctctcagcactg

SEQ ID NO: 9303703 - DNA, 22 bp, Homo sapiens
cctggctctagaggccactcct

SEQ ID NO: 9303704 - DNA, 22 bp, Homo sapiens
cctggctcgctgacctcagggg

SEQ ID NO: 9303705 - DNA, 22 bp, Homo sapiens
cctggctctagaggccactcct

SEQ ID NO: 9303706 - DNA, 22 bp, Homo sapiens
cctggcctcctggccttctcat

SEQ ID NO: 9303707 - DNA, 22 bp, Homo sapiens
cctggcctcctggccttctcat

SEQ ID NO: 9303708 - DNA, 22 bp, Homo sapiens
cctggcctcgtgctcacggctc

SEQ ID NO: 9303709 - DNA, 22 bp, Homo sapiens
cctggctccaaagctgtgactc

SEQ ID NO: 9303710 - DNA, 22 bp, Homo sapiens
cctggctccaaagctgtgactc

SEQ ID NO: 9303711 - DNA, 22 bp, Homo sapiens
cctggctccagctgcctgtcct

SEQ ID NO: 9303712 - DNA, 22 bp, Homo sapiens
cctggcctggcactccctctgc

SEQ ID NO: 9303713 - DNA, 22 bp, Homo sapiens
cctggcctggcactccctctgc

SEQ ID NO: 9303714 - DNA, 22 bp, Homo sapiens
cctggcctgctcggctcttaag

SEQ ID NO: 9303715 - DNA, 22 bp, Homo sapiens
cctggcctctccgagtaacctg

SEQ ID NO: 9303716 - DNA, 22 bp, Homo sapiens
cctggcctgtgaatctgagagc

SEQ ID NO: 9303717 - DNA, 22 bp, Homo sapiens
tgtctctggctgcagcctgttc

SEQ ID NO: 9303718 - DNA, 22 bp, Homo sapiens
tgtctctgtcttccagggctgt

SEQ ID NO: 9303719 - DNA, 22 bp, Homo sapiens
cctggcccacatggcttctccc

SEQ ID NO: 9303720 - DNA, 22 bp, Homo sapiens
tgtcctctccaacagcctctgt

SEQ ID NO: 9303721 - DNA, 22 bp, Homo sapiens
tgtcctggagacacaaggtggt

SEQ ID NO: 9303722 - DNA, 22 bp, Homo sapiens
tgtcctggatcatgcctctgaa

SEQ ID NO: 9303723 - DNA, 22 bp, Homo sapiens
tgtcctggatcatgcctctgaa

SEQ ID NO: 9303724 - DNA, 22 bp, Homo sapiens
tggtccagtagcagggatacca

SEQ ID NO: 9303725 - DNA, 22 bp, Homo sapiens
tggtccagtaagggtggagaga

SEQ ID NO: 9303726 - DNA, 22 bp, Homo sapiens
tggtccagtcgttcctttcctt

SEQ ID NO: 9303727 - DNA, 22 bp, Homo sapiens
tggtccagtcgttcctttcctt

SEQ ID NO: 9303728 - DNA, 22 bp, Homo sapiens
tggtccagtgacagataggcac

SEQ ID NO: 9303729 - DNA, 22 bp, Homo sapiens
tggtccagttctgtgatattgc

SEQ ID NO: 9303730 - DNA, 22 bp, Homo sapiens
tggtccagtttagcattgagtg

SEQ ID NO: 9303731 - DNA, 18 bp, Homo sapiens
tggtccagttcagatata

SEQ ID NO: 9303732 - DNA, 22 bp, Homo sapiens
tggtgctgagatgaagtgctcc

SEQ ID NO: 9303733 - DNA, 22 bp, Homo sapiens
cctgccatgccagcatgcccgt

SEQ ID NO: 9303734 - DNA, 20 bp, Homo sapiens
tggtcctcacaggtcctccc

SEQ ID NO: 9303735 - DNA, 22 bp, Homo sapiens
tggtgctgccaggctcctgcca

SEQ ID NO: 9303736 - DNA, 22 bp, Homo sapiens
tggtgctgccacctcctctgct

SEQ ID NO: 9303737 - DNA, 22 bp, Homo sapiens
tggtgctgcctcagatgcctta

SEQ ID NO: 9303738 - DNA, 22 bp, Homo sapiens
tgtaaacatatcagactttctt

SEQ ID NO: 9303739 - DNA, 22 bp, Homo sapiens
tgtaaacatatcagactttctt

SEQ ID NO: 9303740 - DNA, 22 bp, Homo sapiens
tgtaaacataccagagccaagt

SEQ ID NO: 9303741 - DNA, 22 bp, Homo sapiens
tgtaaacagccccatggagagc

SEQ ID NO: 9303742 - DNA, 22 bp, Homo sapiens
tgtaaacagtaggactaaagag

SEQ ID NO: 9303743 - DNA, 22 bp, Homo sapiens
tggtgggacatctgaggagagg

SEQ ID NO: 9303744 - DNA, 22 bp, Homo sapiens
tgtaaacatgctgaggctggag

SEQ ID NO: 9303745 - DNA, 22 bp, Homo sapiens
tgtaaacatatgtatgtatgta

SEQ ID NO: 9303746 - DNA, 23 bp, Homo sapiens
tgtaaacatcaccccctggagtt

SEQ ID NO: 9303747 - DNA, 23 bp, Homo sapiens
tgtaaaccattttgcatcccatg

SEQ ID NO: 9303748 - DNA, 20 bp, Homo sapiens
tgtaggtgtacagtaaggag

SEQ ID NO: 9303749 - DNA, 22 bp, Homo sapiens
cctggcagacagcactgaagct

SEQ ID NO: 9303750 - DNA, 22 bp, Homo sapiens
cctggcagaatattaaagtgca

SEQ ID NO: 9303751 - DNA, 22 bp, Homo sapiens
cctggcagacagcactgaagct

SEQ ID NO: 9303752 - DNA, 22 bp, Homo sapiens
tgtattagagcatataatttga

SEQ ID NO: 9303753 - DNA, 22 bp, Homo sapiens
gaccaggcttccccagacctca

SEQ ID NO: 9303754 - DNA, 22 bp, Homo sapiens
gaccatcctggccaacgtggta

SEQ ID NO: 9303755 - DNA, 22 bp, Homo sapiens
gaccagtcattactcatgccct

SEQ ID NO: 9303756 - DNA, 22 bp, Homo sapiens
gacaggaggcagagctcaggtg

SEQ ID NO: 9303757 - DNA, 22 bp, Homo sapiens
gacccaggagtgcagagagtgg

SEQ ID NO: 9303758 - DNA, 22 bp, Homo sapiens
gacccaggctcgtgggacggct

SEQ ID NO: 9303759 - DNA, 18 bp, Homo sapiens
gacccaggaaagagtcct

SEQ ID NO: 9303760 - DNA, 22 bp, Homo sapiens
gactggggtaaggtgaggaggt

SEQ ID NO: 9303761 - DNA, 22 bp, Homo sapiens
gactggggtaaggtgaggaggt

SEQ ID NO: 9303762 - DNA, 22 bp, Homo sapiens
gacttgggtgtcggggcagtct

SEQ ID NO: 9303763 - DNA, 22 bp, Homo sapiens
gacttaaaggctgaatgtagga

SEQ ID NO: 9303764 - DNA, 22 bp, Homo sapiens
gagagcccttaggtttagagtt

SEQ ID NO: 9303765 - DNA, 22 bp, Homo sapiens
gagagcctgccagtgagtgtat

SEQ ID NO: 9303766 - DNA, 22 bp, Homo sapiens
gagacagagtttcactcttgtt

SEQ ID NO: 9303767 - DNA, 22 bp, Homo sapiens
gagacagagtgttttttaaggt

SEQ ID NO: 9303768 - DNA, 22 bp, Homo sapiens
gagacagagatcttgctgagtc

SEQ ID NO: 9303769 - DNA, 22 bp, Homo sapiens
gagagctgaggggcctggcact

SEQ ID NO: 9303770 - DNA, 22 bp, Homo sapiens
gagagctgaggggcctggcact

SEQ ID NO: 9303771 - DNA, 22 bp, Homo sapiens
gagagctgcaaggtagggcggg

SEQ ID NO: 9303772 - DNA, 22 bp, Homo sapiens
gagagctgcagccgagaggggg

SEQ ID NO: 9303773 - DNA, 22 bp, Homo sapiens
gagagctgcattctcagacaca

SEQ ID NO: 9303774 - DNA, 20 bp, Homo sapiens
gagagctggggatgaggctg

SEQ ID NO: 9303775 - DNA, 22 bp, Homo sapiens
gagagctgggggactgtggatg

SEQ ID NO: 9303776 - DNA, 22 bp, Homo sapiens
gagagctgggttcaagtagctg

SEQ ID NO: 9303777 - DNA, 22 bp, Homo sapiens
gagagctgggaaagccgtggag

SEQ ID NO: 9303778 - DNA, 20 bp, Homo sapiens
gagagctggggatgaggctg

SEQ ID NO: 9303779 - DNA, 22 bp, Homo sapiens
gactttatcctgcctgaccacg

SEQ ID NO: 9303780 - DNA, 22 bp, Homo sapiens
gactttatcttgtccttcctgc

SEQ ID NO: 9303781 - DNA, 22 bp, Homo sapiens
gactttattatagtggcaatag

SEQ ID NO: 9303782 - DNA, 22 bp, Homo sapiens
gactttatttccttatttgtga

SEQ ID NO: 9303783 - DNA, 22 bp, Homo sapiens
gagaaacaacacttgatgcctt

SEQ ID NO: 9303784 - DNA, 22 bp, Homo sapiens
gaactgtagttaatactacaca

SEQ ID NO: 9303785 - DNA, 22 bp, Homo sapiens
gaaggctgagtgggtacggagg

SEQ ID NO: 9303786 - DNA, 22 bp, Homo sapiens
gaaggctgagcagacaggccaa

SEQ ID NO: 9303787 - DNA, 22 bp, Homo sapiens
gaaggctgcgaggggagtgccg

SEQ ID NO: 9303788 - DNA, 22 bp, Homo sapiens
gaagtgggctttgtggtcagct

SEQ ID NO: 9303789 - DNA, 22 bp, Homo sapiens
gaagtggcctgaagtgaatgct

SEQ ID NO: 9303790 - DNA, 22 bp, Homo sapiens
gaagtggggaagcaacaggaga

SEQ ID NO: 9303791 - DNA, 22 bp, Homo sapiens
gaagtgggtggtgatatcactg

SEQ ID NO: 9303792 - DNA, 22 bp, Homo sapiens
gacaggaatgtgtggatgcgga

SEQ ID NO: 9303793 - DNA, 20 bp, Homo sapiens
gacaggagagttaggtaggt

SEQ ID NO: 9303794 - DNA, 22 bp, Homo sapiens
gacacagagctcacagtctcct

SEQ ID NO: 9303795 - DNA, 22 bp, Homo sapiens
gacacagagataggcctgtgtt

SEQ ID NO: 9303796 - DNA, 22 bp, Homo sapiens
gacacagagataggcctgtgtt

SEQ ID NO: 9303797 - DNA, 22 bp, Homo sapiens
gaatttaagaggatgaatctgt

SEQ ID NO: 9303798 - DNA, 22 bp, Homo sapiens
gacacagagtattttaagtact

SEQ ID NO: 9303799 - DNA, 22 bp, Homo sapiens
gacacagagtattttaagtact

SEQ ID NO: 9303800 - DNA, 22 bp, Homo sapiens
gacacagataatttagttaaaa

SEQ ID NO: 9303801 - DNA, 22 bp, Homo sapiens
gacacagataatttagttaaaa

SEQ ID NO: 9303802 - DNA, 22 bp, Homo sapiens
gacacagagggcaccagatatg

SEQ ID NO: 9303803 - DNA, 22 bp, Homo sapiens
gacacagatatctctgagatta

SEQ ID NO: 9303804 - DNA, 22 bp, Homo sapiens
gacacagcactgtacaaggaat

SEQ ID NO: 9303805 - DNA, 22 bp, Homo sapiens
gacacagatgatcaggtgtgga

SEQ ID NO: 9303806 - DNA, 22 bp, Homo sapiens
gaattgggggttttgcaaggca

SEQ ID NO: 9303807 - DNA, 22 bp, Homo sapiens
gaattgctgatgaatctgattg

SEQ ID NO: 9303808 - DNA, 22 bp, Homo sapiens
gaattgcttctggtatgttact

SEQ ID NO: 9303809 - DNA, 22 bp, Homo sapiens
gaattgcttgtgaagtgtgtct

SEQ ID NO: 9303810 - DNA, 22 bp, Homo sapiens
gaattgcttgctgagattaaag

SEQ ID NO: 9303811 - DNA, 22 bp, Homo sapiens
gaattgggggttttgcaaggca

SEQ ID NO: 9303812 - DNA, 22 bp, Homo sapiens
gaattgctaatccaagtgactg

SEQ ID NO: 9303813 - DNA, 22 bp, Homo sapiens
gaattgctagcgcaccaattct

SEQ ID NO: 9303814 - DNA, 22 bp, Homo sapiens
gaattgctgaatcatatgttta

SEQ ID NO: 9303815 - DNA, 22 bp, Homo sapiens
gaattgctctgcctggccagcc

SEQ ID NO: 9303816 - DNA, 22 bp, Homo sapiens
gaattgctaggctgcatgtgtc

SEQ ID NO: 9303817 - DNA, 22 bp, Homo sapiens
gaattgctaaccaattcaaaat

SEQ ID NO: 9303818 - DNA, 22 bp, Homo sapiens
gaattccttaggctcttgactg

SEQ ID NO: 9303819 - DNA, 22 bp, Homo sapiens
gaattacatgaccctgagtaga

SEQ ID NO: 9303820 - DNA, 22 bp, Homo sapiens
gaattacattgttagccttcct

SEQ ID NO: 9303821 - DNA, 22 bp, Homo sapiens
gaattacatttgtgttactgca

SEQ ID NO: 9303822 - DNA, 22 bp, Homo sapiens
gaattacatagtttctaggttc

SEQ ID NO: 9303823 - DNA, 21 bp, Homo sapiens
gaaaagcaagggagtagaaca

SEQ ID NO: 9303824 - DNA, 21 bp, Homo sapiens
gaaaagcaagggagtagaaca

SEQ ID NO: 9303825 - DNA, 21 bp, Homo sapiens
gaaaagcaagggagtagaaca

SEQ ID NO: 9303826 - DNA, 22 bp, Homo sapiens
gaaaagggcaagagagagggca

SEQ ID NO: 9303827 - DNA, 22 bp, Homo sapiens
ctttgtgcgtagtgagtggtca

SEQ ID NO: 9303828 - DNA, 22 bp, Homo sapiens
ctttgtgcaaaccctagaatca

SEQ ID NO: 9303829 - DNA, 22 bp, Homo sapiens
ctttgtgccacagcttgactac

SEQ ID NO: 9303830 - DNA, 22 bp, Homo sapiens
ctttgtttatatttctcctcga

SEQ ID NO: 9303831 - DNA, 22 bp, Homo sapiens
ctttgtttatatttctcctcga

SEQ ID NO: 9303832 - DNA, 22 bp, Homo sapiens
ctttgtttatatttctcctcga

SEQ ID NO: 9303833 - DNA, 22 bp, Homo sapiens
ctttgttgttaattggcgctta

SEQ ID NO: 9303834 - DNA, 22 bp, Homo sapiens
ctttgttttactcagaggcatg

SEQ ID NO: 9303835 - DNA, 22 bp, Homo sapiens
ctttgttttactcagaggcatg

SEQ ID NO: 9303836 - DNA, 22 bp, Homo sapiens
gaaaacactttgatctgaaagt

SEQ ID NO: 9303837 - DNA, 17 bp, Homo sapiens
cttttaatttacttccc

SEQ ID NO: 9303838 - DNA, 22 bp, Homo sapiens
cttttaatgggagcagtatttg

SEQ ID NO: 9303839 - DNA, 22 bp, Homo sapiens
cttttaatgggagcagtatttg

SEQ ID NO: 9303840 - DNA, 22 bp, Homo sapiens
gaaagttgcaatcatggctttt

SEQ ID NO: 9303841 - DNA, 22 bp, Homo sapiens
gaaaggcagtacagctgagcct

SEQ ID NO: 9303842 - DNA, 22 bp, Homo sapiens
gaaaagtatgtttattttgact

SEQ ID NO: 9303843 - DNA, 22 bp, Homo sapiens
gaaaagttcatcatatattcag

SEQ ID NO: 9303844 - DNA, 22 bp, Homo sapiens
gaaaatacaaatagccttgaaa

SEQ ID NO: 9303845 - DNA, 22 bp, Homo sapiens
gaacccagtccaggtgcagcct

SEQ ID NO: 9303846 - DNA, 22 bp, Homo sapiens
gaacagaattaccgaagatctg

SEQ ID NO: 9303847 - DNA, 22 bp, Homo sapiens
gaactgtagagaatacatttct

SEQ ID NO: 9303848 - DNA, 22 bp, Homo sapiens
gaactgtaaaataattggcaat

SEQ ID NO: 9303849 - DNA, 22 bp, Homo sapiens
gaactgaaacttggtttaaagc

SEQ ID NO: 9303850 - DNA, 22 bp, Homo sapiens
gaaataattctgtgtctgaaca

SEQ ID NO: 9303851 - DNA, 22 bp, Homo sapiens
gaaataatacagtgctcttctc

SEQ ID NO: 9303852 - DNA, 22 bp, Homo sapiens
gaaataatttagaaggtattcc

SEQ ID NO: 9303853 - DNA, 22 bp, Homo sapiens
gaaatacaaagccagccatttt

SEQ ID NO: 9303854 - DNA, 19 bp, Homo sapiens
gaacaatttgttagctctc

SEQ ID NO: 9303855 - DNA, 22 bp, Homo sapiens
cttggctgaactccaggatgca

SEQ ID NO: 9303856 - DNA, 22 bp, Homo sapiens
cttgaatccaaatgggagatga

SEQ ID NO: 9303857 - DNA, 22 bp, Homo sapiens
cttggagtgaatgggggcaggt

SEQ ID NO: 9303858 - DNA, 22 bp, Homo sapiens
cttggattacccatatgattag

SEQ ID NO: 9303859 - DNA, 22 bp, Homo sapiens
cttggattccgtgaacttaacc

SEQ ID NO: 9303860 - DNA, 22 bp, Homo sapiens
cttggattgtacctagtatggt

SEQ ID NO: 9303861 - DNA, 22 bp, Homo sapiens
cttggcaactgaagactggctg

SEQ ID NO: 9303862 - DNA, 22 bp, Homo sapiens
ctttacaaattagctctcggga

SEQ ID NO: 9303863 - DNA, 22 bp, Homo sapiens
cttggggcagtgcttggcacat

SEQ ID NO: 9303864 - DNA, 22 bp, Homo sapiens
cttggggacacagagcccaggg

SEQ ID NO: 9303865 - DNA, 22 bp, Homo sapiens
ctttatatattcccaggctgcc

SEQ ID NO: 9303866 - DNA, 22 bp, Homo sapiens
ctttagttttcatcaaatctat

SEQ ID NO: 9303867 - DNA, 22 bp, Homo sapiens
ctttatatccagatgtttggtg

SEQ ID NO: 9303868 - DNA, 21 bp, Homo sapiens
ctttggtttcctcctgccttc

SEQ ID NO: 9303869 - DNA, 22 bp, Homo sapiens
ctttggttctgtccttcccaga

SEQ ID NO: 9303870 - DNA, 18 bp, Homo sapiens
ctttagctgtcatctttg

SEQ ID NO: 9303871 - DNA, 20 bp, Homo sapiens
ctttagttacacgtttcctc

SEQ ID NO: 9303872 - DNA, 22 bp, Homo sapiens
ctttagttgttatttcttcaca

SEQ ID NO: 9303873 - DNA, 22 bp, Homo sapiens
ctttagttgtctcctcaagggt

SEQ ID NO: 9303874 - DNA, 22 bp, Homo sapiens
ctttagttatttagactacagt

SEQ ID NO: 9303875 - DNA, 22 bp, Homo sapiens
ctttagttgttatttcttcaca

SEQ ID NO: 9303876 - DNA, 22 bp, Homo sapiens
ctttagtttgctgtcccctggg

SEQ ID NO: 9303877 - DNA, 22 bp, Homo sapiens
ctttagtttaagaacatgatga

SEQ ID NO: 9303878 - DNA, 22 bp, Homo sapiens
ctttacaattcaagggaactct

SEQ ID NO: 9303879 - DNA, 22 bp, Homo sapiens
ctttacaacctaagttgaagct

SEQ ID NO: 9303880 - DNA, 22 bp, Homo sapiens
ctggctgggcagacagaatgct

SEQ ID NO: 9303881 - DNA, 22 bp, Homo sapiens
ctggctgggcagacagaatgct

SEQ ID NO: 9303882 - DNA, 22 bp, Homo sapiens
ctggctggtcatgtcatgagcc

SEQ ID NO: 9303883 - DNA, 22 bp, Homo sapiens
ctggctggggtccatcctctaa

SEQ ID NO: 9303884 - DNA, 22 bp, Homo sapiens
cttctctccctggcactcagac

SEQ ID NO: 9303885 - DNA, 22 bp, Homo sapiens
cttctctccctggcactcagac

SEQ ID NO: 9303886 - DNA, 22 bp, Homo sapiens
cttctctccctggcactcagac

SEQ ID NO: 9303887 - DNA, 22 bp, Homo sapiens
cttctctcggtgcatccctcac

SEQ ID NO: 9303888 - DNA, 22 bp, Homo sapiens
cttctctcggtgcatccctcac

SEQ ID NO: 9303889 - DNA, 22 bp, Homo sapiens
ctggctggtctgagcagtcgca

SEQ ID NO: 9303890 - DNA, 22 bp, Homo sapiens
ctggctggttactatttctggt

SEQ ID NO: 9303891 - DNA, 22 bp, Homo sapiens
ctggctggttccctgctccagg

SEQ ID NO: 9303892 - DNA, 22 bp, Homo sapiens
ctggctggttccctgctccagg

SEQ ID NO: 9303893 - DNA, 22 bp, Homo sapiens
ctggctgtatgctggcctcaga

SEQ ID NO: 9303894 - DNA, 22 bp, Homo sapiens
ctggctgtcttctgggagctgt

SEQ ID NO: 9303895 - DNA, 22 bp, Homo sapiens
cttctctctgcataggcatggg

SEQ ID NO: 9303896 - DNA, 22 bp, Homo sapiens
cttctcttcctttgtcaactga

SEQ ID NO: 9303897 - DNA, 22 bp, Homo sapiens
cttctctgtcacagggttacgt

SEQ ID NO: 9303898 - DNA, 22 bp, Homo sapiens
cttctcttcccagggacacagg

SEQ ID NO: 9303899 - DNA, 22 bp, Homo sapiens
cttcttcttttgtgggtggtaa

SEQ ID NO: 9303900 - DNA, 22 bp, Homo sapiens
cttctcttggtagttcttgttg

SEQ ID NO: 9303901 - DNA, 22 bp, Homo sapiens
cttctttgaaaaaggcagtcag

SEQ ID NO: 9303902 - DNA, 22 bp, Homo sapiens
gaggcagcagaacatggaagag

SEQ ID NO: 9303903 - DNA, 22 bp, Homo sapiens
gaggcagcaggctgaggaggat

SEQ ID NO: 9303904 - DNA, 22 bp, Homo sapiens
gaggcagctcttctgaatgggg

SEQ ID NO: 9303905 - DNA, 22 bp, Homo sapiens
gaggcagctgggctggtggttt

SEQ ID NO: 9303906 - DNA, 22 bp, Homo sapiens
gaggcagctgaagcttcaaaga

SEQ ID NO: 9303907 - DNA, 22 bp, Homo sapiens
gaggcagctgggctggtggttt

SEQ ID NO: 9303908 - DNA, 22 bp, Homo sapiens
gaggcagctgggatacaaggga

SEQ ID NO: 9303909 - DNA, 22 bp, Homo sapiens
gaggcctctgtcccaccaggga

SEQ ID NO: 9303910 - DNA, 22 bp, Homo sapiens
gaggcctcagcctgccctgaac

SEQ ID NO: 9303911 - DNA, 22 bp, Homo sapiens
gaggccctgaagacagctgggg

SEQ ID NO: 9303912 - DNA, 22 bp, Homo sapiens
gaggccctggtaggtcagagtg

SEQ ID NO: 9303913 - DNA, 19 bp, Homo sapiens
gaggaggcttcagctttct

SEQ ID NO: 9303914 - DNA, 22 bp, Homo sapiens
gaggaggcttccgggaggcacg

SEQ ID NO: 9303915 - DNA, 22 bp, Homo sapiens
gaggaggcttccgggaggcacg

SEQ ID NO: 9303916 - DNA, 22 bp, Homo sapiens
gaggaggctgtttctctgcatt

SEQ ID NO: 9303917 - DNA, 22 bp, Homo sapiens
gaggaggcttccgggaggcacg

SEQ ID NO: 9303918 - DNA, 22 bp, Homo sapiens
gaggagggagaattaggcttaa

SEQ ID NO: 9303919 - DNA, 22 bp, Homo sapiens
gaggagggagctggaagctctt

SEQ ID NO: 9303920 - DNA, 22 bp, Homo sapiens
gaggcagagtcacaaagagtct

SEQ ID NO: 9303921 - DNA, 22 bp, Homo sapiens
gaggcagaggttgttgcagtga

SEQ ID NO: 9303922 - DNA, 22 bp, Homo sapiens
gaggcagagtgcaccccaggag

SEQ ID NO: 9303923 - DNA, 22 bp, Homo sapiens
gaggcagagtgcaccccaggag

SEQ ID NO: 9303924 - DNA, 22 bp, Homo sapiens
gaggcagaggttgcagtgagct

SEQ ID NO: 9303925 - DNA, 22 bp, Homo sapiens
gaggaggtctcctccgcagggg

SEQ ID NO: 9303926 - DNA, 22 bp, Homo sapiens
gaggaggtcgctgctgagcccc

SEQ ID NO: 9303927 - DNA, 22 bp, Homo sapiens
gaggagggttggccttaggtag

SEQ ID NO: 9303928 - DNA, 22 bp, Homo sapiens
gagctggcctcaggcacaggag

SEQ ID NO: 9303929 - DNA, 22 bp, Homo sapiens
gagctgggaagatagcttgagc

SEQ ID NO: 9303930 - DNA, 22 bp, Homo sapiens
gagctggccgcagagagggcag

SEQ ID NO: 9303931 - DNA, 22 bp, Homo sapiens
gagctggccgcagagagggcag

SEQ ID NO: 9303932 - DNA, 22 bp, Homo sapiens
gagagtggatggagctgcgaag

SEQ ID NO: 9303933 - DNA, 22 bp, Homo sapiens
gagagtctagtgcacctagttt

SEQ ID NO: 9303934 - DNA, 18 bp, Homo sapiens
gagctgggagaaggaagg

SEQ ID NO: 9303935 - DNA, 22 bp, Homo sapiens
gagctgggagctgggatttgga

SEQ ID NO: 9303936 - DNA, 22 bp, Homo sapiens
gagctgggaggactgggaactt

SEQ ID NO: 9303937 - DNA, 22 bp, Homo sapiens
gagctgggaggactgggaactt

SEQ ID NO: 9303938 - DNA, 22 bp, Homo sapiens
gaggacacaaagtggctgagat

SEQ ID NO: 9303939 - DNA, 22 bp, Homo sapiens
gaggaatgttattaaaggagct

SEQ ID NO: 9303940 - DNA, 22 bp, Homo sapiens
gaggaatgtcagcacaggcctc

SEQ ID NO: 9303941 - DNA, 22 bp, Homo sapiens
gaggaatgggtgtctcgtgatt

SEQ ID NO: 9303942 - DNA, 21 bp, Homo sapiens
gaggaatggtttgcaaagcac

SEQ ID NO: 9303943 - DNA, 22 bp, Homo sapiens
gaggacagagccgcctggcaag

SEQ ID NO: 9303944 - DNA, 22 bp, Homo sapiens
gaggacagcttagggcttcctg

SEQ ID NO: 9303945 - DNA, 22 bp, Homo sapiens
gaggacacctcacagcctcaca

SEQ ID NO: 9303946 - DNA, 22 bp, Homo sapiens
gaggggcagtgcacccgggccc

SEQ ID NO: 9303947 - DNA, 22 bp, Homo sapiens
gaggggcacagtaaagggtccc

SEQ ID NO: 9303948 - DNA, 22 bp, Homo sapiens
gaggggatgcagagaggcttat

SEQ ID NO: 9303949 - DNA, 22 bp, Homo sapiens
gaggggcacagcagctgttgca

SEQ ID NO: 9303950 - DNA, 22 bp, Homo sapiens
gaggggcaatgagggaaagagt

SEQ ID NO: 9303951 - DNA, 22 bp, Homo sapiens
gagggcagtagcctcgtaccct

SEQ ID NO: 9303952 - DNA, 22 bp, Homo sapiens
gagggcagtgaattttgaagct

SEQ ID NO: 9303953 - DNA, 22 bp, Homo sapiens
gaggggaaagtgtgaggctgcg

SEQ ID NO: 9303954 - DNA, 20 bp, Homo sapiens
gagggcaggcacccatttca

SEQ ID NO: 9303955 - DNA, 22 bp, Homo sapiens
gagggcaggggtcttgcacggt

SEQ ID NO: 9303956 - DNA, 22 bp, Homo sapiens
gagggcagtagcctcgtaccct

SEQ ID NO: 9303957 - DNA, 22 bp, Homo sapiens
gagggcagagtctaatgatgca

SEQ ID NO: 9303958 - DNA, 16 bp, Homo sapiens
gagggcagaggcggaa

SEQ ID NO: 9303959 - DNA, 16 bp, Homo sapiens
gagggcagaggcggaa

SEQ ID NO: 9303960 - DNA, 16 bp, Homo sapiens
gaggctggcagatgtc

SEQ ID NO: 9303961 - DNA, 22 bp, Homo sapiens
gaggctgggaagtccaagacca

SEQ ID NO: 9303962 - DNA, 22 bp, Homo sapiens
gaggctgggaagtccaagatca

SEQ ID NO: 9303963 - DNA, 22 bp, Homo sapiens
gaggctgggaagtccaagacca

SEQ ID NO: 9303964 - DNA, 22 bp, Homo sapiens
gaggctgggaagtccaagacca

SEQ ID NO: 9303965 - DNA, 22 bp, Homo sapiens
gaggctgggaagtccaatatca

SEQ ID NO: 9303966 - DNA, 22 bp, Homo sapiens
gaggctgggaagtccaagatca

SEQ ID NO: 9303967 - DNA, 22 bp, Homo sapiens
gaggctgggaagtccaatatca

SEQ ID NO: 9303968 - DNA, 22 bp, Homo sapiens
gaggctgggggctgccttcctc

SEQ ID NO: 9303969 - DNA, 22 bp, Homo sapiens
gaggctgggggctgccttcctc

SEQ ID NO: 9303970 - DNA, 22 bp, Homo sapiens
gaggcctgcagcgtggtccctg

SEQ ID NO: 9303971 - DNA, 22 bp, Homo sapiens
gaggcctgctttggcactctgg

SEQ ID NO: 9303972 - DNA, 22 bp, Homo sapiens
gaggctggacgtgcatttctac

SEQ ID NO: 9303973 - DNA, 22 bp, Homo sapiens
gaggctggaatattagaaatgt

SEQ ID NO: 9303974 - DNA, 22 bp, Homo sapiens
gaggctggaatattagaaatgt

SEQ ID NO: 9303975 - DNA, 22 bp, Homo sapiens
gaggctgcccaactggagtgga

SEQ ID NO: 9303976 - DNA, 22 bp, Homo sapiens
gaggctggagatattccaatct

SEQ ID NO: 9303977 - DNA, 22 bp, Homo sapiens
gaggctggacgtgcatttctac

SEQ ID NO: 9303978 - DNA, 22 bp, Homo sapiens
gaggctggagatattccaatct

SEQ ID NO: 9303979 - DNA, 22 bp, Homo sapiens
gaggctggaggtcaaagatgaa

SEQ ID NO: 9303980 - DNA, 22 bp, Homo sapiens
gaggctggaggtcaaagatgaa

SEQ ID NO: 9303981 - DNA, 22 bp, Homo sapiens
gaggctggcagaaaagcacagg

SEQ ID NO: 9303982 - DNA, 16 bp, Homo sapiens
gaggctggcagatgtc

SEQ ID NO: 9303983 - DNA, 22 bp, Homo sapiens
gaggctggcagaaaagcacagg

SEQ ID NO: 9303984 - DNA, 22 bp, Homo sapiens
gagtcacaaagcctttcttatt

SEQ ID NO: 9303985 - DNA, 22 bp, Homo sapiens
gagtcacattaatttaatttta

SEQ ID NO: 9303986 - DNA, 22 bp, Homo sapiens
gagtcacattaatttaatttta

SEQ ID NO: 9303987 - DNA, 22 bp, Homo sapiens
gaggtggtggtggaggcatagc

SEQ ID NO: 9303988 - DNA, 22 bp, Homo sapiens
gaggtggtttgtggtgactcat

SEQ ID NO: 9303989 - DNA, 22 bp, Homo sapiens
gaggtggtcgaggaggggtacc

SEQ ID NO: 9303990 - DNA, 19 bp, Homo sapiens
gaggtgggtccccgcagcc

SEQ ID NO: 9303991 - DNA, 22 bp, Homo sapiens
gaggtgggtgtatcacaggtca

SEQ ID NO: 9303992 - DNA, 19 bp, Homo sapiens
gaggtgggtccccgcagcc

SEQ ID NO: 9303993 - DNA, 22 bp, Homo sapiens
gagtccagttgttcacagaggc

SEQ ID NO: 9303994 - DNA, 22 bp, Homo sapiens
gagtccagttgttcacagaggc

SEQ ID NO: 9303995 - DNA, 22 bp, Homo sapiens
gagtcaggtccgtggacagtta

SEQ ID NO: 9303996 - DNA, 22 bp, Homo sapiens
gaggtaggtgtaggaggcctgc

SEQ ID NO: 9303997 - DNA, 22 bp, Homo sapiens
gaggtaggtgtaggaggcctgc

SEQ ID NO: 9303998 - DNA, 22 bp, Homo sapiens
gaggtaggtgtaggaggcctgc

SEQ ID NO: 9303999 - DNA, 19 bp, Homo sapiens
gaggtcagcaagaagtatt

SEQ ID NO: 9304000 - DNA, 22 bp, Homo sapiens
gaggggcctggcgaggacatgt

SEQ ID NO: 9304001 - DNA, 22 bp, Homo sapiens
gaggggccggcatgtgcctctc

SEQ ID NO: 9304002 - DNA, 22 bp, Homo sapiens
gaggggccggcatgtgcctctc

SEQ ID NO: 9304003 - DNA, 22 bp, Homo sapiens
gaggtcaggggagaggctgatg

SEQ ID NO: 9304004 - DNA, 22 bp, Homo sapiens
gaggtcaggtgaggaattaaga

SEQ ID NO: 9304005 - DNA, 22 bp, Homo sapiens
gaggtcaggggagaggctgatg

SEQ ID NO: 9304006 - DNA, 22 bp, Homo sapiens
gaggtccactgaggcaacaggg

SEQ ID NO: 9304007 - DNA, 22 bp, Homo sapiens
gaggtccaacacaatgggtgtt

SEQ ID NO: 9304008 - DNA, 22 bp, Homo sapiens
gaggtcaggctcaagctgggcc

SEQ ID NO: 9304009 - DNA, 22 bp, Homo sapiens
gaggtcaggctcaagctgggcc

SEQ ID NO: 9304010 - DNA, 22 bp, Homo sapiens
gaggtcaggctcaagctgggcc

SEQ ID NO: 9304011 - DNA, 22 bp, Homo sapiens
gaggtcaggcttgcagcagggt

SEQ ID NO: 9304012 - DNA, 22 bp, Homo sapiens
gaggtgggcggatcacaaggtc

SEQ ID NO: 9304013 - DNA, 22 bp, Homo sapiens
gaggtccactgaggcaacaggg

SEQ ID NO: 9304014 - DNA, 22 bp, Homo sapiens
gaggtccattttcacatatgat

SEQ ID NO: 9304015 - DNA, 22 bp, Homo sapiens
gaggtccatacagctattctac

SEQ ID NO: 9304016 - DNA, 22 bp, Homo sapiens
gaggtccagagcaggttcagtg

SEQ ID NO: 9304017 - DNA, 22 bp, Homo sapiens
gaggtccagggtggggcctgag

SEQ ID NO: 9304018 - DNA, 22 bp, Homo sapiens
gaggtccagccaagcggcaagg

SEQ ID NO: 9304019 - DNA, 22 bp, Homo sapiens
gagtggggtctgggcatcagtc

SEQ ID NO: 9304020 - DNA, 22 bp, Homo sapiens
gagtggggggtccgtctcagtg

SEQ ID NO: 9304021 - DNA, 22 bp, Homo sapiens
gagtgtgtgacttcactttagc

SEQ ID NO: 9304022 - DNA, 19 bp, Homo sapiens
gagttctctgcatcagtga

SEQ ID NO: 9304023 - DNA, 18 bp, Homo sapiens
gagtgtggcactgggccc

SEQ ID NO: 9304024 - DNA, 22 bp, Homo sapiens
gagtgtgggcacgggggccttg

SEQ ID NO: 9304025 - DNA, 22 bp, Homo sapiens
gataaattatcaggggtttaaa

SEQ ID NO: 9304026 - DNA, 22 bp, Homo sapiens
gataaattgcactttttcttac

SEQ ID NO: 9304027 - DNA, 22 bp, Homo sapiens
gataaaataactatggaatact

SEQ ID NO: 9304028 - DNA, 22 bp, Homo sapiens
gataaaagaggaaatttgttca

SEQ ID NO: 9304029 - DNA, 22 bp, Homo sapiens
gataaaatatgtggcctttagt

SEQ ID NO: 9304030 - DNA, 21 bp, Homo sapiens
gataaaatgggccttggtcct

SEQ ID NO: 9304031 - DNA, 22 bp, Homo sapiens
gagtttctgatttagtaggtct

SEQ ID NO: 9304032 - DNA, 22 bp, Homo sapiens
gagtttctccagtgctagttgt

SEQ ID NO: 9304033 - DNA, 22 bp, Homo sapiens
gagttggctgttcgaaggtagc

SEQ ID NO: 9304034 - DNA, 22 bp, Homo sapiens
gagttggctactctctgaggct

SEQ ID NO: 9304035 - DNA, 22 bp, Homo sapiens
gagttgtatatggctttattga

SEQ ID NO: 9304036 - DNA, 22 bp, Homo sapiens
gagtgcagtatgagaggctgct

SEQ ID NO: 9304037 - DNA, 18 bp, Homo sapiens
gagtgcggtggtgcacac

SEQ ID NO: 9304038 - DNA, 22 bp, Homo sapiens
gagtgcagttggggtgagggga

SEQ ID NO: 9304039 - DNA, 22 bp, Homo sapiens
gagtgctggggtgcagagaggt

SEQ ID NO: 9304040 - DNA, 22 bp, Homo sapiens
gagtgctgtaggactgagccct

SEQ ID NO: 9304041 - DNA, 17 bp, Homo sapiens
gagtgctggtggagctc

SEQ ID NO: 9304042 - DNA, 22 bp, Homo sapiens
gagtgctgtaggactgagccct

SEQ ID NO: 9304043 - DNA, 17 bp, Homo sapiens
gagtgctggtggagctc

SEQ ID NO: 9304044 - DNA, 22 bp, Homo sapiens
gagtgctgaatgcgagaacaga

SEQ ID NO: 9304045 - DNA, 22 bp, Homo sapiens
gagtgctgcttgggatagtgag

SEQ ID NO: 9304046 - DNA, 22 bp, Homo sapiens
gagtggcatatgtgcctgtgaa

SEQ ID NO: 9304047 - DNA, 21 bp, Homo sapiens
gagtgggacatgggagtggtt

SEQ ID NO: 9304048 - DNA, 22 bp, Homo sapiens
gagtggggctttaaaggctcag

SEQ ID NO: 9304049 - DNA, 18 bp, Homo sapiens
gagtcgtcggagagtctg

SEQ ID NO: 9304050 - DNA, 22 bp, Homo sapiens
gagtctggactattctggtctt

SEQ ID NO: 9304051 - DNA, 22 bp, Homo sapiens
gagtctggtcattttctctccc

SEQ ID NO: 9304052 - DNA, 22 bp, Homo sapiens
gagtgagggcagcaggggctgc

SEQ ID NO: 9304053 - DNA, 22 bp, Homo sapiens
gagtgacaggaatatttatctg

SEQ ID NO: 9304054 - DNA, 18 bp, Homo sapiens
gatatataggaggaaagt

SEQ ID NO: 9304055 - DNA, 22 bp, Homo sapiens
gatatttattaagtggttggta

SEQ ID NO: 9304056 - DNA, 22 bp, Homo sapiens
gatatttattaagtggttggta

SEQ ID NO: 9304057 - DNA, 22 bp, Homo sapiens
gatatttattaagtggttggta

SEQ ID NO: 9304058 - DNA, 22 bp, Homo sapiens
gatatttacattaagcacattg

SEQ ID NO: 9304059 - DNA, 21 bp, Homo sapiens
gatatttatgactcattcctt

SEQ ID NO: 9304060 - DNA, 21 bp, Homo sapiens
gatatttatgactcattcctt

SEQ ID NO: 9304061 - DNA, 22 bp, Homo sapiens
gatatttacattaagcacattg

SEQ ID NO: 9304062 - DNA, 22 bp, Homo sapiens
gatatttacattaagcacattg

SEQ ID NO: 9304063 - DNA, 22 bp, Homo sapiens
gatattttgagaaatcctatga

SEQ ID NO: 9304064 - DNA, 22 bp, Homo sapiens
gatatttttaggtgatgcaggc

SEQ ID NO: 9304065 - DNA, 22 bp, Homo sapiens
gatattttcagtctcctttcaa

SEQ ID NO: 9304066 - DNA, 22 bp, Homo sapiens
gatattttcattcggatgctca

SEQ ID NO: 9304067 - DNA, 22 bp, Homo sapiens
gatattttcgcagggagaattc

SEQ ID NO: 9304068 - DNA, 22 bp, Homo sapiens
gatatttttgcagacacctggg

SEQ ID NO: 9304069 - DNA, 22 bp, Homo sapiens
gatatttttagtatttctgcct

SEQ ID NO: 9304070 - DNA, 22 bp, Homo sapiens
gataccagagcccaaagcagca

SEQ ID NO: 9304071 - DNA, 22 bp, Homo sapiens
gatatacaatccacagttgatt

SEQ ID NO: 9304072 - DNA, 23 bp, Homo sapiens
gataggctggttagtgtatctgt

SEQ ID NO: 9304073 - DNA, 22 bp, Homo sapiens
gatagtattacaggaaatcata

SEQ ID NO: 9304074 - DNA, 22 bp, Homo sapiens
gataagctaacccaagcccttt

SEQ ID NO: 9304075 - DNA, 22 bp, Homo sapiens
gatacattccatttctacttaa

SEQ ID NO: 9304076 - DNA, 22 bp, Homo sapiens
gatgcaggtgtgccacagagct

SEQ ID NO: 9304077 - DNA, 22 bp, Homo sapiens
gatgcagggctggcaggagctt

SEQ ID NO: 9304078 - DNA, 22 bp, Homo sapiens
gatgaaatttgggcaggttaaa

SEQ ID NO: 9304079 - DNA, 22 bp, Homo sapiens
gatgagaaatggacaggagtgg

SEQ ID NO: 9304080 - DNA, 22 bp, Homo sapiens
gatcttgagcaagttgcatccc

SEQ ID NO: 9304081 - DNA, 22 bp, Homo sapiens
gatctgttttttcttagacagt

SEQ ID NO: 9304082 - DNA, 22 bp, Homo sapiens
gatctgtttcattcacagtctg

SEQ ID NO: 9304083 - DNA, 22 bp, Homo sapiens
gatctgtttgcctagagattta

SEQ ID NO: 9304084 - DNA, 22 bp, Homo sapiens
gatcttgaaatatcttttccta

SEQ ID NO: 9304085 - DNA, 22 bp, Homo sapiens
gatctgtgtgattggatgcatt

SEQ ID NO: 9304086 - DNA, 16 bp, Homo sapiens
gatctgttctatttca

SEQ ID NO: 9304087 - DNA, 22 bp, Homo sapiens
gatctgttataatctcttttat

SEQ ID NO: 9304088 - DNA, 22 bp, Homo sapiens
gatctgtttcaattgtcttagt

SEQ ID NO: 9304089 - DNA, 22 bp, Homo sapiens
gatgaaattgttttgatacttt

SEQ ID NO: 9304090 - DNA, 22 bp, Homo sapiens
gatgaaatttgaaaatagtgtt

SEQ ID NO: 9304091 - DNA, 22 bp, Homo sapiens
gatgaaattcagaattgagggg

SEQ ID NO: 9304092 - DNA, 22 bp, Homo sapiens
gatgaaatgctgagcctgagtt

SEQ ID NO: 9304093 - DNA, 22 bp, Homo sapiens
gatgaaatgtgaaagttctggg

SEQ ID NO: 9304094 - DNA, 22 bp, Homo sapiens
gatgaaatagcaaaggcatttg

SEQ ID NO: 9304095 - DNA, 22 bp, Homo sapiens
gatgaaatagaattaatttagg

SEQ ID NO: 9304096 - DNA, 17 bp, Homo sapiens
gatgaaatgatgcacac

SEQ ID NO: 9304097 - DNA, 22 bp, Homo sapiens
gatgaaatccagatcacaggtg

SEQ ID NO: 9304098 - DNA, 20 bp, Homo sapiens
gatgaaatcactgggcagcc

SEQ ID NO: 9304099 - DNA, 22 bp, Homo sapiens
gatctttcatctatgtatttag

SEQ ID NO: 9304100 - DNA, 22 bp, Homo sapiens
gccgccgctgtgcaatttagca

SEQ ID NO: 9304101 - DNA, 20 bp, Homo sapiens
gccgactgccttgtgagcct

SEQ ID NO: 9304102 - DNA, 22 bp, Homo sapiens
gccggggctggggagagacatg

SEQ ID NO: 9304103 - DNA, 22 bp, Homo sapiens
gccggggctggggagagacatg

SEQ ID NO: 9304104 - DNA, 22 bp, Homo sapiens
gccggggctggggagagacatg

SEQ ID NO: 9304105 - DNA, 22 bp, Homo sapiens
gccggggctggggagagacatg

SEQ ID NO: 9304106 - DNA, 22 bp, Homo sapiens
gccgttagataataacaagcat

SEQ ID NO: 9304107 - DNA, 22 bp, Homo sapiens
gcctcctgtcccaggctgagga

SEQ ID NO: 9304108 - DNA, 22 bp, Homo sapiens
gcctcctgtcccaggctgagga

SEQ ID NO: 9304109 - DNA, 22 bp, Homo sapiens
gcctctgcatcatcactccagc

SEQ ID NO: 9304110 - DNA, 22 bp, Homo sapiens
gcctctgcatgctcagcaccca

SEQ ID NO: 9304111 - DNA, 22 bp, Homo sapiens
gcctctgcccatccaccatcag

SEQ ID NO: 9304112 - DNA, 22 bp, Homo sapiens
gcctctgctcggactttgcctc

SEQ ID NO: 9304113 - DNA, 22 bp, Homo sapiens
gccctctcttctgcagcctcca

SEQ ID NO: 9304114 - DNA, 22 bp, Homo sapiens
gccctctgctcagctcctcagc

SEQ ID NO: 9304115 - DNA, 20 bp, Homo sapiens
gccctctgcctccctcagcg

SEQ ID NO: 9304116 - DNA, 22 bp, Homo sapiens
gcccttagggccactgtcactg

SEQ ID NO: 9304117 - DNA, 22 bp, Homo sapiens
gcccttaggcaagcagaagccc

SEQ ID NO: 9304118 - DNA, 22 bp, Homo sapiens
gcccttagccttatagcctcta

SEQ ID NO: 9304119 - DNA, 22 bp, Homo sapiens
gccctctgctggcctcacctcg

SEQ ID NO: 9304120 - DNA, 22 bp, Homo sapiens
gccctttcttcttctggactgg

SEQ ID NO: 9304121 - DNA, 22 bp, Homo sapiens
gcccttaggtactacttattct

SEQ ID NO: 9304122 - DNA, 22 bp, Homo sapiens
gcccttagtcagcactttcact

SEQ ID NO: 9304123 - DNA, 22 bp, Homo sapiens
gcccttataaacaaggcttcag

SEQ ID NO: 9304124 - DNA, 22 bp, Homo sapiens
gcccttctgctgttaggtagcc

SEQ ID NO: 9304125 - DNA, 22 bp, Homo sapiens
gcccttccttagacagcaggat

SEQ ID NO: 9304126 - DNA, 22 bp, Homo sapiens
gccctcagcaggaaagatcaac

SEQ ID NO: 9304127 - DNA, 22 bp, Homo sapiens
gccctctcggcatagcaggggc

SEQ ID NO: 9304128 - DNA, 22 bp, Homo sapiens
gccctctcttctgcagcctcca

SEQ ID NO: 9304129 - DNA, 19 bp, Homo sapiens
gccctcaggcagctccatc

SEQ ID NO: 9304130 - DNA, 18 bp, Homo sapiens
gccatgttctatgcttac

SEQ ID NO: 9304131 - DNA, 22 bp, Homo sapiens
gcccaggaggagaggctgcagt

SEQ ID NO: 9304132 - DNA, 22 bp, Homo sapiens
gcccaggaggcagaggttgtgg

SEQ ID NO: 9304133 - DNA, 22 bp, Homo sapiens
gcccaggataatgctgtccctg

SEQ ID NO: 9304134 - DNA, 22 bp, Homo sapiens
gcccaggagtttgcattttaac

SEQ ID NO: 9304135 - DNA, 22 bp, Homo sapiens
gcccaggagttggaggctgcag

SEQ ID NO: 9304136 - DNA, 22 bp, Homo sapiens
gcccaggagttggtggctgcag

SEQ ID NO: 9304137 - DNA, 22 bp, Homo sapiens
gcccaggatggagaatagtggt

SEQ ID NO: 9304138 - DNA, 22 bp, Homo sapiens
gcccaggatctgctcagatcat

SEQ ID NO: 9304139 - DNA, 20 bp, Homo sapiens
gcccaggatctctgaggcat

SEQ ID NO: 9304140 - DNA, 22 bp, Homo sapiens
gcccaggatggtgtgtagtggt

SEQ ID NO: 9304141 - DNA, 22 bp, Homo sapiens
gcccaggatggctggaggtgct

SEQ ID NO: 9304142 - DNA, 22 bp, Homo sapiens
gcccaggattctttcttcctta

SEQ ID NO: 9304143 - DNA, 22 bp, Homo sapiens
gccaggctgaggctctggaaga

SEQ ID NO: 9304144 - DNA, 22 bp, Homo sapiens
gccaggctcttggttatgtttt

SEQ ID NO: 9304145 - DNA, 22 bp, Homo sapiens
gccaggctgactcccccggcct

SEQ ID NO: 9304146 - DNA, 22 bp, Homo sapiens
gccaggctcttccatttgggtc

SEQ ID NO: 9304147 - DNA, 22 bp, Homo sapiens
gccaggctcttccatttgggtc

SEQ ID NO: 9304148 - DNA, 19 bp, Homo sapiens
gccaggctcttattctgtg

SEQ ID NO: 9304149 - DNA, 19 bp, Homo sapiens
gccaggctcttattctgtg

SEQ ID NO: 9304150 - DNA, 22 bp, Homo sapiens
gccaggctctcagtgactgccc

SEQ ID NO: 9304151 - DNA, 22 bp, Homo sapiens
gccagcagggcccaaatgctgg

SEQ ID NO: 9304152 - DNA, 22 bp, Homo sapiens
gccaggctctcagtgactgccc

SEQ ID NO: 9304153 - DNA, 22 bp, Homo sapiens
gccaggctgccttatctctagc

SEQ ID NO: 9304154 - DNA, 22 bp, Homo sapiens
gccaggctgccttatctctagc

SEQ ID NO: 9304155 - DNA, 22 bp, Homo sapiens
gccaggctgctccagggaggcc

SEQ ID NO: 9304156 - DNA, 22 bp, Homo sapiens
gccaggctggttatttaatgag

SEQ ID NO: 9304157 - DNA, 22 bp, Homo sapiens
gccaggctggtgtcacaactct

SEQ ID NO: 9304158 - DNA, 22 bp, Homo sapiens
gccagtgtgcaagaaaacagaa

SEQ ID NO: 9304159 - DNA, 22 bp, Homo sapiens
gccagtgtgcaagaaaacagaa

SEQ ID NO: 9304160 - DNA, 22 bp, Homo sapiens
gccaggctgtttttattactgt

SEQ ID NO: 9304161 - DNA, 22 bp, Homo sapiens
gccaggctgtggggaacttgaa

SEQ ID NO: 9304162 - DNA, 22 bp, Homo sapiens
gcctggaatcatgcaggggtta

SEQ ID NO: 9304163 - DNA, 22 bp, Homo sapiens
gcctggagggatagaatgcaag

SEQ ID NO: 9304164 - DNA, 22 bp, Homo sapiens
gcctggaggggacagtctctgg

SEQ ID NO: 9304165 - DNA, 22 bp, Homo sapiens
gcctggagggtccctctctgga

SEQ ID NO: 9304166 - DNA, 22 bp, Homo sapiens
gcctgctctccggatccctgat

SEQ ID NO: 9304167 - DNA, 22 bp, Homo sapiens
gcctgctctgacatccatccca

SEQ ID NO: 9304168 - DNA, 22 bp, Homo sapiens
gcctgctctgacatccatccca

SEQ ID NO: 9304169 - DNA, 23 bp, Homo sapiens
gcctgctggtcacctaatctgcc

SEQ ID NO: 9304170 - DNA, 22 bp, Homo sapiens
gcctgctcagacctagcaggcc

SEQ ID NO: 9304171 - DNA, 22 bp, Homo sapiens
gcctgccttttggaggcacatt

SEQ ID NO: 9304172 - DNA, 22 bp, Homo sapiens
gcctgcctttgtgaggaagcgg

SEQ ID NO: 9304173 - DNA, 22 bp, Homo sapiens
gcctgctttgtgcctgatcttt

SEQ ID NO: 9304174 - DNA, 22 bp, Homo sapiens
gcctgctttaagtctgttgcct

SEQ ID NO: 9304175 - DNA, 21 bp, Homo sapiens
gcctgctgttcaccctgccac

SEQ ID NO: 9304176 - DNA, 22 bp, Homo sapiens
gcctgctgtcctgattcccatg

SEQ ID NO: 9304177 - DNA, 22 bp, Homo sapiens
gcctgcctgttggctgaggtgc

SEQ ID NO: 9304178 - DNA, 22 bp, Homo sapiens
gcctgcctttgtatgaccctga

SEQ ID NO: 9304179 - DNA, 22 bp, Homo sapiens
gcctgccttcggtgcgcagcgg

SEQ ID NO: 9304180 - DNA, 22 bp, Homo sapiens
gcctgccttcggtgcgcagcgg

SEQ ID NO: 9304181 - DNA, 22 bp, Homo sapiens
gcctgcctgctgtgtgcaagtt

SEQ ID NO: 9304182 - DNA, 22 bp, Homo sapiens
gcctgcctggagcttgaggtga

SEQ ID NO: 9304183 - DNA, 19 bp, Homo sapiens
gcctgcctgggtttctgag

SEQ ID NO: 9304184 - DNA, 22 bp, Homo sapiens
gcctgcctgctgtcatctgcct

SEQ ID NO: 9304185 - DNA, 21 bp, Homo sapiens
gcctgcctgcgtgaccctctt

SEQ ID NO: 9304186 - DNA, 22 bp, Homo sapiens
gcctctggaagtgggaaggggt

SEQ ID NO: 9304187 - DNA, 22 bp, Homo sapiens
gcctctggaagaattacatcca

SEQ ID NO: 9304188 - DNA, 23 bp, Homo sapiens
gcctctggagccccagtgctcag

SEQ ID NO: 9304189 - DNA, 20 bp, Homo sapiens
gcctgcctcagctagctgag

SEQ ID NO: 9304190 - DNA, 22 bp, Homo sapiens
gcctgcctcaaaatcccagttc

SEQ ID NO: 9304191 - DNA, 22 bp, Homo sapiens
gcctgcctgaaggctgtaccag

SEQ ID NO: 9304192 - DNA, 20 bp, Homo sapiens
gcctgcctcagctagctgag

SEQ ID NO: 9304193 - DNA, 23 bp, Homo sapiens
gcctgcctgacctgtgcaaagtc

SEQ ID NO: 9304194 - DNA, 22 bp, Homo sapiens
gcctggccgctccgagctccgc

SEQ ID NO: 9304195 - DNA, 22 bp, Homo sapiens
gcctggcttttgcctcatgttc

SEQ ID NO: 9304196 - DNA, 22 bp, Homo sapiens
gcctggccgctccgagctccgc

SEQ ID NO: 9304197 - DNA, 22 bp, Homo sapiens
gcctggcccagggctcttgttg

SEQ ID NO: 9304198 - DNA, 22 bp, Homo sapiens
gcctggcccagggctccgcagg

SEQ ID NO: 9304199 - DNA, 17 bp, Homo sapiens
gcctggcccagcctggc

SEQ ID NO: 9304200 - DNA, 22 bp, Homo sapiens
gcctggcagttgacagtttgct

SEQ ID NO: 9304201 - DNA, 22 bp, Homo sapiens
gcctggcattacagcactcctg

SEQ ID NO: 9304202 - DNA, 22 bp, Homo sapiens
gcctggcagtgtaattcctgtc

SEQ ID NO: 9304203 - DNA, 22 bp, Homo sapiens
gcctggcagtggggccctggga

SEQ ID NO: 9304204 - DNA, 22 bp, Homo sapiens
gcctggcaggggcctgggagtg

SEQ ID NO: 9304205 - DNA, 22 bp, Homo sapiens
gcctggcagtgatgtcttttgg

SEQ ID NO: 9304206 - DNA, 22 bp, Homo sapiens
gcctggcaggcctgttggggct

SEQ ID NO: 9304207 - DNA, 22 bp, Homo sapiens
gcctggcaggcctcatgagggg

SEQ ID NO: 9304208 - DNA, 22 bp, Homo sapiens
gcctgtgtggatgcgccggtgc

SEQ ID NO: 9304209 - DNA, 22 bp, Homo sapiens
gcctgtgtgtttagctctgggg

SEQ ID NO: 9304210 - DNA, 18 bp, Homo sapiens
gcctgtgttcagcctttc

SEQ ID NO: 9304211 - DNA, 22 bp, Homo sapiens
gcctgttccttagtggcttcac

SEQ ID NO: 9304212 - DNA, 20 bp, Homo sapiens
gcctgtgtcttctctgctgt

SEQ ID NO: 9304213 - DNA, 22 bp, Homo sapiens
gcctgtgtctgggtggccagag

SEQ ID NO: 9304214 - DNA, 22 bp, Homo sapiens
gcctgtgtcatgtagtagcttc

SEQ ID NO: 9304215 - DNA, 23 bp, Homo sapiens
gcctgggactcaggaggagctca

SEQ ID NO: 9304216 - DNA, 21 bp, Homo sapiens
gcctgggatagtggcctccgg

SEQ ID NO: 9304217 - DNA, 22 bp, Homo sapiens
gcctgggattcccagaggggca

SEQ ID NO: 9304218 - DNA, 22 bp, Homo sapiens
gctctgccaaggacccattctc

SEQ ID NO: 9304219 - DNA, 23 bp, Homo sapiens
gctctgccacttaatagctgtgt

SEQ ID NO: 9304220 - DNA, 21 bp, Homo sapiens
gctctgccacttaccagattt

SEQ ID NO: 9304221 - DNA, 19 bp, Homo sapiens
gctcctgggcctcactcat

SEQ ID NO: 9304222 - DNA, 22 bp, Homo sapiens
gctcctggcttcactgacatca

SEQ ID NO: 9304223 - DNA, 22 bp, Homo sapiens
gctcttggaagacaggatgtgt

SEQ ID NO: 9304224 - DNA, 21 bp, Homo sapiens
gctgaagaactctttattttc

SEQ ID NO: 9304225 - DNA, 22 bp, Homo sapiens
gctctgcccaaagctgtggctg

SEQ ID NO: 9304226 - DNA, 22 bp, Homo sapiens
gctctgcccaaagctgtggctg

SEQ ID NO: 9304227 - DNA, 22 bp, Homo sapiens
gctctgcccaatgtccctacac

SEQ ID NO: 9304228 - DNA, 22 bp, Homo sapiens
gctctgccagacactgtggcca

SEQ ID NO: 9304229 - DNA, 20 bp, Homo sapiens
gctctgccacttagaagctg

SEQ ID NO: 9304230 - DNA, 22 bp, Homo sapiens
gctctgccagacactgtggcca

SEQ ID NO: 9304231 - DNA, 22 bp, Homo sapiens
gctccaggagagggaagcagat

SEQ ID NO: 9304232 - DNA, 22 bp, Homo sapiens
gctccaggagctcacagctcgc

SEQ ID NO: 9304233 - DNA, 22 bp, Homo sapiens
gctccaggagctcacagctcgc

SEQ ID NO: 9304234 - DNA, 22 bp, Homo sapiens
gctccaggaggatgaccttcct

SEQ ID NO: 9304235 - DNA, 22 bp, Homo sapiens
gctcctcttatttcatcagggc

SEQ ID NO: 9304236 - DNA, 22 bp, Homo sapiens
gctccaggaagggaaatctcca

SEQ ID NO: 9304237 - DNA, 22 bp, Homo sapiens
gctccaggaagggaaatctcca

SEQ ID NO: 9304238 - DNA, 22 bp, Homo sapiens
gctccagctctgttctggggaa

SEQ ID NO: 9304239 - DNA, 22 bp, Homo sapiens
gctccagctcgtggctcccagc

SEQ ID NO: 9304240 - DNA, 22 bp, Homo sapiens
gctccagcacctagagcaggtc

SEQ ID NO: 9304241 - DNA, 22 bp, Homo sapiens
gctccacttccttctgccctca

SEQ ID NO: 9304242 - DNA, 20 bp, Homo sapiens
gctccaagcccctttagagg

SEQ ID NO: 9304243 - DNA, 22 bp, Homo sapiens
gctcactgcaagctctgcctcc

SEQ ID NO: 9304244 - DNA, 22 bp, Homo sapiens
gctcagagataaaactgatcag

SEQ ID NO: 9304245 - DNA, 22 bp, Homo sapiens
gctcagagatggggaatgaaaa

SEQ ID NO: 9304246 - DNA, 22 bp, Homo sapiens
gctcagagatgttcagtagctt

SEQ ID NO: 9304247 - DNA, 22 bp, Homo sapiens
gctcagagatgtctgctgcctt

SEQ ID NO: 9304248 - DNA, 22 bp, Homo sapiens
gctcatgggcccagagcagccc

SEQ ID NO: 9304249 - DNA, 22 bp, Homo sapiens
gctcatgactgtaatcccagca

SEQ ID NO: 9304250 - DNA, 20 bp, Homo sapiens
gctcagagcctgaacttcat

SEQ ID NO: 9304251 - DNA, 22 bp, Homo sapiens
gctcagagcatcccagtgaatg

SEQ ID NO: 9304252 - DNA, 22 bp, Homo sapiens
gctcagagcactcagactcagc

SEQ ID NO: 9304253 - DNA, 22 bp, Homo sapiens
gctcagagcagatggtactcag

SEQ ID NO: 9304254 - DNA, 22 bp, Homo sapiens
gctcagagcccgaggcttgcat

SEQ ID NO: 9304255 - DNA, 19 bp, Homo sapiens
gctcagagccatgggggct

SEQ ID NO: 9304256 - DNA, 22 bp, Homo sapiens
gctcactgcaacctctgcttcc

SEQ ID NO: 9304257 - DNA, 22 bp, Homo sapiens
gctcactgcaacctctgcctcc

SEQ ID NO: 9304258 - DNA, 22 bp, Homo sapiens
gccttagcatcttaaagctgtg

SEQ ID NO: 9304259 - DNA, 22 bp, Homo sapiens
gccttaattgcagagcaatata

SEQ ID NO: 9304260 - DNA, 22 bp, Homo sapiens
gctcactgcaagctctgcctcc

SEQ ID NO: 9304261 - DNA, 22 bp, Homo sapiens
gctcactgcaacctctgcctcc

SEQ ID NO: 9304262 - DNA, 22 bp, Homo sapiens
gctgggcaggcctcgtgagggc

SEQ ID NO: 9304263 - DNA, 22 bp, Homo sapiens
gctgggcaggcctcgtgagggc

SEQ ID NO: 9304264 - DNA, 22 bp, Homo sapiens
gctgggcaacggaagagagaaa

SEQ ID NO: 9304265 - DNA, 22 bp, Homo sapiens
gctgggcactgtcccataggct

SEQ ID NO: 9304266 - DNA, 22 bp, Homo sapiens
gctgggcaccggagagacccca

SEQ ID NO: 9304267 - DNA, 22 bp, Homo sapiens
gctgggcacctctcccagattg

SEQ ID NO: 9304268 - DNA, 22 bp, Homo sapiens
gctggcctgggcagcctgtcgg

SEQ ID NO: 9304269 - DNA, 22 bp, Homo sapiens
gctggccttctgcagagttctg

SEQ ID NO: 9304270 - DNA, 22 bp, Homo sapiens
gctggcctgggcagcctgtcgg

SEQ ID NO: 9304271 - DNA, 22 bp, Homo sapiens
gctggcctgctgggcaccaccg

SEQ ID NO: 9304272 - DNA, 22 bp, Homo sapiens
gctgggagtgggcaagatgaga

SEQ ID NO: 9304273 - DNA, 22 bp, Homo sapiens
gctggcctttgaggaagctgcg

SEQ ID NO: 9304274 - DNA, 22 bp, Homo sapiens
gctggccagtgtcccagggatc

SEQ ID NO: 9304275 - DNA, 22 bp, Homo sapiens
gctggcctgacctgaggctggg

SEQ ID NO: 9304276 - DNA, 22 bp, Homo sapiens
gctggagatgctatgcagaggg

SEQ ID NO: 9304277 - DNA, 22 bp, Homo sapiens
gctggagccattggcttggcct

SEQ ID NO: 9304278 - DNA, 22 bp, Homo sapiens
gctggagccttctgctctgttg

SEQ ID NO: 9304279 - DNA, 22 bp, Homo sapiens
gctggagagtgaggggagcaag

SEQ ID NO: 9304280 - DNA, 22 bp, Homo sapiens
gctgctctcatagatggcttca

SEQ ID NO: 9304281 - DNA, 22 bp, Homo sapiens
gctgctctccaagcctccttga

SEQ ID NO: 9304282 - DNA, 20 bp, Homo sapiens
gctgctctccacggtctgca

SEQ ID NO: 9304283 - DNA, 22 bp, Homo sapiens
gctgctctgaaaatgactgttg

SEQ ID NO: 9304284 - DNA, 22 bp, Homo sapiens
gctgctctacccatgcatctgt

SEQ ID NO: 9304285 - DNA, 22 bp, Homo sapiens
gctgctctgttaattgctgtaa

SEQ ID NO: 9304286 - DNA, 22 bp, Homo sapiens
gctgctcttgaggggctcactg

SEQ ID NO: 9304287 - DNA, 22 bp, Homo sapiens
gctgctctgtgacagcctccgg

SEQ ID NO: 9304288 - DNA, 21 bp, Homo sapiens
gctggagagccaggcaggggc

SEQ ID NO: 9304289 - DNA, 22 bp, Homo sapiens
gctgcctgccttgcctggagga

SEQ ID NO: 9304290 - DNA, 22 bp, Homo sapiens
gctgaggattgaagagttgcca

SEQ ID NO: 9304291 - DNA, 22 bp, Homo sapiens
gctgaggattgaagagttgcca

SEQ ID NO: 9304292 - DNA, 22 bp, Homo sapiens
gctgaggaggtgtggttaggtg

SEQ ID NO: 9304293 - DNA, 22 bp, Homo sapiens
gcacacacatgtgagtacatgc

SEQ ID NO: 9304294 - DNA, 22 bp, Homo sapiens
gcaccctctgagctccgctccg

SEQ ID NO: 9304295 - DNA, 22 bp, Homo sapiens
gcacccctcagcttgtttacta

SEQ ID NO: 9304296 - DNA, 22 bp, Homo sapiens
gcacccctgcgtgccttccctt

SEQ ID NO: 9304297 - DNA, 22 bp, Homo sapiens
gcacccctggacggtagggcca

SEQ ID NO: 9304298 - DNA, 22 bp, Homo sapiens
gcaccctgtttatcctgagttc

SEQ ID NO: 9304299 - DNA, 22 bp, Homo sapiens
gcagagccaggagcccaggatc

SEQ ID NO: 9304300 - DNA, 22 bp, Homo sapiens
gcagagccaggctggggcaggt

SEQ ID NO: 9304301 - DNA, 22 bp, Homo sapiens
gcagagccagaatggccaggac

SEQ ID NO: 9304302 - DNA, 22 bp, Homo sapiens
gcagagcccctcaagccagcct

SEQ ID NO: 9304303 - DNA, 22 bp, Homo sapiens
gcagaagctgttcgaaggccgc

SEQ ID NO: 9304304 - DNA, 22 bp, Homo sapiens
gcagaaggatccgcaggtgcaa

SEQ ID NO: 9304305 - DNA, 23 bp, Homo sapiens
gcagaaattctcacactgaggcc

SEQ ID NO: 9304306 - DNA, 22 bp, Homo sapiens
gattttctgagccttcaaattt

SEQ ID NO: 9304307 - DNA, 22 bp, Homo sapiens
gcaatagattatgatctacagt

SEQ ID NO: 9304308 - DNA, 22 bp, Homo sapiens
gcacaaactgcaattacttttg

SEQ ID NO: 9304309 - DNA, 22 bp, Homo sapiens
gcacaaactgcaattacttttg

SEQ ID NO: 9304310 - DNA, 22 bp, Homo sapiens
gcaattgtactagaaaacaata

SEQ ID NO: 9304311 - DNA, 22 bp, Homo sapiens
gcacaaaggtggaaggaggaag

SEQ ID NO: 9304312 - DNA, 22 bp, Homo sapiens
gattgcttctggaaagcagttt

SEQ ID NO: 9304313 - DNA, 22 bp, Homo sapiens
gattgcttgatacccagtcaat

SEQ ID NO: 9304314 - DNA, 22 bp, Homo sapiens
gattgcttatacacaagatgaa

SEQ ID NO: 9304315 - DNA, 22 bp, Homo sapiens
gatttaaagtagacctttgttt

SEQ ID NO: 9304316 - DNA, 22 bp, Homo sapiens
gatttattggtctttcattggt

SEQ ID NO: 9304317 - DNA, 22 bp, Homo sapiens
gatttattggtctttcattggt

SEQ ID NO: 9304318 - DNA, 22 bp, Homo sapiens
gatttatttttaatcagcaggg

SEQ ID NO: 9304319 - DNA, 22 bp, Homo sapiens
gatttatttttaatcagcaggg

SEQ ID NO: 9304320 - DNA, 22 bp, Homo sapiens
gatttattgtccctgtcctgct

SEQ ID NO: 9304321 - DNA, 22 bp, Homo sapiens
gatttattgtccctgtcctgct

SEQ ID NO: 9304322 - DNA, 22 bp, Homo sapiens
gatttataaaggttgcactgga

SEQ ID NO: 9304323 - DNA, 22 bp, Homo sapiens
gatgttaaatgtaaatagctgc

SEQ ID NO: 9304324 - DNA, 22 bp, Homo sapiens
gatgttaagaaggaattgaagt

SEQ ID NO: 9304325 - DNA, 22 bp, Homo sapiens
gatgtttatatctaacttaagt

SEQ ID NO: 9304326 - DNA, 22 bp, Homo sapiens
gattacacgtttttaatcacat

SEQ ID NO: 9304327 - DNA, 22 bp, Homo sapiens
gattagctctagatctgggcta

SEQ ID NO: 9304328 - DNA, 22 bp, Homo sapiens
gattagttgattaagagtcaga

SEQ ID NO: 9304329 - DNA, 22 bp, Homo sapiens
gattatgactgtcctagaaaaa

SEQ ID NO: 9304330 - DNA, 22 bp, Homo sapiens
gattatgattaagatggacctg

SEQ ID NO: 9304331 - DNA, 22 bp, Homo sapiens
gattatgagaataagggggtat

SEQ ID NO: 9304332 - DNA, 21 bp, Homo sapiens
gattatgagttcggtttgggg

SEQ ID NO: 9304333 - DNA, 22 bp, Homo sapiens
gattatgatgcgaggtcagagc

SEQ ID NO: 9304334 - DNA, 22 bp, Homo sapiens
gattatgattgaagccaggtgt

SEQ ID NO: 9304335 - DNA, 22 bp, Homo sapiens
gatgcctgcatttcaggagagt

SEQ ID NO: 9304336 - DNA, 22 bp, Homo sapiens
gatgcgggcccgctccactgcc

SEQ ID NO: 9304337 - DNA, 22 bp, Homo sapiens
gatgcttaccgacttacagtgc

SEQ ID NO: 9304338 - DNA, 22 bp, Homo sapiens
gatgctgtggtaagccccaccg

SEQ ID NO: 9304339 - DNA, 22 bp, Homo sapiens
gatgctgtgctatgtctacaga

SEQ ID NO: 9304340 - DNA, 22 bp, Homo sapiens
gatggaggagatggcagggtgc

SEQ ID NO: 9304341 - DNA, 22 bp, Homo sapiens
gatggctggagccagtgctttg

SEQ ID NO: 9304342 - DNA, 22 bp, Homo sapiens
gatgggaggaacctgggtccct

SEQ ID NO: 9304343 - DNA, 22 bp, Homo sapiens
gatgggaggaacctgggtccct

SEQ ID NO: 9304344 - DNA, 22 bp, Homo sapiens
gatgtagacacttggaggctta

SEQ ID NO: 9304345 - DNA, 22 bp, Homo sapiens
gatggtggcaagagccaagtct

SEQ ID NO: 9304346 - DNA, 22 bp, Homo sapiens
gatggtgtcccaggctcaggct

SEQ ID NO: 9304347 - DNA, 22 bp, Homo sapiens
gatgggtggtctcagacttgcc

SEQ ID NO: 9304348 - DNA, 22 bp, Homo sapiens
gatgggtgccccagacaagctg

SEQ ID NO: 9304349 - DNA, 22 bp, Homo sapiens
gatggggatgagaagtgagcag

SEQ ID NO: 9304350 - DNA, 22 bp, Homo sapiens
gcaggcacatgggcgggtctgg

SEQ ID NO: 9304351 - DNA, 22 bp, Homo sapiens
gcaggagttcaattgcccatga

SEQ ID NO: 9304352 - DNA, 22 bp, Homo sapiens
gcaggcaccacggctcaggtct

SEQ ID NO: 9304353 - DNA, 22 bp, Homo sapiens
gcaggcaccgcggcggcaggtt

SEQ ID NO: 9304354 - DNA, 22 bp, Homo sapiens
gcaggagctgctctcctgacga

SEQ ID NO: 9304355 - DNA, 22 bp, Homo sapiens
gcaggagctcgtttccaggctg

SEQ ID NO: 9304356 - DNA, 22 bp, Homo sapiens
gcaggacagcaggatgcttaga

SEQ ID NO: 9304357 - DNA, 22 bp, Homo sapiens
gcaggacaggcgttggtccagt

SEQ ID NO: 9304358 - DNA, 22 bp, Homo sapiens
gcaggagaacaaagcaagctgc

SEQ ID NO: 9304359 - DNA, 21 bp, Homo sapiens
gcagagccggggcgagaaggc

SEQ ID NO: 9304360 - DNA, 18 bp, Homo sapiens
gcagctgacactggagtt

SEQ ID NO: 9304361 - DNA, 22 bp, Homo sapiens
gcagctcttcacttactccttt

SEQ ID NO: 9304362 - DNA, 22 bp, Homo sapiens
gcagctctgagactctacagaa

SEQ ID NO: 9304363 - DNA, 22 bp, Homo sapiens
gcagctctctggcctgccctgg

SEQ ID NO: 9304364 - DNA, 22 bp, Homo sapiens
gcagctcctttaggctgcaaag

SEQ ID NO: 9304365 - DNA, 22 bp, Homo sapiens
gcagctcctggcacagtttttt

SEQ ID NO: 9304366 - DNA, 22 bp, Homo sapiens
gcagctcccatcagggcacaga

SEQ ID NO: 9304367 - DNA, 22 bp, Homo sapiens
gcagctcccttgaacttctcct

SEQ ID NO: 9304368 - DNA, 22 bp, Homo sapiens
gcagctccctggctgcaaatga

SEQ ID NO: 9304369 - DNA, 22 bp, Homo sapiens
gcagctccctggctgcaaatga

SEQ ID NO: 9304370 - DNA, 22 bp, Homo sapiens
gcagggcagccacaggccccct

SEQ ID NO: 9304371 - DNA, 21 bp, Homo sapiens
gcaggggatagaaatggtctg

SEQ ID NO: 9304372 - DNA, 22 bp, Homo sapiens
gcaggggctactctgagcttcc

SEQ ID NO: 9304373 - DNA, 22 bp, Homo sapiens
gcaggggcaggagatctcaggc

SEQ ID NO: 9304374 - DNA, 22 bp, Homo sapiens
gcagggcagacctccagcctat

SEQ ID NO: 9304375 - DNA, 22 bp, Homo sapiens
gcagggcagagggagaatctct

SEQ ID NO: 9304376 - DNA, 22 bp, Homo sapiens
gcagggcacagacagtgccaag

SEQ ID NO: 9304377 - DNA, 22 bp, Homo sapiens
gcagggcagaaggtgctgagga

SEQ ID NO: 9304378 - DNA, 22 bp, Homo sapiens
gcagggcacagacagtgccaag

SEQ ID NO: 9304379 - DNA, 22 bp, Homo sapiens
gcagggcagaaggtgctgagga

SEQ ID NO: 9304380 - DNA, 22 bp, Homo sapiens
gcagggcagaaggtgctgagga

SEQ ID NO: 9304381 - DNA, 20 bp, Homo sapiens
gcagggcaagggatatgaaa

SEQ ID NO: 9304382 - DNA, 22 bp, Homo sapiens
gcagggcaaatgtggaaaggag

SEQ ID NO: 9304383 - DNA, 22 bp, Homo sapiens
gcagggcaaatgtggaaaggag

SEQ ID NO: 9304384 - DNA, 22 bp, Homo sapiens
gcagggcacaaggacgcacagg

SEQ ID NO: 9304385 - DNA, 22 bp, Homo sapiens
gcagggcacaaggacgcacagg

SEQ ID NO: 9304386 - DNA, 22 bp, Homo sapiens
gcaggcttgcccggcctccttc

SEQ ID NO: 9304387 - DNA, 22 bp, Homo sapiens
gcaggcttctctcttccctacc

SEQ ID NO: 9304388 - DNA, 22 bp, Homo sapiens
gcaggcttgttgaagtaaaata

SEQ ID NO: 9304389 - DNA, 19 bp, Homo sapiens
gcaggcttgggtctcccca

SEQ ID NO: 9304390 - DNA, 18 bp, Homo sapiens
gcaggcttttcctgggtc

SEQ ID NO: 9304391 - DNA, 22 bp, Homo sapiens
gcaggcttatggggagacagag

SEQ ID NO: 9304392 - DNA, 22 bp, Homo sapiens
gcaggctgtggtatgttgggca

SEQ ID NO: 9304393 - DNA, 22 bp, Homo sapiens
gcaggctggaggctgttctggg

SEQ ID NO: 9304394 - DNA, 22 bp, Homo sapiens
gcaggctgctgagatccttagg

SEQ ID NO: 9304395 - DNA, 22 bp, Homo sapiens
gcaggcagaggtggaggagaca

SEQ ID NO: 9304396 - DNA, 22 bp, Homo sapiens
gcaggctgccaccttctgagtt

SEQ ID NO: 9304397 - DNA, 17 bp, Homo sapiens
gcaggcactgctgcctg

SEQ ID NO: 9304398 - DNA, 21 bp, Homo sapiens
gcaggcactctagaggagctg

SEQ ID NO: 9304399 - DNA, 21 bp, Homo sapiens
gcaggcactctagaggagctg

SEQ ID NO: 9304400 - DNA, 22 bp, Homo sapiens
gcaggcactcctaggaccatca

SEQ ID NO: 9304401 - DNA, 22 bp, Homo sapiens
gcaggcagagaggggtttccag

SEQ ID NO: 9304402 - DNA, 22 bp, Homo sapiens
gccagatgccgtaaagatgggc

SEQ ID NO: 9304403 - DNA, 20 bp, Homo sapiens
gccagaggccggcaggggct

SEQ ID NO: 9304404 - DNA, 20 bp, Homo sapiens
gccagaggccggcaggggct

SEQ ID NO: 9304405 - DNA, 22 bp, Homo sapiens
gccagcagctcttgggcgggca

SEQ ID NO: 9304406 - DNA, 22 bp, Homo sapiens
gccagcagggaagccttgggct

SEQ ID NO: 9304407 - DNA, 22 bp, Homo sapiens
gccacagcccgagcaccatgag

SEQ ID NO: 9304408 - DNA, 17 bp, Homo sapiens
gcatgtagtacatgtaa

SEQ ID NO: 9304409 - DNA, 22 bp, Homo sapiens
gcatgggcaccagtctctaggt

SEQ ID NO: 9304410 - DNA, 22 bp, Homo sapiens
gcatgtggcccaaggaggctgt

SEQ ID NO: 9304411 - DNA, 22 bp, Homo sapiens
gcaggtggaagcagcagactca

SEQ ID NO: 9304412 - DNA, 22 bp, Homo sapiens
gcaggtggaagcagcagactca

SEQ ID NO: 9304413 - DNA, 19 bp, Homo sapiens
gcaggtggatgtggtcagc

SEQ ID NO: 9304414 - DNA, 22 bp, Homo sapiens
gcaggtggattatcagaagtgc

SEQ ID NO: 9304415 - DNA, 19 bp, Homo sapiens
gcaggtggatgtggtcagc

SEQ ID NO: 9304416 - DNA, 22 bp, Homo sapiens
gcaggtggcagaggtgggatct

SEQ ID NO: 9304417 - DNA, 22 bp, Homo sapiens
gcaggtggcagaggtgggatct

SEQ ID NO: 9304418 - DNA, 22 bp, Homo sapiens
gcaggtggtgggggagccgttc

SEQ ID NO: 9304419 - DNA, 23 bp, Homo sapiens
gcaggtggttcgaacagaagttt

SEQ ID NO: 9304420 - DNA, 22 bp, Homo sapiens
gcaggtggtccccgtggagtgg

SEQ ID NO: 9304421 - DNA, 22 bp, Homo sapiens
gcaggtgggagccgctgcctga

SEQ ID NO: 9304422 - DNA, 22 bp, Homo sapiens
gcaggtggggctgctaccagaa

SEQ ID NO: 9304423 - DNA, 22 bp, Homo sapiens
gcaggtgggggtcggtgcatct

SEQ ID NO: 9304424 - DNA, 22 bp, Homo sapiens
gcagtggggaatgctggggaga

SEQ ID NO: 9304425 - DNA, 22 bp, Homo sapiens
gcagtggggcgctgggagttgg

SEQ ID NO: 9304426 - DNA, 22 bp, Homo sapiens
gcagtgggcctgaggaagggtg

SEQ ID NO: 9304427 - DNA, 22 bp, Homo sapiens
gcagtggggaatgctggggaga

SEQ ID NO: 9304428 - DNA, 22 bp, Homo sapiens
gcagtgggcctgaggaagggtg

SEQ ID NO: 9304429 - DNA, 19 bp, Homo sapiens
gcagtgtcatggtaggagc

SEQ ID NO: 9304430 - DNA, 22 bp, Homo sapiens
gcagtgggcaacaagagctgga

SEQ ID NO: 9304431 - DNA, 18 bp, Homo sapiens
gcagtaggcgcgcaggac

SEQ ID NO: 9304432 - DNA, 22 bp, Homo sapiens
gcagtaggggctggagggctgt

SEQ ID NO: 9304433 - DNA, 22 bp, Homo sapiens
gggctctggtacttcctggctc

SEQ ID NO: 9304434 - DNA, 18 bp, Homo sapiens
gggctaggcaaggaccac

SEQ ID NO: 9304435 - DNA, 22 bp, Homo sapiens
gggctagcctcttccctgctcc

SEQ ID NO: 9304436 - DNA, 22 bp, Homo sapiens
gggctgagaattcagctttcct

SEQ ID NO: 9304437 - DNA, 22 bp, Homo sapiens
gggctctgtgttctagctctcg

SEQ ID NO: 9304438 - DNA, 22 bp, Homo sapiens
gggctctgtggttgtgctttgt

SEQ ID NO: 9304439 - DNA, 22 bp, Homo sapiens
gggctgagacgatggggtcttc

SEQ ID NO: 9304440 - DNA, 22 bp, Homo sapiens
gggctggagacaagtgagccgc

SEQ ID NO: 9304441 - DNA, 22 bp, Homo sapiens
gggctggaccgcgacccctgag

SEQ ID NO: 9304442 - DNA, 21 bp, Homo sapiens
gggctggacatggtggctcat

SEQ ID NO: 9304443 - DNA, 22 bp, Homo sapiens
gggctggactgcattgcctcgc

SEQ ID NO: 9304444 - DNA, 22 bp, Homo sapiens
gggctggcaggacctgggctga

SEQ ID NO: 9304445 - DNA, 22 bp, Homo sapiens
gggctggcatcagttgccgaga

SEQ ID NO: 9304446 - DNA, 22 bp, Homo sapiens
gggctggcatcggttgctgaga

SEQ ID NO: 9304447 - DNA, 22 bp, Homo sapiens
gggctggatgggagccttggcc

SEQ ID NO: 9304448 - DNA, 17 bp, Homo sapiens
gggctggatggccatgg

SEQ ID NO: 9304449 - DNA, 22 bp, Homo sapiens
ggggaaggattgagttgaccca

SEQ ID NO: 9304450 - DNA, 16 bp, Homo sapiens
ggggaaggcaagaggg

SEQ ID NO: 9304451 - DNA, 22 bp, Homo sapiens
ggggaagggagtccaagtgtta

SEQ ID NO: 9304452 - DNA, 22 bp, Homo sapiens
ggggaagggagtccaagtgtta

SEQ ID NO: 9304453 - DNA, 22 bp, Homo sapiens
gggtctgacctgggcacaccat

SEQ ID NO: 9304454 - DNA, 22 bp, Homo sapiens
gggtccagggccagtggctgag

SEQ ID NO: 9304455 - DNA, 22 bp, Homo sapiens
gggtctggacggctgcaggaag

SEQ ID NO: 9304456 - DNA, 22 bp, Homo sapiens
gggtgaagctcctgcaggggcc

SEQ ID NO: 9304457 - DNA, 22 bp, Homo sapiens
gggtgggatggcaggagccgct

SEQ ID NO: 9304458 - DNA, 22 bp, Homo sapiens
gggtgggcctgtctggccatgt

SEQ ID NO: 9304459 - DNA, 19 bp, Homo sapiens
gggtgaggaagagcgttgc

SEQ ID NO: 9304460 - DNA, 22 bp, Homo sapiens
gggtgaggagctgccagtcatg

SEQ ID NO: 9304461 - DNA, 22 bp, Homo sapiens
gggtgggaacaggatgccagga

SEQ ID NO: 9304462 - DNA, 22 bp, Homo sapiens
gggtgggaacaggatgccagga

SEQ ID NO: 9304463 - DNA, 22 bp, Homo sapiens
gggtggctgagaacaggacccc

SEQ ID NO: 9304464 - DNA, 22 bp, Homo sapiens
gggtgggaacaggatgccagga

SEQ ID NO: 9304465 - DNA, 22 bp, Homo sapiens
gggtgggatgccgctgtctcca

SEQ ID NO: 9304466 - DNA, 22 bp, Homo sapiens
gggtgggatggcaggagccgct

SEQ ID NO: 9304467 - DNA, 22 bp, Homo sapiens
ggggactgccttccacagacac

SEQ ID NO: 9304468 - DNA, 22 bp, Homo sapiens
ggggaccctcaggactgcgtct

SEQ ID NO: 9304469 - DNA, 22 bp, Homo sapiens
gggggctggaatatccatcaac

SEQ ID NO: 9304470 - DNA, 22 bp, Homo sapiens
gggggctggactttcccacaca

SEQ ID NO: 9304471 - DNA, 23 bp, Homo sapiens
gggggctggttgactctctgcag

SEQ ID NO: 9304472 - DNA, 22 bp, Homo sapiens
ggggtaggaagagaaaatagtg

SEQ ID NO: 9304473 - DNA, 22 bp, Homo sapiens
ggggtaggaagagaaaatagtg

SEQ ID NO: 9304474 - DNA, 20 bp, Homo sapiens
gggtccaggactctgaattt

SEQ ID NO: 9304475 - DNA, 22 bp, Homo sapiens
gggtccagctacatcagggtgg

SEQ ID NO: 9304476 - DNA, 22 bp, Homo sapiens
gggtccagggacgtttctgcag

SEQ ID NO: 9304477 - DNA, 22 bp, Homo sapiens
gggtccagggccagtggctgag

SEQ ID NO: 9304478 - DNA, 22 bp, Homo sapiens
gggtccaggcggcatagttgta

SEQ ID NO: 9304479 - DNA, 22 bp, Homo sapiens
gggtccaggcactatgctaagt

SEQ ID NO: 9304480 - DNA, 22 bp, Homo sapiens
gggtccaggcgtggcccagatg

SEQ ID NO: 9304481 - DNA, 22 bp, Homo sapiens
gggggtggttctaagtcctata

SEQ ID NO: 9304482 - DNA, 22 bp, Homo sapiens
gggggtggttctaagtcctata

SEQ ID NO: 9304483 - DNA, 22 bp, Homo sapiens
gggggtggttctaagtcctata

SEQ ID NO: 9304484 - DNA, 20 bp, Homo sapiens
gggaggcgagggctgagcag

SEQ ID NO: 9304485 - DNA, 22 bp, Homo sapiens
gggaggctgccatccttcagga

SEQ ID NO: 9304486 - DNA, 22 bp, Homo sapiens
gggaggctcagtggtgtcctct

SEQ ID NO: 9304487 - DNA, 22 bp, Homo sapiens
gggaggagggtgctggctaaac

SEQ ID NO: 9304488 - DNA, 22 bp, Homo sapiens
gggaggaggaatgttttgtgta

SEQ ID NO: 9304489 - DNA, 22 bp, Homo sapiens
gggacgagatcttggcagtgtg

SEQ ID NO: 9304490 - DNA, 22 bp, Homo sapiens
gggacgagccccaggctggagg

SEQ ID NO: 9304491 - DNA, 22 bp, Homo sapiens
gggacgggcagtccaaggggtc

SEQ ID NO: 9304492 - DNA, 22 bp, Homo sapiens
gggacctgaggccctgctccac

SEQ ID NO: 9304493 - DNA, 22 bp, Homo sapiens
gggatggacttggggactccag

SEQ ID NO: 9304494 - DNA, 22 bp, Homo sapiens
gggatggactgacggtagcgcg

SEQ ID NO: 9304495 - DNA, 22 bp, Homo sapiens
gggatggagggtagagcaagtg

SEQ ID NO: 9304496 - DNA, 22 bp, Homo sapiens
gggatggatcttggctgaggct

SEQ ID NO: 9304497 - DNA, 22 bp, Homo sapiens
gggatctgagttgtcaggaagg

SEQ ID NO: 9304498 - DNA, 22 bp, Homo sapiens
gggaggctggctctggccacag

SEQ ID NO: 9304499 - DNA, 22 bp, Homo sapiens
gggagggaaggaccttatgaat

SEQ ID NO: 9304500 - DNA, 22 bp, Homo sapiens
gggcctggtgcttctgactcct

SEQ ID NO: 9304501 - DNA, 22 bp, Homo sapiens
gggccatgagaggttcatcaac

SEQ ID NO: 9304502 - DNA, 22 bp, Homo sapiens
gggcggatcatttgaggtcagg

SEQ ID NO: 9304503 - DNA, 22 bp, Homo sapiens
gggcggatcacctgaggtcagg

SEQ ID NO: 9304504 - DNA, 22 bp, Homo sapiens
gggctaagtggatcagtcagga

SEQ ID NO: 9304505 - DNA, 22 bp, Homo sapiens
gggcagctcctgtggaatccac

SEQ ID NO: 9304506 - DNA, 22 bp, Homo sapiens
gggcagctcggaagtgggaaag

SEQ ID NO: 9304507 - DNA, 20 bp, Homo sapiens
gggcagcctcgggagtgggt

SEQ ID NO: 9304508 - DNA, 22 bp, Homo sapiens
gggccacaggagaggctgtcag

SEQ ID NO: 9304509 - DNA, 22 bp, Homo sapiens
gggccaggagtggagatatggg

SEQ ID NO: 9304510 - DNA, 22 bp, Homo sapiens
gggccaggagtggagatatggg

SEQ ID NO: 9304511 - DNA, 22 bp, Homo sapiens
gggcagaggttcaacttcaaca

SEQ ID NO: 9304512 - DNA, 22 bp, Homo sapiens
gggcagatcacctgaggtcagg

SEQ ID NO: 9304513 - DNA, 22 bp, Homo sapiens
gggcagatggggcacaggctga

SEQ ID NO: 9304514 - DNA, 22 bp, Homo sapiens
gggcagatgtctggacacctca

SEQ ID NO: 9304515 - DNA, 22 bp, Homo sapiens
ggctcgtctgagttctagtctc

SEQ ID NO: 9304516 - DNA, 22 bp, Homo sapiens
ggctcgagcagctgtgtaggat

SEQ ID NO: 9304517 - DNA, 22 bp, Homo sapiens
ggctcctggggaggtgagcttg

SEQ ID NO: 9304518 - DNA, 22 bp, Homo sapiens
ggctcctggcatctggtgggta

SEQ ID NO: 9304519 - DNA, 22 bp, Homo sapiens
ggctcctggaggcaccactggt

SEQ ID NO: 9304520 - DNA, 22 bp, Homo sapiens
ggctctcagggaaaggcctccc

SEQ ID NO: 9304521 - DNA, 22 bp, Homo sapiens
ggctgagttgagaggattactt

SEQ ID NO: 9304522 - DNA, 22 bp, Homo sapiens
ggctgagttgagaggattactt

SEQ ID NO: 9304523 - DNA, 22 bp, Homo sapiens
ggctgatgggcatgagctgtca

SEQ ID NO: 9304524 - DNA, 22 bp, Homo sapiens
ggctgcagagctgggtgggcct

SEQ ID NO: 9304525 - DNA, 19 bp, Homo sapiens
ggctgcagagccccggcgc

SEQ ID NO: 9304526 - DNA, 22 bp, Homo sapiens
ggctgcaagcctttggggctgg

SEQ ID NO: 9304527 - DNA, 22 bp, Homo sapiens
ggctgcagcggattggggattg

SEQ ID NO: 9304528 - DNA, 22 bp, Homo sapiens
ggctgcagagctggtgccctgg

SEQ ID NO: 9304529 - DNA, 22 bp, Homo sapiens
ggctggcgggtgggtgaaagac

SEQ ID NO: 9304530 - DNA, 22 bp, Homo sapiens
ggctgctctgccttccagctgg

SEQ ID NO: 9304531 - DNA, 22 bp, Homo sapiens
ggctgctcggagcctcctgtga

SEQ ID NO: 9304532 - DNA, 19 bp, Homo sapiens
ggctgccttctgctcatct

SEQ ID NO: 9304533 - DNA, 22 bp, Homo sapiens
ggctgccttccctgagccccgg

SEQ ID NO: 9304534 - DNA, 22 bp, Homo sapiens
ggctgcaggatgcccagccgtg

SEQ ID NO: 9304535 - DNA, 20 bp, Homo sapiens
ggctgcaggactcattggct

SEQ ID NO: 9304536 - DNA, 22 bp, Homo sapiens
ggctgcaggaacgacggagggg

SEQ ID NO: 9304537 - DNA, 22 bp, Homo sapiens
ggctgcaggcagaggctgtctg

SEQ ID NO: 9304538 - DNA, 22 bp, Homo sapiens
ggctgccttcagactccagctt

SEQ ID NO: 9304539 - DNA, 18 bp, Homo sapiens
ggctgcctgttcctgaag

SEQ ID NO: 9304540 - DNA, 22 bp, Homo sapiens
ggctgcctggtttagtgctgac

SEQ ID NO: 9304541 - DNA, 22 bp, Homo sapiens
ggctgcctgtgcccaggcacac

SEQ ID NO: 9304542 - DNA, 22 bp, Homo sapiens
ggcttcagtgactggtgccctc

SEQ ID NO: 9304543 - DNA, 22 bp, Homo sapiens
ggcttcaggggcccagtcagca

SEQ ID NO: 9304544 - DNA, 22 bp, Homo sapiens
ggcttcaggggcccagtcagca

SEQ ID NO: 9304545 - DNA, 22 bp, Homo sapiens
ggcttcaggggtctgtctgcac

SEQ ID NO: 9304546 - DNA, 22 bp, Homo sapiens
ggcttcaggggtctgtctgcac

SEQ ID NO: 9304547 - DNA, 22 bp, Homo sapiens
ggcttcatttctgtccttgatt

SEQ ID NO: 9304548 - DNA, 19 bp, Homo sapiens
ggcttcagtttagcaggct

SEQ ID NO: 9304549 - DNA, 23 bp, Homo sapiens
ggcttcagtgagagtccctgctg

SEQ ID NO: 9304550 - DNA, 22 bp, Homo sapiens
ggcttcagtgagctgagctcac

SEQ ID NO: 9304551 - DNA, 22 bp, Homo sapiens
ggcttcagtgagctgagctcac

SEQ ID NO: 9304552 - DNA, 22 bp, Homo sapiens
ggcttcagtgagctgagctcac

SEQ ID NO: 9304553 - DNA, 22 bp, Homo sapiens
ggcttccagctgggccttggag

SEQ ID NO: 9304554 - DNA, 17 bp, Homo sapiens
ggcttccaggtggctct

SEQ ID NO: 9304555 - DNA, 22 bp, Homo sapiens
ggcttccagtgatgcctctttg

SEQ ID NO: 9304556 - DNA, 22 bp, Homo sapiens
ggcttccatgtgaaattctttg

SEQ ID NO: 9304557 - DNA, 22 bp, Homo sapiens
ggctggctggcttagcagagga

SEQ ID NO: 9304558 - DNA, 22 bp, Homo sapiens
ggctggctgcatgccccctcct

SEQ ID NO: 9304559 - DNA, 22 bp, Homo sapiens
ggctggctcttaccgacagcgt

SEQ ID NO: 9304560 - DNA, 22 bp, Homo sapiens
ggctggctatctgtggttgcct

SEQ ID NO: 9304561 - DNA, 22 bp, Homo sapiens
ggctggctcagggcttgagaga

SEQ ID NO: 9304562 - DNA, 22 bp, Homo sapiens
ggctggctcatgcaaagggtga

SEQ ID NO: 9304563 - DNA, 22 bp, Homo sapiens
ggcttcgcagctcggcagccgc

SEQ ID NO: 9304564 - DNA, 22 bp, Homo sapiens
ggcttctaaggagtatcctttg

SEQ ID NO: 9304565 - DNA, 22 bp, Homo sapiens
ggctttgcttctccagatgctt

SEQ ID NO: 9304566 - DNA, 22 bp, Homo sapiens
ggcttcctatcccatctgagtg

SEQ ID NO: 9304567 - DNA, 22 bp, Homo sapiens
ggcttcctccttcctgctgtca

SEQ ID NO: 9304568 - DNA, 22 bp, Homo sapiens
ggcttcctggagaaggtctgag

SEQ ID NO: 9304569 - DNA, 22 bp, Homo sapiens
gggaaattttaggtttgtctcg

SEQ ID NO: 9304570 - DNA, 22 bp, Homo sapiens
gggaaattaatgactggttgga

SEQ ID NO: 9304571 - DNA, 19 bp, Homo sapiens
gggaaattcacttgcttcc

SEQ ID NO: 9304572 - DNA, 19 bp, Homo sapiens
gggaaattcacttgcttcc

SEQ ID NO: 9304573 - DNA, 22 bp, Homo sapiens
gggaaattgtaacaagtctgtt

SEQ ID NO: 9304574 - DNA, 22 bp, Homo sapiens
gggaaaggatttacagtttgat

SEQ ID NO: 9304575 - DNA, 22 bp, Homo sapiens
gggaacagggcctgagctgggg

SEQ ID NO: 9304576 - DNA, 22 bp, Homo sapiens
gggaactgtttaacaggggttt

SEQ ID NO: 9304577 - DNA, 22 bp, Homo sapiens
gggaacagagtgccagactgac

SEQ ID NO: 9304578 - DNA, 22 bp, Homo sapiens
gggaacagcatatctgaagggt

SEQ ID NO: 9304579 - DNA, 22 bp, Homo sapiens
gggaacagcttgggctctgcca

SEQ ID NO: 9304580 - DNA, 22 bp, Homo sapiens
gggaagagaggaggtggtttcg

SEQ ID NO: 9304581 - DNA, 22 bp, Homo sapiens
gggaagagatttccacatcatt

SEQ ID NO: 9304582 - DNA, 22 bp, Homo sapiens
ggccagaagttggaaaagagcc

SEQ ID NO: 9304583 - DNA, 22 bp, Homo sapiens
ggccagaagttggaaaagagcc

SEQ ID NO: 9304584 - DNA, 22 bp, Homo sapiens
ggcaggtgcttgtcgaaggcct

SEQ ID NO: 9304585 - DNA, 22 bp, Homo sapiens
ggcaggtgctgggagcatctca

SEQ ID NO: 9304586 - DNA, 22 bp, Homo sapiens
ggcaggtgctctgtgggcctgg

SEQ ID NO: 9304587 - DNA, 18 bp, Homo sapiens
ggccagagggagggtccc

SEQ ID NO: 9304588 - DNA, 17 bp, Homo sapiens
ggccagaggcggggctg

SEQ ID NO: 9304589 - DNA, 22 bp, Homo sapiens
ggccagagagcagccaggattc

SEQ ID NO: 9304590 - DNA, 19 bp, Homo sapiens
ggcccaagtactgagtgcc

SEQ ID NO: 9304591 - DNA, 22 bp, Homo sapiens
ggccatggtgaggtcttctcag

SEQ ID NO: 9304592 - DNA, 22 bp, Homo sapiens
ggccccagattctgggctgggt

SEQ ID NO: 9304593 - DNA, 22 bp, Homo sapiens
ggcccctgcggactgcctagag

SEQ ID NO: 9304594 - DNA, 22 bp, Homo sapiens
ggccttggagtcagccttgagc

SEQ ID NO: 9304595 - DNA, 22 bp, Homo sapiens
ggccttgatctctctaactgct

SEQ ID NO: 9304596 - DNA, 22 bp, Homo sapiens
ggccttctgcctttcagcaatg

SEQ ID NO: 9304597 - DNA, 22 bp, Homo sapiens
ggccttcctgctgctccgggcc

SEQ ID NO: 9304598 - DNA, 22 bp, Homo sapiens
ggcccctgtaaaatgtacatgt

SEQ ID NO: 9304599 - DNA, 22 bp, Homo sapiens
ggcccctggcaccaggctgatt

SEQ ID NO: 9304600 - DNA, 22 bp, Homo sapiens
ggccctctgtggctgccatgga

SEQ ID NO: 9304601 - DNA, 22 bp, Homo sapiens
ggcctggctggttcagtaccct

SEQ ID NO: 9304602 - DNA, 22 bp, Homo sapiens
ggccctgcgattaggtggcagg

SEQ ID NO: 9304603 - DNA, 22 bp, Homo sapiens
ggcctgggcccactgtcaagag

SEQ ID NO: 9304604 - DNA, 22 bp, Homo sapiens
ggcctggctggttcagtaccct

SEQ ID NO: 9304605 - DNA, 22 bp, Homo sapiens
ggctcaggtttaaagtgcttta

SEQ ID NO: 9304606 - DNA, 22 bp, Homo sapiens
ggctcctgatttgagggggctg

SEQ ID NO: 9304607 - DNA, 21 bp, Homo sapiens
ggctcctgctttgtgaggggc

SEQ ID NO: 9304608 - DNA, 22 bp, Homo sapiens
ggctcagcttggtgcgcagaaa

SEQ ID NO: 9304609 - DNA, 22 bp, Homo sapiens
ggctcagcttatctgggcaggc

SEQ ID NO: 9304610 - DNA, 22 bp, Homo sapiens
ggctcaggactgcagcgtagag

SEQ ID NO: 9304611 - DNA, 22 bp, Homo sapiens
ggccttggatccaagctgcggc

SEQ ID NO: 9304612 - DNA, 22 bp, Homo sapiens
ggctcagcacagggctggcatc

SEQ ID NO: 9304613 - DNA, 22 bp, Homo sapiens
ggagggctccctgggagtggat

SEQ ID NO: 9304614 - DNA, 22 bp, Homo sapiens
ggagggctgccaggtggagcgg

SEQ ID NO: 9304615 - DNA, 22 bp, Homo sapiens
ggagggctgccaggtggagcgg

SEQ ID NO: 9304616 - DNA, 22 bp, Homo sapiens
ggagggacccactctagaggtg

SEQ ID NO: 9304617 - DNA, 22 bp, Homo sapiens
ggagggacccactgcggtgacc

SEQ ID NO: 9304618 - DNA, 22 bp, Homo sapiens
ggagggagagtgaccctaccaa

SEQ ID NO: 9304619 - DNA, 21 bp, Homo sapiens
ggagggcagcccagactggct

SEQ ID NO: 9304620 - DNA, 22 bp, Homo sapiens
ggagggcatcaatcaggcctgg

SEQ ID NO: 9304621 - DNA, 22 bp, Homo sapiens
ggagggccatcttgggtgtgat

SEQ ID NO: 9304622 - DNA, 22 bp, Homo sapiens
ggagggcccctccagtgggcag

SEQ ID NO: 9304623 - DNA, 22 bp, Homo sapiens
ggaggctcgctggtcgcacagc

SEQ ID NO: 9304624 - DNA, 22 bp, Homo sapiens
ggaggctcttgagaggggagta

SEQ ID NO: 9304625 - DNA, 22 bp, Homo sapiens
ggaggctgagaagtccaagatc

SEQ ID NO: 9304626 - DNA, 22 bp, Homo sapiens
ggaggctgagaagtccaagatc

SEQ ID NO: 9304627 - DNA, 22 bp, Homo sapiens
ggaggctgagaagtccaagatc

SEQ ID NO: 9304628 - DNA, 22 bp, Homo sapiens
ggaggctgagaagtccaagatc

SEQ ID NO: 9304629 - DNA, 22 bp, Homo sapiens
ggaggctgctgcctcacgtggg

SEQ ID NO: 9304630 - DNA, 22 bp, Homo sapiens
ggaggctgctgcctcacgtggg

SEQ ID NO: 9304631 - DNA, 22 bp, Homo sapiens
ggaggctgaggcccctcacagg

SEQ ID NO: 9304632 - DNA, 22 bp, Homo sapiens
ggaggctgaggcccctcacagg

SEQ ID NO: 9304633 - DNA, 22 bp, Homo sapiens
ggaggctgaggcaggcggatca

SEQ ID NO: 9304634 - DNA, 22 bp, Homo sapiens
ggaggctgaggcaggcggatca

SEQ ID NO: 9304635 - DNA, 22 bp, Homo sapiens
ggaggctgaggcaggcggatca

SEQ ID NO: 9304636 - DNA, 22 bp, Homo sapiens
ggaggctgagaggtcgcagtgg

SEQ ID NO: 9304637 - DNA, 22 bp, Homo sapiens
ggaggctgagaggtcgcagtgg

SEQ ID NO: 9304638 - DNA, 22 bp, Homo sapiens
ggaggcccagaaggaagcccag

SEQ ID NO: 9304639 - DNA, 22 bp, Homo sapiens
ggaggcggaggttgcagtgagc

SEQ ID NO: 9304640 - DNA, 22 bp, Homo sapiens
ggaggcggaggttgcagtgagt

SEQ ID NO: 9304641 - DNA, 22 bp, Homo sapiens
ggaggctccactgctcttcctg

SEQ ID NO: 9304642 - DNA, 22 bp, Homo sapiens
ggaggctcagtgaggaaatgga

SEQ ID NO: 9304643 - DNA, 23 bp, Homo sapiens
ggaggtcagtgcctgagggtgag

SEQ ID NO: 9304644 - DNA, 22 bp, Homo sapiens
ggaggtcacgactgggatgcct

SEQ ID NO: 9304645 - DNA, 22 bp, Homo sapiens
ggaggtcatagctgtgcaggta

SEQ ID NO: 9304646 - DNA, 22 bp, Homo sapiens
ggaggtccatgtgaatgtggcc

SEQ ID NO: 9304647 - DNA, 22 bp, Homo sapiens
ggaggtggcagagggacattct

SEQ ID NO: 9304648 - DNA, 22 bp, Homo sapiens
ggaggtggcagagggacattct

SEQ ID NO: 9304649 - DNA, 22 bp, Homo sapiens
ggaggtggaggttgcagtgagc

SEQ ID NO: 9304650 - DNA, 22 bp, Homo sapiens
ggaggtggaggttgcagtgagc

SEQ ID NO: 9304651 - DNA, 22 bp, Homo sapiens
ggaggtggaggttgcagtgagc

SEQ ID NO: 9304652 - DNA, 22 bp, Homo sapiens
ggagggtggcagcgtcctgggc

SEQ ID NO: 9304653 - DNA, 22 bp, Homo sapiens
ggaggtcaaatggagggctggg

SEQ ID NO: 9304654 - DNA, 20 bp, Homo sapiens
ggaggtcaaatgatgagaag

SEQ ID NO: 9304655 - DNA, 22 bp, Homo sapiens
ggaggtggcagggaacataatt

SEQ ID NO: 9304656 - DNA, 22 bp, Homo sapiens
ggaggtggcctgaaaatgtggc

SEQ ID NO: 9304657 - DNA, 22 bp, Homo sapiens
ggaggtgggagacataggcggc

SEQ ID NO: 9304658 - DNA, 22 bp, Homo sapiens
ggaggtgggagacataggcggc

SEQ ID NO: 9304659 - DNA, 22 bp, Homo sapiens
ggaggtgggagcctccagtggt

SEQ ID NO: 9304660 - DNA, 22 bp, Homo sapiens
ggaggtgggagcctccagtggt

SEQ ID NO: 9304661 - DNA, 22 bp, Homo sapiens
ggaggtgggagcctccagtggt

SEQ ID NO: 9304662 - DNA, 22 bp, Homo sapiens
ggaggtgggattaggacctaaa

SEQ ID NO: 9304663 - DNA, 22 bp, Homo sapiens
ggaggtgggattaggacctaaa

SEQ ID NO: 9304664 - DNA, 22 bp, Homo sapiens
ggaggtgggagtttagttcttg

SEQ ID NO: 9304665 - DNA, 22 bp, Homo sapiens
ggaggtggtttgatttctatat

SEQ ID NO: 9304666 - DNA, 22 bp, Homo sapiens
ggaggtggtggcagtgacaatt

SEQ ID NO: 9304667 - DNA, 22 bp, Homo sapiens
ggaggtgggctaaggactctct

SEQ ID NO: 9304668 - DNA, 16 bp, Homo sapiens
ggaggtgggtaaggtg

SEQ ID NO: 9304669 - DNA, 22 bp, Homo sapiens
ggaggtggtggcagtgacaatt

SEQ ID NO: 9304670 - DNA, 22 bp, Homo sapiens
ggaggtgggctaaggactctct

SEQ ID NO: 9304671 - DNA, 22 bp, Homo sapiens
ggaggtgggctaaggactctct

SEQ ID NO: 9304672 - DNA, 22 bp, Homo sapiens
ggagggggaagaagctaaagac

SEQ ID NO: 9304673 - DNA, 22 bp, Homo sapiens
ggaggggtgagaatggctgcct

SEQ ID NO: 9304674 - DNA, 22 bp, Homo sapiens
ggaggggtgctcagctgtcacg

SEQ ID NO: 9304675 - DNA, 22 bp, Homo sapiens
ggaggggtggaaggagtgcctg

SEQ ID NO: 9304676 - DNA, 22 bp, Homo sapiens
ggaggggtctctagcgaggaga

SEQ ID NO: 9304677 - DNA, 22 bp, Homo sapiens
ggaggggtctctagcgaggaga

SEQ ID NO: 9304678 - DNA, 22 bp, Homo sapiens
ggagggtccactgtgaggcaga

SEQ ID NO: 9304679 - DNA, 22 bp, Homo sapiens
ggagtggtgtcactgagaggaa

SEQ ID NO: 9304680 - DNA, 22 bp, Homo sapiens
ggagtgtggagaggacatgggt

SEQ ID NO: 9304681 - DNA, 22 bp, Homo sapiens
ggcacacagcttggcaggagat

SEQ ID NO: 9304682 - DNA, 22 bp, Homo sapiens
ggcacacagcggaatttgctct

SEQ ID NO: 9304683 - DNA, 22 bp, Homo sapiens
ggcacacagcggaatttgctct

SEQ ID NO: 9304684 - DNA, 22 bp, Homo sapiens
ggcacacagatggagcactagc

SEQ ID NO: 9304685 - DNA, 22 bp, Homo sapiens
ggcacacatggtggttggtgaa

SEQ ID NO: 9304686 - DNA, 22 bp, Homo sapiens
ggcacacatagatctgcactgg

SEQ ID NO: 9304687 - DNA, 22 bp, Homo sapiens
ggcacacaggcagatggagtgt

SEQ ID NO: 9304688 - DNA, 22 bp, Homo sapiens
ggcacactcaccacgtggaggg

SEQ ID NO: 9304689 - DNA, 22 bp, Homo sapiens
ggcacactcacttctgccctga

SEQ ID NO: 9304690 - DNA, 22 bp, Homo sapiens
ggagtggcctctcctgtgcagg

SEQ ID NO: 9304691 - DNA, 22 bp, Homo sapiens
ggagtggcagctaggctgtcag

SEQ ID NO: 9304692 - DNA, 22 bp, Homo sapiens
ggagtggcagctaggctgtcag

SEQ ID NO: 9304693 - DNA, 22 bp, Homo sapiens
ggagtgctttgaagccttcatt

SEQ ID NO: 9304694 - DNA, 22 bp, Homo sapiens
ggagtgggaacaatgacatggt

SEQ ID NO: 9304695 - DNA, 22 bp, Homo sapiens
ggagtggtggtcaggccatggc

SEQ ID NO: 9304696 - DNA, 23 bp, Homo sapiens
ggcacagatgctgagcatgtgca

SEQ ID NO: 9304697 - DNA, 22 bp, Homo sapiens
ggcacagcactgtaggcctggg

SEQ ID NO: 9304698 - DNA, 22 bp, Homo sapiens
ggcagacacaaaaacataaggt

SEQ ID NO: 9304699 - DNA, 22 bp, Homo sapiens
ggcagacactcaaaagctggga

SEQ ID NO: 9304700 - DNA, 22 bp, Homo sapiens
ggcagagacaccgaatgactct

SEQ ID NO: 9304701 - DNA, 22 bp, Homo sapiens
ggcaggctagcactgatgtcct

SEQ ID NO: 9304702 - DNA, 22 bp, Homo sapiens
ggcaggctagcactgatgtcct

SEQ ID NO: 9304703 - DNA, 18 bp, Homo sapiens
ggcaggctctctgggtca

SEQ ID NO: 9304704 - DNA, 22 bp, Homo sapiens
ggcaggctgcttgggtcatgtc

SEQ ID NO: 9304705 - DNA, 22 bp, Homo sapiens
ggcaggctccgtgttccattcc

SEQ ID NO: 9304706 - DNA, 22 bp, Homo sapiens
ggcaggctcttggccttatgag

SEQ ID NO: 9304707 - DNA, 22 bp, Homo sapiens
ggcaggctcagcagccaaggag

SEQ ID NO: 9304708 - DNA, 22 bp, Homo sapiens
ggcaggctcagcagccaaggag

SEQ ID NO: 9304709 - DNA, 22 bp, Homo sapiens
ggcaggctccagagccctctcc

SEQ ID NO: 9304710 - DNA, 22 bp, Homo sapiens
ggcaggctccaagcatcctatg

SEQ ID NO: 9304711 - DNA, 22 bp, Homo sapiens
ggcaggctccagagccctctcc

SEQ ID NO: 9304712 - DNA, 22 bp, Homo sapiens
ggcaggctgggtgtcatggagt

SEQ ID NO: 9304713 - DNA, 22 bp, Homo sapiens
ggcaggctgggagtcatcagag

SEQ ID NO: 9304714 - DNA, 22 bp, Homo sapiens
ggcaggtgaggcatgtgcctgg

SEQ ID NO: 9304715 - DNA, 22 bp, Homo sapiens
ggcaggctggctttgttccagg

SEQ ID NO: 9304716 - DNA, 22 bp, Homo sapiens
ggcaggctgggagtcatcagag

SEQ ID NO: 9304717 - DNA, 19 bp, Homo sapiens
ggcaggctggatagagagg

SEQ ID NO: 9304718 - DNA, 22 bp, Homo sapiens
ggcaggctgcttgggtcatgtc

SEQ ID NO: 9304719 - DNA, 19 bp, Homo sapiens
ggcaggctggatagagagg

SEQ ID NO: 9304720 - DNA, 22 bp, Homo sapiens
ggcaggtgctaagagaggtaaa

SEQ ID NO: 9304721 - DNA, 22 bp, Homo sapiens
ggcaggtgcgcatgttgcatta

SEQ ID NO: 9304722 - DNA, 22 bp, Homo sapiens
ggcaggtgctaagagaggtaaa

SEQ ID NO: 9304723 - DNA, 17 bp, Homo sapiens
ggcaggtgcggggccgc

SEQ ID NO: 9304724 - DNA, 22 bp, Homo sapiens
ggcaggcagatggctgcaccaa

SEQ ID NO: 9304725 - DNA, 22 bp, Homo sapiens
ggcagctgtaagatgagtgaat

SEQ ID NO: 9304726 - DNA, 22 bp, Homo sapiens
ggcagctgggttggccagaaac

SEQ ID NO: 9304727 - DNA, 22 bp, Homo sapiens
ggcagaggaagctggaagtggg

SEQ ID NO: 9304728 - DNA, 22 bp, Homo sapiens
ggcagaggaagctggaagtggg

SEQ ID NO: 9304729 - DNA, 22 bp, Homo sapiens
ggcagaggaagctggaagtggg

SEQ ID NO: 9304730 - DNA, 22 bp, Homo sapiens
ggaggaggcaagtaccagatgc

SEQ ID NO: 9304731 - DNA, 22 bp, Homo sapiens
ggaggcagaatagagtgtgggt

SEQ ID NO: 9304732 - DNA, 22 bp, Homo sapiens
ggaggcagaatagagtgtgggt

SEQ ID NO: 9304733 - DNA, 22 bp, Homo sapiens
ggaggaagaggttgttctctca

SEQ ID NO: 9304734 - DNA, 22 bp, Homo sapiens
ggaggaagcacacggcttgtat

SEQ ID NO: 9304735 - DNA, 22 bp, Homo sapiens
ggaggaagcacacggcttgtat

SEQ ID NO: 9304736 - DNA, 22 bp, Homo sapiens
ggaggagcatgagagggtagtg

SEQ ID NO: 9304737 - DNA, 22 bp, Homo sapiens
ggaggaagtgcagttctactac

SEQ ID NO: 9304738 - DNA, 17 bp, Homo sapiens
ggagctccagctactgc

SEQ ID NO: 9304739 - DNA, 22 bp, Homo sapiens
ggaagtggtagagccatgagtg

SEQ ID NO: 9304740 - DNA, 22 bp, Homo sapiens
ggagaaggaatattggagtagg

SEQ ID NO: 9304741 - DNA, 22 bp, Homo sapiens
ggagaaggaagaaagctactat

SEQ ID NO: 9304742 - DNA, 22 bp, Homo sapiens
ggagaggcttggcccagcctgg

SEQ ID NO: 9304743 - DNA, 22 bp, Homo sapiens
ggagaattctttattagctttt

SEQ ID NO: 9304744 - DNA, 22 bp, Homo sapiens
ggagagggtaggggtcctgccc

SEQ ID NO: 9304745 - DNA, 22 bp, Homo sapiens
ggagagggtaggggtcctgccc

SEQ ID NO: 9304746 - DNA, 22 bp, Homo sapiens
ggagaggtgaatggctgctcta

SEQ ID NO: 9304747 - DNA, 22 bp, Homo sapiens
ggagaggtgtattcagtgggtc

SEQ ID NO: 9304748 - DNA, 22 bp, Homo sapiens
ggagaggtgtattcagtgggtc

SEQ ID NO: 9304749 - DNA, 22 bp, Homo sapiens
ggagatcttgcttgaaggcatg

SEQ ID NO: 9304750 - DNA, 22 bp, Homo sapiens
ggagaggtgagaggtacaagtt

SEQ ID NO: 9304751 - DNA, 22 bp, Homo sapiens
ggagaggtgaatggctgctcta

SEQ ID NO: 9304752 - DNA, 22 bp, Homo sapiens
ggagaggtgcaggtcagtggca

SEQ ID NO: 9304753 - DNA, 22 bp, Homo sapiens
ggagaggtgcaggtcagtggca

SEQ ID NO: 9304754 - DNA, 22 bp, Homo sapiens
ggagaggggaacttgttgcttg

SEQ ID NO: 9304755 - DNA, 23 bp, Homo sapiens
ggagaggggtgtgggcatcttta

SEQ ID NO: 9304756 - DNA, 22 bp, Homo sapiens
ggagagggggctccctgcttgg

SEQ ID NO: 9304757 - DNA, 22 bp, Homo sapiens
ggagaggggcaagtttatctag

SEQ ID NO: 9304758 - DNA, 22 bp, Homo sapiens
ggagcctggtcaggttggctcc

SEQ ID NO: 9304759 - DNA, 22 bp, Homo sapiens
ggagcctgtgcccaagcccaga

SEQ ID NO: 9304760 - DNA, 22 bp, Homo sapiens
ggagatgcgactcgcggggctg

SEQ ID NO: 9304761 - DNA, 22 bp, Homo sapiens
ggagatctttaggagttggact

SEQ ID NO: 9304762 - DNA, 22 bp, Homo sapiens
ggagcctggttactagagcctg

SEQ ID NO: 9304763 - DNA, 22 bp, Homo sapiens
ggagcctgtgcccaagcccaga

SEQ ID NO: 9304764 - DNA, 22 bp, Homo sapiens
ggagcctgttagttgagtgctc

SEQ ID NO: 9304765 - DNA, 22 bp, Homo sapiens
ggagcctgtgggatgagatgtg

SEQ ID NO: 9304766 - DNA, 22 bp, Homo sapiens
ggagcgtgcagcatgagctcat

SEQ ID NO: 9304767 - DNA, 22 bp, Homo sapiens
gcttcatgaaaatcactggtca

SEQ ID NO: 9304768 - DNA, 22 bp, Homo sapiens
gcttcatagcattcattgcctg

SEQ ID NO: 9304769 - DNA, 22 bp, Homo sapiens
gcttcagcctcacactgatatc

SEQ ID NO: 9304770 - DNA, 22 bp, Homo sapiens
gcttcagctttgtctccttggg

SEQ ID NO: 9304771 - DNA, 22 bp, Homo sapiens
gcttcagctttgtctccttggg

SEQ ID NO: 9304772 - DNA, 22 bp, Homo sapiens
gcttcagggttatgcaagagtg

SEQ ID NO: 9304773 - DNA, 22 bp, Homo sapiens
gcttcagagatttcactagttt

SEQ ID NO: 9304774 - DNA, 22 bp, Homo sapiens
gcttcagattcttttcatgtct

SEQ ID NO: 9304775 - DNA, 22 bp, Homo sapiens
gcttcagactgtgcttctgttg

SEQ ID NO: 9304776 - DNA, 22 bp, Homo sapiens
gcttcagattcctcttctgtaa

SEQ ID NO: 9304777 - DNA, 22 bp, Homo sapiens
gcttcagccgggcacttaatga

SEQ ID NO: 9304778 - DNA, 22 bp, Homo sapiens
gcttcagcccatcccagtacat

SEQ ID NO: 9304779 - DNA, 21 bp, Homo sapiens
gcttcagcaaggcttgctggt

SEQ ID NO: 9304780 - DNA, 21 bp, Homo sapiens
gcttcagcaaggcttgctggt

SEQ ID NO: 9304781 - DNA, 21 bp, Homo sapiens
gcttcagcaaggcttgctggt

SEQ ID NO: 9304782 - DNA, 22 bp, Homo sapiens
gcttcagactggagcagaggaa

SEQ ID NO: 9304783 - DNA, 20 bp, Homo sapiens
gcttcagaacctgggtgctg

SEQ ID NO: 9304784 - DNA, 22 bp, Homo sapiens
gcttcagaagttgggctctgac

SEQ ID NO: 9304785 - DNA, 22 bp, Homo sapiens
gcttcaaactgagcttcaagtg

SEQ ID NO: 9304786 - DNA, 22 bp, Homo sapiens
gcttcaaagattcacagtttca

SEQ ID NO: 9304787 - DNA, 22 bp, Homo sapiens
gcttcaaagaacaaagggaggc

SEQ ID NO: 9304788 - DNA, 20 bp, Homo sapiens
gcttcaaagccatcctttta

SEQ ID NO: 9304789 - DNA, 20 bp, Homo sapiens
gcttcaaagccatcctttta

SEQ ID NO: 9304790 - DNA, 22 bp, Homo sapiens
gcttcaaattaaggtgaatccc

SEQ ID NO: 9304791 - DNA, 22 bp, Homo sapiens
gcttcaaggccaagacacctta

SEQ ID NO: 9304792 - DNA, 22 bp, Homo sapiens
gcttcacagaatcaatagttgg

SEQ ID NO: 9304793 - DNA, 22 bp, Homo sapiens
gcttcagaaatatcatcattat

SEQ ID NO: 9304794 - DNA, 22 bp, Homo sapiens
gcttcggggtccaagcgcgtgt

SEQ ID NO: 9304795 - DNA, 22 bp, Homo sapiens
gcttctaacctgcttcctgtag

SEQ ID NO: 9304796 - DNA, 23 bp, Homo sapiens
gcttctagtcaatttcaccagga

SEQ ID NO: 9304797 - DNA, 22 bp, Homo sapiens
gcttctatcctaccatgtcttg

SEQ ID NO: 9304798 - DNA, 22 bp, Homo sapiens
gcttctcaattctcaccctcca

SEQ ID NO: 9304799 - DNA, 22 bp, Homo sapiens
gcttctgcagagccgtcctgag

SEQ ID NO: 9304800 - DNA, 22 bp, Homo sapiens
gcttccttggtcctggtctaag

SEQ ID NO: 9304801 - DNA, 22 bp, Homo sapiens
gctgggctgcccaacctctgac

SEQ ID NO: 9304802 - DNA, 22 bp, Homo sapiens
gctgggctgcgtcggggaagcc

SEQ ID NO: 9304803 - DNA, 22 bp, Homo sapiens
gcttacaggtgaggcagcaaga

SEQ ID NO: 9304804 - DNA, 22 bp, Homo sapiens
gcttagcaatgtgacaagatgc

SEQ ID NO: 9304805 - DNA, 20 bp, Homo sapiens
gcttagcaggcatagtagct

SEQ ID NO: 9304806 - DNA, 22 bp, Homo sapiens
gcttagcatcttacaatgctga

SEQ ID NO: 9304807 - DNA, 22 bp, Homo sapiens
gctgggcagtgagtgagtcctt

SEQ ID NO: 9304808 - DNA, 22 bp, Homo sapiens
gctgggcatgtgaccaacagaa

SEQ ID NO: 9304809 - DNA, 22 bp, Homo sapiens
gctgggctcagacctagtgaac

SEQ ID NO: 9304810 - DNA, 22 bp, Homo sapiens
gctgggctctgtcatgccttcc

SEQ ID NO: 9304811 - DNA, 17 bp, Homo sapiens
ggaagaaaaggatcatc

SEQ ID NO: 9304812 - DNA, 22 bp, Homo sapiens
ggaacttgaaaatcaaggtggt

SEQ ID NO: 9304813 - DNA, 22 bp, Homo sapiens
ggaacttgcaacctctggtcac

SEQ ID NO: 9304814 - DNA, 19 bp, Homo sapiens
ggaacttggcctttaccca

SEQ ID NO: 9304815 - DNA, 22 bp, Homo sapiens
ggaaggggtgggtgagcctcag

SEQ ID NO: 9304816 - DNA, 21 bp, Homo sapiens
ggaaggggtcctcccaacagt

SEQ ID NO: 9304817 - DNA, 22 bp, Homo sapiens
ggaaggggttaggggtccctga

SEQ ID NO: 9304818 - DNA, 22 bp, Homo sapiens
ggaaggggtgtcgcccatggat

SEQ ID NO: 9304819 - DNA, 17 bp, Homo sapiens
ggaaggtcaaggggagg

SEQ ID NO: 9304820 - DNA, 22 bp, Homo sapiens
ggaaaacaagagaatgatgttt

SEQ ID NO: 9304821 - DNA, 22 bp, Homo sapiens
ggaaaactgaggctctcagcag

SEQ ID NO: 9304822 - DNA, 22 bp, Homo sapiens
ggaaacttgttattgtattttc

SEQ ID NO: 9304823 - DNA, 22 bp, Homo sapiens
ggaaacttgttattgtattttc

SEQ ID NO: 9304824 - DNA, 22 bp, Homo sapiens
ggaaacttggcataattttaag

SEQ ID NO: 9304825 - DNA, 22 bp, Homo sapiens
ggaaacttggatgccagcactc

SEQ ID NO: 9304826 - DNA, 22 bp, Homo sapiens
ggaaactaaagaggtgtttttg

SEQ ID NO: 9304827 - DNA, 20 bp, Homo sapiens
ggaaacatttttatttccat

SEQ ID NO: 9304828 - DNA, 22 bp, Homo sapiens
ggaaagatgtaatattatctaa

SEQ ID NO: 9304829 - DNA, 22 bp, Homo sapiens
ggaactcctgctccaagcagct

SEQ ID NO: 9304830 - DNA, 23 bp, Homo sapiens
ggaaagagaggagttgtgcatag

SEQ ID NO: 9304831 - DNA, 22 bp, Homo sapiens
taacactaagaatctaaattta

SEQ ID NO: 9304832 - DNA, 22 bp, Homo sapiens
taaatcagcctttgctatttta

SEQ ID NO: 9304833 - DNA, 22 bp, Homo sapiens
taaatcttgtggcaatgcttct

SEQ ID NO: 9304834 - DNA, 22 bp, Homo sapiens
taaatctttaggaagctcaaac

SEQ ID NO: 9304835 - DNA, 22 bp, Homo sapiens
taaatgaaagggtttaatttat

SEQ ID NO: 9304836 - DNA, 21 bp, Homo sapiens
taaatctctgtattcttcagt

SEQ ID NO: 9304837 - DNA, 22 bp, Homo sapiens
taaatctcctgtttttcatcta

SEQ ID NO: 9304838 - DNA, 18 bp, Homo sapiens
taaaggaagtgggagagg

SEQ ID NO: 9304839 - DNA, 22 bp, Homo sapiens
taaaggaagaattctctgtgat

SEQ ID NO: 9304840 - DNA, 19 bp, Homo sapiens
taaaggaagaagggaggat

SEQ ID NO: 9304841 - DNA, 22 bp, Homo sapiens
taaaaccaggtcttgggattta

SEQ ID NO: 9304842 - DNA, 22 bp, Homo sapiens
taaaaccattcctgctttcatg

SEQ ID NO: 9304843 - DNA, 22 bp, Homo sapiens
taaaaccataaggctggaagga

SEQ ID NO: 9304844 - DNA, 22 bp, Homo sapiens
taaagctagccaaccactgtct

SEQ ID NO: 9304845 - DNA, 22 bp, Homo sapiens
gtttttctttgtgtgaagacaa

SEQ ID NO: 9304846 - DNA, 22 bp, Homo sapiens
taaaacacataaactctctatt

SEQ ID NO: 9304847 - DNA, 22 bp, Homo sapiens
gttttttgggtgtatatcttct

SEQ ID NO: 9304848 - DNA, 18 bp, Homo sapiens
gtggggtgttgtgaggat

SEQ ID NO: 9304849 - DNA, 22 bp, Homo sapiens
gtggggtgtccagcagcgagct

SEQ ID NO: 9304850 - DNA, 22 bp, Homo sapiens
gtggggtgcagcagtactgtgt

SEQ ID NO: 9304851 - DNA, 22 bp, Homo sapiens
gtgggtgatgtactggaggcca

SEQ ID NO: 9304852 - DNA, 22 bp, Homo sapiens
gtgggtgcggggagccgaggcg

SEQ ID NO: 9304853 - DNA, 22 bp, Homo sapiens
gtgggtgctgtcaggcagggaa

SEQ ID NO: 9304854 - DNA, 22 bp, Homo sapiens
gtgggtggagactgggtgcaag

SEQ ID NO: 9304855 - DNA, 22 bp, Homo sapiens
gtgtaaatcagcttgtgtaata

SEQ ID NO: 9304856 - DNA, 18 bp, Homo sapiens
gtgtaaacagccattgag

SEQ ID NO: 9304857 - DNA, 21 bp, Homo sapiens
gtgtaaacggactcatgcagt

SEQ ID NO: 9304858 - DNA, 22 bp, Homo sapiens
gtgtaaacaacagtggtttgaa

SEQ ID NO: 9304859 - DNA, 22 bp, Homo sapiens
gtgtaaacaatgaaaacagagc

SEQ ID NO: 9304860 - DNA, 22 bp, Homo sapiens
gtgtaaacacccttactgtggc

SEQ ID NO: 9304861 - DNA, 18 bp, Homo sapiens
gtgtaaacagccattgag

SEQ ID NO: 9304862 - DNA, 17 bp, Homo sapiens
gtgtaaatgctagaaac

SEQ ID NO: 9304863 - DNA, 22 bp, Homo sapiens
gtgtaaatttgtacttgtaaat

SEQ ID NO: 9304864 - DNA, 22 bp, Homo sapiens
gtgtaaatgccccattcattga

SEQ ID NO: 9304865 - DNA, 22 bp, Homo sapiens
gtggtgcaggccagcaggggcg

SEQ ID NO: 9304866 - DNA, 22 bp, Homo sapiens
gtggtgcaggccagcaggggcg

SEQ ID NO: 9304867 - DNA, 22 bp, Homo sapiens
gtggtgagttcaggctggggtg

SEQ ID NO: 9304868 - DNA, 22 bp, Homo sapiens
gtggtgtggctggcagagttta

SEQ ID NO: 9304869 - DNA, 22 bp, Homo sapiens
gtggtgtgtgcttagggctagg

SEQ ID NO: 9304870 - DNA, 22 bp, Homo sapiens
gtggggaggcattcttctccct

SEQ ID NO: 9304871 - DNA, 22 bp, Homo sapiens
gtggggagcagccttagcccct

SEQ ID NO: 9304872 - DNA, 22 bp, Homo sapiens
gtggggacgggatggctcactg

SEQ ID NO: 9304873 - DNA, 22 bp, Homo sapiens
gtgggggcaggcagtgctagga

SEQ ID NO: 9304874 - DNA, 22 bp, Homo sapiens
gtgggccttgcagggtgcaggg

SEQ ID NO: 9304875 - DNA, 22 bp, Homo sapiens
gtgggctgcccttgaggtcagc

SEQ ID NO: 9304876 - DNA, 20 bp, Homo sapiens
gtgggcagagcaccacctgg

SEQ ID NO: 9304877 - DNA, 22 bp, Homo sapiens
gtgtgcagggggccagcgcagc

SEQ ID NO: 9304878 - DNA, 21 bp, Homo sapiens
gtgtgagtagcatgtgtctca

SEQ ID NO: 9304879 - DNA, 22 bp, Homo sapiens
gtgtgagggacagagaaagggg

SEQ ID NO: 9304880 - DNA, 22 bp, Homo sapiens
gtgtgagtgaaagtagtttgat

SEQ ID NO: 9304881 - DNA, 22 bp, Homo sapiens
gtgtggtcgaagttctcccgga

SEQ ID NO: 9304882 - DNA, 22 bp, Homo sapiens
gtgtgtaatgcttattgtgctt

SEQ ID NO: 9304883 - DNA, 22 bp, Homo sapiens
gtgtgtaaacctccaatctggg

SEQ ID NO: 9304884 - DNA, 22 bp, Homo sapiens
gtgtggtgaggccccttaggct

SEQ ID NO: 9304885 - DNA, 22 bp, Homo sapiens
gtgtggggccaggatcagggct

SEQ ID NO: 9304886 - DNA, 22 bp, Homo sapiens
gtgtgggctgcagaggcacagc

SEQ ID NO: 9304887 - DNA, 22 bp, Homo sapiens
gtgtggggagctgcagccacat

SEQ ID NO: 9304888 - DNA, 22 bp, Homo sapiens
gtgtcctgagtgaggcctggcc

SEQ ID NO: 9304889 - DNA, 22 bp, Homo sapiens
gtgtcctgggggacttcaggtt

SEQ ID NO: 9304890 - DNA, 22 bp, Homo sapiens
gtgtctactgatctgattcaga

SEQ ID NO: 9304891 - DNA, 22 bp, Homo sapiens
gtgtctacaggatggagtggct

SEQ ID NO: 9304892 - DNA, 21 bp, Homo sapiens
gtgtctaccggatgagggaga

SEQ ID NO: 9304893 - DNA, 22 bp, Homo sapiens
gtgtccagggctggaagtgagg

SEQ ID NO: 9304894 - DNA, 22 bp, Homo sapiens
gtgtccagcgtggaatgagggt

SEQ ID NO: 9304895 - DNA, 22 bp, Homo sapiens
gttcaagaccagcctggccaac

SEQ ID NO: 9304896 - DNA, 21 bp, Homo sapiens
gttcaaatgggtagattcaca

SEQ ID NO: 9304897 - DNA, 22 bp, Homo sapiens
gttcaaatctcaggacttcaga

SEQ ID NO: 9304898 - DNA, 22 bp, Homo sapiens
gttcaaggaagggaggaaagcc

SEQ ID NO: 9304899 - DNA, 22 bp, Homo sapiens
gttctctcaaactttgtgtttg

SEQ ID NO: 9304900 - DNA, 16 bp, Homo sapiens
gttctctcactgtacc

SEQ ID NO: 9304901 - DNA, 22 bp, Homo sapiens
gttctctcagcctttgttatta

SEQ ID NO: 9304902 - DNA, 22 bp, Homo sapiens
gttctctcagcgatagtgatgg

SEQ ID NO: 9304903 - DNA, 22 bp, Homo sapiens
gttctctctgcttccaagatgg

SEQ ID NO: 9304904 - DNA, 22 bp, Homo sapiens
gttctctctcttgcctgggtgg

SEQ ID NO: 9304905 - DNA, 22 bp, Homo sapiens
gttctgctcctgtggcaatcta

SEQ ID NO: 9304906 - DNA, 22 bp, Homo sapiens
gttctgagtcctcctttgaagg

SEQ ID NO: 9304907 - DNA, 22 bp, Homo sapiens
gttgtattcttcaatatcagag

SEQ ID NO: 9304908 - DNA, 22 bp, Homo sapiens
gttgtttataaaaatatctagc

SEQ ID NO: 9304909 - DNA, 22 bp, Homo sapiens
gttgttgatcacatgcatatct

SEQ ID NO: 9304910 - DNA, 22 bp, Homo sapiens
gttgttcagcctagagtgcagt

SEQ ID NO: 9304911 - DNA, 22 bp, Homo sapiens
gttgttttataggctcatgcct

SEQ ID NO: 9304912 - DNA, 23 bp, Homo sapiens
gtgcgccaggacaacctgacgga

SEQ ID NO: 9304913 - DNA, 22 bp, Homo sapiens
gtgcctggcatgcgccggtgct

SEQ ID NO: 9304914 - DNA, 20 bp, Homo sapiens
gtgcctggagaagaggctgt

SEQ ID NO: 9304915 - DNA, 22 bp, Homo sapiens
gtgcctggaccctctttccgga

SEQ ID NO: 9304916 - DNA, 22 bp, Homo sapiens
gtgcctggagctaatgtgtata

SEQ ID NO: 9304917 - DNA, 20 bp, Homo sapiens
gtgcctggagaagaggctgt

SEQ ID NO: 9304918 - DNA, 20 bp, Homo sapiens
gtgcctggagaagaggctgt

SEQ ID NO: 9304919 - DNA, 22 bp, Homo sapiens
gtgcctggcagggtcagctgct

SEQ ID NO: 9304920 - DNA, 22 bp, Homo sapiens
gtgcctggcacacagaaggcaa

SEQ ID NO: 9304921 - DNA, 22 bp, Homo sapiens
gtgcctggcacacagaaggcaa

SEQ ID NO: 9304922 - DNA, 22 bp, Homo sapiens
gtggaaagaacacaaaattagg

SEQ ID NO: 9304923 - DNA, 22 bp, Homo sapiens
gtgacaggcccagtgggatgca

SEQ ID NO: 9304924 - DNA, 20 bp, Homo sapiens
gtgaagggagtcaggtgtgc

SEQ ID NO: 9304925 - DNA, 22 bp, Homo sapiens
gtgaaggattggagggcatctt

SEQ ID NO: 9304926 - DNA, 22 bp, Homo sapiens
gtgacaatattagctcaggggc

SEQ ID NO: 9304927 - DNA, 22 bp, Homo sapiens
gtgacaatattagctcaggggc

SEQ ID NO: 9304928 - DNA, 22 bp, Homo sapiens
gtgcctggaactgggtaggctg

SEQ ID NO: 9304929 - DNA, 22 bp, Homo sapiens
gtgcctggaactgggtaggctg

SEQ ID NO: 9304930 - DNA, 22 bp, Homo sapiens
gtgcctggaatgcgcctcggcg

SEQ ID NO: 9304931 - DNA, 22 bp, Homo sapiens
gtgcctggaatgcgcctcggcg

SEQ ID NO: 9304932 - DNA, 22 bp, Homo sapiens
gtggcagagttgctgactagaa

SEQ ID NO: 9304933 - DNA, 18 bp, Homo sapiens
gtggcagcctttggcttt

SEQ ID NO: 9304934 - DNA, 22 bp, Homo sapiens
gtggcagcaggtactcacgcac

SEQ ID NO: 9304935 - DNA, 22 bp, Homo sapiens
gtggcagcaaaatcctgcattc

SEQ ID NO: 9304936 - DNA, 22 bp, Homo sapiens
gtggcagcaaatgcctggacta

SEQ ID NO: 9304937 - DNA, 22 bp, Homo sapiens
gtggcaacaaaagagcctagtg

SEQ ID NO: 9304938 - DNA, 22 bp, Homo sapiens
gtggattacaagacagttgaga

SEQ ID NO: 9304939 - DNA, 22 bp, Homo sapiens
gtggcacagtgggagagcccca

SEQ ID NO: 9304940 - DNA, 22 bp, Homo sapiens
gtggcagagccaaggctggagc

SEQ ID NO: 9304941 - DNA, 22 bp, Homo sapiens
gtggcacagccaagcctcactc

SEQ ID NO: 9304942 - DNA, 22 bp, Homo sapiens
gtggaggacaaaagaagccttt

SEQ ID NO: 9304943 - DNA, 22 bp, Homo sapiens
gtggaggcagtgacacagtagc

SEQ ID NO: 9304944 - DNA, 22 bp, Homo sapiens
gtggagggtgattgccggctgt

SEQ ID NO: 9304945 - DNA, 22 bp, Homo sapiens
gtggagtggtgatggataggtt

SEQ ID NO: 9304946 - DNA, 22 bp, Homo sapiens
gtggcctggatgagcttcgaca

SEQ ID NO: 9304947 - DNA, 22 bp, Homo sapiens
gtggcctgagcttcagagttgg

SEQ ID NO: 9304948 - DNA, 22 bp, Homo sapiens
gtggcctgatgccagccctgtg

SEQ ID NO: 9304949 - DNA, 22 bp, Homo sapiens
gtggcctggaaaggctggtctg

SEQ ID NO: 9304950 - DNA, 22 bp, Homo sapiens
gtgggagagaccccgcttaggg

SEQ ID NO: 9304951 - DNA, 22 bp, Homo sapiens
gtgggagaaattagctctagtt

SEQ ID NO: 9304952 - DNA, 22 bp, Homo sapiens
gtgggagaatggccttgcaaac

SEQ ID NO: 9304953 - DNA, 22 bp, Homo sapiens
gtgggagctttggcatcaggct

SEQ ID NO: 9304954 - DNA, 22 bp, Homo sapiens
gtgggagctgcggaggcctggg

SEQ ID NO: 9304955 - DNA, 22 bp, Homo sapiens
gtgggagctgcggaggcctggg

SEQ ID NO: 9304956 - DNA, 22 bp, Homo sapiens
gtggctggccctggaccctaag

SEQ ID NO: 9304957 - DNA, 22 bp, Homo sapiens
gtggctggccctggaccctaag

SEQ ID NO: 9304958 - DNA, 22 bp, Homo sapiens
gtggctggagtatgaggaaagg

SEQ ID NO: 9304959 - DNA, 22 bp, Homo sapiens
gtggctgggctccgagcggctt

SEQ ID NO: 9304960 - DNA, 22 bp, Homo sapiens
gtggctggtttcctgcatgcaa

SEQ ID NO: 9304961 - DNA, 22 bp, Homo sapiens
gtggctggtttcctgcatgcaa

SEQ ID NO: 9304962 - DNA, 22 bp, Homo sapiens
gtggctgggctccgagcggctt

SEQ ID NO: 9304963 - DNA, 22 bp, Homo sapiens
gtggccagccagggtgctgatg

SEQ ID NO: 9304964 - DNA, 22 bp, Homo sapiens
gtggccagccccatggacagtt

SEQ ID NO: 9304965 - DNA, 18 bp, Homo sapiens
gtggccagcctggtcttg

SEQ ID NO: 9304966 - DNA, 22 bp, Homo sapiens
gtggccaggagagggtgggaca

SEQ ID NO: 9304967 - DNA, 22 bp, Homo sapiens
gtggcccagccctacagaggac

SEQ ID NO: 9304968 - DNA, 22 bp, Homo sapiens
gtggcagtgtggagggaggagt

SEQ ID NO: 9304969 - DNA, 20 bp, Homo sapiens
gtggcagtggtggcagcagt

SEQ ID NO: 9304970 - DNA, 22 bp, Homo sapiens
gtggcagggtgctcatcatgca

SEQ ID NO: 9304971 - DNA, 22 bp, Homo sapiens
gtggcaggggtattccagctga

SEQ ID NO: 9304972 - DNA, 22 bp, Homo sapiens
gtggccaataggagcagctatc

SEQ ID NO: 9304973 - DNA, 22 bp, Homo sapiens
gtggccaagagataaaattgtg

SEQ ID NO: 9304974 - DNA, 22 bp, Homo sapiens
gtggccaagaaaatagatgcat

SEQ ID NO: 9304975 - DNA, 22 bp, Homo sapiens
gtggccaactcaatgtttttca

SEQ ID NO: 9304976 - DNA, 22 bp, Homo sapiens
gtggccaaacaccagtttagga

SEQ ID NO: 9304977 - DNA, 22 bp, Homo sapiens
gtggccaaaaggaagaaggtta

SEQ ID NO: 9304978 - DNA, 20 bp, Homo sapiens
gtggcaggcagtgaaggagc

SEQ ID NO: 9304979 - DNA, 22 bp, Homo sapiens
gtggcaggagactggaagatgg

SEQ ID NO: 9304980 - DNA, 22 bp, Homo sapiens
gtggcagctggtatgcagacag

SEQ ID NO: 9304981 - DNA, 22 bp, Homo sapiens
gtcgcttgaacccaggaagtgg

SEQ ID NO: 9304982 - DNA, 22 bp, Homo sapiens
gtctctgcctggggggatcaga

SEQ ID NO: 9304983 - DNA, 22 bp, Homo sapiens
gtctctgctctagagtctgtga

SEQ ID NO: 9304984 - DNA, 19 bp, Homo sapiens
gtctctgctccagggtctc

SEQ ID NO: 9304985 - DNA, 22 bp, Homo sapiens
gtctgaggcctgaggccctggg

SEQ ID NO: 9304986 - DNA, 22 bp, Homo sapiens
gtctgaggcgaggcctgagaac

SEQ ID NO: 9304987 - DNA, 22 bp, Homo sapiens
gtctgagggtcatgggtctcac

SEQ ID NO: 9304988 - DNA, 22 bp, Homo sapiens
gtctgagggacagagtcctggc

SEQ ID NO: 9304989 - DNA, 22 bp, Homo sapiens
gtcggccacgcaggtgcggtag

SEQ ID NO: 9304990 - DNA, 22 bp, Homo sapiens
gtctgggagtttggtgctgccg

SEQ ID NO: 9304991 - DNA, 22 bp, Homo sapiens
gtctggctttcatggctctgca

SEQ ID NO: 9304992 - DNA, 22 bp, Homo sapiens
gtctgggcaggaatctgcattc

SEQ ID NO: 9304993 - DNA, 22 bp, Homo sapiens
gtctgggcagcagcatttctta

SEQ ID NO: 9304994 - DNA, 22 bp, Homo sapiens
gtctgggcaagggagatggcgc

SEQ ID NO: 9304995 - DNA, 22 bp, Homo sapiens
gtctggggaagtcagggcatca

SEQ ID NO: 9304996 - DNA, 22 bp, Homo sapiens
gtctgggcttagggacatggca

SEQ ID NO: 9304997 - DNA, 22 bp, Homo sapiens
gtctgggctcctggcaggcagc

SEQ ID NO: 9304998 - DNA, 22 bp, Homo sapiens
gtctgggccaggcgagccgagg

SEQ ID NO: 9304999 - DNA, 22 bp, Homo sapiens
gtctgggctcccagggtcggcg

SEQ ID NO: 9305000 - DNA, 22 bp, Homo sapiens
gtctggctcccactcttacaaa

SEQ ID NO: 9305001 - DNA, 22 bp, Homo sapiens
gtctgagggttgtgctggagga

SEQ ID NO: 9305002 - DNA, 22 bp, Homo sapiens
gtcaggactctgacccgtcccg

SEQ ID NO: 9305003 - DNA, 22 bp, Homo sapiens
gtccagggaaatagcgacaggg

SEQ ID NO: 9305004 - DNA, 22 bp, Homo sapiens
gtccagggaaatagcgacaggg

SEQ ID NO: 9305005 - DNA, 18 bp, Homo sapiens
gtcaggcatgaatctggg

SEQ ID NO: 9305006 - DNA, 22 bp, Homo sapiens
gtcagaggggcagctgccaggc

SEQ ID NO: 9305007 - DNA, 18 bp, Homo sapiens
gtcagaggatggggaaat

SEQ ID NO: 9305008 - DNA, 22 bp, Homo sapiens
gtcagcttccctttggtttatt

SEQ ID NO: 9305009 - DNA, 22 bp, Homo sapiens
gtccagtgacaagtagctggcc

SEQ ID NO: 9305010 - DNA, 22 bp, Homo sapiens
gtccagtgcttatagaatcagt

SEQ ID NO: 9305011 - DNA, 22 bp, Homo sapiens
gtccagtgctaacaggttgagg

SEQ ID NO: 9305012 - DNA, 22 bp, Homo sapiens
gtccagggggcttaagcaaact

SEQ ID NO: 9305013 - DNA, 22 bp, Homo sapiens
gtcccagggaagaaggcagcac

SEQ ID NO: 9305014 - DNA, 22 bp, Homo sapiens
gtcccagggaggttcagggctt

SEQ ID NO: 9305015 - DNA, 22 bp, Homo sapiens
gtcctgggtccccgcaggtcag

SEQ ID NO: 9305016 - DNA, 22 bp, Homo sapiens
gtcctgttggtgaatggctctt

SEQ ID NO: 9305017 - DNA, 22 bp, Homo sapiens
gtcccaggtcccagcacatctg

SEQ ID NO: 9305018 - DNA, 22 bp, Homo sapiens
gtcccaggtgcccagtgggcag

SEQ ID NO: 9305019 - DNA, 22 bp, Homo sapiens
ggtggcaggctggcattggcaa

SEQ ID NO: 9305020 - DNA, 22 bp, Homo sapiens
ggtggcagttacaggggcaaat

SEQ ID NO: 9305021 - DNA, 22 bp, Homo sapiens
ggtggcagttacaggggcaaat

SEQ ID NO: 9305022 - DNA, 22 bp, Homo sapiens
ggtggcaggctggcattggcaa

SEQ ID NO: 9305023 - DNA, 22 bp, Homo sapiens
ggtggcaggctggcattggcaa

SEQ ID NO: 9305024 - DNA, 22 bp, Homo sapiens
ggtgtccgcgctgtagaaggtc

SEQ ID NO: 9305025 - DNA, 23 bp, Homo sapiens
ggtggtggtgagtcacgggctca

SEQ ID NO: 9305026 - DNA, 22 bp, Homo sapiens
ggtgcaggacgaagtgggggtt

SEQ ID NO: 9305027 - DNA, 22 bp, Homo sapiens
ggtgcaggaatctgcaattgaa

SEQ ID NO: 9305028 - DNA, 22 bp, Homo sapiens
ggtgcaggaatctgcaattgaa

SEQ ID NO: 9305029 - DNA, 22 bp, Homo sapiens
ggtgcaggcggtggggcaagta

SEQ ID NO: 9305030 - DNA, 22 bp, Homo sapiens
ggtgcaggcggtggggcaagta

SEQ ID NO: 9305031 - DNA, 22 bp, Homo sapiens
gggtggggttcaggaatcttca

SEQ ID NO: 9305032 - DNA, 22 bp, Homo sapiens
gggtggggtgtatcggatccta

SEQ ID NO: 9305033 - DNA, 22 bp, Homo sapiens
gtatatatcggcactattttaa

SEQ ID NO: 9305034 - DNA, 22 bp, Homo sapiens
gtatatattggataaaccagag

SEQ ID NO: 9305035 - DNA, 23 bp, Homo sapiens
gtaaaatacgcagtgcagtgtga

SEQ ID NO: 9305036 - DNA, 22 bp, Homo sapiens
gtaaagctctcatttaatatca

SEQ ID NO: 9305037 - DNA, 22 bp, Homo sapiens
gtaaagcaaaatgtagagattg

SEQ ID NO: 9305038 - DNA, 22 bp, Homo sapiens
gtaaagcaggtagttgggacac

SEQ ID NO: 9305039 - DNA, 22 bp, Homo sapiens
gtaaagaaggcaacctggttat

SEQ ID NO: 9305040 - DNA, 22 bp, Homo sapiens
gtaaacattttcatctgtgccc

SEQ ID NO: 9305041 - DNA, 22 bp, Homo sapiens
ttccagagttgggggagtggtt

SEQ ID NO: 9305042 - DNA, 22 bp, Homo sapiens
ttccagagtccatgttggctca

SEQ ID NO: 9305043 - DNA, 22 bp, Homo sapiens
ttccagagtctggttccatggt

SEQ ID NO: 9305044 - DNA, 23 bp, Homo sapiens
ttccagagtccacatctgccacc

SEQ ID NO: 9305045 - DNA, 22 bp, Homo sapiens
ttccagagtattggtagctata

SEQ ID NO: 9305046 - DNA, 22 bp, Homo sapiens
ttccagagtcagccactgggag

SEQ ID NO: 9305047 - DNA, 22 bp, Homo sapiens
ttccagaggcttcagggaagaa

SEQ ID NO: 9305048 - DNA, 22 bp, Homo sapiens
ttccagaggctctaggggagaa

SEQ ID NO: 9305049 - DNA, 22 bp, Homo sapiens
ttccagaggggaggtggcagcc

SEQ ID NO: 9305050 - DNA, 22 bp, Homo sapiens
ttccagctaactcacatccctt

SEQ ID NO: 9305051 - DNA, 22 bp, Homo sapiens
ttccagctaactcacatccctt

SEQ ID NO: 9305052 - DNA, 22 bp, Homo sapiens
ttcattcacccaggaaacatct

SEQ ID NO: 9305053 - DNA, 22 bp, Homo sapiens
ttcaggaatataggcattgaca

SEQ ID NO: 9305054 - DNA, 23 bp, Homo sapiens
ttccagaggaagaagtcatgact

SEQ ID NO: 9305055 - DNA, 23 bp, Homo sapiens
ttccagaggaagaagtcatgact

SEQ ID NO: 9305056 - DNA, 22 bp, Homo sapiens
ttccagagctttgcgcttggaa

SEQ ID NO: 9305057 - DNA, 22 bp, Homo sapiens
ttcacattggtgatatgtttct

SEQ ID NO: 9305058 - DNA, 22 bp, Homo sapiens
ttcacatttactggtttgtccg

SEQ ID NO: 9305059 - DNA, 22 bp, Homo sapiens
ttcacattgtgcagattatggt

SEQ ID NO: 9305060 - DNA, 22 bp, Homo sapiens
ttcacatttctctgctgtttga

SEQ ID NO: 9305061 - DNA, 22 bp, Homo sapiens
ttcacatttcataccacagctt

SEQ ID NO: 9305062 - DNA, 19 bp, Homo sapiens
ttcacattttgctctgagg

SEQ ID NO: 9305063 - DNA, 22 bp, Homo sapiens
ttatttgtgaatcatttatcta

SEQ ID NO: 9305064 - DNA, 22 bp, Homo sapiens
ttatttgccagaatttctcttg

SEQ ID NO: 9305065 - DNA, 20 bp, Homo sapiens
ttatttgctctttatctgca

SEQ ID NO: 9305066 - DNA, 22 bp, Homo sapiens
ttatttgctgatttcagtttca

SEQ ID NO: 9305067 - DNA, 22 bp, Homo sapiens
ttatttgcccatgtttagcaga

SEQ ID NO: 9305068 - DNA, 22 bp, Homo sapiens
ttatttctactattttgcctga

SEQ ID NO: 9305069 - DNA, 22 bp, Homo sapiens
ttatttgaatgatggcacaatt

SEQ ID NO: 9305070 - DNA, 20 bp, Homo sapiens
ttatttctcattctcctact

SEQ ID NO: 9305071 - DNA, 20 bp, Homo sapiens
ttatttctcattctcctact

SEQ ID NO: 9305072 - DNA, 22 bp, Homo sapiens
ttcaggaaattggagtccttct

SEQ ID NO: 9305073 - DNA, 22 bp, Homo sapiens
ttcagctttgaggttgattttc

SEQ ID NO: 9305074 - DNA, 22 bp, Homo sapiens
ttcactgaattaatttccttct

SEQ ID NO: 9305075 - DNA, 22 bp, Homo sapiens
ttcaccctgagccccacctctg

SEQ ID NO: 9305076 - DNA, 22 bp, Homo sapiens
ttcaccatgttggccaggctgg

SEQ ID NO: 9305077 - DNA, 22 bp, Homo sapiens
ttcagcatagcagcttcaggac

SEQ ID NO: 9305078 - DNA, 22 bp, Homo sapiens
ttagaaaggcttatggtgcctt

SEQ ID NO: 9305079 - DNA, 22 bp, Homo sapiens
ttacattttgcacagatgtccc

SEQ ID NO: 9305080 - DNA, 22 bp, Homo sapiens
ttagaaatcacctctgaagatc

SEQ ID NO: 9305081 - DNA, 22 bp, Homo sapiens
ttagcattgtacatttgtgctt

SEQ ID NO: 9305082 - DNA, 22 bp, Homo sapiens
ttagcatttcagtacacatgtt

SEQ ID NO: 9305083 - DNA, 22 bp, Homo sapiens
ttagcatttcatttcaagagga

SEQ ID NO: 9305084 - DNA, 22 bp, Homo sapiens
ttagcattttctgggctgaaat

SEQ ID NO: 9305085 - DNA, 22 bp, Homo sapiens
ttagcatttctggaatcacaag

SEQ ID NO: 9305086 - DNA, 22 bp, Homo sapiens
ttaggtattcatttacatgttc

SEQ ID NO: 9305087 - DNA, 22 bp, Homo sapiens
ttagtaaataaagtctactttc

SEQ ID NO: 9305088 - DNA, 22 bp, Homo sapiens
ttagtagctgtggccctgaagt

SEQ ID NO: 9305089 - DNA, 22 bp, Homo sapiens
ttagcactttgattcatgcaga

SEQ ID NO: 9305090 - DNA, 22 bp, Homo sapiens
ttagcatctgctgtaagcttat

SEQ ID NO: 9305091 - DNA, 22 bp, Homo sapiens
ttagcattctcatttgcataaa

SEQ ID NO: 9305092 - DNA, 22 bp, Homo sapiens
ttagcattcttctggggggcac

SEQ ID NO: 9305093 - DNA, 22 bp, Homo sapiens
ttagcattctgcctcctatatc

SEQ ID NO: 9305094 - DNA, 22 bp, Homo sapiens
ttagcattctctgtgtgcataa

SEQ ID NO: 9305095 - DNA, 22 bp, Homo sapiens
ttagcaaacaaatgaaatggtt

SEQ ID NO: 9305096 - DNA, 22 bp, Homo sapiens
ttagatttacaagcactgttta

SEQ ID NO: 9305097 - DNA, 22 bp, Homo sapiens
ttagatttatatgtgagaatgg

SEQ ID NO: 9305098 - DNA, 17 bp, Homo sapiens
ttagcaaaatagcactt

SEQ ID NO: 9305099 - DNA, 22 bp, Homo sapiens
ttagcaaaaatatctcatatta

SEQ ID NO: 9305100 - DNA, 22 bp, Homo sapiens
ttagtgcaaacctcagagacac

SEQ ID NO: 9305101 - DNA, 22 bp, Homo sapiens
ttagtcacttcttccttcatca

SEQ ID NO: 9305102 - DNA, 22 bp, Homo sapiens
ttagtcacatgcccatctctga

SEQ ID NO: 9305103 - DNA, 22 bp, Homo sapiens
ttatctctcacttttaaggaca

SEQ ID NO: 9305104 - DNA, 18 bp, Homo sapiens
ttatctgctgcaaagggt

SEQ ID NO: 9305105 - DNA, 22 bp, Homo sapiens
ttatctgttgttttagtacaat

SEQ ID NO: 9305106 - DNA, 22 bp, Homo sapiens
ttatgagactgttttacacact

SEQ ID NO: 9305107 - DNA, 22 bp, Homo sapiens
ttatgagctaagttgtggcccc

SEQ ID NO: 9305108 - DNA, 22 bp, Homo sapiens
ttatgcaaaggggcctcttcct

SEQ ID NO: 9305109 - DNA, 22 bp, Homo sapiens
ttatgcaacaggtgagcagaca

SEQ ID NO: 9305110 - DNA, 22 bp, Homo sapiens
ttatgaaagacatttctgttgg

SEQ ID NO: 9305111 - DNA, 22 bp, Homo sapiens
ttattcagttcccttcactctc

SEQ ID NO: 9305112 - DNA, 22 bp, Homo sapiens
ttattcattaacagggaccaaa

SEQ ID NO: 9305113 - DNA, 22 bp, Homo sapiens
ttattccaatttctcctacaaa

SEQ ID NO: 9305114 - DNA, 22 bp, Homo sapiens
ttattccagctaagagtcctgg

SEQ ID NO: 9305115 - DNA, 22 bp, Homo sapiens
ttattctgagagttgaagtaat

SEQ ID NO: 9305116 - DNA, 21 bp, Homo sapiens
ttattctgagatgagattctt

SEQ ID NO: 9305117 - DNA, 22 bp, Homo sapiens
ttattctgccaggagcgtcagt

SEQ ID NO: 9305118 - DNA, 22 bp, Homo sapiens
ttattctgcacttttaaaatat

SEQ ID NO: 9305119 - DNA, 22 bp, Homo sapiens
ttattcctgccttaggtggctg

SEQ ID NO: 9305120 - DNA, 16 bp, Homo sapiens
ttattccctgcctcaa

SEQ ID NO: 9305121 - DNA, 22 bp, Homo sapiens
ttattctcatctccctacttag

SEQ ID NO: 9305122 - DNA, 22 bp, Homo sapiens
ttattctgaactagactctcat

SEQ ID NO: 9305123 - DNA, 22 bp, Homo sapiens
ttattctgactaatgtataact

SEQ ID NO: 9305124 - DNA, 22 bp, Homo sapiens
ttatttatggccctcacctgat

SEQ ID NO: 9305125 - DNA, 22 bp, Homo sapiens
ttatttatggccctcacctgat

SEQ ID NO: 9305126 - DNA, 22 bp, Homo sapiens
ttatttatggcactgttggtgg

SEQ ID NO: 9305127 - DNA, 22 bp, Homo sapiens
ttatttatggccctcacctgat

SEQ ID NO: 9305128 - DNA, 22 bp, Homo sapiens
ttatttcattgatttctaagac

SEQ ID NO: 9305129 - DNA, 22 bp, Homo sapiens
ttatttatggccctcacctgat

SEQ ID NO: 9305130 - DNA, 20 bp, Homo sapiens
ttatttccagtccaggtcct

SEQ ID NO: 9305131 - DNA, 22 bp, Homo sapiens
ttattctgtcaaacttatacat

SEQ ID NO: 9305132 - DNA, 19 bp, Homo sapiens
ttattctgtcagagcacac

SEQ ID NO: 9305133 - DNA, 22 bp, Homo sapiens
ttattctgtctttggtctcaat

SEQ ID NO: 9305134 - DNA, 22 bp, Homo sapiens
ttattctgtgaacatggttaat

SEQ ID NO: 9305135 - DNA, 22 bp, Homo sapiens
ttattctgtagaacctagtaca

SEQ ID NO: 9305136 - DNA, 17 bp, Homo sapiens
ttattctggcatatgtg

SEQ ID NO: 9305137 - DNA, 22 bp, Homo sapiens
ttattctgtatttcaggtatgt

SEQ ID NO: 9305138 - DNA, 22 bp, Homo sapiens
ttattctggaggaagcaaatgg

SEQ ID NO: 9305139 - DNA, 22 bp, Homo sapiens
ttattctgtttgccgaccagta

SEQ ID NO: 9305140 - DNA, 18 bp, Homo sapiens
ttattcttccaggccacc

SEQ ID NO: 9305141 - DNA, 22 bp, Homo sapiens
ttattcttcttctcttgccagg

SEQ ID NO: 9305142 - DNA, 22 bp, Homo sapiens
ttattctgttgcttttacagta

SEQ ID NO: 9305143 - DNA, 22 bp, Homo sapiens
ttattctgttggccctctcatc

SEQ ID NO: 9305144 - DNA, 22 bp, Homo sapiens
ttattctgttgttcagggttgg

SEQ ID NO: 9305145 - DNA, 22 bp, Homo sapiens
ttacaaagtgctgcaccatttt

SEQ ID NO: 9305146 - DNA, 22 bp, Homo sapiens
ttacaaaggtagttttgtctat

SEQ ID NO: 9305147 - DNA, 22 bp, Homo sapiens
ttacaaagtttaaggtggcact

SEQ ID NO: 9305148 - DNA, 22 bp, Homo sapiens
ttacaaagtgttatgataaaca

SEQ ID NO: 9305149 - DNA, 20 bp, Homo sapiens
ttacaaagaggcatcgcttt

SEQ ID NO: 9305150 - DNA, 20 bp, Homo sapiens
ttacaaagaggcatcgcttt

SEQ ID NO: 9305151 - DNA, 22 bp, Homo sapiens
ttacaaagagaagttgtagaat

SEQ ID NO: 9305152 - DNA, 22 bp, Homo sapiens
ttacaaagaaaattaggcattt

SEQ ID NO: 9305153 - DNA, 22 bp, Homo sapiens
ttacaagacacagtgctgaagg

SEQ ID NO: 9305154 - DNA, 22 bp, Homo sapiens
ttacaactctagagaaaagaaa

SEQ ID NO: 9305155 - DNA, 22 bp, Homo sapiens
ttacaacagacacatattctaa

SEQ ID NO: 9305156 - DNA, 22 bp, Homo sapiens
ttacaacactacttatccttga

SEQ ID NO: 9305157 - DNA, 22 bp, Homo sapiens
ttaataataatgagcccatttt

SEQ ID NO: 9305158 - DNA, 22 bp, Homo sapiens
ttaataagtagtagttattgtt

SEQ ID NO: 9305159 - DNA, 22 bp, Homo sapiens
ttaaagcaaccatcaatttgga

SEQ ID NO: 9305160 - DNA, 22 bp, Homo sapiens
ttaaagatgcagctttagagaa

SEQ ID NO: 9305161 - DNA, 22 bp, Homo sapiens
ttaaagaatagtgcccctattg

SEQ ID NO: 9305162 - DNA, 22 bp, Homo sapiens
ttacacaaaaataagatatggc

SEQ ID NO: 9305163 - DNA, 22 bp, Homo sapiens
ttacacttttgacaaacctgag

SEQ ID NO: 9305164 - DNA, 17 bp, Homo sapiens
ttacagaggtaattaag

SEQ ID NO: 9305165 - DNA, 22 bp, Homo sapiens
ttacagaggtatgtatgtctct

SEQ ID NO: 9305166 - DNA, 22 bp, Homo sapiens
ttacaagacagtgtggtaaata

SEQ ID NO: 9305167 - DNA, 22 bp, Homo sapiens
ttacaagataacctgatgctgt

SEQ ID NO: 9305168 - DNA, 20 bp, Homo sapiens
ttacaaggtagaggagggaa

SEQ ID NO: 9305169 - DNA, 22 bp, Homo sapiens
ttacaattacttgatctcagct

SEQ ID NO: 9305170 - DNA, 22 bp, Homo sapiens
ttacaattgagtctattgtatg

SEQ ID NO: 9305171 - DNA, 22 bp, Homo sapiens
ttacagatgtaggaactgaagt

SEQ ID NO: 9305172 - DNA, 22 bp, Homo sapiens
ttacagatggggttgcaataaa

SEQ ID NO: 9305173 - DNA, 22 bp, Homo sapiens
ttacagatggatctagcaaaat

SEQ ID NO: 9305174 - DNA, 22 bp, Homo sapiens
ttacatgatgatttcataaaca

SEQ ID NO: 9305175 - DNA, 22 bp, Homo sapiens
ttacattaagccaatggattct

SEQ ID NO: 9305176 - DNA, 22 bp, Homo sapiens
tgtgtgtgagtcctggctttcc

SEQ ID NO: 9305177 - DNA, 22 bp, Homo sapiens
tgtgtgtgcacatgcatataca

SEQ ID NO: 9305178 - DNA, 22 bp, Homo sapiens
tgtgtgtgaaccattgagggct

SEQ ID NO: 9305179 - DNA, 22 bp, Homo sapiens
tgtgtgggagcacgggctgttg

SEQ ID NO: 9305180 - DNA, 22 bp, Homo sapiens
tgtgtgtgacaacctagttcag

SEQ ID NO: 9305181 - DNA, 22 bp, Homo sapiens
tgtgtcaattttcattcctact

SEQ ID NO: 9305182 - DNA, 22 bp, Homo sapiens
tgtgtattaccattttacagct

SEQ ID NO: 9305183 - DNA, 22 bp, Homo sapiens
tgtgtattctgaggtaggtata

SEQ ID NO: 9305184 - DNA, 20 bp, Homo sapiens
tgtgtgtgtacttctaaata

SEQ ID NO: 9305185 - DNA, 22 bp, Homo sapiens
tgtgtgtgtcctcatttgcaga

SEQ ID NO: 9305186 - DNA, 22 bp, Homo sapiens
tgtgtgtgtgcgcgcacgcata

SEQ ID NO: 9305187 - DNA, 22 bp, Homo sapiens
tgtgtgtgttcctcctcagcta

SEQ ID NO: 9305188 - DNA, 22 bp, Homo sapiens
tgtgtgtggggaggcagcagat

SEQ ID NO: 9305189 - DNA, 22 bp, Homo sapiens
tgtgtgtgtaaaagcatttata

SEQ ID NO: 9305190 - DNA, 22 bp, Homo sapiens
tgtgtgtgggcggaacggcccc

SEQ ID NO: 9305191 - DNA, 22 bp, Homo sapiens
tgtgtgtgcaggagagcaggtg

SEQ ID NO: 9305192 - DNA, 21 bp, Homo sapiens
tgtgtgtgcaggcacacacac

SEQ ID NO: 9305193 - DNA, 22 bp, Homo sapiens
tgtgtgtgcacgtgcgcgcgag

SEQ ID NO: 9305194 - DNA, 22 bp, Homo sapiens
tgtgtgtgtttctgctcataca

SEQ ID NO: 9305195 - DNA, 22 bp, Homo sapiens
tgtgtgttctcaattattgatg

SEQ ID NO: 9305196 - DNA, 22 bp, Homo sapiens
tgtgtgtgtttacagtttctca

SEQ ID NO: 9305197 - DNA, 22 bp, Homo sapiens
tgtgtgtgtttataaatctaaa

SEQ ID NO: 9305198 - DNA, 19 bp, Homo sapiens
tgtgtgtttatatatgtat

SEQ ID NO: 9305199 - DNA, 22 bp, Homo sapiens
tgtggaatgctcctaagtgaat

SEQ ID NO: 9305200 - DNA, 22 bp, Homo sapiens
tgtggaatttctttcaggtatg

SEQ ID NO: 9305201 - DNA, 22 bp, Homo sapiens
tgtggaatattagattaggttg

SEQ ID NO: 9305202 - DNA, 22 bp, Homo sapiens
tgtggaagggacactggactgg

SEQ ID NO: 9305203 - DNA, 22 bp, Homo sapiens
tgtggctgatcaaagcgctcag

SEQ ID NO: 9305204 - DNA, 22 bp, Homo sapiens
tgtgggagaaggaagcaagctg

SEQ ID NO: 9305205 - DNA, 22 bp, Homo sapiens
tgtgggaggaacacagccagaa

SEQ ID NO: 9305206 - DNA, 22 bp, Homo sapiens
tgtgggaggaattagaatggga

SEQ ID NO: 9305207 - DNA, 22 bp, Homo sapiens
tgtgggctgtactgagggcagg

SEQ ID NO: 9305208 - DNA, 22 bp, Homo sapiens
tgtgggctctaatggcagcaga

SEQ ID NO: 9305209 - DNA, 22 bp, Homo sapiens
tgtgggctccccctcactctgt

SEQ ID NO: 9305210 - DNA, 22 bp, Homo sapiens
tgtgggaggtctggaaggctcc

SEQ ID NO: 9305211 - DNA, 22 bp, Homo sapiens
tgtgggaggtctggaaggctcc

SEQ ID NO: 9305212 - DNA, 22 bp, Homo sapiens
tgtgggaggtctggaaggctcc

SEQ ID NO: 9305213 - DNA, 19 bp, Homo sapiens
tgtgggcaagggatggcag

SEQ ID NO: 9305214 - DNA, 22 bp, Homo sapiens
tgtgggcaaagggtagctgggt

SEQ ID NO: 9305215 - DNA, 22 bp, Homo sapiens
tgtggggacccatgccatgggc

SEQ ID NO: 9305216 - DNA, 22 bp, Homo sapiens
tgtggggacccatgccatgggc

SEQ ID NO: 9305217 - DNA, 22 bp, Homo sapiens
tgtggggactgagtggaggctt

SEQ ID NO: 9305218 - DNA, 22 bp, Homo sapiens
tgtggggactgagtggaggctt

SEQ ID NO: 9305219 - DNA, 22 bp, Homo sapiens
tgttagtattggcaaatttgtt

SEQ ID NO: 9305220 - DNA, 22 bp, Homo sapiens
tgttagcagagcagctgacaga

SEQ ID NO: 9305221 - DNA, 22 bp, Homo sapiens
tgttaaatgttcctttactgga

SEQ ID NO: 9305222 - DNA, 22 bp, Homo sapiens
tgttacattggagttgtttaga

SEQ ID NO: 9305223 - DNA, 22 bp, Homo sapiens
tgttacagtggctttttaaaca

SEQ ID NO: 9305224 - DNA, 22 bp, Homo sapiens
tgttactgatttgatatacagt

SEQ ID NO: 9305225 - DNA, 22 bp, Homo sapiens
tgtttataccttggtataacca

SEQ ID NO: 9305226 - DNA, 22 bp, Homo sapiens
tgtttatgcatcgttaatacca

SEQ ID NO: 9305227 - DNA, 22 bp, Homo sapiens
tgtttattacagttcttggaat

SEQ ID NO: 9305228 - DNA, 22 bp, Homo sapiens
tgtttattcatggctaatgaaa

SEQ ID NO: 9305229 - DNA, 22 bp, Homo sapiens
tgtttattcatggctaatgaaa

SEQ ID NO: 9305230 - DNA, 22 bp, Homo sapiens
tgtttattacagttcttggaat

SEQ ID NO: 9305231 - DNA, 18 bp, Homo sapiens
tgtttattctcctgacag

SEQ ID NO: 9305232 - DNA, 18 bp, Homo sapiens
tgtttattctcctgacag

SEQ ID NO: 9305233 - DNA, 22 bp, Homo sapiens
tgtttattgagtgcctactata

SEQ ID NO: 9305234 - DNA, 22 bp, Homo sapiens
tgtttattgagtgcctactata

SEQ ID NO: 9305235 - DNA, 22 bp, Homo sapiens
tgtttattgcagtgctgggctg

SEQ ID NO: 9305236 - DNA, 22 bp, Homo sapiens
tgtttattgcagtgctgggctg

SEQ ID NO: 9305237 - DNA, 22 bp, Homo sapiens
tgtttattttcaggatggattg

SEQ ID NO: 9305238 - DNA, 22 bp, Homo sapiens
tgtttattttcaggatggattg

SEQ ID NO: 9305239 - DNA, 22 bp, Homo sapiens
tgtttattgctgcaattgtgcc

SEQ ID NO: 9305240 - DNA, 22 bp, Homo sapiens
tgtttattgctgcaattgtgcc

SEQ ID NO: 9305241 - DNA, 21 bp, Homo sapiens
tgttgttttatggctatgaat

SEQ ID NO: 9305242 - DNA, 22 bp, Homo sapiens
tgttgttttctcatggagaata

SEQ ID NO: 9305243 - DNA, 22 bp, Homo sapiens
tgttgtaaaatttgagatgtca

SEQ ID NO: 9305244 - DNA, 22 bp, Homo sapiens
tgtttaaatagaacatactgca

SEQ ID NO: 9305245 - DNA, 22 bp, Homo sapiens
tgttgacaataaagtctaccat

SEQ ID NO: 9305246 - DNA, 22 bp, Homo sapiens
tgttgtaatcattttatgaaaa

SEQ ID NO: 9305247 - DNA, 22 bp, Homo sapiens
tgttttatgagccatataacct

SEQ ID NO: 9305248 - DNA, 22 bp, Homo sapiens
tgtttttgtctccttgtctgct

SEQ ID NO: 9305249 - DNA, 22 bp, Homo sapiens
tgttttaaagccattgcctttc

SEQ ID NO: 9305250 - DNA, 22 bp, Homo sapiens
tgttttaagctctagaagggga

SEQ ID NO: 9305251 - DNA, 22 bp, Homo sapiens
tgttttaagagcgcactttata

SEQ ID NO: 9305252 - DNA, 22 bp, Homo sapiens
tgttttaatctcccattgctct

SEQ ID NO: 9305253 - DNA, 22 bp, Homo sapiens
tgttttaagggtcaactgtcac

SEQ ID NO: 9305254 - DNA, 20 bp, Homo sapiens
tgtttgtgccagctttgtca

SEQ ID NO: 9305255 - DNA, 22 bp, Homo sapiens
tgtttattttcaggatggattg

SEQ ID NO: 9305256 - DNA, 18 bp, Homo sapiens
tgtttatttttctcttac

SEQ ID NO: 9305257 - DNA, 18 bp, Homo sapiens
tgtttatttttctcttac

SEQ ID NO: 9305258 - DNA, 22 bp, Homo sapiens
ttaaaacagcgtgaatctggca

SEQ ID NO: 9305259 - DNA, 22 bp, Homo sapiens
ttaaaactgcaaatcctactga

SEQ ID NO: 9305260 - DNA, 22 bp, Homo sapiens
ttaaaatgcagattatgactca

SEQ ID NO: 9305261 - DNA, 22 bp, Homo sapiens
ttaaaccatagtttaacataag

SEQ ID NO: 9305262 - DNA, 17 bp, Homo sapiens
ttaaaccataaagaagg

SEQ ID NO: 9305263 - DNA, 22 bp, Homo sapiens
ttaaaattatggcccatttgga

SEQ ID NO: 9305264 - DNA, 22 bp, Homo sapiens
tgtctccttgcttttccctgta

SEQ ID NO: 9305265 - DNA, 22 bp, Homo sapiens
tgtctctccacacagccagtgc

SEQ ID NO: 9305266 - DNA, 22 bp, Homo sapiens
tgtctcctgggccctggccctg

SEQ ID NO: 9305267 - DNA, 22 bp, Homo sapiens
tgtctcctcaactcatgctcga

SEQ ID NO: 9305268 - DNA, 22 bp, Homo sapiens
tgtctacacaaatcaaagcttc

SEQ ID NO: 9305269 - DNA, 22 bp, Homo sapiens
tgtctacaaagtccgcagtcat

SEQ ID NO: 9305270 - DNA, 22 bp, Homo sapiens
tgtctacaagccttgttcggca

SEQ ID NO: 9305271 - DNA, 22 bp, Homo sapiens
tgtctacaaacgtgtacacatt

SEQ ID NO: 9305272 - DNA, 22 bp, Homo sapiens
tgtctaatgaattaattaatta

SEQ ID NO: 9305273 - DNA, 22 bp, Homo sapiens
tgtcgtcccgctctaagtggcg

SEQ ID NO: 9305274 - DNA, 22 bp, Homo sapiens
tgtctacagttctgtgtatgag

SEQ ID NO: 9305275 - DNA, 22 bp, Homo sapiens
tgtctacagaatgttaatattt

SEQ ID NO: 9305276 - DNA, 21 bp, Homo sapiens
tgtctacatgttatccctgga

SEQ ID NO: 9305277 - DNA, 19 bp, Homo sapiens
tgtctacataatagattga

SEQ ID NO: 9305278 - DNA, 22 bp, Homo sapiens
tgtctataagagttgtttattt

SEQ ID NO: 9305279 - DNA, 18 bp, Homo sapiens
tgtctctgaattccagtg

SEQ ID NO: 9305280 - DNA, 22 bp, Homo sapiens
tgtctctgagatgactcccacc

SEQ ID NO: 9305281 - DNA, 22 bp, Homo sapiens
tgtctgaaacttatgatatact

SEQ ID NO: 9305282 - DNA, 22 bp, Homo sapiens
tgtctctgctttccttgcaggg

SEQ ID NO: 9305283 - DNA, 22 bp, Homo sapiens
tgtctgcagtgccacagtggga

SEQ ID NO: 9305284 - DNA, 22 bp, Homo sapiens
tgtctgcctgtctctgtgcaaa

SEQ ID NO: 9305285 - DNA, 22 bp, Homo sapiens
tgtctgctcggggttcccacct

SEQ ID NO: 9305286 - DNA, 22 bp, Homo sapiens
tgtctgggatgttggcagccac

SEQ ID NO: 9305287 - DNA, 22 bp, Homo sapiens
tgtctgggagggacagggctac

SEQ ID NO: 9305288 - DNA, 22 bp, Homo sapiens
tgtctgctgccctggagcctgg

SEQ ID NO: 9305289 - DNA, 22 bp, Homo sapiens
tgtctgctggttgggagcttaa

SEQ ID NO: 9305290 - DNA, 22 bp, Homo sapiens
tgtctgctgatgtcacatagcc

SEQ ID NO: 9305291 - DNA, 18 bp, Homo sapiens
tgtctgcttctccaactc

SEQ ID NO: 9305292 - DNA, 22 bp, Homo sapiens
tgtcttttataactgacatata

SEQ ID NO: 9305293 - DNA, 20 bp, Homo sapiens
tgtcttccagcaggtgttta

SEQ ID NO: 9305294 - DNA, 22 bp, Homo sapiens
tgtctttaaaattaaacacatc

SEQ ID NO: 9305295 - DNA, 22 bp, Homo sapiens
tgtgcctgttggtgtagacata

SEQ ID NO: 9305296 - DNA, 22 bp, Homo sapiens
tgtgcctgttcccactttgcct

SEQ ID NO: 9305297 - DNA, 22 bp, Homo sapiens
tgtgcctgtcccgcattctggt

SEQ ID NO: 9305298 - DNA, 22 bp, Homo sapiens
tgtgcctgtgacagcgacctgg

SEQ ID NO: 9305299 - DNA, 22 bp, Homo sapiens
tgtgcctgtcccgcattctggt

SEQ ID NO: 9305300 - DNA, 22 bp, Homo sapiens
tgtgcctgtcaccctcagagag

SEQ ID NO: 9305301 - DNA, 20 bp, Homo sapiens
tgtgcctggctttgtcctga

SEQ ID NO: 9305302 - DNA, 22 bp, Homo sapiens
tgtgcctggtccctgagtcgag

SEQ ID NO: 9305303 - DNA, 22 bp, Homo sapiens
tgtgcctgagttggctgagtac

SEQ ID NO: 9305304 - DNA, 22 bp, Homo sapiens
tgtgcctgagtctcggcccacc

SEQ ID NO: 9305305 - DNA, 22 bp, Homo sapiens
tgtgcctgactaggtgaatcaa

SEQ ID NO: 9305306 - DNA, 22 bp, Homo sapiens
tgtgcctgactaggtgaatcaa

SEQ ID NO: 9305307 - DNA, 22 bp, Homo sapiens
tgtgcctgctagatggttgtcg

SEQ ID NO: 9305308 - DNA, 22 bp, Homo sapiens
tgtgcctgatggtcacgtggcc

SEQ ID NO: 9305309 - DNA, 22 bp, Homo sapiens
tgtgcctggagtccctgaggag

SEQ ID NO: 9305310 - DNA, 22 bp, Homo sapiens
tgtgcctggatctctgtgacaa

SEQ ID NO: 9305311 - DNA, 22 bp, Homo sapiens
tgtgcctggcattctgggcttc

SEQ ID NO: 9305312 - DNA, 22 bp, Homo sapiens
tgtgcctggcccagtggtgtca

SEQ ID NO: 9305313 - DNA, 23 bp, Homo sapiens
tgtgctggcatctcaggctttgg

SEQ ID NO: 9305314 - DNA, 22 bp, Homo sapiens
tgtgctcttgggcaatagctgc

SEQ ID NO: 9305315 - DNA, 22 bp, Homo sapiens
tgtgctcagccaggggcaggcc

SEQ ID NO: 9305316 - DNA, 22 bp, Homo sapiens
tgtgctcagtctttggctggga

SEQ ID NO: 9305317 - DNA, 22 bp, Homo sapiens
tgtgcagagaagccactggggg

SEQ ID NO: 9305318 - DNA, 22 bp, Homo sapiens
tgtgcacataaaacagtactag

SEQ ID NO: 9305319 - DNA, 22 bp, Homo sapiens
tgtgattcaagaaagtaaaatg

SEQ ID NO: 9305320 - DNA, 21 bp, Homo sapiens
tgtgagtccatctgagcagaa

SEQ ID NO: 9305321 - DNA, 22 bp, Homo sapiens
tgtgagtctaggtcagggtgtt

SEQ ID NO: 9305322 - DNA, 22 bp, Homo sapiens
tgtgactggttgtcccgctttc

SEQ ID NO: 9305323 - DNA, 22 bp, Homo sapiens
tgtgacctcatcttaactggaa

SEQ ID NO: 9305324 - DNA, 22 bp, Homo sapiens
tgtgacagttagtttggtgtta

SEQ ID NO: 9305325 - DNA, 22 bp, Homo sapiens
tgtgaatggacaattaaatcta

SEQ ID NO: 9305326 - DNA, 22 bp, Homo sapiens
tgtgaatgtctaggttttatgt

SEQ ID NO: 9305327 - DNA, 22 bp, Homo sapiens
tgtgaatgtatagtttgtatat

SEQ ID NO: 9305328 - DNA, 22 bp, Homo sapiens
tgggccaggggcctcttctgat

SEQ ID NO: 9305329 - DNA, 20 bp, Homo sapiens
tgggcctgagcctgtgggct

SEQ ID NO: 9305330 - DNA, 22 bp, Homo sapiens
tgggcctgagctcaccaggggc

SEQ ID NO: 9305331 - DNA, 22 bp, Homo sapiens
tgggcctgacacttactaggga

SEQ ID NO: 9305332 - DNA, 22 bp, Homo sapiens
tgggcctgaaggagctgcgccc

SEQ ID NO: 9305333 - DNA, 22 bp, Homo sapiens
tgggcctgactcacctgcctcc

SEQ ID NO: 9305334 - DNA, 22 bp, Homo sapiens
tgggcctgatttatcatcttca

SEQ ID NO: 9305335 - DNA, 22 bp, Homo sapiens
tgggcctgattcttgaatcctg

SEQ ID NO: 9305336 - DNA, 22 bp, Homo sapiens
tgggcctgccccaggcttcagc

SEQ ID NO: 9305337 - DNA, 19 bp, Homo sapiens
tgggcctgcatctgggtct

SEQ ID NO: 9305338 - DNA, 18 bp, Homo sapiens
tgggcctgcatcctagtc

SEQ ID NO: 9305339 - DNA, 22 bp, Homo sapiens
tgggcctgctggggcattttca

SEQ ID NO: 9305340 - DNA, 23 bp, Homo sapiens
tgggcctggaaagccttagagag

SEQ ID NO: 9305341 - DNA, 22 bp, Homo sapiens
tgggcctggggcagcccaaatc

SEQ ID NO: 9305342 - DNA, 22 bp, Homo sapiens
tgggcctgggctggacagcctg

SEQ ID NO: 9305343 - DNA, 22 bp, Homo sapiens
tgggcctgggctcctgtcctct

SEQ ID NO: 9305344 - DNA, 22 bp, Homo sapiens
tgggctagcagggaagagagac

SEQ ID NO: 9305345 - DNA, 22 bp, Homo sapiens
tgggctcaatctgcttctgttt

SEQ ID NO: 9305346 - DNA, 22 bp, Homo sapiens
tgggcgaggcccagggctgcgt

SEQ ID NO: 9305347 - DNA, 22 bp, Homo sapiens
tgggcctgttgcctgagtccat

SEQ ID NO: 9305348 - DNA, 22 bp, Homo sapiens
tgggcctgtggcttggctctag

SEQ ID NO: 9305349 - DNA, 22 bp, Homo sapiens
tgggcctgttggggttgagtta

SEQ ID NO: 9305350 - DNA, 22 bp, Homo sapiens
tgggcctgtttcccttcagggc

SEQ ID NO: 9305351 - DNA, 21 bp, Homo sapiens
tgggcctgtccctcttggagg

SEQ ID NO: 9305352 - DNA, 22 bp, Homo sapiens
tgggcctgggtctttgctgcca

SEQ ID NO: 9305353 - DNA, 22 bp, Homo sapiens
tgggcctgggttcctcctgggc

SEQ ID NO: 9305354 - DNA, 22 bp, Homo sapiens
tgggcctgtggcttggctctag

SEQ ID NO: 9305355 - DNA, 22 bp, Homo sapiens
tgggcctgtgatgctgggctat

SEQ ID NO: 9305356 - DNA, 22 bp, Homo sapiens
tgggctgcactccattttctgc

SEQ ID NO: 9305357 - DNA, 22 bp, Homo sapiens
tgggctgcactgctctttatcg

SEQ ID NO: 9305358 - DNA, 22 bp, Homo sapiens
tgggctgccagctctccagatg

SEQ ID NO: 9305359 - DNA, 22 bp, Homo sapiens
tgggctcagtctgcttggtcct

SEQ ID NO: 9305360 - DNA, 22 bp, Homo sapiens
tgggctctcaaagtgcggcttg

SEQ ID NO: 9305361 - DNA, 23 bp, Homo sapiens
tgggatggattcaccagtgtgct

SEQ ID NO: 9305362 - DNA, 22 bp, Homo sapiens
tgggatggcatcctgggccttg

SEQ ID NO: 9305363 - DNA, 22 bp, Homo sapiens
tgggatggagcctgagtatagt

SEQ ID NO: 9305364 - DNA, 23 bp, Homo sapiens
tgggatggattcaccagtgtgct

SEQ ID NO: 9305365 - DNA, 18 bp, Homo sapiens
tgggatggagagtaactg

SEQ ID NO: 9305366 - DNA, 22 bp, Homo sapiens
tgggatgagttgttaggactga

SEQ ID NO: 9305367 - DNA, 22 bp, Homo sapiens
tgggagtcaaccctcacgagca

SEQ ID NO: 9305368 - DNA, 22 bp, Homo sapiens
tgggagtcagtcgttctcagag

SEQ ID NO: 9305369 - DNA, 22 bp, Homo sapiens
tgggagtccaaggcaggcggat

SEQ ID NO: 9305370 - DNA, 22 bp, Homo sapiens
tgggaggtgattaaattatggg

SEQ ID NO: 9305371 - DNA, 22 bp, Homo sapiens
tgggaggtctcttgcggcctag

SEQ ID NO: 9305372 - DNA, 22 bp, Homo sapiens
tgggaggccgaggcaggtggat

SEQ ID NO: 9305373 - DNA, 22 bp, Homo sapiens
tgggaggcttccagaccttgct

SEQ ID NO: 9305374 - DNA, 22 bp, Homo sapiens
tgggaggccaaggcaggcggat

SEQ ID NO: 9305375 - DNA, 22 bp, Homo sapiens
tgggaggcaggtaggtgatgat

SEQ ID NO: 9305376 - DNA, 22 bp, Homo sapiens
tgggaggcccaggcctggcagg

SEQ ID NO: 9305377 - DNA, 22 bp, Homo sapiens
tgggaggccgaggcaggtggat

SEQ ID NO: 9305378 - DNA, 20 bp, Homo sapiens
tgggcaccagatgggatgcc

SEQ ID NO: 9305379 - DNA, 21 bp, Homo sapiens
tgggcaccaaaacctaggagt

SEQ ID NO: 9305380 - DNA, 22 bp, Homo sapiens
tgggcacctgaggcctggcagg

SEQ ID NO: 9305381 - DNA, 21 bp, Homo sapiens
tgggcaagtttgggggtcctc

SEQ ID NO: 9305382 - DNA, 22 bp, Homo sapiens
tgggcaaatgtcactttctttt

SEQ ID NO: 9305383 - DNA, 22 bp, Homo sapiens
tgggcaagcaggagggcctcag

SEQ ID NO: 9305384 - DNA, 21 bp, Homo sapiens
tgggatgggtctgggaccagc

SEQ ID NO: 9305385 - DNA, 22 bp, Homo sapiens
tgggatgtctttaggggaagag

SEQ ID NO: 9305386 - DNA, 21 bp, Homo sapiens
tgggatgggtctgggaccagc

SEQ ID NO: 9305387 - DNA, 22 bp, Homo sapiens
tgggatgggatctcgctgtgtc

SEQ ID NO: 9305388 - DNA, 22 bp, Homo sapiens
tgggatgggatctcgctgtgtc

SEQ ID NO: 9305389 - DNA, 22 bp, Homo sapiens
tgggatggcctttgaaagccag

SEQ ID NO: 9305390 - DNA, 22 bp, Homo sapiens
tgggatggcatcctgggccttg

SEQ ID NO: 9305391 - DNA, 22 bp, Homo sapiens
tgggcagggatctcttttgcaa

SEQ ID NO: 9305392 - DNA, 22 bp, Homo sapiens
tgggcagggagctggaaccaca

SEQ ID NO: 9305393 - DNA, 22 bp, Homo sapiens
tgggcaggggccctgcttccgt

SEQ ID NO: 9305394 - DNA, 21 bp, Homo sapiens
tgggcagatggcagtgtggct

SEQ ID NO: 9305395 - DNA, 22 bp, Homo sapiens
tgggcagatgtggctctccttg

SEQ ID NO: 9305396 - DNA, 22 bp, Homo sapiens
tgggccacgggggtggagagct

SEQ ID NO: 9305397 - DNA, 22 bp, Homo sapiens
tgggccacagagtgagaaatgt

SEQ ID NO: 9305398 - DNA, 19 bp, Homo sapiens
tgggcaggttcagtaatgg

SEQ ID NO: 9305399 - DNA, 22 bp, Homo sapiens
tgggcaggttgttatttgacat

SEQ ID NO: 9305400 - DNA, 22 bp, Homo sapiens
tgggcatggactgtggagccgc

SEQ ID NO: 9305401 - DNA, 20 bp, Homo sapiens
tgggttcaactcctacagtc

SEQ ID NO: 9305402 - DNA, 22 bp, Homo sapiens
tgggttggaagcaggaggcacc

SEQ ID NO: 9305403 - DNA, 22 bp, Homo sapiens
tggtaaaaactgcaattacttt

SEQ ID NO: 9305404 - DNA, 22 bp, Homo sapiens
tggtagtcggcctcggtggctc

SEQ ID NO: 9305405 - DNA, 22 bp, Homo sapiens
tggtattacttctagacacaag

SEQ ID NO: 9305406 - DNA, 23 bp, Homo sapiens
tgggtgctaatctgctctgtgga

SEQ ID NO: 9305407 - DNA, 20 bp, Homo sapiens
tgggtgcctgccacggggcc

SEQ ID NO: 9305408 - DNA, 22 bp, Homo sapiens
tgggtgccaacctctggtggcc

SEQ ID NO: 9305409 - DNA, 22 bp, Homo sapiens
tgggtgctgctttagggggtca

SEQ ID NO: 9305410 - DNA, 22 bp, Homo sapiens
tgggtgctctgcttccctgcac

SEQ ID NO: 9305411 - DNA, 22 bp, Homo sapiens
tgggtgcttcgtcagctctgag

SEQ ID NO: 9305412 - DNA, 22 bp, Homo sapiens
tgggtctgtagggctgtccaat

SEQ ID NO: 9305413 - DNA, 22 bp, Homo sapiens
tgggtgagccacaggagttgtc

SEQ ID NO: 9305414 - DNA, 22 bp, Homo sapiens
tgggtgaggatgatgaggcagc

SEQ ID NO: 9305415 - DNA, 22 bp, Homo sapiens
tgggtgtgagcccgggagccgc

SEQ ID NO: 9305416 - DNA, 22 bp, Homo sapiens
tgggtggtccaggctcagcaga

SEQ ID NO: 9305417 - DNA, 22 bp, Homo sapiens
tgggtgtgaagtctgttggcct

SEQ ID NO: 9305418 - DNA, 22 bp, Homo sapiens
tgggtgggagcgccctgtctgg

SEQ ID NO: 9305419 - DNA, 22 bp, Homo sapiens
tgggtagggacttagctggctg

SEQ ID NO: 9305420 - DNA, 22 bp, Homo sapiens
tgggtagggacttagctggctg

SEQ ID NO: 9305421 - DNA, 22 bp, Homo sapiens
tgggtaggccaggaagcagtgt

SEQ ID NO: 9305422 - DNA, 23 bp, Homo sapiens
tgggtagagctgcaaggacactg

SEQ ID NO: 9305423 - DNA, 22 bp, Homo sapiens
tgggtagagtggagggataaga

SEQ ID NO: 9305424 - DNA, 22 bp, Homo sapiens
tggggtgtgctcagagcagggg

SEQ ID NO: 9305425 - DNA, 23 bp, Homo sapiens
tgggtctctagtacaggcaggca

SEQ ID NO: 9305426 - DNA, 20 bp, Homo sapiens
tgggtctgcttggcttcagt

SEQ ID NO: 9305427 - DNA, 22 bp, Homo sapiens
tgggtgaaaattttggtggcac

SEQ ID NO: 9305428 - DNA, 22 bp, Homo sapiens
tgggtcccaaactcctagaggt

SEQ ID NO: 9305429 - DNA, 22 bp, Homo sapiens
tgggtcccaggaaggaccagca

SEQ ID NO: 9305430 - DNA, 22 bp, Homo sapiens
tggggtggatagaaagtgatgt

SEQ ID NO: 9305431 - DNA, 22 bp, Homo sapiens
tggggtggaacccttctgctgg

SEQ ID NO: 9305432 - DNA, 22 bp, Homo sapiens
tggggtggaacccttctgctgg

SEQ ID NO: 9305433 - DNA, 22 bp, Homo sapiens
tggggtgccgacagggagggca

SEQ ID NO: 9305434 - DNA, 22 bp, Homo sapiens
tggggtggtgggaaccaagtag

SEQ ID NO: 9305435 - DNA, 22 bp, Homo sapiens
tggggtggtaatacaccgttct

SEQ ID NO: 9305436 - DNA, 22 bp, Homo sapiens
tggggtggggttactcattctg

SEQ ID NO: 9305437 - DNA, 22 bp, Homo sapiens
tggggtgggcatgcgctgtcct

SEQ ID NO: 9305438 - DNA, 22 bp, Homo sapiens
tggggtgggcatgcgctgtcct

SEQ ID NO: 9305439 - DNA, 22 bp, Homo sapiens
tggggtggggttactcattctg

SEQ ID NO: 9305440 - DNA, 22 bp, Homo sapiens
tggggtgggcatgcgctgtcct

SEQ ID NO: 9305441 - DNA, 20 bp, Homo sapiens
tggggtctagttggcctggg

SEQ ID NO: 9305442 - DNA, 22 bp, Homo sapiens
tgggggtgctgagaagacagga

SEQ ID NO: 9305443 - DNA, 22 bp, Homo sapiens
tgggggtgccctatgaggaagc

SEQ ID NO: 9305444 - DNA, 22 bp, Homo sapiens
tgggggctgtgcacaggctcac

SEQ ID NO: 9305445 - DNA, 22 bp, Homo sapiens
tgggggctgtgcacaggctcac

SEQ ID NO: 9305446 - DNA, 22 bp, Homo sapiens
tgggggtcctcctctgcttaag

SEQ ID NO: 9305447 - DNA, 22 bp, Homo sapiens
tgggggtgaaagtctggacagt

SEQ ID NO: 9305448 - DNA, 22 bp, Homo sapiens
tgggggtgactatctcgggaat

SEQ ID NO: 9305449 - DNA, 22 bp, Homo sapiens
tgggggagccttcacagtagct

SEQ ID NO: 9305450 - DNA, 22 bp, Homo sapiens
tgggggcacttcgaggtcgcct

SEQ ID NO: 9305451 - DNA, 22 bp, Homo sapiens
tgggggctccaggctccaggga

SEQ ID NO: 9305452 - DNA, 22 bp, Homo sapiens
tgggggctgggatgtcactttc

SEQ ID NO: 9305453 - DNA, 22 bp, Homo sapiens
tgggggcagccaggctgtcaag

SEQ ID NO: 9305454 - DNA, 22 bp, Homo sapiens
tgggggcatggaccagcctggc

SEQ ID NO: 9305455 - DNA, 22 bp, Homo sapiens
tgggggcagccaggctgtcaag

SEQ ID NO: 9305456 - DNA, 22 bp, Homo sapiens
tgggggcagaggattcaggaat

SEQ ID NO: 9305457 - DNA, 22 bp, Homo sapiens
tggggctggctattgtctccct

SEQ ID NO: 9305458 - DNA, 22 bp, Homo sapiens
tggggctggcacagtctctatt

SEQ ID NO: 9305459 - DNA, 22 bp, Homo sapiens
tgggggagagtgcaagcatgaa

SEQ ID NO: 9305460 - DNA, 22 bp, Homo sapiens
tgggggagagtttagatgattt

SEQ ID NO: 9305461 - DNA, 22 bp, Homo sapiens
tggggcctgcacaggctgaatg

SEQ ID NO: 9305462 - DNA, 23 bp, Homo sapiens
tggggctgatggagacggaccag

SEQ ID NO: 9305463 - DNA, 23 bp, Homo sapiens
tggggctgatggagacggaccag

SEQ ID NO: 9305464 - DNA, 22 bp, Homo sapiens
tggggctgaggagcctcactct

SEQ ID NO: 9305465 - DNA, 23 bp, Homo sapiens
tggggctctggcaggcctgaggt

SEQ ID NO: 9305466 - DNA, 22 bp, Homo sapiens
tggggaggtaacaatttcaggc

SEQ ID NO: 9305467 - DNA, 21 bp, Homo sapiens
tggggaggggacctgattatg

SEQ ID NO: 9305468 - DNA, 22 bp, Homo sapiens
tggggatgaaacccaggcatct

SEQ ID NO: 9305469 - DNA, 20 bp, Homo sapiens
tggggagttgagcacgagca

SEQ ID NO: 9305470 - DNA, 22 bp, Homo sapiens
tggggagtcgctgcagagcgat

SEQ ID NO: 9305471 - DNA, 22 bp, Homo sapiens
tggggagtgatgcctcggataa

SEQ ID NO: 9305472 - DNA, 23 bp, Homo sapiens
tgggcttctgagaaagcacctaa

SEQ ID NO: 9305473 - DNA, 22 bp, Homo sapiens
tggggaagggcaccctggagac

SEQ ID NO: 9305474 - DNA, 16 bp, Homo sapiens
tggggaagctcgtgag

SEQ ID NO: 9305475 - DNA, 17 bp, Homo sapiens
tggggaagctcagattt

SEQ ID NO: 9305476 - DNA, 22 bp, Homo sapiens
tggggaaggcggagcttgcagc

SEQ ID NO: 9305477 - DNA, 22 bp, Homo sapiens
tggggaaggatcaccacaatct

SEQ ID NO: 9305478 - DNA, 22 bp, Homo sapiens
tggggaaactatttccttgtcc

SEQ ID NO: 9305479 - DNA, 22 bp, Homo sapiens
tggggaaagggatggctcccgc

SEQ ID NO: 9305480 - DNA, 20 bp, Homo sapiens
tggggaaagccatcgatgag

SEQ ID NO: 9305481 - DNA, 22 bp, Homo sapiens
tggggaagacagcagacactgt

SEQ ID NO: 9305482 - DNA, 22 bp, Homo sapiens
tggggaagcactttgaacttaa

SEQ ID NO: 9305483 - DNA, 22 bp, Homo sapiens
tggggaagaataatgtatgtac

SEQ ID NO: 9305484 - DNA, 22 bp, Homo sapiens
tgtacacattaagctctttaga

SEQ ID NO: 9305485 - DNA, 22 bp, Homo sapiens
tgtacacatttattctctctca

SEQ ID NO: 9305486 - DNA, 22 bp, Homo sapiens
tgtacaatagctattatctcca

SEQ ID NO: 9305487 - DNA, 22 bp, Homo sapiens
tgtacaatagctattatctcca

SEQ ID NO: 9305488 - DNA, 22 bp, Homo sapiens
tgtacaatcttggtccctttat

SEQ ID NO: 9305489 - DNA, 22 bp, Homo sapiens
tgtacaatctgatgatgtatgg

SEQ ID NO: 9305490 - DNA, 22 bp, Homo sapiens
tgtacaatctgatgatgtatgg

SEQ ID NO: 9305491 - DNA, 22 bp, Homo sapiens
tgtacaatgtggccagtgttaa

SEQ ID NO: 9305492 - DNA, 22 bp, Homo sapiens
tgtacaatgtggccagtgttaa

SEQ ID NO: 9305493 - DNA, 22 bp, Homo sapiens
tgtacaatgtgtttgttggctt

SEQ ID NO: 9305494 - DNA, 22 bp, Homo sapiens
tgtacaatgtgtttgttggctt

SEQ ID NO: 9305495 - DNA, 22 bp, Homo sapiens
tgtacaatggctataataccct

SEQ ID NO: 9305496 - DNA, 22 bp, Homo sapiens
tgtacaatggctataataccct

SEQ ID NO: 9305497 - DNA, 22 bp, Homo sapiens
tgtacaatgctgaggtttgggg

SEQ ID NO: 9305498 - DNA, 22 bp, Homo sapiens
tgtacaatgctgaggtttgggg

SEQ ID NO: 9305499 - DNA, 22 bp, Homo sapiens
tgtacaatgccgagactaactc

SEQ ID NO: 9305500 - DNA, 22 bp, Homo sapiens
tgtacaatgccgagactaactc

SEQ ID NO: 9305501 - DNA, 22 bp, Homo sapiens
tgtacaatgccagggaacacca

SEQ ID NO: 9305502 - DNA, 22 bp, Homo sapiens
tgtacaatcttggtccctttat

SEQ ID NO: 9305503 - DNA, 22 bp, Homo sapiens
tgtacaatgccagggaacacca

SEQ ID NO: 9305504 - DNA, 22 bp, Homo sapiens
tgtacaatgccagggaacacca

SEQ ID NO: 9305505 - DNA, 22 bp, Homo sapiens
tgtaactggttataatttttga

SEQ ID NO: 9305506 - DNA, 22 bp, Homo sapiens
tgtaagaataatgatttctaag

SEQ ID NO: 9305507 - DNA, 22 bp, Homo sapiens
tgtacaaagttaaacctatata

SEQ ID NO: 9305508 - DNA, 22 bp, Homo sapiens
tgtacaaagagtatagctttga

SEQ ID NO: 9305509 - DNA, 22 bp, Homo sapiens
tgtaacaatttcttactattgt

SEQ ID NO: 9305510 - DNA, 22 bp, Homo sapiens
tgtaaatggtcagataaaccta

SEQ ID NO: 9305511 - DNA, 22 bp, Homo sapiens
tgtaacaaaataccttggattg

SEQ ID NO: 9305512 - DNA, 22 bp, Homo sapiens
tggtgtgggcgtggcaggcaag

SEQ ID NO: 9305513 - DNA, 22 bp, Homo sapiens
tggtgtgggcagcagcaggtac

SEQ ID NO: 9305514 - DNA, 22 bp, Homo sapiens
tggtgtggtccagtgacatact

SEQ ID NO: 9305515 - DNA, 22 bp, Homo sapiens
tggtgtggggataagcactctg

SEQ ID NO: 9305516 - DNA, 22 bp, Homo sapiens
tggtggtcaaagccagtgttct

SEQ ID NO: 9305517 - DNA, 23 bp, Homo sapiens
tggtggtcagccctttctggagg

SEQ ID NO: 9305518 - DNA, 22 bp, Homo sapiens
tggtggtcatagcagaggccgt

SEQ ID NO: 9305519 - DNA, 22 bp, Homo sapiens
tggtggtccacaaatgggtaca

SEQ ID NO: 9305520 - DNA, 22 bp, Homo sapiens
tggtggtctggctttatatcct

SEQ ID NO: 9305521 - DNA, 22 bp, Homo sapiens
tggtttatgctgttgcagctct

SEQ ID NO: 9305522 - DNA, 22 bp, Homo sapiens
tggtttacccctgtcctatatc

SEQ ID NO: 9305523 - DNA, 22 bp, Homo sapiens
tggttaaatgggaagagcaaca

SEQ ID NO: 9305524 - DNA, 22 bp, Homo sapiens
tggttggggtctgcagccatcc

SEQ ID NO: 9305525 - DNA, 22 bp, Homo sapiens
tggttggctgagcagagtcact

SEQ ID NO: 9305526 - DNA, 22 bp, Homo sapiens
tggtttgggtagttattattat

SEQ ID NO: 9305527 - DNA, 22 bp, Homo sapiens
tgtaaaacaaaatttgtggaga

SEQ ID NO: 9305528 - DNA, 22 bp, Homo sapiens
tgtaaaaccaaatcaatctagt

SEQ ID NO: 9305529 - DNA, 22 bp, Homo sapiens
tgtaaaaccaaatcaatctagt

SEQ ID NO: 9305530 - DNA, 20 bp, Homo sapiens
tgtaaaacaaggtgaatcct

SEQ ID NO: 9305531 - DNA, 17 bp, Homo sapiens
tgtaaaacccagaggtc

SEQ ID NO: 9305532 - DNA, 22 bp, Homo sapiens
tgtaaagctttgagtgtttatc

SEQ ID NO: 9305533 - DNA, 22 bp, Homo sapiens
tgtaaagcatctctgtcatata

SEQ ID NO: 9305534 - DNA, 22 bp, Homo sapiens
tgtaaagcaactgatctgctcc

SEQ ID NO: 9305535 - DNA, 18 bp, Homo sapiens
tgtaaacactttcattct

SEQ ID NO: 9305536 - DNA, 18 bp, Homo sapiens
tgtaaacactttcattct

SEQ ID NO: 9305537 - DNA, 22 bp, Homo sapiens
tgtaaacaaatgcattcttgct

SEQ ID NO: 9305538 - DNA, 22 bp, Homo sapiens
tgtaaacaaatgcattcttgct

SEQ ID NO: 9305539 - DNA, 20 bp, Homo sapiens
tgtaaacaatagtgttcttg

SEQ ID NO: 9305540 - DNA, 20 bp, Homo sapiens
tgtaaacaatagtgttcttg

SEQ ID NO: 9305541 - DNA, 22 bp, Homo sapiens
tggtggcaaaagaggcaaagtg

SEQ ID NO: 9305542 - DNA, 22 bp, Homo sapiens
tggtggcagtgagaaggagagg

SEQ ID NO: 9305543 - DNA, 22 bp, Homo sapiens
tggtggcagagcaagagctgga

SEQ ID NO: 9305544 - DNA, 22 bp, Homo sapiens
tggtggcaattcaaagacagca

SEQ ID NO: 9305545 - DNA, 16 bp, Homo sapiens
tggtggggaggacagc

SEQ ID NO: 9305546 - DNA, 22 bp, Homo sapiens
tggtgggagtccgctgtgctgc

SEQ ID NO: 9305547 - DNA, 22 bp, Homo sapiens
tggtgggagtgagggcatgcca

SEQ ID NO: 9305548 - DNA, 22 bp, Homo sapiens
tggtgggagtccgctgtgctgc

SEQ ID NO: 9305549 - DNA, 22 bp, Homo sapiens
tggtggggccagacttcagctc

SEQ ID NO: 9305550 - DNA, 22 bp, Homo sapiens
tggtgggggaggctgtctagca

SEQ ID NO: 9305551 - DNA, 22 bp, Homo sapiens
tggtggggctttccttctgctt

SEQ ID NO: 9305552 - DNA, 22 bp, Homo sapiens
tggtgaggtcatagagaactgt

SEQ ID NO: 9305553 - DNA, 22 bp, Homo sapiens
tggtgaggccaaagccatgaca

SEQ ID NO: 9305554 - DNA, 22 bp, Homo sapiens
tggtgaggccaaagccatgaca

SEQ ID NO: 9305555 - DNA, 17 bp, Homo sapiens
tggtccaggtggagcca

SEQ ID NO: 9305556 - DNA, 22 bp, Homo sapiens
tggtcctcaggttctctgtgcg

SEQ ID NO: 9305557 - DNA, 20 bp, Homo sapiens
tggtccaggacctggtgtcc

SEQ ID NO: 9305558 - DNA, 22 bp, Homo sapiens
tggtccagcttgattctcttct

SEQ ID NO: 9305559 - DNA, 22 bp, Homo sapiens
tggtccaggcacccttctagag

SEQ ID NO: 9305560 - DNA, 22 bp, Homo sapiens
tggtccaggcacccttctagag

SEQ ID NO: 9305561 - DNA, 22 bp, Homo sapiens
tggtccagggtgtagtacagag

SEQ ID NO: 9305562 - DNA, 22 bp, Homo sapiens
tggtccagacatttctgaggta

SEQ ID NO: 9305563 - DNA, 22 bp, Homo sapiens
tggtccagactttgacctctca

SEQ ID NO: 9305564 - DNA, 19 bp, Homo sapiens
tggtccagcttcttctcct

SEQ ID NO: 9305565 - DNA, 22 bp, Homo sapiens
tggtccagatgccttggcttta

SEQ ID NO: 9305566 - DNA, 22 bp, Homo sapiens
tggtccagaagatattcaacca

SEQ ID NO: 9305567 - DNA, 22 bp, Homo sapiens
tgtccccagcactcactctcca

SEQ ID NO: 9305568 - DNA, 22 bp, Homo sapiens
tgtccccagagcctgttcctgc

SEQ ID NO: 9305569 - DNA, 20 bp, Homo sapiens
tgtccccacccaaatctcat

SEQ ID NO: 9305570 - DNA, 22 bp, Homo sapiens
tgtccccacctaaatcttatct

SEQ ID NO: 9305571 - DNA, 20 bp, Homo sapiens
tgtccccaccaaaatttcat

SEQ ID NO: 9305572 - DNA, 22 bp, Homo sapiens
tgtccccaaggttcagcccaca

SEQ ID NO: 9305573 - DNA, 22 bp, Homo sapiens
tgtccccaggtcctctgccgtc

SEQ ID NO: 9305574 - DNA, 22 bp, Homo sapiens
tgtccccattctaagaggtggc

SEQ ID NO: 9305575 - DNA, 22 bp, Homo sapiens
tgtccccacccaaatctcatct

SEQ ID NO: 9305576 - DNA, 18 bp, Homo sapiens
tgtccctgcaaataacat

SEQ ID NO: 9305577 - DNA, 22 bp, Homo sapiens
tgtccctggaactatggctcca

SEQ ID NO: 9305578 - DNA, 22 bp, Homo sapiens
tgtccctgctgtacttagagca

SEQ ID NO: 9305579 - DNA, 22 bp, Homo sapiens
tgtccctggtggaggctggcag

SEQ ID NO: 9305580 - DNA, 22 bp, Homo sapiens
tgtccaggtggcctctgctgct

SEQ ID NO: 9305581 - DNA, 20 bp, Homo sapiens
tgtccaggggatcgttggcc

SEQ ID NO: 9305582 - DNA, 22 bp, Homo sapiens
tgtccaggcactgggactctag

SEQ ID NO: 9305583 - DNA, 22 bp, Homo sapiens
tgtcctagagtacattccactg

SEQ ID NO: 9305584 - DNA, 22 bp, Homo sapiens
tgtcctggccaaggccttgctt

SEQ ID NO: 9305585 - DNA, 22 bp, Homo sapiens
tgtcctggccaaggccttgctt

SEQ ID NO: 9305586 - DNA, 22 bp, Homo sapiens
tgtcctagatccagctgtgctg

SEQ ID NO: 9305587 - DNA, 22 bp, Homo sapiens
tgtcctcaaggagcttcagtct

SEQ ID NO: 9305588 - DNA, 22 bp, Homo sapiens
tgtcctgggaaatcccttaggc

SEQ ID NO: 9305589 - DNA, 22 bp, Homo sapiens
tgtcctgttcatggctctggac

SEQ ID NO: 9305590 - DNA, 22 bp, Homo sapiens
tgtcctgttcttgctgtgtcct

SEQ ID NO: 9305591 - DNA, 22 bp, Homo sapiens
tgtcctggtgctccaggtggct

SEQ ID NO: 9305592 - DNA, 21 bp, Homo sapiens
tgtcctggtcactgctctccc

SEQ ID NO: 9305593 - DNA, 22 bp, Homo sapiens
tgtcatgaccatgataactaag

SEQ ID NO: 9305594 - DNA, 22 bp, Homo sapiens
tgtccagatcaatgcccacatg

SEQ ID NO: 9305595 - DNA, 22 bp, Homo sapiens
tgtccagagtcacagagctcaa

SEQ ID NO: 9305596 - DNA, 22 bp, Homo sapiens
tgtagaggaggaaactgaggct

SEQ ID NO: 9305597 - DNA, 22 bp, Homo sapiens
tgtagatatagaaaaagactga

SEQ ID NO: 9305598 - DNA, 22 bp, Homo sapiens
tgtagcacaagatagatacttc

SEQ ID NO: 9305599 - DNA, 22 bp, Homo sapiens
tgtagcacactcataatctttc

SEQ ID NO: 9305600 - DNA, 22 bp, Homo sapiens
tgtagcacactcaggggtagca

SEQ ID NO: 9305601 - DNA, 22 bp, Homo sapiens
tgtagcacagctgctctctact

SEQ ID NO: 9305602 - DNA, 22 bp, Homo sapiens
tgtagcacagggttgggggaga

SEQ ID NO: 9305603 - DNA, 22 bp, Homo sapiens
tgtagcacatgcattagagtgt

SEQ ID NO: 9305604 - DNA, 22 bp, Homo sapiens
tgtagcacagagctttgacact

SEQ ID NO: 9305605 - DNA, 22 bp, Homo sapiens
tgtagcacaaacacagtccagg

SEQ ID NO: 9305606 - DNA, 22 bp, Homo sapiens
tgtagcacaaaaaggatcttgg

SEQ ID NO: 9305607 - DNA, 22 bp, Homo sapiens
tgtagcacctagcagaaactct

SEQ ID NO: 9305608 - DNA, 22 bp, Homo sapiens
tgtagcaccatctcctccttcc

SEQ ID NO: 9305609 - DNA, 22 bp, Homo sapiens
tgtagcaccaacctgccttttt

SEQ ID NO: 9305610 - DNA, 22 bp, Homo sapiens
tgtagcaccagtcaccagccca

SEQ ID NO: 9305611 - DNA, 22 bp, Homo sapiens
tgtagcactatttggtcattga

SEQ ID NO: 9305612 - DNA, 22 bp, Homo sapiens
tgtagcactcatcaactatgtt

SEQ ID NO: 9305613 - DNA, 22 bp, Homo sapiens
tgtagcactgggttagaaatca

SEQ ID NO: 9305614 - DNA, 22 bp, Homo sapiens
tgtagcactatgcactacacat

SEQ ID NO: 9305615 - DNA, 22 bp, Homo sapiens
tgtagcacgttagtgttagagc

SEQ ID NO: 9305616 - DNA, 22 bp, Homo sapiens
tgtagctctccagccagcaagg

SEQ ID NO: 9305617 - DNA, 23 bp, Homo sapiens
tgtagctgtctgagcagacactg

SEQ ID NO: 9305618 - DNA, 18 bp, Homo sapiens
tgtagctggaggccaggc

SEQ ID NO: 9305619 - DNA, 22 bp, Homo sapiens
tgtagcattttatgtaataagt

SEQ ID NO: 9305620 - DNA, 18 bp, Homo sapiens
tgtagaaaagataggaat

SEQ ID NO: 9305621 - DNA, 22 bp, Homo sapiens
tgtagaaactacacatgcaaca

SEQ ID NO: 9305622 - DNA, 22 bp, Homo sapiens
tgtagaaactacacatgcaaca

SEQ ID NO: 9305623 - DNA, 22 bp, Homo sapiens
tgtagaaagctcttctgaaatc

SEQ ID NO: 9305624 - DNA, 22 bp, Homo sapiens
tgtagaaattagtaagatcaac

SEQ ID NO: 9305625 - DNA, 22 bp, Homo sapiens
tgtatatatttctttcattcta

SEQ ID NO: 9305626 - DNA, 22 bp, Homo sapiens
tgtatacaggattactcatagc

SEQ ID NO: 9305627 - DNA, 22 bp, Homo sapiens
tgtatacatacatatgtgtgtg

SEQ ID NO: 9305628 - DNA, 22 bp, Homo sapiens
tgtatagactagctttcacgat

SEQ ID NO: 9305629 - DNA, 22 bp, Homo sapiens
tgtcacaaacatacattataga

SEQ ID NO: 9305630 - DNA, 23 bp, Homo sapiens
tgtcacatttagttggcattgtt

SEQ ID NO: 9305631 - DNA, 22 bp, Homo sapiens
tgtcacatgacacaaatatcta

SEQ ID NO: 9305632 - DNA, 22 bp, Homo sapiens
tgtcacataggcaaaatgtttt

SEQ ID NO: 9305633 - DNA, 22 bp, Homo sapiens
tgtcacagggataccatggggc

SEQ ID NO: 9305634 - DNA, 20 bp, Homo sapiens
tgtattcttctccttcctcc

SEQ ID NO: 9305635 - DNA, 22 bp, Homo sapiens
tgtatttaattgtatcatcaca

SEQ ID NO: 9305636 - DNA, 22 bp, Homo sapiens
tgtatttaattgtatcatcaca

SEQ ID NO: 9305637 - DNA, 20 bp, Homo sapiens
tgtattctttgctctccact

SEQ ID NO: 9305638 - DNA, 22 bp, Homo sapiens
tgtatttattcaggatgtaact

SEQ ID NO: 9305639 - DNA, 17 bp, Homo sapiens
tgtatttatcatgtcag

SEQ ID NO: 9305640 - DNA, 22 bp, Homo sapiens
tgggaggaatgtcactgagcca

SEQ ID NO: 9305641 - DNA, 22 bp, Homo sapiens
tgggaggaatgtcactgagcca

SEQ ID NO: 9305642 - DNA, 22 bp, Homo sapiens
tgggaggacttgtgggcttcat

SEQ ID NO: 9305643 - DNA, 22 bp, Homo sapiens
tgggaggatcgcttgagcccag

SEQ ID NO: 9305644 - DNA, 22 bp, Homo sapiens
tgggaggatctcttgaggccag

SEQ ID NO: 9305645 - DNA, 22 bp, Homo sapiens
tgggaggcagaagttgactgga

SEQ ID NO: 9305646 - DNA, 22 bp, Homo sapiens
tgggaggatcgcttgagcccag

SEQ ID NO: 9305647 - DNA, 22 bp, Homo sapiens
tgggagcagctttgcgagggag

SEQ ID NO: 9305648 - DNA, 22 bp, Homo sapiens
tgggagcaccctgaggagcttc

SEQ ID NO: 9305649 - DNA, 22 bp, Homo sapiens
tgggagcaccttgagggcagaa

SEQ ID NO: 9305650 - DNA, 22 bp, Homo sapiens
tgggagaaactgtctctcccac

SEQ ID NO: 9305651 - DNA, 22 bp, Homo sapiens
tgggagaacactgctctggatg

SEQ ID NO: 9305652 - DNA, 22 bp, Homo sapiens
tgggagaacactgctctggatg

SEQ ID NO: 9305653 - DNA, 22 bp, Homo sapiens
tgggagaacccagggtcaggct

SEQ ID NO: 9305654 - DNA, 20 bp, Homo sapiens
tgggagaagaacactggaac

SEQ ID NO: 9305655 - DNA, 22 bp, Homo sapiens
tgggagaagacgtactttagac

SEQ ID NO: 9305656 - DNA, 22 bp, Homo sapiens
tgggagaagcagtgggacagta

SEQ ID NO: 9305657 - DNA, 22 bp, Homo sapiens
tgggagaacccagggtcaggct

SEQ ID NO: 9305658 - DNA, 22 bp, Homo sapiens
tgggagaagcagtgggacagta

SEQ ID NO: 9305659 - DNA, 22 bp, Homo sapiens
tgggagaatcttgctctgctac

SEQ ID NO: 9305660 - DNA, 22 bp, Homo sapiens
tgggagaagcatggggtgcaga

SEQ ID NO: 9305661 - DNA, 22 bp, Homo sapiens
tgggagcaaatgactgggagat

SEQ ID NO: 9305662 - DNA, 22 bp, Homo sapiens
tgggagcaagctacttagggaa

SEQ ID NO: 9305663 - DNA, 22 bp, Homo sapiens
tgggagatattgctgtggctgt

SEQ ID NO: 9305664 - DNA, 22 bp, Homo sapiens
tgggaaggtacacgggaaagag

SEQ ID NO: 9305665 - DNA, 22 bp, Homo sapiens
tgggaaggtgtagaaagaacaa

SEQ ID NO: 9305666 - DNA, 22 bp, Homo sapiens
tgggaaggggagctggaaagga

SEQ ID NO: 9305667 - DNA, 22 bp, Homo sapiens
tgggaagggtcaacagctggaa

SEQ ID NO: 9305668 - DNA, 22 bp, Homo sapiens
tgggaagggccgatggagcctc

SEQ ID NO: 9305669 - DNA, 22 bp, Homo sapiens
tgggaagggagtttcttggagt

SEQ ID NO: 9305670 - DNA, 22 bp, Homo sapiens
tgggacaggttggagagaagca

SEQ ID NO: 9305671 - DNA, 22 bp, Homo sapiens
tgggaatgggcctagaaggctg

SEQ ID NO: 9305672 - DNA, 22 bp, Homo sapiens
tgggaactctctgggaggcatc

SEQ ID NO: 9305673 - DNA, 22 bp, Homo sapiens
tgggaaagtgttgaggtgtctt

SEQ ID NO: 9305674 - DNA, 22 bp, Homo sapiens
tggctttttctcagctctggct

SEQ ID NO: 9305675 - DNA, 22 bp, Homo sapiens
tggcttttgttggtaccacctt

SEQ ID NO: 9305676 - DNA, 22 bp, Homo sapiens
tgggaaagactcaggacaggag

SEQ ID NO: 9305677 - DNA, 21 bp, Homo sapiens
tggcttttatggagctctggg

SEQ ID NO: 9305678 - DNA, 22 bp, Homo sapiens
tggcttttgaaaaggtgatgta

SEQ ID NO: 9305679 - DNA, 22 bp, Homo sapiens
tggcttttgcctttcaaattgg

SEQ ID NO: 9305680 - DNA, 17 bp, Homo sapiens
tggctttcctgacacag

SEQ ID NO: 9305681 - DNA, 22 bp, Homo sapiens
tggctttctcacagaccacctc

SEQ ID NO: 9305682 - DNA, 22 bp, Homo sapiens
tggctttcgctatagagcacgg

SEQ ID NO: 9305683 - DNA, 22 bp, Homo sapiens
tggctttatccatcatcgccaa

SEQ ID NO: 9305684 - DNA, 22 bp, Homo sapiens
tggctttcccccagcccagttg

SEQ ID NO: 9305685 - DNA, 23 bp, Homo sapiens
tggctttattcacatatctgacc

SEQ ID NO: 9305686 - DNA, 22 bp, Homo sapiens
tggctttatacctttgccttgg

SEQ ID NO: 9305687 - DNA, 22 bp, Homo sapiens
tggcttcctgcatggatcctct

SEQ ID NO: 9305688 - DNA, 22 bp, Homo sapiens
tggcttcctgcacagtgtctgc

SEQ ID NO: 9305689 - DNA, 19 bp, Homo sapiens
tggcttcctgactctcatc

SEQ ID NO: 9305690 - DNA, 22 bp, Homo sapiens
tggcttcaggagcacctggctt

SEQ ID NO: 9305691 - DNA, 18 bp, Homo sapiens
tggcttcagagtaaaatg

SEQ ID NO: 9305692 - DNA, 22 bp, Homo sapiens
tggcttcagagtctgagttctt

SEQ ID NO: 9305693 - DNA, 22 bp, Homo sapiens
tggcttcagatctgccccggag

SEQ ID NO: 9305694 - DNA, 21 bp, Homo sapiens
tggcttcagccattttctctg

SEQ ID NO: 9305695 - DNA, 17 bp, Homo sapiens
tggcttcagatgtacat

SEQ ID NO: 9305696 - DNA, 22 bp, Homo sapiens
tggcttcaggagcacctggctt

SEQ ID NO: 9305697 - DNA, 22 bp, Homo sapiens
tggcttcaggagcacctggctt

SEQ ID NO: 9305698 - DNA, 22 bp, Homo sapiens
tggcttcacctcagcatgaagg

SEQ ID NO: 9305699 - DNA, 22 bp, Homo sapiens
tggcttcactgctcaagtgatt

SEQ ID NO: 9305700 - DNA, 22 bp, Homo sapiens
tggcttcactgctcaagtgatt

SEQ ID NO: 9305701 - DNA, 22 bp, Homo sapiens
tggcttcagagacagaatctat

SEQ ID NO: 9305702 - DNA, 22 bp, Homo sapiens
tggcttcagacttctgctacgt

SEQ ID NO: 9305703 - DNA, 22 bp, Homo sapiens
tggcttcagacttctgctacgt

SEQ ID NO: 9305704 - DNA, 22 bp, Homo sapiens
tggcttcctgtttcccagaaag

SEQ ID NO: 9305705 - DNA, 22 bp, Homo sapiens
tggcttctagagcccatccttc

SEQ ID NO: 9305706 - DNA, 18 bp, Homo sapiens
tggcttcctgcgggctgc

SEQ ID NO: 9305707 - DNA, 22 bp, Homo sapiens
tggcttcctgtgtaatgaggtg

SEQ ID NO: 9305708 - DNA, 22 bp, Homo sapiens
tggcttctcaaaataactggtt

SEQ ID NO: 9305709 - DNA, 22 bp, Homo sapiens
tggcttctattgctgtggcatt

SEQ ID NO: 9305710 - DNA, 18 bp, Homo sapiens
tggcttctattttactca

SEQ ID NO: 9305711 - DNA, 22 bp, Homo sapiens
tggcttctgggatgtgttgaca

SEQ ID NO: 9305712 - DNA, 22 bp, Homo sapiens
tggcttctggggtggcctgcat

SEQ ID NO: 9305713 - DNA, 22 bp, Homo sapiens
tggcttctcccgacaccctggc

SEQ ID NO: 9305714 - DNA, 22 bp, Homo sapiens
tggcttctgagtctcctgacat

SEQ ID NO: 9305715 - DNA, 20 bp, Homo sapiens
tggcttctcttcactcctgt

SEQ ID NO: 9305716 - DNA, 22 bp, Homo sapiens
tggctgggtgctatccagtact

SEQ ID NO: 9305717 - DNA, 22 bp, Homo sapiens
tggctgggtgctatccagtact

SEQ ID NO: 9305718 - DNA, 22 bp, Homo sapiens
tggctgggtgctatccagtact

SEQ ID NO: 9305719 - DNA, 22 bp, Homo sapiens
tggctggttttggtgagctccg

SEQ ID NO: 9305720 - DNA, 19 bp, Homo sapiens
tggctgggtgccaatggcc

SEQ ID NO: 9305721 - DNA, 19 bp, Homo sapiens
tggctgggtgccaatggcc

SEQ ID NO: 9305722 - DNA, 22 bp, Homo sapiens
tggctgggggtgctatagctgc

SEQ ID NO: 9305723 - DNA, 22 bp, Homo sapiens
tggctgggggtgctatagctgc

SEQ ID NO: 9305724 - DNA, 22 bp, Homo sapiens
tggctgggccgggccttgtgcc

SEQ ID NO: 9305725 - DNA, 19 bp, Homo sapiens
tggctgggcgtgcctccgt

SEQ ID NO: 9305726 - DNA, 22 bp, Homo sapiens
tggctggggcctgaatcctgca

SEQ ID NO: 9305727 - DNA, 22 bp, Homo sapiens
tggctggggcctgaatcctgca

SEQ ID NO: 9305728 - DNA, 22 bp, Homo sapiens
tggctggggagccccgactccc

SEQ ID NO: 9305729 - DNA, 22 bp, Homo sapiens
tggctggggccacagttttcct

SEQ ID NO: 9305730 - DNA, 22 bp, Homo sapiens
tggctggggccacagttttcct

SEQ ID NO: 9305731 - DNA, 22 bp, Homo sapiens
tggctgtggactcagatggctc

SEQ ID NO: 9305732 - DNA, 22 bp, Homo sapiens
tggctgtgggatgagagcctca

SEQ ID NO: 9305733 - DNA, 22 bp, Homo sapiens
tggctgtgggatatgtgactga

SEQ ID NO: 9305734 - DNA, 22 bp, Homo sapiens
tggcttcaaaatctagtggtct

SEQ ID NO: 9305735 - DNA, 22 bp, Homo sapiens
tggcttcaaaggtagcatacaa

SEQ ID NO: 9305736 - DNA, 22 bp, Homo sapiens
tggcttcaaggtgataatttac

SEQ ID NO: 9305737 - DNA, 23 bp, Homo sapiens
tggcttcaactctgtcggcagcc

SEQ ID NO: 9305738 - DNA, 22 bp, Homo sapiens
tggcttcaagtctaggttctac

SEQ ID NO: 9305739 - DNA, 22 bp, Homo sapiens
tggcttcacaatttcataacta

SEQ ID NO: 9305740 - DNA, 22 bp, Homo sapiens
tggcttcacacaggcacttccg

SEQ ID NO: 9305741 - DNA, 22 bp, Homo sapiens
tggcttcacaatttcataacta

SEQ ID NO: 9305742 - DNA, 22 bp, Homo sapiens
tggcttcacccgtcctccccac

SEQ ID NO: 9305743 - DNA, 22 bp, Homo sapiens
tggcttcacacaggcacttccg

SEQ ID NO: 9305744 - DNA, 22 bp, Homo sapiens
tggcttcacccgtcctccccac

SEQ ID NO: 9305745 - DNA, 22 bp, Homo sapiens
tggctgtgtgccaggctgtctg

SEQ ID NO: 9305746 - DNA, 22 bp, Homo sapiens
tggctgtgtccctgtccagagt

SEQ ID NO: 9305747 - DNA, 22 bp, Homo sapiens
tggctggcaaggctggagtcag

SEQ ID NO: 9305748 - DNA, 22 bp, Homo sapiens
tggctgggcccccacctgcctc

SEQ ID NO: 9305749 - DNA, 22 bp, Homo sapiens
tggctgggcccccacctgcctc

SEQ ID NO: 9305750 - DNA, 22 bp, Homo sapiens
tggctgggagctggaactgggc

SEQ ID NO: 9305751 - DNA, 22 bp, Homo sapiens
tggctgggagctggaactgggc

SEQ ID NO: 9305752 - DNA, 22 bp, Homo sapiens
tggctggctagaatggaaatgt

SEQ ID NO: 9305753 - DNA, 22 bp, Homo sapiens
tggctggcgttggggccagtga

SEQ ID NO: 9305754 - DNA, 23 bp, Homo sapiens
tggctggcgcctgcctcaccctg

SEQ ID NO: 9305755 - DNA, 22 bp, Homo sapiens
tggctggcgttggggccagtga

SEQ ID NO: 9305756 - DNA, 23 bp, Homo sapiens
tggctggcgcctgcctcaccctg

SEQ ID NO: 9305757 - DNA, 23 bp, Homo sapiens
tggctggcgcctgcctcaccctg

SEQ ID NO: 9305758 - DNA, 22 bp, Homo sapiens
tggctggcgccgggctagccac

SEQ ID NO: 9305759 - DNA, 22 bp, Homo sapiens
tggctggcgccgggctagccac

SEQ ID NO: 9305760 - DNA, 22 bp, Homo sapiens
tggctggcagttatctttggat

SEQ ID NO: 9305761 - DNA, 22 bp, Homo sapiens
tggctggcatagccattgctcc

SEQ ID NO: 9305762 - DNA, 22 bp, Homo sapiens
tggctggcgccgggctagccac

SEQ ID NO: 9305763 - DNA, 22 bp, Homo sapiens
tggctggccctgggagtgcaga

SEQ ID NO: 9305764 - DNA, 22 bp, Homo sapiens
tggctggcagtaggctagtggc

SEQ ID NO: 9305765 - DNA, 18 bp, Homo sapiens
tggctggcagtgggcagc

SEQ ID NO: 9305766 - DNA, 18 bp, Homo sapiens
tggctggcagtgggcagc

SEQ ID NO: 9305767 - DNA, 22 bp, Homo sapiens
tggctggcagtaggctagtggc

SEQ ID NO: 9305768 - DNA, 23 bp, Homo sapiens
tggctggcagaaactgaagcatg

SEQ ID NO: 9305769 - DNA, 22 bp, Homo sapiens
tggctggcaaggctggagtcag

SEQ ID NO: 9305770 - DNA, 22 bp, Homo sapiens
tggctcagtgcattcacagtaa

SEQ ID NO: 9305771 - DNA, 22 bp, Homo sapiens
tggctcagccagccctaggaac

SEQ ID NO: 9305772 - DNA, 22 bp, Homo sapiens
tggctcagatttttgtaggctt

SEQ ID NO: 9305773 - DNA, 22 bp, Homo sapiens
tggctcaggcctacgacgcctt

SEQ ID NO: 9305774 - DNA, 22 bp, Homo sapiens
tggctcagctttccccatctgg

SEQ ID NO: 9305775 - DNA, 22 bp, Homo sapiens
tggctccagcgtccacgtcctg

SEQ ID NO: 9305776 - DNA, 22 bp, Homo sapiens
tggctccagctcaagtatggca

SEQ ID NO: 9305777 - DNA, 22 bp, Homo sapiens
tggctccagatttcctgctgca

SEQ ID NO: 9305778 - DNA, 22 bp, Homo sapiens
tggctccagccctgagcaagct

SEQ ID NO: 9305779 - DNA, 20 bp, Homo sapiens
tggctccagcctcccctacc

SEQ ID NO: 9305780 - DNA, 22 bp, Homo sapiens
tggctccagatctgtctcctgt

SEQ ID NO: 9305781 - DNA, 22 bp, Homo sapiens
tggctccagaagggagggcgcc

SEQ ID NO: 9305782 - DNA, 22 bp, Homo sapiens
tggctccactctccaggagttt

SEQ ID NO: 9305783 - DNA, 22 bp, Homo sapiens
tggctccactactgggtgtgtt

SEQ ID NO: 9305784 - DNA, 22 bp, Homo sapiens
tggctccacaggccagggtgtg

SEQ ID NO: 9305785 - DNA, 22 bp, Homo sapiens
tggctccaccgccgcggagctc

SEQ ID NO: 9305786 - DNA, 22 bp, Homo sapiens
tggctcagttccatcatctgga

SEQ ID NO: 9305787 - DNA, 22 bp, Homo sapiens
tggctccaaaaacaaatgacat

SEQ ID NO: 9305788 - DNA, 22 bp, Homo sapiens
tggctccaaatcaactgctgtt

SEQ ID NO: 9305789 - DNA, 22 bp, Homo sapiens
tggctccatcatccatgcaaga

SEQ ID NO: 9305790 - DNA, 22 bp, Homo sapiens
tggctccaggttgaactttggg

SEQ ID NO: 9305791 - DNA, 22 bp, Homo sapiens
tggctccaggggacacgcagta

SEQ ID NO: 9305792 - DNA, 23 bp, Homo sapiens
tggctccaggagaagccagaagc

SEQ ID NO: 9305793 - DNA, 22 bp, Homo sapiens
tggctccatgatagttcttaca

SEQ ID NO: 9305794 - DNA, 23 bp, Homo sapiens
tggctccatgaaaattacgagga

SEQ ID NO: 9305795 - DNA, 22 bp, Homo sapiens
tggctccattctttatgagttg

SEQ ID NO: 9305796 - DNA, 22 bp, Homo sapiens
tggctcccgcagaccctgtgct

SEQ ID NO: 9305797 - DNA, 22 bp, Homo sapiens
tggcgaggccaggccagggcct

SEQ ID NO: 9305798 - DNA, 22 bp, Homo sapiens
tggcgaggtttcagagagcggc

SEQ ID NO: 9305799 - DNA, 22 bp, Homo sapiens
tggcctggtccttgtcaaggca

SEQ ID NO: 9305800 - DNA, 22 bp, Homo sapiens
tggcctggtgctcaggcagtag

SEQ ID NO: 9305801 - DNA, 22 bp, Homo sapiens
tggcctggttgttgctgccgtt

SEQ ID NO: 9305802 - DNA, 22 bp, Homo sapiens
tggcctggttatattgctatca

SEQ ID NO: 9305803 - DNA, 22 bp, Homo sapiens
tggcctggttgttgctgccgtt

SEQ ID NO: 9305804 - DNA, 22 bp, Homo sapiens
tggcctggtgtctgcgaggcct

SEQ ID NO: 9305805 - DNA, 22 bp, Homo sapiens
tggcctgggtcacaccagggtc

SEQ ID NO: 9305806 - DNA, 22 bp, Homo sapiens
tggcctgggtgctgctgacatc

SEQ ID NO: 9305807 - DNA, 22 bp, Homo sapiens
tggcctggtaccacatagattt

SEQ ID NO: 9305808 - DNA, 22 bp, Homo sapiens
tggcctggctcacagtgagatt

SEQ ID NO: 9305809 - DNA, 22 bp, Homo sapiens
tggcctggccctgaggccctgt

SEQ ID NO: 9305810 - DNA, 21 bp, Homo sapiens
tggcggggacttgtggctgcc

SEQ ID NO: 9305811 - DNA, 22 bp, Homo sapiens
tggctattcttgttgctgtgtg

SEQ ID NO: 9305812 - DNA, 22 bp, Homo sapiens
tggctcagataattcaaggggc

SEQ ID NO: 9305813 - DNA, 22 bp, Homo sapiens
tggctcagagccttgagagctg

SEQ ID NO: 9305814 - DNA, 22 bp, Homo sapiens
tggctcagatgctcttccagtg

SEQ ID NO: 9305815 - DNA, 22 bp, Homo sapiens
tggctcagagccttgagagctg

SEQ ID NO: 9305816 - DNA, 22 bp, Homo sapiens
tggctcagagcagggactctgg

SEQ ID NO: 9305817 - DNA, 21 bp, Homo sapiens
tggctgcaagcagctgcctcc

SEQ ID NO: 9305818 - DNA, 22 bp, Homo sapiens
tggctgcagacacctatggcag

SEQ ID NO: 9305819 - DNA, 22 bp, Homo sapiens
tggctggaatatgtggagacca

SEQ ID NO: 9305820 - DNA, 22 bp, Homo sapiens
tggctgctgcagacagacagga

SEQ ID NO: 9305821 - DNA, 22 bp, Homo sapiens
tggctgcaggggtgtctgacat

SEQ ID NO: 9305822 - DNA, 22 bp, Homo sapiens
tggctgcagttgggccctcaga

SEQ ID NO: 9305823 - DNA, 22 bp, Homo sapiens
tggctgccccctcccgtggaca

SEQ ID NO: 9305824 - DNA, 22 bp, Homo sapiens
tggctgccatgacgcctgggga

SEQ ID NO: 9305825 - DNA, 22 bp, Homo sapiens
tggctgccaatggcttggaaag

SEQ ID NO: 9305826 - DNA, 22 bp, Homo sapiens
tggctgctgagaaggcagctgt

SEQ ID NO: 9305827 - DNA, 19 bp, Homo sapiens
tggctgagctggactgagg

SEQ ID NO: 9305828 - DNA, 22 bp, Homo sapiens
tggctgagaagttctggtggga

SEQ ID NO: 9305829 - DNA, 22 bp, Homo sapiens
tggctgaattcatcaagaaaat

SEQ ID NO: 9305830 - DNA, 22 bp, Homo sapiens
tggctgaagtgggcaggaggga

SEQ ID NO: 9305831 - DNA, 21 bp, Homo sapiens
tggctgagccaggtgtgtgga

SEQ ID NO: 9305832 - DNA, 19 bp, Homo sapiens
tggctctgtttctctggag

SEQ ID NO: 9305833 - DNA, 23 bp, Homo sapiens
tggctctgtggatccctcaggag

SEQ ID NO: 9305834 - DNA, 23 bp, Homo sapiens
tggctctgagcttcctggtggcc

SEQ ID NO: 9305835 - DNA, 22 bp, Homo sapiens
tggccagtgcctgccagtgcag

SEQ ID NO: 9305836 - DNA, 22 bp, Homo sapiens
tggccagtggggttgagcagga

SEQ ID NO: 9305837 - DNA, 22 bp, Homo sapiens
tggccatgggatagtgcagggg

SEQ ID NO: 9305838 - DNA, 22 bp, Homo sapiens
tggccctgacacgtggtactgg

SEQ ID NO: 9305839 - DNA, 22 bp, Homo sapiens
tggccctgaggggctgtgcccc

SEQ ID NO: 9305840 - DNA, 22 bp, Homo sapiens
tggccctgagggctcggagcca

SEQ ID NO: 9305841 - DNA, 22 bp, Homo sapiens
tggccctgcagaactagcctgg

SEQ ID NO: 9305842 - DNA, 22 bp, Homo sapiens
tggcctggaacctggcagggac

SEQ ID NO: 9305843 - DNA, 22 bp, Homo sapiens
tggcctggaaaaatgcagatgg

SEQ ID NO: 9305844 - DNA, 22 bp, Homo sapiens
tggcctgctttcatttgatgct

SEQ ID NO: 9305845 - DNA, 22 bp, Homo sapiens
tggcctgccttcgctgagctga

SEQ ID NO: 9305846 - DNA, 22 bp, Homo sapiens
tggcctgctctgactttggggg

SEQ ID NO: 9305847 - DNA, 22 bp, Homo sapiens
tggcctgctttcttaggtgttc

SEQ ID NO: 9305848 - DNA, 18 bp, Homo sapiens
tggcctggagacaactct

SEQ ID NO: 9305849 - DNA, 22 bp, Homo sapiens
tggcctggaagagaggtcgagg

SEQ ID NO: 9305850 - DNA, 23 bp, Homo sapiens
tggcctggagagaaaagatgagt

SEQ ID NO: 9305851 - DNA, 22 bp, Homo sapiens
tggcctggcagagcaaggcctg

SEQ ID NO: 9305852 - DNA, 22 bp, Homo sapiens
tggcctggccacatccagcagg

SEQ ID NO: 9305853 - DNA, 22 bp, Homo sapiens
tggcctgcattggctttggtgt

SEQ ID NO: 9305854 - DNA, 22 bp, Homo sapiens
tggcctgccactgccacgccac

SEQ ID NO: 9305855 - DNA, 22 bp, Homo sapiens
tggcctgcagaggctgtggggc

SEQ ID NO: 9305856 - DNA, 22 bp, Homo sapiens
tggcctgcccagagcagctctg

SEQ ID NO: 9305857 - DNA, 22 bp, Homo sapiens
tggcctgcctcccggcttcttt

SEQ ID NO: 9305858 - DNA, 22 bp, Homo sapiens
tggcctgcaaagtcttcttgct

SEQ ID NO: 9305859 - DNA, 20 bp, Homo sapiens
tggcctctgtagaggccaag

SEQ ID NO: 9305860 - DNA, 22 bp, Homo sapiens
tggcctctggctgaggactaac

SEQ ID NO: 9305861 - DNA, 20 bp, Homo sapiens
tggcctctgagatgccacgg

SEQ ID NO: 9305862 - DNA, 22 bp, Homo sapiens
tggcctctgcactgggctcccc

SEQ ID NO: 9305863 - DNA, 22 bp, Homo sapiens
tggcctcttaaggatgacacaa

SEQ ID NO: 9305864 - DNA, 22 bp, Homo sapiens
tggcctcttaggacatcctcta

SEQ ID NO: 9305865 - DNA, 22 bp, Homo sapiens
tggcctcttaggacatcctcta

SEQ ID NO: 9305866 - DNA, 23 bp, Homo sapiens
tggccctgtgcatgctgcttccc

SEQ ID NO: 9305867 - DNA, 22 bp, Homo sapiens
tggccctgtgtcctgctgccag

SEQ ID NO: 9305868 - DNA, 22 bp, Homo sapiens
tggccctggtggcacagcctgc

SEQ ID NO: 9305869 - DNA, 22 bp, Homo sapiens
tggccctgtccctggagcctgg

SEQ ID NO: 9305870 - DNA, 22 bp, Homo sapiens
tggccctgccgcactatcctca

SEQ ID NO: 9305871 - DNA, 22 bp, Homo sapiens
tggcaggtgaagttgttaggga

SEQ ID NO: 9305872 - DNA, 22 bp, Homo sapiens
tggcaggtgcctgtaatctcag

SEQ ID NO: 9305873 - DNA, 22 bp, Homo sapiens
tggcaggtgcacttttggtttc

SEQ ID NO: 9305874 - DNA, 22 bp, Homo sapiens
tggcaggtgccatgggctcaga

SEQ ID NO: 9305875 - DNA, 18 bp, Homo sapiens
tggcaggtccagctgtgg

SEQ ID NO: 9305876 - DNA, 22 bp, Homo sapiens
tggcaggtccactcacagatct

SEQ ID NO: 9305877 - DNA, 22 bp, Homo sapiens
tggcaggtggctctggcattct

SEQ ID NO: 9305878 - DNA, 23 bp, Homo sapiens
tggcaggtggttagatgttttgt

SEQ ID NO: 9305879 - DNA, 22 bp, Homo sapiens
tggcaggttaacttacaactgt

SEQ ID NO: 9305880 - DNA, 22 bp, Homo sapiens
tggcaggttatgcgggccacat

SEQ ID NO: 9305881 - DNA, 22 bp, Homo sapiens
tggcaggtggagacagcagagc

SEQ ID NO: 9305882 - DNA, 20 bp, Homo sapiens
tggcaggtggcctcagttcc

SEQ ID NO: 9305883 - DNA, 22 bp, Homo sapiens
tggcaggtggcacagcctggga

SEQ ID NO: 9305884 - DNA, 22 bp, Homo sapiens
tggcaggtcatgagtggccacc

SEQ ID NO: 9305885 - DNA, 22 bp, Homo sapiens
tggcagggtgccagttgcgagt

SEQ ID NO: 9305886 - DNA, 22 bp, Homo sapiens
tggcagggtacaccttaacacc

SEQ ID NO: 9305887 - DNA, 22 bp, Homo sapiens
tggcagggtcttgctgtgttgc

SEQ ID NO: 9305888 - DNA, 22 bp, Homo sapiens
tggcagggtcttgctgtgttgc

SEQ ID NO: 9305889 - DNA, 22 bp, Homo sapiens
tggcaggttggcctttggttca

SEQ ID NO: 9305890 - DNA, 22 bp, Homo sapiens
tggcaggtttcctcctcatagt

SEQ ID NO: 9305891 - DNA, 21 bp, Homo sapiens
tggcaggttcaaaggcctatc

SEQ ID NO: 9305892 - DNA, 22 bp, Homo sapiens
tggcaggtttcgttaaaaatgg

SEQ ID NO: 9305893 - DNA, 16 bp, Homo sapiens
tggcaggtttttatct

SEQ ID NO: 9305894 - DNA, 22 bp, Homo sapiens
tggcatggccagtgctgggagt

SEQ ID NO: 9305895 - DNA, 22 bp, Homo sapiens
tggcatggccagtgctgggagt

SEQ ID NO: 9305896 - DNA, 22 bp, Homo sapiens
tggcatgggccagggagagctg

SEQ ID NO: 9305897 - DNA, 22 bp, Homo sapiens
tggcatgggccagggagagctg

SEQ ID NO: 9305898 - DNA, 21 bp, Homo sapiens
tggcatggaggtagcagtgtg

SEQ ID NO: 9305899 - DNA, 22 bp, Homo sapiens
tggcatggactagtgctgaggt

SEQ ID NO: 9305900 - DNA, 22 bp, Homo sapiens
tggcatcctttatctgcaggct

SEQ ID NO: 9305901 - DNA, 22 bp, Homo sapiens
tggcatcctttgtgtcagttta

SEQ ID NO: 9305902 - DNA, 22 bp, Homo sapiens
tggcatgaagtcagcagctggg

SEQ ID NO: 9305903 - DNA, 22 bp, Homo sapiens
tggcatgataggaggtgcagaa

SEQ ID NO: 9305904 - DNA, 22 bp, Homo sapiens
tggcagtttcatgtgattcaac

SEQ ID NO: 9305905 - DNA, 22 bp, Homo sapiens
tggcatcctccctcaagctgaa

SEQ ID NO: 9305906 - DNA, 22 bp, Homo sapiens
tggcatccagccatgtgatttt

SEQ ID NO: 9305907 - DNA, 22 bp, Homo sapiens
tggcatcctccctcaagctgaa

SEQ ID NO: 9305908 - DNA, 22 bp, Homo sapiens
tggcatcctctcttctgagtgc

SEQ ID NO: 9305909 - DNA, 22 bp, Homo sapiens
tggcatcctctcttctgagtgc

SEQ ID NO: 9305910 - DNA, 22 bp, Homo sapiens
tggcatcctttatctgcaggct

SEQ ID NO: 9305911 - DNA, 21 bp, Homo sapiens
tggcatcctcttctcctttcc

SEQ ID NO: 9305912 - DNA, 18 bp, Homo sapiens
tggcatcccttctcttac

SEQ ID NO: 9305913 - DNA, 22 bp, Homo sapiens
tggcatcccttcccacccttta

SEQ ID NO: 9305914 - DNA, 22 bp, Homo sapiens
tggcatccagataccctgaggg

SEQ ID NO: 9305915 - DNA, 22 bp, Homo sapiens
tggcatccaggtcctcacatgg

SEQ ID NO: 9305916 - DNA, 19 bp, Homo sapiens
tggcatcccagtaaagctt

SEQ ID NO: 9305917 - DNA, 23 bp, Homo sapiens
tggcatccatttttgtacaacct

SEQ ID NO: 9305918 - DNA, 22 bp, Homo sapiens
tggcatccagataccctgaggg

SEQ ID NO: 9305919 - DNA, 22 bp, Homo sapiens
tggcatccacaaatgcttagat

SEQ ID NO: 9305920 - DNA, 22 bp, Homo sapiens
tggcatccacaaatgcttagat

SEQ ID NO: 9305921 - DNA, 22 bp, Homo sapiens
tggcatccaacggctcgctttc

SEQ ID NO: 9305922 - DNA, 23 bp, Homo sapiens
tggccaggtagaggaggtagtga

SEQ ID NO: 9305923 - DNA, 22 bp, Homo sapiens
tggccagctgagatttagcaca

SEQ ID NO: 9305924 - DNA, 22 bp, Homo sapiens
tggccagcctggtgcttgctcc

SEQ ID NO: 9305925 - DNA, 22 bp, Homo sapiens
tggccagagttgagggggtttc

SEQ ID NO: 9305926 - DNA, 22 bp, Homo sapiens
tggccacatgcgtctgtgaggc

SEQ ID NO: 9305927 - DNA, 22 bp, Homo sapiens
tggccacatctgaaatgagtgt

SEQ ID NO: 9305928 - DNA, 22 bp, Homo sapiens
tggccacatcctttccttgtca

SEQ ID NO: 9305929 - DNA, 22 bp, Homo sapiens
tggccacagtgtccagcagcag

SEQ ID NO: 9305930 - DNA, 23 bp, Homo sapiens
tggccacagtccatgcatgccca

SEQ ID NO: 9305931 - DNA, 23 bp, Homo sapiens
tggccacagggtgctccattgta

SEQ ID NO: 9305932 - DNA, 22 bp, Homo sapiens
tggccactcagggatgcaggaa

SEQ ID NO: 9305933 - DNA, 22 bp, Homo sapiens
tggccactcctccctgcaggct

SEQ ID NO: 9305934 - DNA, 22 bp, Homo sapiens
tggccagaacctgcagtaggcc

SEQ ID NO: 9305935 - DNA, 22 bp, Homo sapiens
tggccagacagagaggctttgt

SEQ ID NO: 9305936 - DNA, 22 bp, Homo sapiens
tggccagacctgactgtcaggg

SEQ ID NO: 9305937 - DNA, 22 bp, Homo sapiens
tggccacactgcccccactggg

SEQ ID NO: 9305938 - DNA, 22 bp, Homo sapiens
tggccacacccacctagaggag

SEQ ID NO: 9305939 - DNA, 22 bp, Homo sapiens
tggcatgggtggagagagcaca

SEQ ID NO: 9305940 - DNA, 22 bp, Homo sapiens
tggcatggtggagtgacgggca

SEQ ID NO: 9305941 - DNA, 22 bp, Homo sapiens
tggcagaggaaaaagtcactgg

SEQ ID NO: 9305942 - DNA, 22 bp, Homo sapiens
tggcagagctggctgcggatga

SEQ ID NO: 9305943 - DNA, 22 bp, Homo sapiens
tggcagagatgaagagttgttt

SEQ ID NO: 9305944 - DNA, 22 bp, Homo sapiens
tggcagagcccagactccagtc

SEQ ID NO: 9305945 - DNA, 22 bp, Homo sapiens
tggcagagagactctccttgat

SEQ ID NO: 9305946 - DNA, 22 bp, Homo sapiens
tggcagagagagtgcagtcgac

SEQ ID NO: 9305947 - DNA, 22 bp, Homo sapiens
tggcagagagagtgcagtcgac

SEQ ID NO: 9305948 - DNA, 23 bp, Homo sapiens
tggcagagacccagaatctacat

SEQ ID NO: 9305949 - DNA, 22 bp, Homo sapiens
tggcagagagactctccttgat

SEQ ID NO: 9305950 - DNA, 22 bp, Homo sapiens
tggcagagaacacggctgatct

SEQ ID NO: 9305951 - DNA, 22 bp, Homo sapiens
tggcagagaacctgggctttgt

SEQ ID NO: 9305952 - DNA, 22 bp, Homo sapiens
tggcagagacaaggccgggcct

SEQ ID NO: 9305953 - DNA, 22 bp, Homo sapiens
tggcagagaataaatcttgact

SEQ ID NO: 9305954 - DNA, 22 bp, Homo sapiens
tggcagagacaaggccgggcct

SEQ ID NO: 9305955 - DNA, 22 bp, Homo sapiens
tggcactggaatcgtagccttg

SEQ ID NO: 9305956 - DNA, 22 bp, Homo sapiens
tggcactcactctcagagtctg

SEQ ID NO: 9305957 - DNA, 22 bp, Homo sapiens
tggcacccagtggagctgtgct

SEQ ID NO: 9305958 - DNA, 22 bp, Homo sapiens
tggcaccatcaaggctgagaac

SEQ ID NO: 9305959 - DNA, 22 bp, Homo sapiens
tggcaccagggaacaagcattt

SEQ ID NO: 9305960 - DNA, 22 bp, Homo sapiens
tggcaccaccagacaccaggag

SEQ ID NO: 9305961 - DNA, 22 bp, Homo sapiens
tggcaaccgcatggcctgcttc

SEQ ID NO: 9305962 - DNA, 22 bp, Homo sapiens
tggcaatacataatcttaatgg

SEQ ID NO: 9305963 - DNA, 22 bp, Homo sapiens
tggcaacatggacaggtctgcc

SEQ ID NO: 9305964 - DNA, 22 bp, Homo sapiens
tggcaaagtatctgtcccagct

SEQ ID NO: 9305965 - DNA, 22 bp, Homo sapiens
tggcaaagatggttctcaccat

SEQ ID NO: 9305966 - DNA, 22 bp, Homo sapiens
tggcaaagctagacattccctc

SEQ ID NO: 9305967 - DNA, 22 bp, Homo sapiens
tggcaaagtaattgggtttctc

SEQ ID NO: 9305968 - DNA, 18 bp, Homo sapiens
tggattgaattgagaggt

SEQ ID NO: 9305969 - DNA, 22 bp, Homo sapiens
tggattgataaaatgggatgtt

SEQ ID NO: 9305970 - DNA, 22 bp, Homo sapiens
tggatgggttgaaatgtgagcc

SEQ ID NO: 9305971 - DNA, 17 bp, Homo sapiens
tggcacagaggtgctat

SEQ ID NO: 9305972 - DNA, 22 bp, Homo sapiens
tggcacagtgctggatggtgct

SEQ ID NO: 9305973 - DNA, 21 bp, Homo sapiens
tggcacagcaagtgggctcat

SEQ ID NO: 9305974 - DNA, 22 bp, Homo sapiens
tggcacagccatcttctcctgc

SEQ ID NO: 9305975 - DNA, 18 bp, Homo sapiens
tggcagggaggaaatata

SEQ ID NO: 9305976 - DNA, 22 bp, Homo sapiens
tggcagggagccaccggtcatg

SEQ ID NO: 9305977 - DNA, 22 bp, Homo sapiens
tggcagggagccaccggtcatg

SEQ ID NO: 9305978 - DNA, 22 bp, Homo sapiens
tggcaggcatccggcaccttct

SEQ ID NO: 9305979 - DNA, 22 bp, Homo sapiens
tggcagggagttcgttcacaac

SEQ ID NO: 9305980 - DNA, 22 bp, Homo sapiens
tggcagggagttcgttcacaac

SEQ ID NO: 9305981 - DNA, 19 bp, Homo sapiens
tggcagggagtgatattag

SEQ ID NO: 9305982 - DNA, 22 bp, Homo sapiens
tggcaggcagagagcggccttt

SEQ ID NO: 9305983 - DNA, 22 bp, Homo sapiens
tggcaggcaagttcagctccac

SEQ ID NO: 9305984 - DNA, 22 bp, Homo sapiens
tggcaggatctttgagagtgaa

SEQ ID NO: 9305985 - DNA, 21 bp, Homo sapiens
tggcaggcagctggaagcttg

SEQ ID NO: 9305986 - DNA, 22 bp, Homo sapiens
tggcaggcaggcagccttctga

SEQ ID NO: 9305987 - DNA, 22 bp, Homo sapiens
tggcaggcagctggcatcctaa

SEQ ID NO: 9305988 - DNA, 22 bp, Homo sapiens
tggcaggcagtgtgggagctgg

SEQ ID NO: 9305989 - DNA, 21 bp, Homo sapiens
tggcaggggtagtagtacagc

SEQ ID NO: 9305990 - DNA, 18 bp, Homo sapiens
tggcaggggcagtacgcc

SEQ ID NO: 9305991 - DNA, 22 bp, Homo sapiens
tggcagggtacaccttaacacc

SEQ ID NO: 9305992 - DNA, 18 bp, Homo sapiens
tggcaggggcagtacgcc

SEQ ID NO: 9305993 - DNA, 22 bp, Homo sapiens
tggcaggggaggtgcttgctta

SEQ ID NO: 9305994 - DNA, 22 bp, Homo sapiens
tggcaggggaggtgcttgctta

SEQ ID NO: 9305995 - DNA, 22 bp, Homo sapiens
tggcagggagttgcaggatttc

SEQ ID NO: 9305996 - DNA, 22 bp, Homo sapiens
tggcagggcctaccccaatatc

SEQ ID NO: 9305997 - DNA, 22 bp, Homo sapiens
tggcagggcctgctcatcatcc

SEQ ID NO: 9305998 - DNA, 22 bp, Homo sapiens
tggcagggcctgaatcttatac

SEQ ID NO: 9305999 - DNA, 22 bp, Homo sapiens
tggcaggaaggagactcagccc

SEQ ID NO: 9306000 - DNA, 22 bp, Homo sapiens
tggcaggaaggagactcagccc

SEQ ID NO: 9306001 - DNA, 22 bp, Homo sapiens
tggcaggagacacatggcatag

SEQ ID NO: 9306002 - DNA, 20 bp, Homo sapiens
tggcaggactggctccaccc

SEQ ID NO: 9306003 - DNA, 20 bp, Homo sapiens
tggcaggagccactggaagc

SEQ ID NO: 9306004 - DNA, 20 bp, Homo sapiens
tggcaggagccactggaagc

SEQ ID NO: 9306005 - DNA, 20 bp, Homo sapiens
tggcaggaggcagcagtgga

SEQ ID NO: 9306006 - DNA, 22 bp, Homo sapiens
tggcaggaaataccctgcctag

SEQ ID NO: 9306007 - DNA, 22 bp, Homo sapiens
tggcaggaaccttaaccacaaa

SEQ ID NO: 9306008 - DNA, 22 bp, Homo sapiens
tggcagctctgttcaacatgag

SEQ ID NO: 9306009 - DNA, 22 bp, Homo sapiens
tggcagctgccatgtccacgtg

SEQ ID NO: 9306010 - DNA, 22 bp, Homo sapiens
tggcagctgcaggcctcctgag

SEQ ID NO: 9306011 - DNA, 22 bp, Homo sapiens
tggcagataaaataatagggaa

SEQ ID NO: 9306012 - DNA, 23 bp, Homo sapiens
tggcagatacaggcatgacttct

SEQ ID NO: 9306013 - DNA, 22 bp, Homo sapiens
tggcagataacctgctgtgccc

SEQ ID NO: 9306014 - DNA, 22 bp, Homo sapiens
tggcagatacccaggcaaatgg

SEQ ID NO: 9306015 - DNA, 21 bp, Homo sapiens
tggcagagttgagtagttatg

SEQ ID NO: 9306016 - DNA, 22 bp, Homo sapiens
tggcagagttatgggtatttat

SEQ ID NO: 9306017 - DNA, 18 bp, Homo sapiens
tggcagagtgtctgttct

SEQ ID NO: 9306018 - DNA, 22 bp, Homo sapiens
tggcagagtggaccatactcaa

SEQ ID NO: 9306019 - DNA, 22 bp, Homo sapiens
tggcagagttcgctgtgccttt

SEQ ID NO: 9306020 - DNA, 22 bp, Homo sapiens
tggcagagttcgctgtgccttt

SEQ ID NO: 9306021 - DNA, 21 bp, Homo sapiens
tggcagagtgcagtctataca

SEQ ID NO: 9306022 - DNA, 22 bp, Homo sapiens
tggcagagtgcagaagaggcat

SEQ ID NO: 9306023 - DNA, 22 bp, Homo sapiens
tggcagagtctgggcttgggca

SEQ ID NO: 9306024 - DNA, 22 bp, Homo sapiens
tggcagagtaggatggccctgt

SEQ ID NO: 9306025 - DNA, 22 bp, Homo sapiens
tggcagagtaggatggccctgt

SEQ ID NO: 9306026 - DNA, 22 bp, Homo sapiens
tggcagagtcatcacatctgga

SEQ ID NO: 9306027 - DNA, 22 bp, Homo sapiens
tggcagctatggtctaagggcc

SEQ ID NO: 9306028 - DNA, 22 bp, Homo sapiens
tggcagctcctggggccagcac

SEQ ID NO: 9306029 - DNA, 22 bp, Homo sapiens
tggcagctcctggggccagcac

SEQ ID NO: 9306030 - DNA, 22 bp, Homo sapiens
tggcagctcctggggccagcac

SEQ ID NO: 9306031 - DNA, 19 bp, Homo sapiens
tggcagcattggtaccttg

SEQ ID NO: 9306032 - DNA, 22 bp, Homo sapiens
tggcagccatcagagcaggggt

SEQ ID NO: 9306033 - DNA, 22 bp, Homo sapiens
tggcagcctcccagctgcattc

SEQ ID NO: 9306034 - DNA, 22 bp, Homo sapiens
tggcagcctggaatctctcagc

SEQ ID NO: 9306035 - DNA, 22 bp, Homo sapiens
tggcagcatgtcccggcctcag

SEQ ID NO: 9306036 - DNA, 22 bp, Homo sapiens
tggcagcagtggaggtagaaag

SEQ ID NO: 9306037 - DNA, 22 bp, Homo sapiens
tggcagcagctaacttaggcag

SEQ ID NO: 9306038 - DNA, 22 bp, Homo sapiens
tggacaacatagtgagacctca

SEQ ID NO: 9306039 - DNA, 22 bp, Homo sapiens
tggaaggaagccaaggaaggtt

SEQ ID NO: 9306040 - DNA, 22 bp, Homo sapiens
tggaaggggccaggcgcggagt

SEQ ID NO: 9306041 - DNA, 22 bp, Homo sapiens
tggaaggggagctggaaagggg

SEQ ID NO: 9306042 - DNA, 22 bp, Homo sapiens
tggaatctctggtatctgggga

SEQ ID NO: 9306043 - DNA, 22 bp, Homo sapiens
tggaatcttgcgggcacatggc

SEQ ID NO: 9306044 - DNA, 22 bp, Homo sapiens
tggaatctttaggaagcacata

SEQ ID NO: 9306045 - DNA, 22 bp, Homo sapiens
tggaatctttaggaagcacata

SEQ ID NO: 9306046 - DNA, 22 bp, Homo sapiens
tggaatctctttggggactgaa

SEQ ID NO: 9306047 - DNA, 22 bp, Homo sapiens
tggaaggaaaggtagcagagaa

SEQ ID NO: 9306048 - DNA, 22 bp, Homo sapiens
tggaagagacacttacattcag

SEQ ID NO: 9306049 - DNA, 22 bp, Homo sapiens
tgctttatagacaaggaagtag

SEQ ID NO: 9306050 - DNA, 22 bp, Homo sapiens
tgctttataggggattgcaggc

SEQ ID NO: 9306051 - DNA, 22 bp, Homo sapiens
tgctttataaccatttctgtgg

SEQ ID NO: 9306052 - DNA, 22 bp, Homo sapiens
tgctttataacttagtttatgg

SEQ ID NO: 9306053 - DNA, 22 bp, Homo sapiens
tgctttatctgacttggcgctg

SEQ ID NO: 9306054 - DNA, 22 bp, Homo sapiens
tgctttatctgtgagaacctga

SEQ ID NO: 9306055 - DNA, 22 bp, Homo sapiens
tgctttatatctctcttcttag

SEQ ID NO: 9306056 - DNA, 22 bp, Homo sapiens
tgctttatcaaagctatagtga

SEQ ID NO: 9306057 - DNA, 22 bp, Homo sapiens
tgctttatggagcccatctcat

SEQ ID NO: 9306058 - DNA, 18 bp, Homo sapiens
tgctttatgcttatataa

SEQ ID NO: 9306059 - DNA, 20 bp, Homo sapiens
tgctttatgctatactttgt

SEQ ID NO: 9306060 - DNA, 22 bp, Homo sapiens
tgctttatgtggctgatactca

SEQ ID NO: 9306061 - DNA, 22 bp, Homo sapiens
tgctttatggatttgtgtcctg

SEQ ID NO: 9306062 - DNA, 21 bp, Homo sapiens
tgctttatgggaaaaatgtca

SEQ ID NO: 9306063 - DNA, 17 bp, Homo sapiens
tgctttcttcctgccct

SEQ ID NO: 9306064 - DNA, 17 bp, Homo sapiens
tgctttcttcctgccct

SEQ ID NO: 9306065 - DNA, 22 bp, Homo sapiens
tgctttctttagctcctgagtc

SEQ ID NO: 9306066 - DNA, 22 bp, Homo sapiens
tgctttctgctcttgtccacac

SEQ ID NO: 9306067 - DNA, 22 bp, Homo sapiens
tgctttattcagggtttacccc

SEQ ID NO: 9306068 - DNA, 22 bp, Homo sapiens
tgctttattcagtctctgccat

SEQ ID NO: 9306069 - DNA, 22 bp, Homo sapiens
tgctttatgttatcagaagggt

SEQ ID NO: 9306070 - DNA, 22 bp, Homo sapiens
tgctttattaagagagaaattt

SEQ ID NO: 9306071 - DNA, 22 bp, Homo sapiens
tgctttattcgacatctggtag

SEQ ID NO: 9306072 - DNA, 22 bp, Homo sapiens
tgctttattcccttctgatgtg

SEQ ID NO: 9306073 - DNA, 18 bp, Homo sapiens
tgctttctagcttcagat

SEQ ID NO: 9306074 - DNA, 21 bp, Homo sapiens
tgctttctaaaaatactattg

SEQ ID NO: 9306075 - DNA, 22 bp, Homo sapiens
tgctttagttcaacatgccaaa

SEQ ID NO: 9306076 - DNA, 22 bp, Homo sapiens
tgctttacaagcctgcttcctc

SEQ ID NO: 9306077 - DNA, 22 bp, Homo sapiens
tgctttaaaatggactgttttg

SEQ ID NO: 9306078 - DNA, 22 bp, Homo sapiens
tgctttaaagtatttctcgcaa

SEQ ID NO: 9306079 - DNA, 22 bp, Homo sapiens
tgctttaaatatgaattagcat

SEQ ID NO: 9306080 - DNA, 22 bp, Homo sapiens
tgcttgatgattgctgtctccc

SEQ ID NO: 9306081 - DNA, 22 bp, Homo sapiens
tgcttgatgagtgtgccaagca

SEQ ID NO: 9306082 - DNA, 22 bp, Homo sapiens
tgcttgatggctcttctttcta

SEQ ID NO: 9306083 - DNA, 22 bp, Homo sapiens
tgcttgattaagccttgtttgc

SEQ ID NO: 9306084 - DNA, 21 bp, Homo sapiens
tgcttgcagaactttcaggct

SEQ ID NO: 9306085 - DNA, 22 bp, Homo sapiens
tgcttgtgagagttttttcaga

SEQ ID NO: 9306086 - DNA, 18 bp, Homo sapiens
tggaaattgaaacagaaa

SEQ ID NO: 9306087 - DNA, 22 bp, Homo sapiens
tggaaaattagtagtgaaaggc

SEQ ID NO: 9306088 - DNA, 22 bp, Homo sapiens
tggaaaatgtgactattctaaa

SEQ ID NO: 9306089 - DNA, 19 bp, Homo sapiens
tggaaaatggattgaatca

SEQ ID NO: 9306090 - DNA, 22 bp, Homo sapiens
tggaaaatcaggggacattgat

SEQ ID NO: 9306091 - DNA, 22 bp, Homo sapiens
tggaaaatatttaggtgaatga

SEQ ID NO: 9306092 - DNA, 22 bp, Homo sapiens
tggaaaatatttaggtgaatga

SEQ ID NO: 9306093 - DNA, 22 bp, Homo sapiens
tgcttttatttaatatcttgca

SEQ ID NO: 9306094 - DNA, 22 bp, Homo sapiens
tgctttttagtactgtcttatt

SEQ ID NO: 9306095 - DNA, 22 bp, Homo sapiens
tgctttttccccttctggcgag

SEQ ID NO: 9306096 - DNA, 22 bp, Homo sapiens
tgctttttccccttctggcgag

SEQ ID NO: 9306097 - DNA, 22 bp, Homo sapiens
tgctttttgcaccctttgccgt

SEQ ID NO: 9306098 - DNA, 18 bp, Homo sapiens
tggagccattgccaccat

SEQ ID NO: 9306099 - DNA, 22 bp, Homo sapiens
tggagcccacggatgtcgcttt

SEQ ID NO: 9306100 - DNA, 22 bp, Homo sapiens
tggagccagtgttgcccaacac

SEQ ID NO: 9306101 - DNA, 22 bp, Homo sapiens
tggagcccagacactggcattg

SEQ ID NO: 9306102 - DNA, 22 bp, Homo sapiens
tggagcccctcacccacacctg

SEQ ID NO: 9306103 - DNA, 22 bp, Homo sapiens
tggagcccatgagccataccag

SEQ ID NO: 9306104 - DNA, 21 bp, Homo sapiens
tggagctgaatttttggcatc

SEQ ID NO: 9306105 - DNA, 22 bp, Homo sapiens
tggagctgaactttgaggccag

SEQ ID NO: 9306106 - DNA, 22 bp, Homo sapiens
tggagctggcttgtggaagttg

SEQ ID NO: 9306107 - DNA, 22 bp, Homo sapiens
tggagctggaatttgagctgga

SEQ ID NO: 9306108 - DNA, 22 bp, Homo sapiens
tggagctggcagcggaaaaggg

SEQ ID NO: 9306109 - DNA, 22 bp, Homo sapiens
tggagctggaatttgagctgga

SEQ ID NO: 9306110 - DNA, 22 bp, Homo sapiens
tggagctggaagacagtgatat

SEQ ID NO: 9306111 - DNA, 21 bp, Homo sapiens
tggagctgccacttgtcctcc

SEQ ID NO: 9306112 - DNA, 22 bp, Homo sapiens
tggagctggaatttctgggcct

SEQ ID NO: 9306113 - DNA, 22 bp, Homo sapiens
tggagctgatacagctggcttt

SEQ ID NO: 9306114 - DNA, 22 bp, Homo sapiens
tggagctgatacagctggcttt

SEQ ID NO: 9306115 - DNA, 18 bp, Homo sapiens
tggagctgagtgctgtgc

SEQ ID NO: 9306116 - DNA, 21 bp, Homo sapiens
tggagctgccacttgagctgc

SEQ ID NO: 9306117 - DNA, 21 bp, Homo sapiens
tggagctgccacttgtcctcc

SEQ ID NO: 9306118 - DNA, 22 bp, Homo sapiens
tggagctgcctggcacctacag

SEQ ID NO: 9306119 - DNA, 17 bp, Homo sapiens
tggagctgcgtgtgttc

SEQ ID NO: 9306120 - DNA, 22 bp, Homo sapiens
tggagctggaagaatgtagacg

SEQ ID NO: 9306121 - DNA, 22 bp, Homo sapiens
tggagccagcccaggcccctct

SEQ ID NO: 9306122 - DNA, 22 bp, Homo sapiens
tggagccaatgaacatttgctg

SEQ ID NO: 9306123 - DNA, 22 bp, Homo sapiens
tggagccagaagagccagttca

SEQ ID NO: 9306124 - DNA, 22 bp, Homo sapiens
tggagccaggctggccctgcca

SEQ ID NO: 9306125 - DNA, 22 bp, Homo sapiens
tggagcaggaaacatctagagg

SEQ ID NO: 9306126 - DNA, 22 bp, Homo sapiens
tggagcaggaagtctatggctg

SEQ ID NO: 9306127 - DNA, 18 bp, Homo sapiens
tggagcaggtaggcatga

SEQ ID NO: 9306128 - DNA, 22 bp, Homo sapiens
tggagaggaaagtgcagttttg

SEQ ID NO: 9306129 - DNA, 22 bp, Homo sapiens
tggagagcgtgcttagcactct

SEQ ID NO: 9306130 - DNA, 22 bp, Homo sapiens
tggagaagctgtaggtggactc

SEQ ID NO: 9306131 - DNA, 22 bp, Homo sapiens
tggagaaggacagcctgagaaa

SEQ ID NO: 9306132 - DNA, 22 bp, Homo sapiens
tggagagaaagttgaatggagg

SEQ ID NO: 9306133 - DNA, 22 bp, Homo sapiens
tggagcagcatcactttgagct

SEQ ID NO: 9306134 - DNA, 22 bp, Homo sapiens
tggagaggttgaataacttgtc

SEQ ID NO: 9306135 - DNA, 22 bp, Homo sapiens
tggagaggtttaaacaaaagtt

SEQ ID NO: 9306136 - DNA, 19 bp, Homo sapiens
tggagaggaaatgctgctc

SEQ ID NO: 9306137 - DNA, 22 bp, Homo sapiens
tggagaggagcaccatggccat

SEQ ID NO: 9306138 - DNA, 22 bp, Homo sapiens
tggaggagggctggtgtctgta

SEQ ID NO: 9306139 - DNA, 22 bp, Homo sapiens
tggaggagggctggtgtctgta

SEQ ID NO: 9306140 - DNA, 20 bp, Homo sapiens
tggagctgtggtaaggagca

SEQ ID NO: 9306141 - DNA, 22 bp, Homo sapiens
tggagctgtcactcagaaccaa

SEQ ID NO: 9306142 - DNA, 22 bp, Homo sapiens
tggagctgtagccaccaccctg

SEQ ID NO: 9306143 - DNA, 20 bp, Homo sapiens
tggagctgtaatcttgtctg

SEQ ID NO: 9306144 - DNA, 22 bp, Homo sapiens
tggagctgtagccaccaccctg

SEQ ID NO: 9306145 - DNA, 22 bp, Homo sapiens
tggagctggttctggggaagct

SEQ ID NO: 9306146 - DNA, 20 bp, Homo sapiens
tggagctgtaatcttgtctg

SEQ ID NO: 9306147 - DNA, 22 bp, Homo sapiens
tggagctggtaaacagtgacat

SEQ ID NO: 9306148 - DNA, 22 bp, Homo sapiens
tggagctgggagtcctgggctg

SEQ ID NO: 9306149 - DNA, 22 bp, Homo sapiens
tggagctgggatttgaactgca

SEQ ID NO: 9306150 - DNA, 22 bp, Homo sapiens
tggagctggggtttgaatctgg

SEQ ID NO: 9306151 - DNA, 23 bp, Homo sapiens
tggagctgggctcagaccctggg

SEQ ID NO: 9306152 - DNA, 22 bp, Homo sapiens
tggaggcccaagattctacagc

SEQ ID NO: 9306153 - DNA, 22 bp, Homo sapiens
tggaggccatgccagagcccta

SEQ ID NO: 9306154 - DNA, 22 bp, Homo sapiens
tggaggccatacctcctgacat

SEQ ID NO: 9306155 - DNA, 19 bp, Homo sapiens
tggaggccaggacacaggt

SEQ ID NO: 9306156 - DNA, 22 bp, Homo sapiens
tggaggcctggtctctcttccc

SEQ ID NO: 9306157 - DNA, 22 bp, Homo sapiens
tggaggcccccaggcaacagca

SEQ ID NO: 9306158 - DNA, 22 bp, Homo sapiens
tggagggctaagctgagggata

SEQ ID NO: 9306159 - DNA, 22 bp, Homo sapiens
tggagggctctttcacctggta

SEQ ID NO: 9306160 - DNA, 20 bp, Homo sapiens
tggaggtggtctgctgtcct

SEQ ID NO: 9306161 - DNA, 22 bp, Homo sapiens
tggaggtgggagggactgtcct

SEQ ID NO: 9306162 - DNA, 22 bp, Homo sapiens
tggaggctggtttctgctgagg

SEQ ID NO: 9306163 - DNA, 22 bp, Homo sapiens
tggaggctggagtgcagtggcg

SEQ ID NO: 9306164 - DNA, 22 bp, Homo sapiens
tggaggctggagtgcagtggcg

SEQ ID NO: 9306165 - DNA, 22 bp, Homo sapiens
tggagggcgcttagatggaggg

SEQ ID NO: 9306166 - DNA, 22 bp, Homo sapiens
tggagggatacaaagatgaaaa

SEQ ID NO: 9306167 - DNA, 22 bp, Homo sapiens
tggagggcatctgtggtcaggc

SEQ ID NO: 9306168 - DNA, 22 bp, Homo sapiens
tggatggagactgatatgggta

SEQ ID NO: 9306169 - DNA, 22 bp, Homo sapiens
tggatggatctcaagggaatta

SEQ ID NO: 9306170 - DNA, 19 bp, Homo sapiens
tggatggagcctgtggttg

SEQ ID NO: 9306171 - DNA, 22 bp, Homo sapiens
tggatggggcagcttaggtgtg

SEQ ID NO: 9306172 - DNA, 22 bp, Homo sapiens
tggatggattgacgaaggcagc

SEQ ID NO: 9306173 - DNA, 22 bp, Homo sapiens
tggagtttccctgtgaaaatgc

SEQ ID NO: 9306174 - DNA, 22 bp, Homo sapiens
tggaggtgtccaactcgtgggt

SEQ ID NO: 9306175 - DNA, 22 bp, Homo sapiens
tggaggtgtataaggtagcttc

SEQ ID NO: 9306176 - DNA, 22 bp, Homo sapiens
tggagtcagtggctattgggca

SEQ ID NO: 9306177 - DNA, 22 bp, Homo sapiens
tggagtcatcttaatctaggca

SEQ ID NO: 9306178 - DNA, 22 bp, Homo sapiens
tggagtcacttccatatgggaa

SEQ ID NO: 9306179 - DNA, 22 bp, Homo sapiens
tggagtcacagtgacctgagtc

SEQ ID NO: 9306180 - DNA, 22 bp, Homo sapiens
tggagtcagaatgcgacaggcc

SEQ ID NO: 9306181 - DNA, 22 bp, Homo sapiens
tggagtgcagttgggaggacac

SEQ ID NO: 9306182 - DNA, 22 bp, Homo sapiens
tggagtgcagttgggaggacac

SEQ ID NO: 9306183 - DNA, 22 bp, Homo sapiens
tggagtccccgagaggcctgca

SEQ ID NO: 9306184 - DNA, 22 bp, Homo sapiens
tgctggaggggatgccttcact

SEQ ID NO: 9306185 - DNA, 22 bp, Homo sapiens
tgctggagggggtaccactcaa

SEQ ID NO: 9306186 - DNA, 20 bp, Homo sapiens
tgctggcacgggtggactcc

SEQ ID NO: 9306187 - DNA, 22 bp, Homo sapiens
tgctggcagtggcagtgatggt

SEQ ID NO: 9306188 - DNA, 18 bp, Homo sapiens
tgctggcaactactattg

SEQ ID NO: 9306189 - DNA, 23 bp, Homo sapiens
tgctggagtttactcaggccagc

SEQ ID NO: 9306190 - DNA, 22 bp, Homo sapiens
tgctggatgcttgattttgagg

SEQ ID NO: 9306191 - DNA, 22 bp, Homo sapiens
tgctggcttagatatcactgcc

SEQ ID NO: 9306192 - DNA, 22 bp, Homo sapiens
tgctggctgtccctacctggct

SEQ ID NO: 9306193 - DNA, 22 bp, Homo sapiens
tgctggccaacaaggctccaag

SEQ ID NO: 9306194 - DNA, 22 bp, Homo sapiens
tgctggctcctcgaggcttcgt

SEQ ID NO: 9306195 - DNA, 21 bp, Homo sapiens
tgctggctgaaaggcacagag

SEQ ID NO: 9306196 - DNA, 22 bp, Homo sapiens
tgctggctgaggcctgagcggg

SEQ ID NO: 9306197 - DNA, 22 bp, Homo sapiens
tgctgctttggaactccacagg

SEQ ID NO: 9306198 - DNA, 22 bp, Homo sapiens
tgctgctttaaaaagtgctgat

SEQ ID NO: 9306199 - DNA, 22 bp, Homo sapiens
tgctgcttggcaccctcagagt

SEQ ID NO: 9306200 - DNA, 22 bp, Homo sapiens
tgctgcttggaaatggggctga

SEQ ID NO: 9306201 - DNA, 21 bp, Homo sapiens
tgctgccatagacctgaggga

SEQ ID NO: 9306202 - DNA, 22 bp, Homo sapiens
tgctgccagagagacagggact

SEQ ID NO: 9306203 - DNA, 22 bp, Homo sapiens
tgctgccacctggtggctgaag

SEQ ID NO: 9306204 - DNA, 22 bp, Homo sapiens
tgctgccatggtcgctggtgtc

SEQ ID NO: 9306205 - DNA, 22 bp, Homo sapiens
tgctgcctaggaatctgtattt

SEQ ID NO: 9306206 - DNA, 22 bp, Homo sapiens
tgctggggtctctccggtgccc

SEQ ID NO: 9306207 - DNA, 22 bp, Homo sapiens
tgctggggtcatggggcgcccg

SEQ ID NO: 9306208 - DNA, 22 bp, Homo sapiens
tgctggggtcatggggcgcccg

SEQ ID NO: 9306209 - DNA, 23 bp, Homo sapiens
tgctggggtagtttgtggcacag

SEQ ID NO: 9306210 - DNA, 22 bp, Homo sapiens
tgctggggagtgattgaccatc

SEQ ID NO: 9306211 - DNA, 20 bp, Homo sapiens
tgctggggacatacagggtg

SEQ ID NO: 9306212 - DNA, 20 bp, Homo sapiens
tgctggggacatacagggtg

SEQ ID NO: 9306213 - DNA, 22 bp, Homo sapiens
tgctggggatccgtaccaaccc

SEQ ID NO: 9306214 - DNA, 22 bp, Homo sapiens
tgctggggcagaagagccaaga

SEQ ID NO: 9306215 - DNA, 16 bp, Homo sapiens
tgctggggcgccgtcc

SEQ ID NO: 9306216 - DNA, 22 bp, Homo sapiens
tgctggtaccgcgcctccgcca

SEQ ID NO: 9306217 - DNA, 22 bp, Homo sapiens
tgctgggctgcacccccagagt

SEQ ID NO: 9306218 - DNA, 22 bp, Homo sapiens
tgctgggctggagctgccaggg

SEQ ID NO: 9306219 - DNA, 22 bp, Homo sapiens
tgctgggcttgaaagctgctaa

SEQ ID NO: 9306220 - DNA, 22 bp, Homo sapiens
tgctgggcttcacccccacagt

SEQ ID NO: 9306221 - DNA, 22 bp, Homo sapiens
tgctgggctgttcctgtccatg

SEQ ID NO: 9306222 - DNA, 22 bp, Homo sapiens
tgctgggctcaacctccagagc

SEQ ID NO: 9306223 - DNA, 22 bp, Homo sapiens
tgctgggcctttacctccaggg

SEQ ID NO: 9306224 - DNA, 22 bp, Homo sapiens
tgctgggcggtgggctcatccc

SEQ ID NO: 9306225 - DNA, 22 bp, Homo sapiens
tgcttcgccccctggtgcagct

SEQ ID NO: 9306226 - DNA, 22 bp, Homo sapiens
tgcttctagacactgcaattga

SEQ ID NO: 9306227 - DNA, 22 bp, Homo sapiens
tgcttctaatctactgcattag

SEQ ID NO: 9306228 - DNA, 22 bp, Homo sapiens
tgcttccaattcaaatctgtgg

SEQ ID NO: 9306229 - DNA, 22 bp, Homo sapiens
tgcttcattttgacttagccag

SEQ ID NO: 9306230 - DNA, 22 bp, Homo sapiens
tgcttccagctctctgtaaggt

SEQ ID NO: 9306231 - DNA, 22 bp, Homo sapiens
tgcttccagccttcccaatgct

SEQ ID NO: 9306232 - DNA, 22 bp, Homo sapiens
tgcttccactaatgagctgtgt

SEQ ID NO: 9306233 - DNA, 22 bp, Homo sapiens
tgcttcatgaggtagtggcagt

SEQ ID NO: 9306234 - DNA, 22 bp, Homo sapiens
tgcttcagtgtgtcattattta

SEQ ID NO: 9306235 - DNA, 22 bp, Homo sapiens
tgcttcagtgtgtcattattta

SEQ ID NO: 9306236 - DNA, 22 bp, Homo sapiens
tgcttcaggagatgtcaccatg

SEQ ID NO: 9306237 - DNA, 22 bp, Homo sapiens
tgcttcaaaaagttgttagagg

SEQ ID NO: 9306238 - DNA, 22 bp, Homo sapiens
tgcttattaaacatgcatattc

SEQ ID NO: 9306239 - DNA, 23 bp, Homo sapiens
tgcttattcaaaaggtgctttca

SEQ ID NO: 9306240 - DNA, 22 bp, Homo sapiens
tgcttcaaggacactgactttt

SEQ ID NO: 9306241 - DNA, 22 bp, Homo sapiens
tgcttcagaggaaaggcaaaag

SEQ ID NO: 9306242 - DNA, 22 bp, Homo sapiens
tgcttcactggctccacatagg

SEQ ID NO: 9306243 - DNA, 22 bp, Homo sapiens
tgcttaatagtgcactggtttc

SEQ ID NO: 9306244 - DNA, 22 bp, Homo sapiens
tgcttaatacgtatttgctgga

SEQ ID NO: 9306245 - DNA, 23 bp, Homo sapiens
tgcttaattcctctgcttcacct

SEQ ID NO: 9306246 - DNA, 17 bp, Homo sapiens
tgcttaattttgactgg

SEQ ID NO: 9306247 - DNA, 22 bp, Homo sapiens
tgcttaatccaacctggctgac

SEQ ID NO: 9306248 - DNA, 19 bp, Homo sapiens
tgcttaccatctgtgctgg

SEQ ID NO: 9306249 - DNA, 22 bp, Homo sapiens
tgcttacctctggctgttttcc

SEQ ID NO: 9306250 - DNA, 21 bp, Homo sapiens
tgcttaccgccccagggctcc

SEQ ID NO: 9306251 - DNA, 22 bp, Homo sapiens
tgcttaggctaacaaaaatagc

SEQ ID NO: 9306252 - DNA, 22 bp, Homo sapiens
tgcttatatttattgggcttag

SEQ ID NO: 9306253 - DNA, 22 bp, Homo sapiens
tgcttaaacatactatttatat

SEQ ID NO: 9306254 - DNA, 22 bp, Homo sapiens
tgcttaaaccctgatcatgtgt

SEQ ID NO: 9306255 - DNA, 22 bp, Homo sapiens
tgcttaaaatgatgattatttt

SEQ ID NO: 9306256 - DNA, 22 bp, Homo sapiens
tgcttaaaatagttcatttttg

SEQ ID NO: 9306257 - DNA, 22 bp, Homo sapiens
tgctgtcccccgtgtctgggct

SEQ ID NO: 9306258 - DNA, 21 bp, Homo sapiens
tgctgtcctagaaccagggcc

SEQ ID NO: 9306259 - DNA, 22 bp, Homo sapiens
tgctgtcctgctgagggatgtg

SEQ ID NO: 9306260 - DNA, 21 bp, Homo sapiens
tgctcctttaccccacaagac

SEQ ID NO: 9306261 - DNA, 22 bp, Homo sapiens
tgctccttcccttcccagtgag

SEQ ID NO: 9306262 - DNA, 21 bp, Homo sapiens
tgctccttagctgcccctgcc

SEQ ID NO: 9306263 - DNA, 22 bp, Homo sapiens
tgctcctggctccttccctaac

SEQ ID NO: 9306264 - DNA, 17 bp, Homo sapiens
tgctcctgtggcagcct

SEQ ID NO: 9306265 - DNA, 22 bp, Homo sapiens
tgctctgggattcagcagcctg

SEQ ID NO: 9306266 - DNA, 22 bp, Homo sapiens
tgctctgggctcaatggcagct

SEQ ID NO: 9306267 - DNA, 22 bp, Homo sapiens
tgctctgggggaagccagctgt

SEQ ID NO: 9306268 - DNA, 19 bp, Homo sapiens
tgctctctggtgcttcatg

SEQ ID NO: 9306269 - DNA, 22 bp, Homo sapiens
tgctctccggcttccgtggcct

SEQ ID NO: 9306270 - DNA, 22 bp, Homo sapiens
tgctctcctgctcctcagccca

SEQ ID NO: 9306271 - DNA, 22 bp, Homo sapiens
tgctccaggctgctgaagatct

SEQ ID NO: 9306272 - DNA, 21 bp, Homo sapiens
tgctccagggcagcttccagc

SEQ ID NO: 9306273 - DNA, 19 bp, Homo sapiens
tgctccaggccttgccgca

SEQ ID NO: 9306274 - DNA, 22 bp, Homo sapiens
tgctccaggccgcctggggctg

SEQ ID NO: 9306275 - DNA, 21 bp, Homo sapiens
tgctccaggagggggcagtcc

SEQ ID NO: 9306276 - DNA, 22 bp, Homo sapiens
tgctccaggagcactttccatt

SEQ ID NO: 9306277 - DNA, 22 bp, Homo sapiens
tgctccaggcaagctgagagtt

SEQ ID NO: 9306278 - DNA, 18 bp, Homo sapiens
tgctccaggcccatgggc

SEQ ID NO: 9306279 - DNA, 22 bp, Homo sapiens
tgctccagcatgaccctcaatg

SEQ ID NO: 9306280 - DNA, 22 bp, Homo sapiens
tgctccagcccctggtgcacag

SEQ ID NO: 9306281 - DNA, 23 bp, Homo sapiens
tgctccagcctctttgatagtgt

SEQ ID NO: 9306282 - DNA, 22 bp, Homo sapiens
tgctccagcctatgctctccgg

SEQ ID NO: 9306283 - DNA, 22 bp, Homo sapiens
tgctccagcccctggtgcacag

SEQ ID NO: 9306284 - DNA, 22 bp, Homo sapiens
tgctccaggagcaacctttgag

SEQ ID NO: 9306285 - DNA, 20 bp, Homo sapiens
tgctccaggaacactggccg

SEQ ID NO: 9306286 - DNA, 20 bp, Homo sapiens
tgctccaggaacactggccg

SEQ ID NO: 9306287 - DNA, 22 bp, Homo sapiens
tgctccagctggagatgggggc

SEQ ID NO: 9306288 - DNA, 22 bp, Homo sapiens
tgctccagcgctgccaccagtt

SEQ ID NO: 9306289 - DNA, 22 bp, Homo sapiens
tgctcctgctgcatgcatctcc

SEQ ID NO: 9306290 - DNA, 22 bp, Homo sapiens
tgctcccagggactctggctgg

SEQ ID NO: 9306291 - DNA, 22 bp, Homo sapiens
tgctcccaggactcttgagcca

SEQ ID NO: 9306292 - DNA, 22 bp, Homo sapiens
tgctccagggcctccagtgggg

SEQ ID NO: 9306293 - DNA, 22 bp, Homo sapiens
tgctccagggcctccagtgggg

SEQ ID NO: 9306294 - DNA, 23 bp, Homo sapiens
tgctcccaggtgacgctgctgtt

SEQ ID NO: 9306295 - DNA, 23 bp, Homo sapiens
tgctcccaggtgacgctgctgtt

SEQ ID NO: 9306296 - DNA, 22 bp, Homo sapiens
tgctgaggtcacggcggccaga

SEQ ID NO: 9306297 - DNA, 20 bp, Homo sapiens
tgctgaggcctgaggcctgg

SEQ ID NO: 9306298 - DNA, 22 bp, Homo sapiens
tgctgaggcatttggacagagt

SEQ ID NO: 9306299 - DNA, 22 bp, Homo sapiens
tgctgagtactctcctgtgtag

SEQ ID NO: 9306300 - DNA, 22 bp, Homo sapiens
tgctgagtcgtattatttttta

SEQ ID NO: 9306301 - DNA, 22 bp, Homo sapiens
tgctgagtgggattcctgtgct

SEQ ID NO: 9306302 - DNA, 22 bp, Homo sapiens
tgctgatatattctagttttct

SEQ ID NO: 9306303 - DNA, 22 bp, Homo sapiens
tgctgagtggcggcctcacttt

SEQ ID NO: 9306304 - DNA, 22 bp, Homo sapiens
tgctgagtctgaaacagctcag

SEQ ID NO: 9306305 - DNA, 20 bp, Homo sapiens
tgctgaggttgacatgccca

SEQ ID NO: 9306306 - DNA, 22 bp, Homo sapiens
tgctgcagggccttccctgcat

SEQ ID NO: 9306307 - DNA, 19 bp, Homo sapiens
tgctgcagtcaggcgaggg

SEQ ID NO: 9306308 - DNA, 22 bp, Homo sapiens
tgctctgtaacaaattgacatg

SEQ ID NO: 9306309 - DNA, 22 bp, Homo sapiens
tgctctgtattctatggcagtt

SEQ ID NO: 9306310 - DNA, 22 bp, Homo sapiens
tgctcttacattaattcagcat

SEQ ID NO: 9306311 - DNA, 22 bp, Homo sapiens
tgctctggtcctccctcggcgc

SEQ ID NO: 9306312 - DNA, 22 bp, Homo sapiens
tgctgaggactaaaggagatga

SEQ ID NO: 9306313 - DNA, 22 bp, Homo sapiens
tgctgaggaggtggctgtgctt

SEQ ID NO: 9306314 - DNA, 22 bp, Homo sapiens
tgctgagcgcatccggcggccg

SEQ ID NO: 9306315 - DNA, 22 bp, Homo sapiens
tgctgagcgcatccggcggccg

SEQ ID NO: 9306316 - DNA, 22 bp, Homo sapiens
tgctgagatctgccagtagatg

SEQ ID NO: 9306317 - DNA, 22 bp, Homo sapiens
tgctgagatgaatagggctgtc

SEQ ID NO: 9306318 - DNA, 22 bp, Homo sapiens
tgctgaaagaccgtatttatct

SEQ ID NO: 9306319 - DNA, 22 bp, Homo sapiens
tgcgggtcccagggtcacaggc

SEQ ID NO: 9306320 - DNA, 22 bp, Homo sapiens
tgcgttattgtgtctggctatg

SEQ ID NO: 9306321 - DNA, 22 bp, Homo sapiens
tgctaacaaagtctaaatcata

SEQ ID NO: 9306322 - DNA, 16 bp, Homo sapiens
tgcggcaacttgcggc

SEQ ID NO: 9306323 - DNA, 22 bp, Homo sapiens
tgcggaggtcggtgctgcgggc

SEQ ID NO: 9306324 - DNA, 22 bp, Homo sapiens
tgcggaggtcggtgctgcgggc

SEQ ID NO: 9306325 - DNA, 22 bp, Homo sapiens
tgcggagggagcagtcggctgt

SEQ ID NO: 9306326 - DNA, 22 bp, Homo sapiens
tgcggggagagaggtccaggat

SEQ ID NO: 9306327 - DNA, 22 bp, Homo sapiens
tgctatgtccagcacagagtgg

SEQ ID NO: 9306328 - DNA, 22 bp, Homo sapiens
tgctattaatgaggctgcattt

SEQ ID NO: 9306329 - DNA, 22 bp, Homo sapiens
tgctattagaagccatgctgtt

SEQ ID NO: 9306330 - DNA, 22 bp, Homo sapiens
tgctatttgggggctacatgat

SEQ ID NO: 9306331 - DNA, 22 bp, Homo sapiens
tgctatttctatctcatttaaa

SEQ ID NO: 9306332 - DNA, 16 bp, Homo sapiens
tgctattttagagagg

SEQ ID NO: 9306333 - DNA, 22 bp, Homo sapiens
tgctatttgtgtaatggtaaat

SEQ ID NO: 9306334 - DNA, 22 bp, Homo sapiens
tgctccagaaaaacttgagact

SEQ ID NO: 9306335 - DNA, 22 bp, Homo sapiens
tgctccagaacctgaccatgct

SEQ ID NO: 9306336 - DNA, 22 bp, Homo sapiens
tgctccagcaacaggcttagct

SEQ ID NO: 9306337 - DNA, 16 bp, Homo sapiens
tgctccagaggaccca

SEQ ID NO: 9306338 - DNA, 22 bp, Homo sapiens
tgctccagcaccaagagctcca

SEQ ID NO: 9306339 - DNA, 22 bp, Homo sapiens
tgctcacatatcacctacctaa

SEQ ID NO: 9306340 - DNA, 22 bp, Homo sapiens
tgctcagaacatgattcaggcg

SEQ ID NO: 9306341 - DNA, 22 bp, Homo sapiens
tgctcagaaagccaccagagcg

SEQ ID NO: 9306342 - DNA, 22 bp, Homo sapiens
tgctcacaattatcagaagtat

SEQ ID NO: 9306343 - DNA, 22 bp, Homo sapiens
tgctcacaattatcagaagtat

SEQ ID NO: 9306344 - DNA, 22 bp, Homo sapiens
tgctcagagggtgatgtcattt

SEQ ID NO: 9306345 - DNA, 22 bp, Homo sapiens
tgctcagactagctccagggaa

SEQ ID NO: 9306346 - DNA, 22 bp, Homo sapiens
tgctcagattacagccccacat

SEQ ID NO: 9306347 - DNA, 21 bp, Homo sapiens
tgctcagattctccatctgga

SEQ ID NO: 9306348 - DNA, 22 bp, Homo sapiens
tgcctgtcttcaggagtgtcac

SEQ ID NO: 9306349 - DNA, 22 bp, Homo sapiens
tgcctgtctttcctccctcgta

SEQ ID NO: 9306350 - DNA, 22 bp, Homo sapiens
tgcctgggttgactcttagctg

SEQ ID NO: 9306351 - DNA, 22 bp, Homo sapiens
tgcctggccctgacagccctgg

SEQ ID NO: 9306352 - DNA, 20 bp, Homo sapiens
tgcctggcctttctctgccc

SEQ ID NO: 9306353 - DNA, 22 bp, Homo sapiens
tgcctggccctgacagccctgg

SEQ ID NO: 9306354 - DNA, 22 bp, Homo sapiens
tgcctggcatgttatagacaca

SEQ ID NO: 9306355 - DNA, 22 bp, Homo sapiens
tgcctggcatgttatagacaca

SEQ ID NO: 9306356 - DNA, 22 bp, Homo sapiens
tgcctggccagaccctatagag

SEQ ID NO: 9306357 - DNA, 21 bp, Homo sapiens
tgcctggcctttgcttttcct

SEQ ID NO: 9306358 - DNA, 20 bp, Homo sapiens
tgcctggcctttctctgccc

SEQ ID NO: 9306359 - DNA, 22 bp, Homo sapiens
tgcctggctaatttttgtatcc

SEQ ID NO: 9306360 - DNA, 22 bp, Homo sapiens
tgcctggctctatcagtggtgg

SEQ ID NO: 9306361 - DNA, 22 bp, Homo sapiens
tgcctggctctatcagtggtgg

SEQ ID NO: 9306362 - DNA, 22 bp, Homo sapiens
tgcctggctgaggtgacaggtt

SEQ ID NO: 9306363 - DNA, 22 bp, Homo sapiens
tgcctggctgaggtgacaggtt

SEQ ID NO: 9306364 - DNA, 22 bp, Homo sapiens
tgcctggctgggctgctcatgg

SEQ ID NO: 9306365 - DNA, 22 bp, Homo sapiens
tgcctggctgaggtgacaggtt

SEQ ID NO: 9306366 - DNA, 22 bp, Homo sapiens
tgcctggctgggctgctcatgg

SEQ ID NO: 9306367 - DNA, 22 bp, Homo sapiens
tgccttcttctccctggctcag

SEQ ID NO: 9306368 - DNA, 22 bp, Homo sapiens
tgccttcttctccctggctcag

SEQ ID NO: 9306369 - DNA, 19 bp, Homo sapiens
tgccttggctgccaggaaa

SEQ ID NO: 9306370 - DNA, 22 bp, Homo sapiens
tgcctttaaggaatcattcttg

SEQ ID NO: 9306371 - DNA, 22 bp, Homo sapiens
tgcctttactgattagctgtgt

SEQ ID NO: 9306372 - DNA, 22 bp, Homo sapiens
tgcctttaacaagatctccaga

SEQ ID NO: 9306373 - DNA, 22 bp, Homo sapiens
tgcctttaaccagtctagacag

SEQ ID NO: 9306374 - DNA, 22 bp, Homo sapiens
tgcgaccctagccccctcactt

SEQ ID NO: 9306375 - DNA, 22 bp, Homo sapiens
tgcctttaggggcctctccctc

SEQ ID NO: 9306376 - DNA, 22 bp, Homo sapiens
tgagacagcctctgcactcatg

SEQ ID NO: 9306377 - DNA, 22 bp, Homo sapiens
tgagacagcagtcagggaaata

SEQ ID NO: 9306378 - DNA, 22 bp, Homo sapiens
tgagacagcccttctgcacagg

SEQ ID NO: 9306379 - DNA, 22 bp, Homo sapiens
tgagacagtaattgtatagttt

SEQ ID NO: 9306380 - DNA, 22 bp, Homo sapiens
tgagaatgtgcaatatccttcc

SEQ ID NO: 9306381 - DNA, 22 bp, Homo sapiens
tgagaatgccataagagctatt

SEQ ID NO: 9306382 - DNA, 23 bp, Homo sapiens
tgagaagccgccgggcagcctgg

SEQ ID NO: 9306383 - DNA, 22 bp, Homo sapiens
tgagacagcagattagcaatga

SEQ ID NO: 9306384 - DNA, 22 bp, Homo sapiens
tgagaaatgggtctgctgaaga

SEQ ID NO: 9306385 - DNA, 22 bp, Homo sapiens
tgactttaaaataacaagttta

SEQ ID NO: 9306386 - DNA, 22 bp, Homo sapiens
tgagaacagttggaagcagtca

SEQ ID NO: 9306387 - DNA, 22 bp, Homo sapiens
tgagaagcagtttcagtaagaa

SEQ ID NO: 9306388 - DNA, 22 bp, Homo sapiens
tgagagagcctgaatctcttac

SEQ ID NO: 9306389 - DNA, 22 bp, Homo sapiens
tgagagaggggactgcctgctt

SEQ ID NO: 9306390 - DNA, 21 bp, Homo sapiens
tgagagagtagcaggacatat

SEQ ID NO: 9306391 - DNA, 22 bp, Homo sapiens
tgagagcacagtgtggtctgga

SEQ ID NO: 9306392 - DNA, 17 bp, Homo sapiens
tgagagcagggctgggc

SEQ ID NO: 9306393 - DNA, 18 bp, Homo sapiens
tgagagcattcgaggcaa

SEQ ID NO: 9306394 - DNA, 22 bp, Homo sapiens
tgagagggcccagagcacacca

SEQ ID NO: 9306395 - DNA, 22 bp, Homo sapiens
tgagagggttcccaggggtttc

SEQ ID NO: 9306396 - DNA, 22 bp, Homo sapiens
tgagaggtaggaaatgaacaag

SEQ ID NO: 9306397 - DNA, 22 bp, Homo sapiens
tgagatgaaagcagaaagactt

SEQ ID NO: 9306398 - DNA, 22 bp, Homo sapiens
tgagatgaataactcctgctaa

SEQ ID NO: 9306399 - DNA, 22 bp, Homo sapiens
tgagatgagatttcactgtcct

SEQ ID NO: 9306400 - DNA, 22 bp, Homo sapiens
tgagatgatgggataagagggc

SEQ ID NO: 9306401 - DNA, 22 bp, Homo sapiens
tgagatgcaggagatgggactg

SEQ ID NO: 9306402 - DNA, 22 bp, Homo sapiens
tgagatggagttctgctcttgt

SEQ ID NO: 9306403 - DNA, 22 bp, Homo sapiens
tgagatggagtcttgctctgtt

SEQ ID NO: 9306404 - DNA, 22 bp, Homo sapiens
tgagatggagtctcactctgtt

SEQ ID NO: 9306405 - DNA, 22 bp, Homo sapiens
tgagatgggtggggagctcagg

SEQ ID NO: 9306406 - DNA, 22 bp, Homo sapiens
tgagatggattgggttggttcc

SEQ ID NO: 9306407 - DNA, 22 bp, Homo sapiens
tgagatggagttttggggatat

SEQ ID NO: 9306408 - DNA, 22 bp, Homo sapiens
tgagatgggtgggtagccaagg

SEQ ID NO: 9306409 - DNA, 21 bp, Homo sapiens
tgagcaaaatttagagtgatg

SEQ ID NO: 9306410 - DNA, 19 bp, Homo sapiens
tgagcatgcgagctgagaa

SEQ ID NO: 9306411 - DNA, 22 bp, Homo sapiens
tgagcatggtgggtgcagagca

SEQ ID NO: 9306412 - DNA, 22 bp, Homo sapiens
tgagcagggagctgggctgagc

SEQ ID NO: 9306413 - DNA, 22 bp, Homo sapiens
tgagccagagtggagtgtgcct

SEQ ID NO: 9306414 - DNA, 22 bp, Homo sapiens
tgagccacagtgagagctcctg

SEQ ID NO: 9306415 - DNA, 22 bp, Homo sapiens
tgagccaagttcacaccattgc

SEQ ID NO: 9306416 - DNA, 22 bp, Homo sapiens
tgagccaagatcatgccgttgt

SEQ ID NO: 9306417 - DNA, 22 bp, Homo sapiens
tgagccaagcagcttcccaggg

SEQ ID NO: 9306418 - DNA, 22 bp, Homo sapiens
tgagccaggcccagtggggtca

SEQ ID NO: 9306419 - DNA, 22 bp, Homo sapiens
tgagccaggcactgctcctgga

SEQ ID NO: 9306420 - DNA, 20 bp, Homo sapiens
tgagccaggctaggaagggc

SEQ ID NO: 9306421 - DNA, 22 bp, Homo sapiens
tgagccaggctcaagtgatcct

SEQ ID NO: 9306422 - DNA, 19 bp, Homo sapiens
tgagccagggaggccatgc

SEQ ID NO: 9306423 - DNA, 22 bp, Homo sapiens
tgagccaggagtttgaggctgt

SEQ ID NO: 9306424 - DNA, 22 bp, Homo sapiens
tgagccagcctcagaagtcacg

SEQ ID NO: 9306425 - DNA, 22 bp, Homo sapiens
tgagccagataagggctcacgc

SEQ ID NO: 9306426 - DNA, 22 bp, Homo sapiens
tgagcagagcagtaacaggagc

SEQ ID NO: 9306427 - DNA, 22 bp, Homo sapiens
tgagcagatggaggcttctgca

SEQ ID NO: 9306428 - DNA, 22 bp, Homo sapiens
tgagcaggcgcagcaggaggtc

SEQ ID NO: 9306429 - DNA, 22 bp, Homo sapiens
tgagcaggctcccacttcagtg

SEQ ID NO: 9306430 - DNA, 22 bp, Homo sapiens
tgagcagcttctgtctgaaggc

SEQ ID NO: 9306431 - DNA, 22 bp, Homo sapiens
tgagcagctactgtgttcaggg

SEQ ID NO: 9306432 - DNA, 22 bp, Homo sapiens
tgagctggtcttgagtgtagct

SEQ ID NO: 9306433 - DNA, 19 bp, Homo sapiens
tgagctgctgctgcccatc

SEQ ID NO: 9306434 - DNA, 22 bp, Homo sapiens
tgagcttccctcctgcactaca

SEQ ID NO: 9306435 - DNA, 22 bp, Homo sapiens
tgagcttttaatatacaggtgt

SEQ ID NO: 9306436 - DNA, 22 bp, Homo sapiens
tgagccagtctgtctgggtgaa

SEQ ID NO: 9306437 - DNA, 22 bp, Homo sapiens
tgagccagtggaagatggcagt

SEQ ID NO: 9306438 - DNA, 20 bp, Homo sapiens
tgagccagtcaagctacatt

SEQ ID NO: 9306439 - DNA, 22 bp, Homo sapiens
tgagcgttttcttggtcagttc

SEQ ID NO: 9306440 - DNA, 22 bp, Homo sapiens
tgaggcaacagaaagggccaat

SEQ ID NO: 9306441 - DNA, 22 bp, Homo sapiens
tgaggcaaagacaaagcagcat

SEQ ID NO: 9306442 - DNA, 19 bp, Homo sapiens
tgaggattgaggtccagta

SEQ ID NO: 9306443 - DNA, 22 bp, Homo sapiens
tgaggatggtgttggagagggc

SEQ ID NO: 9306444 - DNA, 21 bp, Homo sapiens
tgaggatgtgcagcagcagga

SEQ ID NO: 9306445 - DNA, 22 bp, Homo sapiens
tgaggcaggacatggacaactg

SEQ ID NO: 9306446 - DNA, 22 bp, Homo sapiens
tgaggcaggaatggggaaaagt

SEQ ID NO: 9306447 - DNA, 22 bp, Homo sapiens
tgaggcaggaagttatataatg

SEQ ID NO: 9306448 - DNA, 22 bp, Homo sapiens
tgaggcagctttttctgtgtgt

SEQ ID NO: 9306449 - DNA, 22 bp, Homo sapiens
tgaggcagctttttctgtgtgt

SEQ ID NO: 9306450 - DNA, 22 bp, Homo sapiens
tgaggcagctttttctgtgtgt

SEQ ID NO: 9306451 - DNA, 22 bp, Homo sapiens
tgaggcaggagaatcacatgaa

SEQ ID NO: 9306452 - DNA, 22 bp, Homo sapiens
tgaggcaggagaatcacatgaa

SEQ ID NO: 9306453 - DNA, 22 bp, Homo sapiens
tgaggcaggagaatcacatgaa

SEQ ID NO: 9306454 - DNA, 22 bp, Homo sapiens
tgaggcaggagaatcaccggaa

SEQ ID NO: 9306455 - DNA, 22 bp, Homo sapiens
tgaggcaggagaatcaccggaa

SEQ ID NO: 9306456 - DNA, 20 bp, Homo sapiens
tgaggcaggagaatggcatg

SEQ ID NO: 9306457 - DNA, 22 bp, Homo sapiens
tgaggcaggacttgcataaagt

SEQ ID NO: 9306458 - DNA, 22 bp, Homo sapiens
tgaggcaggacatggacaactg

SEQ ID NO: 9306459 - DNA, 22 bp, Homo sapiens
tgaggcaggactgagcgggatg

SEQ ID NO: 9306460 - DNA, 22 bp, Homo sapiens
tgaggaggtcagagtctggctg

SEQ ID NO: 9306461 - DNA, 22 bp, Homo sapiens
tgaggaggtcagagtctggctg

SEQ ID NO: 9306462 - DNA, 22 bp, Homo sapiens
tgaggaggtcagagtctggctg

SEQ ID NO: 9306463 - DNA, 22 bp, Homo sapiens
tgaggaggcccaggttggggct

SEQ ID NO: 9306464 - DNA, 22 bp, Homo sapiens
tgaggaggcccaggttggggct

SEQ ID NO: 9306465 - DNA, 19 bp, Homo sapiens
tgaggagcagctggttgat

SEQ ID NO: 9306466 - DNA, 22 bp, Homo sapiens
tgaggagcgggcagggatgcag

SEQ ID NO: 9306467 - DNA, 22 bp, Homo sapiens
tgaggatgacgatggcaatggc

SEQ ID NO: 9306468 - DNA, 22 bp, Homo sapiens
tgaggagtttttctagagctaa

SEQ ID NO: 9306469 - DNA, 22 bp, Homo sapiens
tgaggatggcagtgtgctcagc

SEQ ID NO: 9306470 - DNA, 22 bp, Homo sapiens
tgaggatggtcccgaggacact

SEQ ID NO: 9306471 - DNA, 22 bp, Homo sapiens
tgaggatggtcccgaggacact

SEQ ID NO: 9306472 - DNA, 22 bp, Homo sapiens
tgaggaagcaaaggcttgtgtg

SEQ ID NO: 9306473 - DNA, 22 bp, Homo sapiens
tgaggaaattgaggctcacaga

SEQ ID NO: 9306474 - DNA, 22 bp, Homo sapiens
tgaggaaatatggtgaactctt

SEQ ID NO: 9306475 - DNA, 22 bp, Homo sapiens
tgaggaaggaattgaggtttta

SEQ ID NO: 9306476 - DNA, 22 bp, Homo sapiens
tgaggaaggaattgaggtttta

SEQ ID NO: 9306477 - DNA, 22 bp, Homo sapiens
tgaggaagtggttgtatggttt

SEQ ID NO: 9306478 - DNA, 22 bp, Homo sapiens
tgaggagaaatgctcagagcca

SEQ ID NO: 9306479 - DNA, 22 bp, Homo sapiens
tgaggccagagagtttgcattt

SEQ ID NO: 9306480 - DNA, 22 bp, Homo sapiens
tgaggccacaggaaagggcccg

SEQ ID NO: 9306481 - DNA, 22 bp, Homo sapiens
tgaggccaactagggagatgga

SEQ ID NO: 9306482 - DNA, 22 bp, Homo sapiens
tgaggcagttgagcttcctgag

SEQ ID NO: 9306483 - DNA, 22 bp, Homo sapiens
tgaggcagttgagcttcctgag

SEQ ID NO: 9306484 - DNA, 23 bp, Homo sapiens
tgaggcaggcggatcacgaggtc

SEQ ID NO: 9306485 - DNA, 22 bp, Homo sapiens
tgaggcagggagtttaattgtc

SEQ ID NO: 9306486 - DNA, 22 bp, Homo sapiens
tgaggcagggagagtggatatg

SEQ ID NO: 9306487 - DNA, 23 bp, Homo sapiens
tgaggcaggcggatcacgaggtc

SEQ ID NO: 9306488 - DNA, 22 bp, Homo sapiens
tgaggcagggagtttaattgtc

SEQ ID NO: 9306489 - DNA, 22 bp, Homo sapiens
tgaggcagttcttacttgtatt

SEQ ID NO: 9306490 - DNA, 21 bp, Homo sapiens
tgaggcaggggtgcttttgtc

SEQ ID NO: 9306491 - DNA, 22 bp, Homo sapiens
tgaggcaggatgcttgcacagg

SEQ ID NO: 9306492 - DNA, 22 bp, Homo sapiens
tgaggcaggatgcttgcacagg

SEQ ID NO: 9306493 - DNA, 22 bp, Homo sapiens
tgaggcaggagttaatgtgctc

SEQ ID NO: 9306494 - DNA, 22 bp, Homo sapiens
tgaggcaggagttcaggctgcg

SEQ ID NO: 9306495 - DNA, 22 bp, Homo sapiens
tgaggcaggagaatggcgggaa

SEQ ID NO: 9306496 - DNA, 22 bp, Homo sapiens
tgaggcaggagaatggcgggaa

SEQ ID NO: 9306497 - DNA, 22 bp, Homo sapiens
tgaggcaggaggattgcaggat

SEQ ID NO: 9306498 - DNA, 22 bp, Homo sapiens
tgaggcaggaggattgcaggat

SEQ ID NO: 9306499 - DNA, 22 bp, Homo sapiens
tgaggcaggaggttgagaactg

SEQ ID NO: 9306500 - DNA, 22 bp, Homo sapiens
tgaggcaggagttaatgtgctc

SEQ ID NO: 9306501 - DNA, 22 bp, Homo sapiens
tgaggcaggaggttgagaactg

SEQ ID NO: 9306502 - DNA, 22 bp, Homo sapiens
tgagggagagggcgaaaatgaa

SEQ ID NO: 9306503 - DNA, 22 bp, Homo sapiens
tgagggagcacacactgaagtg

SEQ ID NO: 9306504 - DNA, 22 bp, Homo sapiens
tgagggagcacacactgaagtg

SEQ ID NO: 9306505 - DNA, 22 bp, Homo sapiens
tgagggagcacacactgaagtg

SEQ ID NO: 9306506 - DNA, 22 bp, Homo sapiens
tgagggaggccctttgagcaga

SEQ ID NO: 9306507 - DNA, 22 bp, Homo sapiens
tgagggagttgggtgtatagga

SEQ ID NO: 9306508 - DNA, 22 bp, Homo sapiens
tgagggagtcatgattaaggaa

SEQ ID NO: 9306509 - DNA, 22 bp, Homo sapiens
tgagggagtcatgattaaggaa

SEQ ID NO: 9306510 - DNA, 22 bp, Homo sapiens
tgaggggagacagagtggactc

SEQ ID NO: 9306511 - DNA, 22 bp, Homo sapiens
tgaggctgccttgggaagaggg

SEQ ID NO: 9306512 - DNA, 22 bp, Homo sapiens
tgaggctgccttgggaagaggg

SEQ ID NO: 9306513 - DNA, 22 bp, Homo sapiens
tgaggctggatgggatgcctcc

SEQ ID NO: 9306514 - DNA, 22 bp, Homo sapiens
tgaggctggatgggatgcctcc

SEQ ID NO: 9306515 - DNA, 21 bp, Homo sapiens
tgaggctgttgtaccagggag

SEQ ID NO: 9306516 - DNA, 21 bp, Homo sapiens
tgaggctgttgtaccagggag

SEQ ID NO: 9306517 - DNA, 21 bp, Homo sapiens
tgaggctgttgtaccagggag

SEQ ID NO: 9306518 - DNA, 22 bp, Homo sapiens
tgaggctggcaaggctggtatt

SEQ ID NO: 9306519 - DNA, 22 bp, Homo sapiens
tgaggctggcaaggctggtatt

SEQ ID NO: 9306520 - DNA, 22 bp, Homo sapiens
tgaggctgttctaccagggcca

SEQ ID NO: 9306521 - DNA, 22 bp, Homo sapiens
tgaggctgttctaccagggcca

SEQ ID NO: 9306522 - DNA, 22 bp, Homo sapiens
tgaggctgttctaccagggcca

SEQ ID NO: 9306523 - DNA, 20 bp, Homo sapiens
tgaggctcagagaggttgag

SEQ ID NO: 9306524 - DNA, 18 bp, Homo sapiens
tgaggctcagagacggtg

SEQ ID NO: 9306525 - DNA, 21 bp, Homo sapiens
tgaggggttataacagggtgg

SEQ ID NO: 9306526 - DNA, 22 bp, Homo sapiens
tgagggtcatttggaagtggaa

SEQ ID NO: 9306527 - DNA, 22 bp, Homo sapiens
tgagggtgcatttagcatgtag

SEQ ID NO: 9306528 - DNA, 22 bp, Homo sapiens
tgaggggcggcctgcagaggcc

SEQ ID NO: 9306529 - DNA, 22 bp, Homo sapiens
tgaggggcggcctgcagaggcc

SEQ ID NO: 9306530 - DNA, 22 bp, Homo sapiens
tgaggggccagaccccacctag

SEQ ID NO: 9306531 - DNA, 21 bp, Homo sapiens
tgaggtagccagtgagatgga

SEQ ID NO: 9306532 - DNA, 22 bp, Homo sapiens
tgagggtggccttgtgtggact

SEQ ID NO: 9306533 - DNA, 22 bp, Homo sapiens
tgagggtgggccctgggcatct

SEQ ID NO: 9306534 - DNA, 22 bp, Homo sapiens
tgagggtgtgcggcccagacag

SEQ ID NO: 9306535 - DNA, 18 bp, Homo sapiens
tgaggtagctttcctcct

SEQ ID NO: 9306536 - DNA, 22 bp, Homo sapiens
tgaggtgagtcatgcattggag

SEQ ID NO: 9306537 - DNA, 22 bp, Homo sapiens
tgagtcttcttccgggattgct

SEQ ID NO: 9306538 - DNA, 22 bp, Homo sapiens
tgagtctttccaaagccgtcat

SEQ ID NO: 9306539 - DNA, 22 bp, Homo sapiens
tgagtactcggagtgctttgga

SEQ ID NO: 9306540 - DNA, 22 bp, Homo sapiens
tgaggtggtttgtatcactggg

SEQ ID NO: 9306541 - DNA, 22 bp, Homo sapiens
tgaggtggttcaagagccttgt

SEQ ID NO: 9306542 - DNA, 22 bp, Homo sapiens
tgaggtgggtgtcaggtcagag

SEQ ID NO: 9306543 - DNA, 22 bp, Homo sapiens
tgaggtgggtgtcaggtcagag

SEQ ID NO: 9306544 - DNA, 22 bp, Homo sapiens
tgaggtggtccaaagactgttt

SEQ ID NO: 9306545 - DNA, 22 bp, Homo sapiens
tgaggtggtccaaagactgttt

SEQ ID NO: 9306546 - DNA, 22 bp, Homo sapiens
tgaggtggtgctaatctctgct

SEQ ID NO: 9306547 - DNA, 22 bp, Homo sapiens
tgaggtggttactgtggtgctc

SEQ ID NO: 9306548 - DNA, 22 bp, Homo sapiens
tgaggtggaaggatcctttgaa

SEQ ID NO: 9306549 - DNA, 22 bp, Homo sapiens
tgaggtggcacacacttcctgc

SEQ ID NO: 9306550 - DNA, 22 bp, Homo sapiens
tgaggtggccgaggagcaggac

SEQ ID NO: 9306551 - DNA, 22 bp, Homo sapiens
tgaggtggctggatctcagcct

SEQ ID NO: 9306552 - DNA, 22 bp, Homo sapiens
tgaggtgggcttgtggatttgc

SEQ ID NO: 9306553 - DNA, 22 bp, Homo sapiens
tgaggtgggtggcttctgttat

SEQ ID NO: 9306554 - DNA, 22 bp, Homo sapiens
tgaggtggctagggaggcactc

SEQ ID NO: 9306555 - DNA, 22 bp, Homo sapiens
tgaatgtgatgctaaacatatg

SEQ ID NO: 9306556 - DNA, 22 bp, Homo sapiens
tgaatgtttgatgagaaataga

SEQ ID NO: 9306557 - DNA, 22 bp, Homo sapiens
tgaatgaatcctaacaaagaca

SEQ ID NO: 9306558 - DNA, 22 bp, Homo sapiens
tgaatctttttggaaataaaga

SEQ ID NO: 9306559 - DNA, 22 bp, Homo sapiens
tgaatcatggataaatagctta

SEQ ID NO: 9306560 - DNA, 22 bp, Homo sapiens
tgaatcaatagttgcaagtatt

SEQ ID NO: 9306561 - DNA, 22 bp, Homo sapiens
tgacaaaactgcaattactttt

SEQ ID NO: 9306562 - DNA, 22 bp, Homo sapiens
tgacacaaaggaaagcataatc

SEQ ID NO: 9306563 - DNA, 22 bp, Homo sapiens
tgacaattgttgtgaattcttc

SEQ ID NO: 9306564 - DNA, 22 bp, Homo sapiens
tgaatttaagcactgatgttaa

SEQ ID NO: 9306565 - DNA, 22 bp, Homo sapiens
tgaattcttatgaaagtgcttg

SEQ ID NO: 9306566 - DNA, 22 bp, Homo sapiens
tgaattcttttagaattcagtg

SEQ ID NO: 9306567 - DNA, 22 bp, Homo sapiens
tgaagccataggacagaggata

SEQ ID NO: 9306568 - DNA, 22 bp, Homo sapiens
tgaagccatccctcagatggcc

SEQ ID NO: 9306569 - DNA, 22 bp, Homo sapiens
tgaaggagctcaatgatgatgc

SEQ ID NO: 9306570 - DNA, 22 bp, Homo sapiens
tgaaggagctcaggagatagtc

SEQ ID NO: 9306571 - DNA, 22 bp, Homo sapiens
tgaagctggaagcatgcagact

SEQ ID NO: 9306572 - DNA, 22 bp, Homo sapiens
tgaaggagggaagaaggctctg

SEQ ID NO: 9306573 - DNA, 22 bp, Homo sapiens
tgaaggaggaatgtggcctcca

SEQ ID NO: 9306574 - DNA, 22 bp, Homo sapiens
tgaaggcaaaacatgttacacc

SEQ ID NO: 9306575 - DNA, 19 bp, Homo sapiens
tgaaggagggggatggcca

SEQ ID NO: 9306576 - DNA, 22 bp, Homo sapiens
tgaaggcacgtgggtggatact

SEQ ID NO: 9306577 - DNA, 22 bp, Homo sapiens
tgaagttttctggttgattaag

SEQ ID NO: 9306578 - DNA, 21 bp, Homo sapiens
tgaaggggccatcacaaaggc

SEQ ID NO: 9306579 - DNA, 22 bp, Homo sapiens
tgaagggggagatatatgtgtg

SEQ ID NO: 9306580 - DNA, 22 bp, Homo sapiens
tgaaggggttcagcatgggggt

SEQ ID NO: 9306581 - DNA, 21 bp, Homo sapiens
tgaaggggtggcagtgtgctt

SEQ ID NO: 9306582 - DNA, 22 bp, Homo sapiens
tgacagaacaggttgggagcaa

SEQ ID NO: 9306583 - DNA, 18 bp, Homo sapiens
tgacagaacctggagcct

SEQ ID NO: 9306584 - DNA, 22 bp, Homo sapiens
tgacacatgcaccagtctttaa

SEQ ID NO: 9306585 - DNA, 22 bp, Homo sapiens
tgacagggacagtggagatgga

SEQ ID NO: 9306586 - DNA, 22 bp, Homo sapiens
tgacagggacagtggagatgga

SEQ ID NO: 9306587 - DNA, 22 bp, Homo sapiens
tgacaggcttgctaagacatag

SEQ ID NO: 9306588 - DNA, 21 bp, Homo sapiens
tgactgaggcttcttcacaca

SEQ ID NO: 9306589 - DNA, 22 bp, Homo sapiens
tgactgaaattgcattttaaaa

SEQ ID NO: 9306590 - DNA, 22 bp, Homo sapiens
tgactggattgtcattacgacg

SEQ ID NO: 9306591 - DNA, 22 bp, Homo sapiens
tgactaattgataactctgtaa

SEQ ID NO: 9306592 - DNA, 21 bp, Homo sapiens
tgacatttagtagcattgtca

SEQ ID NO: 9306593 - DNA, 22 bp, Homo sapiens
tgacatttatcttctacaatga

SEQ ID NO: 9306594 - DNA, 22 bp, Homo sapiens
tgacatttcagatatggtattt

SEQ ID NO: 9306595 - DNA, 22 bp, Homo sapiens
tgaaatgtcagtgttttataag

SEQ ID NO: 9306596 - DNA, 22 bp, Homo sapiens
tgaaatgtgttctagtgttttg

SEQ ID NO: 9306597 - DNA, 22 bp, Homo sapiens
tgaaatgttaaacaagtggctc

SEQ ID NO: 9306598 - DNA, 22 bp, Homo sapiens
tgaaatgttaatcacacaaagg

SEQ ID NO: 9306599 - DNA, 22 bp, Homo sapiens
tgaaatgtacaagtgctttttt

SEQ ID NO: 9306600 - DNA, 22 bp, Homo sapiens
tgaaatctcctctttatatatc

SEQ ID NO: 9306601 - DNA, 22 bp, Homo sapiens
tgaaatctgcatgcaaagtcct

SEQ ID NO: 9306602 - DNA, 21 bp, Homo sapiens
tgaaagttggagtcaaatgta

SEQ ID NO: 9306603 - DNA, 22 bp, Homo sapiens
tgaaatatgctcccattcactt

SEQ ID NO: 9306604 - DNA, 23 bp, Homo sapiens
tgaaagcaatgggtctatagtat

SEQ ID NO: 9306605 - DNA, 22 bp, Homo sapiens
tgaactcctgacctcatgatcc

SEQ ID NO: 9306606 - DNA, 22 bp, Homo sapiens
tgaacatgctgttgatggcctg

SEQ ID NO: 9306607 - DNA, 22 bp, Homo sapiens
tgaaattagtgaagttacagtt

SEQ ID NO: 9306608 - DNA, 22 bp, Homo sapiens
tgaaatttaggtgcagataaat

SEQ ID NO: 9306609 - DNA, 22 bp, Homo sapiens
tgaagcagatggtctggtcatt

SEQ ID NO: 9306610 - DNA, 22 bp, Homo sapiens
tgaagcaggaaccagcagcatt

SEQ ID NO: 9306611 - DNA, 19 bp, Homo sapiens
tgaagcaggcagagaagat

SEQ ID NO: 9306612 - DNA, 22 bp, Homo sapiens
tgaagcagagtgaaggtgaatt

SEQ ID NO: 9306613 - DNA, 22 bp, Homo sapiens
tgaaaattaagcagatgaatga

SEQ ID NO: 9306614 - DNA, 22 bp, Homo sapiens
tgaaaattcatctcatagcaga

SEQ ID NO: 9306615 - DNA, 22 bp, Homo sapiens
tgaaaattgttgtacttgataa

SEQ ID NO: 9306616 - DNA, 22 bp, Homo sapiens
tgaaaattctcaggctcacccc

SEQ ID NO: 9306617 - DNA, 22 bp, Homo sapiens
tgaaaatttccatcagttatat

SEQ ID NO: 9306618 - DNA, 22 bp, Homo sapiens
tgaaaatttccatcagttatat

SEQ ID NO: 9306619 - DNA, 22 bp, Homo sapiens
tgaaaatatagttttccagact

SEQ ID NO: 9306620 - DNA, 22 bp, Homo sapiens
tgaaaaacctcagtccgcttta

SEQ ID NO: 9306621 - DNA, 22 bp, Homo sapiens
tgaaaacagaatccttgttttc

SEQ ID NO: 9306622 - DNA, 23 bp, Homo sapiens
tctttttaagagatctagtgacg

SEQ ID NO: 9306623 - DNA, 23 bp, Homo sapiens
tgaaacatttagggtagaatttc

SEQ ID NO: 9306624 - DNA, 22 bp, Homo sapiens
tgaaacttttgaggttcttcca

SEQ ID NO: 9306625 - DNA, 22 bp, Homo sapiens
tgaaacttattcagtttctacc

SEQ ID NO: 9306626 - DNA, 22 bp, Homo sapiens
tgaaagaactagcatcttcaag

SEQ ID NO: 9306627 - DNA, 22 bp, Homo sapiens
tcttttattaggctgaaatggg

SEQ ID NO: 9306628 - DNA, 22 bp, Homo sapiens
tcttttatctgttgtgtaacaa

SEQ ID NO: 9306629 - DNA, 22 bp, Homo sapiens
tcttttatcctacatttagctc

SEQ ID NO: 9306630 - DNA, 20 bp, Homo sapiens
tcttttattggcagatcctg

SEQ ID NO: 9306631 - DNA, 23 bp, Homo sapiens
tcttttcaatggttctttatgtg

SEQ ID NO: 9306632 - DNA, 19 bp, Homo sapiens
tcttttcacgcattttgaa

SEQ ID NO: 9306633 - DNA, 22 bp, Homo sapiens
tctttgtttgcctttatcaaga

SEQ ID NO: 9306634 - DNA, 22 bp, Homo sapiens
tctttgtttgtactgttagaat

SEQ ID NO: 9306635 - DNA, 22 bp, Homo sapiens
tctttgttattgctttatctat

SEQ ID NO: 9306636 - DNA, 20 bp, Homo sapiens
tctttgttaattttatctcc

SEQ ID NO: 9306637 - DNA, 22 bp, Homo sapiens
tcttttatagtgaattttcttg

SEQ ID NO: 9306638 - DNA, 22 bp, Homo sapiens
tctttgtaagttatatgtagta

SEQ ID NO: 9306639 - DNA, 22 bp, Homo sapiens
tctttggcatttaggagcagga

SEQ ID NO: 9306640 - DNA, 22 bp, Homo sapiens
tctttggcatcagggccagcta

SEQ ID NO: 9306641 - DNA, 22 bp, Homo sapiens
tctttgtaactgtctattgaga

SEQ ID NO: 9306642 - DNA, 22 bp, Homo sapiens
tgcaggtgtctccagggcaggt

SEQ ID NO: 9306643 - DNA, 22 bp, Homo sapiens
tgcaggtggtttggacactgct

SEQ ID NO: 9306644 - DNA, 22 bp, Homo sapiens
tgcaggtggtttggacactgct

SEQ ID NO: 9306645 - DNA, 22 bp, Homo sapiens
tgcaggtgtgtgcaagggaggg

SEQ ID NO: 9306646 - DNA, 20 bp, Homo sapiens
tgcaggtgttggagaaggta

SEQ ID NO: 9306647 - DNA, 22 bp, Homo sapiens
tgcaggtgtgggcaggggagca

SEQ ID NO: 9306648 - DNA, 22 bp, Homo sapiens
tgcaggtgaaaattatgaggat

SEQ ID NO: 9306649 - DNA, 22 bp, Homo sapiens
tgcaggtctccattggcagact

SEQ ID NO: 9306650 - DNA, 22 bp, Homo sapiens
tgcaggtctctgcaaggcctat

SEQ ID NO: 9306651 - DNA, 22 bp, Homo sapiens
tgcaggtcatgtggcgggactg

SEQ ID NO: 9306652 - DNA, 22 bp, Homo sapiens
tgcaggtcaatcttcaggttcc

SEQ ID NO: 9306653 - DNA, 22 bp, Homo sapiens
tgcaggtcatccctgtgcttct

SEQ ID NO: 9306654 - DNA, 22 bp, Homo sapiens
tgcaggtctatttaaatgattg

SEQ ID NO: 9306655 - DNA, 22 bp, Homo sapiens
tgcaggtggcagcggggcacca

SEQ ID NO: 9306656 - DNA, 22 bp, Homo sapiens
tgcaggtggctccagggactgc

SEQ ID NO: 9306657 - DNA, 22 bp, Homo sapiens
tgcaggtgattctgatgcagtt

SEQ ID NO: 9306658 - DNA, 22 bp, Homo sapiens
tgcaggtggacacgggagacgg

SEQ ID NO: 9306659 - DNA, 22 bp, Homo sapiens
tgcaggtggacacgggagacgg

SEQ ID NO: 9306660 - DNA, 20 bp, Homo sapiens
tgcagggctgcctcccagct

SEQ ID NO: 9306661 - DNA, 23 bp, Homo sapiens
tgcaggggaggcttaaagcaggt

SEQ ID NO: 9306662 - DNA, 22 bp, Homo sapiens
tgcaggggcttgtctgggcctg

SEQ ID NO: 9306663 - DNA, 22 bp, Homo sapiens
tgcagggcccctctgcatgagt

SEQ ID NO: 9306664 - DNA, 22 bp, Homo sapiens
tgcagggccgctggaggtcatg

SEQ ID NO: 9306665 - DNA, 22 bp, Homo sapiens
tgcagggctataactccattct

SEQ ID NO: 9306666 - DNA, 22 bp, Homo sapiens
tgcagggccgctggaggtcatg

SEQ ID NO: 9306667 - DNA, 22 bp, Homo sapiens
tgcagggcatagggtccagttt

SEQ ID NO: 9306668 - DNA, 22 bp, Homo sapiens
tgcaggcttggatcacatctcc

SEQ ID NO: 9306669 - DNA, 20 bp, Homo sapiens
tgcaggcttcgctctaggag

SEQ ID NO: 9306670 - DNA, 20 bp, Homo sapiens
tgcaggcttcgctctaggag

SEQ ID NO: 9306671 - DNA, 22 bp, Homo sapiens
tgcaggctgtttggtggatctc

SEQ ID NO: 9306672 - DNA, 21 bp, Homo sapiens
tgcaggctgtgcgctcctgcc

SEQ ID NO: 9306673 - DNA, 21 bp, Homo sapiens
tgcaggctgtgcgctcctgcc

SEQ ID NO: 9306674 - DNA, 21 bp, Homo sapiens
tgcaggctgtttaagaggcaa

SEQ ID NO: 9306675 - DNA, 17 bp, Homo sapiens
tgcaggctgttatagcc

SEQ ID NO: 9306676 - DNA, 22 bp, Homo sapiens
tgcaggctgtgtcatttagtga

SEQ ID NO: 9306677 - DNA, 18 bp, Homo sapiens
tgcaggctgttgaaactg

SEQ ID NO: 9306678 - DNA, 22 bp, Homo sapiens
tgcaggctgtaatctgaggcta

SEQ ID NO: 9306679 - DNA, 22 bp, Homo sapiens
tgcaggctggggaggcagactt

SEQ ID NO: 9306680 - DNA, 22 bp, Homo sapiens
tgcaggctggcagtgctgaaat

SEQ ID NO: 9306681 - DNA, 22 bp, Homo sapiens
tgcaggctgccttcacagagcc

SEQ ID NO: 9306682 - DNA, 22 bp, Homo sapiens
tgcaggctggaggagggactaa

SEQ ID NO: 9306683 - DNA, 22 bp, Homo sapiens
tgcaggctgctggcagtagctt

SEQ ID NO: 9306684 - DNA, 22 bp, Homo sapiens
tgcaggctctggtttatagtgc

SEQ ID NO: 9306685 - DNA, 22 bp, Homo sapiens
tgcaggctctgtgtgtgcctgg

SEQ ID NO: 9306686 - DNA, 22 bp, Homo sapiens
tgcaggctctgtgtgtgcctgg

SEQ ID NO: 9306687 - DNA, 22 bp, Homo sapiens
tgcaggctgcagtctcaggtgg

SEQ ID NO: 9306688 - DNA, 22 bp, Homo sapiens
tgcaggctgcacccctgccctg

SEQ ID NO: 9306689 - DNA, 22 bp, Homo sapiens
tgcaggctgcacccctgccctg

SEQ ID NO: 9306690 - DNA, 22 bp, Homo sapiens
tgcaggctgaggctggctcaac

SEQ ID NO: 9306691 - DNA, 17 bp, Homo sapiens
tgcaggctcctgtccct

SEQ ID NO: 9306692 - DNA, 22 bp, Homo sapiens
tgcaggctccatgaggacaggc

SEQ ID NO: 9306693 - DNA, 22 bp, Homo sapiens
tgcaggctctctgctgccagat

SEQ ID NO: 9306694 - DNA, 22 bp, Homo sapiens
tgcaggctctctgctgccagat

SEQ ID NO: 9306695 - DNA, 17 bp, Homo sapiens
tgcaggctcctgtccct

SEQ ID NO: 9306696 - DNA, 22 bp, Homo sapiens
tgcatcttggaagattgcacaa

SEQ ID NO: 9306697 - DNA, 22 bp, Homo sapiens
tgcattccacataaagcgataa

SEQ ID NO: 9306698 - DNA, 22 bp, Homo sapiens
tgcattccacacccatagagat

SEQ ID NO: 9306699 - DNA, 21 bp, Homo sapiens
tgcataaagaaatacaaatac

SEQ ID NO: 9306700 - DNA, 22 bp, Homo sapiens
tgcataaacttctctggtgtga

SEQ ID NO: 9306701 - DNA, 22 bp, Homo sapiens
tgcataaacagatacttcatgt

SEQ ID NO: 9306702 - DNA, 22 bp, Homo sapiens
tgcataaagtgccatagtatta

SEQ ID NO: 9306703 - DNA, 19 bp, Homo sapiens
tgcataaattatatacttt

SEQ ID NO: 9306704 - DNA, 22 bp, Homo sapiens
tgcatacacaagcatacatgta

SEQ ID NO: 9306705 - DNA, 22 bp, Homo sapiens
tgcatacacatgtgcacatacg

SEQ ID NO: 9306706 - DNA, 22 bp, Homo sapiens
tgcatcctagggaaggcactga

SEQ ID NO: 9306707 - DNA, 22 bp, Homo sapiens
tgccagagagtggctgggtgtc

SEQ ID NO: 9306708 - DNA, 22 bp, Homo sapiens
tgccaagagggcagagggcagt

SEQ ID NO: 9306709 - DNA, 17 bp, Homo sapiens
tgccaagaagagcagag

SEQ ID NO: 9306710 - DNA, 22 bp, Homo sapiens
tgccactggctcaatggtgcag

SEQ ID NO: 9306711 - DNA, 22 bp, Homo sapiens
tgccactggggctaggactgtt

SEQ ID NO: 9306712 - DNA, 23 bp, Homo sapiens
tgccacccttctcttcccagctt

SEQ ID NO: 9306713 - DNA, 22 bp, Homo sapiens
tgcatttgtaacattcaagaat

SEQ ID NO: 9306714 - DNA, 22 bp, Homo sapiens
tgcatttgaagtcagacaggct

SEQ ID NO: 9306715 - DNA, 22 bp, Homo sapiens
tgcatttatggagttacctcat

SEQ ID NO: 9306716 - DNA, 22 bp, Homo sapiens
tgcatttataaaatgttcgtgg

SEQ ID NO: 9306717 - DNA, 22 bp, Homo sapiens
tgcatttatgtctcccaccagc

SEQ ID NO: 9306718 - DNA, 22 bp, Homo sapiens
tgcatttattaccaggctttca

SEQ ID NO: 9306719 - DNA, 22 bp, Homo sapiens
tgcattgttgaatatttcatag

SEQ ID NO: 9306720 - DNA, 22 bp, Homo sapiens
tgcatttaatagatgctccctg

SEQ ID NO: 9306721 - DNA, 22 bp, Homo sapiens
tgcatttaactagaatattaat

SEQ ID NO: 9306722 - DNA, 22 bp, Homo sapiens
tgcatttaagaaaacatgagtc

SEQ ID NO: 9306723 - DNA, 22 bp, Homo sapiens
tgcattcctttgtctgttaaag

SEQ ID NO: 9306724 - DNA, 22 bp, Homo sapiens
tgcattcctttctaggatagct

SEQ ID NO: 9306725 - DNA, 22 bp, Homo sapiens
tgcattcctccacctcctgcac

SEQ ID NO: 9306726 - DNA, 21 bp, Homo sapiens
tgcattcctccatccaacagg

SEQ ID NO: 9306727 - DNA, 22 bp, Homo sapiens
tgccagcctggcctgagtcttt

SEQ ID NO: 9306728 - DNA, 22 bp, Homo sapiens
tgccaggcaactgcccagccat

SEQ ID NO: 9306729 - DNA, 22 bp, Homo sapiens
tgccatcttctctggggatgtt

SEQ ID NO: 9306730 - DNA, 22 bp, Homo sapiens
tgccagggtcctgagggccttg

SEQ ID NO: 9306731 - DNA, 22 bp, Homo sapiens
tgccagggaccctgtcggccct

SEQ ID NO: 9306732 - DNA, 20 bp, Homo sapiens
tgccaggctgcacgcctgcc

SEQ ID NO: 9306733 - DNA, 22 bp, Homo sapiens
tgccccctggtggccagagccg

SEQ ID NO: 9306734 - DNA, 19 bp, Homo sapiens
tgccatgtttaagcaattt

SEQ ID NO: 9306735 - DNA, 22 bp, Homo sapiens
tgcccaaggtcacctagttagt

SEQ ID NO: 9306736 - DNA, 22 bp, Homo sapiens
tgcccaaggtggccttttactc

SEQ ID NO: 9306737 - DNA, 22 bp, Homo sapiens
tgcccagcactgtgccagtcac

SEQ ID NO: 9306738 - DNA, 22 bp, Homo sapiens
tgcccagcagggagctacctgg

SEQ ID NO: 9306739 - DNA, 22 bp, Homo sapiens
tgcccctgacctcaggcgaagg

SEQ ID NO: 9306740 - DNA, 19 bp, Homo sapiens
tgcccctgcagtctaccca

SEQ ID NO: 9306741 - DNA, 22 bp, Homo sapiens
tgcccctgatgcctagaacaga

SEQ ID NO: 9306742 - DNA, 22 bp, Homo sapiens
tgccctggaggggcttacagtc

SEQ ID NO: 9306743 - DNA, 22 bp, Homo sapiens
tgccctggcttcagctttggct

SEQ ID NO: 9306744 - DNA, 22 bp, Homo sapiens
tgccctgggaacacagatgcca

SEQ ID NO: 9306745 - DNA, 22 bp, Homo sapiens
tgcccttacacatggaaaggga

SEQ ID NO: 9306746 - DNA, 22 bp, Homo sapiens
tgcccttatgaaagaggcccaa

SEQ ID NO: 9306747 - DNA, 22 bp, Homo sapiens
tgcccttataaaggaggcctga

SEQ ID NO: 9306748 - DNA, 22 bp, Homo sapiens
tgcccttaggaaggctcaccaa

SEQ ID NO: 9306749 - DNA, 22 bp, Homo sapiens
tgccgcagtgcggggagggccc

SEQ ID NO: 9306750 - DNA, 22 bp, Homo sapiens
tgccgcagtgcggggagggccc

SEQ ID NO: 9306751 - DNA, 22 bp, Homo sapiens
tgccgcagtgcggggagggccc

SEQ ID NO: 9306752 - DNA, 22 bp, Homo sapiens
tgcctctgtgggccttcctggc

SEQ ID NO: 9306753 - DNA, 22 bp, Homo sapiens
tgcctctggttatctggtacct

SEQ ID NO: 9306754 - DNA, 22 bp, Homo sapiens
tgcctctgctgctgtggcatca

SEQ ID NO: 9306755 - DNA, 22 bp, Homo sapiens
tgcctgaattcaattcctggct

SEQ ID NO: 9306756 - DNA, 22 bp, Homo sapiens
tgcctgaatgatcagtcagatt

SEQ ID NO: 9306757 - DNA, 22 bp, Homo sapiens
tgcctgaacatgaatagtttat

SEQ ID NO: 9306758 - DNA, 22 bp, Homo sapiens
tgcctctgttgagccttggctg

SEQ ID NO: 9306759 - DNA, 22 bp, Homo sapiens
tgcctcttggagcctttcctct

SEQ ID NO: 9306760 - DNA, 22 bp, Homo sapiens
tgcctccctctctgccactgga

SEQ ID NO: 9306761 - DNA, 22 bp, Homo sapiens
tgcctccctctctgccactgga

SEQ ID NO: 9306762 - DNA, 22 bp, Homo sapiens
tgcctcagctgaggccgctcca

SEQ ID NO: 9306763 - DNA, 22 bp, Homo sapiens
tgcctcagagtgggcttgctat

SEQ ID NO: 9306764 - DNA, 22 bp, Homo sapiens
tgcctcagagttgtccctacca

SEQ ID NO: 9306765 - DNA, 19 bp, Homo sapiens
tgcctggcaccagctccac

SEQ ID NO: 9306766 - DNA, 19 bp, Homo sapiens
tgcctggcaccagctccac

SEQ ID NO: 9306767 - DNA, 22 bp, Homo sapiens
tgcctggcaatgccagaagcca

SEQ ID NO: 9306768 - DNA, 22 bp, Homo sapiens
tgcctggcaatgccagaagcca

SEQ ID NO: 9306769 - DNA, 22 bp, Homo sapiens
tgcctggcacagagcaggtggc

SEQ ID NO: 9306770 - DNA, 22 bp, Homo sapiens
tgcctggcaccccagtctgcac

SEQ ID NO: 9306771 - DNA, 22 bp, Homo sapiens
tgcctggcactcctggagctca

SEQ ID NO: 9306772 - DNA, 22 bp, Homo sapiens
tgcctggcatctagccctggga

SEQ ID NO: 9306773 - DNA, 22 bp, Homo sapiens
tgcctggcatctagccctggga

SEQ ID NO: 9306774 - DNA, 22 bp, Homo sapiens
tgcctggcagcttgaaagaaat

SEQ ID NO: 9306775 - DNA, 22 bp, Homo sapiens
tgcctggcaactgtggtgggct

SEQ ID NO: 9306776 - DNA, 22 bp, Homo sapiens
tgcctggattcaaagctcatgt

SEQ ID NO: 9306777 - DNA, 22 bp, Homo sapiens
tgcctggcaagaggggctggct

SEQ ID NO: 9306778 - DNA, 22 bp, Homo sapiens
tgcctggcaagaggggctggct

SEQ ID NO: 9306779 - DNA, 22 bp, Homo sapiens
tgcctggcaatgccagaagcca

SEQ ID NO: 9306780 - DNA, 22 bp, Homo sapiens
tgcctgctgccactgctgttac

SEQ ID NO: 9306781 - DNA, 22 bp, Homo sapiens
tgcctgctgattggagttgaat

SEQ ID NO: 9306782 - DNA, 20 bp, Homo sapiens
tgcctgcccaggtcctgcac

SEQ ID NO: 9306783 - DNA, 19 bp, Homo sapiens
tgcctgctgtattccagag

SEQ ID NO: 9306784 - DNA, 22 bp, Homo sapiens
tgcctgcttgtttacctactcc

SEQ ID NO: 9306785 - DNA, 22 bp, Homo sapiens
tgcctgcttgtgtacctggtga

SEQ ID NO: 9306786 - DNA, 22 bp, Homo sapiens
tgcctgctgcctttcatcccaa

SEQ ID NO: 9306787 - DNA, 22 bp, Homo sapiens
tgcctgctgcctttcatcccaa

SEQ ID NO: 9306788 - DNA, 22 bp, Homo sapiens
tgcctgctgctaagctctttgt

SEQ ID NO: 9306789 - DNA, 22 bp, Homo sapiens
tgcctgctttctcctcaactca

SEQ ID NO: 9306790 - DNA, 22 bp, Homo sapiens
tgcctgctttctgggctgccat

SEQ ID NO: 9306791 - DNA, 17 bp, Homo sapiens
tgcctgccagcattgga

SEQ ID NO: 9306792 - DNA, 22 bp, Homo sapiens
tgcctgcatcttggaggcccca

SEQ ID NO: 9306793 - DNA, 22 bp, Homo sapiens
tgattcacagacttcacaaggc

SEQ ID NO: 9306794 - DNA, 22 bp, Homo sapiens
tgattacaattgtcttagattt

SEQ ID NO: 9306795 - DNA, 22 bp, Homo sapiens
tgatggtgggtctgatctcata

SEQ ID NO: 9306796 - DNA, 22 bp, Homo sapiens
tgatggtgatggttgcacaatg

SEQ ID NO: 9306797 - DNA, 22 bp, Homo sapiens
tgatgtttaatactatgctttt

SEQ ID NO: 9306798 - DNA, 22 bp, Homo sapiens
tgattaaattaattaagatgag

SEQ ID NO: 9306799 - DNA, 22 bp, Homo sapiens
tgatgttattagatacaaacca

SEQ ID NO: 9306800 - DNA, 22 bp, Homo sapiens
tgatgttatggtactattcatt

SEQ ID NO: 9306801 - DNA, 22 bp, Homo sapiens
tgatgttctgtatatcatatag

SEQ ID NO: 9306802 - DNA, 22 bp, Homo sapiens
tgattctgtctccttcactccg

SEQ ID NO: 9306803 - DNA, 22 bp, Homo sapiens
tgattctatggaaggcataagg

SEQ ID NO: 9306804 - DNA, 22 bp, Homo sapiens
tgattcctaggcactcttctcc

SEQ ID NO: 9306805 - DNA, 23 bp, Homo sapiens
tgatgcagtaaattggtctctaa

SEQ ID NO: 9306806 - DNA, 22 bp, Homo sapiens
tgatgcagtgtcctcccatgca

SEQ ID NO: 9306807 - DNA, 22 bp, Homo sapiens
tgatgatttcatttctagctgt

SEQ ID NO: 9306808 - DNA, 22 bp, Homo sapiens
tgatgatgtttatcttggtatt

SEQ ID NO: 9306809 - DNA, 22 bp, Homo sapiens
tgatgaaaatgttcagcaatta

SEQ ID NO: 9306810 - DNA, 22 bp, Homo sapiens
tgatgaaagtgtttactcacct

SEQ ID NO: 9306811 - DNA, 18 bp, Homo sapiens
tgatggaggagggctggt

SEQ ID NO: 9306812 - DNA, 18 bp, Homo sapiens
tgatggaggagggctggt

SEQ ID NO: 9306813 - DNA, 22 bp, Homo sapiens
tgatctaggttggcttcaactg

SEQ ID NO: 9306814 - DNA, 22 bp, Homo sapiens
tgatcccaatctttcctgctcc

SEQ ID NO: 9306815 - DNA, 22 bp, Homo sapiens
tgatctggtcctactgtgggca

SEQ ID NO: 9306816 - DNA, 22 bp, Homo sapiens
tgatcagcatcttcccagctcg

SEQ ID NO: 9306817 - DNA, 22 bp, Homo sapiens
tgatattttatgagctttcata

SEQ ID NO: 9306818 - DNA, 22 bp, Homo sapiens
tgatatttttcactggcctctg

SEQ ID NO: 9306819 - DNA, 22 bp, Homo sapiens
tgatacttttcttttagactaa

SEQ ID NO: 9306820 - DNA, 22 bp, Homo sapiens
tgataggcttaattttcctgtc

SEQ ID NO: 9306821 - DNA, 20 bp, Homo sapiens
tgatatttctggaagtggag

SEQ ID NO: 9306822 - DNA, 22 bp, Homo sapiens
tgatatttaagcaaaaatatgg

SEQ ID NO: 9306823 - DNA, 22 bp, Homo sapiens
tgatatttgctgactgcattgt

SEQ ID NO: 9306824 - DNA, 22 bp, Homo sapiens
tgatatgtgaagctattagttc

SEQ ID NO: 9306825 - DNA, 22 bp, Homo sapiens
tgatatctgaagtgtataaaca

SEQ ID NO: 9306826 - DNA, 23 bp, Homo sapiens
tgagtgtggggacagtggtttgc

SEQ ID NO: 9306827 - DNA, 22 bp, Homo sapiens
tgagttagtcactttgtacatc

SEQ ID NO: 9306828 - DNA, 22 bp, Homo sapiens
tgagttagaagttccgtttctt

SEQ ID NO: 9306829 - DNA, 22 bp, Homo sapiens
tgagttagaggctgtattagtt

SEQ ID NO: 9306830 - DNA, 22 bp, Homo sapiens
tgagtcttttatcctgggaatg

SEQ ID NO: 9306831 - DNA, 22 bp, Homo sapiens
tgagtcttttcattgtgtggat

SEQ ID NO: 9306832 - DNA, 22 bp, Homo sapiens
tgcaatgagaatatattaacca

SEQ ID NO: 9306833 - DNA, 22 bp, Homo sapiens
tgcacacaaatgtgaacgtgcc

SEQ ID NO: 9306834 - DNA, 22 bp, Homo sapiens
tgcacacaagttggagaatgaa

SEQ ID NO: 9306835 - DNA, 22 bp, Homo sapiens
tgcacacacacgtagagaaaag

SEQ ID NO: 9306836 - DNA, 22 bp, Homo sapiens
tgcacacaggtctaggacatgg

SEQ ID NO: 9306837 - DNA, 22 bp, Homo sapiens
tgcacacagctgggcctggctg

SEQ ID NO: 9306838 - DNA, 19 bp, Homo sapiens
tgcacacagataagtatct

SEQ ID NO: 9306839 - DNA, 22 bp, Homo sapiens
tgcacacagccagtgagtggca

SEQ ID NO: 9306840 - DNA, 22 bp, Homo sapiens
tgcacacagccagtgagtggca

SEQ ID NO: 9306841 - DNA, 22 bp, Homo sapiens
tgcacacagatggtacatgcat

SEQ ID NO: 9306842 - DNA, 22 bp, Homo sapiens
tgcacacactcgtgtatatgag

SEQ ID NO: 9306843 - DNA, 20 bp, Homo sapiens
tgcacacagaaatttgcatt

SEQ ID NO: 9306844 - DNA, 22 bp, Homo sapiens
tgcacacactctgcatatactt

SEQ ID NO: 9306845 - DNA, 22 bp, Homo sapiens
tgcacacacggagataggcttt

SEQ ID NO: 9306846 - DNA, 22 bp, Homo sapiens
tgcacacacggagataggcttt

SEQ ID NO: 9306847 - DNA, 22 bp, Homo sapiens
tgcacacacgcggcacatctgt

SEQ ID NO: 9306848 - DNA, 22 bp, Homo sapiens
tgcacacaccgtgcttcactga

SEQ ID NO: 9306849 - DNA, 20 bp, Homo sapiens
tgcacacaccctgtcctcca

SEQ ID NO: 9306850 - DNA, 22 bp, Homo sapiens
tgcacacacatgcagagggaga

SEQ ID NO: 9306851 - DNA, 22 bp, Homo sapiens
tgcacacacatgaagtagcatg

SEQ ID NO: 9306852 - DNA, 22 bp, Homo sapiens
tgcacacacaggagtctcctcc

SEQ ID NO: 9306853 - DNA, 22 bp, Homo sapiens
tgcaacaggctgtgacatggaa

SEQ ID NO: 9306854 - DNA, 22 bp, Homo sapiens
tgcaagtaattccagctactga

SEQ ID NO: 9306855 - DNA, 22 bp, Homo sapiens
tgcaagtaacttgtttgggagg

SEQ ID NO: 9306856 - DNA, 22 bp, Homo sapiens
tgcaagtaaccatcactatctc

SEQ ID NO: 9306857 - DNA, 21 bp, Homo sapiens
tgcaagcctctgtgagattct

SEQ ID NO: 9306858 - DNA, 22 bp, Homo sapiens
tgattttattggtgaggaaatt

SEQ ID NO: 9306859 - DNA, 22 bp, Homo sapiens
tgcaaaataatgaacgattttt

SEQ ID NO: 9306860 - DNA, 22 bp, Homo sapiens
tgatttatgcattatactgttg

SEQ ID NO: 9306861 - DNA, 22 bp, Homo sapiens
tgatttatgaccaagttagaat

SEQ ID NO: 9306862 - DNA, 22 bp, Homo sapiens
tgcaaaataatgaacgattttt

SEQ ID NO: 9306863 - DNA, 22 bp, Homo sapiens
tgcaggagcagagatggctgga

SEQ ID NO: 9306864 - DNA, 22 bp, Homo sapiens
tgcaggagaaagtacggagcgt

SEQ ID NO: 9306865 - DNA, 22 bp, Homo sapiens
tgcagctgtgcctgaaaagtac

SEQ ID NO: 9306866 - DNA, 21 bp, Homo sapiens
tgcaggctacttctgactcta

SEQ ID NO: 9306867 - DNA, 21 bp, Homo sapiens
tgcaggctacttctgactcta

SEQ ID NO: 9306868 - DNA, 22 bp, Homo sapiens
tgcaggctatatcttatttgac

SEQ ID NO: 9306869 - DNA, 22 bp, Homo sapiens
tgcaggctatcctttgctgcaa

SEQ ID NO: 9306870 - DNA, 22 bp, Homo sapiens
tgcaggctatcctttgctgcaa

SEQ ID NO: 9306871 - DNA, 22 bp, Homo sapiens
tgcaggctcaccctggagctga

SEQ ID NO: 9306872 - DNA, 22 bp, Homo sapiens
tgcaggctccaggtgcacatat

SEQ ID NO: 9306873 - DNA, 22 bp, Homo sapiens
tgcaggctccaggtgcacatat

SEQ ID NO: 9306874 - DNA, 22 bp, Homo sapiens
tgcaggctccacgttgttgtcc

SEQ ID NO: 9306875 - DNA, 22 bp, Homo sapiens
tgcaggcagctaaaccatgtaa

SEQ ID NO: 9306876 - DNA, 22 bp, Homo sapiens
tgcaggcagctgaaaggtgcct

SEQ ID NO: 9306877 - DNA, 22 bp, Homo sapiens
tgcaggagctgtgcggtgaggg

SEQ ID NO: 9306878 - DNA, 22 bp, Homo sapiens
tgcaggagcccttgggctctgg

SEQ ID NO: 9306879 - DNA, 19 bp, Homo sapiens
tgcaggaggactgagcaga

SEQ ID NO: 9306880 - DNA, 22 bp, Homo sapiens
tgcaggagtccaatcaggagac

SEQ ID NO: 9306881 - DNA, 17 bp, Homo sapiens
tgcagctgctcccaggc

SEQ ID NO: 9306882 - DNA, 17 bp, Homo sapiens
tgcagctgatggggaaa

SEQ ID NO: 9306883 - DNA, 22 bp, Homo sapiens
tgcagctggtttagaactagat

SEQ ID NO: 9306884 - DNA, 22 bp, Homo sapiens
tgcagctggaacttagaggaga

SEQ ID NO: 9306885 - DNA, 22 bp, Homo sapiens
tgcagccttggcaaccagggac

SEQ ID NO: 9306886 - DNA, 22 bp, Homo sapiens
tgcagctcattgctggggtctg

SEQ ID NO: 9306887 - DNA, 21 bp, Homo sapiens
tgcagcctctgcccagcagtg

SEQ ID NO: 9306888 - DNA, 22 bp, Homo sapiens
tgcagccatctttcttggagga

SEQ ID NO: 9306889 - DNA, 22 bp, Homo sapiens
tgcagcagggcccaggcacaga

SEQ ID NO: 9306890 - DNA, 22 bp, Homo sapiens
tgcagcagaatatggctgcagg

SEQ ID NO: 9306891 - DNA, 21 bp, Homo sapiens
tgcagcagagtaagcagggga

SEQ ID NO: 9306892 - DNA, 22 bp, Homo sapiens
tgcagcagagtgggcctgggtg

SEQ ID NO: 9306893 - DNA, 22 bp, Homo sapiens
tgcagcagagtgggcctgggtg

SEQ ID NO: 9306894 - DNA, 22 bp, Homo sapiens
tgcagcagcagggaggaggctc

SEQ ID NO: 9306895 - DNA, 21 bp, Homo sapiens
tgcagcagatttgggggaaga

SEQ ID NO: 9306896 - DNA, 22 bp, Homo sapiens
tgcacaggtgagactcaggaag

SEQ ID NO: 9306897 - DNA, 22 bp, Homo sapiens
tgcacacagtggacaagtcttg

SEQ ID NO: 9306898 - DNA, 22 bp, Homo sapiens
tgcacacagttctcaggaaaga

SEQ ID NO: 9306899 - DNA, 22 bp, Homo sapiens
tgcacacatacatgggaagtgc

SEQ ID NO: 9306900 - DNA, 22 bp, Homo sapiens
tgcacaggtgagactcaggaag

SEQ ID NO: 9306901 - DNA, 22 bp, Homo sapiens
tgcacaggtggtccatctgcac

SEQ ID NO: 9306902 - DNA, 22 bp, Homo sapiens
tgcagaacgggtcttctagcac

SEQ ID NO: 9306903 - DNA, 22 bp, Homo sapiens
tgcagaaagtcacattcccttt

SEQ ID NO: 9306904 - DNA, 22 bp, Homo sapiens
tgcagaaaccaattcaagtaag

SEQ ID NO: 9306905 - DNA, 21 bp, Homo sapiens
tgcagaaatggtttttctaag

SEQ ID NO: 9306906 - DNA, 22 bp, Homo sapiens
tgcacgtgggctctctgctctt

SEQ ID NO: 9306907 - DNA, 22 bp, Homo sapiens
tgcacgtgtgagcattcacatg

SEQ ID NO: 9306908 - DNA, 22 bp, Homo sapiens
tgcagaaacaagccatcattca

SEQ ID NO: 9306909 - DNA, 22 bp, Homo sapiens
tgcagaggcgccgtgggtgggg

SEQ ID NO: 9306910 - DNA, 22 bp, Homo sapiens
tgcagaggcgccgtgggtgggg

SEQ ID NO: 9306911 - DNA, 22 bp, Homo sapiens
tgcagaggctggctcgccgggt

SEQ ID NO: 9306912 - DNA, 22 bp, Homo sapiens
tgcagagggaaaaggtgctcct

SEQ ID NO: 9306913 - DNA, 22 bp, Homo sapiens
tgcagaggagctggaaggctgg

SEQ ID NO: 9306914 - DNA, 22 bp, Homo sapiens
tgcagaggagctggaaggctgg

SEQ ID NO: 9306915 - DNA, 22 bp, Homo sapiens
tgcagaggagtcagcctgggca

SEQ ID NO: 9306916 - DNA, 21 bp, Homo sapiens
tgcagagatatctgaagcaga

SEQ ID NO: 9306917 - DNA, 21 bp, Homo sapiens
tgcagagatatctgaagcaga

SEQ ID NO: 9306918 - DNA, 22 bp, Homo sapiens
tgcagacagagaaatgaggccc

SEQ ID NO: 9306919 - DNA, 22 bp, Homo sapiens
tgcagagatttggctcttaaag

SEQ ID NO: 9306920 - DNA, 22 bp, Homo sapiens
tgcagaggagctggaaggctgg

SEQ ID NO: 9306921 - DNA, 19 bp, Homo sapiens
tgcagagggtaggaaggcc

SEQ ID NO: 9306922 - DNA, 19 bp, Homo sapiens
tgcagagggtaggaaggcc

SEQ ID NO: 9306923 - DNA, 21 bp, Homo sapiens
tgcagataattgaaagctgac

SEQ ID NO: 9306924 - DNA, 22 bp, Homo sapiens
tgcagatgaatgctgagacact

SEQ ID NO: 9306925 - DNA, 21 bp, Homo sapiens
tgcagataattgaaagctgac

SEQ ID NO: 9306926 - DNA, 22 bp, Homo sapiens
tgcagatggggatcagtggctc

SEQ ID NO: 9306927 - DNA, 21 bp, Homo sapiens
tgcagcagaagtctctgtgtc

SEQ ID NO: 9306928 - DNA, 19 bp, Homo sapiens
tctctgcttctcttggcat

SEQ ID NO: 9306929 - DNA, 20 bp, Homo sapiens
tctctgctgtccacatttgc

SEQ ID NO: 9306930 - DNA, 22 bp, Homo sapiens
tctctgctctgtgcctcagttt

SEQ ID NO: 9306931 - DNA, 22 bp, Homo sapiens
tctctgctcaggcaccagccct

SEQ ID NO: 9306932 - DNA, 22 bp, Homo sapiens
tctctgctaagattgtgtctag

SEQ ID NO: 9306933 - DNA, 19 bp, Homo sapiens
tctctgccgatcagggccc

SEQ ID NO: 9306934 - DNA, 19 bp, Homo sapiens
tctctggcagttcagagca

SEQ ID NO: 9306935 - DNA, 22 bp, Homo sapiens
tctctggcagaggccctatccc

SEQ ID NO: 9306936 - DNA, 22 bp, Homo sapiens
tctctggcagaggccctatccc

SEQ ID NO: 9306937 - DNA, 22 bp, Homo sapiens
tctctgggggtagaactcaggc

SEQ ID NO: 9306938 - DNA, 22 bp, Homo sapiens
tctctggggtagggcccaggac

SEQ ID NO: 9306939 - DNA, 22 bp, Homo sapiens
tctctgggttctcactcagcac

SEQ ID NO: 9306940 - DNA, 20 bp, Homo sapiens
tctctgggttctcactcagc

SEQ ID NO: 9306941 - DNA, 20 bp, Homo sapiens
tctctgggttctcactcagc

SEQ ID NO: 9306942 - DNA, 22 bp, Homo sapiens
tctctgggttctcactcagcac

SEQ ID NO: 9306943 - DNA, 23 bp, Homo sapiens
tctctgggtgggctgtgtctata

SEQ ID NO: 9306944 - DNA, 22 bp, Homo sapiens
tctctgggtgatggcagggcac

SEQ ID NO: 9306945 - DNA, 22 bp, Homo sapiens
tctctgggcctgttttctcatc

SEQ ID NO: 9306946 - DNA, 22 bp, Homo sapiens
tctctggggaaaaggctgatac

SEQ ID NO: 9306947 - DNA, 22 bp, Homo sapiens
tctctgggatcaggtggcccag

SEQ ID NO: 9306948 - DNA, 21 bp, Homo sapiens
tctctgggccctcctgtgggg

SEQ ID NO: 9306949 - DNA, 22 bp, Homo sapiens
tctctctgccaactcacagcca

SEQ ID NO: 9306950 - DNA, 22 bp, Homo sapiens
tctctctggagctggggcatga

SEQ ID NO: 9306951 - DNA, 22 bp, Homo sapiens
tctctcttttttgaacccgctc

SEQ ID NO: 9306952 - DNA, 22 bp, Homo sapiens
tctctgaaggggagctgtttaa

SEQ ID NO: 9306953 - DNA, 22 bp, Homo sapiens
tctctgaagatatttattatta

SEQ ID NO: 9306954 - DNA, 18 bp, Homo sapiens
tctctgaatattttatgt

SEQ ID NO: 9306955 - DNA, 22 bp, Homo sapiens
tctctgactaggtctgattttc

SEQ ID NO: 9306956 - DNA, 21 bp, Homo sapiens
tctctgagacactctggagcc

SEQ ID NO: 9306957 - DNA, 22 bp, Homo sapiens
tctctccttatcattgtgttta

SEQ ID NO: 9306958 - DNA, 22 bp, Homo sapiens
tctctctcagccattacagaac

SEQ ID NO: 9306959 - DNA, 22 bp, Homo sapiens
tctctctcctagtttttagtgg

SEQ ID NO: 9306960 - DNA, 22 bp, Homo sapiens
tctctcctgtgttctgatgttt

SEQ ID NO: 9306961 - DNA, 22 bp, Homo sapiens
tctctcctctagtcagggtggt

SEQ ID NO: 9306962 - DNA, 21 bp, Homo sapiens
tctctcctcaagctcgacccc

SEQ ID NO: 9306963 - DNA, 21 bp, Homo sapiens
tctctcctcaagctcgacccc

SEQ ID NO: 9306964 - DNA, 22 bp, Homo sapiens
tctctcctccacaccgggtgct

SEQ ID NO: 9306965 - DNA, 22 bp, Homo sapiens
tctctcctaatttcaggtgctt

SEQ ID NO: 9306966 - DNA, 22 bp, Homo sapiens
tctctccctttccttatcagtt

SEQ ID NO: 9306967 - DNA, 18 bp, Homo sapiens
tctctccatctatttgtt

SEQ ID NO: 9306968 - DNA, 22 bp, Homo sapiens
tctctcccaaatctgcagatag

SEQ ID NO: 9306969 - DNA, 22 bp, Homo sapiens
tctctccaacatggtggtgctg

SEQ ID NO: 9306970 - DNA, 18 bp, Homo sapiens
tctctcagggaaacagaa

SEQ ID NO: 9306971 - DNA, 22 bp, Homo sapiens
tctctcagcattactcttacta

SEQ ID NO: 9306972 - DNA, 22 bp, Homo sapiens
tctctcagatggggcactagta

SEQ ID NO: 9306973 - DNA, 22 bp, Homo sapiens
tctctcagctttgagacctgct

SEQ ID NO: 9306974 - DNA, 22 bp, Homo sapiens
tctctcaccctggaaaagccaa

SEQ ID NO: 9306975 - DNA, 19 bp, Homo sapiens
tctctatatttgtttctga

SEQ ID NO: 9306976 - DNA, 22 bp, Homo sapiens
tctctcagaactgcagctgcag

SEQ ID NO: 9306977 - DNA, 22 bp, Homo sapiens
tctctcactggtgcctctgttg

SEQ ID NO: 9306978 - DNA, 22 bp, Homo sapiens
tctctcagactccccatggttt

SEQ ID NO: 9306979 - DNA, 22 bp, Homo sapiens
tctctcagaaagcccatgtctg

SEQ ID NO: 9306980 - DNA, 20 bp, Homo sapiens
tctctcacgggttggtttct

SEQ ID NO: 9306981 - DNA, 22 bp, Homo sapiens
tctctcactggtgcctctgttg

SEQ ID NO: 9306982 - DNA, 22 bp, Homo sapiens
tctctcagaaagcccatgtctg

SEQ ID NO: 9306983 - DNA, 22 bp, Homo sapiens
tctctgtctgagcctggcagac

SEQ ID NO: 9306984 - DNA, 22 bp, Homo sapiens
tctcttaattttggaatagtgt

SEQ ID NO: 9306985 - DNA, 22 bp, Homo sapiens
tctcttagtcttatatgtaaaa

SEQ ID NO: 9306986 - DNA, 22 bp, Homo sapiens
tctcttcctagtgatgggcttt

SEQ ID NO: 9306987 - DNA, 22 bp, Homo sapiens
tctcttctgaaacctgtcttta

SEQ ID NO: 9306988 - DNA, 22 bp, Homo sapiens
tctcttctgaaacctgtcttta

SEQ ID NO: 9306989 - DNA, 20 bp, Homo sapiens
tctcttctggggagataaaa

SEQ ID NO: 9306990 - DNA, 22 bp, Homo sapiens
tctcttcttgattttcactgga

SEQ ID NO: 9306991 - DNA, 22 bp, Homo sapiens
tctcttctaattagggtccatg

SEQ ID NO: 9306992 - DNA, 22 bp, Homo sapiens
tctcttctaattttcccgagta

SEQ ID NO: 9306993 - DNA, 19 bp, Homo sapiens
tctcttctccctggtttta

SEQ ID NO: 9306994 - DNA, 22 bp, Homo sapiens
tctctttgtctgctcttagttg

SEQ ID NO: 9306995 - DNA, 22 bp, Homo sapiens
tctctttctattgcaccatgct

SEQ ID NO: 9306996 - DNA, 17 bp, Homo sapiens
tctctttccctttctgc

SEQ ID NO: 9306997 - DNA, 21 bp, Homo sapiens
tctctttctggaagcttccct

SEQ ID NO: 9306998 - DNA, 22 bp, Homo sapiens
tctcttgttgggtatatgaaat

SEQ ID NO: 9306999 - DNA, 22 bp, Homo sapiens
tctcttcttgtgttttcctgcc

SEQ ID NO: 9307000 - DNA, 22 bp, Homo sapiens
tctcccagtcctctgtgcttac

SEQ ID NO: 9307001 - DNA, 22 bp, Homo sapiens
tctcccaggtgggtgcctggag

SEQ ID NO: 9307002 - DNA, 22 bp, Homo sapiens
tctcccaggctgccctgtggac

SEQ ID NO: 9307003 - DNA, 22 bp, Homo sapiens
tctccctactgactccaggacc

SEQ ID NO: 9307004 - DNA, 22 bp, Homo sapiens
tctccctcattcctgcttccat

SEQ ID NO: 9307005 - DNA, 23 bp, Homo sapiens
tctccctcatgcctaggcctggg

SEQ ID NO: 9307006 - DNA, 22 bp, Homo sapiens
tctcccccagtctctacagcag

SEQ ID NO: 9307007 - DNA, 22 bp, Homo sapiens
tctcccctccctggaccagtgc

SEQ ID NO: 9307008 - DNA, 22 bp, Homo sapiens
tctccccaggggtatgggtatt

SEQ ID NO: 9307009 - DNA, 22 bp, Homo sapiens
tctcccagtgtctggcagtcag

SEQ ID NO: 9307010 - DNA, 19 bp, Homo sapiens
tctcccatgcctgtgtcta

SEQ ID NO: 9307011 - DNA, 22 bp, Homo sapiens
tctcccattacttatggcccac

SEQ ID NO: 9307012 - DNA, 22 bp, Homo sapiens
tctcccataaaatttatgctta

SEQ ID NO: 9307013 - DNA, 22 bp, Homo sapiens
tctcccatgaggctgcggtcaa

SEQ ID NO: 9307014 - DNA, 22 bp, Homo sapiens
tctcccattcagcttgcagtca

SEQ ID NO: 9307015 - DNA, 22 bp, Homo sapiens
tctcccactggccttgtatgat

SEQ ID NO: 9307016 - DNA, 22 bp, Homo sapiens
tctcccacggtacaggataaac

SEQ ID NO: 9307017 - DNA, 22 bp, Homo sapiens
tctcccactgcaagcccaggct

SEQ ID NO: 9307018 - DNA, 22 bp, Homo sapiens
tctccaggttcagtcgatggaa

SEQ ID NO: 9307019 - DNA, 22 bp, Homo sapiens
tctccaggtggcttgggcttct

SEQ ID NO: 9307020 - DNA, 22 bp, Homo sapiens
tctccaggtggggtcacctttt

SEQ ID NO: 9307021 - DNA, 22 bp, Homo sapiens
tctccaggtgaaacttgcaggg

SEQ ID NO: 9307022 - DNA, 22 bp, Homo sapiens
tctccaggtaaatggcatcctg

SEQ ID NO: 9307023 - DNA, 22 bp, Homo sapiens
tctccaggtagatatgtcagga

SEQ ID NO: 9307024 - DNA, 22 bp, Homo sapiens
tctccaggtgactctgatgtat

SEQ ID NO: 9307025 - DNA, 22 bp, Homo sapiens
tctccaggtgagggtggttaga

SEQ ID NO: 9307026 - DNA, 19 bp, Homo sapiens
tctccaggtgccccaaaca

SEQ ID NO: 9307027 - DNA, 22 bp, Homo sapiens
tctccaggtgctaagtgtgcct

SEQ ID NO: 9307028 - DNA, 23 bp, Homo sapiens
tctccaggccttactccaggcct

SEQ ID NO: 9307029 - DNA, 22 bp, Homo sapiens
tctccaggcctttcccatctta

SEQ ID NO: 9307030 - DNA, 22 bp, Homo sapiens
tctccaggcttaatctcagctt

SEQ ID NO: 9307031 - DNA, 22 bp, Homo sapiens
tctccaggctttttgtgaattg

SEQ ID NO: 9307032 - DNA, 22 bp, Homo sapiens
tctccagggacatgtttctgga

SEQ ID NO: 9307033 - DNA, 22 bp, Homo sapiens
tctccagggactgaggctggag

SEQ ID NO: 9307034 - DNA, 22 bp, Homo sapiens
tctccaggggcagggtctggag

SEQ ID NO: 9307035 - DNA, 22 bp, Homo sapiens
tctccaggggctgctgtgccac

SEQ ID NO: 9307036 - DNA, 22 bp, Homo sapiens
tctccagggtgagctaggccag

SEQ ID NO: 9307037 - DNA, 22 bp, Homo sapiens
tctccagggcccccgagcgttg

SEQ ID NO: 9307038 - DNA, 22 bp, Homo sapiens
tctccagggcagagaatagcaa

SEQ ID NO: 9307039 - DNA, 22 bp, Homo sapiens
tctccagggaggtagcccagtg

SEQ ID NO: 9307040 - DNA, 22 bp, Homo sapiens
tctcctgggtaaaagggttgat

SEQ ID NO: 9307041 - DNA, 22 bp, Homo sapiens
tctcctggtacccttcctagca

SEQ ID NO: 9307042 - DNA, 22 bp, Homo sapiens
tctcctggtacccttcctagca

SEQ ID NO: 9307043 - DNA, 22 bp, Homo sapiens
tctcgacagcctggcacagtgg

SEQ ID NO: 9307044 - DNA, 22 bp, Homo sapiens
tctcctttctggagcctgctca

SEQ ID NO: 9307045 - DNA, 22 bp, Homo sapiens
tctcgatctcctgaccttgtga

SEQ ID NO: 9307046 - DNA, 22 bp, Homo sapiens
tctcgctctgtcgcccaggctg

SEQ ID NO: 9307047 - DNA, 22 bp, Homo sapiens
tctccttcgaggcccagctccc

SEQ ID NO: 9307048 - DNA, 22 bp, Homo sapiens
tctccttcgaggcccagctccc

SEQ ID NO: 9307049 - DNA, 22 bp, Homo sapiens
tctcgctctgtcgcccaggctg

SEQ ID NO: 9307050 - DNA, 22 bp, Homo sapiens
tctcctgatgactttatcttgg

SEQ ID NO: 9307051 - DNA, 22 bp, Homo sapiens
tctcctgatatctgcagaccta

SEQ ID NO: 9307052 - DNA, 22 bp, Homo sapiens
tctcctgacatgtctggaggaa

SEQ ID NO: 9307053 - DNA, 22 bp, Homo sapiens
tctcctgacatgtctggaggaa

SEQ ID NO: 9307054 - DNA, 22 bp, Homo sapiens
tctcctgaagtttatgaaaact

SEQ ID NO: 9307055 - DNA, 22 bp, Homo sapiens
tctcctgaagaccatgtgcact

SEQ ID NO: 9307056 - DNA, 22 bp, Homo sapiens
tctcctgaagaccatgtgcact

SEQ ID NO: 9307057 - DNA, 22 bp, Homo sapiens
tctcctctgtgccacagcttgg

SEQ ID NO: 9307058 - DNA, 23 bp, Homo sapiens
tctcctcctagatacagtcatgg

SEQ ID NO: 9307059 - DNA, 22 bp, Homo sapiens
tctcctcccaggctcttccagg

SEQ ID NO: 9307060 - DNA, 22 bp, Homo sapiens
tctcctcccaggctcttccagg

SEQ ID NO: 9307061 - DNA, 22 bp, Homo sapiens
tctcctggaagaataccacact

SEQ ID NO: 9307062 - DNA, 22 bp, Homo sapiens
tctcctgccactgcttcccatt

SEQ ID NO: 9307063 - DNA, 22 bp, Homo sapiens
tctcctgatgatggtactggca

SEQ ID NO: 9307064 - DNA, 22 bp, Homo sapiens
tctcctggatggaccttctctt

SEQ ID NO: 9307065 - DNA, 22 bp, Homo sapiens
tctcatttgcctcatctataaa

SEQ ID NO: 9307066 - DNA, 22 bp, Homo sapiens
tctccaggcacttggctgctac

SEQ ID NO: 9307067 - DNA, 19 bp, Homo sapiens
tctccaggcaggtgagcga

SEQ ID NO: 9307068 - DNA, 22 bp, Homo sapiens
tctccaggcccactgatttata

SEQ ID NO: 9307069 - DNA, 22 bp, Homo sapiens
tctccaggcactacctgggtaa

SEQ ID NO: 9307070 - DNA, 22 bp, Homo sapiens
tctccaggagcaagtcacccag

SEQ ID NO: 9307071 - DNA, 22 bp, Homo sapiens
tctccaggagaaatatgaagga

SEQ ID NO: 9307072 - DNA, 22 bp, Homo sapiens
tctccaggactgagctccagcc

SEQ ID NO: 9307073 - DNA, 17 bp, Homo sapiens
tctccaggacgagctca

SEQ ID NO: 9307074 - DNA, 22 bp, Homo sapiens
tctccaggaagccctccctgac

SEQ ID NO: 9307075 - DNA, 22 bp, Homo sapiens
tctccaaatcaatcaatatgaa

SEQ ID NO: 9307076 - DNA, 22 bp, Homo sapiens
tctcatcttcattgtctcccat

SEQ ID NO: 9307077 - DNA, 22 bp, Homo sapiens
tctcatctgcgagctctgccag

SEQ ID NO: 9307078 - DNA, 22 bp, Homo sapiens
tctcatctagactctgcccttg

SEQ ID NO: 9307079 - DNA, 23 bp, Homo sapiens
tctcagtgcacgcaccatgcctg

SEQ ID NO: 9307080 - DNA, 22 bp, Homo sapiens
tctcagggcttttcttttgaat

SEQ ID NO: 9307081 - DNA, 22 bp, Homo sapiens
tctcagggctcagagctcaggc

SEQ ID NO: 9307082 - DNA, 22 bp, Homo sapiens
tctcagggcgcagtgaggcagt

SEQ ID NO: 9307083 - DNA, 22 bp, Homo sapiens
tctcagggcgcagtgaggcagt

SEQ ID NO: 9307084 - DNA, 22 bp, Homo sapiens
tctcaggggcagtgatcctaag

SEQ ID NO: 9307085 - DNA, 22 bp, Homo sapiens
tctcaggggcctggagtcctgg

SEQ ID NO: 9307086 - DNA, 22 bp, Homo sapiens
tctcaggggcagtgatcctaag

SEQ ID NO: 9307087 - DNA, 22 bp, Homo sapiens
tctcaggggattcactggcacc

SEQ ID NO: 9307088 - DNA, 20 bp, Homo sapiens
tctcagggttcagcaaagta

SEQ ID NO: 9307089 - DNA, 22 bp, Homo sapiens
tctcagagtgacaatgagaatt

SEQ ID NO: 9307090 - DNA, 22 bp, Homo sapiens
tctcagagtggtggtccctctg

SEQ ID NO: 9307091 - DNA, 22 bp, Homo sapiens
tctcagagttcctctggagtcc

SEQ ID NO: 9307092 - DNA, 22 bp, Homo sapiens
tctcagagttcctctggagtcc

SEQ ID NO: 9307093 - DNA, 22 bp, Homo sapiens
tctcagagtaattctttaaggt

SEQ ID NO: 9307094 - DNA, 22 bp, Homo sapiens
tctcagaggtgccctggcatct

SEQ ID NO: 9307095 - DNA, 22 bp, Homo sapiens
tctcagagggaaacatgagtga

SEQ ID NO: 9307096 - DNA, 22 bp, Homo sapiens
tctcagaggcccgacgttctcc

SEQ ID NO: 9307097 - DNA, 22 bp, Homo sapiens
tctcagagggaggattactgcc

SEQ ID NO: 9307098 - DNA, 22 bp, Homo sapiens
tctcagagggaaaggccaattt

SEQ ID NO: 9307099 - DNA, 22 bp, Homo sapiens
tctcagaggtcttcagcctctg

SEQ ID NO: 9307100 - DNA, 22 bp, Homo sapiens
tctcagagtttgaatctggagt

SEQ ID NO: 9307101 - DNA, 22 bp, Homo sapiens
tctcagagtttacggggctgaa

SEQ ID NO: 9307102 - DNA, 22 bp, Homo sapiens
tctcagagtttagagctgagcc

SEQ ID NO: 9307103 - DNA, 22 bp, Homo sapiens
tctcagagtttagagctgagcc

SEQ ID NO: 9307104 - DNA, 22 bp, Homo sapiens
tctcagcagggccatcctgagc

SEQ ID NO: 9307105 - DNA, 22 bp, Homo sapiens
tctcagagtttttttccaggac

SEQ ID NO: 9307106 - DNA, 22 bp, Homo sapiens
tctcagcaaggaaagaggcagg

SEQ ID NO: 9307107 - DNA, 22 bp, Homo sapiens
tctcagggagggcgagtcagcg

SEQ ID NO: 9307108 - DNA, 22 bp, Homo sapiens
tctcagggagggcgagtcagcg

SEQ ID NO: 9307109 - DNA, 22 bp, Homo sapiens
tctcagggcaattctcagcgac

SEQ ID NO: 9307110 - DNA, 22 bp, Homo sapiens
tctcagggcaattctcagcgac

SEQ ID NO: 9307111 - DNA, 22 bp, Homo sapiens
tctcagggcagcaaggaagcat

SEQ ID NO: 9307112 - DNA, 22 bp, Homo sapiens
tctcagggaccatgatgatgac

SEQ ID NO: 9307113 - DNA, 22 bp, Homo sapiens
tctcagggagcccagtacttac

SEQ ID NO: 9307114 - DNA, 22 bp, Homo sapiens
tctcaggcttcctggtgctgtg

SEQ ID NO: 9307115 - DNA, 19 bp, Homo sapiens
tctcagagccctagaggcc

SEQ ID NO: 9307116 - DNA, 22 bp, Homo sapiens
tctcagagctcacacctcctgg

SEQ ID NO: 9307117 - DNA, 22 bp, Homo sapiens
tctcagagcttcagaaagcacc

SEQ ID NO: 9307118 - DNA, 18 bp, Homo sapiens
tctcagaggccatcctag

SEQ ID NO: 9307119 - DNA, 23 bp, Homo sapiens
tctcagaggattcctgggccttg

SEQ ID NO: 9307120 - DNA, 22 bp, Homo sapiens
tctcagagcttcagttattttc

SEQ ID NO: 9307121 - DNA, 19 bp, Homo sapiens
tctcagaggaaaaattgct

SEQ ID NO: 9307122 - DNA, 22 bp, Homo sapiens
tctcagagcctaactaacctaa

SEQ ID NO: 9307123 - DNA, 22 bp, Homo sapiens
tctcagagatttatggaaaact

SEQ ID NO: 9307124 - DNA, 22 bp, Homo sapiens
tctcagagattttgtttccctt

SEQ ID NO: 9307125 - DNA, 22 bp, Homo sapiens
tctcagagatgttagggaagag

SEQ ID NO: 9307126 - DNA, 22 bp, Homo sapiens
tctcagagatgttagggaagag

SEQ ID NO: 9307127 - DNA, 22 bp, Homo sapiens
tctcagagattcagggagaagt

SEQ ID NO: 9307128 - DNA, 19 bp, Homo sapiens
tctcagagccctagaggcc

SEQ ID NO: 9307129 - DNA, 22 bp, Homo sapiens
tctcagagcatcattttcttag

SEQ ID NO: 9307130 - DNA, 22 bp, Homo sapiens
tctcagagagatgaaacttcca

SEQ ID NO: 9307131 - DNA, 22 bp, Homo sapiens
tctcagagagctgtgttttcct

SEQ ID NO: 9307132 - DNA, 22 bp, Homo sapiens
tctcagagatgtcaagagtcta

SEQ ID NO: 9307133 - DNA, 22 bp, Homo sapiens
tctcagagatctttctgcatgt

SEQ ID NO: 9307134 - DNA, 22 bp, Homo sapiens
tctcagagaggggccgggcctt

SEQ ID NO: 9307135 - DNA, 22 bp, Homo sapiens
tctcacagtgcaggtctgtctc

SEQ ID NO: 9307136 - DNA, 19 bp, Homo sapiens
tctcacatcagctcctagc

SEQ ID NO: 9307137 - DNA, 22 bp, Homo sapiens
tctcacatctgccctgtgctgg

SEQ ID NO: 9307138 - DNA, 22 bp, Homo sapiens
tctcactagtaggcctctgatg

SEQ ID NO: 9307139 - DNA, 22 bp, Homo sapiens
tctcacagggctaggccctgcc

SEQ ID NO: 9307140 - DNA, 19 bp, Homo sapiens
tctcacagtttccttgcct

SEQ ID NO: 9307141 - DNA, 22 bp, Homo sapiens
tctcacagtgcaggtctgtctc

SEQ ID NO: 9307142 - DNA, 22 bp, Homo sapiens
taagaagcagttcacaagtaaa

SEQ ID NO: 9307143 - DNA, 22 bp, Homo sapiens
taagaagcttctgctaatgcct

SEQ ID NO: 9307144 - DNA, 22 bp, Homo sapiens
tcctgcttcttcgagcttctgg

SEQ ID NO: 9307145 - DNA, 20 bp, Homo sapiens
tcctgcttccaccagagcac

SEQ ID NO: 9307146 - DNA, 22 bp, Homo sapiens
tcctgctgttttctggcccaca

SEQ ID NO: 9307147 - DNA, 22 bp, Homo sapiens
tcctgcttcaggtagagggggt

SEQ ID NO: 9307148 - DNA, 22 bp, Homo sapiens
tcctgctggcaaggaagggact

SEQ ID NO: 9307149 - DNA, 19 bp, Homo sapiens
tcctgctgtgtgaagggga

SEQ ID NO: 9307150 - DNA, 22 bp, Homo sapiens
tcctgctggattgtgtctggtg

SEQ ID NO: 9307151 - DNA, 22 bp, Homo sapiens
tcctgctgtgtctagctggttc

SEQ ID NO: 9307152 - DNA, 22 bp, Homo sapiens
tcctgctgtgcttattatcctg

SEQ ID NO: 9307153 - DNA, 20 bp, Homo sapiens
tcctggaggcttcatccata

SEQ ID NO: 9307154 - DNA, 22 bp, Homo sapiens
tcctggaggcaaatgagcacat

SEQ ID NO: 9307155 - DNA, 22 bp, Homo sapiens
tcctggaggcactcgctggggc

SEQ ID NO: 9307156 - DNA, 22 bp, Homo sapiens
tcctggagtaggccttagccat

SEQ ID NO: 9307157 - DNA, 20 bp, Homo sapiens
tcctggagtattccatgctt

SEQ ID NO: 9307158 - DNA, 20 bp, Homo sapiens
tcctggagtattccatgctt

SEQ ID NO: 9307159 - DNA, 22 bp, Homo sapiens
tcctggagaagaggggcttgga

SEQ ID NO: 9307160 - DNA, 22 bp, Homo sapiens
tcctgctttgtgcctcacactt

SEQ ID NO: 9307161 - DNA, 22 bp, Homo sapiens
tcctgctttgtgcctcacactt

SEQ ID NO: 9307162 - DNA, 22 bp, Homo sapiens
tcctggacagatccccatcatc

SEQ ID NO: 9307163 - DNA, 22 bp, Homo sapiens
tcctggcacattgcaggggctc

SEQ ID NO: 9307164 - DNA, 20 bp, Homo sapiens
tcctggcaagccgtacctcc

SEQ ID NO: 9307165 - DNA, 22 bp, Homo sapiens
tcctggagttgtctgtactcat

SEQ ID NO: 9307166 - DNA, 22 bp, Homo sapiens
tcctggagtggagtctgttgtt

SEQ ID NO: 9307167 - DNA, 17 bp, Homo sapiens
tcctggcagtcccctgg

SEQ ID NO: 9307168 - DNA, 22 bp, Homo sapiens
tcctggcacattgcaggggctc

SEQ ID NO: 9307169 - DNA, 19 bp, Homo sapiens
tcctggcatcttcctccct

SEQ ID NO: 9307170 - DNA, 22 bp, Homo sapiens
tcctggcagttcagccccctaa

SEQ ID NO: 9307171 - DNA, 22 bp, Homo sapiens
tcctggcattgtgcagggtgtg

SEQ ID NO: 9307172 - DNA, 22 bp, Homo sapiens
tcctggccaagtagatgtggcg

SEQ ID NO: 9307173 - DNA, 22 bp, Homo sapiens
tcctggccacccgacagaagtc

SEQ ID NO: 9307174 - DNA, 18 bp, Homo sapiens
tcctggccacactacctt

SEQ ID NO: 9307175 - DNA, 22 bp, Homo sapiens
tcctggctctgctgcctcctag

SEQ ID NO: 9307176 - DNA, 17 bp, Homo sapiens
tcctggctctgccactg

SEQ ID NO: 9307177 - DNA, 22 bp, Homo sapiens
tcctggccctgtggcctgcagt

SEQ ID NO: 9307178 - DNA, 22 bp, Homo sapiens
tcctggcccactatgccagcat

SEQ ID NO: 9307179 - DNA, 22 bp, Homo sapiens
tcctggcccaatctgcccatga

SEQ ID NO: 9307180 - DNA, 21 bp, Homo sapiens
tcctggcccactctatcccca

SEQ ID NO: 9307181 - DNA, 22 bp, Homo sapiens
tcctggcccggccgggcctgct

SEQ ID NO: 9307182 - DNA, 22 bp, Homo sapiens
tcctgtcctgaggctccaggcc

SEQ ID NO: 9307183 - DNA, 22 bp, Homo sapiens
tcctgtctaaagacctgcaggc

SEQ ID NO: 9307184 - DNA, 21 bp, Homo sapiens
tcctgtaagcttgggtggctc

SEQ ID NO: 9307185 - DNA, 22 bp, Homo sapiens
tcctggtgtttatgtcacatag

SEQ ID NO: 9307186 - DNA, 22 bp, Homo sapiens
tcctggtggtgccagctgcagg

SEQ ID NO: 9307187 - DNA, 22 bp, Homo sapiens
tcctgtggtatgggagtgatgt

SEQ ID NO: 9307188 - DNA, 22 bp, Homo sapiens
tcctgtggaagacagtgttggg

SEQ ID NO: 9307189 - DNA, 22 bp, Homo sapiens
tcctgtgcctccacctgctccg

SEQ ID NO: 9307190 - DNA, 22 bp, Homo sapiens
tcctgtggcgttatcatgtgat

SEQ ID NO: 9307191 - DNA, 22 bp, Homo sapiens
tcctgtctgctcacagagctgg

SEQ ID NO: 9307192 - DNA, 22 bp, Homo sapiens
tcctgtcttaatgatctcgtgc

SEQ ID NO: 9307193 - DNA, 22 bp, Homo sapiens
tcctgggtctgggtgtctgagg

SEQ ID NO: 9307194 - DNA, 22 bp, Homo sapiens
tcctgggtcccgcacatctgtc

SEQ ID NO: 9307195 - DNA, 22 bp, Homo sapiens
tcctgggttaattatgattcac

SEQ ID NO: 9307196 - DNA, 22 bp, Homo sapiens
tcctgggtgtgatattcataga

SEQ ID NO: 9307197 - DNA, 23 bp, Homo sapiens
tcctgggtttgaattctagtctt

SEQ ID NO: 9307198 - DNA, 22 bp, Homo sapiens
tcctggggtcctgactgcttcc

SEQ ID NO: 9307199 - DNA, 22 bp, Homo sapiens
tcctggggttttggccgcagct

SEQ ID NO: 9307200 - DNA, 19 bp, Homo sapiens
tcctggggatgtggtcacc

SEQ ID NO: 9307201 - DNA, 21 bp, Homo sapiens
tcctggggggtaggtgagttt

SEQ ID NO: 9307202 - DNA, 22 bp, Homo sapiens
tcctggggctctttgatgtgat

SEQ ID NO: 9307203 - DNA, 22 bp, Homo sapiens
tcctggcttccactcctctgtt

SEQ ID NO: 9307204 - DNA, 22 bp, Homo sapiens
tcctggcttctgtctccttatt

SEQ ID NO: 9307205 - DNA, 18 bp, Homo sapiens
tcctgggaacttgctagc

SEQ ID NO: 9307206 - DNA, 22 bp, Homo sapiens
tcctgggaagagacctgagcat

SEQ ID NO: 9307207 - DNA, 22 bp, Homo sapiens
tcctgggaagttgcatcaccgt

SEQ ID NO: 9307208 - DNA, 22 bp, Homo sapiens
tcctgggacaagccgtggaagt

SEQ ID NO: 9307209 - DNA, 22 bp, Homo sapiens
tcctgggactcaacttagaagg

SEQ ID NO: 9307210 - DNA, 22 bp, Homo sapiens
tcctgggaggcaggaccccttt

SEQ ID NO: 9307211 - DNA, 22 bp, Homo sapiens
tcctgggagtaattgagtcatg

SEQ ID NO: 9307212 - DNA, 22 bp, Homo sapiens
tcctgggatcaagtgatcctcc

SEQ ID NO: 9307213 - DNA, 22 bp, Homo sapiens
tcctgggcagaatgggatggct

SEQ ID NO: 9307214 - DNA, 22 bp, Homo sapiens
tcctgggcagcctctctggaag

SEQ ID NO: 9307215 - DNA, 22 bp, Homo sapiens
tcctgggcacaagtgagtctcc

SEQ ID NO: 9307216 - DNA, 22 bp, Homo sapiens
tcctgggcacaagtgagtctcc

SEQ ID NO: 9307217 - DNA, 22 bp, Homo sapiens
tcctgggattaaggtggtgatt

SEQ ID NO: 9307218 - DNA, 22 bp, Homo sapiens
tcctgggcaaagaggggcagtg

SEQ ID NO: 9307219 - DNA, 22 bp, Homo sapiens
tcctgggcaaagaggggcagtg

SEQ ID NO: 9307220 - DNA, 22 bp, Homo sapiens
tcctgggcaaaagtatctgtga

SEQ ID NO: 9307221 - DNA, 22 bp, Homo sapiens
tcctgggccctccggatcaggt

SEQ ID NO: 9307222 - DNA, 22 bp, Homo sapiens
tcctgggccctccggatcaggt

SEQ ID NO: 9307223 - DNA, 22 bp, Homo sapiens
tcctgggcctgtactccatccg

SEQ ID NO: 9307224 - DNA, 22 bp, Homo sapiens
tcctgggcgaggtactggggct

SEQ ID NO: 9307225 - DNA, 22 bp, Homo sapiens
tcctgggcgaggtactggggct

SEQ ID NO: 9307226 - DNA, 22 bp, Homo sapiens
tcctgggcgagtggtggtacac

SEQ ID NO: 9307227 - DNA, 22 bp, Homo sapiens
tcctgggcgagtggtggtacac

SEQ ID NO: 9307228 - DNA, 22 bp, Homo sapiens
tcctgggccaagggctgtgagg

SEQ ID NO: 9307229 - DNA, 22 bp, Homo sapiens
tcctgggcccaggctgccaggg

SEQ ID NO: 9307230 - DNA, 22 bp, Homo sapiens
tcctgggccaagggctgtgagg

SEQ ID NO: 9307231 - DNA, 22 bp, Homo sapiens
tcctgggccaagggctgtgagg

SEQ ID NO: 9307232 - DNA, 22 bp, Homo sapiens
tcctgggcagcgggacgctcag

SEQ ID NO: 9307233 - DNA, 19 bp, Homo sapiens
tcctgggctgcgtcttgcc

SEQ ID NO: 9307234 - DNA, 22 bp, Homo sapiens
tcctgggctgcagggaagagca

SEQ ID NO: 9307235 - DNA, 19 bp, Homo sapiens
tcctgggcgttgactttgg

SEQ ID NO: 9307236 - DNA, 22 bp, Homo sapiens
tcctgggcgattttctgaatat

SEQ ID NO: 9307237 - DNA, 22 bp, Homo sapiens
tcctgggcggttatgtgatctg

SEQ ID NO: 9307238 - DNA, 22 bp, Homo sapiens
tcctgggctgtgtgccactctg

SEQ ID NO: 9307239 - DNA, 19 bp, Homo sapiens
tcctgggctgcgtcttgcc

SEQ ID NO: 9307240 - DNA, 19 bp, Homo sapiens
tcctgggctgggccaggtc

SEQ ID NO: 9307241 - DNA, 22 bp, Homo sapiens
tctcacagaggcttgggctcat

SEQ ID NO: 9307242 - DNA, 22 bp, Homo sapiens
tctcacactaatgctctatcag

SEQ ID NO: 9307243 - DNA, 22 bp, Homo sapiens
tctcacagcaggggccaggtct

SEQ ID NO: 9307244 - DNA, 22 bp, Homo sapiens
tctcacagctctgctgcatgct

SEQ ID NO: 9307245 - DNA, 22 bp, Homo sapiens
tctcacacaacatgttactttg

SEQ ID NO: 9307246 - DNA, 19 bp, Homo sapiens
tctcacaagactgctgctc

SEQ ID NO: 9307247 - DNA, 22 bp, Homo sapiens
tctcaagttttctcataatctc

SEQ ID NO: 9307248 - DNA, 22 bp, Homo sapiens
tctatttgttctcaggatcatc

SEQ ID NO: 9307249 - DNA, 22 bp, Homo sapiens
tctatttaccaaatgtagttcc

SEQ ID NO: 9307250 - DNA, 22 bp, Homo sapiens
tctagggagaagctctgtctgt

SEQ ID NO: 9307251 - DNA, 22 bp, Homo sapiens
tctaggcccaggcctgcggctg

SEQ ID NO: 9307252 - DNA, 22 bp, Homo sapiens
tctaggccctttttccctccaa

SEQ ID NO: 9307253 - DNA, 22 bp, Homo sapiens
tctagtcatattttttcagtat

SEQ ID NO: 9307254 - DNA, 19 bp, Homo sapiens
tctagtcagtcagtcattc

SEQ ID NO: 9307255 - DNA, 22 bp, Homo sapiens
tctatgttggtccatattatgg

SEQ ID NO: 9307256 - DNA, 22 bp, Homo sapiens
tctatgtaaagccatattgata

SEQ ID NO: 9307257 - DNA, 22 bp, Homo sapiens
tctatgaattccatttcacgat

SEQ ID NO: 9307258 - DNA, 22 bp, Homo sapiens
tctatgaatcaattttaacatc

SEQ ID NO: 9307259 - DNA, 22 bp, Homo sapiens
tctatgaaaagtctattcattc

SEQ ID NO: 9307260 - DNA, 22 bp, Homo sapiens
tctatgaaaagtctattcattc

SEQ ID NO: 9307261 - DNA, 22 bp, Homo sapiens
tctacatgcagcgaggggactt

SEQ ID NO: 9307262 - DNA, 22 bp, Homo sapiens
tctacaaataaattactatgta

SEQ ID NO: 9307263 - DNA, 22 bp, Homo sapiens
tctacagactcctatgtaacac

SEQ ID NO: 9307264 - DNA, 22 bp, Homo sapiens
tctacaaagaagaattaatgtc

SEQ ID NO: 9307265 - DNA, 22 bp, Homo sapiens
tctaggaggcctattgtaaaca

SEQ ID NO: 9307266 - DNA, 19 bp, Homo sapiens
tctagcaacccactgcatg

SEQ ID NO: 9307267 - DNA, 22 bp, Homo sapiens
tctagatctgcactgttggaca

SEQ ID NO: 9307268 - DNA, 22 bp, Homo sapiens
tctagatcatgtctgtggtcaa

SEQ ID NO: 9307269 - DNA, 22 bp, Homo sapiens
tctagagattggacttcctaga

SEQ ID NO: 9307270 - DNA, 18 bp, Homo sapiens
tctaccctctcagagtct

SEQ ID NO: 9307271 - DNA, 22 bp, Homo sapiens
tctaccctgcggtcttggggca

SEQ ID NO: 9307272 - DNA, 22 bp, Homo sapiens
tctacttccgcaaaaggcacat

SEQ ID NO: 9307273 - DNA, 22 bp, Homo sapiens
tctacttctccttcatttccca

SEQ ID NO: 9307274 - DNA, 22 bp, Homo sapiens
tctaaactgcgagcatgccccc

SEQ ID NO: 9307275 - DNA, 22 bp, Homo sapiens
tcgcccaggctggaagtgcagt

SEQ ID NO: 9307276 - DNA, 22 bp, Homo sapiens
tcgtctgtgaaattgggataag

SEQ ID NO: 9307277 - DNA, 22 bp, Homo sapiens
tcgcacctgtcctctgattatg

SEQ ID NO: 9307278 - DNA, 22 bp, Homo sapiens
tcgtgatctgtccacctcggcc

SEQ ID NO: 9307279 - DNA, 22 bp, Homo sapiens
tcgtcctgtgcacctgcctgca

SEQ ID NO: 9307280 - DNA, 22 bp, Homo sapiens
tcgtttgagataaatacatgta

SEQ ID NO: 9307281 - DNA, 21 bp, Homo sapiens
tcgacctgctgggctcgggct

SEQ ID NO: 9307282 - DNA, 22 bp, Homo sapiens
tcgaaggaacctcaattttcgt

SEQ ID NO: 9307283 - DNA, 22 bp, Homo sapiens
tcctttgcttctgtcattctcc

SEQ ID NO: 9307284 - DNA, 22 bp, Homo sapiens
tcctttgcttctgtcattctcc

SEQ ID NO: 9307285 - DNA, 23 bp, Homo sapiens
tcctttgtctttgcatagatggt

SEQ ID NO: 9307286 - DNA, 22 bp, Homo sapiens
tcctttcttcttctgcccatgg

SEQ ID NO: 9307287 - DNA, 18 bp, Homo sapiens
tcctttctccctcatctt

SEQ ID NO: 9307288 - DNA, 22 bp, Homo sapiens
tcctttccctttccatcctggc

SEQ ID NO: 9307289 - DNA, 20 bp, Homo sapiens
tcctttcctccttctaaatg

SEQ ID NO: 9307290 - DNA, 22 bp, Homo sapiens
tcctttccctttccatcctggc

SEQ ID NO: 9307291 - DNA, 22 bp, Homo sapiens
tcctttccatgcttctagaggc

SEQ ID NO: 9307292 - DNA, 22 bp, Homo sapiens
tccttgggaaacatcatgtaat

SEQ ID NO: 9307293 - DNA, 22 bp, Homo sapiens
tccttctttccccctagtcatt

SEQ ID NO: 9307294 - DNA, 22 bp, Homo sapiens
tccttcttccctggtttgcatc

SEQ ID NO: 9307295 - DNA, 22 bp, Homo sapiens
tccttcttcatgaagatatatg

SEQ ID NO: 9307296 - DNA, 19 bp, Homo sapiens
tccttctccggccaccccg

SEQ ID NO: 9307297 - DNA, 19 bp, Homo sapiens
tccttctccggccaccccg

SEQ ID NO: 9307298 - DNA, 22 bp, Homo sapiens
tccttctctacaaatccaggca

SEQ ID NO: 9307299 - DNA, 23 bp, Homo sapiens
tccttcctttgagaggctccatc

SEQ ID NO: 9307300 - DNA, 22 bp, Homo sapiens
tccttcagggggccgcctgcac

SEQ ID NO: 9307301 - DNA, 19 bp, Homo sapiens
tccttcagtcagatctggg

SEQ ID NO: 9307302 - DNA, 19 bp, Homo sapiens
tccttcagtcagatctggg

SEQ ID NO: 9307303 - DNA, 22 bp, Homo sapiens
tccttcctggggtctctgctgc

SEQ ID NO: 9307304 - DNA, 22 bp, Homo sapiens
tccttcagaaaacctcagtctt

SEQ ID NO: 9307305 - DNA, 23 bp, Homo sapiens
tccttcagagcctccctccaagc

SEQ ID NO: 9307306 - DNA, 22 bp, Homo sapiens
tccttcagaacctgtgatggaa

SEQ ID NO: 9307307 - DNA, 22 bp, Homo sapiens
tccttcagaggacggcagccag

SEQ ID NO: 9307308 - DNA, 22 bp, Homo sapiens
tccttcagcttatttcttagga

SEQ ID NO: 9307309 - DNA, 22 bp, Homo sapiens
tccttcagctactcagtttcca

SEQ ID NO: 9307310 - DNA, 22 bp, Homo sapiens
tccttcagccatgggctctcca

SEQ ID NO: 9307311 - DNA, 22 bp, Homo sapiens
tccttcagcctcccagctcaaa

SEQ ID NO: 9307312 - DNA, 22 bp, Homo sapiens
tccttcaggcctcattctcata

SEQ ID NO: 9307313 - DNA, 23 bp, Homo sapiens
tccttcaggctcttcccctggac

SEQ ID NO: 9307314 - DNA, 22 bp, Homo sapiens
tccttcagggctgaccacaggc

SEQ ID NO: 9307315 - DNA, 20 bp, Homo sapiens
tccttcaggcagggcctagt

SEQ ID NO: 9307316 - DNA, 17 bp, Homo sapiens
tccttcagggcctcaca

SEQ ID NO: 9307317 - DNA, 22 bp, Homo sapiens
tccttcagggctgaccacaggc

SEQ ID NO: 9307318 - DNA, 22 bp, Homo sapiens
tccttcaagatgccacagcttt

SEQ ID NO: 9307319 - DNA, 22 bp, Homo sapiens
tccttagcaggcattcaggacc

SEQ ID NO: 9307320 - DNA, 22 bp, Homo sapiens
tccttagccagggcagctcaaa

SEQ ID NO: 9307321 - DNA, 22 bp, Homo sapiens
tccttagcccactaatacttat

SEQ ID NO: 9307322 - DNA, 22 bp, Homo sapiens
tccttagccggagcagctcatc

SEQ ID NO: 9307323 - DNA, 18 bp, Homo sapiens
tccttagctgagcttgtc

SEQ ID NO: 9307324 - DNA, 22 bp, Homo sapiens
tccttagctgtgaaatgagaat

SEQ ID NO: 9307325 - DNA, 22 bp, Homo sapiens
tccttagcttacaagtcttctg

SEQ ID NO: 9307326 - DNA, 22 bp, Homo sapiens
tccttagcaacactgttataat

SEQ ID NO: 9307327 - DNA, 22 bp, Homo sapiens
tccttagacaaagagtgggctt

SEQ ID NO: 9307328 - DNA, 22 bp, Homo sapiens
tccttagacaaagagtgggctt

SEQ ID NO: 9307329 - DNA, 22 bp, Homo sapiens
tctgggcagcagcagctagtag

SEQ ID NO: 9307330 - DNA, 22 bp, Homo sapiens
tctgggcactgctgagcctgta

SEQ ID NO: 9307331 - DNA, 19 bp, Homo sapiens
tctgggcagggccagcacc

SEQ ID NO: 9307332 - DNA, 23 bp, Homo sapiens
tctgggcaccttgttgacatgat

SEQ ID NO: 9307333 - DNA, 22 bp, Homo sapiens
tctgggccctaaaccagctcta

SEQ ID NO: 9307334 - DNA, 21 bp, Homo sapiens
tctgggcccatgctgcctcac

SEQ ID NO: 9307335 - DNA, 22 bp, Homo sapiens
tctgggcatgtctgtgaacacg

SEQ ID NO: 9307336 - DNA, 23 bp, Homo sapiens
tctgggccacttgtctgcacttc

SEQ ID NO: 9307337 - DNA, 22 bp, Homo sapiens
tctgggctgctgtgcagtgacc

SEQ ID NO: 9307338 - DNA, 21 bp, Homo sapiens
tctgggctgctgctgcccatc

SEQ ID NO: 9307339 - DNA, 22 bp, Homo sapiens
tctgggctgctatgaggcagag

SEQ ID NO: 9307340 - DNA, 22 bp, Homo sapiens
tctgggctgaaatgaaggcctt

SEQ ID NO: 9307341 - DNA, 23 bp, Homo sapiens
tctgggctgagctcgagtgtaga

SEQ ID NO: 9307342 - DNA, 23 bp, Homo sapiens
tctgggctgagacttggaaggtc

SEQ ID NO: 9307343 - DNA, 22 bp, Homo sapiens
tctgggagagcacgtggctgac

SEQ ID NO: 9307344 - DNA, 22 bp, Homo sapiens
tctgggagtgtgtctggccatc

SEQ ID NO: 9307345 - DNA, 22 bp, Homo sapiens
tctgggagtaaggcctaggcat

SEQ ID NO: 9307346 - DNA, 22 bp, Homo sapiens
tctgggagagtcacaggcattg

SEQ ID NO: 9307347 - DNA, 22 bp, Homo sapiens
tctgggagagctgctgtcagag

SEQ ID NO: 9307348 - DNA, 22 bp, Homo sapiens
tctggctgaaattagaaggttc

SEQ ID NO: 9307349 - DNA, 22 bp, Homo sapiens
tctggctgaagcttttgcagct

SEQ ID NO: 9307350 - DNA, 22 bp, Homo sapiens
tctggctgaaaggggctgtgcc

SEQ ID NO: 9307351 - DNA, 22 bp, Homo sapiens
tctggctccactttcttcattt

SEQ ID NO: 9307352 - DNA, 22 bp, Homo sapiens
tctggcccctggtctctggtgt

SEQ ID NO: 9307353 - DNA, 18 bp, Homo sapiens
tctggctttgttccttgt

SEQ ID NO: 9307354 - DNA, 22 bp, Homo sapiens
tctggctgacatcctgtatgag

SEQ ID NO: 9307355 - DNA, 22 bp, Homo sapiens
tctggctgaattagccttgggt

SEQ ID NO: 9307356 - DNA, 22 bp, Homo sapiens
tctggctgattccctgggactg

SEQ ID NO: 9307357 - DNA, 22 bp, Homo sapiens
tctggctgacatcctgtatgag

SEQ ID NO: 9307358 - DNA, 22 bp, Homo sapiens
tctggctgccaccatcctcccc

SEQ ID NO: 9307359 - DNA, 19 bp, Homo sapiens
tctggctgccaaggattga

SEQ ID NO: 9307360 - DNA, 22 bp, Homo sapiens
tctggctgcgtggcctttagca

SEQ ID NO: 9307361 - DNA, 22 bp, Homo sapiens
tctggctgcaccattatagtag

SEQ ID NO: 9307362 - DNA, 22 bp, Homo sapiens
tctggctggcagtgatggtgtg

SEQ ID NO: 9307363 - DNA, 22 bp, Homo sapiens
tctggctggcagtgatggtgtg

SEQ ID NO: 9307364 - DNA, 22 bp, Homo sapiens
tctggctgctgcgtgagtgctt

SEQ ID NO: 9307365 - DNA, 23 bp, Homo sapiens
tctggctgctcctttcaatgctc

SEQ ID NO: 9307366 - DNA, 22 bp, Homo sapiens
tctggctgtgtatgagagtttt

SEQ ID NO: 9307367 - DNA, 22 bp, Homo sapiens
tctggctgtgtaatatgtgtag

SEQ ID NO: 9307368 - DNA, 22 bp, Homo sapiens
tctggctttctgactctacaac

SEQ ID NO: 9307369 - DNA, 22 bp, Homo sapiens
tctggctgggtgagagcttctc

SEQ ID NO: 9307370 - DNA, 22 bp, Homo sapiens
tctggctgggtgagagcttctc

SEQ ID NO: 9307371 - DNA, 23 bp, Homo sapiens
tctggctgtaatatgaaagttag

SEQ ID NO: 9307372 - DNA, 22 bp, Homo sapiens
tctggctgggctgacattgaac

SEQ ID NO: 9307373 - DNA, 22 bp, Homo sapiens
tctggctggctcggccgggagt

SEQ ID NO: 9307374 - DNA, 22 bp, Homo sapiens
tctggctgggaagggggcccga

SEQ ID NO: 9307375 - DNA, 22 bp, Homo sapiens
tctggctgtgtaaggtagcacc

SEQ ID NO: 9307376 - DNA, 22 bp, Homo sapiens
tctggctgtcattggaggcccc

SEQ ID NO: 9307377 - DNA, 22 bp, Homo sapiens
tctggagtaattacagtgactg

SEQ ID NO: 9307378 - DNA, 22 bp, Homo sapiens
tctggagtagggtctgggaatt

SEQ ID NO: 9307379 - DNA, 22 bp, Homo sapiens
tctggagtctgagatctgagga

SEQ ID NO: 9307380 - DNA, 22 bp, Homo sapiens
tctggagttgtgcagtggacct

SEQ ID NO: 9307381 - DNA, 22 bp, Homo sapiens
tctggagtgtgtgtattcagct

SEQ ID NO: 9307382 - DNA, 22 bp, Homo sapiens
tctggcagtgatttctgtgatc

SEQ ID NO: 9307383 - DNA, 22 bp, Homo sapiens
tctggcagtgaagtcatgaggt

SEQ ID NO: 9307384 - DNA, 22 bp, Homo sapiens
tctggcaggtcaatcattcttt

SEQ ID NO: 9307385 - DNA, 22 bp, Homo sapiens
tctgctctagttgcttcctgcc

SEQ ID NO: 9307386 - DNA, 22 bp, Homo sapiens
tctgctctagttgcttcctgcc

SEQ ID NO: 9307387 - DNA, 17 bp, Homo sapiens
tctgctctgccaatcca

SEQ ID NO: 9307388 - DNA, 22 bp, Homo sapiens
tctgctctgtactgcactggcc

SEQ ID NO: 9307389 - DNA, 22 bp, Homo sapiens
tctgctctgtggcttcagctaa

SEQ ID NO: 9307390 - DNA, 22 bp, Homo sapiens
tctgctctgtggcttcagctaa

SEQ ID NO: 9307391 - DNA, 22 bp, Homo sapiens
tctgctgacatttatgaataga

SEQ ID NO: 9307392 - DNA, 22 bp, Homo sapiens
tctgctgccatgcagagcagta

SEQ ID NO: 9307393 - DNA, 22 bp, Homo sapiens
tctgctgcacaaattcatctct

SEQ ID NO: 9307394 - DNA, 22 bp, Homo sapiens
tctgctgctgcagctacactat

SEQ ID NO: 9307395 - DNA, 22 bp, Homo sapiens
tctgctgtaaccttcagaggta

SEQ ID NO: 9307396 - DNA, 22 bp, Homo sapiens
tctgctgttgagcacaagtgaa

SEQ ID NO: 9307397 - DNA, 22 bp, Homo sapiens
tctggacaatcctgagacagac

SEQ ID NO: 9307398 - DNA, 23 bp, Homo sapiens
tctggacataacggagaagcaaa

SEQ ID NO: 9307399 - DNA, 20 bp, Homo sapiens
tctgaggctgagctctactt

SEQ ID NO: 9307400 - DNA, 20 bp, Homo sapiens
tctgaggctgagcccagcgt

SEQ ID NO: 9307401 - DNA, 22 bp, Homo sapiens
tctgaggctatgttcaggctaa

SEQ ID NO: 9307402 - DNA, 22 bp, Homo sapiens
tctgaggctgaatggactccgt

SEQ ID NO: 9307403 - DNA, 22 bp, Homo sapiens
tctgaggctgaatggactccgt

SEQ ID NO: 9307404 - DNA, 22 bp, Homo sapiens
tctgaggctgcatctatgtgac

SEQ ID NO: 9307405 - DNA, 22 bp, Homo sapiens
tctgaggccctaccctgagcct

SEQ ID NO: 9307406 - DNA, 22 bp, Homo sapiens
tctgaggctaagagacagaggc

SEQ ID NO: 9307407 - DNA, 22 bp, Homo sapiens
tctgaggccttggcagctaagg

SEQ ID NO: 9307408 - DNA, 22 bp, Homo sapiens
tctgaggcctgaagcagcagag

SEQ ID NO: 9307409 - DNA, 22 bp, Homo sapiens
tctgaggcctgaagcagcagag

SEQ ID NO: 9307410 - DNA, 17 bp, Homo sapiens
tctgaggcctctaggag

SEQ ID NO: 9307411 - DNA, 21 bp, Homo sapiens
tctgatggtagatgagatgtg

SEQ ID NO: 9307412 - DNA, 22 bp, Homo sapiens
tctgatgttgcttctgcagaac

SEQ ID NO: 9307413 - DNA, 22 bp, Homo sapiens
tctgatgtgtttaagaaagaag

SEQ ID NO: 9307414 - DNA, 22 bp, Homo sapiens
tctgattccagtgaccctagga

SEQ ID NO: 9307415 - DNA, 22 bp, Homo sapiens
tctgattccagaaggggcatac

SEQ ID NO: 9307416 - DNA, 22 bp, Homo sapiens
tctgagcactgggcagtcggtg

SEQ ID NO: 9307417 - DNA, 22 bp, Homo sapiens
tctgagcatatgcagcacctgg

SEQ ID NO: 9307418 - DNA, 22 bp, Homo sapiens
tctgacatgagggctgtggaga

SEQ ID NO: 9307419 - DNA, 17 bp, Homo sapiens
tctgccagttttagaat

SEQ ID NO: 9307420 - DNA, 22 bp, Homo sapiens
tctgcattgtcccagaagtgac

SEQ ID NO: 9307421 - DNA, 22 bp, Homo sapiens
tctgcattacatgccatagaca

SEQ ID NO: 9307422 - DNA, 22 bp, Homo sapiens
tctgcatctcaggattcccttc

SEQ ID NO: 9307423 - DNA, 22 bp, Homo sapiens
tctgcatattgttaatggaatg

SEQ ID NO: 9307424 - DNA, 22 bp, Homo sapiens
tctgcagaaactgtgactatgt

SEQ ID NO: 9307425 - DNA, 22 bp, Homo sapiens
tctgcagaactttatgagcaaa

SEQ ID NO: 9307426 - DNA, 22 bp, Homo sapiens
tctgcacagctcacctccctgg

SEQ ID NO: 9307427 - DNA, 21 bp, Homo sapiens
tctgcacagccccgcaggagg

SEQ ID NO: 9307428 - DNA, 22 bp, Homo sapiens
tctgcacagagacccttgccag

SEQ ID NO: 9307429 - DNA, 22 bp, Homo sapiens
tctgcacaaaactgtcgcagaa

SEQ ID NO: 9307430 - DNA, 22 bp, Homo sapiens
tctgcacaattgatcatggcaa

SEQ ID NO: 9307431 - DNA, 22 bp, Homo sapiens
tctgccctaattcagtgcttag

SEQ ID NO: 9307432 - DNA, 21 bp, Homo sapiens
tctgccctccaggagctcata

SEQ ID NO: 9307433 - DNA, 22 bp, Homo sapiens
tctgccctcattgctgcctgga

SEQ ID NO: 9307434 - DNA, 22 bp, Homo sapiens
tctgcccaggacacctgccact

SEQ ID NO: 9307435 - DNA, 22 bp, Homo sapiens
tctgcccaggaggtcccatggg

SEQ ID NO: 9307436 - DNA, 22 bp, Homo sapiens
tctgccctggggtcagcctcca

SEQ ID NO: 9307437 - DNA, 22 bp, Homo sapiens
tctgccgtgcgaggtcccacca

SEQ ID NO: 9307438 - DNA, 22 bp, Homo sapiens
tctgcctagaaacagtgtttgc

SEQ ID NO: 9307439 - DNA, 22 bp, Homo sapiens
tctgcctaggtttccaatgtgc

SEQ ID NO: 9307440 - DNA, 18 bp, Homo sapiens
tctgccctgccattcact

SEQ ID NO: 9307441 - DNA, 22 bp, Homo sapiens
tctgccctggggtcagcctcca

SEQ ID NO: 9307442 - DNA, 18 bp, Homo sapiens
tctgcctgcagggcatct

SEQ ID NO: 9307443 - DNA, 22 bp, Homo sapiens
tctgcctgccagtctggtcctc

SEQ ID NO: 9307444 - DNA, 22 bp, Homo sapiens
tctgcctgctaactcctgcacc

SEQ ID NO: 9307445 - DNA, 22 bp, Homo sapiens
tctgcctgcgctcacggggccg

SEQ ID NO: 9307446 - DNA, 22 bp, Homo sapiens
tctgcctggattccattctcca

SEQ ID NO: 9307447 - DNA, 22 bp, Homo sapiens
tctgcctggcctggagggcaca

SEQ ID NO: 9307448 - DNA, 22 bp, Homo sapiens
tctgcctggctcatggcagtga

SEQ ID NO: 9307449 - DNA, 22 bp, Homo sapiens
tctgcctggcggactcccggaa

SEQ ID NO: 9307450 - DNA, 22 bp, Homo sapiens
tctgcctgtggatacatgctct

SEQ ID NO: 9307451 - DNA, 22 bp, Homo sapiens
tctgctcacatggctccatgca

SEQ ID NO: 9307452 - DNA, 22 bp, Homo sapiens
tctgctcagcatccctctgaga

SEQ ID NO: 9307453 - DNA, 22 bp, Homo sapiens
tctgctcagccgatctgctccg

SEQ ID NO: 9307454 - DNA, 22 bp, Homo sapiens
tctgctcaggttacctagctag

SEQ ID NO: 9307455 - DNA, 22 bp, Homo sapiens
tctggggttttcacgctgtctc

SEQ ID NO: 9307456 - DNA, 22 bp, Homo sapiens
tctgggggttaagtgaggacaa

SEQ ID NO: 9307457 - DNA, 20 bp, Homo sapiens
tctggggtgaagcccaggaa

SEQ ID NO: 9307458 - DNA, 22 bp, Homo sapiens
tctgggcttgcctggttgtgca

SEQ ID NO: 9307459 - DNA, 20 bp, Homo sapiens
tctgggcttcccccagctcc

SEQ ID NO: 9307460 - DNA, 22 bp, Homo sapiens
tctgggctgtctacaggttggc

SEQ ID NO: 9307461 - DNA, 22 bp, Homo sapiens
tctgggctggttgtgcttgctt

SEQ ID NO: 9307462 - DNA, 22 bp, Homo sapiens
tctgggctgcttcagccttcgc

SEQ ID NO: 9307463 - DNA, 22 bp, Homo sapiens
tctgggcttggattggctctgc

SEQ ID NO: 9307464 - DNA, 22 bp, Homo sapiens
tctgggcttggttagggctgtt

SEQ ID NO: 9307465 - DNA, 22 bp, Homo sapiens
tctgggctttaagaactctgtt

SEQ ID NO: 9307466 - DNA, 22 bp, Homo sapiens
tctgggctttacactgtgctta

SEQ ID NO: 9307467 - DNA, 22 bp, Homo sapiens
tctgggggcgaccagggactgc

SEQ ID NO: 9307468 - DNA, 22 bp, Homo sapiens
tctgtacagtaccagatagtaa

SEQ ID NO: 9307469 - DNA, 21 bp, Homo sapiens
tctgtacatcattgagtcccc

SEQ ID NO: 9307470 - DNA, 22 bp, Homo sapiens
tctgtacacttcagcatgcatc

SEQ ID NO: 9307471 - DNA, 20 bp, Homo sapiens
tctgtacactcatcttctgc

SEQ ID NO: 9307472 - DNA, 22 bp, Homo sapiens
tctgtacaccaggggccattct

SEQ ID NO: 9307473 - DNA, 22 bp, Homo sapiens
tctgtacaacaaagggatgaga

SEQ ID NO: 9307474 - DNA, 23 bp, Homo sapiens
tctgtacaattgagaagagaaca

SEQ ID NO: 9307475 - DNA, 23 bp, Homo sapiens
tctgtacacatcagcatctccca

SEQ ID NO: 9307476 - DNA, 22 bp, Homo sapiens
tctgtaatcttccccagctcag

SEQ ID NO: 9307477 - DNA, 22 bp, Homo sapiens
tctgtacaaaggctatttggag

SEQ ID NO: 9307478 - DNA, 22 bp, Homo sapiens
tctgtaaatcctgctcagcaac

SEQ ID NO: 9307479 - DNA, 20 bp, Homo sapiens
tctgtaaagactccagaagc

SEQ ID NO: 9307480 - DNA, 22 bp, Homo sapiens
tctgtaaagactccaaaagcca

SEQ ID NO: 9307481 - DNA, 22 bp, Homo sapiens
tctgtacatgagttgagaatca

SEQ ID NO: 9307482 - DNA, 22 bp, Homo sapiens
tctgtacatttgtgttgtgaat

SEQ ID NO: 9307483 - DNA, 22 bp, Homo sapiens
tctgtacatttggggaccccag

SEQ ID NO: 9307484 - DNA, 22 bp, Homo sapiens
tctgtcctccacactgtaagtt

SEQ ID NO: 9307485 - DNA, 22 bp, Homo sapiens
tctgtcatgccacaggacttgg

SEQ ID NO: 9307486 - DNA, 20 bp, Homo sapiens
tctgtctctgagctagactt

SEQ ID NO: 9307487 - DNA, 21 bp, Homo sapiens
tctgtctctccactgccctgc

SEQ ID NO: 9307488 - DNA, 22 bp, Homo sapiens
tctgtctcctgccagtgcctct

SEQ ID NO: 9307489 - DNA, 22 bp, Homo sapiens
tctgtcctctttgaagctgctc

SEQ ID NO: 9307490 - DNA, 22 bp, Homo sapiens
tctgtcctgtttcctcctgaca

SEQ ID NO: 9307491 - DNA, 22 bp, Homo sapiens
tctgtcctgtttcctcctgaca

SEQ ID NO: 9307492 - DNA, 18 bp, Homo sapiens
tctgtccttccattcttc

SEQ ID NO: 9307493 - DNA, 22 bp, Homo sapiens
tctgtctcaagttcttgcactc

SEQ ID NO: 9307494 - DNA, 22 bp, Homo sapiens
tctgtctcctctgaggtgccag

SEQ ID NO: 9307495 - DNA, 22 bp, Homo sapiens
tctgtctcctcagatgactcca

SEQ ID NO: 9307496 - DNA, 22 bp, Homo sapiens
tctgtctttgagatctcagcct

SEQ ID NO: 9307497 - DNA, 22 bp, Homo sapiens
tctgtgcaagtatttgacattt

SEQ ID NO: 9307498 - DNA, 22 bp, Homo sapiens
tctgtgcaccagaatgatattt

SEQ ID NO: 9307499 - DNA, 22 bp, Homo sapiens
tctgtctgcgcttgccctggtg

SEQ ID NO: 9307500 - DNA, 22 bp, Homo sapiens
tctgtctgcttcacttgcattt

SEQ ID NO: 9307501 - DNA, 22 bp, Homo sapiens
tctgtgcctcatctggttcagg

SEQ ID NO: 9307502 - DNA, 22 bp, Homo sapiens
tctgtgcagggaccccaagagt

SEQ ID NO: 9307503 - DNA, 22 bp, Homo sapiens
tctgtgcaggaagtcattatga

SEQ ID NO: 9307504 - DNA, 22 bp, Homo sapiens
tctgtgcactaacattcctggt

SEQ ID NO: 9307505 - DNA, 22 bp, Homo sapiens
tctgtttcttcctagccatgct

SEQ ID NO: 9307506 - DNA, 22 bp, Homo sapiens
tcttaaaccacaaaattcagag

SEQ ID NO: 9307507 - DNA, 22 bp, Homo sapiens
tcttaaaagtatgccaattgga

SEQ ID NO: 9307508 - DNA, 22 bp, Homo sapiens
tcttatgaaaagcacttagaac

SEQ ID NO: 9307509 - DNA, 22 bp, Homo sapiens
tcttataatctctattttaatg

SEQ ID NO: 9307510 - DNA, 22 bp, Homo sapiens
tcttagcatttgttaataccca

SEQ ID NO: 9307511 - DNA, 22 bp, Homo sapiens
tcttagcatttcataacaactg

SEQ ID NO: 9307512 - DNA, 22 bp, Homo sapiens
tcttagcacagctatataagtt

SEQ ID NO: 9307513 - DNA, 22 bp, Homo sapiens
tcttagcaaatactacttagaa

SEQ ID NO: 9307514 - DNA, 22 bp, Homo sapiens
tcttaactatcatttgaacacc

SEQ ID NO: 9307515 - DNA, 22 bp, Homo sapiens
tctgtgtgaccataagccagct

SEQ ID NO: 9307516 - DNA, 22 bp, Homo sapiens
tctgtgtgatttcagggaagtc

SEQ ID NO: 9307517 - DNA, 22 bp, Homo sapiens
tctgtgtgcccacctgacacct

SEQ ID NO: 9307518 - DNA, 22 bp, Homo sapiens
tctgtgtgggatagtttgagga

SEQ ID NO: 9307519 - DNA, 22 bp, Homo sapiens
tctgttagagaatcagtgaggt

SEQ ID NO: 9307520 - DNA, 22 bp, Homo sapiens
tctgttagagaggtagttcttg

SEQ ID NO: 9307521 - DNA, 22 bp, Homo sapiens
tctgttagctgtcaaagtgttt

SEQ ID NO: 9307522 - DNA, 16 bp, Homo sapiens
tctgttaggtagtaaa

SEQ ID NO: 9307523 - DNA, 22 bp, Homo sapiens
tctgttaggttactggttctgt

SEQ ID NO: 9307524 - DNA, 22 bp, Homo sapiens
tctgtgtgttgtcaggaggatt

SEQ ID NO: 9307525 - DNA, 22 bp, Homo sapiens
tctgttatgcataagcatcagt

SEQ ID NO: 9307526 - DNA, 22 bp, Homo sapiens
tctgttcttggtgcagctggga

SEQ ID NO: 9307527 - DNA, 22 bp, Homo sapiens
tctgttctttccaacaagacag

SEQ ID NO: 9307528 - DNA, 22 bp, Homo sapiens
tcttcaggctctggctgccttt

SEQ ID NO: 9307529 - DNA, 22 bp, Homo sapiens
tcttccagatacttcctgactt

SEQ ID NO: 9307530 - DNA, 22 bp, Homo sapiens
tcttccagaatctcagagggct

SEQ ID NO: 9307531 - DNA, 22 bp, Homo sapiens
tcttattcagtgggctctgcca

SEQ ID NO: 9307532 - DNA, 22 bp, Homo sapiens
tcttattttagagccccgagcc

SEQ ID NO: 9307533 - DNA, 22 bp, Homo sapiens
tcttcaaactgaaaatttagaa

SEQ ID NO: 9307534 - DNA, 22 bp, Homo sapiens
tcttcaaactgaaaatttagaa

SEQ ID NO: 9307535 - DNA, 22 bp, Homo sapiens
tcttcaaagaagccttggatta

SEQ ID NO: 9307536 - DNA, 22 bp, Homo sapiens
tcttcaaagaattttagtaatt

SEQ ID NO: 9307537 - DNA, 22 bp, Homo sapiens
tcttcaaagcatatgcaggcat

SEQ ID NO: 9307538 - DNA, 22 bp, Homo sapiens
tcttcaaagaattttagtaatt

SEQ ID NO: 9307539 - DNA, 22 bp, Homo sapiens
tcttcaaaaaatatccatcagt

SEQ ID NO: 9307540 - DNA, 22 bp, Homo sapiens
tcttcaaaaactgcaccttgct

SEQ ID NO: 9307541 - DNA, 22 bp, Homo sapiens
tcttcaaaccctggttttgtga

SEQ ID NO: 9307542 - DNA, 22 bp, Homo sapiens
tcttcaaaccctggctcttcct

SEQ ID NO: 9307543 - DNA, 22 bp, Homo sapiens
tcttcaaaattgattggagaag

SEQ ID NO: 9307544 - DNA, 22 bp, Homo sapiens
tcttcaaaaatacaggttttca

SEQ ID NO: 9307545 - DNA, 22 bp, Homo sapiens
tcttcaaaatattccatccatt

SEQ ID NO: 9307546 - DNA, 22 bp, Homo sapiens
tcttcacacacagtcctctttc

SEQ ID NO: 9307547 - DNA, 22 bp, Homo sapiens
tcttcaacagtaaacccacttt

SEQ ID NO: 9307548 - DNA, 22 bp, Homo sapiens
tcttcaaatgctagtaatatca

SEQ ID NO: 9307549 - DNA, 22 bp, Homo sapiens
tcttcaaatcctacagtgtctg

SEQ ID NO: 9307550 - DNA, 22 bp, Homo sapiens
tcttcaaatgagtgtggattat

SEQ ID NO: 9307551 - DNA, 22 bp, Homo sapiens
tcttcaaatcctacagtgtctg

SEQ ID NO: 9307552 - DNA, 22 bp, Homo sapiens
tcttcaaatacagtcatattga

SEQ ID NO: 9307553 - DNA, 22 bp, Homo sapiens
tcttcacatgaccttcatgtct

SEQ ID NO: 9307554 - DNA, 23 bp, Homo sapiens
tcttcacagggcttcccatgtgc

SEQ ID NO: 9307555 - DNA, 22 bp, Homo sapiens
tcttctccagttcatcctacca

SEQ ID NO: 9307556 - DNA, 22 bp, Homo sapiens
tcttctccagttcatcctacca

SEQ ID NO: 9307557 - DNA, 22 bp, Homo sapiens
tcttctccagtgcttctgcaca

SEQ ID NO: 9307558 - DNA, 22 bp, Homo sapiens
tcttctcccatctccaggcagg

SEQ ID NO: 9307559 - DNA, 22 bp, Homo sapiens
tcttctcccagggtcgcccaag

SEQ ID NO: 9307560 - DNA, 22 bp, Homo sapiens
tcttctccataatcaacactct

SEQ ID NO: 9307561 - DNA, 22 bp, Homo sapiens
tcttctctacaccagcagcccc

SEQ ID NO: 9307562 - DNA, 22 bp, Homo sapiens
tcttctctcatgtaggagggaa

SEQ ID NO: 9307563 - DNA, 22 bp, Homo sapiens
tcttctctacaccagcagcccc

SEQ ID NO: 9307564 - DNA, 22 bp, Homo sapiens
tcttctcctttgccatgtgttt

SEQ ID NO: 9307565 - DNA, 22 bp, Homo sapiens
tcttctttggatgaaagaatat

SEQ ID NO: 9307566 - DNA, 22 bp, Homo sapiens
tcttctttgaatcatagtgacc

SEQ ID NO: 9307567 - DNA, 22 bp, Homo sapiens
tcttctttatgtcatatgccag

SEQ ID NO: 9307568 - DNA, 22 bp, Homo sapiens
tcttcttcccatccctcaaatg

SEQ ID NO: 9307569 - DNA, 22 bp, Homo sapiens
tcttcctttcattcatgtgtta

SEQ ID NO: 9307570 - DNA, 22 bp, Homo sapiens
tcttccttctttgatgacaagg

SEQ ID NO: 9307571 - DNA, 20 bp, Homo sapiens
tcttccagcttctggtagaa

SEQ ID NO: 9307572 - DNA, 22 bp, Homo sapiens
tcttccaggccctgccacagct

SEQ ID NO: 9307573 - DNA, 21 bp, Homo sapiens
tcttcctccacagcgtgccac

SEQ ID NO: 9307574 - DNA, 22 bp, Homo sapiens
tcttccagggagcctcaaacct

SEQ ID NO: 9307575 - DNA, 22 bp, Homo sapiens
tcttcctccctacagagctcag

SEQ ID NO: 9307576 - DNA, 22 bp, Homo sapiens
tctttagtattgagttatggta

SEQ ID NO: 9307577 - DNA, 22 bp, Homo sapiens
tctttagagcacgggaaaaaca

SEQ ID NO: 9307578 - DNA, 22 bp, Homo sapiens
tctttagagctcagaaatacag

SEQ ID NO: 9307579 - DNA, 22 bp, Homo sapiens
tctttattgctactggtttgtc

SEQ ID NO: 9307580 - DNA, 22 bp, Homo sapiens
tctttattgctactggtttgtc

SEQ ID NO: 9307581 - DNA, 21 bp, Homo sapiens
tctttccaatattcatgtctc

SEQ ID NO: 9307582 - DNA, 22 bp, Homo sapiens
tctttcccagtagctctcccag

SEQ ID NO: 9307583 - DNA, 22 bp, Homo sapiens
tctttccctgtgttagcctgta

SEQ ID NO: 9307584 - DNA, 17 bp, Homo sapiens
tctttccctgggagatg

SEQ ID NO: 9307585 - DNA, 22 bp, Homo sapiens
tctttccttagaataattcttt

SEQ ID NO: 9307586 - DNA, 22 bp, Homo sapiens
tctttctacatcatttgcttct

SEQ ID NO: 9307587 - DNA, 22 bp, Homo sapiens
tctttcctgtaactgctgttca

SEQ ID NO: 9307588 - DNA, 22 bp, Homo sapiens
tctttcctctgagctcctgtag

SEQ ID NO: 9307589 - DNA, 22 bp, Homo sapiens
tctttcttacaaagaaaacggt

SEQ ID NO: 9307590 - DNA, 22 bp, Homo sapiens
tctttgaattcaaactgttcaa

SEQ ID NO: 9307591 - DNA, 22 bp, Homo sapiens
tctttgaagtatcttaaatggt

SEQ ID NO: 9307592 - DNA, 22 bp, Homo sapiens
tcttgcttctgctcaaggggag

SEQ ID NO: 9307593 - DNA, 22 bp, Homo sapiens
tcttgatgctttttctaaatgt

SEQ ID NO: 9307594 - DNA, 22 bp, Homo sapiens
tcttgagtgcgcttgggtgttc

SEQ ID NO: 9307595 - DNA, 22 bp, Homo sapiens
tcttggcagtggaataccagga

SEQ ID NO: 9307596 - DNA, 22 bp, Homo sapiens
tcttggcaatttgatctcagtt

SEQ ID NO: 9307597 - DNA, 22 bp, Homo sapiens
tctttacatcacaattgtatgg

SEQ ID NO: 9307598 - DNA, 23 bp, Homo sapiens
tctttagaagaacatcagaaatg

SEQ ID NO: 9307599 - DNA, 23 bp, Homo sapiens
tctttagaagaacatcagaaatg

SEQ ID NO: 9307600 - DNA, 22 bp, Homo sapiens
tctttaattgtggaagagcagc

SEQ ID NO: 9307601 - DNA, 22 bp, Homo sapiens
tctttaatgtgattgtaattat

SEQ ID NO: 9307602 - DNA, 22 bp, Homo sapiens
tctttaatgtgattgtaattat

SEQ ID NO: 9307603 - DNA, 22 bp, Homo sapiens
tctttacaagtcacattttctg

SEQ ID NO: 9307604 - DNA, 22 bp, Homo sapiens
aatattagtttctcaagagaga

SEQ ID NO: 9307605 - DNA, 22 bp, Homo sapiens
aatatgtttataagatatcttc

SEQ ID NO: 9307606 - DNA, 20 bp, Homo sapiens
agaaaatgttttcagctgga

SEQ ID NO: 9307607 - DNA, 21 bp, Homo sapiens
agaaaatggcgttttagattt

SEQ ID NO: 9307608 - DNA, 22 bp, Homo sapiens
agaaacctgggggttgtacata

SEQ ID NO: 9307609 - DNA, 22 bp, Homo sapiens
agaaactacttggaggaaagat

SEQ ID NO: 9307610 - DNA, 22 bp, Homo sapiens
aatctgtttccattagagtcat

SEQ ID NO: 9307611 - DNA, 22 bp, Homo sapiens
aatctgtttccatgttttattg

SEQ ID NO: 9307612 - DNA, 22 bp, Homo sapiens
aatctgtttgatgcttgtgata

SEQ ID NO: 9307613 - DNA, 22 bp, Homo sapiens
aatctgtttgtttacacctttt

SEQ ID NO: 9307614 - DNA, 22 bp, Homo sapiens
aatctgttttaaagtttgtgcc

SEQ ID NO: 9307615 - DNA, 22 bp, Homo sapiens
aatctgtttccaatacttgcta

SEQ ID NO: 9307616 - DNA, 22 bp, Homo sapiens
aatctgtttagttctgcgtatg

SEQ ID NO: 9307617 - DNA, 22 bp, Homo sapiens
aatctgttcccagagcttgtct

SEQ ID NO: 9307618 - DNA, 17 bp, Homo sapiens
aatctgtttacagtcag

SEQ ID NO: 9307619 - DNA, 22 bp, Homo sapiens
aatctgttttctgcctctatga

SEQ ID NO: 9307620 - DNA, 22 bp, Homo sapiens
aatctgtttttgaaactttgta

SEQ ID NO: 9307621 - DNA, 22 bp, Homo sapiens
aatctgttttatcatttgttac

SEQ ID NO: 9307622 - DNA, 22 bp, Homo sapiens
aatctattccctttctgtaaaa

SEQ ID NO: 9307623 - DNA, 22 bp, Homo sapiens
aatctgtttaacagatttctgt

SEQ ID NO: 9307624 - DNA, 22 bp, Homo sapiens
aatctgttgatgcaaacctccc

SEQ ID NO: 9307625 - DNA, 22 bp, Homo sapiens
aatctgttgtcaggaatccaca

SEQ ID NO: 9307626 - DNA, 22 bp, Homo sapiens
aatctgttctactctattcaga

SEQ ID NO: 9307627 - DNA, 22 bp, Homo sapiens
aatctgttcctgaggcaccaga

SEQ ID NO: 9307628 - DNA, 22 bp, Homo sapiens
aatctgttaggatgaggatacg

SEQ ID NO: 9307629 - DNA, 22 bp, Homo sapiens
aatctgttaagaacagaaatgt

SEQ ID NO: 9307630 - DNA, 22 bp, Homo sapiens
aatcttcataaaaatctagtag

SEQ ID NO: 9307631 - DNA, 22 bp, Homo sapiens
aatcttcagcactccagagact

SEQ ID NO: 9307632 - DNA, 22 bp, Homo sapiens
aatcttcagagaccatggagcc

SEQ ID NO: 9307633 - DNA, 22 bp, Homo sapiens
aatcttcacagaaaaatgtctg

SEQ ID NO: 9307634 - DNA, 22 bp, Homo sapiens
aatcttcattttgacaagattc

SEQ ID NO: 9307635 - DNA, 22 bp, Homo sapiens
aatcttcattttgacaagattc

SEQ ID NO: 9307636 - DNA, 22 bp, Homo sapiens
aatctttccctattaaatgtgg

SEQ ID NO: 9307637 - DNA, 22 bp, Homo sapiens
aatctttcattcattcatacat

SEQ ID NO: 9307638 - DNA, 22 bp, Homo sapiens
acttagcaggtactttcatatt

SEQ ID NO: 9307639 - DNA, 22 bp, Homo sapiens
acttagcagtttagaatatgtc

SEQ ID NO: 9307640 - DNA, 22 bp, Homo sapiens
acttagcattatgtaattacta

SEQ ID NO: 9307641 - DNA, 22 bp, Homo sapiens
aatagaaaggaggggctcttgt

SEQ ID NO: 9307642 - DNA, 22 bp, Homo sapiens
acttagcaatttgattaaaaga

SEQ ID NO: 9307643 - DNA, 22 bp, Homo sapiens
acttcctgcaatcgtccactcc

SEQ ID NO: 9307644 - DNA, 22 bp, Homo sapiens
aagtgggcggtttatgattctg

SEQ ID NO: 9307645 - DNA, 23 bp, Homo sapiens
actcagagaccccgggaagtgac

SEQ ID NO: 9307646 - DNA, 22 bp, Homo sapiens
actcagagatatggtggttgat

SEQ ID NO: 9307647 - DNA, 22 bp, Homo sapiens
actcagtacatctggagttggc

SEQ ID NO: 9307648 - DNA, 22 bp, Homo sapiens
actcagagcagagcagcctgag

SEQ ID NO: 9307649 - DNA, 22 bp, Homo sapiens
actcatcagattagattagggc

SEQ ID NO: 9307650 - DNA, 22 bp, Homo sapiens
aagttttatgggaagatgtgca

SEQ ID NO: 9307651 - DNA, 22 bp, Homo sapiens
aataaagcctgtctctttagag

SEQ ID NO: 9307652 - DNA, 22 bp, Homo sapiens
aagtgaaattgccattcttata

SEQ ID NO: 9307653 - DNA, 22 bp, Homo sapiens
aagtgaaattgccattcttata

SEQ ID NO: 9307654 - DNA, 22 bp, Homo sapiens
aagtgatttctgcctgcatgtt

SEQ ID NO: 9307655 - DNA, 18 bp, Homo sapiens
acctgcctgttcttctct

SEQ ID NO: 9307656 - DNA, 22 bp, Homo sapiens
acctggctggttgtgattccca

SEQ ID NO: 9307657 - DNA, 18 bp, Homo sapiens
acctggctgtgtgagctg

SEQ ID NO: 9307658 - DNA, 22 bp, Homo sapiens
acagtgctgatctagactgacc

SEQ ID NO: 9307659 - DNA, 22 bp, Homo sapiens
acaggtgattcaggctctggga

SEQ ID NO: 9307660 - DNA, 22 bp, Homo sapiens
acaggtgatgacatttgaacca

SEQ ID NO: 9307661 - DNA, 22 bp, Homo sapiens
acagtctttgcagaagcaatat

SEQ ID NO: 9307662 - DNA, 22 bp, Homo sapiens
acagtctttgcaaagtcctggt

SEQ ID NO: 9307663 - DNA, 22 bp, Homo sapiens
acaggtcctcaagtcagctggg

SEQ ID NO: 9307664 - DNA, 22 bp, Homo sapiens
acaggtccttataagagcactc

SEQ ID NO: 9307665 - DNA, 22 bp, Homo sapiens
acaggtctactggcaagcagtg

SEQ ID NO: 9307666 - DNA, 22 bp, Homo sapiens
acaggtgaggatctgagcctca

SEQ ID NO: 9307667 - DNA, 22 bp, Homo sapiens
acaggtctgtgtgcacagtgct

SEQ ID NO: 9307668 - DNA, 22 bp, Homo sapiens
acaggtctgcagtaactgggaa

SEQ ID NO: 9307669 - DNA, 22 bp, Homo sapiens
acaggtctggtctgggtgggac

SEQ ID NO: 9307670 - DNA, 23 bp, Homo sapiens
acagggcttatctgtcactcatc

SEQ ID NO: 9307671 - DNA, 22 bp, Homo sapiens
acaggctttatgtagtgactta

SEQ ID NO: 9307672 - DNA, 20 bp, Homo sapiens
acaggctttctgaggctggc

SEQ ID NO: 9307673 - DNA, 22 bp, Homo sapiens
acaggcttgcactagggtggca

SEQ ID NO: 9307674 - DNA, 22 bp, Homo sapiens
acaggcttagggcttgggcccg

SEQ ID NO: 9307675 - DNA, 22 bp, Homo sapiens
acaggctgttggggtccagggt

SEQ ID NO: 9307676 - DNA, 23 bp, Homo sapiens
acaggctcttaatcagtgctcct

SEQ ID NO: 9307677 - DNA, 23 bp, Homo sapiens
acaggctcttaatcagtgctcct

SEQ ID NO: 9307678 - DNA, 22 bp, Homo sapiens
acaggctgaggatgattgcatc

SEQ ID NO: 9307679 - DNA, 22 bp, Homo sapiens
acaggaggagcagctgtgtgcc

SEQ ID NO: 9307680 - DNA, 22 bp, Homo sapiens
acaggagcccaggatgggcgga

SEQ ID NO: 9307681 - DNA, 22 bp, Homo sapiens
acaggcagagaactcagccaga

SEQ ID NO: 9307682 - DNA, 19 bp, Homo sapiens
acaggcagaattgggtgtg

SEQ ID NO: 9307683 - DNA, 22 bp, Homo sapiens
acaggcactgtcaagtcatgaa

SEQ ID NO: 9307684 - DNA, 22 bp, Homo sapiens
acaggcactgtcaagtcatgaa

SEQ ID NO: 9307685 - DNA, 22 bp, Homo sapiens
acaggcactgtcaagtcatgaa

SEQ ID NO: 9307686 - DNA, 22 bp, Homo sapiens
acaggcagagaactcagccaga

SEQ ID NO: 9307687 - DNA, 22 bp, Homo sapiens
acaggcagagagtggcggactc

SEQ ID NO: 9307688 - DNA, 22 bp, Homo sapiens
acaggcagagagtggcggactc

SEQ ID NO: 9307689 - DNA, 22 bp, Homo sapiens
aagccctgagcactgcagagaa

SEQ ID NO: 9307690 - DNA, 22 bp, Homo sapiens
aagccctgcagtctctgccaca

SEQ ID NO: 9307691 - DNA, 22 bp, Homo sapiens
acaggctctggggcaggatggc

SEQ ID NO: 9307692 - DNA, 22 bp, Homo sapiens
aagccctgccacccattcactg

SEQ ID NO: 9307693 - DNA, 22 bp, Homo sapiens
aagccctggaactttcctagcc

SEQ ID NO: 9307694 - DNA, 22 bp, Homo sapiens
acaggaaattggcatatcagtt

SEQ ID NO: 9307695 - DNA, 22 bp, Homo sapiens
acagcttttctgatagatcctg

SEQ ID NO: 9307696 - DNA, 22 bp, Homo sapiens
acagcttttgaaaaattactgg

SEQ ID NO: 9307697 - DNA, 22 bp, Homo sapiens
acagcttcttgtttcccaggag

SEQ ID NO: 9307698 - DNA, 22 bp, Homo sapiens
acagatttttggtaaataattt

SEQ ID NO: 9307699 - DNA, 22 bp, Homo sapiens
acagatttgactggtacctggc

SEQ ID NO: 9307700 - DNA, 22 bp, Homo sapiens
accaggaaaaacactgtgttgg

SEQ ID NO: 9307701 - DNA, 22 bp, Homo sapiens
accaggcaaaaccacaggagca

SEQ ID NO: 9307702 - DNA, 22 bp, Homo sapiens
accaggccaacagctaagttaa

SEQ ID NO: 9307703 - DNA, 22 bp, Homo sapiens
accaggccaaaatcatatttac

SEQ ID NO: 9307704 - DNA, 22 bp, Homo sapiens
aagtaaaagcaggtgtgctggg

SEQ ID NO: 9307705 - DNA, 22 bp, Homo sapiens
aagtaaaatgtttcctttatta

SEQ ID NO: 9307706 - DNA, 22 bp, Homo sapiens
aagtaaaagctttaccatgcgc

SEQ ID NO: 9307707 - DNA, 22 bp, Homo sapiens
aagggcagctattatcgtcatc

SEQ ID NO: 9307708 - DNA, 22 bp, Homo sapiens
aagggcagctgacagatgctta

SEQ ID NO: 9307709 - DNA, 22 bp, Homo sapiens
aagggcagcctgactcacggtc

SEQ ID NO: 9307710 - DNA, 22 bp, Homo sapiens
aagggcagcttaaattggtagc

SEQ ID NO: 9307711 - DNA, 22 bp, Homo sapiens
accagcagagttgaggaggaca

SEQ ID NO: 9307712 - DNA, 22 bp, Homo sapiens
accaccccagaatttttcaagg

SEQ ID NO: 9307713 - DNA, 22 bp, Homo sapiens
acattcttaacagttaaaaact

SEQ ID NO: 9307714 - DNA, 22 bp, Homo sapiens
aaggccaggacaccaggggact

SEQ ID NO: 9307715 - DNA, 22 bp, Homo sapiens
aaggccagctggagggatgagg

SEQ ID NO: 9307716 - DNA, 22 bp, Homo sapiens
aaggccagcttgtagggctggt

SEQ ID NO: 9307717 - DNA, 21 bp, Homo sapiens
acatgggacctgcgaaaggaa

SEQ ID NO: 9307718 - DNA, 22 bp, Homo sapiens
acataataggtgcctgaatatt

SEQ ID NO: 9307719 - DNA, 22 bp, Homo sapiens
acataatagcatttctaatttg

SEQ ID NO: 9307720 - DNA, 22 bp, Homo sapiens
acataataggtacctgaataat

SEQ ID NO: 9307721 - DNA, 22 bp, Homo sapiens
agcccaggtggagtgtgtgggg

SEQ ID NO: 9307722 - DNA, 22 bp, Homo sapiens
agcccaggtctcaaagtacagg

SEQ ID NO: 9307723 - DNA, 22 bp, Homo sapiens
acagaacaggctgagaaaaaca

SEQ ID NO: 9307724 - DNA, 22 bp, Homo sapiens
acagaacatggatttttgaagt

SEQ ID NO: 9307725 - DNA, 22 bp, Homo sapiens
agcccagggctaataggaacca

SEQ ID NO: 9307726 - DNA, 22 bp, Homo sapiens
agcccaggtccagttcactgca

SEQ ID NO: 9307727 - DNA, 22 bp, Homo sapiens
agcatttaatcctacatagatc

SEQ ID NO: 9307728 - DNA, 22 bp, Homo sapiens
acagaacagagggttttagaat

SEQ ID NO: 9307729 - DNA, 20 bp, Homo sapiens
agccaggctcaagctccccc

SEQ ID NO: 9307730 - DNA, 22 bp, Homo sapiens
agcatgaaaacatgaaacagca

SEQ ID NO: 9307731 - DNA, 22 bp, Homo sapiens
agcatcctgcctctcctcccaa

SEQ ID NO: 9307732 - DNA, 22 bp, Homo sapiens
agcatcctgcctctcctcccaa

SEQ ID NO: 9307733 - DNA, 22 bp, Homo sapiens
agccctggggctggtcttggaa

SEQ ID NO: 9307734 - DNA, 22 bp, Homo sapiens
agccctgccattctctggagct

SEQ ID NO: 9307735 - DNA, 22 bp, Homo sapiens
agcccctgtcctctctgatgac

SEQ ID NO: 9307736 - DNA, 22 bp, Homo sapiens
agcccctgtcctctctgatgac

SEQ ID NO: 9307737 - DNA, 22 bp, Homo sapiens
agccctgcacaggtctgtggct

SEQ ID NO: 9307738 - DNA, 22 bp, Homo sapiens
agcccctgtaccctgagtgctt

SEQ ID NO: 9307739 - DNA, 22 bp, Homo sapiens
agcccctgtaccctgagtgctt

SEQ ID NO: 9307740 - DNA, 20 bp, Homo sapiens
agcctgctgtagaagtttgg

SEQ ID NO: 9307741 - DNA, 22 bp, Homo sapiens
agcctgcttccctttgtgcccc

SEQ ID NO: 9307742 - DNA, 22 bp, Homo sapiens
agccctggtagcctgctgccat

SEQ ID NO: 9307743 - DNA, 22 bp, Homo sapiens
agcctgctggaccaagctcatg

SEQ ID NO: 9307744 - DNA, 22 bp, Homo sapiens
agcctgctgggaagggaggctt

SEQ ID NO: 9307745 - DNA, 22 bp, Homo sapiens
agcctggccaggcctgcccagg

SEQ ID NO: 9307746 - DNA, 22 bp, Homo sapiens
agcctggcctgggcaggcacat

SEQ ID NO: 9307747 - DNA, 22 bp, Homo sapiens
agccctggggctggtgcttacc

SEQ ID NO: 9307748 - DNA, 22 bp, Homo sapiens
agccctgggttagggtgggagc

SEQ ID NO: 9307749 - DNA, 22 bp, Homo sapiens
agccctggtttgcagcatttgc

SEQ ID NO: 9307750 - DNA, 22 bp, Homo sapiens
agccttaaatgctagattcata

SEQ ID NO: 9307751 - DNA, 22 bp, Homo sapiens
agcctggctgtaacctcatggt

SEQ ID NO: 9307752 - DNA, 22 bp, Homo sapiens
agcctggctgggaagagcctct

SEQ ID NO: 9307753 - DNA, 22 bp, Homo sapiens
agcctggcggtcgtcggtcagg

SEQ ID NO: 9307754 - DNA, 22 bp, Homo sapiens
agcctggctaaattctcccatg

SEQ ID NO: 9307755 - DNA, 22 bp, Homo sapiens
agcctggctgggaagagcctct

SEQ ID NO: 9307756 - DNA, 22 bp, Homo sapiens
agcctggctgtaacctcatggt

SEQ ID NO: 9307757 - DNA, 22 bp, Homo sapiens
agcctggcttaatcctcctttt

SEQ ID NO: 9307758 - DNA, 22 bp, Homo sapiens
agcctggcttaatcctcctttt

SEQ ID NO: 9307759 - DNA, 22 bp, Homo sapiens
agctcaggccggagctacaggc

SEQ ID NO: 9307760 - DNA, 22 bp, Homo sapiens
agccttagataaatgctagctc

SEQ ID NO: 9307761 - DNA, 22 bp, Homo sapiens
agctcaggctctgcagggacta

SEQ ID NO: 9307762 - DNA, 22 bp, Homo sapiens
agctcagggcaaagactcaaat

SEQ ID NO: 9307763 - DNA, 22 bp, Homo sapiens
agctcaggctctgcagggacta

SEQ ID NO: 9307764 - DNA, 22 bp, Homo sapiens
agctcagggctccaggaccgct

SEQ ID NO: 9307765 - DNA, 22 bp, Homo sapiens
agctcaggtcattccagggatg

SEQ ID NO: 9307766 - DNA, 22 bp, Homo sapiens
agctcaggtctcaggaggtgtc

SEQ ID NO: 9307767 - DNA, 23 bp, Homo sapiens
agctccagggaacaggcagtagg

SEQ ID NO: 9307768 - DNA, 23 bp, Homo sapiens
agctccagggaacaggcagtagg

SEQ ID NO: 9307769 - DNA, 22 bp, Homo sapiens
agctccaggtcagtgcacccct

SEQ ID NO: 9307770 - DNA, 22 bp, Homo sapiens
agctccaggtagtgccttatcg

SEQ ID NO: 9307771 - DNA, 22 bp, Homo sapiens
agcagttatattactctcaggt

SEQ ID NO: 9307772 - DNA, 22 bp, Homo sapiens
agcatcagcagactctcagcta

SEQ ID NO: 9307773 - DNA, 22 bp, Homo sapiens
agcaggtcttgctctcaacagg

SEQ ID NO: 9307774 - DNA, 22 bp, Homo sapiens
agcaggtgacagggctgtggtg

SEQ ID NO: 9307775 - DNA, 22 bp, Homo sapiens
agcagggctgtgctccttccga

SEQ ID NO: 9307776 - DNA, 22 bp, Homo sapiens
agcagggcttctgtgcctgtgc

SEQ ID NO: 9307777 - DNA, 22 bp, Homo sapiens
agcagggctgtgtaggtaatga

SEQ ID NO: 9307778 - DNA, 22 bp, Homo sapiens
agcagggcttctgtgcctgtgc

SEQ ID NO: 9307779 - DNA, 22 bp, Homo sapiens
agcagggctttgcagacttggg

SEQ ID NO: 9307780 - DNA, 22 bp, Homo sapiens
agcagggcttgccgcttgtcct

SEQ ID NO: 9307781 - DNA, 23 bp, Homo sapiens
agcaggcatctgtggcacaaggc

SEQ ID NO: 9307782 - DNA, 19 bp, Homo sapiens
agcaggcaggtggcccagg

SEQ ID NO: 9307783 - DNA, 22 bp, Homo sapiens
agcaggagtgtcccctggctgt

SEQ ID NO: 9307784 - DNA, 22 bp, Homo sapiens
agcaggcaggctgccagtgaat

SEQ ID NO: 9307785 - DNA, 21 bp, Homo sapiens
agcaggaggcagtcacagctc

SEQ ID NO: 9307786 - DNA, 22 bp, Homo sapiens
agcaggagctgtgggaagatgg

SEQ ID NO: 9307787 - DNA, 22 bp, Homo sapiens
agcaggagcccttatcaccagg

SEQ ID NO: 9307788 - DNA, 17 bp, Homo sapiens
agcagctgaagcagcca

SEQ ID NO: 9307789 - DNA, 22 bp, Homo sapiens
agcagccatagatagcatgcaa

SEQ ID NO: 9307790 - DNA, 22 bp, Homo sapiens
acacacagaaggaagccccact

SEQ ID NO: 9307791 - DNA, 22 bp, Homo sapiens
agatttggtgtctggttgatat

SEQ ID NO: 9307792 - DNA, 22 bp, Homo sapiens
agatttgcggctttactttgca

SEQ ID NO: 9307793 - DNA, 22 bp, Homo sapiens
agatttctctttccctggctga

SEQ ID NO: 9307794 - DNA, 22 bp, Homo sapiens
agcagaaacagccagtctggac

SEQ ID NO: 9307795 - DNA, 22 bp, Homo sapiens
agcactttagaatttagagttg

SEQ ID NO: 9307796 - DNA, 22 bp, Homo sapiens
agcactttaagcaacagatcaa

SEQ ID NO: 9307797 - DNA, 22 bp, Homo sapiens
agcactttcctggcaaatgtgg

SEQ ID NO: 9307798 - DNA, 22 bp, Homo sapiens
agcactttgagcagatgaagga

SEQ ID NO: 9307799 - DNA, 22 bp, Homo sapiens
agcactttgtgcatttctgaag

SEQ ID NO: 9307800 - DNA, 22 bp, Homo sapiens
acacacttcacccttgagctaa

SEQ ID NO: 9307801 - DNA, 22 bp, Homo sapiens
acacacttgcagagaggaggga

SEQ ID NO: 9307802 - DNA, 22 bp, Homo sapiens
acacacttcagatgtaatttgt

SEQ ID NO: 9307803 - DNA, 20 bp, Homo sapiens
acacactttgatcttgagcc

SEQ ID NO: 9307804 - DNA, 22 bp, Homo sapiens
acacactttaaattaaacctct

SEQ ID NO: 9307805 - DNA, 22 bp, Homo sapiens
acacacttttgctaaaaattgt

SEQ ID NO: 9307806 - DNA, 22 bp, Homo sapiens
agcagcagccgtagccttatta

SEQ ID NO: 9307807 - DNA, 22 bp, Homo sapiens
agcagcagctcagttctcagct

SEQ ID NO: 9307808 - DNA, 22 bp, Homo sapiens
agcagcagcattgagcgcttgt

SEQ ID NO: 9307809 - DNA, 19 bp, Homo sapiens
agcagcagcaccagggatt

SEQ ID NO: 9307810 - DNA, 22 bp, Homo sapiens
agcagcaaagccaggggatggg

SEQ ID NO: 9307811 - DNA, 22 bp, Homo sapiens
agcagcaaagtattgggcaaga

SEQ ID NO: 9307812 - DNA, 22 bp, Homo sapiens
agcagcagattatggtctacat

SEQ ID NO: 9307813 - DNA, 22 bp, Homo sapiens
agaggttgggtctgaggtgaga

SEQ ID NO: 9307814 - DNA, 22 bp, Homo sapiens
agaggtggccatgggcgctgga

SEQ ID NO: 9307815 - DNA, 22 bp, Homo sapiens
agaggtgggagcctggtcacat

SEQ ID NO: 9307816 - DNA, 22 bp, Homo sapiens
agaggtgggagcctggtcacat

SEQ ID NO: 9307817 - DNA, 22 bp, Homo sapiens
acaaaaaccgtggattcagcat

SEQ ID NO: 9307818 - DNA, 22 bp, Homo sapiens
agaggggttatgcttgacattt

SEQ ID NO: 9307819 - DNA, 22 bp, Homo sapiens
agaggggttaagtgctagtccg

SEQ ID NO: 9307820 - DNA, 22 bp, Homo sapiens
agaggtggccatgggcgctgga

SEQ ID NO: 9307821 - DNA, 22 bp, Homo sapiens
agatatgttgtttaaggcacca

SEQ ID NO: 9307822 - DNA, 22 bp, Homo sapiens
agatatcaccagttttacatac

SEQ ID NO: 9307823 - DNA, 22 bp, Homo sapiens
agatatacagagaattattcac

SEQ ID NO: 9307824 - DNA, 20 bp, Homo sapiens
agattattcctaagatttct

SEQ ID NO: 9307825 - DNA, 22 bp, Homo sapiens
agatcttatttagctttaatca

SEQ ID NO: 9307826 - DNA, 22 bp, Homo sapiens
agatctggttggagtcctgaca

SEQ ID NO: 9307827 - DNA, 22 bp, Homo sapiens
agatctggaaaatcacaggtgc

SEQ ID NO: 9307828 - DNA, 22 bp, Homo sapiens
aattcacttgtgcacgctatgg

SEQ ID NO: 9307829 - DNA, 22 bp, Homo sapiens
aattcagttggcaaacatgctg

SEQ ID NO: 9307830 - DNA, 22 bp, Homo sapiens
agagcagctgcattcagcacct

SEQ ID NO: 9307831 - DNA, 22 bp, Homo sapiens
agaggccaagccagactgtgca

SEQ ID NO: 9307832 - DNA, 22 bp, Homo sapiens
agaggcatgcacagatgtgctg

SEQ ID NO: 9307833 - DNA, 22 bp, Homo sapiens
agaggcatgatcttataattta

SEQ ID NO: 9307834 - DNA, 21 bp, Homo sapiens
agaggcaggcattaagtacac

SEQ ID NO: 9307835 - DNA, 19 bp, Homo sapiens
agaggcagtctccaacagg

SEQ ID NO: 9307836 - DNA, 22 bp, Homo sapiens
agaggcagtatacaatccgagc

SEQ ID NO: 9307837 - DNA, 22 bp, Homo sapiens
agagcagctggggcagagacca

SEQ ID NO: 9307838 - DNA, 22 bp, Homo sapiens
agagcagctgtgacatggacag

SEQ ID NO: 9307839 - DNA, 22 bp, Homo sapiens
aatttattcccgtctctgggct

SEQ ID NO: 9307840 - DNA, 22 bp, Homo sapiens
aatttattatatcctaggggaa

SEQ ID NO: 9307841 - DNA, 22 bp, Homo sapiens
aatttattatatcctaggggaa

SEQ ID NO: 9307842 - DNA, 22 bp, Homo sapiens
aatttatttcctgccagtacac

SEQ ID NO: 9307843 - DNA, 22 bp, Homo sapiens
aatttatttcctgccagtacac

SEQ ID NO: 9307844 - DNA, 22 bp, Homo sapiens
aatttattcccgtctctgggct

SEQ ID NO: 9307845 - DNA, 22 bp, Homo sapiens
aatttcaagtggcatctttgat

SEQ ID NO: 9307846 - DNA, 22 bp, Homo sapiens
agaggctttctctgcttaggca

SEQ ID NO: 9307847 - DNA, 22 bp, Homo sapiens
agaggcttggaggtgcaaggtt

SEQ ID NO: 9307848 - DNA, 22 bp, Homo sapiens
agagggccataggtgcatagtt

SEQ ID NO: 9307849 - DNA, 22 bp, Homo sapiens
agagggcataaaatagagcacg

SEQ ID NO: 9307850 - DNA, 22 bp, Homo sapiens
agagggctaactgggaagcagg

SEQ ID NO: 9307851 - DNA, 22 bp, Homo sapiens
agagggctgcctcagtcagcta

SEQ ID NO: 9307852 - DNA, 22 bp, Homo sapiens
aattttctggtgtgtaatgaag

SEQ ID NO: 9307853 - DNA, 22 bp, Homo sapiens
aattttgtgtgggatcaaagga

SEQ ID NO: 9307854 - DNA, 22 bp, Homo sapiens
aatgtagaatgatccttaggat

SEQ ID NO: 9307855 - DNA, 22 bp, Homo sapiens
agaattgctggaatttgcttta

SEQ ID NO: 9307856 - DNA, 22 bp, Homo sapiens
agaattgttggggtaataaaag

SEQ ID NO: 9307857 - DNA, 22 bp, Homo sapiens
agaatccttgactcaggctgag

SEQ ID NO: 9307858 - DNA, 22 bp, Homo sapiens
agaatcctggccaggtcagagc

SEQ ID NO: 9307859 - DNA, 22 bp, Homo sapiens
aatggaatacctaggtggccca

SEQ ID NO: 9307860 - DNA, 22 bp, Homo sapiens
aatgcttttgctgtcattgctt

SEQ ID NO: 9307861 - DNA, 22 bp, Homo sapiens
aatgctttgccaacagctattg

SEQ ID NO: 9307862 - DNA, 22 bp, Homo sapiens
agagacagggttttgccatgtt

SEQ ID NO: 9307863 - DNA, 21 bp, Homo sapiens
agagagaaggccatatggtcc

SEQ ID NO: 9307864 - DNA, 22 bp, Homo sapiens
agagagaattggataaattggt

SEQ ID NO: 9307865 - DNA, 23 bp, Homo sapiens
agactggggcataagaagatggc

SEQ ID NO: 9307866 - DNA, 22 bp, Homo sapiens
agactgggattctccctgatca

SEQ ID NO: 9307867 - DNA, 22 bp, Homo sapiens
agactgcagcaaccccttcagc

SEQ ID NO: 9307868 - DNA, 22 bp, Homo sapiens
aaaggcctctgtcctagtgcct

SEQ ID NO: 9307869 - DNA, 22 bp, Homo sapiens
aaagcaatgcttgtggaatgta

SEQ ID NO: 9307870 - DNA, 22 bp, Homo sapiens
aaagcaatcagattcagatgtc

SEQ ID NO: 9307871 - DNA, 22 bp, Homo sapiens
aaagcaataggttaggtcaaga

SEQ ID NO: 9307872 - DNA, 22 bp, Homo sapiens
aaagcaatagtaatggtaatag

SEQ ID NO: 9307873 - DNA, 22 bp, Homo sapiens
aaagcaatgatggtagacacgt

SEQ ID NO: 9307874 - DNA, 22 bp, Homo sapiens
aaagcaatgatggtagacacgt

SEQ ID NO: 9307875 - DNA, 22 bp, Homo sapiens
aaagcaatctagttccaattct

SEQ ID NO: 9307876 - DNA, 22 bp, Homo sapiens
aaagcaatctagttccaattct

SEQ ID NO: 9307877 - DNA, 22 bp, Homo sapiens
aaagcaatgcccgttcattatc

SEQ ID NO: 9307878 - DNA, 22 bp, Homo sapiens
aaagcaataggttaggtcaaga

SEQ ID NO: 9307879 - DNA, 22 bp, Homo sapiens
aaacatcataggcatgcatgat

SEQ ID NO: 9307880 - DNA, 22 bp, Homo sapiens
aaacatcataggcatgcatgat

SEQ ID NO: 9307881 - DNA, 22 bp, Homo sapiens
aaacatcaccattttacctaat

SEQ ID NO: 9307882 - DNA, 22 bp, Homo sapiens
aaacatcaattgcatctcccaa

SEQ ID NO: 9307883 - DNA, 22 bp, Homo sapiens
aaacagttttgccaaaaggaca

SEQ ID NO: 9307884 - DNA, 22 bp, Homo sapiens
aaagtgctgggattacaggtgt

SEQ ID NO: 9307885 - DNA, 22 bp, Homo sapiens
aaagtgctgaagacctagctgt

SEQ ID NO: 9307886 - DNA, 22 bp, Homo sapiens
aaagtgctcggcgctggtccca

SEQ ID NO: 9307887 - DNA, 22 bp, Homo sapiens
aaagtgctcggattacaggtat

SEQ ID NO: 9307888 - DNA, 22 bp, Homo sapiens
aaagtgctgaaattacaggtgt

SEQ ID NO: 9307889 - DNA, 22 bp, Homo sapiens
aaacactggtatgatgtatagt

SEQ ID NO: 9307890 - DNA, 20 bp, Homo sapiens
aaacactggctggggcacag

SEQ ID NO: 9307891 - DNA, 22 bp, Homo sapiens
aaatagaattaactagctactg

SEQ ID NO: 9307892 - DNA, 22 bp, Homo sapiens
aaatagaattggaagcagagtt

SEQ ID NO: 9307893 - DNA, 22 bp, Homo sapiens
aaactactatgggaatgtactt

SEQ ID NO: 9307894 - DNA, 22 bp, Homo sapiens
aaactactatgggaatgtactt

SEQ ID NO: 9307895 - DNA, 22 bp, Homo sapiens
aaatgctaacaaggaatgctgc

SEQ ID NO: 9307896 - DNA, 22 bp, Homo sapiens
aaatgctagggagaaactctcc

SEQ ID NO: 9307897 - DNA, 22 bp, Homo sapiens
aaatggcatagaggtgaaggta

SEQ ID NO: 9307898 - DNA, 22 bp, Homo sapiens
aaatggcagtgtcataaggctc

SEQ ID NO: 9307899 - DNA, 22 bp, Homo sapiens
aaatggcaggctctttgctagt

SEQ ID NO: 9307900 - DNA, 22 bp, Homo sapiens
aaatcatctctgcatccttagc

SEQ ID NO: 9307901 - DNA, 22 bp, Homo sapiens
aaatcatggtggaagaaacaga

SEQ ID NO: 9307902 - DNA, 22 bp, Homo sapiens
aaatgcagcctagctcagtttt

SEQ ID NO: 9307903 - DNA, 22 bp, Homo sapiens
aaatccagctacggggcaacat

SEQ ID NO: 9307904 - DNA, 22 bp, Homo sapiens
aaatcagttgttatattaaaga

SEQ ID NO: 9307905 - DNA, 22 bp, Homo sapiens
aaatcagtgctcatttgaaagg

SEQ ID NO: 9307906 - DNA, 22 bp, Homo sapiens
aaatcagttcacgttctgaggt

SEQ ID NO: 9307907 - DNA, 22 bp, Homo sapiens
aaatatgttttccagttgtcat

SEQ ID NO: 9307908 - DNA, 22 bp, Homo sapiens
aaagaactacctgtatgatatt

SEQ ID NO: 9307909 - DNA, 22 bp, Homo sapiens
aaagaactacctgtatgatatt

SEQ ID NO: 9307910 - DNA, 22 bp, Homo sapiens
aaagaacttatcctagaatttg

SEQ ID NO: 9307911 - DNA, 22 bp, Homo sapiens
aaactttaagacagtcctcaag

SEQ ID NO: 9307912 - DNA, 22 bp, Homo sapiens
aaactttaaatttgtacctctg

SEQ ID NO: 9307913 - DNA, 22 bp, Homo sapiens
aaacatttttcttcatcatcct

SEQ ID NO: 9307914 - DNA, 22 bp, Homo sapiens
aaaccactcctgattcacttca

SEQ ID NO: 9307915 - DNA, 22 bp, Homo sapiens
aaaccacttatatcgtgatttg

SEQ ID NO: 9307916 - DNA, 22 bp, Homo sapiens
aaaccatcagataattcatact

SEQ ID NO: 9307917 - DNA, 22 bp, Homo sapiens
aaaccatgcagtctgtgtacat

SEQ ID NO: 9307918 - DNA, 22 bp, Homo sapiens
aaacatgagcatttctgtttaa

SEQ ID NO: 9307919 - DNA, 23 bp, Homo sapiens
aaacatttctcttttcctgcctc

SEQ ID NO: 9307920 - DNA, 22 bp, Homo sapiens
aaacatttgcaactcggtttgg

SEQ ID NO: 9307921 - DNA, 22 bp, Homo sapiens
aaacatttttctaggtcttggt

SEQ ID NO: 9307922 - DNA, 20 bp, Homo sapiens
aaaaagacaaaacgagttgg

SEQ ID NO: 9307923 - DNA, 22 bp, Homo sapiens
aaaaagagaaatgctctagtcc

SEQ ID NO: 9307924 - DNA, 22 bp, Homo sapiens
aaaaagacttccaactcaggag

SEQ ID NO: 9307925 - DNA, 22 bp, Homo sapiens
aaaaatgcttggacttaataaa

SEQ ID NO: 9307926 - DNA, 22 bp, Homo sapiens
aaaaatgctgtggtagctgtgt

SEQ ID NO: 9307927 - DNA, 22 bp, Homo sapiens
aaaaatgctgtggtagctgtgt

SEQ ID NO: 9307928 - DNA, 22 bp, Homo sapiens
aaaaatgctgtggtagctgtgt

SEQ ID NO: 9307929 - DNA, 22 bp, Homo sapiens
aaaatagcctcacataattgct

SEQ ID NO: 9307930 - DNA, 22 bp, Homo sapiens
aaaatagcctcacataattgct

SEQ ID NO: 9307931 - DNA, 22 bp, Homo sapiens
aaaatagcatattgctttcttt

SEQ ID NO: 9307932 - DNA, 22 bp, Homo sapiens
aaaatagcagggatgtgggaaa

SEQ ID NO: 9307933 - DNA, 22 bp, Homo sapiens
aaaattcatggcttgggaaaag

SEQ ID NO: 9307934 - DNA, 22 bp, Homo sapiens
aaaatagctatggaatgtcact

SEQ ID NO: 9307935 - DNA, 22 bp, Homo sapiens
aaacaactcggcaactgctttt

SEQ ID NO: 9307936 - DNA, 22 bp, Homo sapiens
aaacaactcggcaactgctttt

SEQ ID NO: 9307937 - DNA, 22 bp, Homo sapiens
aaacacacagaaatgaatgagg

SEQ ID NO: 9307938 - DNA, 22 bp, Homo sapiens
aaacacacctttggaactgtga

SEQ ID NO: 9307939 - DNA, 22 bp, Homo sapiens
aaacaaacataggtttgaaagt

SEQ ID NO: 9307940 - DNA, 22 bp, Homo sapiens
aaacaaacataggtttgaaagt

SEQ ID NO: 9307941 - DNA, 22 bp, Homo sapiens
aaacaaacaattagttgtgtgg

SEQ ID NO: 9307942 - DNA, 22 bp, Homo sapiens
aacttgcttatattattacatt

SEQ ID NO: 9307943 - DNA, 23 bp, Homo sapiens
aacttgctgtaaagttctaggca

SEQ ID NO: 9307944 - DNA, 20 bp, Homo sapiens
aactcagagatgaaaaagac

SEQ ID NO: 9307945 - DNA, 22 bp, Homo sapiens
aacagtaatttgcggtttttgc

SEQ ID NO: 9307946 - DNA, 22 bp, Homo sapiens
aacagcagcatgacagctgggt

SEQ ID NO: 9307947 - DNA, 22 bp, Homo sapiens
aacacatggcaagagcaggaaa

SEQ ID NO: 9307948 - DNA, 22 bp, Homo sapiens
aacaattgacacttcattgtga

SEQ ID NO: 9307949 - DNA, 22 bp, Homo sapiens
aacacaaagaagctgcaggatc

SEQ ID NO: 9307950 - DNA, 22 bp, Homo sapiens
aacacaaagaagctgcaggatc

SEQ ID NO: 9307951 - DNA, 22 bp, Homo sapiens
aacaagaagggaaggcatgatt

SEQ ID NO: 9307952 - DNA, 22 bp, Homo sapiens
aacaaattagttgcaagactgg

SEQ ID NO: 9307953 - DNA, 22 bp, Homo sapiens
aacaaatttagctctgagtgct

SEQ ID NO: 9307954 - DNA, 22 bp, Homo sapiens
aaagcaattgtggtttttgtca

SEQ ID NO: 9307955 - DNA, 22 bp, Homo sapiens
aaagcaatttaatggaccatga

SEQ ID NO: 9307956 - DNA, 22 bp, Homo sapiens
aaatggctccagttgacttttt

SEQ ID NO: 9307957 - DNA, 22 bp, Homo sapiens
aaatggctgacttttcatggga

SEQ ID NO: 9307958 - DNA, 22 bp, Homo sapiens
aaatggctacaagatgtgctct

SEQ ID NO: 9307959 - DNA, 19 bp, Homo sapiens
aaatggctttctacttaat

SEQ ID NO: 9307960 - DNA, 23 bp, Homo sapiens
aaatggctttagacgtgccttat

SEQ ID NO: 9307961 - DNA, 23 bp, Homo sapiens
aaatggcttgccctctcgtttgg

SEQ ID NO: 9307962 - DNA, 22 bp, Homo sapiens
aaagcaatagagggtaagactg

SEQ ID NO: 9307963 - DNA, 22 bp, Homo sapiens
aaagcaatggcacatgatggta

SEQ ID NO: 9307964 - DNA, 22 bp, Homo sapiens
aaagcaattgtggtttttgcca

SEQ ID NO: 9307965 - DNA, 22 bp, Homo sapiens
aaagcaattacaaaagggataa

SEQ ID NO: 9307966 - DNA, 22 bp, Homo sapiens
aaagcaatgggtctaaggtaaa

SEQ ID NO: 9307967 - DNA, 22 bp, Homo sapiens
aaagcaatggcacatgatggta

SEQ ID NO: 9307968 - DNA, 22 bp, Homo sapiens
aaagcaatgtctctgcctggtt

SEQ ID NO: 9307969 - DNA, 22 bp, Homo sapiens
aagagcagtgttttactcagct

SEQ ID NO: 9307970 - DNA, 22 bp, Homo sapiens
aagagccagctagtgaagaggc

SEQ ID NO: 9307971 - DNA, 22 bp, Homo sapiens
aagagcatggcaagaaaagggt

SEQ ID NO: 9307972 - DNA, 22 bp, Homo sapiens
aagaggaagtctccatggagag

SEQ ID NO: 9307973 - DNA, 22 bp, Homo sapiens
aagagccagctagtgaagaggc

SEQ ID NO: 9307974 - DNA, 22 bp, Homo sapiens
aagaatgattacaaagcaacga

SEQ ID NO: 9307975 - DNA, 22 bp, Homo sapiens
aagaatgtgctaatgaaaactt

SEQ ID NO: 9307976 - DNA, 22 bp, Homo sapiens
aacttttacaaattgtcatcat

SEQ ID NO: 9307977 - DNA, 22 bp, Homo sapiens
aagaaagccaaagttcatacct

SEQ ID NO: 9307978 - DNA, 22 bp, Homo sapiens
aacttgcttcaacttatttcac

SEQ ID NO: 9307979 - DNA, 22 bp, Homo sapiens
aactttctttgcatctaagttt

SEQ ID NO: 9307980 - DNA, 22 bp, Homo sapiens
aagattctccctgagatattta

SEQ ID NO: 9307981 - DNA, 22 bp, Homo sapiens
aagcaaaggaaagctgactttt

SEQ ID NO: 9307982 - DNA, 22 bp, Homo sapiens
aagcaaagagataaccttttgg

SEQ ID NO: 9307983 - DNA, 22 bp, Homo sapiens
aagcaaagagtttagtgggtga

SEQ ID NO: 9307984 - DNA, 22 bp, Homo sapiens
aagcaaaggcaggagcttgtga

SEQ ID NO: 9307985 - DNA, 22 bp, Homo sapiens
aagcaaagtgaattttgccaag

SEQ ID NO: 9307986 - DNA, 22 bp, Homo sapiens
aagcaaagtgctttgcctccag

SEQ ID NO: 9307987 - DNA, 22 bp, Homo sapiens
aagcaaatgtgggtgcagaatt

SEQ ID NO: 9307988 - DNA, 22 bp, Homo sapiens
aagcaaattggatgtctgtgag

SEQ ID NO: 9307989 - DNA, 22 bp, Homo sapiens
aagcactaggtcacacaagtta

SEQ ID NO: 9307990 - DNA, 22 bp, Homo sapiens
aagcagcaacaaactggataaa

SEQ ID NO: 9307991 - DNA, 22 bp, Homo sapiens
aagcagaaagaacaactgagtg

SEQ ID NO: 9307992 - DNA, 22 bp, Homo sapiens
aagccactttcagctgtctcag

SEQ ID NO: 9307993 - DNA, 22 bp, Homo sapiens
aagccactgttttggagtgctt

SEQ ID NO: 9307994 - DNA, 22 bp, Homo sapiens
aagcagcataattgctatttta

SEQ ID NO: 9307995 - DNA, 22 bp, Homo sapiens
aagcagcagccatcccccaagg

SEQ ID NO: 9307996 - DNA, 22 bp, Homo sapiens
aagcagcacgctttgccaacaa

SEQ ID NO: 9307997 - DNA, 22 bp, Homo sapiens
aagcagcagcaggattaaagag

SEQ ID NO: 9307998 - DNA, 22 bp, Homo sapiens
aagcagcagcctgaagtacgtc

SEQ ID NO: 9307999 - DNA, 22 bp, Homo sapiens
aagcagcagacctgattttgaa

SEQ ID NO: 9308000 - DNA, 22 bp, Homo sapiens
aagcagcacagcaatgactcta

SEQ ID NO: 9308001 - DNA, 22 bp, Homo sapiens
aagcagcaagtttatttctatc

SEQ ID NO: 9308002 - DNA, 15 bp, Homo sapiens
aagcagcaatatata

SEQ ID NO: 9308003 - DNA, 22 bp, Homo sapiens
aagcagcacagtaatattggtg

SEQ ID NO: 9308004 - DNA, 22 bp, Homo sapiens
aactttctaaagtcaaattggt

SEQ ID NO: 9308005 - DNA, 22 bp, Homo sapiens
aactttcaggcaatgaatattt

SEQ ID NO: 9308006 - DNA, 22 bp, Homo sapiens
aattacttaactctctgggcct

SEQ ID NO: 9308007 - DNA, 22 bp, Homo sapiens
aatgttaagtttagattataac

SEQ ID NO: 9308008 - DNA, 22 bp, Homo sapiens
aatgttacgatcaacaacacat

SEQ ID NO: 9308009 - DNA, 22 bp, Homo sapiens
aatgttacaggacctaagatga

SEQ ID NO: 9308010 - DNA, 22 bp, Homo sapiens
aatgtatttgatgtattagcct

SEQ ID NO: 9308011 - DNA, 23 bp, Homo sapiens
aactcctgaatcgtgagccatct

SEQ ID NO: 9308012 - DNA, 22 bp, Homo sapiens
aactcctgaggaaatggtctca

SEQ ID NO: 9308013 - DNA, 20 bp, Homo sapiens
aactcctagcctcaagtgat

SEQ ID NO: 9308014 - DNA, 22 bp, Homo sapiens
aactgaaacggtgatcttttaa

SEQ ID NO: 9308015 - DNA, 23 bp, Homo sapiens
acaactttacagatacattttgt

SEQ ID NO: 9308016 - DNA, 22 bp, Homo sapiens
acaactttctgggttatctgat

SEQ ID NO: 9308017 - DNA, 22 bp, Homo sapiens
acaactttgacccttgttctta

SEQ ID NO: 9308018 - DNA, 22 bp, Homo sapiens
aagacaatcctggacagtcagc

SEQ ID NO: 9308019 - DNA, 22 bp, Homo sapiens
aagacaatgcattactaagaag

SEQ ID NO: 9308020 - DNA, 22 bp, Homo sapiens
aagacaatttgatactagttgc

SEQ ID NO: 9308021 - DNA, 22 bp, Homo sapiens
aattagctaattaattgtagcc

SEQ ID NO: 9308022 - DNA, 22 bp, Homo sapiens
aattagctaattaattgtagcc

SEQ ID NO: 9308023 - DNA, 22 bp, Homo sapiens
aagaattttccagcatgtcagt

SEQ ID NO: 9308024 - DNA, 22 bp, Homo sapiens
aagaattggtcacatgctacaa

SEQ ID NO: 9308025 - DNA, 22 bp, Homo sapiens
aagaattggtttcctctgtcat

SEQ ID NO: 9308026 - DNA, 21 bp, Homo sapiens
aagagtggctgaggaggtgat

SEQ ID NO: 9308027 - DNA, 22 bp, Homo sapiens
aagagtttaattttgtctagac

SEQ ID NO: 9308028 - DNA, 22 bp, Homo sapiens
aagagtatttggtatagaacac

SEQ ID NO: 9308029 - DNA, 22 bp, Homo sapiens
acactaattaagctgctttact

SEQ ID NO: 9308030 - DNA, 21 bp, Homo sapiens
acacgtgtgtgtaaacacaca

SEQ ID NO: 9308031 - DNA, 22 bp, Homo sapiens
acaccccaccagtaactgaggg

SEQ ID NO: 9308032 - DNA, 20 bp, Homo sapiens
acacacagagacatgcgcat

SEQ ID NO: 9308033 - DNA, 22 bp, Homo sapiens
acacacagagtttatacaggca

SEQ ID NO: 9308034 - DNA, 22 bp, Homo sapiens
acacacagcgcctaccatgtgc

SEQ ID NO: 9308035 - DNA, 22 bp, Homo sapiens
acacacaggtaaaggagcctgg

SEQ ID NO: 9308036 - DNA, 22 bp, Homo sapiens
aagaggtggaacagcaattcgt

SEQ ID NO: 9308037 - DNA, 22 bp, Homo sapiens
aagaggtgggttggacagatac

SEQ ID NO: 9308038 - DNA, 22 bp, Homo sapiens
aagaggtgagaagctacactta

SEQ ID NO: 9308039 - DNA, 22 bp, Homo sapiens
aagaggtgccaggggttttgta

SEQ ID NO: 9308040 - DNA, 20 bp, Homo sapiens
aagaggtgataacaggtgag

SEQ ID NO: 9308041 - DNA, 22 bp, Homo sapiens
aagaggaggattgatgtgggag

SEQ ID NO: 9308042 - DNA, 22 bp, Homo sapiens
aagcacatgagctattcatgct

SEQ ID NO: 9308043 - DNA, 22 bp, Homo sapiens
acagaggacaactaggcgctca

SEQ ID NO: 9308044 - DNA, 22 bp, Homo sapiens
acagaggacaactaggcgctca

SEQ ID NO: 9308045 - DNA, 22 bp, Homo sapiens
acagaggacaactaggcgctca

SEQ ID NO: 9308046 - DNA, 22 bp, Homo sapiens
acagaggaagcatatagcacaa

SEQ ID NO: 9308047 - DNA, 18 bp, Homo sapiens
acagaggcagacatgtat

SEQ ID NO: 9308048 - DNA, 22 bp, Homo sapiens
aagcaaacaggagaagagctgt

SEQ ID NO: 9308049 - DNA, 22 bp, Homo sapiens
aagcaaaaggttacacttctgg

SEQ ID NO: 9308050 - DNA, 22 bp, Homo sapiens
aagcaaaaggttacacttctgg

SEQ ID NO: 9308051 - DNA, 22 bp, Homo sapiens
acagagcttaattcaggagctt

SEQ ID NO: 9308052 - DNA, 22 bp, Homo sapiens
acagaggaagcatatagcacaa

SEQ ID NO: 9308053 - DNA, 22 bp, Homo sapiens
aagattttctcaactgtatttg

SEQ ID NO: 9308054 - DNA, 22 bp, Homo sapiens
aagattttcagctaatggtgca

SEQ ID NO: 9308055 - DNA, 22 bp, Homo sapiens
aagattttcagtgcctaaaaca

SEQ ID NO: 9308056 - DNA, 22 bp, Homo sapiens
acagaagcagccgtcacagata

SEQ ID NO: 9308057 - DNA, 22 bp, Homo sapiens
acagaagcagcgcggctcttct

SEQ ID NO: 9308058 - DNA, 22 bp, Homo sapiens
acagaagcaaagactcaggcaa

SEQ ID NO: 9308059 - DNA, 22 bp, Homo sapiens
aagggctggaatatctcttaga

SEQ ID NO: 9308060 - DNA, 17 bp, Homo sapiens
aacaataggatgtgtat

SEQ ID NO: 9308061 - DNA, 22 bp, Homo sapiens
aacaataggagtgatgcagtat

SEQ ID NO: 9308062 - DNA, 22 bp, Homo sapiens
aacaataattgcggttctctat

SEQ ID NO: 9308063 - DNA, 22 bp, Homo sapiens
aagggggagaggtgtttggatg

SEQ ID NO: 9308064 - DNA, 22 bp, Homo sapiens
aaggggctcttgtcaggcgcag

SEQ ID NO: 9308065 - DNA, 17 bp, Homo sapiens
aacaataggatgtgtat

SEQ ID NO: 9308066 - DNA, 22 bp, Homo sapiens
aacaatcaagtttctaaatgac

SEQ ID NO: 9308067 - DNA, 22 bp, Homo sapiens
aagtatgacatttaagacaatt

SEQ ID NO: 9308068 - DNA, 22 bp, Homo sapiens
aacaataactagacatgccatg

SEQ ID NO: 9308069 - DNA, 22 bp, Homo sapiens
aacaagttgttgaaaataatta

SEQ ID NO: 9308070 - DNA, 22 bp, Homo sapiens
aacaagttctaagtgtctactt

SEQ ID NO: 9308071 - DNA, 22 bp, Homo sapiens
aaatttctaagcagccacttcc

SEQ ID NO: 9308072 - DNA, 22 bp, Homo sapiens
aaatttcagttggaatgagctc

SEQ ID NO: 9308073 - DNA, 22 bp, Homo sapiens
aaatttcagttacctttacgtt

SEQ ID NO: 9308074 - DNA, 22 bp, Homo sapiens
aaggccaccaccagcgaggggg

SEQ ID NO: 9308075 - DNA, 22 bp, Homo sapiens
aaggccacagagcctcagagag

SEQ ID NO: 9308076 - DNA, 22 bp, Homo sapiens
aaggactgtctaaggcctccaa

SEQ ID NO: 9308077 - DNA, 22 bp, Homo sapiens
aaggactgacaaatgtcttcct

SEQ ID NO: 9308078 - DNA, 22 bp, Homo sapiens
aaattgccaaattgttttccag

SEQ ID NO: 9308079 - DNA, 22 bp, Homo sapiens
aaattgcattgagctgcttatt

SEQ ID NO: 9308080 - DNA, 21 bp, Homo sapiens
aaattgccacacatttcttcc

SEQ ID NO: 9308081 - DNA, 22 bp, Homo sapiens
aaattgctaaggatctcatgtg

SEQ ID NO: 9308082 - DNA, 22 bp, Homo sapiens
aaattgcgcacatttctccgtt

SEQ ID NO: 9308083 - DNA, 22 bp, Homo sapiens
aaattgctaaattgtaagaggg

SEQ ID NO: 9308084 - DNA, 22 bp, Homo sapiens
aaatttaaggaggtgctcactt

SEQ ID NO: 9308085 - DNA, 22 bp, Homo sapiens
aaggacatggaaggaggagata

SEQ ID NO: 9308086 - DNA, 22 bp, Homo sapiens
aaggaaacactgaactttgtag

SEQ ID NO: 9308087 - DNA, 21 bp, Homo sapiens
aaattagcttcaagttctgca

SEQ ID NO: 9308088 - DNA, 18 bp, Homo sapiens
aagctgggaaggagacag

SEQ ID NO: 9308089 - DNA, 22 bp, Homo sapiens
aagctgggacttagcgcagata

SEQ ID NO: 9308090 - DNA, 20 bp, Homo sapiens
aagctgggtaggagaggagc

SEQ ID NO: 9308091 - DNA, 22 bp, Homo sapiens
aagctgtcaatgtatctagtct

SEQ ID NO: 9308092 - DNA, 21 bp, Homo sapiens
aaggaaaagcttggtctctga

SEQ ID NO: 9308093 - DNA, 22 bp, Homo sapiens
aagcttttctctgtattacctg

SEQ ID NO: 9308094 - DNA, 22 bp, Homo sapiens
aagctggcctcaaactcctagc

SEQ ID NO: 9308095 - DNA, 22 bp, Homo sapiens
aagccatggtagaaaactcagt

SEQ ID NO: 9308096 - DNA, 22 bp, Homo sapiens
aagccagcattttcccattcct

SEQ ID NO: 9308097 - DNA, 22 bp, Homo sapiens
aacattgagctggtggagagga

SEQ ID NO: 9308098 - DNA, 22 bp, Homo sapiens
aacattgcaaataagcttgcag

SEQ ID NO: 9308099 - DNA, 22 bp, Homo sapiens
aacattgccatggttaatttta

SEQ ID NO: 9308100 - DNA, 22 bp, Homo sapiens
aacattgagttctacttccatt

SEQ ID NO: 9308101 - DNA, 22 bp, Homo sapiens
aacattgaatttaaaatacagt

SEQ ID NO: 9308102 - DNA, 22 bp, Homo sapiens
aacattgagaaacattgggata

SEQ ID NO: 9308103 - DNA, 22 bp, Homo sapiens
aacattgagctctggagtggaa

SEQ ID NO: 9308104 - DNA, 20 bp, Homo sapiens
aacattgaaagtctagaaga

SEQ ID NO: 9308105 - DNA, 22 bp, Homo sapiens
aacatttatggtagtcattgca

SEQ ID NO: 9308106 - DNA, 22 bp, Homo sapiens
aacatttatgattgaggtaaat

SEQ ID NO: 9308107 - DNA, 22 bp, Homo sapiens
aacatttattctaattctggga

SEQ ID NO: 9308108 - DNA, 22 bp, Homo sapiens
aacatttatatgggttcatgaa

SEQ ID NO: 9308109 - DNA, 22 bp, Homo sapiens
aacatttacaaatccttctgca

SEQ ID NO: 9308110 - DNA, 22 bp, Homo sapiens
aacatttacaaatccttctgca

SEQ ID NO: 9308111 - DNA, 22 bp, Homo sapiens
aacatttaggaaggacctcctc

SEQ ID NO: 9308112 - DNA, 22 bp, Homo sapiens
aacatttattgagcacctactg

SEQ ID NO: 9308113 - DNA, 22 bp, Homo sapiens
aactccagtgtcagctgcaatg

SEQ ID NO: 9308114 - DNA, 22 bp, Homo sapiens
aactccagctcacacagtgacc

SEQ ID NO: 9308115 - DNA, 22 bp, Homo sapiens
aactccagcaggaaggtgagaa

SEQ ID NO: 9308116 - DNA, 22 bp, Homo sapiens
aactccaggcagggaggccact

SEQ ID NO: 9308117 - DNA, 22 bp, Homo sapiens
aaccatgatgcagggtgggatg

SEQ ID NO: 9308118 - DNA, 22 bp, Homo sapiens
aatcacattagtgaaacactga

SEQ ID NO: 9308119 - DNA, 22 bp, Homo sapiens
aatcacttgtaaggaattcaat

SEQ ID NO: 9308120 - DNA, 22 bp, Homo sapiens
aataaacaaaggacaaggaggt

SEQ ID NO: 9308121 - DNA, 22 bp, Homo sapiens
aataaacaaatctttcctgtgg

SEQ ID NO: 9308122 - DNA, 22 bp, Homo sapiens
aacagtttgcctgaaatgtatt

SEQ ID NO: 9308123 - DNA, 22 bp, Homo sapiens
aacagtttgagctttgaatttc

SEQ ID NO: 9308124 - DNA, 22 bp, Homo sapiens
aagtttctgatattgttaaagc

SEQ ID NO: 9308125 - DNA, 22 bp, Homo sapiens
aagttgctagtgcttttctgag

SEQ ID NO: 9308126 - DNA, 22 bp, Homo sapiens
aagttgctaatgatgtgtttgc

SEQ ID NO: 9308127 - DNA, 22 bp, Homo sapiens
aagttgctaaaggagttctttg

SEQ ID NO: 9308128 - DNA, 22 bp, Homo sapiens
aataaaatggtcagttttctca

SEQ ID NO: 9308129 - DNA, 22 bp, Homo sapiens
aacactgctccaaaaaaggctt

SEQ ID NO: 9308130 - DNA, 22 bp, Homo sapiens
aacactgatggaaagtatgttt

SEQ ID NO: 9308131 - DNA, 22 bp, Homo sapiens
aagtattctacaaagaaattga

SEQ ID NO: 9308132 - DNA, 22 bp, Homo sapiens
aagtatttcgttctgaaaaagt

SEQ ID NO: 9308133 - DNA, 22 bp, Homo sapiens
agccccaggcccggacgcctct

SEQ ID NO: 9308134 - DNA, 22 bp, Homo sapiens
agccccacactctctctgagaa

SEQ ID NO: 9308135 - DNA, 20 bp, Homo sapiens
agccccacccttgtcctggc

SEQ ID NO: 9308136 - DNA, 22 bp, Homo sapiens
agcccaggttgaggctgcagtg

SEQ ID NO: 9308137 - DNA, 22 bp, Homo sapiens
agcccaggttgaggctgcagtg

SEQ ID NO: 9308138 - DNA, 22 bp, Homo sapiens
agcccaggttgaggctgcagtg

SEQ ID NO: 9308139 - DNA, 22 bp, Homo sapiens
agcccaggttctaaagccaaac

SEQ ID NO: 9308140 - DNA, 22 bp, Homo sapiens
agccagtgttaagtgactggtt

SEQ ID NO: 9308141 - DNA, 22 bp, Homo sapiens
agccagtgtcgtgtgacatgag

SEQ ID NO: 9308142 - DNA, 22 bp, Homo sapiens
agccagtgggattagagcctct

SEQ ID NO: 9308143 - DNA, 22 bp, Homo sapiens
agccagtggaattcccaggggt

SEQ ID NO: 9308144 - DNA, 22 bp, Homo sapiens
agccagtgccagtcatgcctgc

SEQ ID NO: 9308145 - DNA, 22 bp, Homo sapiens
agccagtgcagctggaaattca

SEQ ID NO: 9308146 - DNA, 22 bp, Homo sapiens
agccctggcagagccaggtagt

SEQ ID NO: 9308147 - DNA, 22 bp, Homo sapiens
agccctggagcaaaggtgtctt

SEQ ID NO: 9308148 - DNA, 23 bp, Homo sapiens
agccctgctgagacccagctccc

SEQ ID NO: 9308149 - DNA, 22 bp, Homo sapiens
agccctgctcatctggatcccg

SEQ ID NO: 9308150 - DNA, 22 bp, Homo sapiens
agccctggcccggctgtgcttt

SEQ ID NO: 9308151 - DNA, 22 bp, Homo sapiens
agccctggctcccagcagcgct

SEQ ID NO: 9308152 - DNA, 22 bp, Homo sapiens
agccctggctcccagcagcgct

SEQ ID NO: 9308153 - DNA, 22 bp, Homo sapiens
cagatggccagaggcagctgca

SEQ ID NO: 9308154 - DNA, 22 bp, Homo sapiens
agccagcaggaacgtctaggtt

SEQ ID NO: 9308155 - DNA, 22 bp, Homo sapiens
agccagcaggtgagtgcagcct

SEQ ID NO: 9308156 - DNA, 22 bp, Homo sapiens
agccagcaggtgcagaattcca

SEQ ID NO: 9308157 - DNA, 22 bp, Homo sapiens
agccagagttgaatgtgagtct

SEQ ID NO: 9308158 - DNA, 22 bp, Homo sapiens
agccagagagtgttggagatgt

SEQ ID NO: 9308159 - DNA, 22 bp, Homo sapiens
agccagcacggatttcccagga

SEQ ID NO: 9308160 - DNA, 22 bp, Homo sapiens
agccagcacggcgccatggagt

SEQ ID NO: 9308161 - DNA, 22 bp, Homo sapiens
cagagccttcctagcagactct

SEQ ID NO: 9308162 - DNA, 22 bp, Homo sapiens
cagagccttcctagcagactct

SEQ ID NO: 9308163 - DNA, 22 bp, Homo sapiens
cagagccttagttctcctagaa

SEQ ID NO: 9308164 - DNA, 22 bp, Homo sapiens
cagagctcagagctgccaggca

SEQ ID NO: 9308165 - DNA, 22 bp, Homo sapiens
cagagctcagagcagggcactc

SEQ ID NO: 9308166 - DNA, 22 bp, Homo sapiens
cagagctcagagctgccaggca

SEQ ID NO: 9308167 - DNA, 22 bp, Homo sapiens
agccaggccttagggagaggca

SEQ ID NO: 9308168 - DNA, 22 bp, Homo sapiens
agccaggccttagggagaggca

SEQ ID NO: 9308169 - DNA, 22 bp, Homo sapiens
agccaggccttagggagaggca

SEQ ID NO: 9308170 - DNA, 22 bp, Homo sapiens
agccaggccagctgtcttgagt

SEQ ID NO: 9308171 - DNA, 22 bp, Homo sapiens
cagagcccaagagcaagccatg

SEQ ID NO: 9308172 - DNA, 22 bp, Homo sapiens
cagagcctggcgatgtcatgga

SEQ ID NO: 9308173 - DNA, 22 bp, Homo sapiens
agccaggcagggctctcgctct

SEQ ID NO: 9308174 - DNA, 22 bp, Homo sapiens
cagagacatgtggcctgcacgt

SEQ ID NO: 9308175 - DNA, 22 bp, Homo sapiens
cagagacattaagtgccatgat

SEQ ID NO: 9308176 - DNA, 22 bp, Homo sapiens
agctcttacatttaggtctatg

SEQ ID NO: 9308177 - DNA, 22 bp, Homo sapiens
agctcctgtggcagctcttctg

SEQ ID NO: 9308178 - DNA, 22 bp, Homo sapiens
agctctgggattctcaggccac

SEQ ID NO: 9308179 - DNA, 22 bp, Homo sapiens
agctctgggattctcaggccac

SEQ ID NO: 9308180 - DNA, 22 bp, Homo sapiens
agctcctggcaaggtcatggtg

SEQ ID NO: 9308181 - DNA, 22 bp, Homo sapiens
agctcctggctttcctctcacc

SEQ ID NO: 9308182 - DNA, 22 bp, Homo sapiens
agctcctgggccaagcccatgc

SEQ ID NO: 9308183 - DNA, 22 bp, Homo sapiens
agctcctgggccaagcccatgc

SEQ ID NO: 9308184 - DNA, 22 bp, Homo sapiens
agctcctgggccatcacaacca

SEQ ID NO: 9308185 - DNA, 22 bp, Homo sapiens
agctcctggtctttgtccagag

SEQ ID NO: 9308186 - DNA, 22 bp, Homo sapiens
agctcctggtctttgtccagag

SEQ ID NO: 9308187 - DNA, 18 bp, Homo sapiens
agctcctggtctcaggga

SEQ ID NO: 9308188 - DNA, 22 bp, Homo sapiens
agctcctgggggttccaagcag

SEQ ID NO: 9308189 - DNA, 17 bp, Homo sapiens
agctcctggggtcttta

SEQ ID NO: 9308190 - DNA, 22 bp, Homo sapiens
agctaggaaattgaggctgaga

SEQ ID NO: 9308191 - DNA, 22 bp, Homo sapiens
agctaggacaggtagagatggg

SEQ ID NO: 9308192 - DNA, 22 bp, Homo sapiens
agctagcctaggcagagtgcat

SEQ ID NO: 9308193 - DNA, 20 bp, Homo sapiens
agctaggagaaagcatggag

SEQ ID NO: 9308194 - DNA, 23 bp, Homo sapiens
agctccagaacatagcacaggaa

SEQ ID NO: 9308195 - DNA, 22 bp, Homo sapiens
agctccagaaaggtacacacag

SEQ ID NO: 9308196 - DNA, 22 bp, Homo sapiens
agctccagccgctgatgggttt

SEQ ID NO: 9308197 - DNA, 22 bp, Homo sapiens
agctccagccctagtacagctg

SEQ ID NO: 9308198 - DNA, 22 bp, Homo sapiens
agctccagagtctgaactattc

SEQ ID NO: 9308199 - DNA, 22 bp, Homo sapiens
agctccagattaattgtaggag

SEQ ID NO: 9308200 - DNA, 22 bp, Homo sapiens
agctccagcccatctgctcgtg

SEQ ID NO: 9308201 - DNA, 22 bp, Homo sapiens
agctccagagccacatccatca

SEQ ID NO: 9308202 - DNA, 22 bp, Homo sapiens
agctccagaagcctgcaaggta

SEQ ID NO: 9308203 - DNA, 22 bp, Homo sapiens
agctccagaggcagtgatgaag

SEQ ID NO: 9308204 - DNA, 22 bp, Homo sapiens
agctccagaggcagtgatgaag

SEQ ID NO: 9308205 - DNA, 22 bp, Homo sapiens
agctccagaagcctgcaaggta

SEQ ID NO: 9308206 - DNA, 23 bp, Homo sapiens
agctccagaacatagcacaggaa

SEQ ID NO: 9308207 - DNA, 22 bp, Homo sapiens
agctccaggataagacaggtgc

SEQ ID NO: 9308208 - DNA, 22 bp, Homo sapiens
agctccaggataagacaggtgc

SEQ ID NO: 9308209 - DNA, 22 bp, Homo sapiens
agctccaggataagacaggtgc

SEQ ID NO: 9308210 - DNA, 22 bp, Homo sapiens
agctccaggatctgaaagttcg

SEQ ID NO: 9308211 - DNA, 22 bp, Homo sapiens
agctccaggatctgaaagttcg

SEQ ID NO: 9308212 - DNA, 22 bp, Homo sapiens
agctccaggcagcattaataaa

SEQ ID NO: 9308213 - DNA, 19 bp, Homo sapiens
agctccaggcctggatgct

SEQ ID NO: 9308214 - DNA, 23 bp, Homo sapiens
agctccagctgacgtgggcagcc

SEQ ID NO: 9308215 - DNA, 22 bp, Homo sapiens
agctccagcggatggtcttata

SEQ ID NO: 9308216 - DNA, 22 bp, Homo sapiens
agctccagcctcttctggaggt

SEQ ID NO: 9308217 - DNA, 22 bp, Homo sapiens
agctccagggaaagagtggatc

SEQ ID NO: 9308218 - DNA, 22 bp, Homo sapiens
agctccaggccttgggccccgg

SEQ ID NO: 9308219 - DNA, 21 bp, Homo sapiens
agctccaggctcctggggttc

SEQ ID NO: 9308220 - DNA, 22 bp, Homo sapiens
agcctgggtgggggttcggaga

SEQ ID NO: 9308221 - DNA, 22 bp, Homo sapiens
agcctgggcatgggacgggagg

SEQ ID NO: 9308222 - DNA, 22 bp, Homo sapiens
agcctgggcatgggacgggagg

SEQ ID NO: 9308223 - DNA, 23 bp, Homo sapiens
agctaaggaagctgaggcacagt

SEQ ID NO: 9308224 - DNA, 23 bp, Homo sapiens
agctaaggaagctgaggcacagt

SEQ ID NO: 9308225 - DNA, 22 bp, Homo sapiens
agctaatgaaatattttctgat

SEQ ID NO: 9308226 - DNA, 22 bp, Homo sapiens
agctaaggagcaagtaggagtt

SEQ ID NO: 9308227 - DNA, 22 bp, Homo sapiens
agctacctgatccttcttctga

SEQ ID NO: 9308228 - DNA, 22 bp, Homo sapiens
agctagagaatgacagagtctg

SEQ ID NO: 9308229 - DNA, 22 bp, Homo sapiens
agctacctgatccttcttctga

SEQ ID NO: 9308230 - DNA, 22 bp, Homo sapiens
agctacagggaactaaaagcta

SEQ ID NO: 9308231 - DNA, 20 bp, Homo sapiens
cagatgggacgtggaggagt

SEQ ID NO: 9308232 - DNA, 22 bp, Homo sapiens
cagatgtgcatgatgggaaggg

SEQ ID NO: 9308233 - DNA, 23 bp, Homo sapiens
cagatgtgcaactctaggcaatg

SEQ ID NO: 9308234 - DNA, 22 bp, Homo sapiens
cagatgtgagctggggagagtg

SEQ ID NO: 9308235 - DNA, 22 bp, Homo sapiens
agcctgggcaacaacacagcga

SEQ ID NO: 9308236 - DNA, 21 bp, Homo sapiens
agcctgggaggcggaggttgc

SEQ ID NO: 9308237 - DNA, 17 bp, Homo sapiens
agcctgggaaggagtga

SEQ ID NO: 9308238 - DNA, 19 bp, Homo sapiens
agcctggctttgctctgct

SEQ ID NO: 9308239 - DNA, 19 bp, Homo sapiens
agcctggctttgctctgct

SEQ ID NO: 9308240 - DNA, 22 bp, Homo sapiens
agcctggcttagctctctcact

SEQ ID NO: 9308241 - DNA, 22 bp, Homo sapiens
agcctggccactcagggcctga

SEQ ID NO: 9308242 - DNA, 22 bp, Homo sapiens
cacagagatggtctggcaggtg

SEQ ID NO: 9308243 - DNA, 19 bp, Homo sapiens
agcagctggaggtggagtg

SEQ ID NO: 9308244 - DNA, 17 bp, Homo sapiens
agcagctggcacaggag

SEQ ID NO: 9308245 - DNA, 22 bp, Homo sapiens
cacagagaggcttgtctccaag

SEQ ID NO: 9308246 - DNA, 22 bp, Homo sapiens
agcagctagaatagtgcctggt

SEQ ID NO: 9308247 - DNA, 23 bp, Homo sapiens
agcagccctgggacctggcctgc

SEQ ID NO: 9308248 - DNA, 23 bp, Homo sapiens
agcagccctgggacctggcctgc

SEQ ID NO: 9308249 - DNA, 21 bp, Homo sapiens
agcagcagatctggtgagggc

SEQ ID NO: 9308250 - DNA, 21 bp, Homo sapiens
agcagcagatctggtgagggc

SEQ ID NO: 9308251 - DNA, 22 bp, Homo sapiens
agcagcccctcggcgggtgcgc

SEQ ID NO: 9308252 - DNA, 22 bp, Homo sapiens
agcagcccagataaagctcagg

SEQ ID NO: 9308253 - DNA, 22 bp, Homo sapiens
agcagcccgaggatcatgtgtc

SEQ ID NO: 9308254 - DNA, 19 bp, Homo sapiens
agcagcagaagtgtgcctt

SEQ ID NO: 9308255 - DNA, 21 bp, Homo sapiens
agcagcagatctggtgagggc

SEQ ID NO: 9308256 - DNA, 22 bp, Homo sapiens
agcagcagatcaaacaggcttg

SEQ ID NO: 9308257 - DNA, 22 bp, Homo sapiens
agcagagctgcagtggcctgct

SEQ ID NO: 9308258 - DNA, 22 bp, Homo sapiens
agcagaggtttgttggaaacct

SEQ ID NO: 9308259 - DNA, 20 bp, Homo sapiens
agcagagtgcccatcccgga

SEQ ID NO: 9308260 - DNA, 22 bp, Homo sapiens
caataatttacattggatacca

SEQ ID NO: 9308261 - DNA, 22 bp, Homo sapiens
agcactcctgtctttccccttt

SEQ ID NO: 9308262 - DNA, 20 bp, Homo sapiens
agcactaggtgtggcaggtg

SEQ ID NO: 9308263 - DNA, 22 bp, Homo sapiens
agcactagcctgttttgctgtg

SEQ ID NO: 9308264 - DNA, 22 bp, Homo sapiens
agcactagctttaagcattctg

SEQ ID NO: 9308265 - DNA, 22 bp, Homo sapiens
agcactagacatgtaagtgagc

SEQ ID NO: 9308266 - DNA, 17 bp, Homo sapiens
agcactaaaatgcttcc

SEQ ID NO: 9308267 - DNA, 22 bp, Homo sapiens
agcactagagccaaaatttggg

SEQ ID NO: 9308268 - DNA, 22 bp, Homo sapiens
agcacgagatcgatgtgccttt

SEQ ID NO: 9308269 - DNA, 17 bp, Homo sapiens
agcacctgtccagtccc

SEQ ID NO: 9308270 - DNA, 22 bp, Homo sapiens
caaaggctgccactgtggctgt

SEQ ID NO: 9308271 - DNA, 22 bp, Homo sapiens
caaaggctgccactgtggctgt

SEQ ID NO: 9308272 - DNA, 22 bp, Homo sapiens
caaaggctttgctatgatgcat

SEQ ID NO: 9308273 - DNA, 22 bp, Homo sapiens
caaaggcttcatctcagagcag

SEQ ID NO: 9308274 - DNA, 22 bp, Homo sapiens
caaagggcatggcctgagcact

SEQ ID NO: 9308275 - DNA, 22 bp, Homo sapiens
caaagggcattttagtgaactg

SEQ ID NO: 9308276 - DNA, 22 bp, Homo sapiens
agcaggacacgatgcggcagga

SEQ ID NO: 9308277 - DNA, 22 bp, Homo sapiens
agcaggaccaagaaggggaaaa

SEQ ID NO: 9308278 - DNA, 22 bp, Homo sapiens
agcaggaagtcctctcaggaga

SEQ ID NO: 9308279 - DNA, 22 bp, Homo sapiens
agcaggaaggggcctagcctgg

SEQ ID NO: 9308280 - DNA, 22 bp, Homo sapiens
agcaggaactgacaccaagcca

SEQ ID NO: 9308281 - DNA, 21 bp, Homo sapiens
agcagctgggcaacatggagg

SEQ ID NO: 9308282 - DNA, 22 bp, Homo sapiens
agcaggctgggcaatatgggca

SEQ ID NO: 9308283 - DNA, 22 bp, Homo sapiens
cacagcacctaggtttgtggct

SEQ ID NO: 9308284 - DNA, 22 bp, Homo sapiens
agcaggcttactttctgattag

SEQ ID NO: 9308285 - DNA, 22 bp, Homo sapiens
agcaggcttatggttgaaggga

SEQ ID NO: 9308286 - DNA, 22 bp, Homo sapiens
agcagggcagtgatcagaaagg

SEQ ID NO: 9308287 - DNA, 22 bp, Homo sapiens
agcagggcagcttttttcagaa

SEQ ID NO: 9308288 - DNA, 22 bp, Homo sapiens
agcagggcagcttttttcagaa

SEQ ID NO: 9308289 - DNA, 22 bp, Homo sapiens
agcagggcaggtaaggatcaga

SEQ ID NO: 9308290 - DNA, 22 bp, Homo sapiens
agcagggcaggtaaggatcaga

SEQ ID NO: 9308291 - DNA, 22 bp, Homo sapiens
agcagggcagctgatgcgcacg

SEQ ID NO: 9308292 - DNA, 22 bp, Homo sapiens
agcagggcactggaaggcactg

SEQ ID NO: 9308293 - DNA, 22 bp, Homo sapiens
agcagggcagtgatcagaaagg

SEQ ID NO: 9308294 - DNA, 23 bp, Homo sapiens
caccactttctccttctccttgg

SEQ ID NO: 9308295 - DNA, 20 bp, Homo sapiens
caccagcagcagctgccacc

SEQ ID NO: 9308296 - DNA, 22 bp, Homo sapiens
agcagggctctgtggagggtgg

SEQ ID NO: 9308297 - DNA, 22 bp, Homo sapiens
agcagggctctgccatgggccc

SEQ ID NO: 9308298 - DNA, 22 bp, Homo sapiens
caccagccagagtgacagctcc

SEQ ID NO: 9308299 - DNA, 22 bp, Homo sapiens
agcatgtaaagctcttagcacc

SEQ ID NO: 9308300 - DNA, 22 bp, Homo sapiens
agcattaagcctggctcagagg

SEQ ID NO: 9308301 - DNA, 22 bp, Homo sapiens
agcattaagagagactgaactg

SEQ ID NO: 9308302 - DNA, 23 bp, Homo sapiens
agcatggaagaagctggactcct

SEQ ID NO: 9308303 - DNA, 22 bp, Homo sapiens
cactgttgaagatacttcctct

SEQ ID NO: 9308304 - DNA, 23 bp, Homo sapiens
agcattagagatgccagccctgt

SEQ ID NO: 9308305 - DNA, 22 bp, Homo sapiens
agcattaataagaaatggctcc

SEQ ID NO: 9308306 - DNA, 22 bp, Homo sapiens
agcagtgcctggcacatgtaag

SEQ ID NO: 9308307 - DNA, 22 bp, Homo sapiens
agcagtgagccataagtgctag

SEQ ID NO: 9308308 - DNA, 22 bp, Homo sapiens
agcatgaagacttcagagctag

SEQ ID NO: 9308309 - DNA, 22 bp, Homo sapiens
agcagggctgcagtgtgtcttt

SEQ ID NO: 9308310 - DNA, 22 bp, Homo sapiens
agcagggctgcggccccaccac

SEQ ID NO: 9308311 - DNA, 22 bp, Homo sapiens
agcagggctggggcacgagcca

SEQ ID NO: 9308312 - DNA, 22 bp, Homo sapiens
agcaggtgtcggcgagggtctt

SEQ ID NO: 9308313 - DNA, 22 bp, Homo sapiens
agcagtaagcaactgagcttgc

SEQ ID NO: 9308314 - DNA, 22 bp, Homo sapiens
agcagtaagtgaagactagttt

SEQ ID NO: 9308315 - DNA, 22 bp, Homo sapiens
agcagtcaggcctcagagccgt

SEQ ID NO: 9308316 - DNA, 20 bp, Homo sapiens
agcagtccaaaagggcagac

SEQ ID NO: 9308317 - DNA, 22 bp, Homo sapiens
agaggcaagttcagagctagga

SEQ ID NO: 9308318 - DNA, 19 bp, Homo sapiens
agaggcaagggtggaagta

SEQ ID NO: 9308319 - DNA, 22 bp, Homo sapiens
agagctggctgtgggtgacttt

SEQ ID NO: 9308320 - DNA, 20 bp, Homo sapiens
agagctgggaagctccctat

SEQ ID NO: 9308321 - DNA, 22 bp, Homo sapiens
agaggcaagattatcagggcat

SEQ ID NO: 9308322 - DNA, 22 bp, Homo sapiens
attacactaatgtgacaacaat

SEQ ID NO: 9308323 - DNA, 22 bp, Homo sapiens
agaggcaggaggttgacttgag

SEQ ID NO: 9308324 - DNA, 23 bp, Homo sapiens
agaggcaggagtggcttgcccgg

SEQ ID NO: 9308325 - DNA, 22 bp, Homo sapiens
agaggcaggaggttgacttgag

SEQ ID NO: 9308326 - DNA, 22 bp, Homo sapiens
agaggcaggaggttgacttgag

SEQ ID NO: 9308327 - DNA, 22 bp, Homo sapiens
agaggctgatggagtagtgtct

SEQ ID NO: 9308328 - DNA, 22 bp, Homo sapiens
agaggctgatggagtagtgtct

SEQ ID NO: 9308329 - DNA, 22 bp, Homo sapiens
agaggctgcacttgctcatgat

SEQ ID NO: 9308330 - DNA, 22 bp, Homo sapiens
agaggctgcacttgctcatgat

SEQ ID NO: 9308331 - DNA, 18 bp, Homo sapiens
agaggctggacaggggat

SEQ ID NO: 9308332 - DNA, 22 bp, Homo sapiens
agaggctggattgagcatagac

SEQ ID NO: 9308333 - DNA, 22 bp, Homo sapiens
agaggctggattgagcatagac

SEQ ID NO: 9308334 - DNA, 22 bp, Homo sapiens
agaggctgcaggctggaaatca

SEQ ID NO: 9308335 - DNA, 22 bp, Homo sapiens
agaggctgcaggctggaaatca

SEQ ID NO: 9308336 - DNA, 23 bp, Homo sapiens
agaggctgcagggtattgagaat

SEQ ID NO: 9308337 - DNA, 23 bp, Homo sapiens
agaggctgcagggtattgagaat

SEQ ID NO: 9308338 - DNA, 18 bp, Homo sapiens
agaggctggacaggggat

SEQ ID NO: 9308339 - DNA, 23 bp, Homo sapiens
agaggcaggagtggcttgcccgg

SEQ ID NO: 9308340 - DNA, 22 bp, Homo sapiens
agaggtggagctcttggcatca

SEQ ID NO: 9308341 - DNA, 22 bp, Homo sapiens
agagtcagaaagcagacagggg

SEQ ID NO: 9308342 - DNA, 22 bp, Homo sapiens
agagtccaaatgtgcagttatg

SEQ ID NO: 9308343 - DNA, 22 bp, Homo sapiens
agaggctgggcaggacccacag

SEQ ID NO: 9308344 - DNA, 22 bp, Homo sapiens
agaggctgggcaggacccacag

SEQ ID NO: 9308345 - DNA, 22 bp, Homo sapiens
agaggctgggaagggtccccgg

SEQ ID NO: 9308346 - DNA, 22 bp, Homo sapiens
agaggctgggaagggtccccgg

SEQ ID NO: 9308347 - DNA, 19 bp, Homo sapiens
agaggctgtcacctgtagc

SEQ ID NO: 9308348 - DNA, 22 bp, Homo sapiens
agaggctgtcccttgctattcc

SEQ ID NO: 9308349 - DNA, 16 bp, Homo sapiens
agaggctgtaatggaa

SEQ ID NO: 9308350 - DNA, 22 bp, Homo sapiens
agaggctgggtacgggccacct

SEQ ID NO: 9308351 - DNA, 22 bp, Homo sapiens
agaggctgtcccttgctattcc

SEQ ID NO: 9308352 - DNA, 22 bp, Homo sapiens
agaggggaaggatgtgatgtga

SEQ ID NO: 9308353 - DNA, 22 bp, Homo sapiens
agagggcagtctcagattggga

SEQ ID NO: 9308354 - DNA, 22 bp, Homo sapiens
agaggtgacataggagaggctc

SEQ ID NO: 9308355 - DNA, 23 bp, Homo sapiens
agaggggagcatctgctggctga

SEQ ID NO: 9308356 - DNA, 22 bp, Homo sapiens
agatggctgatggcaggagcca

SEQ ID NO: 9308357 - DNA, 22 bp, Homo sapiens
agatggctctttgaaggggaat

SEQ ID NO: 9308358 - DNA, 22 bp, Homo sapiens
agatggccccaggtgcccaggg

SEQ ID NO: 9308359 - DNA, 17 bp, Homo sapiens
agatggcaggaggcaga

SEQ ID NO: 9308360 - DNA, 22 bp, Homo sapiens
agatggcagcagaacaaacagg

SEQ ID NO: 9308361 - DNA, 22 bp, Homo sapiens
agatggagttgtagcagtgact

SEQ ID NO: 9308362 - DNA, 22 bp, Homo sapiens
agatggagttagtaccagagtc

SEQ ID NO: 9308363 - DNA, 22 bp, Homo sapiens
agatggagtggagatgagtaaa

SEQ ID NO: 9308364 - DNA, 22 bp, Homo sapiens
agatggagtctcactcttgttg

SEQ ID NO: 9308365 - DNA, 22 bp, Homo sapiens
agatggagtggagatgagtaaa

SEQ ID NO: 9308366 - DNA, 22 bp, Homo sapiens
agatggagaccttggatgaact

SEQ ID NO: 9308367 - DNA, 22 bp, Homo sapiens
agatggagaccttggatgaact

SEQ ID NO: 9308368 - DNA, 22 bp, Homo sapiens
agatggaggaaggctgaactca

SEQ ID NO: 9308369 - DNA, 22 bp, Homo sapiens
agatggaggaaggctgaactca

SEQ ID NO: 9308370 - DNA, 22 bp, Homo sapiens
agatggaaaatatagacagaga

SEQ ID NO: 9308371 - DNA, 22 bp, Homo sapiens
agatggagaatgacaattaagg

SEQ ID NO: 9308372 - DNA, 23 bp, Homo sapiens
agatcagcatggatcagtcttct

SEQ ID NO: 9308373 - DNA, 22 bp, Homo sapiens
agatatttgtatcttgctattg

SEQ ID NO: 9308374 - DNA, 22 bp, Homo sapiens
agatatttgtatcttgctattg

SEQ ID NO: 9308375 - DNA, 22 bp, Homo sapiens
agagtggcaccttacctgagac

SEQ ID NO: 9308376 - DNA, 22 bp, Homo sapiens
attggcttccttcttattgtca

SEQ ID NO: 9308377 - DNA, 22 bp, Homo sapiens
attggcttgcactgtattttaa

SEQ ID NO: 9308378 - DNA, 21 bp, Homo sapiens
agcaactctgactagatgagg

SEQ ID NO: 9308379 - DNA, 22 bp, Homo sapiens
agcaaatctatgaatgtatatt

SEQ ID NO: 9308380 - DNA, 22 bp, Homo sapiens
agatgtgtttctagttcctgca

SEQ ID NO: 9308381 - DNA, 22 bp, Homo sapiens
agatgtgggcaatggaatggag

SEQ ID NO: 9308382 - DNA, 22 bp, Homo sapiens
attttatgacacgattcttcca

SEQ ID NO: 9308383 - DNA, 22 bp, Homo sapiens
agatgtggccggctagggagag

SEQ ID NO: 9308384 - DNA, 22 bp, Homo sapiens
agatgtggcctttgggagatta

SEQ ID NO: 9308385 - DNA, 22 bp, Homo sapiens
agacctggtaagcaggttgggc

SEQ ID NO: 9308386 - DNA, 22 bp, Homo sapiens
agacctggtgatagctgtccta

SEQ ID NO: 9308387 - DNA, 22 bp, Homo sapiens
agacctgggtgccctgtgcttt

SEQ ID NO: 9308388 - DNA, 22 bp, Homo sapiens
agacctgaagagtatcttcaga

SEQ ID NO: 9308389 - DNA, 22 bp, Homo sapiens
agacctggagacctgagtggta

SEQ ID NO: 9308390 - DNA, 22 bp, Homo sapiens
agacccagagggctgctgggag

SEQ ID NO: 9308391 - DNA, 22 bp, Homo sapiens
atgcctggtcccacctctaggt

SEQ ID NO: 9308392 - DNA, 22 bp, Homo sapiens
atgatatacttcctagaacagt

SEQ ID NO: 9308393 - DNA, 22 bp, Homo sapiens
atgatatagagagtagattaaa

SEQ ID NO: 9308394 - DNA, 22 bp, Homo sapiens
atgagggaggggtggtgccgca

SEQ ID NO: 9308395 - DNA, 22 bp, Homo sapiens
atgaggctatgaatggggagat

SEQ ID NO: 9308396 - DNA, 22 bp, Homo sapiens
agacaacatgatcagcagtcct

SEQ ID NO: 9308397 - DNA, 22 bp, Homo sapiens
agacaaatttgttttcctgtct

SEQ ID NO: 9308398 - DNA, 22 bp, Homo sapiens
atctgcttgagtttgaagtcag

SEQ ID NO: 9308399 - DNA, 22 bp, Homo sapiens
atctgcttgcaggctggccctt

SEQ ID NO: 9308400 - DNA, 22 bp, Homo sapiens
atctgcttgaatgagcaacagg

SEQ ID NO: 9308401 - DNA, 22 bp, Homo sapiens
atctgcttgaaacttcttatac

SEQ ID NO: 9308402 - DNA, 22 bp, Homo sapiens
atctgcttcagtgatatgtgaa

SEQ ID NO: 9308403 - DNA, 17 bp, Homo sapiens
atctgcttcacccagca

SEQ ID NO: 9308404 - DNA, 17 bp, Homo sapiens
atctgcttcacccagca

SEQ ID NO: 9308405 - DNA, 22 bp, Homo sapiens
atctgcttagaattcattgtcc

SEQ ID NO: 9308406 - DNA, 21 bp, Homo sapiens
atctgcttaggtttgttcaga

SEQ ID NO: 9308407 - DNA, 22 bp, Homo sapiens
atctgcttcctccttagggaaa

SEQ ID NO: 9308408 - DNA, 22 bp, Homo sapiens
atctgcttcgcgccaatttcat

SEQ ID NO: 9308409 - DNA, 22 bp, Homo sapiens
atctgcttcctgggctccatga

SEQ ID NO: 9308410 - DNA, 22 bp, Homo sapiens
atctgcttgccctcttaggacc

SEQ ID NO: 9308411 - DNA, 18 bp, Homo sapiens
atgaacactgagctgaat

SEQ ID NO: 9308412 - DNA, 22 bp, Homo sapiens
atctgcttgaatgagcaacagg

SEQ ID NO: 9308413 - DNA, 22 bp, Homo sapiens
atgaagcatctcacaatctagt

SEQ ID NO: 9308414 - DNA, 22 bp, Homo sapiens
atctgcctgtatttaccatcat

SEQ ID NO: 9308415 - DNA, 22 bp, Homo sapiens
atctgcctccaagtccatgtgt

SEQ ID NO: 9308416 - DNA, 22 bp, Homo sapiens
agaatatatgactgcaagacta

SEQ ID NO: 9308417 - DNA, 22 bp, Homo sapiens
agagcagagtggctgtagcttg

SEQ ID NO: 9308418 - DNA, 21 bp, Homo sapiens
agagcacaggtggacaatgct

SEQ ID NO: 9308419 - DNA, 22 bp, Homo sapiens
agagcagatggagctggaagag

SEQ ID NO: 9308420 - DNA, 22 bp, Homo sapiens
agagcagatggagctggaagag

SEQ ID NO: 9308421 - DNA, 22 bp, Homo sapiens
agagcagcacgttgtccccaca

SEQ ID NO: 9308422 - DNA, 22 bp, Homo sapiens
agagcccctcggtggaggggtc

SEQ ID NO: 9308423 - DNA, 22 bp, Homo sapiens
agagcccatcagtggcagtgga

SEQ ID NO: 9308424 - DNA, 22 bp, Homo sapiens
agagcctgaggccctgagaggg

SEQ ID NO: 9308425 - DNA, 22 bp, Homo sapiens
agagcctctgtcatggagagaa

SEQ ID NO: 9308426 - DNA, 22 bp, Homo sapiens
agagcccttgccctcagtcacc

SEQ ID NO: 9308427 - DNA, 22 bp, Homo sapiens
agagccctttctccaggcacct

SEQ ID NO: 9308428 - DNA, 22 bp, Homo sapiens
agagccctgacggggacagatg

SEQ ID NO: 9308429 - DNA, 22 bp, Homo sapiens
agagccctgaagcagagctaaa

SEQ ID NO: 9308430 - DNA, 22 bp, Homo sapiens
agagctggctgctgcggtgctt

SEQ ID NO: 9308431 - DNA, 22 bp, Homo sapiens
agagctggctggtagccctgat

SEQ ID NO: 9308432 - DNA, 22 bp, Homo sapiens
agagctggctggtagccctgat

SEQ ID NO: 9308433 - DNA, 22 bp, Homo sapiens
agagctggctgctgcggtgctt

SEQ ID NO: 9308434 - DNA, 22 bp, Homo sapiens
agagctggatggtcaagatggc

SEQ ID NO: 9308435 - DNA, 21 bp, Homo sapiens
agagacagagaaagtaacatt

SEQ ID NO: 9308436 - DNA, 22 bp, Homo sapiens
agagagcccgggccagggcaca

SEQ ID NO: 9308437 - DNA, 19 bp, Homo sapiens
agacttttgtaagttgaga

SEQ ID NO: 9308438 - DNA, 22 bp, Homo sapiens
agactttatagtttttggctat

SEQ ID NO: 9308439 - DNA, 22 bp, Homo sapiens
agactgtagcttctgtcttgag

SEQ ID NO: 9308440 - DNA, 22 bp, Homo sapiens
agacttaggagctgacatctct

SEQ ID NO: 9308441 - DNA, 22 bp, Homo sapiens
agactttagatacgtcttcttc

SEQ ID NO: 9308442 - DNA, 22 bp, Homo sapiens
agacttctttgtgagcattttc

SEQ ID NO: 9308443 - DNA, 22 bp, Homo sapiens
atagagtgatgtaaggtatgtg

SEQ ID NO: 9308444 - DNA, 22 bp, Homo sapiens
actttggcacagaacttccatt

SEQ ID NO: 9308445 - DNA, 20 bp, Homo sapiens
atagatatcatctttagaag

SEQ ID NO: 9308446 - DNA, 22 bp, Homo sapiens
atagatatttgagttgtttcca

SEQ ID NO: 9308447 - DNA, 22 bp, Homo sapiens
actttgttcctttcacaaagaa

SEQ ID NO: 9308448 - DNA, 22 bp, Homo sapiens
atagatcaattctgcttccaca

SEQ ID NO: 9308449 - DNA, 22 bp, Homo sapiens
atacaaaatatatactggagac

SEQ ID NO: 9308450 - DNA, 22 bp, Homo sapiens
ataatttggcttcctagatgta

SEQ ID NO: 9308451 - DNA, 22 bp, Homo sapiens
atacaaaaattagccgggagta

SEQ ID NO: 9308452 - DNA, 21 bp, Homo sapiens
actttacaatttacatagtga

SEQ ID NO: 9308453 - DNA, 22 bp, Homo sapiens
actgggccttgccatggcagcc

SEQ ID NO: 9308454 - DNA, 22 bp, Homo sapiens
agtttttcctgattttacagaa

SEQ ID NO: 9308455 - DNA, 22 bp, Homo sapiens
agtttttctcccctggcttcat

SEQ ID NO: 9308456 - DNA, 21 bp, Homo sapiens
actgttattcccattttcacc

SEQ ID NO: 9308457 - DNA, 22 bp, Homo sapiens
acttaaaaagaatcttttcacg

SEQ ID NO: 9308458 - DNA, 22 bp, Homo sapiens
acttaaaaagaatcttttcacg

SEQ ID NO: 9308459 - DNA, 22 bp, Homo sapiens
acttaaaaccagacagcgtcat

SEQ ID NO: 9308460 - DNA, 22 bp, Homo sapiens
acttaaaaacagatccagcagg

SEQ ID NO: 9308461 - DNA, 22 bp, Homo sapiens
acttcctggctgggtgacctgg

SEQ ID NO: 9308462 - DNA, 22 bp, Homo sapiens
agaaagcagtcccttccgaccg

SEQ ID NO: 9308463 - DNA, 22 bp, Homo sapiens
agaaagcatctccattgtaggt

SEQ ID NO: 9308464 - DNA, 22 bp, Homo sapiens
agaaagcatctccattgtaggt

SEQ ID NO: 9308465 - DNA, 22 bp, Homo sapiens
agaaagcagcatttatgatctc

SEQ ID NO: 9308466 - DNA, 22 bp, Homo sapiens
agaaagcactctgtcttttacc

SEQ ID NO: 9308467 - DNA, 22 bp, Homo sapiens
agaaagcacgggccccaggctc

SEQ ID NO: 9308468 - DNA, 22 bp, Homo sapiens
agaaagcacagcgggtccattt

SEQ ID NO: 9308469 - DNA, 22 bp, Homo sapiens
agaaagcacagcgggtccattt

SEQ ID NO: 9308470 - DNA, 22 bp, Homo sapiens
agaaagcaccctgcactttctg

SEQ ID NO: 9308471 - DNA, 22 bp, Homo sapiens
atcagtgttccttgagactgcc

SEQ ID NO: 9308472 - DNA, 22 bp, Homo sapiens
atcagtgtttgcatgggagctt

SEQ ID NO: 9308473 - DNA, 22 bp, Homo sapiens
atcaaaacccagacaggctgga

SEQ ID NO: 9308474 - DNA, 22 bp, Homo sapiens
acttttctccctcctgccttca

SEQ ID NO: 9308475 - DNA, 21 bp, Homo sapiens
agaaaaacacgatataagccc

SEQ ID NO: 9308476 - DNA, 22 bp, Homo sapiens
actttttacagggtgtatacca

SEQ ID NO: 9308477 - DNA, 22 bp, Homo sapiens
actttttagtttcctcaaacat

SEQ ID NO: 9308478 - DNA, 22 bp, Homo sapiens
acttttttataaggaagaagat

SEQ ID NO: 9308479 - DNA, 21 bp, Homo sapiens
atctcttcaaggctgatttac

SEQ ID NO: 9308480 - DNA, 22 bp, Homo sapiens
atctcttctagctctgaaatta

SEQ ID NO: 9308481 - DNA, 22 bp, Homo sapiens
agaagccaattctgtgtgagtc

SEQ ID NO: 9308482 - DNA, 22 bp, Homo sapiens
agaagccacaggaaagcagctt

SEQ ID NO: 9308483 - DNA, 22 bp, Homo sapiens
agaagccaacagggcaggagag

SEQ ID NO: 9308484 - DNA, 20 bp, Homo sapiens
agaagccaagtgacatgttt

SEQ ID NO: 9308485 - DNA, 22 bp, Homo sapiens
agaagccaagaacagacagtgc

SEQ ID NO: 9308486 - DNA, 22 bp, Homo sapiens
agaaggagtgtacaggtcatgc

SEQ ID NO: 9308487 - DNA, 22 bp, Homo sapiens
atctctgctagccttcttcagg

SEQ ID NO: 9308488 - DNA, 22 bp, Homo sapiens
atctctgctagccttcttcagg

SEQ ID NO: 9308489 - DNA, 22 bp, Homo sapiens
agaacatttgtcgatcaatttg

SEQ ID NO: 9308490 - DNA, 22 bp, Homo sapiens
agaacattaatgcgaggtatta

SEQ ID NO: 9308491 - DNA, 22 bp, Homo sapiens
atcccaagtagcaatcctggta

SEQ ID NO: 9308492 - DNA, 22 bp, Homo sapiens
agaaatcctgatggagtctgaa

SEQ ID NO: 9308493 - DNA, 16 bp, Homo sapiens
atccaggcaggaaaga

SEQ ID NO: 9308494 - DNA, 22 bp, Homo sapiens
atccaggagggctgactcctta

SEQ ID NO: 9308495 - DNA, 22 bp, Homo sapiens
actggctgtgtaacctcaggca

SEQ ID NO: 9308496 - DNA, 22 bp, Homo sapiens
actggctgtgtaacctcaggca

SEQ ID NO: 9308497 - DNA, 22 bp, Homo sapiens
actggctgtgcccatagagctc

SEQ ID NO: 9308498 - DNA, 22 bp, Homo sapiens
actggctgtgcccatagagctc

SEQ ID NO: 9308499 - DNA, 22 bp, Homo sapiens
actggctgtggccacggctgct

SEQ ID NO: 9308500 - DNA, 22 bp, Homo sapiens
actggctgtgcagagggcagta

SEQ ID NO: 9308501 - DNA, 21 bp, Homo sapiens
actggctgtcttcctactggt

SEQ ID NO: 9308502 - DNA, 21 bp, Homo sapiens
actggctgtcttcctactggt

SEQ ID NO: 9308503 - DNA, 21 bp, Homo sapiens
actggctggtggctaagaatc

SEQ ID NO: 9308504 - DNA, 21 bp, Homo sapiens
actggctggctgagtttcctg

SEQ ID NO: 9308505 - DNA, 22 bp, Homo sapiens
actggctggccgcgctcttcgc

SEQ ID NO: 9308506 - DNA, 21 bp, Homo sapiens
actggctggctgagtttcctg

SEQ ID NO: 9308507 - DNA, 22 bp, Homo sapiens
actggctggccacaccctggta

SEQ ID NO: 9308508 - DNA, 22 bp, Homo sapiens
actggctggccacaccctggta

SEQ ID NO: 9308509 - DNA, 22 bp, Homo sapiens
actgggaggcaaagagcaagga

SEQ ID NO: 9308510 - DNA, 22 bp, Homo sapiens
actgggcccatatactcagtct

SEQ ID NO: 9308511 - DNA, 22 bp, Homo sapiens
actggctgatcacctgcctcag

SEQ ID NO: 9308512 - DNA, 22 bp, Homo sapiens
actggctgatatggctaggaag

SEQ ID NO: 9308513 - DNA, 21 bp, Homo sapiens
actggctgccatgatccaggg

SEQ ID NO: 9308514 - DNA, 21 bp, Homo sapiens
actggctgccatgatccaggg

SEQ ID NO: 9308515 - DNA, 22 bp, Homo sapiens
actggctgcctccaaagtgtgc

SEQ ID NO: 9308516 - DNA, 22 bp, Homo sapiens
actggctggagttgccaaggct

SEQ ID NO: 9308517 - DNA, 22 bp, Homo sapiens
actggctggactctgacctctt

SEQ ID NO: 9308518 - DNA, 22 bp, Homo sapiens
actggctggactctgacctctt

SEQ ID NO: 9308519 - DNA, 22 bp, Homo sapiens
actggctgcgttcctgtgagac

SEQ ID NO: 9308520 - DNA, 20 bp, Homo sapiens
actggctgcctggaatgcgc

SEQ ID NO: 9308521 - DNA, 22 bp, Homo sapiens
actggctgcgatcttggcgctt

SEQ ID NO: 9308522 - DNA, 22 bp, Homo sapiens
actggctgcggggtggaagaag

SEQ ID NO: 9308523 - DNA, 19 bp, Homo sapiens
actgcctgaggctcacagg

SEQ ID NO: 9308524 - DNA, 22 bp, Homo sapiens
actgccagagacaaggatgagt

SEQ ID NO: 9308525 - DNA, 22 bp, Homo sapiens
actgaatttatgtttaaaaaca

SEQ ID NO: 9308526 - DNA, 22 bp, Homo sapiens
actctgcctgaacctcctgcaa

SEQ ID NO: 9308527 - DNA, 22 bp, Homo sapiens
actctgaatgtgcatgtaaatc

SEQ ID NO: 9308528 - DNA, 22 bp, Homo sapiens
actgcactcctgcctgggtaac

SEQ ID NO: 9308529 - DNA, 22 bp, Homo sapiens
actgcactccagcctgggtgat

SEQ ID NO: 9308530 - DNA, 22 bp, Homo sapiens
actgcacttcaccctgggtgac

SEQ ID NO: 9308531 - DNA, 23 bp, Homo sapiens
agtgctcccaggacctggggcag

SEQ ID NO: 9308532 - DNA, 22 bp, Homo sapiens
actgcagcaggtaagagcattt

SEQ ID NO: 9308533 - DNA, 22 bp, Homo sapiens
actgcagccccctattaggact

SEQ ID NO: 9308534 - DNA, 22 bp, Homo sapiens
actgcagcctagggaccacagt

SEQ ID NO: 9308535 - DNA, 22 bp, Homo sapiens
agtgctcctgccagctttctgg

SEQ ID NO: 9308536 - DNA, 22 bp, Homo sapiens
agtgctcctgaagcttgaggca

SEQ ID NO: 9308537 - DNA, 22 bp, Homo sapiens
aggtgggcttggtgccaacatg

SEQ ID NO: 9308538 - DNA, 22 bp, Homo sapiens
aggtgggcggattcatgaggtc

SEQ ID NO: 9308539 - DNA, 22 bp, Homo sapiens
aggtggggaaaccagcgatccc

SEQ ID NO: 9308540 - DNA, 22 bp, Homo sapiens
agtacccttttcactgtcacaa

SEQ ID NO: 9308541 - DNA, 22 bp, Homo sapiens
actccaggggttgctatttaca

SEQ ID NO: 9308542 - DNA, 22 bp, Homo sapiens
agtagaaagaaggcactgggcc

SEQ ID NO: 9308543 - DNA, 22 bp, Homo sapiens
actctccttttgatcttcagaa

SEQ ID NO: 9308544 - DNA, 22 bp, Homo sapiens
actctcccttggagcctcaggc

SEQ ID NO: 9308545 - DNA, 22 bp, Homo sapiens
actctctcacagcttggctgat

SEQ ID NO: 9308546 - DNA, 22 bp, Homo sapiens
actctctcacacacgcctatat

SEQ ID NO: 9308547 - DNA, 22 bp, Homo sapiens
actctctcacagcttggctgat

SEQ ID NO: 9308548 - DNA, 22 bp, Homo sapiens
actctctcacacacgcctatat

SEQ ID NO: 9308549 - DNA, 22 bp, Homo sapiens
actctctctgatggaactttag

SEQ ID NO: 9308550 - DNA, 22 bp, Homo sapiens
actctctgagctaccaggtgag

SEQ ID NO: 9308551 - DNA, 22 bp, Homo sapiens
actctctggtattggcaagttt

SEQ ID NO: 9308552 - DNA, 22 bp, Homo sapiens
actctctgtgatggaggccagc

SEQ ID NO: 9308553 - DNA, 22 bp, Homo sapiens
agtcacttccagctgtgtttca

SEQ ID NO: 9308554 - DNA, 22 bp, Homo sapiens
agtcacttaatctaagtctcag

SEQ ID NO: 9308555 - DNA, 22 bp, Homo sapiens
actcctgggtgcatttctgatt

SEQ ID NO: 9308556 - DNA, 22 bp, Homo sapiens
actcctgggtgctgaccagcgt

SEQ ID NO: 9308557 - DNA, 21 bp, Homo sapiens
actccctgcataagtgattta

SEQ ID NO: 9308558 - DNA, 22 bp, Homo sapiens
actccagggtgactctgtctga

SEQ ID NO: 9308559 - DNA, 22 bp, Homo sapiens
actccagggttttgcacctgga

SEQ ID NO: 9308560 - DNA, 22 bp, Homo sapiens
actcctcagttgcttcttagtt

SEQ ID NO: 9308561 - DNA, 22 bp, Homo sapiens
actcctcagccagcatcaggga

SEQ ID NO: 9308562 - DNA, 22 bp, Homo sapiens
aggtagctggtgctgggctcct

SEQ ID NO: 9308563 - DNA, 19 bp, Homo sapiens
aggtagctcagactcaaag

SEQ ID NO: 9308564 - DNA, 22 bp, Homo sapiens
aggtcaagagtaaatttgggta

SEQ ID NO: 9308565 - DNA, 22 bp, Homo sapiens
aggtccaaatgttgagactgat

SEQ ID NO: 9308566 - DNA, 22 bp, Homo sapiens
aggtcatttccttagaggcaga

SEQ ID NO: 9308567 - DNA, 22 bp, Homo sapiens
aggtcaagtttagatagagtta

SEQ ID NO: 9308568 - DNA, 22 bp, Homo sapiens
aggtcaaggctgcagtgagctg

SEQ ID NO: 9308569 - DNA, 22 bp, Homo sapiens
aggtcaagggcaagagtgaggt

SEQ ID NO: 9308570 - DNA, 22 bp, Homo sapiens
acctttgctaggtaggtattgg

SEQ ID NO: 9308571 - DNA, 19 bp, Homo sapiens
acctttgagaagaaatgtc

SEQ ID NO: 9308572 - DNA, 19 bp, Homo sapiens
acctttcctttctcagatg

SEQ ID NO: 9308573 - DNA, 22 bp, Homo sapiens
acctttcctggctgaccgagga

SEQ ID NO: 9308574 - DNA, 22 bp, Homo sapiens
acctttccaagtatcaggtggt

SEQ ID NO: 9308575 - DNA, 21 bp, Homo sapiens
aggtccagttctgtcttggac

SEQ ID NO: 9308576 - DNA, 21 bp, Homo sapiens
aggtccagttctgtcttggac

SEQ ID NO: 9308577 - DNA, 22 bp, Homo sapiens
aggtccagtgaaactttatttg

SEQ ID NO: 9308578 - DNA, 22 bp, Homo sapiens
aggtccaggttccgtttctgcg

SEQ ID NO: 9308579 - DNA, 22 bp, Homo sapiens
aggtccagtgctcttggtggtt

SEQ ID NO: 9308580 - DNA, 22 bp, Homo sapiens
aggtccaggttccgtttctgcg

SEQ ID NO: 9308581 - DNA, 22 bp, Homo sapiens
aggtccaggcctcatgatggcc

SEQ ID NO: 9308582 - DNA, 22 bp, Homo sapiens
aggtccaggcctcatgatggcc

SEQ ID NO: 9308583 - DNA, 22 bp, Homo sapiens
aggtccaggcatttgggttggg

SEQ ID NO: 9308584 - DNA, 22 bp, Homo sapiens
aggtccaggatttgtggggtct

SEQ ID NO: 9308585 - DNA, 22 bp, Homo sapiens
aggtccaggatttgtggggtct

SEQ ID NO: 9308586 - DNA, 22 bp, Homo sapiens
aggtccaggagatttggcaatt

SEQ ID NO: 9308587 - DNA, 22 bp, Homo sapiens
aggtccagctgttgcagcctcc

SEQ ID NO: 9308588 - DNA, 22 bp, Homo sapiens
aggtccacagttcagctgccca

SEQ ID NO: 9308589 - DNA, 22 bp, Homo sapiens
aggtccagactgtgtaccctag

SEQ ID NO: 9308590 - DNA, 22 bp, Homo sapiens
aggtccagaggctccttattac

SEQ ID NO: 9308591 - DNA, 22 bp, Homo sapiens
aggtccagaacgtgcctactct

SEQ ID NO: 9308592 - DNA, 22 bp, Homo sapiens
aggtccagctctattgaaaaga

SEQ ID NO: 9308593 - DNA, 22 bp, Homo sapiens
aggtccagcctgccctctctcc

SEQ ID NO: 9308594 - DNA, 22 bp, Homo sapiens
aggtccagagttgagatacaga

SEQ ID NO: 9308595 - DNA, 22 bp, Homo sapiens
aggtccagaggttgaacggtgg

SEQ ID NO: 9308596 - DNA, 22 bp, Homo sapiens
aggtgaagttgaggaggcagaa

SEQ ID NO: 9308597 - DNA, 22 bp, Homo sapiens
acgaggttggagagttgtttgg

SEQ ID NO: 9308598 - DNA, 22 bp, Homo sapiens
actacagaagtcttattagaga

SEQ ID NO: 9308599 - DNA, 22 bp, Homo sapiens
actacatttgcagagaagcaat

SEQ ID NO: 9308600 - DNA, 22 bp, Homo sapiens
accccagcgcatatggtctgcg

SEQ ID NO: 9308601 - DNA, 22 bp, Homo sapiens
accctgcttggccccacttcta

SEQ ID NO: 9308602 - DNA, 21 bp, Homo sapiens
accctgctttatgccgtcctc

SEQ ID NO: 9308603 - DNA, 22 bp, Homo sapiens
accctgctttatgccgtcctct

SEQ ID NO: 9308604 - DNA, 22 bp, Homo sapiens
agggcctgacacccttgccagc

SEQ ID NO: 9308605 - DNA, 22 bp, Homo sapiens
agggcctgagaccgtggcttga

SEQ ID NO: 9308606 - DNA, 22 bp, Homo sapiens
acccagggtagagtgcagtggc

SEQ ID NO: 9308607 - DNA, 22 bp, Homo sapiens
accaagcacaaagatgagtaaa

SEQ ID NO: 9308608 - DNA, 22 bp, Homo sapiens
accaagaaacaaccctcttctg

SEQ ID NO: 9308609 - DNA, 22 bp, Homo sapiens
accaagcttcgtggaggaagtt

SEQ ID NO: 9308610 - DNA, 22 bp, Homo sapiens
accaagcacaaagatgagtaaa

SEQ ID NO: 9308611 - DNA, 22 bp, Homo sapiens
accaatataagtataggtaagt

SEQ ID NO: 9308612 - DNA, 22 bp, Homo sapiens
accaggactttgtattcagctt

SEQ ID NO: 9308613 - DNA, 22 bp, Homo sapiens
accaggacttcattaggttctt

SEQ ID NO: 9308614 - DNA, 22 bp, Homo sapiens
accaggactaataaaaatgttc

SEQ ID NO: 9308615 - DNA, 20 bp, Homo sapiens
accaggacaagacaaaagtg

SEQ ID NO: 9308616 - DNA, 22 bp, Homo sapiens
accaggacattttagtcatctt

SEQ ID NO: 9308617 - DNA, 22 bp, Homo sapiens
accaggctgtgaagtgagacta

SEQ ID NO: 9308618 - DNA, 23 bp, Homo sapiens
acattcttgattcaggccttagc

SEQ ID NO: 9308619 - DNA, 22 bp, Homo sapiens
acattctttcgatgtctgattt

SEQ ID NO: 9308620 - DNA, 22 bp, Homo sapiens
acattcaagatgcattcactta

SEQ ID NO: 9308621 - DNA, 22 bp, Homo sapiens
aggcttcagggcttttgagggt

SEQ ID NO: 9308622 - DNA, 19 bp, Homo sapiens
aggcttcaggccacatgct

SEQ ID NO: 9308623 - DNA, 19 bp, Homo sapiens
aggcttcaggccacatgct

SEQ ID NO: 9308624 - DNA, 22 bp, Homo sapiens
aggcttcagtattcaccgcatg

SEQ ID NO: 9308625 - DNA, 22 bp, Homo sapiens
aggcttcagtattcaccgcatg

SEQ ID NO: 9308626 - DNA, 22 bp, Homo sapiens
aggcttcagtagggagcatgtc

SEQ ID NO: 9308627 - DNA, 22 bp, Homo sapiens
aggcttcaggtttgctttgcag

SEQ ID NO: 9308628 - DNA, 22 bp, Homo sapiens
aggcttcatgtgtcctgggtga

SEQ ID NO: 9308629 - DNA, 22 bp, Homo sapiens
aggcttcatgtagatggttccc

SEQ ID NO: 9308630 - DNA, 19 bp, Homo sapiens
aggcttcatcctgggcagc

SEQ ID NO: 9308631 - DNA, 19 bp, Homo sapiens
aggcttcatcctgggcagc

SEQ ID NO: 9308632 - DNA, 23 bp, Homo sapiens
aggcttcatccatatttattgcc

SEQ ID NO: 9308633 - DNA, 22 bp, Homo sapiens
aggcttcagttgtaccttcttg

SEQ ID NO: 9308634 - DNA, 22 bp, Homo sapiens
aggcttcatatttaggcatatg

SEQ ID NO: 9308635 - DNA, 22 bp, Homo sapiens
aggcttcagttgtaccttcttg

SEQ ID NO: 9308636 - DNA, 22 bp, Homo sapiens
aggcttcagtagggagcatgtc

SEQ ID NO: 9308637 - DNA, 22 bp, Homo sapiens
aggcttcccttcctctgggggt

SEQ ID NO: 9308638 - DNA, 22 bp, Homo sapiens
aggcttccgagtagctgggact

SEQ ID NO: 9308639 - DNA, 22 bp, Homo sapiens
aggcttcattgtggcatcagga

SEQ ID NO: 9308640 - DNA, 22 bp, Homo sapiens
aggcttcattgtggcatcagga

SEQ ID NO: 9308641 - DNA, 22 bp, Homo sapiens
aggcttcattacagtggttcaa

SEQ ID NO: 9308642 - DNA, 22 bp, Homo sapiens
aggcttcatgtgtcctgggtga

SEQ ID NO: 9308643 - DNA, 19 bp, Homo sapiens
aggcttcatcctgggcagc

SEQ ID NO: 9308644 - DNA, 22 bp, Homo sapiens
aggcttcatgtgtcctgggtga

SEQ ID NO: 9308645 - DNA, 22 bp, Homo sapiens
aggcttcattacagtggttcaa

SEQ ID NO: 9308646 - DNA, 22 bp, Homo sapiens
aggcttcaggaagtctcctggg

SEQ ID NO: 9308647 - DNA, 22 bp, Homo sapiens
aggcttcaggaagtctcctggg

SEQ ID NO: 9308648 - DNA, 22 bp, Homo sapiens
aggcttcaggaaatatacattt

SEQ ID NO: 9308649 - DNA, 22 bp, Homo sapiens
aggcttcaggaagtctcctggg

SEQ ID NO: 9308650 - DNA, 22 bp, Homo sapiens
aggcttcaggaagtctcctggg

SEQ ID NO: 9308651 - DNA, 22 bp, Homo sapiens
aggcttcagcctagagctggag

SEQ ID NO: 9308652 - DNA, 22 bp, Homo sapiens
aggcttcagcctagagctggag

SEQ ID NO: 9308653 - DNA, 22 bp, Homo sapiens
aggcttcagcagccctctcttg

SEQ ID NO: 9308654 - DNA, 22 bp, Homo sapiens
aggcttcagcagccctctcttg

SEQ ID NO: 9308655 - DNA, 22 bp, Homo sapiens
aggcttcagcagccctctcttg

SEQ ID NO: 9308656 - DNA, 22 bp, Homo sapiens
aggcttcagcagccctctcttg

SEQ ID NO: 9308657 - DNA, 22 bp, Homo sapiens
aggcttcagaaagagtaattgg

SEQ ID NO: 9308658 - DNA, 22 bp, Homo sapiens
aggcttcagaggaagtgcggcc

SEQ ID NO: 9308659 - DNA, 22 bp, Homo sapiens
aggcttcagatgaccttagcat

SEQ ID NO: 9308660 - DNA, 22 bp, Homo sapiens
aggcttcagaggaagtgcggcc

SEQ ID NO: 9308661 - DNA, 22 bp, Homo sapiens
aggcttcagacaaatgttatgg

SEQ ID NO: 9308662 - DNA, 22 bp, Homo sapiens
aggctccagcccaaggctgcag

SEQ ID NO: 9308663 - DNA, 22 bp, Homo sapiens
aggctccaggcaaaatttcgga

SEQ ID NO: 9308664 - DNA, 22 bp, Homo sapiens
aggctccaggcaatgtttctga

SEQ ID NO: 9308665 - DNA, 22 bp, Homo sapiens
aggctccaggcccttcaccagc

SEQ ID NO: 9308666 - DNA, 22 bp, Homo sapiens
aggctccagggctgtgtgggag

SEQ ID NO: 9308667 - DNA, 22 bp, Homo sapiens
aggctccaggcctccctgcatg

SEQ ID NO: 9308668 - DNA, 22 bp, Homo sapiens
aggctccagcagccagaggaag

SEQ ID NO: 9308669 - DNA, 22 bp, Homo sapiens
aggctccagcagccagaggaag

SEQ ID NO: 9308670 - DNA, 22 bp, Homo sapiens
aggctccagccaatgggtctgt

SEQ ID NO: 9308671 - DNA, 22 bp, Homo sapiens
aggctccagcagccagaggaag

SEQ ID NO: 9308672 - DNA, 23 bp, Homo sapiens
aggctccactccctgggatgtgg

SEQ ID NO: 9308673 - DNA, 22 bp, Homo sapiens
aggctccacggtcactggctct

SEQ ID NO: 9308674 - DNA, 22 bp, Homo sapiens
aggcatggctttaggcaggcgt

SEQ ID NO: 9308675 - DNA, 22 bp, Homo sapiens
aggcatggctttaggcaggcgt

SEQ ID NO: 9308676 - DNA, 22 bp, Homo sapiens
aggcatggctttaggcaggcgt

SEQ ID NO: 9308677 - DNA, 19 bp, Homo sapiens
aggcatgggaagagaagtc

SEQ ID NO: 9308678 - DNA, 19 bp, Homo sapiens
aggcatgggaagagaagtc

SEQ ID NO: 9308679 - DNA, 19 bp, Homo sapiens
aggcatgggaagagaagtc

SEQ ID NO: 9308680 - DNA, 22 bp, Homo sapiens
aggcatggggctgcagtcaggt

SEQ ID NO: 9308681 - DNA, 22 bp, Homo sapiens
aggcatggggctgcagtcaggt

SEQ ID NO: 9308682 - DNA, 22 bp, Homo sapiens
aggcatggggctgcagtcaggt

SEQ ID NO: 9308683 - DNA, 18 bp, Homo sapiens
aggcatggtggtgcgcac

SEQ ID NO: 9308684 - DNA, 17 bp, Homo sapiens
aggcatggtctggggtg

SEQ ID NO: 9308685 - DNA, 22 bp, Homo sapiens
aggcatgggtagaagagaagcc

SEQ ID NO: 9308686 - DNA, 17 bp, Homo sapiens
aggcatggtctggggtg

SEQ ID NO: 9308687 - DNA, 22 bp, Homo sapiens
aggcatgggtagaagagaagcc

SEQ ID NO: 9308688 - DNA, 22 bp, Homo sapiens
aggcatgggtagaagagaagcc

SEQ ID NO: 9308689 - DNA, 22 bp, Homo sapiens
aggccacacaactcttagagat

SEQ ID NO: 9308690 - DNA, 18 bp, Homo sapiens
aggcatggtggtgcgcac

SEQ ID NO: 9308691 - DNA, 22 bp, Homo sapiens
aggccacagatactgtgaagta

SEQ ID NO: 9308692 - DNA, 22 bp, Homo sapiens
aggccacagcctgggaggtgac

SEQ ID NO: 9308693 - DNA, 22 bp, Homo sapiens
aggccacaggagtactgtcggt

SEQ ID NO: 9308694 - DNA, 22 bp, Homo sapiens
aggccacaggtggaagccagag

SEQ ID NO: 9308695 - DNA, 22 bp, Homo sapiens
aggccacaggattgcacagcat

SEQ ID NO: 9308696 - DNA, 22 bp, Homo sapiens
aggcccagcttgaagtgggaag

SEQ ID NO: 9308697 - DNA, 22 bp, Homo sapiens
acatgaaacctgagtctaactc

SEQ ID NO: 9308698 - DNA, 22 bp, Homo sapiens
acatgaaactgttgcattagaa

SEQ ID NO: 9308699 - DNA, 22 bp, Homo sapiens
acatgaaacccagccgtggtcc

SEQ ID NO: 9308700 - DNA, 20 bp, Homo sapiens
acatgaaaggaaacaggaaa

SEQ ID NO: 9308701 - DNA, 22 bp, Homo sapiens
aggcccagggctgctctctgaa

SEQ ID NO: 9308702 - DNA, 22 bp, Homo sapiens
acatgaaaactggttccttcag

SEQ ID NO: 9308703 - DNA, 22 bp, Homo sapiens
acatgaaaaatgtttgcagttt

SEQ ID NO: 9308704 - DNA, 22 bp, Homo sapiens
acatcttttttctctaattgtg

SEQ ID NO: 9308705 - DNA, 22 bp, Homo sapiens
acatgaaaagactatctgatta

SEQ ID NO: 9308706 - DNA, 22 bp, Homo sapiens
acatctttgctcttatagagct

SEQ ID NO: 9308707 - DNA, 22 bp, Homo sapiens
acatctttgtttcttagtgtat

SEQ ID NO: 9308708 - DNA, 22 bp, Homo sapiens
aggccagcattctctctccagg

SEQ ID NO: 9308709 - DNA, 22 bp, Homo sapiens
aggaggctgtggagcactccat

SEQ ID NO: 9308710 - DNA, 21 bp, Homo sapiens
aggagctggagaaaactttcc

SEQ ID NO: 9308711 - DNA, 22 bp, Homo sapiens
aggaggctgtggagcactccat

SEQ ID NO: 9308712 - DNA, 22 bp, Homo sapiens
aggaggcttttgcaggtgccac

SEQ ID NO: 9308713 - DNA, 22 bp, Homo sapiens
aggagggagatgcccatcctgg

SEQ ID NO: 9308714 - DNA, 20 bp, Homo sapiens
aggagggacctggattggcg

SEQ ID NO: 9308715 - DNA, 22 bp, Homo sapiens
aggatggcgattcgagcacctc

SEQ ID NO: 9308716 - DNA, 22 bp, Homo sapiens
aggcaaagaagttggtcaggag

SEQ ID NO: 9308717 - DNA, 22 bp, Homo sapiens
aggcaaaataagcctctcctgt

SEQ ID NO: 9308718 - DNA, 22 bp, Homo sapiens
aggcaaatctgagacatttaaa

SEQ ID NO: 9308719 - DNA, 22 bp, Homo sapiens
aggcaaatctgagacatttaaa

SEQ ID NO: 9308720 - DNA, 22 bp, Homo sapiens
aggcaaatgatcctgctccttg

SEQ ID NO: 9308721 - DNA, 22 bp, Homo sapiens
aggcaaagcgataccagagcta

SEQ ID NO: 9308722 - DNA, 22 bp, Homo sapiens
aggcaaatccagatttttccac

SEQ ID NO: 9308723 - DNA, 22 bp, Homo sapiens
aggcaaagaagttggtcaggag

SEQ ID NO: 9308724 - DNA, 22 bp, Homo sapiens
aggcaaagcgataccagagcta

SEQ ID NO: 9308725 - DNA, 22 bp, Homo sapiens
aggagggtcatgttgaagtgta

SEQ ID NO: 9308726 - DNA, 22 bp, Homo sapiens
aggagggtacaatgggtggaaa

SEQ ID NO: 9308727 - DNA, 22 bp, Homo sapiens
aggagggtacaatgggtggaaa

SEQ ID NO: 9308728 - DNA, 22 bp, Homo sapiens
aggaggggttctcgggtgctga

SEQ ID NO: 9308729 - DNA, 22 bp, Homo sapiens
aggcacagagaatgccctccat

SEQ ID NO: 9308730 - DNA, 22 bp, Homo sapiens
aggcacagaatggcattcagtg

SEQ ID NO: 9308731 - DNA, 19 bp, Homo sapiens
aggcacaattctgagaagc

SEQ ID NO: 9308732 - DNA, 22 bp, Homo sapiens
aggcaacatgggccaggcagaa

SEQ ID NO: 9308733 - DNA, 22 bp, Homo sapiens
aggcacaaagacagaaaagcac

SEQ ID NO: 9308734 - DNA, 22 bp, Homo sapiens
aggcaaattattgtatgcagtt

SEQ ID NO: 9308735 - DNA, 17 bp, Homo sapiens
acatacactggtgaaca

SEQ ID NO: 9308736 - DNA, 22 bp, Homo sapiens
acatacacgggaaacctctttt

SEQ ID NO: 9308737 - DNA, 23 bp, Homo sapiens
acatacataagcaccacattttg

SEQ ID NO: 9308738 - DNA, 22 bp, Homo sapiens
acatacacacatactttctcct

SEQ ID NO: 9308739 - DNA, 23 bp, Homo sapiens
acatacataagcaccacattttg

SEQ ID NO: 9308740 - DNA, 22 bp, Homo sapiens
aggagctgcagattctgccttg

SEQ ID NO: 9308741 - DNA, 22 bp, Homo sapiens
aggagctgcatggatacctggt

SEQ ID NO: 9308742 - DNA, 22 bp, Homo sapiens
aggagctgcaaatattagtaat

SEQ ID NO: 9308743 - DNA, 22 bp, Homo sapiens
aggagctgcactgggagttttt

SEQ ID NO: 9308744 - DNA, 22 bp, Homo sapiens
aggagctgctttggtgcggttt

SEQ ID NO: 9308745 - DNA, 22 bp, Homo sapiens
aggagctggaatggtccttttg

SEQ ID NO: 9308746 - DNA, 22 bp, Homo sapiens
aggagctgcttaaatggttggt

SEQ ID NO: 9308747 - DNA, 23 bp, Homo sapiens
aggagcccaaggagaggtaactt

SEQ ID NO: 9308748 - DNA, 23 bp, Homo sapiens
aggagcccctaattctgggcagc

SEQ ID NO: 9308749 - DNA, 22 bp, Homo sapiens
aggagccctccgttgcttcatc

SEQ ID NO: 9308750 - DNA, 22 bp, Homo sapiens
aggagctgcaaaaccggccgct

SEQ ID NO: 9308751 - DNA, 22 bp, Homo sapiens
aggagcctgagtcacagtgcct

SEQ ID NO: 9308752 - DNA, 22 bp, Homo sapiens
aggagctgatgattctttgatc

SEQ ID NO: 9308753 - DNA, 22 bp, Homo sapiens
aggagcctgaatcagagggtga

SEQ ID NO: 9308754 - DNA, 22 bp, Homo sapiens
aggagccatgagtgacatcaca

SEQ ID NO: 9308755 - DNA, 22 bp, Homo sapiens
aggagcagaccgtagtcctgca

SEQ ID NO: 9308756 - DNA, 22 bp, Homo sapiens
aggagccattttccaagggcga

SEQ ID NO: 9308757 - DNA, 22 bp, Homo sapiens
aggagccattttccaagggcga

SEQ ID NO: 9308758 - DNA, 22 bp, Homo sapiens
acagggtgactttgtgacagat

SEQ ID NO: 9308759 - DNA, 22 bp, Homo sapiens
acagggtggggatggtgagctt

SEQ ID NO: 9308760 - DNA, 22 bp, Homo sapiens
acaggggctccgaaggtgaggg

SEQ ID NO: 9308761 - DNA, 17 bp, Homo sapiens
aggaagggcaagtttct

SEQ ID NO: 9308762 - DNA, 22 bp, Homo sapiens
agctgcaggattatggaatgga

SEQ ID NO: 9308763 - DNA, 22 bp, Homo sapiens
agctgcagcttcctagtccagc

SEQ ID NO: 9308764 - DNA, 22 bp, Homo sapiens
agctgcagccgcagctgtggcc

SEQ ID NO: 9308765 - DNA, 22 bp, Homo sapiens
agctgcagccgcagctgtggcc

SEQ ID NO: 9308766 - DNA, 22 bp, Homo sapiens
acagccagtcatctcagcaggg

SEQ ID NO: 9308767 - DNA, 22 bp, Homo sapiens
agctccagtttcctgactgagc

SEQ ID NO: 9308768 - DNA, 22 bp, Homo sapiens
agctccagttacttacctagag

SEQ ID NO: 9308769 - DNA, 22 bp, Homo sapiens
agctcccagaagccagagtcgg

SEQ ID NO: 9308770 - DNA, 20 bp, Homo sapiens
agctccagtgctgacgcttc

SEQ ID NO: 9308771 - DNA, 22 bp, Homo sapiens
agctccaggtgcaagtcatggt

SEQ ID NO: 9308772 - DNA, 22 bp, Homo sapiens
agctccaggtgcaagtcatggt

SEQ ID NO: 9308773 - DNA, 23 bp, Homo sapiens
agctccaggtgattgtaatgtgt

SEQ ID NO: 9308774 - DNA, 23 bp, Homo sapiens
agctccaggtgattgtaatgtgt

SEQ ID NO: 9308775 - DNA, 20 bp, Homo sapiens
agctggcctgtcctaggcct

SEQ ID NO: 9308776 - DNA, 22 bp, Homo sapiens
acagcctgagagtggagctggc

SEQ ID NO: 9308777 - DNA, 22 bp, Homo sapiens
acagcctgatttatggagcagt

SEQ ID NO: 9308778 - DNA, 22 bp, Homo sapiens
acagcctgacttttgttgtcac

SEQ ID NO: 9308779 - DNA, 20 bp, Homo sapiens
agcttcagccctaggattgc

SEQ ID NO: 9308780 - DNA, 22 bp, Homo sapiens
agcttcagcttgcagctgtgat

SEQ ID NO: 9308781 - DNA, 20 bp, Homo sapiens
agcttcaggctcaagagaac

SEQ ID NO: 9308782 - DNA, 22 bp, Homo sapiens
agcttcagggacttgtggcaga

SEQ ID NO: 9308783 - DNA, 22 bp, Homo sapiens
agcttcaggaacaggcagcctg

SEQ ID NO: 9308784 - DNA, 22 bp, Homo sapiens
agcttcaggaacaggcagcctg

SEQ ID NO: 9308785 - DNA, 22 bp, Homo sapiens
agcttcagatttatctttctgt

SEQ ID NO: 9308786 - DNA, 22 bp, Homo sapiens
agctgtggccagatgtgagcgg

SEQ ID NO: 9308787 - DNA, 22 bp, Homo sapiens
agctgggatgataacctcagtc

SEQ ID NO: 9308788 - DNA, 22 bp, Homo sapiens
agctgggaggtgggcagtgaga

SEQ ID NO: 9308789 - DNA, 22 bp, Homo sapiens
agctgggagctgaaggctgatt

SEQ ID NO: 9308790 - DNA, 22 bp, Homo sapiens
agctgggagctgaaggctgatt

SEQ ID NO: 9308791 - DNA, 22 bp, Homo sapiens
agctttatggtgcctcacttga

SEQ ID NO: 9308792 - DNA, 22 bp, Homo sapiens
agcttcatggaacctgaggcta

SEQ ID NO: 9308793 - DNA, 22 bp, Homo sapiens
agcttcaggtggtcttgtttct

SEQ ID NO: 9308794 - DNA, 22 bp, Homo sapiens
agcttcagtgtcaggcccgtgg

SEQ ID NO: 9308795 - DNA, 22 bp, Homo sapiens
agcttcagttttctattgttaa

SEQ ID NO: 9308796 - DNA, 17 bp, Homo sapiens
agcttcagttgcaaaac

SEQ ID NO: 9308797 - DNA, 23 bp, Homo sapiens
agcttttaggtggaaatggcact

SEQ ID NO: 9308798 - DNA, 19 bp, Homo sapiens
agcttttactaacagcaga

SEQ ID NO: 9308799 - DNA, 22 bp, Homo sapiens
aggaaaaaagtctgtgattata

SEQ ID NO: 9308800 - DNA, 22 bp, Homo sapiens
agcttttagtacgttaaaattg

SEQ ID NO: 9308801 - DNA, 22 bp, Homo sapiens
agctttttcactttggatggga

SEQ ID NO: 9308802 - DNA, 22 bp, Homo sapiens
aggaaactaacttatctttata

SEQ ID NO: 9308803 - DNA, 22 bp, Homo sapiens
aggaaactaacttatctttata

SEQ ID NO: 9308804 - DNA, 22 bp, Homo sapiens
aggaaaaagagttgctgccttc

SEQ ID NO: 9308805 - DNA, 19 bp, Homo sapiens
aggaaactgtcttttccag

SEQ ID NO: 9308806 - DNA, 22 bp, Homo sapiens
aggaaactgtcccctcatccta

SEQ ID NO: 9308807 - DNA, 22 bp, Homo sapiens
aggaaacttcagagttttggtc

SEQ ID NO: 9308808 - DNA, 22 bp, Homo sapiens
aggaaactttcttttgcttcat

SEQ ID NO: 9308809 - DNA, 22 bp, Homo sapiens
aggaaactttcttttgcttcat

SEQ ID NO: 9308810 - DNA, 22 bp, Homo sapiens
aggaaactgatgttttttacaa

SEQ ID NO: 9308811 - DNA, 22 bp, Homo sapiens
aggaaactgatgttttttacaa

SEQ ID NO: 9308812 - DNA, 22 bp, Homo sapiens
aggaaactgggcctcaggttag

SEQ ID NO: 9308813 - DNA, 22 bp, Homo sapiens
aggaaactgggcctcaggttag

SEQ ID NO: 9308814 - DNA, 22 bp, Homo sapiens
aggaaactgggtatggttatac

SEQ ID NO: 9308815 - DNA, 22 bp, Homo sapiens
aggaaactgggtatggttatac

SEQ ID NO: 9308816 - DNA, 22 bp, Homo sapiens
aggaagccaggcccttgggtgg

SEQ ID NO: 9308817 - DNA, 22 bp, Homo sapiens
aggaagccaagcctgacactca

SEQ ID NO: 9308818 - DNA, 19 bp, Homo sapiens
agctggggcggtgtgtgtt

SEQ ID NO: 9308819 - DNA, 22 bp, Homo sapiens
agctgggtggtgctgagccttg

SEQ ID NO: 9308820 - DNA, 20 bp, Homo sapiens
caggcagaggatgctgacca

SEQ ID NO: 9308821 - DNA, 22 bp, Homo sapiens
caggcagaggaggccttctcct

SEQ ID NO: 9308822 - DNA, 22 bp, Homo sapiens
caggcagaggaagtctgggtct

SEQ ID NO: 9308823 - DNA, 22 bp, Homo sapiens
caggcagagtcagattagactt

SEQ ID NO: 9308824 - DNA, 22 bp, Homo sapiens
caggcagagtgagaagcccttg

SEQ ID NO: 9308825 - DNA, 22 bp, Homo sapiens
caggcagaggcttttcatggct

SEQ ID NO: 9308826 - DNA, 22 bp, Homo sapiens
caggcagaggtaccaagattga

SEQ ID NO: 9308827 - DNA, 18 bp, Homo sapiens
agctgccctgggctggag

SEQ ID NO: 9308828 - DNA, 22 bp, Homo sapiens
agctgccccgaggcggcgggaa

SEQ ID NO: 9308829 - DNA, 22 bp, Homo sapiens
agctgccctgtggggagggttg

SEQ ID NO: 9308830 - DNA, 22 bp, Homo sapiens
agctgccctttatgatgctgaa

SEQ ID NO: 9308831 - DNA, 22 bp, Homo sapiens
agctgccctcgctggggccaga

SEQ ID NO: 9308832 - DNA, 22 bp, Homo sapiens
caggaaaaggagactttagcac

SEQ ID NO: 9308833 - DNA, 17 bp, Homo sapiens
caggaaaatatgagtga

SEQ ID NO: 9308834 - DNA, 22 bp, Homo sapiens
agctgaaattttactgagtata

SEQ ID NO: 9308835 - DNA, 22 bp, Homo sapiens
caggaactcaaggtttgtaaca

SEQ ID NO: 9308836 - DNA, 22 bp, Homo sapiens
caggaacccccactctcagctc

SEQ ID NO: 9308837 - DNA, 22 bp, Homo sapiens
caggaaccaggagagtccctga

SEQ ID NO: 9308838 - DNA, 22 bp, Homo sapiens
agctttatttgtcattcacggc

SEQ ID NO: 9308839 - DNA, 22 bp, Homo sapiens
agctttattaactctccaggtg

SEQ ID NO: 9308840 - DNA, 22 bp, Homo sapiens
agctttattaactctccaggtg

SEQ ID NO: 9308841 - DNA, 22 bp, Homo sapiens
agctttattcatgatttcaggg

SEQ ID NO: 9308842 - DNA, 22 bp, Homo sapiens
agctttatatgttgtttctcca

SEQ ID NO: 9308843 - DNA, 22 bp, Homo sapiens
caggcttcagggaacgcagtct

SEQ ID NO: 9308844 - DNA, 22 bp, Homo sapiens
caggcttcagggaacgcagtct

SEQ ID NO: 9308845 - DNA, 22 bp, Homo sapiens
caggcttcgctctgtgggcagg

SEQ ID NO: 9308846 - DNA, 22 bp, Homo sapiens
caggcttccgccaggtttccag

SEQ ID NO: 9308847 - DNA, 22 bp, Homo sapiens
caggctggagttacctttaggg

SEQ ID NO: 9308848 - DNA, 21 bp, Homo sapiens
aggaaaattgagggttgttgt

SEQ ID NO: 9308849 - DNA, 22 bp, Homo sapiens
aggaaaattatcatgagagcca

SEQ ID NO: 9308850 - DNA, 22 bp, Homo sapiens
aggaaaatggaccagagttgtt

SEQ ID NO: 9308851 - DNA, 22 bp, Homo sapiens
aggaaaatcaatgtctttttaa

SEQ ID NO: 9308852 - DNA, 22 bp, Homo sapiens
aggaaaagtgtgaagtatggag

SEQ ID NO: 9308853 - DNA, 22 bp, Homo sapiens
aggaaaatgaaacagcaactgt

SEQ ID NO: 9308854 - DNA, 22 bp, Homo sapiens
aggaaaatgatattctgctgtt

SEQ ID NO: 9308855 - DNA, 22 bp, Homo sapiens
aggaaaatcgagtctggaggca

SEQ ID NO: 9308856 - DNA, 22 bp, Homo sapiens
aggaaaagtgtgaagtatggag

SEQ ID NO: 9308857 - DNA, 20 bp, Homo sapiens
aggaaaagggtggtggtaga

SEQ ID NO: 9308858 - DNA, 22 bp, Homo sapiens
aggaaaacacagtattgatgga

SEQ ID NO: 9308859 - DNA, 20 bp, Homo sapiens
aggaaaaatggaaactggag

SEQ ID NO: 9308860 - DNA, 22 bp, Homo sapiens
cagggacccgcacaggtagcat

SEQ ID NO: 9308861 - DNA, 22 bp, Homo sapiens
cagggacatttccaagagaatt

SEQ ID NO: 9308862 - DNA, 22 bp, Homo sapiens
cagggacattggtggccaggtt

SEQ ID NO: 9308863 - DNA, 22 bp, Homo sapiens
aggaaacatgaatctgccttga

SEQ ID NO: 9308864 - DNA, 22 bp, Homo sapiens
aggaaacatccttatctattct

SEQ ID NO: 9308865 - DNA, 22 bp, Homo sapiens
aggaaacaggcagcctttgaac

SEQ ID NO: 9308866 - DNA, 22 bp, Homo sapiens
cagggtgctgcaccatccctca

SEQ ID NO: 9308867 - DNA, 22 bp, Homo sapiens
cagggttgggctccaaggatgg

SEQ ID NO: 9308868 - DNA, 22 bp, Homo sapiens
cagggttggggtagataagaaa

SEQ ID NO: 9308869 - DNA, 22 bp, Homo sapiens
aggaagatgggagagctctgga

SEQ ID NO: 9308870 - DNA, 20 bp, Homo sapiens
aggaagatcctttcttttaa

SEQ ID NO: 9308871 - DNA, 22 bp, Homo sapiens
caggtcccgttccccagagatt

SEQ ID NO: 9308872 - DNA, 22 bp, Homo sapiens
caggtcctcgggggaggccggc

SEQ ID NO: 9308873 - DNA, 22 bp, Homo sapiens
caggtcctgccttggttaccct

SEQ ID NO: 9308874 - DNA, 22 bp, Homo sapiens
caggtcctgcagggagagtaaa

SEQ ID NO: 9308875 - DNA, 22 bp, Homo sapiens
caggtcctggcatcaggcaggt

SEQ ID NO: 9308876 - DNA, 22 bp, Homo sapiens
aggaatgtcgtcataaacatga

SEQ ID NO: 9308877 - DNA, 21 bp, Homo sapiens
aggaatgtgtatatatacaat

SEQ ID NO: 9308878 - DNA, 22 bp, Homo sapiens
caggtccagtaaaaagagtcct

SEQ ID NO: 9308879 - DNA, 22 bp, Homo sapiens
caggtccagtcactggtctgca

SEQ ID NO: 9308880 - DNA, 22 bp, Homo sapiens
aggaagggttctttctgtttat

SEQ ID NO: 9308881 - DNA, 22 bp, Homo sapiens
aggaagggttctttctgtttat

SEQ ID NO: 9308882 - DNA, 22 bp, Homo sapiens
aggcactgaaaggtggccagag

SEQ ID NO: 9308883 - DNA, 22 bp, Homo sapiens
aggcactttaggatcaggttga

SEQ ID NO: 9308884 - DNA, 22 bp, Homo sapiens
catgtgtgacaaactgcctgca

SEQ ID NO: 9308885 - DNA, 22 bp, Homo sapiens
aggcacagggatgcggagccag

SEQ ID NO: 9308886 - DNA, 22 bp, Homo sapiens
aggatataaaaagactatttgg

SEQ ID NO: 9308887 - DNA, 22 bp, Homo sapiens
aggatctgtgagtgctgcagac

SEQ ID NO: 9308888 - DNA, 22 bp, Homo sapiens
aggatcatgaagtataaatagg

SEQ ID NO: 9308889 - DNA, 21 bp, Homo sapiens
aggagttgagtgcacagttgg

SEQ ID NO: 9308890 - DNA, 22 bp, Homo sapiens
aggagttgattacgtttatttt

SEQ ID NO: 9308891 - DNA, 22 bp, Homo sapiens
aggagttgtatgtccaagggac

SEQ ID NO: 9308892 - DNA, 22 bp, Homo sapiens
aggataataataatctcgttta

SEQ ID NO: 9308893 - DNA, 22 bp, Homo sapiens
aggataaaggtcattattccca

SEQ ID NO: 9308894 - DNA, 23 bp, Homo sapiens
aggataaactaaactcattttgg

SEQ ID NO: 9308895 - DNA, 22 bp, Homo sapiens
aggataaatgatctagattttc

SEQ ID NO: 9308896 - DNA, 22 bp, Homo sapiens
aggcagcttaagccctggccca

SEQ ID NO: 9308897 - DNA, 22 bp, Homo sapiens
aggcagctggcaaattctagag

SEQ ID NO: 9308898 - DNA, 22 bp, Homo sapiens
aggcagcgtagcaaggctagta

SEQ ID NO: 9308899 - DNA, 20 bp, Homo sapiens
aggcagagcgcacttttaga

SEQ ID NO: 9308900 - DNA, 22 bp, Homo sapiens
aggcagagctgatgttctgtga

SEQ ID NO: 9308901 - DNA, 22 bp, Homo sapiens
aggcagaggagaatgatcttcc

SEQ ID NO: 9308902 - DNA, 22 bp, Homo sapiens
aggcaggcctacacaatgggag

SEQ ID NO: 9308903 - DNA, 22 bp, Homo sapiens
aggcaggccctgggccatcccg

SEQ ID NO: 9308904 - DNA, 22 bp, Homo sapiens
aggcaggccgtgtccctcctca

SEQ ID NO: 9308905 - DNA, 22 bp, Homo sapiens
aggcaggccctgggccatcccg

SEQ ID NO: 9308906 - DNA, 22 bp, Homo sapiens
aggcaggccctctggaaaggta

SEQ ID NO: 9308907 - DNA, 22 bp, Homo sapiens
aggcaggccctctggaaaggta

SEQ ID NO: 9308908 - DNA, 22 bp, Homo sapiens
aggcaggctcaggcccatgctt

SEQ ID NO: 9308909 - DNA, 22 bp, Homo sapiens
aggcaggctagtcgcttgagcc

SEQ ID NO: 9308910 - DNA, 22 bp, Homo sapiens
aggcaggctgctatggagtaga

SEQ ID NO: 9308911 - DNA, 22 bp, Homo sapiens
aggcaggctctgggtatgtgca

SEQ ID NO: 9308912 - DNA, 22 bp, Homo sapiens
aggcaggctctgggtatgtgca

SEQ ID NO: 9308913 - DNA, 23 bp, Homo sapiens
aggcaggcagttcagctgttgtt

SEQ ID NO: 9308914 - DNA, 22 bp, Homo sapiens
aggcaggcccctgagaatagac

SEQ ID NO: 9308915 - DNA, 22 bp, Homo sapiens
ccaaagagagacctttcttctc

SEQ ID NO: 9308916 - DNA, 22 bp, Homo sapiens
aggagctgggagaaggactaaa

SEQ ID NO: 9308917 - DNA, 22 bp, Homo sapiens
aggagctgggcccaaggatgct

SEQ ID NO: 9308918 - DNA, 22 bp, Homo sapiens
aggagctgggctgctgctggga

SEQ ID NO: 9308919 - DNA, 22 bp, Homo sapiens
aggagctgatagtctatggaga

SEQ ID NO: 9308920 - DNA, 22 bp, Homo sapiens
aggagctggccactaggatgca

SEQ ID NO: 9308921 - DNA, 22 bp, Homo sapiens
aggagctggccactaggatgca

SEQ ID NO: 9308922 - DNA, 22 bp, Homo sapiens
aggagctggcctagaaaggaga

SEQ ID NO: 9308923 - DNA, 22 bp, Homo sapiens
aggagccaagcagaactaagga

SEQ ID NO: 9308924 - DNA, 22 bp, Homo sapiens
aggagcagattggtaagatcat

SEQ ID NO: 9308925 - DNA, 22 bp, Homo sapiens
aggagcagcccactcctgtcct

SEQ ID NO: 9308926 - DNA, 22 bp, Homo sapiens
aggagcagcttctgaaccatgt

SEQ ID NO: 9308927 - DNA, 22 bp, Homo sapiens
cagtgagggaagatctcagcac

SEQ ID NO: 9308928 - DNA, 22 bp, Homo sapiens
cagtgagggcattcagtgctgg

SEQ ID NO: 9308929 - DNA, 22 bp, Homo sapiens
cagtgaggctctgctgagcggt

SEQ ID NO: 9308930 - DNA, 22 bp, Homo sapiens
cagtgaggctctgctgagcggt

SEQ ID NO: 9308931 - DNA, 17 bp, Homo sapiens
cagtgaggcctttcctc

SEQ ID NO: 9308932 - DNA, 21 bp, Homo sapiens
cagtgaggccctcctgttccc

SEQ ID NO: 9308933 - DNA, 22 bp, Homo sapiens
aggacaaaggaccagatctgga

SEQ ID NO: 9308934 - DNA, 20 bp, Homo sapiens
cagtgaggaggtgctggggg

SEQ ID NO: 9308935 - DNA, 22 bp, Homo sapiens
cagtgaggagtccagggcagag

SEQ ID NO: 9308936 - DNA, 18 bp, Homo sapiens
cagtgaggatgaagggtt

SEQ ID NO: 9308937 - DNA, 18 bp, Homo sapiens
cagtgaggatgaagggtt

SEQ ID NO: 9308938 - DNA, 22 bp, Homo sapiens
aggaatttggggttacatgatg

SEQ ID NO: 9308939 - DNA, 23 bp, Homo sapiens
cagttcccactgtctgtcacaag

SEQ ID NO: 9308940 - DNA, 22 bp, Homo sapiens
aggaggctgggcacagtggcct

SEQ ID NO: 9308941 - DNA, 22 bp, Homo sapiens
aggaggctgggcacagtggcct

SEQ ID NO: 9308942 - DNA, 22 bp, Homo sapiens
aggaggctgcaaccctgaggcc

SEQ ID NO: 9308943 - DNA, 23 bp, Homo sapiens
catcagaggttgccactccctgg

SEQ ID NO: 9308944 - DNA, 22 bp, Homo sapiens
aggaggctgcaaccctgaggcc

SEQ ID NO: 9308945 - DNA, 22 bp, Homo sapiens
catcactgtcaccatctttcct

SEQ ID NO: 9308946 - DNA, 22 bp, Homo sapiens
catcactgaaccccaactttct

SEQ ID NO: 9308947 - DNA, 22 bp, Homo sapiens
aggaggtgttgatagaaggttt

SEQ ID NO: 9308948 - DNA, 22 bp, Homo sapiens
aggaggtgttgatagaaggttt

SEQ ID NO: 9308949 - DNA, 22 bp, Homo sapiens
catcatgtctgcaggaatgtgt

SEQ ID NO: 9308950 - DNA, 22 bp, Homo sapiens
catcatttgttcacttgattcc

SEQ ID NO: 9308951 - DNA, 22 bp, Homo sapiens
aggaggctggttcaggccatat

SEQ ID NO: 9308952 - DNA, 22 bp, Homo sapiens
aggaggctggttcaggccatat

SEQ ID NO: 9308953 - DNA, 22 bp, Homo sapiens
aggagggtggggtctgcctgtc

SEQ ID NO: 9308954 - DNA, 22 bp, Homo sapiens
aggagggttctctggacagagg

SEQ ID NO: 9308955 - DNA, 22 bp, Homo sapiens
aggaggtgagcggtcatgtggt

SEQ ID NO: 9308956 - DNA, 22 bp, Homo sapiens
aggagggtttcaatgggatgag

SEQ ID NO: 9308957 - DNA, 20 bp, Homo sapiens
aggaggtcaaatggaatctg

SEQ ID NO: 9308958 - DNA, 22 bp, Homo sapiens
aggagggttctctggacagagg

SEQ ID NO: 9308959 - DNA, 22 bp, Homo sapiens
ccctgcacagcctggctctctt

SEQ ID NO: 9308960 - DNA, 18 bp, Homo sapiens
ccctgccagctcccagca

SEQ ID NO: 9308961 - DNA, 22 bp, Homo sapiens
ccctgccaatcccgtctctctg

SEQ ID NO: 9308962 - DNA, 22 bp, Homo sapiens
ccctccattaaaacagacctat

SEQ ID NO: 9308963 - DNA, 20 bp, Homo sapiens
ccctcccagatgcttcccaa

SEQ ID NO: 9308964 - DNA, 22 bp, Homo sapiens
ccctccatgagtgtgctgctgg

SEQ ID NO: 9308965 - DNA, 22 bp, Homo sapiens
ccctccatgacgtcttcagccg

SEQ ID NO: 9308966 - DNA, 22 bp, Homo sapiens
ccctgctgtcaggtgctgggag

SEQ ID NO: 9308967 - DNA, 22 bp, Homo sapiens
ccctgctgtccctcagtcctgc

SEQ ID NO: 9308968 - DNA, 22 bp, Homo sapiens
ccctgctgtccctcagtcctgc

SEQ ID NO: 9308969 - DNA, 22 bp, Homo sapiens
ccctgctgtgtagcggaggaac

SEQ ID NO: 9308970 - DNA, 22 bp, Homo sapiens
ccctgccagggtcctgacagac

SEQ ID NO: 9308971 - DNA, 22 bp, Homo sapiens
ccctgccccaggcggcttcact

SEQ ID NO: 9308972 - DNA, 21 bp, Homo sapiens
ccctgccctcaaggacagtgc

SEQ ID NO: 9308973 - DNA, 23 bp, Homo sapiens
ccctgcccattgagcaggacgtc

SEQ ID NO: 9308974 - DNA, 22 bp, Homo sapiens
ccccacttgctcagcatgtcca

SEQ ID NO: 9308975 - DNA, 22 bp, Homo sapiens
ccccactttgagtagcacttga

SEQ ID NO: 9308976 - DNA, 22 bp, Homo sapiens
ccctagggtttggccagagccc

SEQ ID NO: 9308977 - DNA, 22 bp, Homo sapiens
ccctcacttcacgctctgcaga

SEQ ID NO: 9308978 - DNA, 22 bp, Homo sapiens
ccctcaccaggctccaggcatg

SEQ ID NO: 9308979 - DNA, 22 bp, Homo sapiens
ccctcaccaggctccaggcatg

SEQ ID NO: 9308980 - DNA, 22 bp, Homo sapiens
aggctggtgcttcctagggcag

SEQ ID NO: 9308981 - DNA, 22 bp, Homo sapiens
aggctggtgattagaagcagcc

SEQ ID NO: 9308982 - DNA, 22 bp, Homo sapiens
aggctggtcccagggagggaat

SEQ ID NO: 9308983 - DNA, 22 bp, Homo sapiens
aggctggtctatacggagacga

SEQ ID NO: 9308984 - DNA, 21 bp, Homo sapiens
aggctgtcctttgccagccct

SEQ ID NO: 9308985 - DNA, 20 bp, Homo sapiens
aggctgtcatttctggcagg

SEQ ID NO: 9308986 - DNA, 22 bp, Homo sapiens
aggctgtctcacctcaggaggg

SEQ ID NO: 9308987 - DNA, 21 bp, Homo sapiens
aggctgtcctttgccagccct

SEQ ID NO: 9308988 - DNA, 22 bp, Homo sapiens
aggctgtctgaccccagagccc

SEQ ID NO: 9308989 - DNA, 22 bp, Homo sapiens
aggctgtctcagcctgcttgca

SEQ ID NO: 9308990 - DNA, 22 bp, Homo sapiens
aggctgtcttcctccctcttgg

SEQ ID NO: 9308991 - DNA, 22 bp, Homo sapiens
cccaggaggtagaggttgcagt

SEQ ID NO: 9308992 - DNA, 22 bp, Homo sapiens
cccaggagatggaggttgcagt

SEQ ID NO: 9308993 - DNA, 22 bp, Homo sapiens
cccaggaatgaggggcggaggc

SEQ ID NO: 9308994 - DNA, 22 bp, Homo sapiens
cccaggaggtcgaagctgcagt

SEQ ID NO: 9308995 - DNA, 22 bp, Homo sapiens
cccaggaggtcgaagctgcagt

SEQ ID NO: 9308996 - DNA, 22 bp, Homo sapiens
cccaggaggtcaaggctgcagt

SEQ ID NO: 9308997 - DNA, 22 bp, Homo sapiens
cccaggctgatgttcagcgggt

SEQ ID NO: 9308998 - DNA, 22 bp, Homo sapiens
cccaggctgatgggatgggcca

SEQ ID NO: 9308999 - DNA, 22 bp, Homo sapiens
cccaggctgatgggatgggcca

SEQ ID NO: 9309000 - DNA, 22 bp, Homo sapiens
cccaggctgcgtatccacaata

SEQ ID NO: 9309001 - DNA, 22 bp, Homo sapiens
cccaggctgcgtatccacaata

SEQ ID NO: 9309002 - DNA, 18 bp, Homo sapiens
cccaggctttgtgggtct

SEQ ID NO: 9309003 - DNA, 22 bp, Homo sapiens
cccaggcttttaagttagacag

SEQ ID NO: 9309004 - DNA, 22 bp, Homo sapiens
cccaggcttttctcttgcccca

SEQ ID NO: 9309005 - DNA, 22 bp, Homo sapiens
cccagtttcaactttccagtgg

SEQ ID NO: 9309006 - DNA, 22 bp, Homo sapiens
agggctggagccacagctggga

SEQ ID NO: 9309007 - DNA, 22 bp, Homo sapiens
agggctggcaagggattgaaat

SEQ ID NO: 9309008 - DNA, 22 bp, Homo sapiens
agggctggagccacagctggga

SEQ ID NO: 9309009 - DNA, 20 bp, Homo sapiens
cctcaggatgagggtgagca

SEQ ID NO: 9309010 - DNA, 22 bp, Homo sapiens
cctcaggatccgcaggtgcagt

SEQ ID NO: 9309011 - DNA, 22 bp, Homo sapiens
agggcgaggagacggaggcaca

SEQ ID NO: 9309012 - DNA, 22 bp, Homo sapiens
agggcctggaactggagaccac

SEQ ID NO: 9309013 - DNA, 22 bp, Homo sapiens
agggcctgctctatcactctca

SEQ ID NO: 9309014 - DNA, 20 bp, Homo sapiens
agggcctgctctgtggtgtc

SEQ ID NO: 9309015 - DNA, 20 bp, Homo sapiens
cctcagagcgcaggccccct

SEQ ID NO: 9309016 - DNA, 22 bp, Homo sapiens
cctcagagcgcgtggcattatt

SEQ ID NO: 9309017 - DNA, 19 bp, Homo sapiens
cctcagagctagtgaacat

SEQ ID NO: 9309018 - DNA, 20 bp, Homo sapiens
agggcctggagtacagcagg

SEQ ID NO: 9309019 - DNA, 22 bp, Homo sapiens
agggcctggactaattggatcc

SEQ ID NO: 9309020 - DNA, 22 bp, Homo sapiens
agggcctgagctctcctccagt

SEQ ID NO: 9309021 - DNA, 22 bp, Homo sapiens
agggcctcagtgttctcatctg

SEQ ID NO: 9309022 - DNA, 22 bp, Homo sapiens
agggcctgagctggctgacctc

SEQ ID NO: 9309023 - DNA, 22 bp, Homo sapiens
agggcctgagctggctgacctc

SEQ ID NO: 9309024 - DNA, 19 bp, Homo sapiens
agggcctgcagctcaagct

SEQ ID NO: 9309025 - DNA, 22 bp, Homo sapiens
agggcctgcatcaggagcttgg

SEQ ID NO: 9309026 - DNA, 22 bp, Homo sapiens
agggtagggccgtagggccatg

SEQ ID NO: 9309027 - DNA, 22 bp, Homo sapiens
agggtaggtgtaagatagccct

SEQ ID NO: 9309028 - DNA, 22 bp, Homo sapiens
agggtatgttttaggctgagtt

SEQ ID NO: 9309029 - DNA, 22 bp, Homo sapiens
cctgagagtgagtgcctcctta

SEQ ID NO: 9309030 - DNA, 22 bp, Homo sapiens
cctgagagtaggtgtctcttta

SEQ ID NO: 9309031 - DNA, 22 bp, Homo sapiens
cctgagagtgagggcctcctta

SEQ ID NO: 9309032 - DNA, 22 bp, Homo sapiens
cctgagaggttggcctgtccag

SEQ ID NO: 9309033 - DNA, 22 bp, Homo sapiens
cctgagaggccctctcactgtc

SEQ ID NO: 9309034 - DNA, 22 bp, Homo sapiens
cctgagagcgagtggcctcatg

SEQ ID NO: 9309035 - DNA, 22 bp, Homo sapiens
cctgagagccagtgcctgccca

SEQ ID NO: 9309036 - DNA, 22 bp, Homo sapiens
cctcttccactgggccccatcc

SEQ ID NO: 9309037 - DNA, 22 bp, Homo sapiens
cctcttccactgggccccatcc

SEQ ID NO: 9309038 - DNA, 22 bp, Homo sapiens
aggggaggagcttttcttgcct

SEQ ID NO: 9309039 - DNA, 22 bp, Homo sapiens
aggcccagactcagcggggcgg

SEQ ID NO: 9309040 - DNA, 23 bp, Homo sapiens
aggcccaactctgtgagggctgc

SEQ ID NO: 9309041 - DNA, 22 bp, Homo sapiens
ccagcaggaaagtgacgtttga

SEQ ID NO: 9309042 - DNA, 22 bp, Homo sapiens
ccagcaggactttggaaatatg

SEQ ID NO: 9309043 - DNA, 22 bp, Homo sapiens
ccagcaggagactagcaacata

SEQ ID NO: 9309044 - DNA, 22 bp, Homo sapiens
ccagcaggaaagtgacgtttga

SEQ ID NO: 9309045 - DNA, 22 bp, Homo sapiens
aggccagtgccatcagggtttt

SEQ ID NO: 9309046 - DNA, 22 bp, Homo sapiens
aggccatcaaatcatgtagtgc

SEQ ID NO: 9309047 - DNA, 23 bp, Homo sapiens
ccagagctctttcatgcttccat

SEQ ID NO: 9309048 - DNA, 22 bp, Homo sapiens
aggccagaaatgtcagggagtg

SEQ ID NO: 9309049 - DNA, 22 bp, Homo sapiens
aggccacagtactttgcagacc

SEQ ID NO: 9309050 - DNA, 22 bp, Homo sapiens
aggccacagtcagtgggtgctg

SEQ ID NO: 9309051 - DNA, 21 bp, Homo sapiens
ccagactggcctatgtggtag

SEQ ID NO: 9309052 - DNA, 22 bp, Homo sapiens
ccagacctgcaaggctgagagg

SEQ ID NO: 9309053 - DNA, 22 bp, Homo sapiens
ccagctggcccagctgtgctcc

SEQ ID NO: 9309054 - DNA, 17 bp, Homo sapiens
aggcctctgccggtgcc

SEQ ID NO: 9309055 - DNA, 22 bp, Homo sapiens
aggcctgctgtcttgaggccaa

SEQ ID NO: 9309056 - DNA, 22 bp, Homo sapiens
ccagctggcactgtggctgccc

SEQ ID NO: 9309057 - DNA, 22 bp, Homo sapiens
ccagctggcaggagagtcaggg

SEQ ID NO: 9309058 - DNA, 22 bp, Homo sapiens
ccagctggagctcgcagatagg

SEQ ID NO: 9309059 - DNA, 22 bp, Homo sapiens
ccagctggaagagtgcagaact

SEQ ID NO: 9309060 - DNA, 22 bp, Homo sapiens
ccagctggaaacaaatagagtg

SEQ ID NO: 9309061 - DNA, 22 bp, Homo sapiens
ccagctggaacggcagcccagc

SEQ ID NO: 9309062 - DNA, 22 bp, Homo sapiens
ccagctcttttggctgagtgag

SEQ ID NO: 9309063 - DNA, 22 bp, Homo sapiens
ccagctctgcttgcccagtcag

SEQ ID NO: 9309064 - DNA, 22 bp, Homo sapiens
ccagctctggcttcttgctggg

SEQ ID NO: 9309065 - DNA, 22 bp, Homo sapiens
ccagctctggcttcttgctggg

SEQ ID NO: 9309066 - DNA, 22 bp, Homo sapiens
ccagctcttggtgcacttacat

SEQ ID NO: 9309067 - DNA, 22 bp, Homo sapiens
ccagctccggtgtgcttatttc

SEQ ID NO: 9309068 - DNA, 22 bp, Homo sapiens
ccagcaggcagtcatatccttt

SEQ ID NO: 9309069 - DNA, 22 bp, Homo sapiens
ccagcaggagatgcctgtgtct

SEQ ID NO: 9309070 - DNA, 22 bp, Homo sapiens
ccagcaggagagaacatttccc

SEQ ID NO: 9309071 - DNA, 22 bp, Homo sapiens
ccaggacaagccagagggacag

SEQ ID NO: 9309072 - DNA, 22 bp, Homo sapiens
aggcctggtgtgccggatgcag

SEQ ID NO: 9309073 - DNA, 22 bp, Homo sapiens
aggcctgtctgaggtccccact

SEQ ID NO: 9309074 - DNA, 22 bp, Homo sapiens
aggcctgtaatcccagcacttt

SEQ ID NO: 9309075 - DNA, 22 bp, Homo sapiens
aggcgctgcgctggggccagaa

SEQ ID NO: 9309076 - DNA, 22 bp, Homo sapiens
aggcggcttctgaggaggctgc

SEQ ID NO: 9309077 - DNA, 22 bp, Homo sapiens
aggcgtgggaggatctgaggcc

SEQ ID NO: 9309078 - DNA, 18 bp, Homo sapiens
aggcctgggaagctgagg

SEQ ID NO: 9309079 - DNA, 22 bp, Homo sapiens
aggcctggcatgagacctgaga

SEQ ID NO: 9309080 - DNA, 22 bp, Homo sapiens
aggcctggccccagttgctagg

SEQ ID NO: 9309081 - DNA, 22 bp, Homo sapiens
aggcctgctgtgtagcctgttg

SEQ ID NO: 9309082 - DNA, 22 bp, Homo sapiens
aggcctggcctgggcggcattg

SEQ ID NO: 9309083 - DNA, 22 bp, Homo sapiens
aggcctggctttggtttgctga

SEQ ID NO: 9309084 - DNA, 22 bp, Homo sapiens
aggcctggcctttatgttcaag

SEQ ID NO: 9309085 - DNA, 22 bp, Homo sapiens
ccagggctggtgggagatgctg

SEQ ID NO: 9309086 - DNA, 22 bp, Homo sapiens
ccagggctggtgggagatgctg

SEQ ID NO: 9309087 - DNA, 22 bp, Homo sapiens
ccagggctgggtttgtcggtgt

SEQ ID NO: 9309088 - DNA, 22 bp, Homo sapiens
ccagggctggtggctgcagagg

SEQ ID NO: 9309089 - DNA, 22 bp, Homo sapiens
ccagggctggtggctgcagagg

SEQ ID NO: 9309090 - DNA, 22 bp, Homo sapiens
ccagggctggtggctgcagagg

SEQ ID NO: 9309091 - DNA, 22 bp, Homo sapiens
aggctgaggcaagaggatcact

SEQ ID NO: 9309092 - DNA, 23 bp, Homo sapiens
ccagggctacgggcaccgtcctg

SEQ ID NO: 9309093 - DNA, 22 bp, Homo sapiens
ccagggctggaccagtgcttgg

SEQ ID NO: 9309094 - DNA, 19 bp, Homo sapiens
ccagggctccaagctgagt

SEQ ID NO: 9309095 - DNA, 20 bp, Homo sapiens
ccagggctggctcctgggat

SEQ ID NO: 9309096 - DNA, 20 bp, Homo sapiens
ccagggctggctcctgggat

SEQ ID NO: 9309097 - DNA, 19 bp, Homo sapiens
ccagggctccaagctgagt

SEQ ID NO: 9309098 - DNA, 22 bp, Homo sapiens
ccagggctcaggctcccagtgg

SEQ ID NO: 9309099 - DNA, 22 bp, Homo sapiens
aggctacaataattcccatgca

SEQ ID NO: 9309100 - DNA, 22 bp, Homo sapiens
aggctaaggaccaggagggcca

SEQ ID NO: 9309101 - DNA, 22 bp, Homo sapiens
aggctaagaccctcctggggcc

SEQ ID NO: 9309102 - DNA, 22 bp, Homo sapiens
aggcgtggttgaggcgagcata

SEQ ID NO: 9309103 - DNA, 22 bp, Homo sapiens
aggctacagatacagaggctac

SEQ ID NO: 9309104 - DNA, 22 bp, Homo sapiens
aggctacaggagacgccaggag

SEQ ID NO: 9309105 - DNA, 22 bp, Homo sapiens
ccaggctctgcgctggacatgg

SEQ ID NO: 9309106 - DNA, 22 bp, Homo sapiens
ccaggctgctgttggtgtccgc

SEQ ID NO: 9309107 - DNA, 22 bp, Homo sapiens
ccaggctgctgttggtgtccgc

SEQ ID NO: 9309108 - DNA, 22 bp, Homo sapiens
ccaggctgctttattactctgt

SEQ ID NO: 9309109 - DNA, 22 bp, Homo sapiens
ccaggctggagtatagtggcgc

SEQ ID NO: 9309110 - DNA, 22 bp, Homo sapiens
ccaggctgggcggggaacctgg

SEQ ID NO: 9309111 - DNA, 21 bp, Homo sapiens
ccaggctgggagggcagttcc

SEQ ID NO: 9309112 - DNA, 21 bp, Homo sapiens
ccaggctgggagggcagttcc

SEQ ID NO: 9309113 - DNA, 22 bp, Homo sapiens
ccaggctggagtatagtggcgc

SEQ ID NO: 9309114 - DNA, 22 bp, Homo sapiens
aggctgcttccttacgtggctg

SEQ ID NO: 9309115 - DNA, 22 bp, Homo sapiens
aggctgcttcttgtccttggca

SEQ ID NO: 9309116 - DNA, 19 bp, Homo sapiens
ccaggtctggggccagatt

SEQ ID NO: 9309117 - DNA, 22 bp, Homo sapiens
ccaggtctggcactggccagtc

SEQ ID NO: 9309118 - DNA, 19 bp, Homo sapiens
ccaggtctggggccagatt

SEQ ID NO: 9309119 - DNA, 22 bp, Homo sapiens
ccaggtctttgactaatatgct

SEQ ID NO: 9309120 - DNA, 22 bp, Homo sapiens
ccaggtcttgtttgacatcaat

SEQ ID NO: 9309121 - DNA, 22 bp, Homo sapiens
aggctgctcagtagatggagct

SEQ ID NO: 9309122 - DNA, 22 bp, Homo sapiens
aggctggagtgtagcagtgcag

SEQ ID NO: 9309123 - DNA, 22 bp, Homo sapiens
aggctggagtgtagcagtgcag

SEQ ID NO: 9309124 - DNA, 22 bp, Homo sapiens
aggctggcccacctcttgtctt

SEQ ID NO: 9309125 - DNA, 22 bp, Homo sapiens
aggctggagcaagggggcatat

SEQ ID NO: 9309126 - DNA, 22 bp, Homo sapiens
aggctggagagtgcagtggcgt

SEQ ID NO: 9309127 - DNA, 22 bp, Homo sapiens
aggctgggaaggtaaagttgta

SEQ ID NO: 9309128 - DNA, 22 bp, Homo sapiens
aggctggctggggatgcgtctt

SEQ ID NO: 9309129 - DNA, 22 bp, Homo sapiens
aggctggctggggatgcgtctt

SEQ ID NO: 9309130 - DNA, 22 bp, Homo sapiens
aggctggctggcaggggacaca

SEQ ID NO: 9309131 - DNA, 22 bp, Homo sapiens
aggctggggaattgaatttgct

SEQ ID NO: 9309132 - DNA, 20 bp, Homo sapiens
aggctggggtgttttgccca

SEQ ID NO: 9309133 - DNA, 22 bp, Homo sapiens
aggctgggtacctgtcatatgc

SEQ ID NO: 9309134 - DNA, 22 bp, Homo sapiens
aggctgggctccgcccaactcc

SEQ ID NO: 9309135 - DNA, 22 bp, Homo sapiens
aggctgggcaccgttttgatcc

SEQ ID NO: 9309136 - DNA, 22 bp, Homo sapiens
aggctgggaaggtaaagttgta

SEQ ID NO: 9309137 - DNA, 22 bp, Homo sapiens
aggctggccctactggctgcct

SEQ ID NO: 9309138 - DNA, 22 bp, Homo sapiens
aggctggcctatttctttatcg

SEQ ID NO: 9309139 - DNA, 17 bp, Homo sapiens
aggctggccttcacagt

SEQ ID NO: 9309140 - DNA, 22 bp, Homo sapiens
aggctggcgacatctggcgggc

SEQ ID NO: 9309141 - DNA, 22 bp, Homo sapiens
aggctggcgacatctggcgggc

SEQ ID NO: 9309142 - DNA, 22 bp, Homo sapiens
aggctggcggtgactgctctga

SEQ ID NO: 9309143 - DNA, 22 bp, Homo sapiens
aggctggcgacatctggcgggc

SEQ ID NO: 9309144 - DNA, 22 bp, Homo sapiens
ccatttaacacagagttttcca

SEQ ID NO: 9309145 - DNA, 22 bp, Homo sapiens
aggctggcgtcaggggctgtac

SEQ ID NO: 9309146 - DNA, 22 bp, Homo sapiens
aggctggcggtgactgctctga

SEQ ID NO: 9309147 - DNA, 22 bp, Homo sapiens
ccatttggatacttttggttac

SEQ ID NO: 9309148 - DNA, 18 bp, Homo sapiens
ccatttggatagtgaagc

SEQ ID NO: 9309149 - DNA, 22 bp, Homo sapiens
ctgctgggcagaggctgcatga

SEQ ID NO: 9309150 - DNA, 22 bp, Homo sapiens
ctgctgggggacacaggtccgg

SEQ ID NO: 9309151 - DNA, 22 bp, Homo sapiens
ctgctgtgcttgtggccacccg

SEQ ID NO: 9309152 - DNA, 22 bp, Homo sapiens
ctgctggggtcagagcactggg

SEQ ID NO: 9309153 - DNA, 20 bp, Homo sapiens
ctgctgtggtcctttatttt

SEQ ID NO: 9309154 - DNA, 22 bp, Homo sapiens
ctgctgtgggcagggtagctgg

SEQ ID NO: 9309155 - DNA, 22 bp, Homo sapiens
ctgctgtggccagccaggtcaa

SEQ ID NO: 9309156 - DNA, 22 bp, Homo sapiens
ataaagctcttagtagcagcct

SEQ ID NO: 9309157 - DNA, 22 bp, Homo sapiens
ctgcctgggttcaagtcctgtt

SEQ ID NO: 9309158 - DNA, 22 bp, Homo sapiens
ctgcctggtctcaggcatgggg

SEQ ID NO: 9309159 - DNA, 22 bp, Homo sapiens
ctgcctgtgccaatgctccttt

SEQ ID NO: 9309160 - DNA, 22 bp, Homo sapiens
ctgcctgtattgtctgcttggg

SEQ ID NO: 9309161 - DNA, 22 bp, Homo sapiens
ctgcctgtgatttttctctagt

SEQ ID NO: 9309162 - DNA, 22 bp, Homo sapiens
ctgctcaattccggcacgctgg

SEQ ID NO: 9309163 - DNA, 22 bp, Homo sapiens
ctgctcaacatttgtaggataa

SEQ ID NO: 9309164 - DNA, 19 bp, Homo sapiens
ctgctcagagcagctccag

SEQ ID NO: 9309165 - DNA, 22 bp, Homo sapiens
ctgctcagcggaaggaagagcg

SEQ ID NO: 9309166 - DNA, 22 bp, Homo sapiens
ctgctggggaggcgcctcgacg

SEQ ID NO: 9309167 - DNA, 22 bp, Homo sapiens
ataaagcatactttgtatgact

SEQ ID NO: 9309168 - DNA, 22 bp, Homo sapiens
ataaagcatctagtctgtcact

SEQ ID NO: 9309169 - DNA, 22 bp, Homo sapiens
ataaagcatgcttgtttggaga

SEQ ID NO: 9309170 - DNA, 22 bp, Homo sapiens
ataaagcatttcccctgtgtgg

SEQ ID NO: 9309171 - DNA, 22 bp, Homo sapiens
ataaagcaggtccccagacact

SEQ ID NO: 9309172 - DNA, 22 bp, Homo sapiens
ataaagcaggtccccagacact

SEQ ID NO: 9309173 - DNA, 22 bp, Homo sapiens
ataaagcaagcataccattaag

SEQ ID NO: 9309174 - DNA, 22 bp, Homo sapiens
ataaagcaatagattgtgtaat

SEQ ID NO: 9309175 - DNA, 22 bp, Homo sapiens
ataaagcaatagattgtgtaat

SEQ ID NO: 9309176 - DNA, 22 bp, Homo sapiens
ataaagcaaataggactattgc

SEQ ID NO: 9309177 - DNA, 22 bp, Homo sapiens
ataaagcaaataggactattgc

SEQ ID NO: 9309178 - DNA, 21 bp, Homo sapiens
ataaagacaaacactatttgg

SEQ ID NO: 9309179 - DNA, 22 bp, Homo sapiens
ataaagatttctttttctctac

SEQ ID NO: 9309180 - DNA, 22 bp, Homo sapiens
ataaaatcaactggctccagtt

SEQ ID NO: 9309181 - DNA, 22 bp, Homo sapiens
ataaaatcagagttggattgga

SEQ ID NO: 9309182 - DNA, 22 bp, Homo sapiens
ataaaatctttatgtgctctgc

SEQ ID NO: 9309183 - DNA, 22 bp, Homo sapiens
ctgcagggaactgaggcccaga

SEQ ID NO: 9309184 - DNA, 22 bp, Homo sapiens
ctgcagggaccacaagcaggtt

SEQ ID NO: 9309185 - DNA, 22 bp, Homo sapiens
ctgcagggaccacaagcaggtt

SEQ ID NO: 9309186 - DNA, 22 bp, Homo sapiens
agttttgtaattctcaaaaata

SEQ ID NO: 9309187 - DNA, 22 bp, Homo sapiens
ataaaaccaaagcagcagtgtt

SEQ ID NO: 9309188 - DNA, 22 bp, Homo sapiens
ataaaaaggacagatgtggtct

SEQ ID NO: 9309189 - DNA, 22 bp, Homo sapiens
agttcgagatctgctgatgaga

SEQ ID NO: 9309190 - DNA, 22 bp, Homo sapiens
agttctgcatgaaaaaggacta

SEQ ID NO: 9309191 - DNA, 22 bp, Homo sapiens
agttctgctgctgcctagggtg

SEQ ID NO: 9309192 - DNA, 22 bp, Homo sapiens
atacatgcacatttttatacat

SEQ ID NO: 9309193 - DNA, 22 bp, Homo sapiens
ctggcacatagcaaatctcaac

SEQ ID NO: 9309194 - DNA, 22 bp, Homo sapiens
ctggcagcttagcactctggtt

SEQ ID NO: 9309195 - DNA, 22 bp, Homo sapiens
ctggcacaaatggaaaccaagc

SEQ ID NO: 9309196 - DNA, 22 bp, Homo sapiens
ctggcacacagtaggcaccaat

SEQ ID NO: 9309197 - DNA, 22 bp, Homo sapiens
ctggcaggtccagctggactca

SEQ ID NO: 9309198 - DNA, 22 bp, Homo sapiens
ctggcaggtccagctggactca

SEQ ID NO: 9309199 - DNA, 22 bp, Homo sapiens
ctggcaggtggatggggactcc

SEQ ID NO: 9309200 - DNA, 22 bp, Homo sapiens
ctggcaggtttggtgtctggtg

SEQ ID NO: 9309201 - DNA, 22 bp, Homo sapiens
ctggcaggttatagagctgccc

SEQ ID NO: 9309202 - DNA, 22 bp, Homo sapiens
ctggccagaagcacctttggcg

SEQ ID NO: 9309203 - DNA, 20 bp, Homo sapiens
ctggccagaacgcctacaca

SEQ ID NO: 9309204 - DNA, 22 bp, Homo sapiens
ctggcccttctcttgcttcctg

SEQ ID NO: 9309205 - DNA, 22 bp, Homo sapiens
ctggcctcggcagcaggaacag

SEQ ID NO: 9309206 - DNA, 22 bp, Homo sapiens
ctggcctcatagccaagctgtg

SEQ ID NO: 9309207 - DNA, 22 bp, Homo sapiens
ctggcctcagagggtcatggtg

SEQ ID NO: 9309208 - DNA, 22 bp, Homo sapiens
ctggcctaggaatggttttccg

SEQ ID NO: 9309209 - DNA, 22 bp, Homo sapiens
ctggcccttgacttacagcagg

SEQ ID NO: 9309210 - DNA, 22 bp, Homo sapiens
ctggccgccgtcccaacctcga

SEQ ID NO: 9309211 - DNA, 22 bp, Homo sapiens
ctggccggtatttgcctctggg

SEQ ID NO: 9309212 - DNA, 22 bp, Homo sapiens
atataatacaacctgctaagtg

SEQ ID NO: 9309213 - DNA, 22 bp, Homo sapiens
atatacactccactgatacagg

SEQ ID NO: 9309214 - DNA, 22 bp, Homo sapiens
atatacagggagaaacagctta

SEQ ID NO: 9309215 - DNA, 22 bp, Homo sapiens
atatacttggagactatcattg

SEQ ID NO: 9309216 - DNA, 22 bp, Homo sapiens
ctgggagctgaggctgacgctg

SEQ ID NO: 9309217 - DNA, 22 bp, Homo sapiens
ctgggagctgtcaggagcgtgt

SEQ ID NO: 9309218 - DNA, 22 bp, Homo sapiens
ctgggagctggatgccctgccc

SEQ ID NO: 9309219 - DNA, 22 bp, Homo sapiens
ctggcctttagccccagtgtct

SEQ ID NO: 9309220 - DNA, 22 bp, Homo sapiens
ctggcctgtgggctgtctccgg

SEQ ID NO: 9309221 - DNA, 19 bp, Homo sapiens
ctggcctgtgtcctgtgct

SEQ ID NO: 9309222 - DNA, 22 bp, Homo sapiens
ctggcctctctgagcagggagc

SEQ ID NO: 9309223 - DNA, 22 bp, Homo sapiens
ctggctaaagagcaagaagatg

SEQ ID NO: 9309224 - DNA, 22 bp, Homo sapiens
ctggctaattgtcagttgttac

SEQ ID NO: 9309225 - DNA, 23 bp, Homo sapiens
atagttttccctggttcttgcca

SEQ ID NO: 9309226 - DNA, 22 bp, Homo sapiens
atataaagagcttagtatagtg

SEQ ID NO: 9309227 - DNA, 22 bp, Homo sapiens
atataaagaagtggaaaatgag

SEQ ID NO: 9309228 - DNA, 22 bp, Homo sapiens
atataaagtgtttagaaagctg

SEQ ID NO: 9309229 - DNA, 22 bp, Homo sapiens
ctggctcttgcgactcagcttg

SEQ ID NO: 9309230 - DNA, 19 bp, Homo sapiens
ctggctcttgggtggagga

SEQ ID NO: 9309231 - DNA, 19 bp, Homo sapiens
ctggctcttgggtggagga

SEQ ID NO: 9309232 - DNA, 22 bp, Homo sapiens
atctgtaaatgcaaatgtagct

SEQ ID NO: 9309233 - DNA, 22 bp, Homo sapiens
atctgtaacatcagtagcagaa

SEQ ID NO: 9309234 - DNA, 22 bp, Homo sapiens
atctgtcaggagcaaggactac

SEQ ID NO: 9309235 - DNA, 22 bp, Homo sapiens
atctgtcatcagcaccacaggt

SEQ ID NO: 9309236 - DNA, 22 bp, Homo sapiens
atctgtagtcactgcacagctc

SEQ ID NO: 9309237 - DNA, 22 bp, Homo sapiens
cttcttaactgtatatactatg

SEQ ID NO: 9309238 - DNA, 22 bp, Homo sapiens
cttcttaatcccttatatattt

SEQ ID NO: 9309239 - DNA, 22 bp, Homo sapiens
atctgtctggaggcctggcatg

SEQ ID NO: 9309240 - DNA, 22 bp, Homo sapiens
atctgtcttccaccacacatcc

SEQ ID NO: 9309241 - DNA, 22 bp, Homo sapiens
atctgtcttttattcatgagct

SEQ ID NO: 9309242 - DNA, 22 bp, Homo sapiens
atctgtgatcaagacagacagt

SEQ ID NO: 9309243 - DNA, 22 bp, Homo sapiens
atctgttatttacccatctctg

SEQ ID NO: 9309244 - DNA, 22 bp, Homo sapiens
atctgttattgaataggtgcta

SEQ ID NO: 9309245 - DNA, 22 bp, Homo sapiens
atctgttaggtcaggtatggaa

SEQ ID NO: 9309246 - DNA, 22 bp, Homo sapiens
atctgttatgaaatttggttgt

SEQ ID NO: 9309247 - DNA, 22 bp, Homo sapiens
atctgttaacaaagaagacagc

SEQ ID NO: 9309248 - DNA, 22 bp, Homo sapiens
cttctgagatgttgttttacag

SEQ ID NO: 9309249 - DNA, 22 bp, Homo sapiens
cttctgagatgttgttttacag

SEQ ID NO: 9309250 - DNA, 22 bp, Homo sapiens
atctctccttcagctgaggccc

SEQ ID NO: 9309251 - DNA, 23 bp, Homo sapiens
atctctctggtggtcacagtcag

SEQ ID NO: 9309252 - DNA, 22 bp, Homo sapiens
atctctccttcagctgaggccc

SEQ ID NO: 9309253 - DNA, 22 bp, Homo sapiens
atctctgaaggctccaggagag

SEQ ID NO: 9309254 - DNA, 22 bp, Homo sapiens
atctccttggtctcgttccagg

SEQ ID NO: 9309255 - DNA, 22 bp, Homo sapiens
ctgtttctcccaacgccctagt

SEQ ID NO: 9309256 - DNA, 22 bp, Homo sapiens
ctgtttctcccatgtccaagtg

SEQ ID NO: 9309257 - DNA, 22 bp, Homo sapiens
cttaaggaaaagtctcttttaa

SEQ ID NO: 9309258 - DNA, 22 bp, Homo sapiens
atccatgattgcccagaggtgt

SEQ ID NO: 9309259 - DNA, 22 bp, Homo sapiens
cttcaacagttttagaacactg

SEQ ID NO: 9309260 - DNA, 19 bp, Homo sapiens
cttattagagtgagagctt

SEQ ID NO: 9309261 - DNA, 22 bp, Homo sapiens
cttattatggcatgtaagtggg

SEQ ID NO: 9309262 - DNA, 22 bp, Homo sapiens
cttattataaaatcctgtttga

SEQ ID NO: 9309263 - DNA, 19 bp, Homo sapiens
cttatgcagctgagcttgg

SEQ ID NO: 9309264 - DNA, 22 bp, Homo sapiens
cttatgctgagaatgaaagaat

SEQ ID NO: 9309265 - DNA, 22 bp, Homo sapiens
cttatgatcctaaattgcaggt

SEQ ID NO: 9309266 - DNA, 22 bp, Homo sapiens
cttatgatctagaactaggtat

SEQ ID NO: 9309267 - DNA, 22 bp, Homo sapiens
cttatgattcaaataggatctt

SEQ ID NO: 9309268 - DNA, 22 bp, Homo sapiens
cttcaaggaagccacgttggga

SEQ ID NO: 9309269 - DNA, 22 bp, Homo sapiens
cttcaaggtggctaaatggggc

SEQ ID NO: 9309270 - DNA, 22 bp, Homo sapiens
cttcaaggcttattccagttgt

SEQ ID NO: 9309271 - DNA, 22 bp, Homo sapiens
cttcaaggccttccaggttgaa

SEQ ID NO: 9309272 - DNA, 22 bp, Homo sapiens
cttcaagaagacagcagagcat

SEQ ID NO: 9309273 - DNA, 22 bp, Homo sapiens
cttcaagaagacagcagagcat

SEQ ID NO: 9309274 - DNA, 22 bp, Homo sapiens
cttcaagtcgccaaatgctgaa

SEQ ID NO: 9309275 - DNA, 22 bp, Homo sapiens
cttcaatgaaattccatcagaa

SEQ ID NO: 9309276 - DNA, 22 bp, Homo sapiens
atattatgtgactcttcaccag

SEQ ID NO: 9309277 - DNA, 23 bp, Homo sapiens
ctggggctttcaaatctgggcag

SEQ ID NO: 9309278 - DNA, 19 bp, Homo sapiens
ctggggctttggtactgcc

SEQ ID NO: 9309279 - DNA, 19 bp, Homo sapiens
ctggggctttggtactgcc

SEQ ID NO: 9309280 - DNA, 22 bp, Homo sapiens
ctgggggcaagcagacagctgt

SEQ ID NO: 9309281 - DNA, 22 bp, Homo sapiens
ctggggctgtgggagacaaggc

SEQ ID NO: 9309282 - DNA, 23 bp, Homo sapiens
ctggggctttcaaatctgggcag

SEQ ID NO: 9309283 - DNA, 22 bp, Homo sapiens
ctggggctgtaggaggacttat

SEQ ID NO: 9309284 - DNA, 22 bp, Homo sapiens
ctgggagcttgttaggaatgca

SEQ ID NO: 9309285 - DNA, 22 bp, Homo sapiens
ctgggaggcggaggttgcagtg

SEQ ID NO: 9309286 - DNA, 22 bp, Homo sapiens
ctgggaggtgaacagaaaaact

SEQ ID NO: 9309287 - DNA, 22 bp, Homo sapiens
atattattctagtaacagtgat

SEQ ID NO: 9309288 - DNA, 22 bp, Homo sapiens
ctgggtggatcgcagccccagg

SEQ ID NO: 9309289 - DNA, 20 bp, Homo sapiens
ctgggtggcaagcaaggggg

SEQ ID NO: 9309290 - DNA, 22 bp, Homo sapiens
ctggtccagaatttatgattct

SEQ ID NO: 9309291 - DNA, 22 bp, Homo sapiens
ctgggtggcgtctggggccagt

SEQ ID NO: 9309292 - DNA, 22 bp, Homo sapiens
ctgggtggcgtctggggccagt

SEQ ID NO: 9309293 - DNA, 22 bp, Homo sapiens
ctgggtggctgtccagccagcc

SEQ ID NO: 9309294 - DNA, 17 bp, Homo sapiens
ctggtcccaccaagccc

SEQ ID NO: 9309295 - DNA, 22 bp, Homo sapiens
ctgtctctctaggacactgggg

SEQ ID NO: 9309296 - DNA, 22 bp, Homo sapiens
ctgtctctgataagctcgaggg

SEQ ID NO: 9309297 - DNA, 22 bp, Homo sapiens
atcagctggaacaagtgtctga

SEQ ID NO: 9309298 - DNA, 21 bp, Homo sapiens
ctgtctacatatatacacaca

SEQ ID NO: 9309299 - DNA, 22 bp, Homo sapiens
ctgtcgtctgtgctgtaggatg

SEQ ID NO: 9309300 - DNA, 22 bp, Homo sapiens
ctgtctacagatgaaataagca

SEQ ID NO: 9309301 - DNA, 22 bp, Homo sapiens
atcagcacaacgtacagagaaa

SEQ ID NO: 9309302 - DNA, 22 bp, Homo sapiens
atcagctcattttgatggaaat

SEQ ID NO: 9309303 - DNA, 22 bp, Homo sapiens
ctgtaatcccagctacctggga

SEQ ID NO: 9309304 - DNA, 22 bp, Homo sapiens
agtgtgggccacgcagctgagc

SEQ ID NO: 9309305 - DNA, 22 bp, Homo sapiens
agtgtgggcccccaggttagcc

SEQ ID NO: 9309306 - DNA, 22 bp, Homo sapiens
agtgtttatggaaccctggtgg

SEQ ID NO: 9309307 - DNA, 19 bp, Homo sapiens
agtgtttatgtagtgccta

SEQ ID NO: 9309308 - DNA, 22 bp, Homo sapiens
agtgtttatggaatcttagtta

SEQ ID NO: 9309309 - DNA, 22 bp, Homo sapiens
agtgtttatggaatcttagtta

SEQ ID NO: 9309310 - DNA, 18 bp, Homo sapiens
agtgtttatttaggtgaa

SEQ ID NO: 9309311 - DNA, 22 bp, Homo sapiens
agtgtttatttacagatggttt

SEQ ID NO: 9309312 - DNA, 22 bp, Homo sapiens
agtgtttattgtgtgccacaca

SEQ ID NO: 9309313 - DNA, 23 bp, Homo sapiens
agtgtttatgttcagtgaccctc

SEQ ID NO: 9309314 - DNA, 22 bp, Homo sapiens
agtgtttattagatttcccttt

SEQ ID NO: 9309315 - DNA, 22 bp, Homo sapiens
agtgttttggagtgggaaggca

SEQ ID NO: 9309316 - DNA, 22 bp, Homo sapiens
agtgtttttgggtagggtgagt

SEQ ID NO: 9309317 - DNA, 23 bp, Homo sapiens
agttccagaaaaatgctcaagca

SEQ ID NO: 9309318 - DNA, 22 bp, Homo sapiens
agttccagaactggaaaaggac

SEQ ID NO: 9309319 - DNA, 22 bp, Homo sapiens
ctgagctgacatcttcctcttt

SEQ ID NO: 9309320 - DNA, 22 bp, Homo sapiens
ctgagctgcagtcctggctctg

SEQ ID NO: 9309321 - DNA, 22 bp, Homo sapiens
ctgagctgctcccgctgcagcg

SEQ ID NO: 9309322 - DNA, 22 bp, Homo sapiens
agttaactaaattaagagacaa

SEQ ID NO: 9309323 - DNA, 22 bp, Homo sapiens
ctgagcagccccaccagccatt

SEQ ID NO: 9309324 - DNA, 22 bp, Homo sapiens
ctgagccaccggcagggacatc

SEQ ID NO: 9309325 - DNA, 22 bp, Homo sapiens
agtgtattatgcagcggaggtc

SEQ ID NO: 9309326 - DNA, 22 bp, Homo sapiens
agtgtattctgcatgggagact

SEQ ID NO: 9309327 - DNA, 22 bp, Homo sapiens
ctctggagttagtgatctgggc

SEQ ID NO: 9309328 - DNA, 22 bp, Homo sapiens
ctctggagtgggtggccgggag

SEQ ID NO: 9309329 - DNA, 22 bp, Homo sapiens
agtggtcccaggtggtcacagc

SEQ ID NO: 9309330 - DNA, 22 bp, Homo sapiens
agtgggtggcgcagaggaggaa

SEQ ID NO: 9309331 - DNA, 22 bp, Homo sapiens
agtgggtgataagaccaaggag

SEQ ID NO: 9309332 - DNA, 22 bp, Homo sapiens
agtggggagtttccagatgtgt

SEQ ID NO: 9309333 - DNA, 22 bp, Homo sapiens
ctcaccacagagcctgtccagc

SEQ ID NO: 9309334 - DNA, 22 bp, Homo sapiens
ctcacattccacttgtgccaac

SEQ ID NO: 9309335 - DNA, 22 bp, Homo sapiens
ctcaccacagagcctgtccagc

SEQ ID NO: 9309336 - DNA, 23 bp, Homo sapiens
ctcaccaagcgccgccgctgtgt

SEQ ID NO: 9309337 - DNA, 22 bp, Homo sapiens
agtctaggcagccctgcagggt

SEQ ID NO: 9309338 - DNA, 22 bp, Homo sapiens
agtctacaagaactccagtgca

SEQ ID NO: 9309339 - DNA, 22 bp, Homo sapiens
agtctacatttctaacaagctc

SEQ ID NO: 9309340 - DNA, 22 bp, Homo sapiens
agtctacagttccctcaggtcc

SEQ ID NO: 9309341 - DNA, 22 bp, Homo sapiens
agtctacaatcttaaatgaact

SEQ ID NO: 9309342 - DNA, 22 bp, Homo sapiens
agtctacagtctgggtcgggtg

SEQ ID NO: 9309343 - DNA, 18 bp, Homo sapiens
agtctacactggttctta

SEQ ID NO: 9309344 - DNA, 22 bp, Homo sapiens
agtctacaccccaggctccggg

SEQ ID NO: 9309345 - DNA, 22 bp, Homo sapiens
agtctacatttttgttaatggt

SEQ ID NO: 9309346 - DNA, 22 bp, Homo sapiens
agtgaggggattcaggcaaggt

SEQ ID NO: 9309347 - DNA, 22 bp, Homo sapiens
agtgacttaaaggaacttactg

SEQ ID NO: 9309348 - DNA, 22 bp, Homo sapiens
agtgaaatcctggtcaacaggt

SEQ ID NO: 9309349 - DNA, 22 bp, Homo sapiens
agtgaaaacactagttcttgcc

SEQ ID NO: 9309350 - DNA, 22 bp, Homo sapiens
agtgaaaagatgcatttctctg

SEQ ID NO: 9309351 - DNA, 22 bp, Homo sapiens
agtgaaaacctaatcatgcagt

SEQ ID NO: 9309352 - DNA, 22 bp, Homo sapiens
agtgaaaacctaatcatgcagt

SEQ ID NO: 9309353 - DNA, 22 bp, Homo sapiens
agtggagtgagtggcagaagga

SEQ ID NO: 9309354 - DNA, 22 bp, Homo sapiens
agtgctttgtagtttcattgtg

SEQ ID NO: 9309355 - DNA, 22 bp, Homo sapiens
agtgctgtaacaacttatttgg

SEQ ID NO: 9309356 - DNA, 22 bp, Homo sapiens
agtgccctcgtgcccagggcct

SEQ ID NO: 9309357 - DNA, 22 bp, Homo sapiens
agtgatgttgctctctttttct

SEQ ID NO: 9309358 - DNA, 22 bp, Homo sapiens
aggtggcagagctggcccagcg

SEQ ID NO: 9309359 - DNA, 22 bp, Homo sapiens
aggtggcagagctggcccagcg

SEQ ID NO: 9309360 - DNA, 22 bp, Homo sapiens
aggtggcagactaacagaagga

SEQ ID NO: 9309361 - DNA, 22 bp, Homo sapiens
aggtggcagactaacagaagga

SEQ ID NO: 9309362 - DNA, 22 bp, Homo sapiens
aggtggcagactaacagaagga

SEQ ID NO: 9309363 - DNA, 22 bp, Homo sapiens
aggtggcagagtgacaggctga

SEQ ID NO: 9309364 - DNA, 22 bp, Homo sapiens
aggtggcagatgggggtgctcg

SEQ ID NO: 9309365 - DNA, 22 bp, Homo sapiens
aggtggcagcagaatcagggag

SEQ ID NO: 9309366 - DNA, 22 bp, Homo sapiens
cctgtttatctatctagagatg

SEQ ID NO: 9309367 - DNA, 22 bp, Homo sapiens
cctgtttattgtgaagaaccca

SEQ ID NO: 9309368 - DNA, 22 bp, Homo sapiens
cctgtttatccatgccaatcct

SEQ ID NO: 9309369 - DNA, 22 bp, Homo sapiens
cctgtttagtgaggtgaggagt

SEQ ID NO: 9309370 - DNA, 22 bp, Homo sapiens
cctgtttaccactgaggggcag

SEQ ID NO: 9309371 - DNA, 22 bp, Homo sapiens
cctgtttacatcatcaaggact

SEQ ID NO: 9309372 - DNA, 22 bp, Homo sapiens
aggtggcagccgagacataagg

SEQ ID NO: 9309373 - DNA, 22 bp, Homo sapiens
ccttccagaggcgtgacaccct

SEQ ID NO: 9309374 - DNA, 22 bp, Homo sapiens
ccttccagaggcgtgacaccct

SEQ ID NO: 9309375 - DNA, 22 bp, Homo sapiens
aggtgcagctggtggagtctgg

SEQ ID NO: 9309376 - DNA, 17 bp, Homo sapiens
aggtgcagaggcagagc

SEQ ID NO: 9309377 - DNA, 17 bp, Homo sapiens
aggtgcagaggcagagc

SEQ ID NO: 9309378 - DNA, 20 bp, Homo sapiens
cctggggtacactggcatgt

SEQ ID NO: 9309379 - DNA, 22 bp, Homo sapiens
cctgggctttgagggcaggatg

SEQ ID NO: 9309380 - DNA, 22 bp, Homo sapiens
cctgggctttgagggcaggatg

SEQ ID NO: 9309381 - DNA, 22 bp, Homo sapiens
aggtcctggtgaccatggagtt

SEQ ID NO: 9309382 - DNA, 19 bp, Homo sapiens
aggtcctgatcagcaagga

SEQ ID NO: 9309383 - DNA, 22 bp, Homo sapiens
cctgggaggtggaggttgcagt

SEQ ID NO: 9309384 - DNA, 22 bp, Homo sapiens
aggtcagctgtgtgtgcatgag

SEQ ID NO: 9309385 - DNA, 22 bp, Homo sapiens
aggtcagctgcactggtgtaat

SEQ ID NO: 9309386 - DNA, 21 bp, Homo sapiens
aggtcagcccagctctggaag

SEQ ID NO: 9309387 - DNA, 23 bp, Homo sapiens
aggtcagcaggcaaggaaatggc

SEQ ID NO: 9309388 - DNA, 22 bp, Homo sapiens
aggtcagaaaaggagagcattg

SEQ ID NO: 9309389 - DNA, 22 bp, Homo sapiens
aggtcagacacagtgctgggtg

SEQ ID NO: 9309390 - DNA, 22 bp, Homo sapiens
aggtcagaagtgccagggaatt

SEQ ID NO: 9309391 - DNA, 22 bp, Homo sapiens
aggtcacagggttgaagtactt

SEQ ID NO: 9309392 - DNA, 22 bp, Homo sapiens
aggtcacagctttctcgtgagg

SEQ ID NO: 9309393 - DNA, 22 bp, Homo sapiens
cctgggaggctgaggctgcagt

SEQ ID NO: 9309394 - DNA, 22 bp, Homo sapiens
aggtcaggtatcagcaggtatt

SEQ ID NO: 9309395 - DNA, 22 bp, Homo sapiens
cctgggaggctgtgggtctgct

SEQ ID NO: 9309396 - DNA, 22 bp, Homo sapiens
cctgggaggctgtttccagcct

SEQ ID NO: 9309397 - DNA, 22 bp, Homo sapiens
cctgggaggtggaggttgcagc

SEQ ID NO: 9309398 - DNA, 22 bp, Homo sapiens
cctgggagggcaagtgctgatg

SEQ ID NO: 9309399 - DNA, 22 bp, Homo sapiens
aggtaaaatgagtctccattat

SEQ ID NO: 9309400 - DNA, 20 bp, Homo sapiens
agggttcccttgttcagcag

SEQ ID NO: 9309401 - DNA, 19 bp, Homo sapiens
cctgaggtggggtggaagg

SEQ ID NO: 9309402 - DNA, 22 bp, Homo sapiens
aggtacagatgaaagtctagtt

SEQ ID NO: 9309403 - DNA, 22 bp, Homo sapiens
aggtaaggtttggaggcagtgg

SEQ ID NO: 9309404 - DNA, 22 bp, Homo sapiens
aggtcacacttggatcatagaa

SEQ ID NO: 9309405 - DNA, 22 bp, Homo sapiens
aggtcacacaactgtcagaggc

SEQ ID NO: 9309406 - DNA, 22 bp, Homo sapiens
aggtcacacaactgtcagaggc

SEQ ID NO: 9309407 - DNA, 22 bp, Homo sapiens
aggtaaatgtcagagcctttaa

SEQ ID NO: 9309408 - DNA, 22 bp, Homo sapiens
aggtaaatgaatgtttagtctt

SEQ ID NO: 9309409 - DNA, 22 bp, Homo sapiens
aggtaaatataaatcttactct

SEQ ID NO: 9309410 - DNA, 22 bp, Homo sapiens
aggtaaggctgtaagctaagcc

SEQ ID NO: 9309411 - DNA, 22 bp, Homo sapiens
ctatttatctatttctgaatga

SEQ ID NO: 9309412 - DNA, 22 bp, Homo sapiens
ctatttatctatttctgaatga

SEQ ID NO: 9309413 - DNA, 22 bp, Homo sapiens
ctattctgattaccagatattg

SEQ ID NO: 9309414 - DNA, 22 bp, Homo sapiens
ctattctgcttgaaattattct

SEQ ID NO: 9309415 - DNA, 22 bp, Homo sapiens
ctattctgtgtatttactggct

SEQ ID NO: 9309416 - DNA, 22 bp, Homo sapiens
ctatctcttgttttcctgaagc

SEQ ID NO: 9309417 - DNA, 18 bp, Homo sapiens
ctatccctggagcttggg

SEQ ID NO: 9309418 - DNA, 22 bp, Homo sapiens
ctatattctggaatgtccattt

SEQ ID NO: 9309419 - DNA, 22 bp, Homo sapiens
ctatatttggtgagggatgtct

SEQ ID NO: 9309420 - DNA, 22 bp, Homo sapiens
ctatatttcttggctttaaaca

SEQ ID NO: 9309421 - DNA, 22 bp, Homo sapiens
ctagctttttatgacaatcttg

SEQ ID NO: 9309422 - DNA, 22 bp, Homo sapiens
ctagctccatataaagcaggat

SEQ ID NO: 9309423 - DNA, 22 bp, Homo sapiens
ctagcctgggatttgaacttat

SEQ ID NO: 9309424 - DNA, 22 bp, Homo sapiens
agtcacatgcattttcttcaat

SEQ ID NO: 9309425 - DNA, 22 bp, Homo sapiens
agtcacactggttgtttacagt

SEQ ID NO: 9309426 - DNA, 22 bp, Homo sapiens
agtaaactgtgggtacagatgt

SEQ ID NO: 9309427 - DNA, 23 bp, Homo sapiens
agtaaagcaattgttggcgagag

SEQ ID NO: 9309428 - DNA, 22 bp, Homo sapiens
agtaaagcagagttgcagtaca

SEQ ID NO: 9309429 - DNA, 21 bp, Homo sapiens
agtaaagcggtatgggtggcc

SEQ ID NO: 9309430 - DNA, 22 bp, Homo sapiens
agtaaagcattgtcttcagagt

SEQ ID NO: 9309431 - DNA, 22 bp, Homo sapiens
agtaaagcctactcaaccacac

SEQ ID NO: 9309432 - DNA, 18 bp, Homo sapiens
agtaaagcttattacatg

SEQ ID NO: 9309433 - DNA, 22 bp, Homo sapiens
agtaaagcttagtagtaggaaa

SEQ ID NO: 9309434 - DNA, 22 bp, Homo sapiens
agtaaagctactcactgtgggc

SEQ ID NO: 9309435 - DNA, 22 bp, Homo sapiens
agtaaagcggtgtcacagaatg

SEQ ID NO: 9309436 - DNA, 22 bp, Homo sapiens
ccttctctaccatgtgaggaaa

SEQ ID NO: 9309437 - DNA, 22 bp, Homo sapiens
ccttctcctgccttgggttcat

SEQ ID NO: 9309438 - DNA, 22 bp, Homo sapiens
ccttctctctgaagaccccaaa

SEQ ID NO: 9309439 - DNA, 22 bp, Homo sapiens
ccttctctctgaagaccccaaa

SEQ ID NO: 9309440 - DNA, 22 bp, Homo sapiens
ccttctcccctctgcagggtgt

SEQ ID NO: 9309441 - DNA, 22 bp, Homo sapiens
ccttccaggttttggctccatt

SEQ ID NO: 9309442 - DNA, 22 bp, Homo sapiens
agtaggcatttaataaacatga

SEQ ID NO: 9309443 - DNA, 22 bp, Homo sapiens
agtagcagtttggctgaattta

SEQ ID NO: 9309444 - DNA, 22 bp, Homo sapiens
agtagcacaattttgtccctaa

SEQ ID NO: 9309445 - DNA, 22 bp, Homo sapiens
agtagcaccagggaagcagggc

SEQ ID NO: 9309446 - DNA, 23 bp, Homo sapiens
agtagcacatacagtacttgttc

SEQ ID NO: 9309447 - DNA, 23 bp, Homo sapiens
agtagcacatcttgtgtggtttg

SEQ ID NO: 9309448 - DNA, 22 bp, Homo sapiens
agtagattttagattacatagt

SEQ ID NO: 9309449 - DNA, 22 bp, Homo sapiens
agtagaataattggattacagt

SEQ ID NO: 9309450 - DNA, 22 bp, Homo sapiens
agtagaatcccttgcaatgtcc

SEQ ID NO: 9309451 - DNA, 22 bp, Homo sapiens
agtagaatgttctatgtcaatg

SEQ ID NO: 9309452 - DNA, 22 bp, Homo sapiens
agtagaaatgtaagaaggatta

SEQ ID NO: 9309453 - DNA, 22 bp, Homo sapiens
caaatgaatagggagtgtgatg

SEQ ID NO: 9309454 - DNA, 22 bp, Homo sapiens
gctgaggaggtgtggttaggtg

SEQ ID NO: 9309455 - DNA, 22 bp, Homo sapiens
caaatgaaggtggtgggtcatt

SEQ ID NO: 9309456 - DNA, 22 bp, Homo sapiens
gctgaggacatcatggaaggaa

SEQ ID NO: 9309457 - DNA, 22 bp, Homo sapiens
gctgaggaagtcaggtggccca

SEQ ID NO: 9309458 - DNA, 22 bp, Homo sapiens
gctgaggaaaggctggaaggga

SEQ ID NO: 9309459 - DNA, 22 bp, Homo sapiens
gctctggtaccagctactccta

SEQ ID NO: 9309460 - DNA, 22 bp, Homo sapiens
gctgagctgaggcagggctggg

SEQ ID NO: 9309461 - DNA, 22 bp, Homo sapiens
caaatattccaggtacatccct

SEQ ID NO: 9309462 - DNA, 22 bp, Homo sapiens
gctctgggtgaacttggagcaa

SEQ ID NO: 9309463 - DNA, 22 bp, Homo sapiens
gctctgggtgaatggcagattg

SEQ ID NO: 9309464 - DNA, 22 bp, Homo sapiens
caaatctatatgttgatattct

SEQ ID NO: 9309465 - DNA, 22 bp, Homo sapiens
caaatctaggatgcatgtagtg

SEQ ID NO: 9309466 - DNA, 21 bp, Homo sapiens
gctctaagctttgggaagaat

SEQ ID NO: 9309467 - DNA, 22 bp, Homo sapiens
gctctaggagaggggcagtcca

SEQ ID NO: 9309468 - DNA, 22 bp, Homo sapiens
gctccttctggctcccttttgg

SEQ ID NO: 9309469 - DNA, 22 bp, Homo sapiens
gctcgcagatcacctgggggcg

SEQ ID NO: 9309470 - DNA, 22 bp, Homo sapiens
gctccaggctgctctgtcccat

SEQ ID NO: 9309471 - DNA, 22 bp, Homo sapiens
gctccaggctgctctgtcccat

SEQ ID NO: 9309472 - DNA, 17 bp, Homo sapiens
gctccaggcgtgagtga

SEQ ID NO: 9309473 - DNA, 22 bp, Homo sapiens
gctccaggcagcatagtggatg

SEQ ID NO: 9309474 - DNA, 22 bp, Homo sapiens
gctccaggccacggcttcttgg

SEQ ID NO: 9309475 - DNA, 22 bp, Homo sapiens
gctccaggccccagcgttccgc

SEQ ID NO: 9309476 - DNA, 22 bp, Homo sapiens
gctccaggcgagctggaccaga

SEQ ID NO: 9309477 - DNA, 22 bp, Homo sapiens
gctcagggtcccttggtgctgg

SEQ ID NO: 9309478 - DNA, 22 bp, Homo sapiens
gctcagggctaaggctgagggg

SEQ ID NO: 9309479 - DNA, 22 bp, Homo sapiens
gctcagggctaaggctgagggg

SEQ ID NO: 9309480 - DNA, 22 bp, Homo sapiens
gctcaggggaatgggctgccgt

SEQ ID NO: 9309481 - DNA, 18 bp, Homo sapiens
gctcaggtatagacaggg

SEQ ID NO: 9309482 - DNA, 22 bp, Homo sapiens
gctaatgactgagtttttagca

SEQ ID NO: 9309483 - DNA, 22 bp, Homo sapiens
gctaaggaggaatagtgaggca

SEQ ID NO: 9309484 - DNA, 22 bp, Homo sapiens
gctaaggaaatgcgcggcacag

SEQ ID NO: 9309485 - DNA, 22 bp, Homo sapiens
gcgtggggtaggtagacatgga

SEQ ID NO: 9309486 - DNA, 22 bp, Homo sapiens
gcgtggggtaggtagacatgga

SEQ ID NO: 9309487 - DNA, 22 bp, Homo sapiens
gcgccactgcactcccacctgg

SEQ ID NO: 9309488 - DNA, 22 bp, Homo sapiens
gcgttggggaccccgaagctgg

SEQ ID NO: 9309489 - DNA, 22 bp, Homo sapiens
gcgttatttcctgtctgatttc

SEQ ID NO: 9309490 - DNA, 21 bp, Homo sapiens
gcctggctctcactggcctgg

SEQ ID NO: 9309491 - DNA, 22 bp, Homo sapiens
gcgcaggcccgggtcagggccg

SEQ ID NO: 9309492 - DNA, 22 bp, Homo sapiens
gcgcaggtgctgctggagcagc

SEQ ID NO: 9309493 - DNA, 21 bp, Homo sapiens
gcctggctctcactggcctgg

SEQ ID NO: 9309494 - DNA, 22 bp, Homo sapiens
gcctggctcgggcactcgccag

SEQ ID NO: 9309495 - DNA, 22 bp, Homo sapiens
gcctggctcctaaggactggct

SEQ ID NO: 9309496 - DNA, 22 bp, Homo sapiens
gcctggctcctaagagcacaac

SEQ ID NO: 9309497 - DNA, 22 bp, Homo sapiens
atttacatttatttgagaaggt

SEQ ID NO: 9309498 - DNA, 22 bp, Homo sapiens
atttacataatagactttaggt

SEQ ID NO: 9309499 - DNA, 22 bp, Homo sapiens
atttacagtttagcatttcaag

SEQ ID NO: 9309500 - DNA, 22 bp, Homo sapiens
gcccagccagagctgtgtgatg

SEQ ID NO: 9309501 - DNA, 22 bp, Homo sapiens
gccagaggggctcgaaggcgcg

SEQ ID NO: 9309502 - DNA, 22 bp, Homo sapiens
gccagaggtatcaaagatagta

SEQ ID NO: 9309503 - DNA, 22 bp, Homo sapiens
gcccagcccctgggtggacgtg

SEQ ID NO: 9309504 - DNA, 22 bp, Homo sapiens
gcccaggaggtcaagtagctat

SEQ ID NO: 9309505 - DNA, 22 bp, Homo sapiens
gcccaggaggtggaggtgcagt

SEQ ID NO: 9309506 - DNA, 22 bp, Homo sapiens
gcccaggaggttgggctgtgca

SEQ ID NO: 9309507 - DNA, 22 bp, Homo sapiens
gcccaggagttcaaggctgcag

SEQ ID NO: 9309508 - DNA, 22 bp, Homo sapiens
gccctccagctgttgcgcgtcg

SEQ ID NO: 9309509 - DNA, 22 bp, Homo sapiens
gccctccatgagacacagtgta

SEQ ID NO: 9309510 - DNA, 22 bp, Homo sapiens
gccctccaccagagcccttctc

SEQ ID NO: 9309511 - DNA, 22 bp, Homo sapiens
gcccaggagttcaagtctagtg

SEQ ID NO: 9309512 - DNA, 22 bp, Homo sapiens
gcccaggagttgaagggctgac

SEQ ID NO: 9309513 - DNA, 22 bp, Homo sapiens
gccctgccctctcggcactcgc

SEQ ID NO: 9309514 - DNA, 22 bp, Homo sapiens
gccctgccctgagccgtagacc

SEQ ID NO: 9309515 - DNA, 22 bp, Homo sapiens
atttgagatggtaaataacttt

SEQ ID NO: 9309516 - DNA, 23 bp, Homo sapiens
atttgagaaagtatttttaagac

SEQ ID NO: 9309517 - DNA, 22 bp, Homo sapiens
atttgcagttattgttcatgaa

SEQ ID NO: 9309518 - DNA, 22 bp, Homo sapiens
atttgccttgtgatttgtaagt

SEQ ID NO: 9309519 - DNA, 22 bp, Homo sapiens
atttgccttggtgatttgtaaa

SEQ ID NO: 9309520 - DNA, 22 bp, Homo sapiens
atttgcctttcgaatcaacagg

SEQ ID NO: 9309521 - DNA, 22 bp, Homo sapiens
attttaataagatccatttggt

SEQ ID NO: 9309522 - DNA, 22 bp, Homo sapiens
gcctgcctagaattgcagcttt

SEQ ID NO: 9309523 - DNA, 22 bp, Homo sapiens
gcctgcctagaattgcagcttt

SEQ ID NO: 9309524 - DNA, 21 bp, Homo sapiens
gcctgccctctgtgatggcca

SEQ ID NO: 9309525 - DNA, 21 bp, Homo sapiens
gcctgccctctgtgatggcca

SEQ ID NO: 9309526 - DNA, 22 bp, Homo sapiens
gcctgccccttcctgggcaggg

SEQ ID NO: 9309527 - DNA, 23 bp, Homo sapiens
attttacaggtcagttccttgaa

SEQ ID NO: 9309528 - DNA, 22 bp, Homo sapiens
attttacataaggaaggtttaa

SEQ ID NO: 9309529 - DNA, 22 bp, Homo sapiens
gcctgcccacggggctggcata

SEQ ID NO: 9309530 - DNA, 22 bp, Homo sapiens
gcctgcccacggggctggcata

SEQ ID NO: 9309531 - DNA, 22 bp, Homo sapiens
attttctgtgtgcagataaata

SEQ ID NO: 9309532 - DNA, 22 bp, Homo sapiens
gcctggctcctaagagcacaac

SEQ ID NO: 9309533 - DNA, 22 bp, Homo sapiens
gcctggctccctctgcagctcc

SEQ ID NO: 9309534 - DNA, 22 bp, Homo sapiens
gcctggctccctctgcagctcc

SEQ ID NO: 9309535 - DNA, 22 bp, Homo sapiens
gcctggctccctctgcagctcc

SEQ ID NO: 9309536 - DNA, 22 bp, Homo sapiens
gcctggctcacagagcagcctt

SEQ ID NO: 9309537 - DNA, 22 bp, Homo sapiens
gcctggctcacagagcagcctt

SEQ ID NO: 9309538 - DNA, 22 bp, Homo sapiens
gcagaggggaagctgaggaatt

SEQ ID NO: 9309539 - DNA, 19 bp, Homo sapiens
gcagatccaaaagtcacat

SEQ ID NO: 9309540 - DNA, 21 bp, Homo sapiens
gcagaggaatggtatacataa

SEQ ID NO: 9309541 - DNA, 22 bp, Homo sapiens
gcagaattccttcttccttggg

SEQ ID NO: 9309542 - DNA, 22 bp, Homo sapiens
gcagaaggtcaaagcaagatgt

SEQ ID NO: 9309543 - DNA, 22 bp, Homo sapiens
gcagaaggttgtttgggaaagg

SEQ ID NO: 9309544 - DNA, 22 bp, Homo sapiens
gcagaagtaggctctgtgtagg

SEQ ID NO: 9309545 - DNA, 22 bp, Homo sapiens
gcagaagtcagaccatctgaat

SEQ ID NO: 9309546 - DNA, 21 bp, Homo sapiens
gcagaagtggctacatctcca

SEQ ID NO: 9309547 - DNA, 19 bp, Homo sapiens
gcagccaggtgctctacct

SEQ ID NO: 9309548 - DNA, 22 bp, Homo sapiens
gcagccagggctaagctgggga

SEQ ID NO: 9309549 - DNA, 22 bp, Homo sapiens
gcagatgccactaggtgaagtg

SEQ ID NO: 9309550 - DNA, 22 bp, Homo sapiens
gcagcctgttgtaccagcctgt

SEQ ID NO: 9309551 - DNA, 22 bp, Homo sapiens
gcagccttctactgaatcctct

SEQ ID NO: 9309552 - DNA, 22 bp, Homo sapiens
gcagccttcctgacctctaccc

SEQ ID NO: 9309553 - DNA, 22 bp, Homo sapiens
gcagccttggtgactgagtctg

SEQ ID NO: 9309554 - DNA, 22 bp, Homo sapiens
gcagccttccgtggacctggac

SEQ ID NO: 9309555 - DNA, 22 bp, Homo sapiens
gcaggagagtctgtgccaggtt

SEQ ID NO: 9309556 - DNA, 22 bp, Homo sapiens
gcagcctgaggccctttctggc

SEQ ID NO: 9309557 - DNA, 22 bp, Homo sapiens
gcagcctgatgatctgggttgt

SEQ ID NO: 9309558 - DNA, 22 bp, Homo sapiens
gcagcctgggcaacagagtgag

SEQ ID NO: 9309559 - DNA, 18 bp, Homo sapiens
gcacagagcccaggctct

SEQ ID NO: 9309560 - DNA, 20 bp, Homo sapiens
gcacagagatgagcaaagta

SEQ ID NO: 9309561 - DNA, 22 bp, Homo sapiens
gcacaggctctcttggggacac

SEQ ID NO: 9309562 - DNA, 22 bp, Homo sapiens
gcacaggctctcttggggacac

SEQ ID NO: 9309563 - DNA, 22 bp, Homo sapiens
gcacagaggatgaggcagctct

SEQ ID NO: 9309564 - DNA, 22 bp, Homo sapiens
gcacaggctgttggccttcaga

SEQ ID NO: 9309565 - DNA, 22 bp, Homo sapiens
gcacagggagacagccgtggcc

SEQ ID NO: 9309566 - DNA, 22 bp, Homo sapiens
gcacagggaggctggcctggcc

SEQ ID NO: 9309567 - DNA, 22 bp, Homo sapiens
gcacagggcaacaggtctgtta

SEQ ID NO: 9309568 - DNA, 22 bp, Homo sapiens
gcaaaattaaacttagcatcat

SEQ ID NO: 9309569 - DNA, 22 bp, Homo sapiens
gcaaaatttacactccttcttc

SEQ ID NO: 9309570 - DNA, 22 bp, Homo sapiens
gcaaaacagtcgatgcctccca

SEQ ID NO: 9309571 - DNA, 22 bp, Homo sapiens
atgtttctagagctttgtccca

SEQ ID NO: 9309572 - DNA, 22 bp, Homo sapiens
atgtttctaaaacttgcatggc

SEQ ID NO: 9309573 - DNA, 22 bp, Homo sapiens
atgtttctataaagaagtttgg

SEQ ID NO: 9309574 - DNA, 22 bp, Homo sapiens
atgtttctagttgtatgtcact

SEQ ID NO: 9309575 - DNA, 22 bp, Homo sapiens
atgtttctcactgtttctctat

SEQ ID NO: 9309576 - DNA, 22 bp, Homo sapiens
gcaacattgagtctaagtacca

SEQ ID NO: 9309577 - DNA, 22 bp, Homo sapiens
gcaacattaaaccaataattgt

SEQ ID NO: 9309578 - DNA, 22 bp, Homo sapiens
gcacacagggatttttgaatgg

SEQ ID NO: 9309579 - DNA, 22 bp, Homo sapiens
gcacacaggggagttctcagaa

SEQ ID NO: 9309580 - DNA, 22 bp, Homo sapiens
gcaaattgggaaatttctctag

SEQ ID NO: 9309581 - DNA, 22 bp, Homo sapiens
gcaaattgctagctttctctgc

SEQ ID NO: 9309582 - DNA, 22 bp, Homo sapiens
attgttttaattccattgtgaa

SEQ ID NO: 9309583 - DNA, 20 bp, Homo sapiens
gccactgggcaccagcaggg

SEQ ID NO: 9309584 - DNA, 16 bp, Homo sapiens
attgttttcaattaga

SEQ ID NO: 9309585 - DNA, 22 bp, Homo sapiens
attgttttccaaagatgctgct

SEQ ID NO: 9309586 - DNA, 21 bp, Homo sapiens
gcattcctaggaggtaagcat

SEQ ID NO: 9309587 - DNA, 22 bp, Homo sapiens
gcattcatcaaaaatgttcctc

SEQ ID NO: 9309588 - DNA, 22 bp, Homo sapiens
gccacagtcactgctgcagggg

SEQ ID NO: 9309589 - DNA, 22 bp, Homo sapiens
attgtaattttagagaaagtgg

SEQ ID NO: 9309590 - DNA, 22 bp, Homo sapiens
attgtaaatagtgccacaataa

SEQ ID NO: 9309591 - DNA, 18 bp, Homo sapiens
gcagtgcaggaagaagag

SEQ ID NO: 9309592 - DNA, 22 bp, Homo sapiens
gcattattaatagctgcatgag

SEQ ID NO: 9309593 - DNA, 22 bp, Homo sapiens
attgttcatgtatgaataaata

SEQ ID NO: 9309594 - DNA, 22 bp, Homo sapiens
attgttcactgtgaatcttgat

SEQ ID NO: 9309595 - DNA, 22 bp, Homo sapiens
attgttcagagaagggaagaat

SEQ ID NO: 9309596 - DNA, 22 bp, Homo sapiens
gcagggacgccagggacagcaa

SEQ ID NO: 9309597 - DNA, 22 bp, Homo sapiens
gcaggctggtctgaccatccct

SEQ ID NO: 9309598 - DNA, 22 bp, Homo sapiens
gcaggagccacttcagggatgc

SEQ ID NO: 9309599 - DNA, 22 bp, Homo sapiens
gcaggagcagtcaggggcagct

SEQ ID NO: 9309600 - DNA, 22 bp, Homo sapiens
gcaggagcaaactgcagtgtgg

SEQ ID NO: 9309601 - DNA, 22 bp, Homo sapiens
gcagggtacattgggatgggat

SEQ ID NO: 9309602 - DNA, 22 bp, Homo sapiens
gcagggtccatggaggcagccc

SEQ ID NO: 9309603 - DNA, 21 bp, Homo sapiens
gcagggtcctttccattccta

SEQ ID NO: 9309604 - DNA, 22 bp, Homo sapiens
gcagggtccatggaggcagccc

SEQ ID NO: 9309605 - DNA, 22 bp, Homo sapiens
gcagggtcttgagaggcagcca

SEQ ID NO: 9309606 - DNA, 22 bp, Homo sapiens
gcagggtcttgagaggcagcca

SEQ ID NO: 9309607 - DNA, 22 bp, Homo sapiens
gcagggtctgaggccacagagg

SEQ ID NO: 9309608 - DNA, 22 bp, Homo sapiens
gcagggtcgctctaggagatca

SEQ ID NO: 9309609 - DNA, 22 bp, Homo sapiens
gcaggggtggaggctgtcctgt

SEQ ID NO: 9309610 - DNA, 16 bp, Homo sapiens
gcaggggtgggtggag

SEQ ID NO: 9309611 - DNA, 22 bp, Homo sapiens
gcagggctgggatttgagccca

SEQ ID NO: 9309612 - DNA, 22 bp, Homo sapiens
gcagggattgtgcagggggcta

SEQ ID NO: 9309613 - DNA, 22 bp, Homo sapiens
gcaggtggatcacctgaggtca

SEQ ID NO: 9309614 - DNA, 22 bp, Homo sapiens
attgtaaaagtattctaagatt

SEQ ID NO: 9309615 - DNA, 22 bp, Homo sapiens
attggttttgttatctccattc

SEQ ID NO: 9309616 - DNA, 22 bp, Homo sapiens
attgtaaagtactgtgtacaat

SEQ ID NO: 9309617 - DNA, 22 bp, Homo sapiens
gaagcacattagatgtgtcttc

SEQ ID NO: 9309618 - DNA, 22 bp, Homo sapiens
gaatcatagaacattaatagaa

SEQ ID NO: 9309619 - DNA, 22 bp, Homo sapiens
gaagcacaaagtgtagttccga

SEQ ID NO: 9309620 - DNA, 22 bp, Homo sapiens
gaagcaatttagaatcagaagc

SEQ ID NO: 9309621 - DNA, 22 bp, Homo sapiens
gaagcacagaatggttaacatg

SEQ ID NO: 9309622 - DNA, 22 bp, Homo sapiens
gaagcacagataattcaagtat

SEQ ID NO: 9309623 - DNA, 22 bp, Homo sapiens
gaagcacactgattttatttct

SEQ ID NO: 9309624 - DNA, 22 bp, Homo sapiens
gaagcacatggctgtgagcaac

SEQ ID NO: 9309625 - DNA, 22 bp, Homo sapiens
gaagcacatggctatagctatt

SEQ ID NO: 9309626 - DNA, 22 bp, Homo sapiens
gaagcacagggctcgatctcag

SEQ ID NO: 9309627 - DNA, 22 bp, Homo sapiens
atgcataatgtatgtattgact

SEQ ID NO: 9309628 - DNA, 22 bp, Homo sapiens
gaatgttcctcagacttcccca

SEQ ID NO: 9309629 - DNA, 22 bp, Homo sapiens
atgccctgctgctggggcagtg

SEQ ID NO: 9309630 - DNA, 22 bp, Homo sapiens
atgccctgctctcgggaaggga

SEQ ID NO: 9309631 - DNA, 22 bp, Homo sapiens
atgccccaggaggtgccatcca

SEQ ID NO: 9309632 - DNA, 22 bp, Homo sapiens
atgccacttcattccagcctcg

SEQ ID NO: 9309633 - DNA, 22 bp, Homo sapiens
atgcccaatgtcacaatttttg

SEQ ID NO: 9309634 - DNA, 22 bp, Homo sapiens
atgctttattattttgcaggga

SEQ ID NO: 9309635 - DNA, 22 bp, Homo sapiens
atgctttatgttctggcatttt

SEQ ID NO: 9309636 - DNA, 19 bp, Homo sapiens
atgctttatgttatttctt

SEQ ID NO: 9309637 - DNA, 22 bp, Homo sapiens
atgctttattgcttctgggcac

SEQ ID NO: 9309638 - DNA, 22 bp, Homo sapiens
gaccctctagatggaagcactg

SEQ ID NO: 9309639 - DNA, 22 bp, Homo sapiens
gactttggcatctagacattgt

SEQ ID NO: 9309640 - DNA, 22 bp, Homo sapiens
atgctttattgttaggtcatgt

SEQ ID NO: 9309641 - DNA, 22 bp, Homo sapiens
atgctttattggagacagtcat

SEQ ID NO: 9309642 - DNA, 23 bp, Homo sapiens
gacagggctgacttggcagctgc

SEQ ID NO: 9309643 - DNA, 22 bp, Homo sapiens
gacagtgtccctctggggtgga

SEQ ID NO: 9309644 - DNA, 22 bp, Homo sapiens
gacagtgttacaatttaatgga

SEQ ID NO: 9309645 - DNA, 22 bp, Homo sapiens
gacagtgtgaacatctaatagt

SEQ ID NO: 9309646 - DNA, 22 bp, Homo sapiens
gacagtgtttgtataattcctg

SEQ ID NO: 9309647 - DNA, 20 bp, Homo sapiens
atgcttaagtgttcattatt

SEQ ID NO: 9309648 - DNA, 22 bp, Homo sapiens
atgcttaagctcagttatatat

SEQ ID NO: 9309649 - DNA, 22 bp, Homo sapiens
gacataaaatggaattctgttg

SEQ ID NO: 9309650 - DNA, 22 bp, Homo sapiens
gacataaaattcaataatttgt

SEQ ID NO: 9309651 - DNA, 22 bp, Homo sapiens
atgctttacgacaaaaaactca

SEQ ID NO: 9309652 - DNA, 22 bp, Homo sapiens
atgctttacccacaccaggatg

SEQ ID NO: 9309653 - DNA, 22 bp, Homo sapiens
atgctttagtgtcaagtttggg

SEQ ID NO: 9309654 - DNA, 22 bp, Homo sapiens
atgctttatacaaaacacttaa

SEQ ID NO: 9309655 - DNA, 22 bp, Homo sapiens
atgctttagttcaaaggactta

SEQ ID NO: 9309656 - DNA, 22 bp, Homo sapiens
atgctttaaactataaatccac

SEQ ID NO: 9309657 - DNA, 22 bp, Homo sapiens
atgctttaaaacgtatgtgtaa

SEQ ID NO: 9309658 - DNA, 22 bp, Homo sapiens
atgctttaaatgtcttttgctt

SEQ ID NO: 9309659 - DNA, 22 bp, Homo sapiens
atgctttacagttttccaaaca

SEQ ID NO: 9309660 - DNA, 22 bp, Homo sapiens
atgaggcatatcctcctatggt

SEQ ID NO: 9309661 - DNA, 22 bp, Homo sapiens
atgaggcatgtgaggagaaggg

SEQ ID NO: 9309662 - DNA, 22 bp, Homo sapiens
gaaaatgcctctggcattaaac

SEQ ID NO: 9309663 - DNA, 22 bp, Homo sapiens
gaaatcttttccaattgtttag

SEQ ID NO: 9309664 - DNA, 22 bp, Homo sapiens
gaaatgaaacaggcttttaagg

SEQ ID NO: 9309665 - DNA, 22 bp, Homo sapiens
gaacattgctttatttcttcta

SEQ ID NO: 9309666 - DNA, 22 bp, Homo sapiens
gaactttaggattttcacaggt

SEQ ID NO: 9309667 - DNA, 22 bp, Homo sapiens
atgcacaacagtggctgccttg

SEQ ID NO: 9309668 - DNA, 22 bp, Homo sapiens
atgcaagagggaaaaggaaata

SEQ ID NO: 9309669 - DNA, 22 bp, Homo sapiens
atgcaagacccagaaatcatta

SEQ ID NO: 9309670 - DNA, 22 bp, Homo sapiens
atgaatgaatgagagtaggtca

SEQ ID NO: 9309671 - DNA, 22 bp, Homo sapiens
atgaatgaagaacatctgtgcc

SEQ ID NO: 9309672 - DNA, 22 bp, Homo sapiens
atgaatatgtacacatctgtca

SEQ ID NO: 9309673 - DNA, 22 bp, Homo sapiens
cttgagcttaggttcaggattg

SEQ ID NO: 9309674 - DNA, 22 bp, Homo sapiens
cttgagcacagcggcttcagga

SEQ ID NO: 9309675 - DNA, 22 bp, Homo sapiens
cttgagctaggaaggctgaggc

SEQ ID NO: 9309676 - DNA, 22 bp, Homo sapiens
cttgagctaggaaggctgaggc

SEQ ID NO: 9309677 - DNA, 23 bp, Homo sapiens
atctgttcatctgacacagattc

SEQ ID NO: 9309678 - DNA, 22 bp, Homo sapiens
atcttcaaagcacatcgtttgt

SEQ ID NO: 9309679 - DNA, 22 bp, Homo sapiens
atgaatgattttatgtaaatga

SEQ ID NO: 9309680 - DNA, 21 bp, Homo sapiens
atgaatgatttctactcttaa

SEQ ID NO: 9309681 - DNA, 22 bp, Homo sapiens
atgaatgatgcaaaagacactg

SEQ ID NO: 9309682 - DNA, 22 bp, Homo sapiens
atgaatgagtgctaggtttgtc

SEQ ID NO: 9309683 - DNA, 22 bp, Homo sapiens
atgaatgactgtctactttggg

SEQ ID NO: 9309684 - DNA, 22 bp, Homo sapiens
gaaaaccacctcccatcaagca

SEQ ID NO: 9309685 - DNA, 22 bp, Homo sapiens
gaaaaccacctcccatcaagca

SEQ ID NO: 9309686 - DNA, 21 bp, Homo sapiens
gaaaaccatttgcatcatgag

SEQ ID NO: 9309687 - DNA, 22 bp, Homo sapiens
gaaaacatccagagatagacct

SEQ ID NO: 9309688 - DNA, 22 bp, Homo sapiens
gaaaataggcagatgcattgta

SEQ ID NO: 9309689 - DNA, 22 bp, Homo sapiens
gaaaatctgcttatattatttt

SEQ ID NO: 9309690 - DNA, 22 bp, Homo sapiens
gaaaataggctgcatctccttc

SEQ ID NO: 9309691 - DNA, 22 bp, Homo sapiens
gaaaactaacggaaaagttagg

SEQ ID NO: 9309692 - DNA, 22 bp, Homo sapiens
gaaaagaactgcatgggattaa

SEQ ID NO: 9309693 - DNA, 22 bp, Homo sapiens
gaggcatgtctggcctgtccca

SEQ ID NO: 9309694 - DNA, 22 bp, Homo sapiens
gaggcattaaagggaatcttct

SEQ ID NO: 9309695 - DNA, 22 bp, Homo sapiens
gaggccacagctatcagggaca

SEQ ID NO: 9309696 - DNA, 22 bp, Homo sapiens
gaggccacagtcctgaggcatc

SEQ ID NO: 9309697 - DNA, 22 bp, Homo sapiens
gaggccacagtcctgaggcatc

SEQ ID NO: 9309698 - DNA, 22 bp, Homo sapiens
gaggctgttaggagggactctg

SEQ ID NO: 9309699 - DNA, 22 bp, Homo sapiens
gaggctgtgtttcagtgaggcc

SEQ ID NO: 9309700 - DNA, 22 bp, Homo sapiens
gaggctgtgtgtccctctggac

SEQ ID NO: 9309701 - DNA, 22 bp, Homo sapiens
gaggctgtgtgtccctctggac

SEQ ID NO: 9309702 - DNA, 22 bp, Homo sapiens
gagggaaaataaaattgcagta

SEQ ID NO: 9309703 - DNA, 22 bp, Homo sapiens
gaggctgttggctgatctgagt

SEQ ID NO: 9309704 - DNA, 22 bp, Homo sapiens
gaggctgttcagtgtccagctt

SEQ ID NO: 9309705 - DNA, 22 bp, Homo sapiens
gaggctgttcagtgtccagctt

SEQ ID NO: 9309706 - DNA, 22 bp, Homo sapiens
gaggctgttagggcctgaggta

SEQ ID NO: 9309707 - DNA, 22 bp, Homo sapiens
gaggcttcccgcccatgctgga

SEQ ID NO: 9309708 - DNA, 22 bp, Homo sapiens
gaggcttctgtaaccctgtcct

SEQ ID NO: 9309709 - DNA, 22 bp, Homo sapiens
gagggaagaaagaattgatgcg

SEQ ID NO: 9309710 - DNA, 17 bp, Homo sapiens
gaggtaggaagtgagtc

SEQ ID NO: 9309711 - DNA, 22 bp, Homo sapiens
gaggtagccacagatagagact

SEQ ID NO: 9309712 - DNA, 22 bp, Homo sapiens
gagtccaggctggtcaaatagc

SEQ ID NO: 9309713 - DNA, 22 bp, Homo sapiens
gagggcagaaaattatgcggtg

SEQ ID NO: 9309714 - DNA, 22 bp, Homo sapiens
gagggggcgtgcaaggctccgc

SEQ ID NO: 9309715 - DNA, 22 bp, Homo sapiens
gagggggctctgccaacctgtc

SEQ ID NO: 9309716 - DNA, 22 bp, Homo sapiens
gagtccagtagttaggacagag

SEQ ID NO: 9309717 - DNA, 20 bp, Homo sapiens
gagtccaggggcctgtagca

SEQ ID NO: 9309718 - DNA, 22 bp, Homo sapiens
gagtccagttctttccagcagt

SEQ ID NO: 9309719 - DNA, 23 bp, Homo sapiens
gagtgcagaatagacatgcagtg

SEQ ID NO: 9309720 - DNA, 21 bp, Homo sapiens
gagtgcaggtctgatgccatc

SEQ ID NO: 9309721 - DNA, 22 bp, Homo sapiens
atgtttattttgcagagtaggg

SEQ ID NO: 9309722 - DNA, 22 bp, Homo sapiens
atgtttattgttttaagctgct

SEQ ID NO: 9309723 - DNA, 22 bp, Homo sapiens
gagttaaatattttctgaagtt

SEQ ID NO: 9309724 - DNA, 22 bp, Homo sapiens
gagttagtgtaaccacaaccat

SEQ ID NO: 9309725 - DNA, 22 bp, Homo sapiens
gatatttaactctcacaggtcc

SEQ ID NO: 9309726 - DNA, 22 bp, Homo sapiens
gatatttaactctcacaggtcc

SEQ ID NO: 9309727 - DNA, 22 bp, Homo sapiens
gatatttaactctcacaggtcc

SEQ ID NO: 9309728 - DNA, 22 bp, Homo sapiens
gatatttacaaatttgccaata

SEQ ID NO: 9309729 - DNA, 22 bp, Homo sapiens
gatatttacaaatttgccaata

SEQ ID NO: 9309730 - DNA, 22 bp, Homo sapiens
gatatttacaaatttgccaata

SEQ ID NO: 9309731 - DNA, 18 bp, Homo sapiens
gatcgggggcgccccaag

SEQ ID NO: 9309732 - DNA, 22 bp, Homo sapiens
gatctgggagcctcatggagac

SEQ ID NO: 9309733 - DNA, 22 bp, Homo sapiens
atgtttcatttagatatcaggc

SEQ ID NO: 9309734 - DNA, 22 bp, Homo sapiens
gagaggtggaggttgcagtgag

SEQ ID NO: 9309735 - DNA, 22 bp, Homo sapiens
gagaggtggtgaggacttgtct

SEQ ID NO: 9309736 - DNA, 22 bp, Homo sapiens
gagaggtggtgaggacttgtct

SEQ ID NO: 9309737 - DNA, 22 bp, Homo sapiens
gagaggtgtgtttcagataaga

SEQ ID NO: 9309738 - DNA, 22 bp, Homo sapiens
gagaggtggaggttgcagtgag

SEQ ID NO: 9309739 - DNA, 22 bp, Homo sapiens
gagaggtgaatgtggatgccac

SEQ ID NO: 9309740 - DNA, 22 bp, Homo sapiens
gagaggtgaaaggatagtttga

SEQ ID NO: 9309741 - DNA, 22 bp, Homo sapiens
gagaggtgaaatagttgtccgg

SEQ ID NO: 9309742 - DNA, 22 bp, Homo sapiens
gagaggtgaaaggatagtttga

SEQ ID NO: 9309743 - DNA, 22 bp, Homo sapiens
gagaggtcggggacactgcaaa

SEQ ID NO: 9309744 - DNA, 22 bp, Homo sapiens
gagaggtgaatgtggatgccac

SEQ ID NO: 9309745 - DNA, 22 bp, Homo sapiens
gagaggtgaaggctgccctggg

SEQ ID NO: 9309746 - DNA, 22 bp, Homo sapiens
gagaggtgaaggctgccctggg

SEQ ID NO: 9309747 - DNA, 22 bp, Homo sapiens
gagaggtgaaatagttgtccgg

SEQ ID NO: 9309748 - DNA, 22 bp, Homo sapiens
gagaggtgtgtttcagataaga

SEQ ID NO: 9309749 - DNA, 22 bp, Homo sapiens
gagcagctaaaattctcatgca

SEQ ID NO: 9309750 - DNA, 22 bp, Homo sapiens
gagaggaatgaggttaaggact

SEQ ID NO: 9309751 - DNA, 22 bp, Homo sapiens
gagaggaatatcattatattag

SEQ ID NO: 9309752 - DNA, 22 bp, Homo sapiens
gagaggctgaaatcacaggagc

SEQ ID NO: 9309753 - DNA, 22 bp, Homo sapiens
gagaggctgatcctgcagagaa

SEQ ID NO: 9309754 - DNA, 22 bp, Homo sapiens
gagaggctggcagtgccaggtt

SEQ ID NO: 9309755 - DNA, 19 bp, Homo sapiens
gagcgcagagggcagggga

SEQ ID NO: 9309756 - DNA, 20 bp, Homo sapiens
gagcctgggaagtctaaggt

SEQ ID NO: 9309757 - DNA, 22 bp, Homo sapiens
gagcctggcctcctgcctcagc

SEQ ID NO: 9309758 - DNA, 22 bp, Homo sapiens
gagcctgggtccttccctggga

SEQ ID NO: 9309759 - DNA, 22 bp, Homo sapiens
gagcctggggaccctcctgagt

SEQ ID NO: 9309760 - DNA, 22 bp, Homo sapiens
gagcaggtctttcatggtgcat

SEQ ID NO: 9309761 - DNA, 17 bp, Homo sapiens
gagcagggatgcggttc

SEQ ID NO: 9309762 - DNA, 17 bp, Homo sapiens
gagcagggatgcggttc

SEQ ID NO: 9309763 - DNA, 17 bp, Homo sapiens
gagcagggatgcggttc

SEQ ID NO: 9309764 - DNA, 22 bp, Homo sapiens
gagcagggagacaactctggtg

SEQ ID NO: 9309765 - DNA, 22 bp, Homo sapiens
gagcagctctgggtgacccagt

SEQ ID NO: 9309766 - DNA, 22 bp, Homo sapiens
gagctggggcggatactcagct

SEQ ID NO: 9309767 - DNA, 22 bp, Homo sapiens
gagcttggggcatatggtgcta

SEQ ID NO: 9309768 - DNA, 22 bp, Homo sapiens
gagcttggtgcacagtggttaa

SEQ ID NO: 9309769 - DNA, 22 bp, Homo sapiens
gagctttaagggcactggtctt

SEQ ID NO: 9309770 - DNA, 22 bp, Homo sapiens
gagctttaggagaaggaggtca

SEQ ID NO: 9309771 - DNA, 22 bp, Homo sapiens
gagctttagctgagacctgctt

SEQ ID NO: 9309772 - DNA, 22 bp, Homo sapiens
gagctttaccttaggttctgtt

SEQ ID NO: 9309773 - DNA, 22 bp, Homo sapiens
gagctttacttctgactggtgc

SEQ ID NO: 9309774 - DNA, 22 bp, Homo sapiens
gaggaagcattgacataatctc

SEQ ID NO: 9309775 - DNA, 22 bp, Homo sapiens
gaggaagccccattgaagccag

SEQ ID NO: 9309776 - DNA, 22 bp, Homo sapiens
gaggaagccccattgaagccag

SEQ ID NO: 9309777 - DNA, 22 bp, Homo sapiens
gaggaagctgcgtggcatttca

SEQ ID NO: 9309778 - DNA, 22 bp, Homo sapiens
gaggaagatggttgagtggtcc

SEQ ID NO: 9309779 - DNA, 22 bp, Homo sapiens
gagctttgtagcaggaaggaag

SEQ ID NO: 9309780 - DNA, 22 bp, Homo sapiens
gaggaaggatttagtttgaggg

SEQ ID NO: 9309781 - DNA, 22 bp, Homo sapiens
gaggaaggatttagtttgaggg

SEQ ID NO: 9309782 - DNA, 22 bp, Homo sapiens
gaggaaggaatgcagtgtatgc

SEQ ID NO: 9309783 - DNA, 22 bp, Homo sapiens
gaggaaggaatgcagtgtatgc

SEQ ID NO: 9309784 - DNA, 22 bp, Homo sapiens
gaggaaggagggaaagcgcgcg

SEQ ID NO: 9309785 - DNA, 22 bp, Homo sapiens
atgtacaacctgcatgacagtc

SEQ ID NO: 9309786 - DNA, 22 bp, Homo sapiens
atgtaatttgccctcaagttaa

SEQ ID NO: 9309787 - DNA, 22 bp, Homo sapiens
ggccccaggcctttggtctggc

SEQ ID NO: 9309788 - DNA, 22 bp, Homo sapiens
ggcgcaggccttggatcctggt

SEQ ID NO: 9309789 - DNA, 22 bp, Homo sapiens
ggcgagggagcagtgcggtggg

SEQ ID NO: 9309790 - DNA, 22 bp, Homo sapiens
ggcgagggagcagtgcggtggg

SEQ ID NO: 9309791 - DNA, 21 bp, Homo sapiens
ggccccagcccatgggttctc

SEQ ID NO: 9309792 - DNA, 22 bp, Homo sapiens
ggcccagagacgtgcaatgtac

SEQ ID NO: 9309793 - DNA, 22 bp, Homo sapiens
ggccagctcagtctccatcagg

SEQ ID NO: 9309794 - DNA, 18 bp, Homo sapiens
ggccagctcctgaggcag

SEQ ID NO: 9309795 - DNA, 22 bp, Homo sapiens
ggccagctacccatctgcgtca

SEQ ID NO: 9309796 - DNA, 22 bp, Homo sapiens
ggccagctcagactccacttgc

SEQ ID NO: 9309797 - DNA, 22 bp, Homo sapiens
ggccagctccttggcagtgcct

SEQ ID NO: 9309798 - DNA, 22 bp, Homo sapiens
cacccagcttttgcatcctccg

SEQ ID NO: 9309799 - DNA, 22 bp, Homo sapiens
ggccactgtttcctgggcagtt

SEQ ID NO: 9309800 - DNA, 20 bp, Homo sapiens
caccaagctaaggttacttt

SEQ ID NO: 9309801 - DNA, 19 bp, Homo sapiens
cacattttgagtctgagat

SEQ ID NO: 9309802 - DNA, 22 bp, Homo sapiens
cacatttgggacaggagataaa

SEQ ID NO: 9309803 - DNA, 22 bp, Homo sapiens
cacatttgaaggaattagcatt

SEQ ID NO: 9309804 - DNA, 22 bp, Homo sapiens
ggcaggtgtggtgaccagagat

SEQ ID NO: 9309805 - DNA, 20 bp, Homo sapiens
ggcaggacccggtagggagc

SEQ ID NO: 9309806 - DNA, 22 bp, Homo sapiens
ggcaggactctcaggaccaagc

SEQ ID NO: 9309807 - DNA, 20 bp, Homo sapiens
ggcaggacccggtagggagc

SEQ ID NO: 9309808 - DNA, 20 bp, Homo sapiens
ggcaggacccggtagggagc

SEQ ID NO: 9309809 - DNA, 20 bp, Homo sapiens
ggcaggaccccagtggcatc

SEQ ID NO: 9309810 - DNA, 22 bp, Homo sapiens
ggcaggacattgactacagtga

SEQ ID NO: 9309811 - DNA, 22 bp, Homo sapiens
ggcaggacagtcccagttcaaa

SEQ ID NO: 9309812 - DNA, 22 bp, Homo sapiens
ggcaggactgatcagtgggatg

SEQ ID NO: 9309813 - DNA, 22 bp, Homo sapiens
ggcaggagaaaggtctcttctt

SEQ ID NO: 9309814 - DNA, 22 bp, Homo sapiens
ggagtctgcggcagacactgta

SEQ ID NO: 9309815 - DNA, 22 bp, Homo sapiens
ggagtctgctcccagacatgat

SEQ ID NO: 9309816 - DNA, 22 bp, Homo sapiens
ggagtctgggaattggagagaa

SEQ ID NO: 9309817 - DNA, 22 bp, Homo sapiens
ggaggtggaggttgcagtgagc

SEQ ID NO: 9309818 - DNA, 22 bp, Homo sapiens
ggagtctgggaattggagagaa

SEQ ID NO: 9309819 - DNA, 22 bp, Homo sapiens
ggagtctggagtggggcccaag

SEQ ID NO: 9309820 - DNA, 21 bp, Homo sapiens
ggagtctgtggatgctgtttc

SEQ ID NO: 9309821 - DNA, 22 bp, Homo sapiens
ggagtctgttttacatgcagga

SEQ ID NO: 9309822 - DNA, 22 bp, Homo sapiens
ggagtctgttttacatgcagga

SEQ ID NO: 9309823 - DNA, 22 bp, Homo sapiens
ggagtcttggcctgctgagaaa

SEQ ID NO: 9309824 - DNA, 22 bp, Homo sapiens
ggagtcttaaaaatcaaatgga

SEQ ID NO: 9309825 - DNA, 22 bp, Homo sapiens
ggagtcttcagatagagtattt

SEQ ID NO: 9309826 - DNA, 22 bp, Homo sapiens
ggagtgactctcggggccacta

SEQ ID NO: 9309827 - DNA, 22 bp, Homo sapiens
ggcaggaagaggagggtgaact

SEQ ID NO: 9309828 - DNA, 22 bp, Homo sapiens
ggcaggaaaacaatgagccagg

SEQ ID NO: 9309829 - DNA, 22 bp, Homo sapiens
ggatccagaggtgaagatggga

SEQ ID NO: 9309830 - DNA, 22 bp, Homo sapiens
ggatccagtccagggctgtgtg

SEQ ID NO: 9309831 - DNA, 22 bp, Homo sapiens
ggatatatgcatgttatcattt

SEQ ID NO: 9309832 - DNA, 21 bp, Homo sapiens
ggataaatggtctggtttctc

SEQ ID NO: 9309833 - DNA, 23 bp, Homo sapiens
ggataaatctcagcttcttccat

SEQ ID NO: 9309834 - DNA, 19 bp, Homo sapiens
ggatccagaggatctgcca

SEQ ID NO: 9309835 - DNA, 22 bp, Homo sapiens
ggctgcagatagccagccacca

SEQ ID NO: 9309836 - DNA, 22 bp, Homo sapiens
ggctgcagaggcgatctgaggt

SEQ ID NO: 9309837 - DNA, 22 bp, Homo sapiens
cactgcctccccaggctccaca

SEQ ID NO: 9309838 - DNA, 22 bp, Homo sapiens
ggctgcagccctcgcctagcca

SEQ ID NO: 9309839 - DNA, 22 bp, Homo sapiens
ggctgcagcagagggactcacg

SEQ ID NO: 9309840 - DNA, 22 bp, Homo sapiens
ggctgcagattgtagtctgtta

SEQ ID NO: 9309841 - DNA, 22 bp, Homo sapiens
ggctgcggatctaaggctggga

SEQ ID NO: 9309842 - DNA, 22 bp, Homo sapiens
ggctgctcctttaccctggcag

SEQ ID NO: 9309843 - DNA, 18 bp, Homo sapiens
ggctgctcctctccctac

SEQ ID NO: 9309844 - DNA, 22 bp, Homo sapiens
ggctgccttgaccctggctccg

SEQ ID NO: 9309845 - DNA, 22 bp, Homo sapiens
ggctgcctcaaagctcaagctc

SEQ ID NO: 9309846 - DNA, 22 bp, Homo sapiens
ggcgctcagtgttgccccagag

SEQ ID NO: 9309847 - DNA, 22 bp, Homo sapiens
cactgaggcttccttaggcaat

SEQ ID NO: 9309848 - DNA, 22 bp, Homo sapiens
ggcgctctggacctggctctcg

SEQ ID NO: 9309849 - DNA, 22 bp, Homo sapiens
cactgagttccctgacatttca

SEQ ID NO: 9309850 - DNA, 20 bp, Homo sapiens
cactgaggtgcagctcatgc

SEQ ID NO: 9309851 - DNA, 21 bp, Homo sapiens
cactgaggtcaggggtagggt

SEQ ID NO: 9309852 - DNA, 22 bp, Homo sapiens
cactgcaacctccacctcctgg

SEQ ID NO: 9309853 - DNA, 22 bp, Homo sapiens
ggctccagtttccccttggggc

SEQ ID NO: 9309854 - DNA, 19 bp, Homo sapiens
ggctcctggggctcagccc

SEQ ID NO: 9309855 - DNA, 22 bp, Homo sapiens
ggctcctgtcccctcagctgct

SEQ ID NO: 9309856 - DNA, 22 bp, Homo sapiens
ggctcctgggggtgctcctgcc

SEQ ID NO: 9309857 - DNA, 22 bp, Homo sapiens
ggctcctgtcctcctggagctc

SEQ ID NO: 9309858 - DNA, 22 bp, Homo sapiens
cagaacagtcgcctgcatggat

SEQ ID NO: 9309859 - DNA, 22 bp, Homo sapiens
ggcttgaactcccaatcattta

SEQ ID NO: 9309860 - DNA, 23 bp, Homo sapiens
ggcttcttgcctgtcttggtgct

SEQ ID NO: 9309861 - DNA, 19 bp, Homo sapiens
ggcttcagggagttagcat

SEQ ID NO: 9309862 - DNA, 17 bp, Homo sapiens
ggcttcagggagctggg

SEQ ID NO: 9309863 - DNA, 17 bp, Homo sapiens
ggcttcagggagctggg

SEQ ID NO: 9309864 - DNA, 17 bp, Homo sapiens
ggcttcagggagctggg

SEQ ID NO: 9309865 - DNA, 22 bp, Homo sapiens
ggcttgcacacagcctcagttt

SEQ ID NO: 9309866 - DNA, 22 bp, Homo sapiens
ggcttgaatggatataatctgt

SEQ ID NO: 9309867 - DNA, 22 bp, Homo sapiens
ggcttgaagggaggaaagcagg

SEQ ID NO: 9309868 - DNA, 22 bp, Homo sapiens
ggcttgaagactatgacatttc

SEQ ID NO: 9309869 - DNA, 22 bp, Homo sapiens
ggcttgagacccgggagccaga

SEQ ID NO: 9309870 - DNA, 22 bp, Homo sapiens
ggcttggcagaggtgggtgctt

SEQ ID NO: 9309871 - DNA, 22 bp, Homo sapiens
cagaaatggaattttccatcac

SEQ ID NO: 9309872 - DNA, 20 bp, Homo sapiens
ggctgctggtttggctctgt

SEQ ID NO: 9309873 - DNA, 22 bp, Homo sapiens
ggctggctttctctccgcacct

SEQ ID NO: 9309874 - DNA, 22 bp, Homo sapiens
ggctgggacgatgaggattagt

SEQ ID NO: 9309875 - DNA, 22 bp, Homo sapiens
ggctgggagccccacagagtca

SEQ ID NO: 9309876 - DNA, 22 bp, Homo sapiens
ggctgggagccccacagagtca

SEQ ID NO: 9309877 - DNA, 23 bp, Homo sapiens
ggctgggagctccgggtgcacgt

SEQ ID NO: 9309878 - DNA, 22 bp, Homo sapiens
cagaacagaatcgtgtggtgag

SEQ ID NO: 9309879 - DNA, 22 bp, Homo sapiens
ggacagcatatcagcagggcag

SEQ ID NO: 9309880 - DNA, 22 bp, Homo sapiens
ggagaggttatccgtgttatgt

SEQ ID NO: 9309881 - DNA, 17 bp, Homo sapiens
ggagagtgggaatggcc

SEQ ID NO: 9309882 - DNA, 22 bp, Homo sapiens
cacagagaatactgctcttgct

SEQ ID NO: 9309883 - DNA, 22 bp, Homo sapiens
cacagagacagaagcacttatg

SEQ ID NO: 9309884 - DNA, 22 bp, Homo sapiens
cacagagacagatctattttgc

SEQ ID NO: 9309885 - DNA, 22 bp, Homo sapiens
cacagagacatgatgtcattgc

SEQ ID NO: 9309886 - DNA, 21 bp, Homo sapiens
ggacaattgttcattttcttt

SEQ ID NO: 9309887 - DNA, 22 bp, Homo sapiens
ggacaaatctcattatttctga

SEQ ID NO: 9309888 - DNA, 22 bp, Homo sapiens
ggacaaattccctatttgcatg

SEQ ID NO: 9309889 - DNA, 22 bp, Homo sapiens
ggaaggggtcacctcctgatga

SEQ ID NO: 9309890 - DNA, 22 bp, Homo sapiens
ggaacaggaaaggagggatgct

SEQ ID NO: 9309891 - DNA, 22 bp, Homo sapiens
ggaacactgccttttattttcc

SEQ ID NO: 9309892 - DNA, 22 bp, Homo sapiens
ggaacagccagctcagtttcag

SEQ ID NO: 9309893 - DNA, 18 bp, Homo sapiens
ggaacagctcagggcagc

SEQ ID NO: 9309894 - DNA, 20 bp, Homo sapiens
ggagctggcatccagcctct

SEQ ID NO: 9309895 - DNA, 22 bp, Homo sapiens
ggagcagcttgcatgctcaggg

SEQ ID NO: 9309896 - DNA, 22 bp, Homo sapiens
ggagcagcttgcatgctcaggg

SEQ ID NO: 9309897 - DNA, 22 bp, Homo sapiens
cacagcagggatgaatggagtg

SEQ ID NO: 9309898 - DNA, 22 bp, Homo sapiens
cacagcaggcagaacgtgggca

SEQ ID NO: 9309899 - DNA, 22 bp, Homo sapiens
cacaggagaaaggggaagctcg

SEQ ID NO: 9309900 - DNA, 18 bp, Homo sapiens
cacaggagatgacctgac

SEQ ID NO: 9309901 - DNA, 22 bp, Homo sapiens
cacaggagaggttaatgggggc

SEQ ID NO: 9309902 - DNA, 22 bp, Homo sapiens
cacaggagagctgggaggtgcc

SEQ ID NO: 9309903 - DNA, 22 bp, Homo sapiens
cacaggagagctgggaggtgcc

SEQ ID NO: 9309904 - DNA, 22 bp, Homo sapiens
ggagggcaacttttcagtaggt

SEQ ID NO: 9309905 - DNA, 19 bp, Homo sapiens
gctgaggtggaggaaggag

SEQ ID NO: 9309906 - DNA, 16 bp, Homo sapiens
gctggagggaggggtt

SEQ ID NO: 9309907 - DNA, 22 bp, Homo sapiens
gctggcagcattagaccctggg

SEQ ID NO: 9309908 - DNA, 22 bp, Homo sapiens
gctggcagagctctgggctggg

SEQ ID NO: 9309909 - DNA, 22 bp, Homo sapiens
gctggcagcattagaccctggg

SEQ ID NO: 9309910 - DNA, 23 bp, Homo sapiens
gctgaggtcctgctgagtggtgg

SEQ ID NO: 9309911 - DNA, 20 bp, Homo sapiens
gctgaggtcattatgcctca

SEQ ID NO: 9309912 - DNA, 22 bp, Homo sapiens
caaattgctaactgtcagacta

SEQ ID NO: 9309913 - DNA, 22 bp, Homo sapiens
caaattgcttgtctgtagtgga

SEQ ID NO: 9309914 - DNA, 21 bp, Homo sapiens
gctgggcctgtacttgccctg

SEQ ID NO: 9309915 - DNA, 22 bp, Homo sapiens
gctgggccccatccctcgagca

SEQ ID NO: 9309916 - DNA, 22 bp, Homo sapiens
gctgggcccagatcccaggatc

SEQ ID NO: 9309917 - DNA, 22 bp, Homo sapiens
gctggccatagaagccaaagag

SEQ ID NO: 9309918 - DNA, 21 bp, Homo sapiens
gctggctgtctcttacacggt

SEQ ID NO: 9309919 - DNA, 21 bp, Homo sapiens
gctggctgtctcttacacggt

SEQ ID NO: 9309920 - DNA, 22 bp, Homo sapiens
gctgggagccccgagccagcgc

SEQ ID NO: 9309921 - DNA, 22 bp, Homo sapiens
ggaaatggtggaggaaggctta

SEQ ID NO: 9309922 - DNA, 22 bp, Homo sapiens
ggaaaattggcgcgtggggctg

SEQ ID NO: 9309923 - DNA, 22 bp, Homo sapiens
ggaaaatttccttcaaaatgtg

SEQ ID NO: 9309924 - DNA, 22 bp, Homo sapiens
gcttccagggctcagtcactgc

SEQ ID NO: 9309925 - DNA, 20 bp, Homo sapiens
gcttccaggagggctgatat

SEQ ID NO: 9309926 - DNA, 22 bp, Homo sapiens
gcttccagcaaacactggctgc

SEQ ID NO: 9309927 - DNA, 22 bp, Homo sapiens
caatggctttatgtatcatctc

SEQ ID NO: 9309928 - DNA, 22 bp, Homo sapiens
gcttccagagactgagctcttc

SEQ ID NO: 9309929 - DNA, 22 bp, Homo sapiens
gcttccagatcccatgctctta

SEQ ID NO: 9309930 - DNA, 22 bp, Homo sapiens
caatgtatcaaccagaaagttc

SEQ ID NO: 9309931 - DNA, 23 bp, Homo sapiens
gcttccagaagactcattgacat

SEQ ID NO: 9309932 - DNA, 20 bp, Homo sapiens
gcttccacctgaagcgcacc

SEQ ID NO: 9309933 - DNA, 22 bp, Homo sapiens
gctggtcctcaagggcacagcc

SEQ ID NO: 9309934 - DNA, 22 bp, Homo sapiens
caagttacattagaaatcatgc

SEQ ID NO: 9309935 - DNA, 22 bp, Homo sapiens
caagtgggacctgtctgattcc

SEQ ID NO: 9309936 - DNA, 22 bp, Homo sapiens
caagtggggcagattctcttcc

SEQ ID NO: 9309937 - DNA, 22 bp, Homo sapiens
caagtgtgactattttttcata

SEQ ID NO: 9309938 - DNA, 22 bp, Homo sapiens
gggctcaggtcagggcatcagc

SEQ ID NO: 9309939 - DNA, 22 bp, Homo sapiens
gggctcaggtcagggcatcagc

SEQ ID NO: 9309940 - DNA, 22 bp, Homo sapiens
gggctcaggcctggcctctcac

SEQ ID NO: 9309941 - DNA, 22 bp, Homo sapiens
gggctcaggagtttgaggctgc

SEQ ID NO: 9309942 - DNA, 22 bp, Homo sapiens
gggctcaggagtttgaggctgc

SEQ ID NO: 9309943 - DNA, 22 bp, Homo sapiens
gggctcagtcggcaagcccctt

SEQ ID NO: 9309944 - DNA, 22 bp, Homo sapiens
gggctcagtctgcggcgcgcgg

SEQ ID NO: 9309945 - DNA, 22 bp, Homo sapiens
gggctcagtctggcgtggaatg

SEQ ID NO: 9309946 - DNA, 21 bp, Homo sapiens
cagagcttgctgagaggcctg

SEQ ID NO: 9309947 - DNA, 22 bp, Homo sapiens
cagaggaaagtatttctggaag

SEQ ID NO: 9309948 - DNA, 22 bp, Homo sapiens
cagagcttttagatgttgaaca

SEQ ID NO: 9309949 - DNA, 22 bp, Homo sapiens
cagaggaacgtttggattgatt

SEQ ID NO: 9309950 - DNA, 22 bp, Homo sapiens
cagaggcagaccctccagggcg

SEQ ID NO: 9309951 - DNA, 22 bp, Homo sapiens
cagaggcagccgggggagaacg

SEQ ID NO: 9309952 - DNA, 22 bp, Homo sapiens
cagaggcagccgggggagaacg

SEQ ID NO: 9309953 - DNA, 22 bp, Homo sapiens
cagaggcaggaagatgggcagt

SEQ ID NO: 9309954 - DNA, 22 bp, Homo sapiens
cagaggcaggaagatgggcagt

SEQ ID NO: 9309955 - DNA, 22 bp, Homo sapiens
cagaggcagccgggggagaacg

SEQ ID NO: 9309956 - DNA, 22 bp, Homo sapiens
cagaggaagctgggtgtggagt

SEQ ID NO: 9309957 - DNA, 22 bp, Homo sapiens
cagaggaagttccttgatgaga

SEQ ID NO: 9309958 - DNA, 22 bp, Homo sapiens
cagaggaaggctctgggaatgt

SEQ ID NO: 9309959 - DNA, 22 bp, Homo sapiens
cagagacagtttcacagggtct

SEQ ID NO: 9309960 - DNA, 22 bp, Homo sapiens
cagaagcaagtagtgattcttt

SEQ ID NO: 9309961 - DNA, 20 bp, Homo sapiens
cagaagcaaggcaggtacct

SEQ ID NO: 9309962 - DNA, 18 bp, Homo sapiens
cagagcagaggtggagcg

SEQ ID NO: 9309963 - DNA, 22 bp, Homo sapiens
cagagcagcctccagggggagc

SEQ ID NO: 9309964 - DNA, 22 bp, Homo sapiens
cagagcagcagagcttccatgg

SEQ ID NO: 9309965 - DNA, 22 bp, Homo sapiens
cagagcagcctccagggggagc

SEQ ID NO: 9309966 - DNA, 21 bp, Homo sapiens
cagagagctagaacttcatga

SEQ ID NO: 9309967 - DNA, 20 bp, Homo sapiens
cagataaacgggaaagaagc

SEQ ID NO: 9309968 - DNA, 22 bp, Homo sapiens
cagataggaaaagctaggcata

SEQ ID NO: 9309969 - DNA, 22 bp, Homo sapiens
ggtgcagaagaaagcagtcatt

SEQ ID NO: 9309970 - DNA, 22 bp, Homo sapiens
ggtgcagaggagccagctgggg

SEQ ID NO: 9309971 - DNA, 22 bp, Homo sapiens
ggtgcagagcagtgtcagagca

SEQ ID NO: 9309972 - DNA, 22 bp, Homo sapiens
ggtgcagaaggaagggagctgg

SEQ ID NO: 9309973 - DNA, 22 bp, Homo sapiens
ggtgcagcctttgtttctactt

SEQ ID NO: 9309974 - DNA, 22 bp, Homo sapiens
ggggtctgcgccactgtctgcg

SEQ ID NO: 9309975 - DNA, 22 bp, Homo sapiens
ggggtctgggcttagctggaat

SEQ ID NO: 9309976 - DNA, 22 bp, Homo sapiens
ggggtctgggttgctcggcctt

SEQ ID NO: 9309977 - DNA, 22 bp, Homo sapiens
cagagtggtgcaagggcagtgt

SEQ ID NO: 9309978 - DNA, 22 bp, Homo sapiens
cagagtggtgcaagggcagtgt

SEQ ID NO: 9309979 - DNA, 22 bp, Homo sapiens
cagagtggtgcaagggcagtgt

SEQ ID NO: 9309980 - DNA, 22 bp, Homo sapiens
cagaggctgccagccatgtgca

SEQ ID NO: 9309981 - DNA, 22 bp, Homo sapiens
cagaggctgccagccatgtgca

SEQ ID NO: 9309982 - DNA, 22 bp, Homo sapiens
cagaggctgccagccatgtgca

SEQ ID NO: 9309983 - DNA, 22 bp, Homo sapiens
cagaggctgatgtgggatgggc

SEQ ID NO: 9309984 - DNA, 22 bp, Homo sapiens
cagaggctgatggctgtagcca

SEQ ID NO: 9309985 - DNA, 21 bp, Homo sapiens
cagaggctgagagggcaatct

SEQ ID NO: 9309986 - DNA, 21 bp, Homo sapiens
cagaggctgagagggcaatct

SEQ ID NO: 9309987 - DNA, 22 bp, Homo sapiens
cagaggctgatggctgtagcca

SEQ ID NO: 9309988 - DNA, 22 bp, Homo sapiens
cagaggctgaccctgctgttgt

SEQ ID NO: 9309989 - DNA, 22 bp, Homo sapiens
cagaggcaggataagaactgcg

SEQ ID NO: 9309990 - DNA, 20 bp, Homo sapiens
cagcagagacccatggggag

SEQ ID NO: 9309991 - DNA, 22 bp, Homo sapiens
gtaagcagaggttaatgttaac

SEQ ID NO: 9309992 - DNA, 22 bp, Homo sapiens
gtaagcacatgtgtgtgcatgg

SEQ ID NO: 9309993 - DNA, 20 bp, Homo sapiens
cagcagagacccatggggag

SEQ ID NO: 9309994 - DNA, 22 bp, Homo sapiens
cagcactatgacatttaattct

SEQ ID NO: 9309995 - DNA, 22 bp, Homo sapiens
cagcactaggatatacatttcc

SEQ ID NO: 9309996 - DNA, 22 bp, Homo sapiens
ggtgggaaggccactgaaggtt

SEQ ID NO: 9309997 - DNA, 22 bp, Homo sapiens
ggtgggaaggccactgaaggtt

SEQ ID NO: 9309998 - DNA, 18 bp, Homo sapiens
ggtgggaagccagggcct

SEQ ID NO: 9309999 - DNA, 22 bp, Homo sapiens
ggtgggaaggccactgaaggtt

SEQ ID NO: 9310000 - DNA, 18 bp, Homo sapiens
ggtgggaagccagggcct

SEQ ID NO: 9310001 - DNA, 22 bp, Homo sapiens
ggtggcagtagcactgggcctg

SEQ ID NO: 9310002 - DNA, 22 bp, Homo sapiens
ggtggcagtagcactgggcctg

SEQ ID NO: 9310003 - DNA, 22 bp, Homo sapiens
ggtggcagggagtgtccctggg

SEQ ID NO: 9310004 - DNA, 22 bp, Homo sapiens
cagatgcttttgattctggggt

SEQ ID NO: 9310005 - DNA, 22 bp, Homo sapiens
ggtgctggttcagggtggctgt

SEQ ID NO: 9310006 - DNA, 22 bp, Homo sapiens
cagatggattttgtaggctgat

SEQ ID NO: 9310007 - DNA, 22 bp, Homo sapiens
cagatggcaacagctctgtgac

SEQ ID NO: 9310008 - DNA, 22 bp, Homo sapiens
gtgctgaggccaatgtcagggt

SEQ ID NO: 9310009 - DNA, 22 bp, Homo sapiens
gtgctgaggccaatgtcagggt

SEQ ID NO: 9310010 - DNA, 22 bp, Homo sapiens
cagctcagcttcctgggtgtgt

SEQ ID NO: 9310011 - DNA, 21 bp, Homo sapiens
cagctccactaaagcagctgt

SEQ ID NO: 9310012 - DNA, 21 bp, Homo sapiens
cagctccactaaagcagctgt

SEQ ID NO: 9310013 - DNA, 22 bp, Homo sapiens
cagctcccagtggcagctcctt

SEQ ID NO: 9310014 - DNA, 22 bp, Homo sapiens
cagctcccagagtgaccagcag

SEQ ID NO: 9310015 - DNA, 22 bp, Homo sapiens
cagctcccagaactgaccatgt

SEQ ID NO: 9310016 - DNA, 22 bp, Homo sapiens
cagctccagcctgacaccaaga

SEQ ID NO: 9310017 - DNA, 23 bp, Homo sapiens
cagctccagtgcactcaggtagc

SEQ ID NO: 9310018 - DNA, 22 bp, Homo sapiens
gtgctgagaattgatgtccttg

SEQ ID NO: 9310019 - DNA, 22 bp, Homo sapiens
gtgctgagatcttccctcactg

SEQ ID NO: 9310020 - DNA, 22 bp, Homo sapiens
gtgcctggtttggggagtgttc

SEQ ID NO: 9310021 - DNA, 22 bp, Homo sapiens
gtgcctggtttggggagtgttc

SEQ ID NO: 9310022 - DNA, 22 bp, Homo sapiens
gtgcctggtatgtaggtagcgg

SEQ ID NO: 9310023 - DNA, 22 bp, Homo sapiens
gtgcctggtttggggaatgttc

SEQ ID NO: 9310024 - DNA, 22 bp, Homo sapiens
gtgcctggtatgtaggtagcgg

SEQ ID NO: 9310025 - DNA, 22 bp, Homo sapiens
gtgcctggggttgagctatgaa

SEQ ID NO: 9310026 - DNA, 22 bp, Homo sapiens
gtgctgaggatacagctgtgaa

SEQ ID NO: 9310027 - DNA, 22 bp, Homo sapiens
gtgctgaggagagggggtggtc

SEQ ID NO: 9310028 - DNA, 22 bp, Homo sapiens
gtgctgagcacaaggcccagag

SEQ ID NO: 9310029 - DNA, 22 bp, Homo sapiens
gtgctgagcacagctgcccagg

SEQ ID NO: 9310030 - DNA, 22 bp, Homo sapiens
gtgcctgggacacgagattttc

SEQ ID NO: 9310031 - DNA, 22 bp, Homo sapiens
gtgcctgggacacagcagatac

SEQ ID NO: 9310032 - DNA, 22 bp, Homo sapiens
gtgcctgggacttgctccggat

SEQ ID NO: 9310033 - DNA, 22 bp, Homo sapiens
gtgcctgggacttgctccggat

SEQ ID NO: 9310034 - DNA, 22 bp, Homo sapiens
gtgcctgggcatgagcttgttg

SEQ ID NO: 9310035 - DNA, 22 bp, Homo sapiens
gtgcctgggggtaatgtaggat

SEQ ID NO: 9310036 - DNA, 22 bp, Homo sapiens
gtgcctgggggtaatgtaggat

SEQ ID NO: 9310037 - DNA, 22 bp, Homo sapiens
cagcccttgtttctaaagctgc

SEQ ID NO: 9310038 - DNA, 22 bp, Homo sapiens
gtgcatggccagggtggtctgg

SEQ ID NO: 9310039 - DNA, 22 bp, Homo sapiens
gtgcaggagcttctggcctgac

SEQ ID NO: 9310040 - DNA, 17 bp, Homo sapiens
cagctctgcagacttcc

SEQ ID NO: 9310041 - DNA, 22 bp, Homo sapiens
cagctcctcagccctgccttgg

SEQ ID NO: 9310042 - DNA, 22 bp, Homo sapiens
cagctcctctggccagccctgc

SEQ ID NO: 9310043 - DNA, 22 bp, Homo sapiens
cagctcccctctgtggggcagt

SEQ ID NO: 9310044 - DNA, 22 bp, Homo sapiens
cagctcccgccatcgggaggca

SEQ ID NO: 9310045 - DNA, 22 bp, Homo sapiens
cagctccccatggttcctgaag

SEQ ID NO: 9310046 - DNA, 22 bp, Homo sapiens
cagctccctatggtgaggcgac

SEQ ID NO: 9310047 - DNA, 20 bp, Homo sapiens
gtctccactgggggttaacc

SEQ ID NO: 9310048 - DNA, 22 bp, Homo sapiens
gtctctgttatttccagggtca

SEQ ID NO: 9310049 - DNA, 22 bp, Homo sapiens
gtctctgggttaagcagtgcat

SEQ ID NO: 9310050 - DNA, 22 bp, Homo sapiens
gtctctggctttatgctggttt

SEQ ID NO: 9310051 - DNA, 18 bp, Homo sapiens
gtctttggagtggaggta

SEQ ID NO: 9310052 - DNA, 20 bp, Homo sapiens
gtgaagggagtcaggtgtgc

SEQ ID NO: 9310053 - DNA, 22 bp, Homo sapiens
gtctttctgctgcacggactgc

SEQ ID NO: 9310054 - DNA, 22 bp, Homo sapiens
gtctgttagtgataactgtttt

SEQ ID NO: 9310055 - DNA, 22 bp, Homo sapiens
gtgcaaaatgatatcctgaagc

SEQ ID NO: 9310056 - DNA, 22 bp, Homo sapiens
gtgcaggagccaggggtaggaa

SEQ ID NO: 9310057 - DNA, 22 bp, Homo sapiens
gtgcaggagcaggagccatgtc

SEQ ID NO: 9310058 - DNA, 22 bp, Homo sapiens
gtgcaaaagtaattgctgtttt

SEQ ID NO: 9310059 - DNA, 22 bp, Homo sapiens
gtgcaaaagtcattgtggtttt

SEQ ID NO: 9310060 - DNA, 22 bp, Homo sapiens
gtgcaaaagtaattgcggtttt

SEQ ID NO: 9310061 - DNA, 22 bp, Homo sapiens
gtgcaaaagtaattgtggtttt

SEQ ID NO: 9310062 - DNA, 22 bp, Homo sapiens
gtgcaaaagtacttgcggattt

SEQ ID NO: 9310063 - DNA, 22 bp, Homo sapiens
gtgcaaaagtaattgcagtact

SEQ ID NO: 9310064 - DNA, 22 bp, Homo sapiens
gtgcaaaagtaattgcagtttt

SEQ ID NO: 9310065 - DNA, 22 bp, Homo sapiens
gtgcaaaagtaatggcagtttt

SEQ ID NO: 9310066 - DNA, 22 bp, Homo sapiens
gtgaatgactgttttcagcatt

SEQ ID NO: 9310067 - DNA, 22 bp, Homo sapiens
gtgaatgatagcttctctttgg

SEQ ID NO: 9310068 - DNA, 22 bp, Homo sapiens
gtgaatgacatattttgtactg

SEQ ID NO: 9310069 - DNA, 22 bp, Homo sapiens
gtgaatgaaaggatgattcttt

SEQ ID NO: 9310070 - DNA, 22 bp, Homo sapiens
gtcctgagtcaagtgtgggcag

SEQ ID NO: 9310071 - DNA, 22 bp, Homo sapiens
gtcctgaggcaggatgggtttc

SEQ ID NO: 9310072 - DNA, 22 bp, Homo sapiens
gtcctgagggcccaggcattct

SEQ ID NO: 9310073 - DNA, 22 bp, Homo sapiens
gtcctgaggatgcagagataaa

SEQ ID NO: 9310074 - DNA, 22 bp, Homo sapiens
gtcctgaggatgcagagataaa

SEQ ID NO: 9310075 - DNA, 22 bp, Homo sapiens
gtcctgagccctcagcacagca

SEQ ID NO: 9310076 - DNA, 18 bp, Homo sapiens
gtcctgagctctgctgta

SEQ ID NO: 9310077 - DNA, 22 bp, Homo sapiens
gtcctgagccctcagcacagca

SEQ ID NO: 9310078 - DNA, 18 bp, Homo sapiens
gtcctgagctctgctgta

SEQ ID NO: 9310079 - DNA, 22 bp, Homo sapiens
gtcctgagagaggctccttgcc

SEQ ID NO: 9310080 - DNA, 22 bp, Homo sapiens
gtcctgagagaggctccttgcc

SEQ ID NO: 9310081 - DNA, 22 bp, Homo sapiens
gtcctgagaatactaggcacaa

SEQ ID NO: 9310082 - DNA, 22 bp, Homo sapiens
gtcctgagaccatggccttagt

SEQ ID NO: 9310083 - DNA, 22 bp, Homo sapiens
gtcctgagatgtcacaaggttt

SEQ ID NO: 9310084 - DNA, 22 bp, Homo sapiens
gtcctgagattggaaccataaa

SEQ ID NO: 9310085 - DNA, 22 bp, Homo sapiens
gtcctgagccacatactatcca

SEQ ID NO: 9310086 - DNA, 22 bp, Homo sapiens
gtcctgagcattaagcaattgt

SEQ ID NO: 9310087 - DNA, 22 bp, Homo sapiens
gtcctgagatgtcacaaggttt

SEQ ID NO: 9310088 - DNA, 22 bp, Homo sapiens
cagcagtggtgtatttgaggct

SEQ ID NO: 9310089 - DNA, 22 bp, Homo sapiens
cagcagtggctgcaggcagctg

SEQ ID NO: 9310090 - DNA, 21 bp, Homo sapiens
gtctcacaaggtggcttacgt

SEQ ID NO: 9310091 - DNA, 22 bp, Homo sapiens
gtctcacacagagtagattttg

SEQ ID NO: 9310092 - DNA, 22 bp, Homo sapiens
cagcatctttataaaaagtaaa

SEQ ID NO: 9310093 - DNA, 22 bp, Homo sapiens
cagcaggtgtctagcaagggtc

SEQ ID NO: 9310094 - DNA, 22 bp, Homo sapiens
cagcaggtgggctttgcggatg

SEQ ID NO: 9310095 - DNA, 22 bp, Homo sapiens
cagcaggtgtctagcaagggtc

SEQ ID NO: 9310096 - DNA, 22 bp, Homo sapiens
cagcaggttaacagaggctggt

SEQ ID NO: 9310097 - DNA, 22 bp, Homo sapiens
cagcaggtcccactgagggccc

SEQ ID NO: 9310098 - DNA, 22 bp, Homo sapiens
cagcagggttaagtgactcacc

SEQ ID NO: 9310099 - DNA, 22 bp, Homo sapiens
tcacactctgcgggtgaccttt

SEQ ID NO: 9310100 - DNA, 22 bp, Homo sapiens
tcacaccttgctggctgagtgc

SEQ ID NO: 9310101 - DNA, 22 bp, Homo sapiens
tcacaccttttagaattactat

SEQ ID NO: 9310102 - DNA, 22 bp, Homo sapiens
cagtgcagttggtggcaggggt

SEQ ID NO: 9310103 - DNA, 22 bp, Homo sapiens
cagtgcaggtttagggctgggg

SEQ ID NO: 9310104 - DNA, 22 bp, Homo sapiens
cagtctggactcaggcatacct

SEQ ID NO: 9310105 - DNA, 22 bp, Homo sapiens
cagtctggaggtcagctggctt

SEQ ID NO: 9310106 - DNA, 22 bp, Homo sapiens
cagtctggatctgtgctgctgt

SEQ ID NO: 9310107 - DNA, 22 bp, Homo sapiens
cagtctgggactgagctccacc

SEQ ID NO: 9310108 - DNA, 22 bp, Homo sapiens
tcaaattagtggaataataatg

SEQ ID NO: 9310109 - DNA, 22 bp, Homo sapiens
tcaaatgccagtggtgtggatc

SEQ ID NO: 9310110 - DNA, 22 bp, Homo sapiens
cagtcttctgagaaggcaaggg

SEQ ID NO: 9310111 - DNA, 22 bp, Homo sapiens
tcaaaggagtttaagttactgg

SEQ ID NO: 9310112 - DNA, 22 bp, Homo sapiens
tcaaaggagacacaaggagaaa

SEQ ID NO: 9310113 - DNA, 22 bp, Homo sapiens
tattccgtggtgccaggtagta

SEQ ID NO: 9310114 - DNA, 22 bp, Homo sapiens
tattcctatttctaaacatatg

SEQ ID NO: 9310115 - DNA, 22 bp, Homo sapiens
tattcctcccagtaagtacaac

SEQ ID NO: 9310116 - DNA, 22 bp, Homo sapiens
tcaaaacctaggctctctgctt

SEQ ID NO: 9310117 - DNA, 22 bp, Homo sapiens
tcaaagcactggggaaagcctg

SEQ ID NO: 9310118 - DNA, 22 bp, Homo sapiens
tcaaagcaatttcaccagtgcc

SEQ ID NO: 9310119 - DNA, 22 bp, Homo sapiens
tattcccattccacttatcaag

SEQ ID NO: 9310120 - DNA, 22 bp, Homo sapiens
tattcccagcacatggccattt

SEQ ID NO: 9310121 - DNA, 22 bp, Homo sapiens
cagtagcagggattattttagg

SEQ ID NO: 9310122 - DNA, 22 bp, Homo sapiens
cagtagcatgcaccaggagggt

SEQ ID NO: 9310123 - DNA, 22 bp, Homo sapiens
cagtagcactagatatgtgtgg

SEQ ID NO: 9310124 - DNA, 22 bp, Homo sapiens
cagtagcacctatgattttgta

SEQ ID NO: 9310125 - DNA, 20 bp, Homo sapiens
cagtagcaataattagaagc

SEQ ID NO: 9310126 - DNA, 22 bp, Homo sapiens
cagtagcaggcaggtgcttttg

SEQ ID NO: 9310127 - DNA, 22 bp, Homo sapiens
cagtagcaggcactcagcacgt

SEQ ID NO: 9310128 - DNA, 22 bp, Homo sapiens
cagtagcactctgtcagtgaag

SEQ ID NO: 9310129 - DNA, 22 bp, Homo sapiens
cagtagcaggatttgggattat

SEQ ID NO: 9310130 - DNA, 22 bp, Homo sapiens
tatgaagacaatgatagcatga

SEQ ID NO: 9310131 - DNA, 22 bp, Homo sapiens
tatgatattctaaattgacacc

SEQ ID NO: 9310132 - DNA, 22 bp, Homo sapiens
tatgatattctaaattgacacc

SEQ ID NO: 9310133 - DNA, 22 bp, Homo sapiens
tatgatattctaaattgacacc

SEQ ID NO: 9310134 - DNA, 22 bp, Homo sapiens
tatgatatgcactttatcagaa

SEQ ID NO: 9310135 - DNA, 22 bp, Homo sapiens
tatgatatgcactttatcagaa

SEQ ID NO: 9310136 - DNA, 22 bp, Homo sapiens
tatgatttgtagacatttgatt

SEQ ID NO: 9310137 - DNA, 22 bp, Homo sapiens
tatgatgtgtacctaagtcacc

SEQ ID NO: 9310138 - DNA, 22 bp, Homo sapiens
tatgcaaacagttcaggtgaca

SEQ ID NO: 9310139 - DNA, 22 bp, Homo sapiens
tatgcaaagtcctaagaaagaa

SEQ ID NO: 9310140 - DNA, 22 bp, Homo sapiens
tatgcaaatcattagatttcct

SEQ ID NO: 9310141 - DNA, 22 bp, Homo sapiens
tatattccttttggcagggact

SEQ ID NO: 9310142 - DNA, 22 bp, Homo sapiens
tatattgaaatgattcagccct

SEQ ID NO: 9310143 - DNA, 22 bp, Homo sapiens
tatattctttcaccttcttcct

SEQ ID NO: 9310144 - DNA, 22 bp, Homo sapiens
tatattctttcaccttcttcct

SEQ ID NO: 9310145 - DNA, 22 bp, Homo sapiens
tatgtacatgatttcatttgct

SEQ ID NO: 9310146 - DNA, 22 bp, Homo sapiens
cagtaaaaatgttgtcaaggca

SEQ ID NO: 9310147 - DNA, 22 bp, Homo sapiens
cagtaaaagatggaaatagaat

SEQ ID NO: 9310148 - DNA, 22 bp, Homo sapiens
tatgcacacatgtatgcatgtg

SEQ ID NO: 9310149 - DNA, 22 bp, Homo sapiens
caggtggcttattagggtcagt

SEQ ID NO: 9310150 - DNA, 22 bp, Homo sapiens
caggtgggcgtggcgagaaggc

SEQ ID NO: 9310151 - DNA, 22 bp, Homo sapiens
caggtgggcgtggcgagaaggc

SEQ ID NO: 9310152 - DNA, 22 bp, Homo sapiens
caggtgggcttgggagaacact

SEQ ID NO: 9310153 - DNA, 22 bp, Homo sapiens
caggtgggcttgggagaacact

SEQ ID NO: 9310154 - DNA, 22 bp, Homo sapiens
caggtggggagagtgtggagca

SEQ ID NO: 9310155 - DNA, 22 bp, Homo sapiens
caggtggggcagctgtgggagc

SEQ ID NO: 9310156 - DNA, 22 bp, Homo sapiens
caggtggggcagctgtgggagc

SEQ ID NO: 9310157 - DNA, 22 bp, Homo sapiens
caggtggggcgccctcaggcag

SEQ ID NO: 9310158 - DNA, 22 bp, Homo sapiens
tatgtacatcgttgaattcaaa

SEQ ID NO: 9310159 - DNA, 22 bp, Homo sapiens
cagggctgagtcatatagcctt

SEQ ID NO: 9310160 - DNA, 22 bp, Homo sapiens
cagggctgaggacacaagtaaa

SEQ ID NO: 9310161 - DNA, 22 bp, Homo sapiens
cagggctgagaatttagagaca

SEQ ID NO: 9310162 - DNA, 19 bp, Homo sapiens
tagtacaaaagcagccata

SEQ ID NO: 9310163 - DNA, 22 bp, Homo sapiens
cagggctgctggccgtgccctc

SEQ ID NO: 9310164 - DNA, 22 bp, Homo sapiens
cagggctggatcctccagactc

SEQ ID NO: 9310165 - DNA, 22 bp, Homo sapiens
tagtaacttttgttataaatca

SEQ ID NO: 9310166 - DNA, 22 bp, Homo sapiens
tagtaagcacatggacaagtgg

SEQ ID NO: 9310167 - DNA, 22 bp, Homo sapiens
tagtaagcctctccagagacag

SEQ ID NO: 9310168 - DNA, 22 bp, Homo sapiens
cagggccaccctctgctgggtg

SEQ ID NO: 9310169 - DNA, 22 bp, Homo sapiens
tatataatttgtaaaagcacct

SEQ ID NO: 9310170 - DNA, 22 bp, Homo sapiens
tatataactactattttgctca

SEQ ID NO: 9310171 - DNA, 22 bp, Homo sapiens
tatatatatgcacacacaccta

SEQ ID NO: 9310172 - DNA, 22 bp, Homo sapiens
tatattcaatgattagtatcag

SEQ ID NO: 9310173 - DNA, 22 bp, Homo sapiens
tatatagaaaagcagatgttgg

SEQ ID NO: 9310174 - DNA, 22 bp, Homo sapiens
tagtttctagtaacaaacccat

SEQ ID NO: 9310175 - DNA, 22 bp, Homo sapiens
tagtttcttgattagccacttt

SEQ ID NO: 9310176 - DNA, 22 bp, Homo sapiens
tacagagagaggggttaccagg

SEQ ID NO: 9310177 - DNA, 22 bp, Homo sapiens
tacagcctcgaactcctgcatt

SEQ ID NO: 9310178 - DNA, 22 bp, Homo sapiens
caggcctgtctgcacatgaggc

SEQ ID NO: 9310179 - DNA, 22 bp, Homo sapiens
caggcctgtgagttgaggcccc

SEQ ID NO: 9310180 - DNA, 22 bp, Homo sapiens
caggccttgcagtctgttgtaa

SEQ ID NO: 9310181 - DNA, 22 bp, Homo sapiens
caggccttgcgtcccatggcct

SEQ ID NO: 9310182 - DNA, 22 bp, Homo sapiens
caggccttgagttttgggcttt

SEQ ID NO: 9310183 - DNA, 22 bp, Homo sapiens
caggccttgggacccagactgg

SEQ ID NO: 9310184 - DNA, 22 bp, Homo sapiens
caggccttgaaggcctgcggga

SEQ ID NO: 9310185 - DNA, 22 bp, Homo sapiens
caggccttatctccaccctgca

SEQ ID NO: 9310186 - DNA, 17 bp, Homo sapiens
caggccttgagccttta

SEQ ID NO: 9310187 - DNA, 22 bp, Homo sapiens
caggccttaaggactcggagaa

SEQ ID NO: 9310188 - DNA, 22 bp, Homo sapiens
caggccttagtaggtgctccct

SEQ ID NO: 9310189 - DNA, 22 bp, Homo sapiens
caggccttctccctccctcaac

SEQ ID NO: 9310190 - DNA, 22 bp, Homo sapiens
caggctcccaccctcctgcagc

SEQ ID NO: 9310191 - DNA, 22 bp, Homo sapiens
caggctcccacttggcttaaag

SEQ ID NO: 9310192 - DNA, 22 bp, Homo sapiens
caggctcccgaaatcacccatg

SEQ ID NO: 9310193 - DNA, 22 bp, Homo sapiens
caggctccattaatcatcctgc

SEQ ID NO: 9310194 - DNA, 22 bp, Homo sapiens
caggctcccacaagctcccagc

SEQ ID NO: 9310195 - DNA, 22 bp, Homo sapiens
caggctcccacaagctcccagc

SEQ ID NO: 9310196 - DNA, 22 bp, Homo sapiens
caggctccagcttcctgctcag

SEQ ID NO: 9310197 - DNA, 22 bp, Homo sapiens
caggctccactgtaggcagctc

SEQ ID NO: 9310198 - DNA, 22 bp, Homo sapiens
caggctcaatggccacttgggc

SEQ ID NO: 9310199 - DNA, 22 bp, Homo sapiens
caggctcaatggccacttgggc

SEQ ID NO: 9310200 - DNA, 22 bp, Homo sapiens
caggctcaaggctgacttccat

SEQ ID NO: 9310201 - DNA, 22 bp, Homo sapiens
tacagtttctgtccttgtggag

SEQ ID NO: 9310202 - DNA, 22 bp, Homo sapiens
tacagtttccaagggcttgaag

SEQ ID NO: 9310203 - DNA, 22 bp, Homo sapiens
caggctccctgccagggccggc

SEQ ID NO: 9310204 - DNA, 22 bp, Homo sapiens
caggctccctgcaggccagtga

SEQ ID NO: 9310205 - DNA, 22 bp, Homo sapiens
caggctccctgcaggccagtga

SEQ ID NO: 9310206 - DNA, 22 bp, Homo sapiens
caggctccctgggcagtggcag

SEQ ID NO: 9310207 - DNA, 22 bp, Homo sapiens
caggctccctgggcagtggcag

SEQ ID NO: 9310208 - DNA, 22 bp, Homo sapiens
caggctcccttctcggaattct

SEQ ID NO: 9310209 - DNA, 22 bp, Homo sapiens
caggctccctaagtcagcagcc

SEQ ID NO: 9310210 - DNA, 22 bp, Homo sapiens
caggctccctaagtcagcagcc

SEQ ID NO: 9310211 - DNA, 23 bp, Homo sapiens
caggctcccggaccaggatccgc

SEQ ID NO: 9310212 - DNA, 22 bp, Homo sapiens
caggctcccgctccactgggca

SEQ ID NO: 9310213 - DNA, 20 bp, Homo sapiens
caggctccgcaggactaggg

SEQ ID NO: 9310214 - DNA, 22 bp, Homo sapiens
caggctcctcactcatgctccc

SEQ ID NO: 9310215 - DNA, 22 bp, Homo sapiens
caggctccttatcttacaactt

SEQ ID NO: 9310216 - DNA, 17 bp, Homo sapiens
caggctccttccagatt

SEQ ID NO: 9310217 - DNA, 22 bp, Homo sapiens
caggctccttcccagggatggt

SEQ ID NO: 9310218 - DNA, 22 bp, Homo sapiens
caggctccttcccagggatggt

SEQ ID NO: 9310219 - DNA, 19 bp, Homo sapiens
tacacttgtaatgagcaga

SEQ ID NO: 9310220 - DNA, 22 bp, Homo sapiens
caggccaatttcttgtcattta

SEQ ID NO: 9310221 - DNA, 22 bp, Homo sapiens
caggccacaagttgggttcaag

SEQ ID NO: 9310222 - DNA, 22 bp, Homo sapiens
caggccacacggcggctccctg

SEQ ID NO: 9310223 - DNA, 22 bp, Homo sapiens
caggcccagggagggagaccaa

SEQ ID NO: 9310224 - DNA, 22 bp, Homo sapiens
caggccacgccccggcgtgtga

SEQ ID NO: 9310225 - DNA, 22 bp, Homo sapiens
tacacagatttcagtatcatca

SEQ ID NO: 9310226 - DNA, 22 bp, Homo sapiens
tacacagatttaaaagcaggga

SEQ ID NO: 9310227 - DNA, 22 bp, Homo sapiens
tacacaggggagcatggttgac

SEQ ID NO: 9310228 - DNA, 22 bp, Homo sapiens
tacacagggtatggcttgagga

SEQ ID NO: 9310229 - DNA, 22 bp, Homo sapiens
tacacagatatgtgatcaatca

SEQ ID NO: 9310230 - DNA, 22 bp, Homo sapiens
tacacagaggctgatgtcttag

SEQ ID NO: 9310231 - DNA, 22 bp, Homo sapiens
tacacagactcttcaattcaga

SEQ ID NO: 9310232 - DNA, 22 bp, Homo sapiens
tacacagaggcagctgtctgct

SEQ ID NO: 9310233 - DNA, 22 bp, Homo sapiens
tacacagagactcaaaagggca

SEQ ID NO: 9310234 - DNA, 22 bp, Homo sapiens
tacacagaagccagaaggcctg

SEQ ID NO: 9310235 - DNA, 22 bp, Homo sapiens
tacaatagggcttttgtttatg

SEQ ID NO: 9310236 - DNA, 23 bp, Homo sapiens
gtggagccacatcacaggctcct

SEQ ID NO: 9310237 - DNA, 22 bp, Homo sapiens
cagctctgccatcatctgcctt

SEQ ID NO: 9310238 - DNA, 22 bp, Homo sapiens
cagggagcggagtcccatgcct

SEQ ID NO: 9310239 - DNA, 22 bp, Homo sapiens
cagggagctttgtcttctcatt

SEQ ID NO: 9310240 - DNA, 22 bp, Homo sapiens
cagggagctttcccaggaccct

SEQ ID NO: 9310241 - DNA, 22 bp, Homo sapiens
cagggatggcctggcgggccac

SEQ ID NO: 9310242 - DNA, 22 bp, Homo sapiens
tagcagcaaaatgaccttctaa

SEQ ID NO: 9310243 - DNA, 22 bp, Homo sapiens
tagcagcaaagcaggatctgct

SEQ ID NO: 9310244 - DNA, 22 bp, Homo sapiens
tagcagcaattacacagtccgt

SEQ ID NO: 9310245 - DNA, 22 bp, Homo sapiens
tagcagcaattcaggtgtgatg

SEQ ID NO: 9310246 - DNA, 22 bp, Homo sapiens
tagcagcaagaatgggatgtgt

SEQ ID NO: 9310247 - DNA, 22 bp, Homo sapiens
tagcagcacagaaagcctggag

SEQ ID NO: 9310248 - DNA, 22 bp, Homo sapiens
tagcagcacaaatggactatga

SEQ ID NO: 9310249 - DNA, 22 bp, Homo sapiens
tagcagcaatttcagaagtttg

SEQ ID NO: 9310250 - DNA, 22 bp, Homo sapiens
cagggatgctgcttaggcagtt

SEQ ID NO: 9310251 - DNA, 22 bp, Homo sapiens
tagcattagagatagaaatagt

SEQ ID NO: 9310252 - DNA, 22 bp, Homo sapiens
tagcattaaaggtaagacatta

SEQ ID NO: 9310253 - DNA, 20 bp, Homo sapiens
tagcatgggtgagggtagag

SEQ ID NO: 9310254 - DNA, 20 bp, Homo sapiens
tagcagcagaaagaacttag

SEQ ID NO: 9310255 - DNA, 18 bp, Homo sapiens
tagcagcactggccgctt

SEQ ID NO: 9310256 - DNA, 22 bp, Homo sapiens
tagcagcacatggtggttttat

SEQ ID NO: 9310257 - DNA, 22 bp, Homo sapiens
tagcagcacctacacgtcagag

SEQ ID NO: 9310258 - DNA, 22 bp, Homo sapiens
tagcagcactatttgttgtagt

SEQ ID NO: 9310259 - DNA, 22 bp, Homo sapiens
tagcagcacctttctaatctga

SEQ ID NO: 9310260 - DNA, 22 bp, Homo sapiens
cagggcagtaccgccctctggc

SEQ ID NO: 9310261 - DNA, 22 bp, Homo sapiens
cagggcagtttgtgcctatgag

SEQ ID NO: 9310262 - DNA, 22 bp, Homo sapiens
cagggcagtgaagaacacacgt

SEQ ID NO: 9310263 - DNA, 22 bp, Homo sapiens
cagggcagttttacttctctct

SEQ ID NO: 9310264 - DNA, 22 bp, Homo sapiens
cagggcataagatgaggctgta

SEQ ID NO: 9310265 - DNA, 22 bp, Homo sapiens
cagggcataagatgaggctgta

SEQ ID NO: 9310266 - DNA, 22 bp, Homo sapiens
cagggcattacttcaggtcctt

SEQ ID NO: 9310267 - DNA, 22 bp, Homo sapiens
cagggcattacttcaggtcctt

SEQ ID NO: 9310268 - DNA, 22 bp, Homo sapiens
cagggagaagtctggtcagtcc

SEQ ID NO: 9310269 - DNA, 22 bp, Homo sapiens
cagggagaagtctggtcagtcc

SEQ ID NO: 9310270 - DNA, 22 bp, Homo sapiens
cagggacagccttggggtggcg

SEQ ID NO: 9310271 - DNA, 22 bp, Homo sapiens
tagaacacttgaccactgctcc

SEQ ID NO: 9310272 - DNA, 22 bp, Homo sapiens
tagaaagcagttgtgggggctc

SEQ ID NO: 9310273 - DNA, 22 bp, Homo sapiens
tagaaagcagtatctccatttt

SEQ ID NO: 9310274 - DNA, 22 bp, Homo sapiens
tagaaatgtgataatagcttaa

SEQ ID NO: 9310275 - DNA, 22 bp, Homo sapiens
tagaaatgttggtattaacatt

SEQ ID NO: 9310276 - DNA, 22 bp, Homo sapiens
caggctgcagaggcctttcatg

SEQ ID NO: 9310277 - DNA, 22 bp, Homo sapiens
caggctgcaagaaaggcattca

SEQ ID NO: 9310278 - DNA, 17 bp, Homo sapiens
caggctccttccagatt

SEQ ID NO: 9310279 - DNA, 22 bp, Homo sapiens
caggctgcagcagcagtggccc

SEQ ID NO: 9310280 - DNA, 22 bp, Homo sapiens
tagaaagaacttcatgtaaaac

SEQ ID NO: 9310281 - DNA, 22 bp, Homo sapiens
tacctaggctctgatctcctgg

SEQ ID NO: 9310282 - DNA, 22 bp, Homo sapiens
tagaaagcagaaaccatcagag

SEQ ID NO: 9310283 - DNA, 22 bp, Homo sapiens
tagaaagcaaaatcctaccaag

SEQ ID NO: 9310284 - DNA, 22 bp, Homo sapiens
catcctgaagaagccgcactgt

SEQ ID NO: 9310285 - DNA, 22 bp, Homo sapiens
catcctgacaagaaagccagaa

SEQ ID NO: 9310286 - DNA, 22 bp, Homo sapiens
catcctgaaagaaacatttcct

SEQ ID NO: 9310287 - DNA, 22 bp, Homo sapiens
catcctagaaaaccctatggaa

SEQ ID NO: 9310288 - DNA, 22 bp, Homo sapiens
catccctgtctgccactctgaa

SEQ ID NO: 9310289 - DNA, 22 bp, Homo sapiens
catcctgagaggtctctctacc

SEQ ID NO: 9310290 - DNA, 22 bp, Homo sapiens
catcctgagaaaataaaggaga

SEQ ID NO: 9310291 - DNA, 22 bp, Homo sapiens
catcctgactgtaactaagaga

SEQ ID NO: 9310292 - DNA, 22 bp, Homo sapiens
catcctgactgggtaaagctta

SEQ ID NO: 9310293 - DNA, 22 bp, Homo sapiens
catcctgacccatgggagggga

SEQ ID NO: 9310294 - DNA, 22 bp, Homo sapiens
tcatcactcattggacaacaga

SEQ ID NO: 9310295 - DNA, 22 bp, Homo sapiens
catcagtggtaactgaatggtt

SEQ ID NO: 9310296 - DNA, 22 bp, Homo sapiens
catcagttcccaggcccagaca

SEQ ID NO: 9310297 - DNA, 22 bp, Homo sapiens
catcagtgcccttggggatgcc

SEQ ID NO: 9310298 - DNA, 22 bp, Homo sapiens
catcatatggaatttaaagtca

SEQ ID NO: 9310299 - DNA, 22 bp, Homo sapiens
tcaggcagagctgtggagctct

SEQ ID NO: 9310300 - DNA, 22 bp, Homo sapiens
tcaggcagaggatggggagcgt

SEQ ID NO: 9310301 - DNA, 22 bp, Homo sapiens
tcaggcagaggatggggagcgt

SEQ ID NO: 9310302 - DNA, 22 bp, Homo sapiens
tcaggcagaccaccgtgggcag

SEQ ID NO: 9310303 - DNA, 22 bp, Homo sapiens
catcaaagcttttttctgtgtt

SEQ ID NO: 9310304 - DNA, 19 bp, Homo sapiens
catatttttgggctggcat

SEQ ID NO: 9310305 - DNA, 22 bp, Homo sapiens
catcaaagttggtatatttgca

SEQ ID NO: 9310306 - DNA, 22 bp, Homo sapiens
catcagagtcagagctctttct

SEQ ID NO: 9310307 - DNA, 19 bp, Homo sapiens
catcaagtggagtatctcg

SEQ ID NO: 9310308 - DNA, 23 bp, Homo sapiens
catcaagtacttttgacaagtgt

SEQ ID NO: 9310309 - DNA, 22 bp, Homo sapiens
tcaggaggccaccaggacctgt

SEQ ID NO: 9310310 - DNA, 22 bp, Homo sapiens
tcaggaggcgtctcgctggggc

SEQ ID NO: 9310311 - DNA, 22 bp, Homo sapiens
tcaggagggagtgtggatagag

SEQ ID NO: 9310312 - DNA, 22 bp, Homo sapiens
tcaggcagaaaaatcactaatt

SEQ ID NO: 9310313 - DNA, 22 bp, Homo sapiens
tcaggcagaattatcaaaagat

SEQ ID NO: 9310314 - DNA, 22 bp, Homo sapiens
tcactgttgacctggaagtggg

SEQ ID NO: 9310315 - DNA, 22 bp, Homo sapiens
tcacttcacacccactatcatg

SEQ ID NO: 9310316 - DNA, 22 bp, Homo sapiens
tcactgtttgcagtgaagagaa

SEQ ID NO: 9310317 - DNA, 22 bp, Homo sapiens
tcacttaaaaattctagttatg

SEQ ID NO: 9310318 - DNA, 22 bp, Homo sapiens
tcacttagatggggatcatcac

SEQ ID NO: 9310319 - DNA, 22 bp, Homo sapiens
cattacaaccccaaattacaaa

SEQ ID NO: 9310320 - DNA, 22 bp, Homo sapiens
tccagggcagggtgcgcatggg

SEQ ID NO: 9310321 - DNA, 22 bp, Homo sapiens
tccagggcagggtgcgcatggg

SEQ ID NO: 9310322 - DNA, 23 bp, Homo sapiens
tccagggcagtggctgggtctgc

SEQ ID NO: 9310323 - DNA, 22 bp, Homo sapiens
tccagggcagtgactacagcgg

SEQ ID NO: 9310324 - DNA, 22 bp, Homo sapiens
tccagggcagtgactacagcgg

SEQ ID NO: 9310325 - DNA, 22 bp, Homo sapiens
tccagggcaggtgctgggctct

SEQ ID NO: 9310326 - DNA, 22 bp, Homo sapiens
tccagggcaggtgctgggctct

SEQ ID NO: 9310327 - DNA, 22 bp, Homo sapiens
cattacaaacatgttaagattt

SEQ ID NO: 9310328 - DNA, 22 bp, Homo sapiens
cattaatattgttcttctttag

SEQ ID NO: 9310329 - DNA, 22 bp, Homo sapiens
cattaataaacatttcagaaga

SEQ ID NO: 9310330 - DNA, 22 bp, Homo sapiens
tccagggcatggggagagagtg

SEQ ID NO: 9310331 - DNA, 22 bp, Homo sapiens
tccagggcatgctcagactcag

SEQ ID NO: 9310332 - DNA, 22 bp, Homo sapiens
tccagggcatgctcagactcag

SEQ ID NO: 9310333 - DNA, 23 bp, Homo sapiens
tccagggcagtggctgggtctgc

SEQ ID NO: 9310334 - DNA, 22 bp, Homo sapiens
tccagggcatccacgcgtgggg

SEQ ID NO: 9310335 - DNA, 22 bp, Homo sapiens
tccagggtcagaagtcacatac

SEQ ID NO: 9310336 - DNA, 22 bp, Homo sapiens
tccaggtcccagactgggcagc

SEQ ID NO: 9310337 - DNA, 22 bp, Homo sapiens
tccaggtccagaggttcaactg

SEQ ID NO: 9310338 - DNA, 22 bp, Homo sapiens
tccaggtcatcttggagagctg

SEQ ID NO: 9310339 - DNA, 22 bp, Homo sapiens
tccaggctttggggcaggagcg

SEQ ID NO: 9310340 - DNA, 22 bp, Homo sapiens
tccaggctttggggcaggagcg

SEQ ID NO: 9310341 - DNA, 22 bp, Homo sapiens
tccaggcttgagaccaggctct

SEQ ID NO: 9310342 - DNA, 22 bp, Homo sapiens
tccaggctgtgcatgagtttag

SEQ ID NO: 9310343 - DNA, 22 bp, Homo sapiens
tccaggctgtgcgcaccgtgtg

SEQ ID NO: 9310344 - DNA, 22 bp, Homo sapiens
tccaggcttcacgtctgccctc

SEQ ID NO: 9310345 - DNA, 22 bp, Homo sapiens
catgctccagctccagacaggt

SEQ ID NO: 9310346 - DNA, 22 bp, Homo sapiens
tccaagaatcagtctcttttgg

SEQ ID NO: 9310347 - DNA, 22 bp, Homo sapiens
tccaagaatcactgacacagct

SEQ ID NO: 9310348 - DNA, 22 bp, Homo sapiens
tccaagaatacagatttgtgaa

SEQ ID NO: 9310349 - DNA, 22 bp, Homo sapiens
tccaagaagcttacaatctaat

SEQ ID NO: 9310350 - DNA, 23 bp, Homo sapiens
tccaagaagtagggcctggactt

SEQ ID NO: 9310351 - DNA, 22 bp, Homo sapiens
tccaagaagtcatctaaactgt

SEQ ID NO: 9310352 - DNA, 16 bp, Homo sapiens
tccaagaagtgcccct

SEQ ID NO: 9310353 - DNA, 22 bp, Homo sapiens
tccaagaagtttcgttaaatgt

SEQ ID NO: 9310354 - DNA, 22 bp, Homo sapiens
tccaagaagtttatgttgtttc

SEQ ID NO: 9310355 - DNA, 22 bp, Homo sapiens
tccaagcactgttaattaaact

SEQ ID NO: 9310356 - DNA, 18 bp, Homo sapiens
tccagaggtgttggagcc

SEQ ID NO: 9310357 - DNA, 22 bp, Homo sapiens
tccagagttgtaagtgttgaca

SEQ ID NO: 9310358 - DNA, 18 bp, Homo sapiens
tccagaggtgttggagcc

SEQ ID NO: 9310359 - DNA, 19 bp, Homo sapiens
catggtgaaaccccgtctc

SEQ ID NO: 9310360 - DNA, 22 bp, Homo sapiens
catgtaaagcacttcataacag

SEQ ID NO: 9310361 - DNA, 22 bp, Homo sapiens
tccagcacagaatttcctagct

SEQ ID NO: 9310362 - DNA, 20 bp, Homo sapiens
tccagcaccctcacagagaa

SEQ ID NO: 9310363 - DNA, 22 bp, Homo sapiens
tccagcagaaaagaggtaggga

SEQ ID NO: 9310364 - DNA, 22 bp, Homo sapiens
tccagcagaaccagagacctgg

SEQ ID NO: 9310365 - DNA, 22 bp, Homo sapiens
ccagaggtcccctgccaggagg

SEQ ID NO: 9310366 - DNA, 22 bp, Homo sapiens
ccagaggtcctgctcactggtg

SEQ ID NO: 9310367 - DNA, 22 bp, Homo sapiens
ccagaggtgaacaggaggctgt

SEQ ID NO: 9310368 - DNA, 22 bp, Homo sapiens
ccagaggtgagggggattcttg

SEQ ID NO: 9310369 - DNA, 22 bp, Homo sapiens
ccagaggtcctgtgatgctgca

SEQ ID NO: 9310370 - DNA, 22 bp, Homo sapiens
ccagaggtcctgtgatgctgca

SEQ ID NO: 9310371 - DNA, 22 bp, Homo sapiens
ccagaggtctcctgcacgggat

SEQ ID NO: 9310372 - DNA, 22 bp, Homo sapiens
ccagaggtctctctatactggg

SEQ ID NO: 9310373 - DNA, 22 bp, Homo sapiens
ccagagggccctggtctcagct

SEQ ID NO: 9310374 - DNA, 22 bp, Homo sapiens
ccagagggcctttggagttatc

SEQ ID NO: 9310375 - DNA, 22 bp, Homo sapiens
ccagaggggctgagcaggtcac

SEQ ID NO: 9310376 - DNA, 22 bp, Homo sapiens
tctctgtaagagaggctttcat

SEQ ID NO: 9310377 - DNA, 22 bp, Homo sapiens
tctctgtaagctgccttctcgt

SEQ ID NO: 9310378 - DNA, 20 bp, Homo sapiens
tctctgtaaatcttctttta

SEQ ID NO: 9310379 - DNA, 22 bp, Homo sapiens
tctctgtagcagcttccttcct

SEQ ID NO: 9310380 - DNA, 21 bp, Homo sapiens
tctctgtatccatgggttcca

SEQ ID NO: 9310381 - DNA, 22 bp, Homo sapiens
ccagatgttcccctggaggcct

SEQ ID NO: 9310382 - DNA, 20 bp, Homo sapiens
ccagagcagccactgaagtt

SEQ ID NO: 9310383 - DNA, 19 bp, Homo sapiens
ccagagcccgccagatggg

SEQ ID NO: 9310384 - DNA, 22 bp, Homo sapiens
ccagagcccagggtcatgcagg

SEQ ID NO: 9310385 - DNA, 22 bp, Homo sapiens
ccagagcccgggacctggactt

SEQ ID NO: 9310386 - DNA, 22 bp, Homo sapiens
ccagagcccgggacctggactt

SEQ ID NO: 9310387 - DNA, 22 bp, Homo sapiens
ccagagcccgggacctggactt

SEQ ID NO: 9310388 - DNA, 22 bp, Homo sapiens
ccagagccggctccctcagctt

SEQ ID NO: 9310389 - DNA, 22 bp, Homo sapiens
ccagagccggctccctcagctt

SEQ ID NO: 9310390 - DNA, 22 bp, Homo sapiens
ccagagggacgttaccagttca

SEQ ID NO: 9310391 - DNA, 22 bp, Homo sapiens
ccagaggctggggaaggataca

SEQ ID NO: 9310392 - DNA, 22 bp, Homo sapiens
ccagaggctggggaaggataca

SEQ ID NO: 9310393 - DNA, 22 bp, Homo sapiens
ccagaggctggcagccagctga

SEQ ID NO: 9310394 - DNA, 22 bp, Homo sapiens
ccagagcctaagatctgatcct

SEQ ID NO: 9310395 - DNA, 22 bp, Homo sapiens
ccagagcctcgcccggagcctc

SEQ ID NO: 9310396 - DNA, 22 bp, Homo sapiens
tctcagtgggaagggcacagtt

SEQ ID NO: 9310397 - DNA, 22 bp, Homo sapiens
tctcagagacctgaactccctg

SEQ ID NO: 9310398 - DNA, 22 bp, Homo sapiens
tctcagagaagtgatgagcaat

SEQ ID NO: 9310399 - DNA, 22 bp, Homo sapiens
tctataaattatgcagtctcag

SEQ ID NO: 9310400 - DNA, 22 bp, Homo sapiens
tcctgtgtgtcagatgcacagt

SEQ ID NO: 9310401 - DNA, 22 bp, Homo sapiens
tcctgtgtgggcaggatgagaa

SEQ ID NO: 9310402 - DNA, 22 bp, Homo sapiens
tcctgtgtgctttctttaggtt

SEQ ID NO: 9310403 - DNA, 20 bp, Homo sapiens
tcctgtgtgtctcatcaacc

SEQ ID NO: 9310404 - DNA, 22 bp, Homo sapiens
tcctgtgtaaatagatctggtt

SEQ ID NO: 9310405 - DNA, 20 bp, Homo sapiens
ccaccctccaggaacacata

SEQ ID NO: 9310406 - DNA, 22 bp, Homo sapiens
ccacccctgtagagggacagac

SEQ ID NO: 9310407 - DNA, 19 bp, Homo sapiens
ccacccctttgctgggccc

SEQ ID NO: 9310408 - DNA, 22 bp, Homo sapiens
ccacccctgggtgcagggagcg

SEQ ID NO: 9310409 - DNA, 22 bp, Homo sapiens
ccacccatgtgactacctcatg

SEQ ID NO: 9310410 - DNA, 22 bp, Homo sapiens
tctagaatactgtgacatgcca

SEQ ID NO: 9310411 - DNA, 22 bp, Homo sapiens
tcctgtttcaacccttacactg

SEQ ID NO: 9310412 - DNA, 22 bp, Homo sapiens
tcctgtttatctgtgtgactcg

SEQ ID NO: 9310413 - DNA, 22 bp, Homo sapiens
tcctgtttccaatttgttgggt

SEQ ID NO: 9310414 - DNA, 22 bp, Homo sapiens
tcctgtttctcctgcaaaatcc

SEQ ID NO: 9310415 - DNA, 17 bp, Homo sapiens
tcctgtttatcattgat

SEQ ID NO: 9310416 - DNA, 22 bp, Homo sapiens
tcctgtttaggctgtggtctgg

SEQ ID NO: 9310417 - DNA, 22 bp, Homo sapiens
tcctgtgttcaagtcattcatt

SEQ ID NO: 9310418 - DNA, 22 bp, Homo sapiens
tcctgtgttctaggtatggtct

SEQ ID NO: 9310419 - DNA, 22 bp, Homo sapiens
tcctgtgttgatagagatggtt

SEQ ID NO: 9310420 - DNA, 22 bp, Homo sapiens
tcctgtgttacccttgcagtga

SEQ ID NO: 9310421 - DNA, 22 bp, Homo sapiens
tcctgtgttaaagggggtgcta

SEQ ID NO: 9310422 - DNA, 22 bp, Homo sapiens
tcctgccttagagcaaggaaaa

SEQ ID NO: 9310423 - DNA, 21 bp, Homo sapiens
tcctgccttagtccagagcag

SEQ ID NO: 9310424 - DNA, 22 bp, Homo sapiens
ccaagaggttgaggctgcagtg

SEQ ID NO: 9310425 - DNA, 19 bp, Homo sapiens
tcctgcccaccagccaggg

SEQ ID NO: 9310426 - DNA, 22 bp, Homo sapiens
ccaagaggtatcttgccataaa

SEQ ID NO: 9310427 - DNA, 22 bp, Homo sapiens
tcctgccttgcctgggacatca

SEQ ID NO: 9310428 - DNA, 22 bp, Homo sapiens
tcctgccttcatactgctgtat

SEQ ID NO: 9310429 - DNA, 22 bp, Homo sapiens
tcctgcggttcatgctcattct

SEQ ID NO: 9310430 - DNA, 22 bp, Homo sapiens
tcctgctctgatgggttctcct

SEQ ID NO: 9310431 - DNA, 23 bp, Homo sapiens
ccaagactgttaggagtggggag

SEQ ID NO: 9310432 - DNA, 22 bp, Homo sapiens
ccaagagccatcctggtcaaca

SEQ ID NO: 9310433 - DNA, 22 bp, Homo sapiens
ccaagaggcagaatgcagagaa

SEQ ID NO: 9310434 - DNA, 22 bp, Homo sapiens
ccaacaggtgttctgtttttca

SEQ ID NO: 9310435 - DNA, 22 bp, Homo sapiens
ccaacctgaggcaggctgcagc

SEQ ID NO: 9310436 - DNA, 22 bp, Homo sapiens
tcctgaggtggattgagcagag

SEQ ID NO: 9310437 - DNA, 22 bp, Homo sapiens
tcctgaggtggattgagcagag

SEQ ID NO: 9310438 - DNA, 22 bp, Homo sapiens
tcctgaggtatatgctttgcag

SEQ ID NO: 9310439 - DNA, 22 bp, Homo sapiens
tcctgaggtctgaaaaaggagc

SEQ ID NO: 9310440 - DNA, 22 bp, Homo sapiens
tcctgagggctgcagtcatagg

SEQ ID NO: 9310441 - DNA, 22 bp, Homo sapiens
tcctggccttgctcctgatgcc

SEQ ID NO: 9310442 - DNA, 22 bp, Homo sapiens
tcctggcctgtctggagtagct

SEQ ID NO: 9310443 - DNA, 22 bp, Homo sapiens
ccacaggcggagtggcgggcag

SEQ ID NO: 9310444 - DNA, 22 bp, Homo sapiens
ccacaggctgctgcaggtcccg

SEQ ID NO: 9310445 - DNA, 22 bp, Homo sapiens
ccacaggctgctgcaggtcccg

SEQ ID NO: 9310446 - DNA, 22 bp, Homo sapiens
tcctggagctggtgtctttccc

SEQ ID NO: 9310447 - DNA, 20 bp, Homo sapiens
tcctggagctgcttgaattc

SEQ ID NO: 9310448 - DNA, 22 bp, Homo sapiens
cattttggctattgtaaatagt

SEQ ID NO: 9310449 - DNA, 22 bp, Homo sapiens
tcctgaggctcactttgaatgt

SEQ ID NO: 9310450 - DNA, 22 bp, Homo sapiens
tcctgagggcattttggtgact

SEQ ID NO: 9310451 - DNA, 20 bp, Homo sapiens
tcctgaggcttcgccagtgt

SEQ ID NO: 9310452 - DNA, 22 bp, Homo sapiens
tcctgagggcgattcagcaggt

SEQ ID NO: 9310453 - DNA, 22 bp, Homo sapiens
tcctgagggcgattcagcaggt

SEQ ID NO: 9310454 - DNA, 22 bp, Homo sapiens
tcctgagggctcggggctcatg

SEQ ID NO: 9310455 - DNA, 22 bp, Homo sapiens
cattttatcctctgggaagcta

SEQ ID NO: 9310456 - DNA, 22 bp, Homo sapiens
cattttatgtttatggagtgct

SEQ ID NO: 9310457 - DNA, 22 bp, Homo sapiens
tccaggtccctggggagatttt

SEQ ID NO: 9310458 - DNA, 22 bp, Homo sapiens
catttattgagtggccacagtg

SEQ ID NO: 9310459 - DNA, 22 bp, Homo sapiens
catttcaccttagagaattatt

SEQ ID NO: 9310460 - DNA, 22 bp, Homo sapiens
tccatagaatgcagtgtaaatt

SEQ ID NO: 9310461 - DNA, 22 bp, Homo sapiens
catttcactattcactaaaagg

SEQ ID NO: 9310462 - DNA, 22 bp, Homo sapiens
catttccactctgggagtcaga

SEQ ID NO: 9310463 - DNA, 22 bp, Homo sapiens
cctctcccgggtgccgctgggc

SEQ ID NO: 9310464 - DNA, 22 bp, Homo sapiens
tgggaaggcgtggaagtagaag

SEQ ID NO: 9310465 - DNA, 22 bp, Homo sapiens
cctctcccagggagagcctgag

SEQ ID NO: 9310466 - DNA, 19 bp, Homo sapiens
cctctcccatgcttacctc

SEQ ID NO: 9310467 - DNA, 19 bp, Homo sapiens
cctctcccatgcttacctc

SEQ ID NO: 9310468 - DNA, 22 bp, Homo sapiens
cctctccagttttaacgtgacc

SEQ ID NO: 9310469 - DNA, 22 bp, Homo sapiens
cctctcccagggagagcctgag

SEQ ID NO: 9310470 - DNA, 22 bp, Homo sapiens
cctctccagcggcctcagggcc

SEQ ID NO: 9310471 - DNA, 22 bp, Homo sapiens
tggctttaggttgcatgtttct

SEQ ID NO: 9310472 - DNA, 22 bp, Homo sapiens
tggctttagggttccttctacc

SEQ ID NO: 9310473 - DNA, 20 bp, Homo sapiens
cctcctggtcaggtgtgcag

SEQ ID NO: 9310474 - DNA, 22 bp, Homo sapiens
tggcttcccaggaaaggagaag

SEQ ID NO: 9310475 - DNA, 20 bp, Homo sapiens
tggctttaagttttttgcta

SEQ ID NO: 9310476 - DNA, 22 bp, Homo sapiens
tgggagagaattctggtgactg

SEQ ID NO: 9310477 - DNA, 22 bp, Homo sapiens
cctcctgggacaggctggcaca

SEQ ID NO: 9310478 - DNA, 22 bp, Homo sapiens
cctcctctggtgctgccaaccc

SEQ ID NO: 9310479 - DNA, 22 bp, Homo sapiens
cctcctgggctcctgtctgcac

SEQ ID NO: 9310480 - DNA, 23 bp, Homo sapiens
cctcctgggcacaggcctgatgg

SEQ ID NO: 9310481 - DNA, 22 bp, Homo sapiens
cctcccacattgaggacatgct

SEQ ID NO: 9310482 - DNA, 22 bp, Homo sapiens
cctcccacattgaggacatgct

SEQ ID NO: 9310483 - DNA, 22 bp, Homo sapiens
cctcccaccgtatctcagtggc

SEQ ID NO: 9310484 - DNA, 22 bp, Homo sapiens
cctcccacatcctagctctgct

SEQ ID NO: 9310485 - DNA, 22 bp, Homo sapiens
cctcccaccatttagagagagc

SEQ ID NO: 9310486 - DNA, 19 bp, Homo sapiens
cctcccacggattccttcc

SEQ ID NO: 9310487 - DNA, 23 bp, Homo sapiens
cctcccacctatttcactttctt

SEQ ID NO: 9310488 - DNA, 23 bp, Homo sapiens
cctcccacctatttcactttctt

SEQ ID NO: 9310489 - DNA, 22 bp, Homo sapiens
cctcccaccgtatctcagtggc

SEQ ID NO: 9310490 - DNA, 19 bp, Homo sapiens
cctcccacggattccttcc

SEQ ID NO: 9310491 - DNA, 22 bp, Homo sapiens
cctcctctggtgctgccaaccc

SEQ ID NO: 9310492 - DNA, 22 bp, Homo sapiens
cctcccacttcttgctgaggtc

SEQ ID NO: 9310493 - DNA, 17 bp, Homo sapiens
cctcccacaccgccctg

SEQ ID NO: 9310494 - DNA, 22 bp, Homo sapiens
cctcccacatcctagctctgct

SEQ ID NO: 9310495 - DNA, 17 bp, Homo sapiens
cctcccacaccgccctg

SEQ ID NO: 9310496 - DNA, 22 bp, Homo sapiens
cctccatcaccatctgccctca

SEQ ID NO: 9310497 - DNA, 22 bp, Homo sapiens
cctccaggtgttacatatgact

SEQ ID NO: 9310498 - DNA, 21 bp, Homo sapiens
cctccaggtgattccgtgctc

SEQ ID NO: 9310499 - DNA, 22 bp, Homo sapiens
tggcaggtagtcagaggcgaca

SEQ ID NO: 9310500 - DNA, 19 bp, Homo sapiens
tggcaggtagtgagcagtc

SEQ ID NO: 9310501 - DNA, 22 bp, Homo sapiens
tggccaagatgcgacctctcag

SEQ ID NO: 9310502 - DNA, 22 bp, Homo sapiens
cctccaggctggttatcagctg

SEQ ID NO: 9310503 - DNA, 22 bp, Homo sapiens
tggccaagccactgctgggtct

SEQ ID NO: 9310504 - DNA, 21 bp, Homo sapiens
tggccaaggaatagaagctct

SEQ ID NO: 9310505 - DNA, 22 bp, Homo sapiens
cctccagggcccctctcactgg

SEQ ID NO: 9310506 - DNA, 22 bp, Homo sapiens
cctccagggcccctctcactgg

SEQ ID NO: 9310507 - DNA, 22 bp, Homo sapiens
cctccagggcagacggggagca

SEQ ID NO: 9310508 - DNA, 22 bp, Homo sapiens
cctccagggcagacggggagca

SEQ ID NO: 9310509 - DNA, 22 bp, Homo sapiens
cctccaggctggttatcagctg

SEQ ID NO: 9310510 - DNA, 22 bp, Homo sapiens
tggggagaagcaatagactcta

SEQ ID NO: 9310511 - DNA, 17 bp, Homo sapiens
cctgatattcaagcagc

SEQ ID NO: 9310512 - DNA, 22 bp, Homo sapiens
cctgatatggtgtcatttaaac

SEQ ID NO: 9310513 - DNA, 22 bp, Homo sapiens
cctgcagaccacactcagtcct

SEQ ID NO: 9310514 - DNA, 22 bp, Homo sapiens
cctgcagctttgcctcctgaac

SEQ ID NO: 9310515 - DNA, 22 bp, Homo sapiens
cctgcaggctgcaggccagttc

SEQ ID NO: 9310516 - DNA, 22 bp, Homo sapiens
cctgcaggctgcaggccagttc

SEQ ID NO: 9310517 - DNA, 22 bp, Homo sapiens
cctgcagggaatcgaggcagaa

SEQ ID NO: 9310518 - DNA, 22 bp, Homo sapiens
cctgcagggaatcgaggcagaa

SEQ ID NO: 9310519 - DNA, 22 bp, Homo sapiens
cctgcagggaatcgaggcagaa

SEQ ID NO: 9310520 - DNA, 23 bp, Homo sapiens
tggggagagttaccctggaagcg

SEQ ID NO: 9310521 - DNA, 22 bp, Homo sapiens
tggggagactggccgagatcct

SEQ ID NO: 9310522 - DNA, 22 bp, Homo sapiens
tggggagagattgaggagtttt

SEQ ID NO: 9310523 - DNA, 22 bp, Homo sapiens
tgggcctggccctgtggaggag

SEQ ID NO: 9310524 - DNA, 22 bp, Homo sapiens
tgggcctggccctgtggaggag

SEQ ID NO: 9310525 - DNA, 23 bp, Homo sapiens
tgggcctggcctcccagtccagc

SEQ ID NO: 9310526 - DNA, 22 bp, Homo sapiens
tgggcaggataatatctcatgt

SEQ ID NO: 9310527 - DNA, 22 bp, Homo sapiens
tgggcaggcaagtgaatacctt

SEQ ID NO: 9310528 - DNA, 22 bp, Homo sapiens
tgggcctggacatctgtatttt

SEQ ID NO: 9310529 - DNA, 22 bp, Homo sapiens
tgggcctggagccctggagagt

SEQ ID NO: 9310530 - DNA, 22 bp, Homo sapiens
tgggcctggagtttgtccagag

SEQ ID NO: 9310531 - DNA, 22 bp, Homo sapiens
tgggcctggacaaggccactag

SEQ ID NO: 9310532 - DNA, 22 bp, Homo sapiens
cctgccactgtaggtgacagtt

SEQ ID NO: 9310533 - DNA, 22 bp, Homo sapiens
cctgcaggttgcagaggcggaa

SEQ ID NO: 9310534 - DNA, 22 bp, Homo sapiens
cctgcaggttgcagaggcggaa

SEQ ID NO: 9310535 - DNA, 19 bp, Homo sapiens
cctgcagggatgagaggtt

SEQ ID NO: 9310536 - DNA, 19 bp, Homo sapiens
cctgcagggatgagaggtt

SEQ ID NO: 9310537 - DNA, 22 bp, Homo sapiens
cctgcaggggagagacttctag

SEQ ID NO: 9310538 - DNA, 22 bp, Homo sapiens
cctgcagggtgctgccacagat

SEQ ID NO: 9310539 - DNA, 19 bp, Homo sapiens
cctgcagggatgagaggtt

SEQ ID NO: 9310540 - DNA, 22 bp, Homo sapiens
tgggtgggagcaccctgtctgg

SEQ ID NO: 9310541 - DNA, 18 bp, Homo sapiens
tgggtggctagggagttt

SEQ ID NO: 9310542 - DNA, 22 bp, Homo sapiens
cctgcctcccagaggtcctcta

SEQ ID NO: 9310543 - DNA, 22 bp, Homo sapiens
cctgcctcccagaggtcctcta

SEQ ID NO: 9310544 - DNA, 19 bp, Homo sapiens
cctgcctgagctgtccctc

SEQ ID NO: 9310545 - DNA, 17 bp, Homo sapiens
cctgcctgagccatagc

SEQ ID NO: 9310546 - DNA, 22 bp, Homo sapiens
cctgcctgcaccttctctgggg

SEQ ID NO: 9310547 - DNA, 22 bp, Homo sapiens
cctgcctgcaccttctctgggg

SEQ ID NO: 9310548 - DNA, 22 bp, Homo sapiens
cctgcctgattccaggatggct

SEQ ID NO: 9310549 - DNA, 22 bp, Homo sapiens
cctgccctgtcactggctaggg

SEQ ID NO: 9310550 - DNA, 22 bp, Homo sapiens
cctgccctgtcactggctaggg

SEQ ID NO: 9310551 - DNA, 21 bp, Homo sapiens
tggtacaccttgcctgtcaga

SEQ ID NO: 9310552 - DNA, 21 bp, Homo sapiens
tggtacaccttgcctgtcaga

SEQ ID NO: 9310553 - DNA, 22 bp, Homo sapiens
cctgcccttctttccccagcat

SEQ ID NO: 9310554 - DNA, 22 bp, Homo sapiens
cctgccctgtgtttggggacta

SEQ ID NO: 9310555 - DNA, 22 bp, Homo sapiens
tggaaactagagagtttgtatt

SEQ ID NO: 9310556 - DNA, 22 bp, Homo sapiens
tggaaactgtggtatttcttta

SEQ ID NO: 9310557 - DNA, 22 bp, Homo sapiens
tggaaactctacctctctaaga

SEQ ID NO: 9310558 - DNA, 19 bp, Homo sapiens
tggaaactcctgatattag

SEQ ID NO: 9310559 - DNA, 22 bp, Homo sapiens
tggaaactgggagttaaatgta

SEQ ID NO: 9310560 - DNA, 22 bp, Homo sapiens
tggaaactgggagttaaatgta

SEQ ID NO: 9310561 - DNA, 22 bp, Homo sapiens
ccctcctcaactctggcttcca

SEQ ID NO: 9310562 - DNA, 22 bp, Homo sapiens
ccctccctttgcagcagtgcat

SEQ ID NO: 9310563 - DNA, 22 bp, Homo sapiens
ccctccctgaagaagttactct

SEQ ID NO: 9310564 - DNA, 22 bp, Homo sapiens
tggagaattctatgttgagggg

SEQ ID NO: 9310565 - DNA, 22 bp, Homo sapiens
tggagaattctatgttgagggg

SEQ ID NO: 9310566 - DNA, 22 bp, Homo sapiens
tggaggacgtgtccaccatgaa

SEQ ID NO: 9310567 - DNA, 22 bp, Homo sapiens
tggaggccaactttcctcatct

SEQ ID NO: 9310568 - DNA, 18 bp, Homo sapiens
tggagctgagggcaatgc

SEQ ID NO: 9310569 - DNA, 18 bp, Homo sapiens
tggagctgagggcaatgc

SEQ ID NO: 9310570 - DNA, 22 bp, Homo sapiens
tggagctgaggggaatgctgag

SEQ ID NO: 9310571 - DNA, 22 bp, Homo sapiens
tggcagagaacacacatgattc

SEQ ID NO: 9310572 - DNA, 22 bp, Homo sapiens
ccctggctgctaccaggtagct

SEQ ID NO: 9310573 - DNA, 22 bp, Homo sapiens
ccctggctgcgtgatggatgaa

SEQ ID NO: 9310574 - DNA, 22 bp, Homo sapiens
tggcagaatgaagactggggcc

SEQ ID NO: 9310575 - DNA, 22 bp, Homo sapiens
tggcagaaagaaccatgtgcaa

SEQ ID NO: 9310576 - DNA, 22 bp, Homo sapiens
ccctggagtagcactgggtcgc

SEQ ID NO: 9310577 - DNA, 22 bp, Homo sapiens
ccctggagtcaggttggcctgg

SEQ ID NO: 9310578 - DNA, 22 bp, Homo sapiens
ccctggaggtggaggttgcagg

SEQ ID NO: 9310579 - DNA, 22 bp, Homo sapiens
ccctggaggttgaggctgcagt

SEQ ID NO: 9310580 - DNA, 22 bp, Homo sapiens
ccctggaggtcagaggcctggg

SEQ ID NO: 9310581 - DNA, 22 bp, Homo sapiens
tggcagggaatacagatgttta

SEQ ID NO: 9310582 - DNA, 19 bp, Homo sapiens
tggcagggagagtttgaag

SEQ ID NO: 9310583 - DNA, 22 bp, Homo sapiens
tggcagggagccaccggtcatg

SEQ ID NO: 9310584 - DNA, 22 bp, Homo sapiens
ccctggcttggcactctccact

SEQ ID NO: 9310585 - DNA, 22 bp, Homo sapiens
ccctgggagctgcctggctgac

SEQ ID NO: 9310586 - DNA, 22 bp, Homo sapiens
tggcaggctgagttggcctggt

SEQ ID NO: 9310587 - DNA, 22 bp, Homo sapiens
tggcaggaaaaacattggagat

SEQ ID NO: 9310588 - DNA, 22 bp, Homo sapiens
tgctaatgtttcatttttagat

SEQ ID NO: 9310589 - DNA, 22 bp, Homo sapiens
tgcagggctaagtcagagcctg

SEQ ID NO: 9310590 - DNA, 22 bp, Homo sapiens
tgcagggctaagtcagagcctg

SEQ ID NO: 9310591 - DNA, 22 bp, Homo sapiens
tgcaggtgctccgggggtgccc

SEQ ID NO: 9310592 - DNA, 22 bp, Homo sapiens
tgcaggtgctccgggggtgccc

SEQ ID NO: 9310593 - DNA, 22 bp, Homo sapiens
tgctctgcacatccctcacaaa

SEQ ID NO: 9310594 - DNA, 18 bp, Homo sapiens
cccagtgctcactgcctc

SEQ ID NO: 9310595 - DNA, 20 bp, Homo sapiens
tgctctggaaatggtctgag

SEQ ID NO: 9310596 - DNA, 22 bp, Homo sapiens
tgctctggaatagtcctaggca

SEQ ID NO: 9310597 - DNA, 22 bp, Homo sapiens
tgctctggaccatgactatgtg

SEQ ID NO: 9310598 - DNA, 21 bp, Homo sapiens
tgctgcctgtgggtgtttacc

SEQ ID NO: 9310599 - DNA, 22 bp, Homo sapiens
tgctgcctttctgaatggtgga

SEQ ID NO: 9310600 - DNA, 22 bp, Homo sapiens
ccccaggaagcctcagatttgc

SEQ ID NO: 9310601 - DNA, 18 bp, Homo sapiens
tgctggggtagaatccac

SEQ ID NO: 9310602 - DNA, 22 bp, Homo sapiens
tgctgggggttcagatgagtaa

SEQ ID NO: 9310603 - DNA, 22 bp, Homo sapiens
tgctgggggttcagatgagtaa

SEQ ID NO: 9310604 - DNA, 22 bp, Homo sapiens
tgctgggggtgtctcaccaggc

SEQ ID NO: 9310605 - DNA, 22 bp, Homo sapiens
tgctgggggtgtctcaccaggc

SEQ ID NO: 9310606 - DNA, 22 bp, Homo sapiens
tgctgggggtgtctcaccaggc

SEQ ID NO: 9310607 - DNA, 22 bp, Homo sapiens
tgctgggggtagctctgcgtag

SEQ ID NO: 9310608 - DNA, 22 bp, Homo sapiens
tgctgggggctttctggatacc

SEQ ID NO: 9310609 - DNA, 22 bp, Homo sapiens
tgctggggctctgaccactcca

SEQ ID NO: 9310610 - DNA, 22 bp, Homo sapiens
tgctggggctctgaccactcca

SEQ ID NO: 9310611 - DNA, 22 bp, Homo sapiens
tgctgggcaccagtgcctgcag

SEQ ID NO: 9310612 - DNA, 22 bp, Homo sapiens
ccccaggagatttgggagcaca

SEQ ID NO: 9310613 - DNA, 22 bp, Homo sapiens
ccccaggagaaatcttaaacta

SEQ ID NO: 9310614 - DNA, 22 bp, Homo sapiens
ccccaggagcttgttttagaga

SEQ ID NO: 9310615 - DNA, 22 bp, Homo sapiens
tgctgttatcacattttgtaaa

SEQ ID NO: 9310616 - DNA, 16 bp, Homo sapiens
ccccaggacttggcac

SEQ ID NO: 9310617 - DNA, 22 bp, Homo sapiens
ccccaggacgtggccctcatag

SEQ ID NO: 9310618 - DNA, 22 bp, Homo sapiens
ccccaggacacatggaccaagt

SEQ ID NO: 9310619 - DNA, 22 bp, Homo sapiens
tgcttcctgctaaggctgcctg

SEQ ID NO: 9310620 - DNA, 22 bp, Homo sapiens
ccctccctctgctgggtgtaga

SEQ ID NO: 9310621 - DNA, 22 bp, Homo sapiens
ccctccctatgtagatgatgtt

SEQ ID NO: 9310622 - DNA, 22 bp, Homo sapiens
tgcttgctggaggcagacagaa

SEQ ID NO: 9310623 - DNA, 22 bp, Homo sapiens
tgcttggctttctgagcttctg

SEQ ID NO: 9310624 - DNA, 22 bp, Homo sapiens
tgcttggctaaaaatggcaaga

SEQ ID NO: 9310625 - DNA, 20 bp, Homo sapiens
tgcttgtaatacctgcttca

SEQ ID NO: 9310626 - DNA, 22 bp, Homo sapiens
tctgggctctgtcagcacctct

SEQ ID NO: 9310627 - DNA, 21 bp, Homo sapiens
tctggggaagacatctaggat

SEQ ID NO: 9310628 - DNA, 22 bp, Homo sapiens
tctgggcttttgcactggccat

SEQ ID NO: 9310629 - DNA, 22 bp, Homo sapiens
ccagcactctgtcccagcttcc

SEQ ID NO: 9310630 - DNA, 22 bp, Homo sapiens
ccagcactctattgaatattct

SEQ ID NO: 9310631 - DNA, 22 bp, Homo sapiens
ccagcactctgtcccagcttcc

SEQ ID NO: 9310632 - DNA, 22 bp, Homo sapiens
ccagcactcctgtctcaagtct

SEQ ID NO: 9310633 - DNA, 22 bp, Homo sapiens
tctgggctcacgagtctggaca

SEQ ID NO: 9310634 - DNA, 22 bp, Homo sapiens
tctgggctatatggtctctgct

SEQ ID NO: 9310635 - DNA, 22 bp, Homo sapiens
tctgggcctcacctgctgctca

SEQ ID NO: 9310636 - DNA, 22 bp, Homo sapiens
tctgggcctgtctcagagctgg

SEQ ID NO: 9310637 - DNA, 22 bp, Homo sapiens
ccaggagcagggctggctgcac

SEQ ID NO: 9310638 - DNA, 19 bp, Homo sapiens
ccaggagcagtggtgagct

SEQ ID NO: 9310639 - DNA, 22 bp, Homo sapiens
ccaggagccactcaggcccaca

SEQ ID NO: 9310640 - DNA, 22 bp, Homo sapiens
ccaggagcagatatggacataa

SEQ ID NO: 9310641 - DNA, 22 bp, Homo sapiens
ccaggagcagatatggacataa

SEQ ID NO: 9310642 - DNA, 22 bp, Homo sapiens
ccaggagcagccggcccacctg

SEQ ID NO: 9310643 - DNA, 22 bp, Homo sapiens
ccaggagcaggagctgcagctg

SEQ ID NO: 9310644 - DNA, 22 bp, Homo sapiens
tctgttccagtagaaaggtgca

SEQ ID NO: 9310645 - DNA, 22 bp, Homo sapiens
tctgttcctgtcctaagggcca

SEQ ID NO: 9310646 - DNA, 22 bp, Homo sapiens
tctgttcctcaaggtctgtgtg

SEQ ID NO: 9310647 - DNA, 22 bp, Homo sapiens
tctgttcagaattgtaacactc

SEQ ID NO: 9310648 - DNA, 22 bp, Homo sapiens
ccaggagccctgccacaatggt

SEQ ID NO: 9310649 - DNA, 20 bp, Homo sapiens
tcttacaatcgttacatcca

SEQ ID NO: 9310650 - DNA, 22 bp, Homo sapiens
tcttacatatacgtcatttagt

SEQ ID NO: 9310651 - DNA, 22 bp, Homo sapiens
tcttacaagaaataagccaatg

SEQ ID NO: 9310652 - DNA, 22 bp, Homo sapiens
ccaggcagcaaattttctgaat

SEQ ID NO: 9310653 - DNA, 22 bp, Homo sapiens
ccaggcagagggatccccatcc

SEQ ID NO: 9310654 - DNA, 22 bp, Homo sapiens
ccaggcagatgggccggcttca

SEQ ID NO: 9310655 - DNA, 22 bp, Homo sapiens
ccaggcagagggatccccatcc

SEQ ID NO: 9310656 - DNA, 22 bp, Homo sapiens
ccaggcagagtgctccagaaag

SEQ ID NO: 9310657 - DNA, 22 bp, Homo sapiens
ccaggcaatgttctaagtgatt

SEQ ID NO: 9310658 - DNA, 22 bp, Homo sapiens
ccaggcacttgtttgccaggca

SEQ ID NO: 9310659 - DNA, 22 bp, Homo sapiens
ccaggaggctctgactggaccc

SEQ ID NO: 9310660 - DNA, 17 bp, Homo sapiens
tcttctcttccagtctt

SEQ ID NO: 9310661 - DNA, 17 bp, Homo sapiens
tcttctcttccagtctt

SEQ ID NO: 9310662 - DNA, 19 bp, Homo sapiens
tcttctgacttgagaaaga

SEQ ID NO: 9310663 - DNA, 22 bp, Homo sapiens
ccaggcaggcagcgttctcagg

SEQ ID NO: 9310664 - DNA, 22 bp, Homo sapiens
ccaggcaggcagcgttctcagg

SEQ ID NO: 9310665 - DNA, 22 bp, Homo sapiens
ccaggcagcctgctccattctg

SEQ ID NO: 9310666 - DNA, 19 bp, Homo sapiens
ccaggcctcctgggaggtc

SEQ ID NO: 9310667 - DNA, 22 bp, Homo sapiens
ccaggcctcctgtgagtggacc

SEQ ID NO: 9310668 - DNA, 22 bp, Homo sapiens
ccaggcctcccttttccagcca

SEQ ID NO: 9310669 - DNA, 22 bp, Homo sapiens
ccaggcctcctgtgagtggacc

SEQ ID NO: 9310670 - DNA, 23 bp, Homo sapiens
ccaggcctctcagagggtgtgcc

SEQ ID NO: 9310671 - DNA, 22 bp, Homo sapiens
ccaggcctgattgggaatcttg

SEQ ID NO: 9310672 - DNA, 19 bp, Homo sapiens
ccaggcctctggggcctgt

SEQ ID NO: 9310673 - DNA, 21 bp, Homo sapiens
tcttttgtaactatttcagcc

SEQ ID NO: 9310674 - DNA, 22 bp, Homo sapiens
ccaggcttattatcttctccat

SEQ ID NO: 9310675 - DNA, 22 bp, Homo sapiens
ccaggctgtaagagtgatgttg

SEQ ID NO: 9310676 - DNA, 22 bp, Homo sapiens
tgaaatgacagtcttaagctct

SEQ ID NO: 9310677 - DNA, 22 bp, Homo sapiens
ccaggcttctgattccaggcac

SEQ ID NO: 9310678 - DNA, 22 bp, Homo sapiens
ccaggcttccctgagaggctgc

SEQ ID NO: 9310679 - DNA, 21 bp, Homo sapiens
ccaggctggccatggtattga

SEQ ID NO: 9310680 - DNA, 22 bp, Homo sapiens
ccagggcacgttgggacagtac

SEQ ID NO: 9310681 - DNA, 22 bp, Homo sapiens
ccagggcacgttgggacagtac

SEQ ID NO: 9310682 - DNA, 22 bp, Homo sapiens
ccagggcaggagaaagactcac

SEQ ID NO: 9310683 - DNA, 22 bp, Homo sapiens
ccagggcaaatgagatcatagc

SEQ ID NO: 9310684 - DNA, 22 bp, Homo sapiens
tgaaatgagcatttattcttta

SEQ ID NO: 9310685 - DNA, 22 bp, Homo sapiens
ccagggaagattagaagccact

SEQ ID NO: 9310686 - DNA, 22 bp, Homo sapiens
tgaagtctttctgatcatttac

SEQ ID NO: 9310687 - DNA, 22 bp, Homo sapiens
tgaagtggaccctggacagacc

SEQ ID NO: 9310688 - DNA, 22 bp, Homo sapiens
ccagggcagtgggagaaggtgc

SEQ ID NO: 9310689 - DNA, 22 bp, Homo sapiens
ccagggcatcacatccagtgtt

SEQ ID NO: 9310690 - DNA, 22 bp, Homo sapiens
ccagggctgagactgtattggg

SEQ ID NO: 9310691 - DNA, 22 bp, Homo sapiens
ccagggctctgcttctgccatg

SEQ ID NO: 9310692 - DNA, 22 bp, Homo sapiens
ccagggctctatgagggtggag

SEQ ID NO: 9310693 - DNA, 22 bp, Homo sapiens
ccagggctctatgagggtggag

SEQ ID NO: 9310694 - DNA, 22 bp, Homo sapiens
ccagggctgagctgtgaccatg

SEQ ID NO: 9310695 - DNA, 22 bp, Homo sapiens
ccagggctccccagaagtaccc

SEQ ID NO: 9310696 - DNA, 22 bp, Homo sapiens
ccagggctcgggtgcttagtca

SEQ ID NO: 9310697 - DNA, 22 bp, Homo sapiens
ccagggctctatgagggtggag

SEQ ID NO: 9310698 - DNA, 22 bp, Homo sapiens
ccagggctccattgctcatcct

SEQ ID NO: 9310699 - DNA, 22 bp, Homo sapiens
ccagggctccccagaagtaccc

SEQ ID NO: 9310700 - DNA, 22 bp, Homo sapiens
tgaagtgggggaacgagagttc

SEQ ID NO: 9310701 - DNA, 22 bp, Homo sapiens
tgaagtgggaatacttcttccc

SEQ ID NO: 9310702 - DNA, 22 bp, Homo sapiens
ccagggctccattgctcatcct

SEQ ID NO: 9310703 - DNA, 22 bp, Homo sapiens
tgcagccaccacctctgctgaa

SEQ ID NO: 9310704 - DNA, 22 bp, Homo sapiens
tgcagctgattaaagggcagac

SEQ ID NO: 9310705 - DNA, 22 bp, Homo sapiens
tgcagccaattcattcattctt

SEQ ID NO: 9310706 - DNA, 20 bp, Homo sapiens
tgcagctgcaggagggtggg

SEQ ID NO: 9310707 - DNA, 22 bp, Homo sapiens
tgcagctgcaggagggtgggag

SEQ ID NO: 9310708 - DNA, 22 bp, Homo sapiens
tgcagggccttctagaccatgg

SEQ ID NO: 9310709 - DNA, 22 bp, Homo sapiens
cccagcagggtctctgtgtcta

SEQ ID NO: 9310710 - DNA, 22 bp, Homo sapiens
cccagcaggaggaggttgcagt

SEQ ID NO: 9310711 - DNA, 22 bp, Homo sapiens
tgcaggcaggggatgagcagcc

SEQ ID NO: 9310712 - DNA, 21 bp, Homo sapiens
tgcaggcaggcagagatgctg

SEQ ID NO: 9310713 - DNA, 22 bp, Homo sapiens
cccagcagccttgtcccttctc

SEQ ID NO: 9310714 - DNA, 22 bp, Homo sapiens
tgcaagtagtccagcctttggg

SEQ ID NO: 9310715 - DNA, 22 bp, Homo sapiens
tgcaagtatgacagccccatgg

SEQ ID NO: 9310716 - DNA, 22 bp, Homo sapiens
cccaaggaagacgcttgtgata

SEQ ID NO: 9310717 - DNA, 22 bp, Homo sapiens
tgcactagccacatttcaaatg

SEQ ID NO: 9310718 - DNA, 22 bp, Homo sapiens
tgcagagaaagtgtagacaggc

SEQ ID NO: 9310719 - DNA, 22 bp, Homo sapiens
tgcactgggaaagaaggaggga

SEQ ID NO: 9310720 - DNA, 22 bp, Homo sapiens
tgcactggtggtgagtgaggga

SEQ ID NO: 9310721 - DNA, 18 bp, Homo sapiens
cccagaggaatgcctgga

SEQ ID NO: 9310722 - DNA, 19 bp, Homo sapiens
cccagaggaatgcctggaa

SEQ ID NO: 9310723 - DNA, 22 bp, Homo sapiens
cccagagctccggtcctgccca

SEQ ID NO: 9310724 - DNA, 22 bp, Homo sapiens
tgcagagagccagctctctcgg

SEQ ID NO: 9310725 - DNA, 22 bp, Homo sapiens
ccaggtggaggtgtgaggtcct

SEQ ID NO: 9310726 - DNA, 22 bp, Homo sapiens
ccagtccagtgccatgcatggc

SEQ ID NO: 9310727 - DNA, 22 bp, Homo sapiens
ccagggctgcctggccgtgtgt

SEQ ID NO: 9310728 - DNA, 22 bp, Homo sapiens
ccagggctgccgcatccctggt

SEQ ID NO: 9310729 - DNA, 22 bp, Homo sapiens
ccagggctgctgggggagttga

SEQ ID NO: 9310730 - DNA, 22 bp, Homo sapiens
ccagggctgctgggggagttga

SEQ ID NO: 9310731 - DNA, 22 bp, Homo sapiens
ccagggctgctcattggctggt

SEQ ID NO: 9310732 - DNA, 22 bp, Homo sapiens
ccagggctgctcattggctggt

SEQ ID NO: 9310733 - DNA, 22 bp, Homo sapiens
tgagcaggggagagcgaatgtg

SEQ ID NO: 9310734 - DNA, 22 bp, Homo sapiens
tgagcaggggagagcgaatgtg

SEQ ID NO: 9310735 - DNA, 22 bp, Homo sapiens
tgagcaggtgagtctagggcag

SEQ ID NO: 9310736 - DNA, 22 bp, Homo sapiens
tgagcaggtcaagactccagct

SEQ ID NO: 9310737 - DNA, 19 bp, Homo sapiens
ccagtcccatacaggagat

SEQ ID NO: 9310738 - DNA, 22 bp, Homo sapiens
tgagccagtggaagatggcagt

SEQ ID NO: 9310739 - DNA, 22 bp, Homo sapiens
tgagccatgggactccaaggga

SEQ ID NO: 9310740 - DNA, 22 bp, Homo sapiens
tgaggcagtgctgggaagcctg

SEQ ID NO: 9310741 - DNA, 22 bp, Homo sapiens
tgaggcagtgtgagataataaa

SEQ ID NO: 9310742 - DNA, 22 bp, Homo sapiens
tgaggctgaaactggcgataga

SEQ ID NO: 9310743 - DNA, 22 bp, Homo sapiens
tgaggctgaaactggcgataga

SEQ ID NO: 9310744 - DNA, 22 bp, Homo sapiens
tgaggctgaaactggcgataga

SEQ ID NO: 9310745 - DNA, 18 bp, Homo sapiens
tgaggctgaatatggggc

SEQ ID NO: 9310746 - DNA, 22 bp, Homo sapiens
ccatatttgcttcttgctgata

SEQ ID NO: 9310747 - DNA, 19 bp, Homo sapiens
ccatataaccagcaagtgt

SEQ ID NO: 9310748 - DNA, 18 bp, Homo sapiens
tgaggctgagggtagagg

SEQ ID NO: 9310749 - DNA, 22 bp, Homo sapiens
tgaggctgagatatcagggagg

SEQ ID NO: 9310750 - DNA, 22 bp, Homo sapiens
tgaggctgagatatcagggagg

SEQ ID NO: 9310751 - DNA, 22 bp, Homo sapiens
tgaggctgagatatcagggagg

SEQ ID NO: 9310752 - DNA, 22 bp, Homo sapiens
ccatccctgggccatgtcccct

SEQ ID NO: 9310753 - DNA, 22 bp, Homo sapiens
ccatcccttctctggccagcag

SEQ ID NO: 9310754 - DNA, 22 bp, Homo sapiens
ccatccaggctgtgggtgagct

SEQ ID NO: 9310755 - DNA, 22 bp, Homo sapiens
ccatcctgcaggacctccatat

SEQ ID NO: 9310756 - DNA, 22 bp, Homo sapiens
ccatcctgaatggtctcagcca

SEQ ID NO: 9310757 - DNA, 22 bp, Homo sapiens
tgagtcatgggcttgaggttac

SEQ ID NO: 9310758 - DNA, 22 bp, Homo sapiens
cttttctgtgatgctgacagtc

SEQ ID NO: 9310759 - DNA, 21 bp, Homo sapiens
cttttctgtgttcctccctgt

SEQ ID NO: 9310760 - DNA, 22 bp, Homo sapiens
cttttctgagagggccaagatt

SEQ ID NO: 9310761 - DNA, 22 bp, Homo sapiens
cttttctggaatcatctctaac

SEQ ID NO: 9310762 - DNA, 22 bp, Homo sapiens
cttttctggccaggaacttgcc

SEQ ID NO: 9310763 - DNA, 22 bp, Homo sapiens
cttttctgggccccacgctgga

SEQ ID NO: 9310764 - DNA, 22 bp, Homo sapiens
cttttctgtatcaaaaggatta

SEQ ID NO: 9310765 - DNA, 22 bp, Homo sapiens
cttttctgtcagtgcccaaatt

SEQ ID NO: 9310766 - DNA, 22 bp, Homo sapiens
gaaaatgtttcctgttatttgc

SEQ ID NO: 9310767 - DNA, 22 bp, Homo sapiens
gaaaatttaattctcttctgtg

SEQ ID NO: 9310768 - DNA, 22 bp, Homo sapiens
gaaaatttagaactgaacttct

SEQ ID NO: 9310769 - DNA, 22 bp, Homo sapiens
gaaaattgaatcagtagctgat

SEQ ID NO: 9310770 - DNA, 22 bp, Homo sapiens
gaaacaactactattgatttct

SEQ ID NO: 9310771 - DNA, 22 bp, Homo sapiens
gaaacaactactattgatttct

SEQ ID NO: 9310772 - DNA, 22 bp, Homo sapiens
gaaacaatcatcatgtgatttg

SEQ ID NO: 9310773 - DNA, 22 bp, Homo sapiens
ctttaatgagtctttctgctgt

SEQ ID NO: 9310774 - DNA, 23 bp, Homo sapiens
ctttaatgaaattctctgtgaag

SEQ ID NO: 9310775 - DNA, 22 bp, Homo sapiens
ctttaacagttccattcaattt

SEQ ID NO: 9310776 - DNA, 22 bp, Homo sapiens
ctttaattgtagctcccataat

SEQ ID NO: 9310777 - DNA, 22 bp, Homo sapiens
ctttacaaactataaagtgcgg

SEQ ID NO: 9310778 - DNA, 22 bp, Homo sapiens
ctttacaaagcaattttgtctc

SEQ ID NO: 9310779 - DNA, 22 bp, Homo sapiens
ctttacaaatagggagggagtg

SEQ ID NO: 9310780 - DNA, 22 bp, Homo sapiens
ctttgaattgccgtttcatctg

SEQ ID NO: 9310781 - DNA, 22 bp, Homo sapiens
ctttgaattccagtacaataac

SEQ ID NO: 9310782 - DNA, 22 bp, Homo sapiens
ctttctttgtccaccaacaatg

SEQ ID NO: 9310783 - DNA, 22 bp, Homo sapiens
ctttctcttcagcacccagccc

SEQ ID NO: 9310784 - DNA, 22 bp, Homo sapiens
cttctggggatggagcccagaa

SEQ ID NO: 9310785 - DNA, 22 bp, Homo sapiens
cttgttttctaaaacatcattt

SEQ ID NO: 9310786 - DNA, 22 bp, Homo sapiens
cttgttttcttctgcagtctat

SEQ ID NO: 9310787 - DNA, 21 bp, Homo sapiens
cttgttttgaaaggactggcc

SEQ ID NO: 9310788 - DNA, 22 bp, Homo sapiens
cttgttttgaaagcagtggcca

SEQ ID NO: 9310789 - DNA, 22 bp, Homo sapiens
cttgttttggaacagagtgaat

SEQ ID NO: 9310790 - DNA, 22 bp, Homo sapiens
cttgtttttaagagatgtttac

SEQ ID NO: 9310791 - DNA, 22 bp, Homo sapiens
cttgttttggctagtatgatgt

SEQ ID NO: 9310792 - DNA, 22 bp, Homo sapiens
cttctgaaatgtgagcaaaatc

SEQ ID NO: 9310793 - DNA, 22 bp, Homo sapiens
cttctgctgccgcctcggcaca

SEQ ID NO: 9310794 - DNA, 22 bp, Homo sapiens
cttctgctgctgttcatggttg

SEQ ID NO: 9310795 - DNA, 22 bp, Homo sapiens
cttctgaagaggttatcataga

SEQ ID NO: 9310796 - DNA, 22 bp, Homo sapiens
cttctgctggcatactgcccca

SEQ ID NO: 9310797 - DNA, 22 bp, Homo sapiens
cttctgggcattcagctgcaca

SEQ ID NO: 9310798 - DNA, 22 bp, Homo sapiens
ctgttttatctcaagagttcaa

SEQ ID NO: 9310799 - DNA, 22 bp, Homo sapiens
ctgtttgcccacatttttatta

SEQ ID NO: 9310800 - DNA, 22 bp, Homo sapiens
ctgtttgcattaaagtatatga

SEQ ID NO: 9310801 - DNA, 19 bp, Homo sapiens
ctgtgctttaaactcctat

SEQ ID NO: 9310802 - DNA, 22 bp, Homo sapiens
ctgtttatcatgtacatttcca

SEQ ID NO: 9310803 - DNA, 22 bp, Homo sapiens
ctgtttatcatgtacatttcca

SEQ ID NO: 9310804 - DNA, 22 bp, Homo sapiens
ctgtttatagcagagcaagcct

SEQ ID NO: 9310805 - DNA, 22 bp, Homo sapiens
ctgtttatactcaaaagataca

SEQ ID NO: 9310806 - DNA, 22 bp, Homo sapiens
ctgtttatacgacaggtggagg

SEQ ID NO: 9310807 - DNA, 22 bp, Homo sapiens
ctgtttataaatagaggggagt

SEQ ID NO: 9310808 - DNA, 22 bp, Homo sapiens
ctgtttataaaccaccagttta

SEQ ID NO: 9310809 - DNA, 22 bp, Homo sapiens
cttacaaatacacttaggagag

SEQ ID NO: 9310810 - DNA, 22 bp, Homo sapiens
cttacaaaggagaggagatagg

SEQ ID NO: 9310811 - DNA, 22 bp, Homo sapiens
cttacaaaggagaggagatagg

SEQ ID NO: 9310812 - DNA, 22 bp, Homo sapiens
cttaatttttgtagtagatgga

SEQ ID NO: 9310813 - DNA, 22 bp, Homo sapiens
cttaatttcaaactgctagtga

SEQ ID NO: 9310814 - DNA, 22 bp, Homo sapiens
cttaatttaaaatagttcaggc

SEQ ID NO: 9310815 - DNA, 22 bp, Homo sapiens
cttaatttaagcctagaatgca

SEQ ID NO: 9310816 - DNA, 22 bp, Homo sapiens
cttaattactgtccaatatgca

SEQ ID NO: 9310817 - DNA, 22 bp, Homo sapiens
cttaaaggtcattctgttgata

SEQ ID NO: 9310818 - DNA, 22 bp, Homo sapiens
cttaaaggaggttttgtttcca

SEQ ID NO: 9310819 - DNA, 22 bp, Homo sapiens
cttagcagaattccaagcttga

SEQ ID NO: 9310820 - DNA, 22 bp, Homo sapiens
cttagcagaagcttcagcttca

SEQ ID NO: 9310821 - DNA, 22 bp, Homo sapiens
cttacacactagatggtaggtg

SEQ ID NO: 9310822 - DNA, 22 bp, Homo sapiens
cttacacagtctggcacttctt

SEQ ID NO: 9310823 - DNA, 22 bp, Homo sapiens
cttataaagtccatctgaacaa

SEQ ID NO: 9310824 - DNA, 22 bp, Homo sapiens
cttataaagtccatctgaacaa

SEQ ID NO: 9310825 - DNA, 22 bp, Homo sapiens
cttagtttttgccctggagttt

SEQ ID NO: 9310826 - DNA, 22 bp, Homo sapiens
cttagttttattaaggaggatt

SEQ ID NO: 9310827 - DNA, 22 bp, Homo sapiens
cttagtttgcatgattatggag

SEQ ID NO: 9310828 - DNA, 22 bp, Homo sapiens
cttagtttctgttgcgttctgt

SEQ ID NO: 9310829 - DNA, 22 bp, Homo sapiens
cttagtttctgtttctgattaa

SEQ ID NO: 9310830 - DNA, 22 bp, Homo sapiens
cttagtttaggtaaacccagca

SEQ ID NO: 9310831 - DNA, 22 bp, Homo sapiens
cttagtttctctgtatgtttac

SEQ ID NO: 9310832 - DNA, 22 bp, Homo sapiens
cttagtagaacgtggatgggaa

SEQ ID NO: 9310833 - DNA, 22 bp, Homo sapiens
cttagtagccattatataattt

SEQ ID NO: 9310834 - DNA, 22 bp, Homo sapiens
cttagtaggcttcacccctctc

SEQ ID NO: 9310835 - DNA, 22 bp, Homo sapiens
cttaggatttaatttcagactc

SEQ ID NO: 9310836 - DNA, 22 bp, Homo sapiens
cttagcatgtggtgtccttgta

SEQ ID NO: 9310837 - DNA, 22 bp, Homo sapiens
cttagccagctaacttaagcac

SEQ ID NO: 9310838 - DNA, 20 bp, Homo sapiens
cttagctagtaagaagctgt

SEQ ID NO: 9310839 - DNA, 22 bp, Homo sapiens
cttagcagataaaaaccttcag

SEQ ID NO: 9310840 - DNA, 22 bp, Homo sapiens
cttagcatgcagtgttctgccc

SEQ ID NO: 9310841 - DNA, 20 bp, Homo sapiens
cttagcttctaaggttctgg

SEQ ID NO: 9310842 - DNA, 22 bp, Homo sapiens
cttagcttcattattggtggcc

SEQ ID NO: 9310843 - DNA, 22 bp, Homo sapiens
cttagcttcactgggtctcagt

SEQ ID NO: 9310844 - DNA, 22 bp, Homo sapiens
cttaggaacgctctgcctagtg

SEQ ID NO: 9310845 - DNA, 22 bp, Homo sapiens
cttaggaaagttttctgctgca

SEQ ID NO: 9310846 - DNA, 22 bp, Homo sapiens
cttagctttgtcctaggtctct

SEQ ID NO: 9310847 - DNA, 22 bp, Homo sapiens
cttagctttgtttaacacaggg

SEQ ID NO: 9310848 - DNA, 22 bp, Homo sapiens
cttagcttttccagcttctaga

SEQ ID NO: 9310849 - DNA, 22 bp, Homo sapiens
cttatactgaaaaattatttgt

SEQ ID NO: 9310850 - DNA, 17 bp, Homo sapiens
cttatactttacggaag

SEQ ID NO: 9310851 - DNA, 19 bp, Homo sapiens
cttctaagtcatttggaat

SEQ ID NO: 9310852 - DNA, 22 bp, Homo sapiens
cttctaagctgagaatgccttt

SEQ ID NO: 9310853 - DNA, 20 bp, Homo sapiens
cttccaccagggccgctgat

SEQ ID NO: 9310854 - DNA, 22 bp, Homo sapiens
cttccagcttgtggcgctttcc

SEQ ID NO: 9310855 - DNA, 22 bp, Homo sapiens
ctgtgctggtccagggagctgg

SEQ ID NO: 9310856 - DNA, 22 bp, Homo sapiens
ctgtgctggagatgggccagag

SEQ ID NO: 9310857 - DNA, 22 bp, Homo sapiens
ctgtgctggattctgaggctac

SEQ ID NO: 9310858 - DNA, 22 bp, Homo sapiens
ctgtgctggattctgaggctac

SEQ ID NO: 9310859 - DNA, 22 bp, Homo sapiens
ctgtctggatataccttggcca

SEQ ID NO: 9310860 - DNA, 22 bp, Homo sapiens
ctgtctgggtctacatcctctg

SEQ ID NO: 9310861 - DNA, 20 bp, Homo sapiens
ctgtcacaaaggatgtgtca

SEQ ID NO: 9310862 - DNA, 22 bp, Homo sapiens
ctgtataaccccatgcgactgt

SEQ ID NO: 9310863 - DNA, 22 bp, Homo sapiens
ctgtcaggggcgggtggagcgg

SEQ ID NO: 9310864 - DNA, 22 bp, Homo sapiens
ctgtcctgtggacctgaggacg

SEQ ID NO: 9310865 - DNA, 22 bp, Homo sapiens
ctgtctctgttgcctgtaggtg

SEQ ID NO: 9310866 - DNA, 22 bp, Homo sapiens
ctgtacaaaagaaagttcctat

SEQ ID NO: 9310867 - DNA, 22 bp, Homo sapiens
ctgtacaaaagaaagttcctat

SEQ ID NO: 9310868 - DNA, 22 bp, Homo sapiens
ctgtacaaagtagctgctggga

SEQ ID NO: 9310869 - DNA, 22 bp, Homo sapiens
ctgtacaaatggcagttgagtt

SEQ ID NO: 9310870 - DNA, 22 bp, Homo sapiens
ctgtacaaagtagctgctggga

SEQ ID NO: 9310871 - DNA, 22 bp, Homo sapiens
ctgtaaaacactgtagtatctg

SEQ ID NO: 9310872 - DNA, 22 bp, Homo sapiens
ctgtacaatgttacctatttat

SEQ ID NO: 9310873 - DNA, 22 bp, Homo sapiens
ctgtacaagtccttcatcaggg

SEQ ID NO: 9310874 - DNA, 22 bp, Homo sapiens
ctgtacaagtccttcatcaggg

SEQ ID NO: 9310875 - DNA, 22 bp, Homo sapiens
ctgtacaagtccttcatcaggg

SEQ ID NO: 9310876 - DNA, 22 bp, Homo sapiens
ctgtacaaatggcagttgagtt

SEQ ID NO: 9310877 - DNA, 22 bp, Homo sapiens
ctgtacaatgttacctatttat

SEQ ID NO: 9310878 - DNA, 22 bp, Homo sapiens
ctgtagcaagttattcaataaa

SEQ ID NO: 9310879 - DNA, 23 bp, Homo sapiens
ctgtagctaaaagctgggatttg

SEQ ID NO: 9310880 - DNA, 22 bp, Homo sapiens
ctgtagcagtgttccagcattg

SEQ ID NO: 9310881 - DNA, 20 bp, Homo sapiens
ctggggagcctcgcggtggc

SEQ ID NO: 9310882 - DNA, 20 bp, Homo sapiens
ctggggagcctcgcggtggc

SEQ ID NO: 9310883 - DNA, 18 bp, Homo sapiens
ctggtctcccttcgcttt

SEQ ID NO: 9310884 - DNA, 22 bp, Homo sapiens
ctggtctgagggctcttgaggc

SEQ ID NO: 9310885 - DNA, 22 bp, Homo sapiens
ctggtctgaggttgcccttgaa

SEQ ID NO: 9310886 - DNA, 20 bp, Homo sapiens
ctggtctgccactcacagtt

SEQ ID NO: 9310887 - DNA, 22 bp, Homo sapiens
ctggggaatagagctggagacc

SEQ ID NO: 9310888 - DNA, 22 bp, Homo sapiens
ctggggaaggcggtgactgcgc

SEQ ID NO: 9310889 - DNA, 22 bp, Homo sapiens
ctggggagacgatcgatgttct

SEQ ID NO: 9310890 - DNA, 22 bp, Homo sapiens
ctggggagaagcgactcggctg

SEQ ID NO: 9310891 - DNA, 22 bp, Homo sapiens
ctggggaacgcagcgagcagcg

SEQ ID NO: 9310892 - DNA, 22 bp, Homo sapiens
ctggggaacaatttgccacact

SEQ ID NO: 9310893 - DNA, 22 bp, Homo sapiens
ctgggctttggtactgtgatta

SEQ ID NO: 9310894 - DNA, 22 bp, Homo sapiens
ctgggcttgtgttagctgacaa

SEQ ID NO: 9310895 - DNA, 22 bp, Homo sapiens
ctgggacatattgctagtgttg

SEQ ID NO: 9310896 - DNA, 22 bp, Homo sapiens
ctgggactgccattcacagcca

SEQ ID NO: 9310897 - DNA, 22 bp, Homo sapiens
ctgggacctgtgtgcctgggcc

SEQ ID NO: 9310898 - DNA, 22 bp, Homo sapiens
ctgggaccctgccctgtggcct

SEQ ID NO: 9310899 - DNA, 22 bp, Homo sapiens
ctgggacctcctgaggtggagc

SEQ ID NO: 9310900 - DNA, 22 bp, Homo sapiens
ctgggaccagtgaagcaactca

SEQ ID NO: 9310901 - DNA, 22 bp, Homo sapiens
ctgggacccccactgcgtagct

SEQ ID NO: 9310902 - DNA, 22 bp, Homo sapiens
ctgggagatctcctgagggcag

SEQ ID NO: 9310903 - DNA, 22 bp, Homo sapiens
ctgggagatctgttgggactgg

SEQ ID NO: 9310904 - DNA, 22 bp, Homo sapiens
ctgctgtgttcctcctgcatct

SEQ ID NO: 9310905 - DNA, 22 bp, Homo sapiens
ctgctgtgcacccaggaaggct

SEQ ID NO: 9310906 - DNA, 22 bp, Homo sapiens
ctgggacacccagagctgcaga

SEQ ID NO: 9310907 - DNA, 22 bp, Homo sapiens
ctgggaagaagtgggctacatt

SEQ ID NO: 9310908 - DNA, 22 bp, Homo sapiens
ctgcttcctgctgggatactga

SEQ ID NO: 9310909 - DNA, 22 bp, Homo sapiens
ctgggaagaagtgggctacatt

SEQ ID NO: 9310910 - DNA, 22 bp, Homo sapiens
ctgcttccatggtctggagact

SEQ ID NO: 9310911 - DNA, 22 bp, Homo sapiens
ctgcttccatgcaatggcagtc

SEQ ID NO: 9310912 - DNA, 21 bp, Homo sapiens
ctgcttcctctcttcatggca

SEQ ID NO: 9310913 - DNA, 22 bp, Homo sapiens
ctgcttcctccctgtaaaggca

SEQ ID NO: 9310914 - DNA, 20 bp, Homo sapiens
ctgcttccaggctcaccccc

SEQ ID NO: 9310915 - DNA, 22 bp, Homo sapiens
ctgcttccacacaagcaaagct

SEQ ID NO: 9310916 - DNA, 22 bp, Homo sapiens
ctgcttccataaataatgtgct

SEQ ID NO: 9310917 - DNA, 22 bp, Homo sapiens
ctgcttccaagaaagagatagg

SEQ ID NO: 9310918 - DNA, 22 bp, Homo sapiens
ctgcttcatagccctggtctct

SEQ ID NO: 9310919 - DNA, 22 bp, Homo sapiens
ctgcttcagcaaagctatttgc

SEQ ID NO: 9310920 - DNA, 22 bp, Homo sapiens
ctgggcagctaccaccactgct

SEQ ID NO: 9310921 - DNA, 22 bp, Homo sapiens
ctgggcactttggggagcctac

SEQ ID NO: 9310922 - DNA, 22 bp, Homo sapiens
ctgggcagagctaacacctgag

SEQ ID NO: 9310923 - DNA, 22 bp, Homo sapiens
ctgggcacctttgcagcaggct

SEQ ID NO: 9310924 - DNA, 22 bp, Homo sapiens
ctgggcactgcagcaggcatca

SEQ ID NO: 9310925 - DNA, 22 bp, Homo sapiens
ctgggcacctttgcagcaggct

SEQ ID NO: 9310926 - DNA, 22 bp, Homo sapiens
ctgggcacttgctcacagctct

SEQ ID NO: 9310927 - DNA, 22 bp, Homo sapiens
ctgggcactgcagggtgttgag

SEQ ID NO: 9310928 - DNA, 22 bp, Homo sapiens
ctgggatgtgaggagcgcctct

SEQ ID NO: 9310929 - DNA, 17 bp, Homo sapiens
ctgggatgtggactctt

SEQ ID NO: 9310930 - DNA, 22 bp, Homo sapiens
ctgggagccctgactagcctgg

SEQ ID NO: 9310931 - DNA, 22 bp, Homo sapiens
ctgggctggcgcatccgacacg

SEQ ID NO: 9310932 - DNA, 22 bp, Homo sapiens
ctgggctggcgcatccgacacg

SEQ ID NO: 9310933 - DNA, 22 bp, Homo sapiens
ctgggctgtttgttctggtctc

SEQ ID NO: 9310934 - DNA, 22 bp, Homo sapiens
ctgggctgtttgtttagaatgg

SEQ ID NO: 9310935 - DNA, 22 bp, Homo sapiens
ctgggctggagtgcaatggcgc

SEQ ID NO: 9310936 - DNA, 22 bp, Homo sapiens
ctgggctggagtgcaatggcgc

SEQ ID NO: 9310937 - DNA, 21 bp, Homo sapiens
ctgggctggcaggcattacct

SEQ ID NO: 9310938 - DNA, 22 bp, Homo sapiens
ctgggctggataattctttgct

SEQ ID NO: 9310939 - DNA, 22 bp, Homo sapiens
ctgggcctttgcttattaattt

SEQ ID NO: 9310940 - DNA, 22 bp, Homo sapiens
ctgggccttgccttgcccacag

SEQ ID NO: 9310941 - DNA, 22 bp, Homo sapiens
ctgggctagaaggaccaggatg

SEQ ID NO: 9310942 - DNA, 22 bp, Homo sapiens
ctgggcctccagctctgccagc

SEQ ID NO: 9310943 - DNA, 22 bp, Homo sapiens
ctgggcctgtgactcccatcct

SEQ ID NO: 9310944 - DNA, 22 bp, Homo sapiens
ctgggcctggtgtggcacctgc

SEQ ID NO: 9310945 - DNA, 22 bp, Homo sapiens
ctgggcctgtcagggctttttg

SEQ ID NO: 9310946 - DNA, 22 bp, Homo sapiens
ctgggccttcattgctctccca

SEQ ID NO: 9310947 - DNA, 22 bp, Homo sapiens
ctgggccttagggcactccctt

SEQ ID NO: 9310948 - DNA, 22 bp, Homo sapiens
gaggcagcttggggctgtgggt

SEQ ID NO: 9310949 - DNA, 22 bp, Homo sapiens
gaggcagcttggggctgtgggt

SEQ ID NO: 9310950 - DNA, 22 bp, Homo sapiens
gaggcaggaggattgcttgagc

SEQ ID NO: 9310951 - DNA, 22 bp, Homo sapiens
gaggcagctgggtccggtcggg

SEQ ID NO: 9310952 - DNA, 22 bp, Homo sapiens
gaggcaggcactgttatcagca

SEQ ID NO: 9310953 - DNA, 22 bp, Homo sapiens
gaggcaggaggattgcttgagc

SEQ ID NO: 9310954 - DNA, 22 bp, Homo sapiens
gaggcaggaggattgcttgagc

SEQ ID NO: 9310955 - DNA, 22 bp, Homo sapiens
gaggcaggcagattgcttgagg

SEQ ID NO: 9310956 - DNA, 22 bp, Homo sapiens
gaggcaggcagattgcttgagg

SEQ ID NO: 9310957 - DNA, 22 bp, Homo sapiens
gaggcaggccctgaatgagtca

SEQ ID NO: 9310958 - DNA, 22 bp, Homo sapiens
gaggcaggcagattgcttgagg

SEQ ID NO: 9310959 - DNA, 22 bp, Homo sapiens
gaggagcacatgaggctgaggg

SEQ ID NO: 9310960 - DNA, 22 bp, Homo sapiens
gaggagccaaggtatgtgtgtt

SEQ ID NO: 9310961 - DNA, 22 bp, Homo sapiens
gaggagcatgggaaggctctgg

SEQ ID NO: 9310962 - DNA, 22 bp, Homo sapiens
gaggagagatggtagattgggt

SEQ ID NO: 9310963 - DNA, 22 bp, Homo sapiens
gaggagagatggtagattgggt

SEQ ID NO: 9310964 - DNA, 22 bp, Homo sapiens
gaggagagatggtagattgggt

SEQ ID NO: 9310965 - DNA, 22 bp, Homo sapiens
gaggagaggggctcccaagagc

SEQ ID NO: 9310966 - DNA, 22 bp, Homo sapiens
gaggagaggctggacgcggtga

SEQ ID NO: 9310967 - DNA, 22 bp, Homo sapiens
gaggagaggctggacgcggtga

SEQ ID NO: 9310968 - DNA, 22 bp, Homo sapiens
gaggctcagagaagtcatggta

SEQ ID NO: 9310969 - DNA, 22 bp, Homo sapiens
gaggctcagagaagtcatggta

SEQ ID NO: 9310970 - DNA, 22 bp, Homo sapiens
gaggctcacctagggagcactg

SEQ ID NO: 9310971 - DNA, 22 bp, Homo sapiens
gaggctcactaggcatcctggg

SEQ ID NO: 9310972 - DNA, 22 bp, Homo sapiens
gaggcagtttgccatgccagga

SEQ ID NO: 9310973 - DNA, 22 bp, Homo sapiens
gaggcagttcctgagtgacaag

SEQ ID NO: 9310974 - DNA, 22 bp, Homo sapiens
gaggctcaacccacaggggttg

SEQ ID NO: 9310975 - DNA, 22 bp, Homo sapiens
gaggcaggccctgaatgagtca

SEQ ID NO: 9310976 - DNA, 22 bp, Homo sapiens
gaggcaggccctgaatgagtca

SEQ ID NO: 9310977 - DNA, 22 bp, Homo sapiens
gaggcagggtgttgattacaga

SEQ ID NO: 9310978 - DNA, 22 bp, Homo sapiens
gaggcagtccagtgggtaagaa

SEQ ID NO: 9310979 - DNA, 22 bp, Homo sapiens
gaggcagtaattgtgggcaata

SEQ ID NO: 9310980 - DNA, 22 bp, Homo sapiens
gaggcagtgttgaaaaggagag

SEQ ID NO: 9310981 - DNA, 22 bp, Homo sapiens
gaggcagtggtctgatgcaagg

SEQ ID NO: 9310982 - DNA, 22 bp, Homo sapiens
gaggcagtggtctgatgcaagg

SEQ ID NO: 9310983 - DNA, 22 bp, Homo sapiens
gaggcagtgcattgtctagggg

SEQ ID NO: 9310984 - DNA, 22 bp, Homo sapiens
gaggcagtgtcggtggcaggat

SEQ ID NO: 9310985 - DNA, 22 bp, Homo sapiens
gaggctcattgcattgtgcatt

SEQ ID NO: 9310986 - DNA, 22 bp, Homo sapiens
gaggctcagttatgtcatcagg

SEQ ID NO: 9310987 - DNA, 22 bp, Homo sapiens
gagggctggggcttaggcttag

SEQ ID NO: 9310988 - DNA, 22 bp, Homo sapiens
gagggctgctggaaaaatgcag

SEQ ID NO: 9310989 - DNA, 22 bp, Homo sapiens
gagggctgtgaaggagcgggtt

SEQ ID NO: 9310990 - DNA, 22 bp, Homo sapiens
gagggctgtggggcatgaccag

SEQ ID NO: 9310991 - DNA, 22 bp, Homo sapiens
gagggctgtgaaggagcgggtt

SEQ ID NO: 9310992 - DNA, 22 bp, Homo sapiens
gaggggctgccctggtgtcagg

SEQ ID NO: 9310993 - DNA, 22 bp, Homo sapiens
gagggcttccatggggagcccc

SEQ ID NO: 9310994 - DNA, 19 bp, Homo sapiens
gagggcttgatggacccga

SEQ ID NO: 9310995 - DNA, 22 bp, Homo sapiens
gagggcttgtaagtgggtggag

SEQ ID NO: 9310996 - DNA, 22 bp, Homo sapiens
gagggcttgtaagtgggtggag

SEQ ID NO: 9310997 - DNA, 22 bp, Homo sapiens
gaggggctggcacgatggctgc

SEQ ID NO: 9310998 - DNA, 22 bp, Homo sapiens
gagggctgccacgttgggcgag

SEQ ID NO: 9310999 - DNA, 22 bp, Homo sapiens
gagggctgctgccagatatgcc

SEQ ID NO: 9311000 - DNA, 22 bp, Homo sapiens
gagggctgatgttgccacctca

SEQ ID NO: 9311001 - DNA, 22 bp, Homo sapiens
gagggctgcaatgagacagaga

SEQ ID NO: 9311002 - DNA, 22 bp, Homo sapiens
gagggctgcaatgagacagaga

SEQ ID NO: 9311003 - DNA, 18 bp, Homo sapiens
gagggagtagctgaggtt

SEQ ID NO: 9311004 - DNA, 22 bp, Homo sapiens
gagggaggtgatactgaacgta

SEQ ID NO: 9311005 - DNA, 22 bp, Homo sapiens
gaggctgcccaactggagtgga

SEQ ID NO: 9311006 - DNA, 22 bp, Homo sapiens
gagggagcttgatggatgtttg

SEQ ID NO: 9311007 - DNA, 22 bp, Homo sapiens
gagggagggccaggtcccaacc

SEQ ID NO: 9311008 - DNA, 22 bp, Homo sapiens
gaggagagagggactgtctgca

SEQ ID NO: 9311009 - DNA, 22 bp, Homo sapiens
gaggaaaatgcaacaggaatgc

SEQ ID NO: 9311010 - DNA, 22 bp, Homo sapiens
gaggaaaatggagtgtaattaa

SEQ ID NO: 9311011 - DNA, 22 bp, Homo sapiens
gaggaaaatgggacaggctgta

SEQ ID NO: 9311012 - DNA, 22 bp, Homo sapiens
gaggaaagaaccccagtcaata

SEQ ID NO: 9311013 - DNA, 22 bp, Homo sapiens
gagcagtggttgaacagaggca

SEQ ID NO: 9311014 - DNA, 22 bp, Homo sapiens
gagcagtgggaaggaacagggt

SEQ ID NO: 9311015 - DNA, 22 bp, Homo sapiens
gagcaggcttgcagagaagggg

SEQ ID NO: 9311016 - DNA, 22 bp, Homo sapiens
gagaggggacctgtgtgtctag

SEQ ID NO: 9311017 - DNA, 21 bp, Homo sapiens
gagcccaggcatctcattaat

SEQ ID NO: 9311018 - DNA, 22 bp, Homo sapiens
gagcccaggttctgcttccagc

SEQ ID NO: 9311019 - DNA, 22 bp, Homo sapiens
gagccagtgatcagacagggag

SEQ ID NO: 9311020 - DNA, 22 bp, Homo sapiens
gagcccagattggaatttccca

SEQ ID NO: 9311021 - DNA, 22 bp, Homo sapiens
gagcccagctaaatttatataa

SEQ ID NO: 9311022 - DNA, 22 bp, Homo sapiens
gagcccagctctacctcagact

SEQ ID NO: 9311023 - DNA, 22 bp, Homo sapiens
gagcccagctgcggccctcagc

SEQ ID NO: 9311024 - DNA, 22 bp, Homo sapiens
gagcccaggagtttgatgctgc

SEQ ID NO: 9311025 - DNA, 22 bp, Homo sapiens
gagcccaggaagtggaggctga

SEQ ID NO: 9311026 - DNA, 22 bp, Homo sapiens
gacagcagatgaagcctgcaga

SEQ ID NO: 9311027 - DNA, 22 bp, Homo sapiens
gaccaggacacagtggcaaggt

SEQ ID NO: 9311028 - DNA, 22 bp, Homo sapiens
gaccaggaaagagtgtgactaa

SEQ ID NO: 9311029 - DNA, 22 bp, Homo sapiens
gaccaggctagttcagagcttc

SEQ ID NO: 9311030 - DNA, 22 bp, Homo sapiens
gactctggttgcgggttctgct

SEQ ID NO: 9311031 - DNA, 22 bp, Homo sapiens
gactctggtgacttgacctgta

SEQ ID NO: 9311032 - DNA, 22 bp, Homo sapiens
gagacctcttggtatcgctagg

SEQ ID NO: 9311033 - DNA, 22 bp, Homo sapiens
gagaccccagctcagcctccag

SEQ ID NO: 9311034 - DNA, 22 bp, Homo sapiens
gagactggtgtttgctgggctg

SEQ ID NO: 9311035 - DNA, 22 bp, Homo sapiens
gagagaacacaaagggccagct

SEQ ID NO: 9311036 - DNA, 18 bp, Homo sapiens
gagagggatccctcagga

SEQ ID NO: 9311037 - DNA, 22 bp, Homo sapiens
gagagggccgggggccagctcc

SEQ ID NO: 9311038 - DNA, 22 bp, Homo sapiens
gagagggccagggtgagaacta

SEQ ID NO: 9311039 - DNA, 22 bp, Homo sapiens
gagagggccagggtgagaacta

SEQ ID NO: 9311040 - DNA, 22 bp, Homo sapiens
gagaaaggcatccttggcttca

SEQ ID NO: 9311041 - DNA, 22 bp, Homo sapiens
gaaggggagtggctagtgtgtg

SEQ ID NO: 9311042 - DNA, 22 bp, Homo sapiens
gaagggggaaaatgacaacaga

SEQ ID NO: 9311043 - DNA, 22 bp, Homo sapiens
gaaggggactggcagctgcaga

SEQ ID NO: 9311044 - DNA, 22 bp, Homo sapiens
gaaggggaaagttgagcaaata

SEQ ID NO: 9311045 - DNA, 19 bp, Homo sapiens
gaaggggaaggtgggtacc

SEQ ID NO: 9311046 - DNA, 22 bp, Homo sapiens
gaaggtggcgagcggattgctg

SEQ ID NO: 9311047 - DNA, 22 bp, Homo sapiens
gaaggtccagcgtggccaagtc

SEQ ID NO: 9311048 - DNA, 22 bp, Homo sapiens
gaaggtagctgctgagatgaca

SEQ ID NO: 9311049 - DNA, 22 bp, Homo sapiens
gaatatttgtaattactgttga

SEQ ID NO: 9311050 - DNA, 20 bp, Homo sapiens
gaatctttccccatgcaatg

SEQ ID NO: 9311051 - DNA, 22 bp, Homo sapiens
gaatctcagtggaagcaggaag

SEQ ID NO: 9311052 - DNA, 22 bp, Homo sapiens
gaatccttggttttaagcaata

SEQ ID NO: 9311053 - DNA, 22 bp, Homo sapiens
gaatgatatattagcagatttt

SEQ ID NO: 9311054 - DNA, 22 bp, Homo sapiens
gaatgatattatttcgtgctgg

SEQ ID NO: 9311055 - DNA, 22 bp, Homo sapiens
gaatgatagagctgccttcgga

SEQ ID NO: 9311056 - DNA, 22 bp, Homo sapiens
gaatgataaatggaagcagcat

SEQ ID NO: 9311057 - DNA, 22 bp, Homo sapiens
gaatgagttaatatttgcttgg

SEQ ID NO: 9311058 - DNA, 22 bp, Homo sapiens
gaatgaaagatttgcattctat

SEQ ID NO: 9311059 - DNA, 22 bp, Homo sapiens
gaagcaaaatgtctgcacatat

SEQ ID NO: 9311060 - DNA, 22 bp, Homo sapiens
gaagcaaagagctagtgccgct

SEQ ID NO: 9311061 - DNA, 21 bp, Homo sapiens
gaagccaagacaggatcaagg

SEQ ID NO: 9311062 - DNA, 22 bp, Homo sapiens
gaagcatataggtactgaacta

SEQ ID NO: 9311063 - DNA, 22 bp, Homo sapiens
gaagcatactttctatactgct

SEQ ID NO: 9311064 - DNA, 17 bp, Homo sapiens
gaaaggaggcaacactg

SEQ ID NO: 9311065 - DNA, 22 bp, Homo sapiens
gaaaggagtgctttccaggtct

SEQ ID NO: 9311066 - DNA, 22 bp, Homo sapiens
gaaaggagggaaacagagcggt

SEQ ID NO: 9311067 - DNA, 22 bp, Homo sapiens
gaagccacgttaaattggctgt

SEQ ID NO: 9311068 - DNA, 22 bp, Homo sapiens
gaaggagccgagctcttcccca

SEQ ID NO: 9311069 - DNA, 22 bp, Homo sapiens
gaaggagctaaagggagccctg

SEQ ID NO: 9311070 - DNA, 22 bp, Homo sapiens
gaaggagctaaagggagccctg

SEQ ID NO: 9311071 - DNA, 22 bp, Homo sapiens
gaaggcagggaatgtggtgcta

SEQ ID NO: 9311072 - DNA, 22 bp, Homo sapiens
gaaggcaggcttctgattaggt

SEQ ID NO: 9311073 - DNA, 22 bp, Homo sapiens
gaaggcaggtttttcaaaactg

SEQ ID NO: 9311074 - DNA, 22 bp, Homo sapiens
gaaggcagtaaatggctgtttt

SEQ ID NO: 9311075 - DNA, 22 bp, Homo sapiens
gaagggaatttggagggtttca

SEQ ID NO: 9311076 - DNA, 22 bp, Homo sapiens
ctgctgagccgcacccaggagc

SEQ ID NO: 9311077 - DNA, 22 bp, Homo sapiens
ctgctctgaagccaggattctg

SEQ ID NO: 9311078 - DNA, 22 bp, Homo sapiens
ctgctctctttcagagacaggt

SEQ ID NO: 9311079 - DNA, 22 bp, Homo sapiens
ctgctctccccaggccagtctg

SEQ ID NO: 9311080 - DNA, 22 bp, Homo sapiens
ctgctggaaggtacacatcttg

SEQ ID NO: 9311081 - DNA, 22 bp, Homo sapiens
ctgctggaagtttgctgtggat

SEQ ID NO: 9311082 - DNA, 22 bp, Homo sapiens
ctgctggagggagctgatagtg

SEQ ID NO: 9311083 - DNA, 22 bp, Homo sapiens
ctgctgccttccaaaggccagg

SEQ ID NO: 9311084 - DNA, 22 bp, Homo sapiens
ctgcctcttaagtggatggagt

SEQ ID NO: 9311085 - DNA, 22 bp, Homo sapiens
ctgcctctgttgggcatggtct

SEQ ID NO: 9311086 - DNA, 22 bp, Homo sapiens
ctgcctgagtacaagtcccaga

SEQ ID NO: 9311087 - DNA, 22 bp, Homo sapiens
ctgcctgcatgctgccatagct

SEQ ID NO: 9311088 - DNA, 22 bp, Homo sapiens
ctgcctgcatcccacagtgggg

SEQ ID NO: 9311089 - DNA, 20 bp, Homo sapiens
ctgctccacccggctctcag

SEQ ID NO: 9311090 - DNA, 22 bp, Homo sapiens
ctgctccacacctccatttcct

SEQ ID NO: 9311091 - DNA, 22 bp, Homo sapiens
ctgcgttcattttgagtgctgt

SEQ ID NO: 9311092 - DNA, 22 bp, Homo sapiens
ctgctccaagccagccctgcag

SEQ ID NO: 9311093 - DNA, 22 bp, Homo sapiens
ctgctccaagccagccctgcag

SEQ ID NO: 9311094 - DNA, 22 bp, Homo sapiens
ctgctccagacacctgcagggg

SEQ ID NO: 9311095 - DNA, 22 bp, Homo sapiens
ctgctccagacacctgcagggg

SEQ ID NO: 9311096 - DNA, 22 bp, Homo sapiens
ctgctcctccccatcaggcagc

SEQ ID NO: 9311097 - DNA, 22 bp, Homo sapiens
ctgctccagtagccccatgtgg

SEQ ID NO: 9311098 - DNA, 22 bp, Homo sapiens
ctgctccaggatttcaggccag

SEQ ID NO: 9311099 - DNA, 18 bp, Homo sapiens
ctgctccagtctggccag

SEQ ID NO: 9311100 - DNA, 22 bp, Homo sapiens
ctgctccccagcctgcgccttt

SEQ ID NO: 9311101 - DNA, 19 bp, Homo sapiens
ctgctccctccttctggca

SEQ ID NO: 9311102 - DNA, 19 bp, Homo sapiens
ctgctccctccttctggca

SEQ ID NO: 9311103 - DNA, 22 bp, Homo sapiens
ctgcctctattcactgaggcag

SEQ ID NO: 9311104 - DNA, 22 bp, Homo sapiens
ctgccctgggccaggaagcggc

SEQ ID NO: 9311105 - DNA, 22 bp, Homo sapiens
ctgcctctgttgggcatggtct

SEQ ID NO: 9311106 - DNA, 22 bp, Homo sapiens
ctgcctctggttttggtccctg

SEQ ID NO: 9311107 - DNA, 22 bp, Homo sapiens
ctgcctctggcctcaggcccag

SEQ ID NO: 9311108 - DNA, 22 bp, Homo sapiens
ctgcctctggttttggtccctg

SEQ ID NO: 9311109 - DNA, 22 bp, Homo sapiens
ctgcctctattcactgaggcag

SEQ ID NO: 9311110 - DNA, 22 bp, Homo sapiens
ctgcctctggcctcaggcccag

SEQ ID NO: 9311111 - DNA, 22 bp, Homo sapiens
ctgccctggcagcctaccatgg

SEQ ID NO: 9311112 - DNA, 22 bp, Homo sapiens
ctgccctgctctccgggatctt

SEQ ID NO: 9311113 - DNA, 22 bp, Homo sapiens
ctgcccctggtgatggacgcca

SEQ ID NO: 9311114 - DNA, 20 bp, Homo sapiens
ctgcagtcccctctgaatca

SEQ ID NO: 9311115 - DNA, 22 bp, Homo sapiens
ctgcccctgctcatggctgtcc

SEQ ID NO: 9311116 - DNA, 22 bp, Homo sapiens
ctgcagggtttttcaaggacaa

SEQ ID NO: 9311117 - DNA, 22 bp, Homo sapiens
ctgcagggtttttcaaggacaa

SEQ ID NO: 9311118 - DNA, 22 bp, Homo sapiens
ctgcaggggcctcgagcacagg

SEQ ID NO: 9311119 - DNA, 22 bp, Homo sapiens
ctgagggcttccttgtcccggg

SEQ ID NO: 9311120 - DNA, 22 bp, Homo sapiens
ctgcaggggctggagttggctt

SEQ ID NO: 9311121 - DNA, 22 bp, Homo sapiens
ctgagggctggagctgaggcct

SEQ ID NO: 9311122 - DNA, 22 bp, Homo sapiens
ctgaaaaatatgttttggagaa

SEQ ID NO: 9311123 - DNA, 22 bp, Homo sapiens
ctgaaaatgttacacaggaaga

SEQ ID NO: 9311124 - DNA, 22 bp, Homo sapiens
ctgaaagaataagatgtttaca

SEQ ID NO: 9311125 - DNA, 22 bp, Homo sapiens
tttttctgtctcttacattgca

SEQ ID NO: 9311126 - DNA, 22 bp, Homo sapiens
tttttcttaaatgtgggttggc

SEQ ID NO: 9311127 - DNA, 22 bp, Homo sapiens
tttttctggataactgtatctc

SEQ ID NO: 9311128 - DNA, 20 bp, Homo sapiens
tttttctgggcttccatagc

SEQ ID NO: 9311129 - DNA, 22 bp, Homo sapiens
tttttctgtaaagggccagaga

SEQ ID NO: 9311130 - DNA, 20 bp, Homo sapiens
tttttctgggcttccatagc

SEQ ID NO: 9311131 - DNA, 22 bp, Homo sapiens
ctgaaggaggtagagtgacata

SEQ ID NO: 9311132 - DNA, 22 bp, Homo sapiens
ttttctccaactcaaaggaaag

SEQ ID NO: 9311133 - DNA, 21 bp, Homo sapiens
ttttctccagctgtgatttta

SEQ ID NO: 9311134 - DNA, 18 bp, Homo sapiens
tttttctgataaaacaag

SEQ ID NO: 9311135 - DNA, 22 bp, Homo sapiens
tttttctgagaatatgagagga

SEQ ID NO: 9311136 - DNA, 22 bp, Homo sapiens
tttttctgagcggtaatcatca

SEQ ID NO: 9311137 - DNA, 22 bp, Homo sapiens
tttttctgccattcaaagagga

SEQ ID NO: 9311138 - DNA, 22 bp, Homo sapiens
tttttctgccattcaaagagga

SEQ ID NO: 9311139 - DNA, 22 bp, Homo sapiens
tttttctagctcaaagattcta

SEQ ID NO: 9311140 - DNA, 19 bp, Homo sapiens
tttttacaagtaggtgtga

SEQ ID NO: 9311141 - DNA, 22 bp, Homo sapiens
ttttctcctaagacccttcacc

SEQ ID NO: 9311142 - DNA, 17 bp, Homo sapiens
ttttctcctgcccattc

SEQ ID NO: 9311143 - DNA, 22 bp, Homo sapiens
ttttctcccgctggctgctctt

SEQ ID NO: 9311144 - DNA, 22 bp, Homo sapiens
ttttctccagggaacaaggtga

SEQ ID NO: 9311145 - DNA, 22 bp, Homo sapiens
ttttctccccagagaccatcat

SEQ ID NO: 9311146 - DNA, 22 bp, Homo sapiens
ttttctctatattgtctgtgaa

SEQ ID NO: 9311147 - DNA, 22 bp, Homo sapiens
ttttctcctttcaagatagcat

SEQ ID NO: 9311148 - DNA, 22 bp, Homo sapiens
ttttctcctttctaggtcacat

SEQ ID NO: 9311149 - DNA, 22 bp, Homo sapiens
ctgagatggtctctttgttact

SEQ ID NO: 9311150 - DNA, 22 bp, Homo sapiens
ctgagatggtctctttgttact

SEQ ID NO: 9311151 - DNA, 22 bp, Homo sapiens
ctgagatggtagatggatgtta

SEQ ID NO: 9311152 - DNA, 22 bp, Homo sapiens
ctgagatggccactgggtctca

SEQ ID NO: 9311153 - DNA, 22 bp, Homo sapiens
ctgagatggagttttgctcttg

SEQ ID NO: 9311154 - DNA, 22 bp, Homo sapiens
ctgagatggagtttcgctcttc

SEQ ID NO: 9311155 - DNA, 22 bp, Homo sapiens
ctgagcaatttcagctctcact

SEQ ID NO: 9311156 - DNA, 22 bp, Homo sapiens
ctgaataatacagactagcttc

SEQ ID NO: 9311157 - DNA, 22 bp, Homo sapiens
ctgagaggggaccagggtgttt

SEQ ID NO: 9311158 - DNA, 22 bp, Homo sapiens
ctgagaggtaagcagcgcagtg

SEQ ID NO: 9311159 - DNA, 22 bp, Homo sapiens
ctgagaggtgctggtggctgca

SEQ ID NO: 9311160 - DNA, 18 bp, Homo sapiens
ctgaggctggcaggagcc

SEQ ID NO: 9311161 - DNA, 22 bp, Homo sapiens
ctgaggctgggcatggggtcca

SEQ ID NO: 9311162 - DNA, 22 bp, Homo sapiens
ctgaggacattgatgaggcaat

SEQ ID NO: 9311163 - DNA, 22 bp, Homo sapiens
ctccccaggttcaggaggtggg

SEQ ID NO: 9311164 - DNA, 22 bp, Homo sapiens
ctccccagccctggtattctga

SEQ ID NO: 9311165 - DNA, 22 bp, Homo sapiens
ttgtttatcgcttgctcacata

SEQ ID NO: 9311166 - DNA, 22 bp, Homo sapiens
ttgtttatgtgttgtctatggc

SEQ ID NO: 9311167 - DNA, 22 bp, Homo sapiens
ttgtttatggattgtagaaact

SEQ ID NO: 9311168 - DNA, 22 bp, Homo sapiens
ttgtttatgtaattggcacact

SEQ ID NO: 9311169 - DNA, 20 bp, Homo sapiens
ttgtttattatgttctgatc

SEQ ID NO: 9311170 - DNA, 21 bp, Homo sapiens
ctcaggctggcagcaggctag

SEQ ID NO: 9311171 - DNA, 22 bp, Homo sapiens
ctcccagggccatcgagtcact

SEQ ID NO: 9311172 - DNA, 22 bp, Homo sapiens
ctccccacatttctccctgtct

SEQ ID NO: 9311173 - DNA, 22 bp, Homo sapiens
ctccccacatttctccctgtct

SEQ ID NO: 9311174 - DNA, 22 bp, Homo sapiens
ctccccaagccttggcttctcc

SEQ ID NO: 9311175 - DNA, 21 bp, Homo sapiens
ctcctcaggaccagccacagg

SEQ ID NO: 9311176 - DNA, 22 bp, Homo sapiens
ctcctcagtcaggtctagggtc

SEQ ID NO: 9311177 - DNA, 22 bp, Homo sapiens
ctcctcagggctggttacatgg

SEQ ID NO: 9311178 - DNA, 22 bp, Homo sapiens
ctcctcaggaagtagcatgtgt

SEQ ID NO: 9311179 - DNA, 20 bp, Homo sapiens
ctcctcagttccatgggagg

SEQ ID NO: 9311180 - DNA, 19 bp, Homo sapiens
ctcctcagtcccagaggtc

SEQ ID NO: 9311181 - DNA, 22 bp, Homo sapiens
ctccctggggctcctcctattt

SEQ ID NO: 9311182 - DNA, 22 bp, Homo sapiens
ctcccttccaatgactatgctt

SEQ ID NO: 9311183 - DNA, 22 bp, Homo sapiens
ctcccttcaggagaggctcaca

SEQ ID NO: 9311184 - DNA, 22 bp, Homo sapiens
ctcctcagctgggaggagtccc

SEQ ID NO: 9311185 - DNA, 22 bp, Homo sapiens
ctccgagactcgagtgtcctca

SEQ ID NO: 9311186 - DNA, 22 bp, Homo sapiens
ctccctgggcagatgtggctct

SEQ ID NO: 9311187 - DNA, 22 bp, Homo sapiens
ctccctgggcctcagtttctct

SEQ ID NO: 9311188 - DNA, 22 bp, Homo sapiens
ctccctggcagccgcactcctg

SEQ ID NO: 9311189 - DNA, 22 bp, Homo sapiens
ctccctgaggacaggccctgtc

SEQ ID NO: 9311190 - DNA, 22 bp, Homo sapiens
ctccctgaggacaggccctgtc

SEQ ID NO: 9311191 - DNA, 22 bp, Homo sapiens
ctccctgagtttgtggctaagt

SEQ ID NO: 9311192 - DNA, 22 bp, Homo sapiens
ctccctgacaggccatgggctt

SEQ ID NO: 9311193 - DNA, 22 bp, Homo sapiens
ctccctgacctggattccaggc

SEQ ID NO: 9311194 - DNA, 22 bp, Homo sapiens
ctccctgaaattcagatgcctc

SEQ ID NO: 9311195 - DNA, 22 bp, Homo sapiens
ctccctgcttgtttcccttcag

SEQ ID NO: 9311196 - DNA, 22 bp, Homo sapiens
ctccctgcttgtttcccttcag

SEQ ID NO: 9311197 - DNA, 22 bp, Homo sapiens
ctccctgcttgtttcccttcag

SEQ ID NO: 9311198 - DNA, 22 bp, Homo sapiens
ctccctggaggcccagacctgg

SEQ ID NO: 9311199 - DNA, 22 bp, Homo sapiens
ctcctgctcctgcttgcaagga

SEQ ID NO: 9311200 - DNA, 22 bp, Homo sapiens
ctcctcagttgtcccatggaga

SEQ ID NO: 9311201 - DNA, 22 bp, Homo sapiens
tttacaatagggtctgaatgaa

SEQ ID NO: 9311202 - DNA, 22 bp, Homo sapiens
tttacaagtttacagaatgatg

SEQ ID NO: 9311203 - DNA, 22 bp, Homo sapiens
tttacaattggttttctctaat

SEQ ID NO: 9311204 - DNA, 22 bp, Homo sapiens
ctcctgtcaataggctcctggc

SEQ ID NO: 9311205 - DNA, 22 bp, Homo sapiens
ctcctgtcagaagcatcctgag

SEQ ID NO: 9311206 - DNA, 22 bp, Homo sapiens
ctcctgggcttcgaaggctccc

SEQ ID NO: 9311207 - DNA, 22 bp, Homo sapiens
tttcaaatagaatctttccaaa

SEQ ID NO: 9311208 - DNA, 22 bp, Homo sapiens
tttcaaataccataaacctaat

SEQ ID NO: 9311209 - DNA, 22 bp, Homo sapiens
ctccttcctggttagcacctta

SEQ ID NO: 9311210 - DNA, 22 bp, Homo sapiens
ctctgcttgtgtcaggcatgct

SEQ ID NO: 9311211 - DNA, 22 bp, Homo sapiens
tttcttctttcccagtgatggg

SEQ ID NO: 9311212 - DNA, 22 bp, Homo sapiens
tttcttgaagtcctaaccctca

SEQ ID NO: 9311213 - DNA, 22 bp, Homo sapiens
tttcttctgtttgtagttacac

SEQ ID NO: 9311214 - DNA, 22 bp, Homo sapiens
tttcttcttaatactggctgct

SEQ ID NO: 9311215 - DNA, 22 bp, Homo sapiens
tttcttagcgatgcttgataaa

SEQ ID NO: 9311216 - DNA, 22 bp, Homo sapiens
tttcttagcgatgcttgataaa

SEQ ID NO: 9311217 - DNA, 21 bp, Homo sapiens
tttcttaggctctaaaatgac

SEQ ID NO: 9311218 - DNA, 22 bp, Homo sapiens
tttcttatactatattgtcatc

SEQ ID NO: 9311219 - DNA, 22 bp, Homo sapiens
ctctgctggtagctcattccat

SEQ ID NO: 9311220 - DNA, 22 bp, Homo sapiens
ctctgcttggaactggacagaa

SEQ ID NO: 9311221 - DNA, 22 bp, Homo sapiens
ctctgcttggaacaggggtttg

SEQ ID NO: 9311222 - DNA, 22 bp, Homo sapiens
ctctgcttgtatcacatttgct

SEQ ID NO: 9311223 - DNA, 19 bp, Homo sapiens
ctctgcttggtccatatgc

SEQ ID NO: 9311224 - DNA, 19 bp, Homo sapiens
ctctgcttggtccatatgc

SEQ ID NO: 9311225 - DNA, 22 bp, Homo sapiens
ctctgcttctgagatggaagct

SEQ ID NO: 9311226 - DNA, 22 bp, Homo sapiens
ctctgcttcatccaccactggc

SEQ ID NO: 9311227 - DNA, 22 bp, Homo sapiens
ctctgctgcttgccagtcattg

SEQ ID NO: 9311228 - DNA, 22 bp, Homo sapiens
ctctgctgcccaggcctgctag

SEQ ID NO: 9311229 - DNA, 22 bp, Homo sapiens
ctctctggatatttgtatgctg

SEQ ID NO: 9311230 - DNA, 22 bp, Homo sapiens
ctctgaggtcctacagtgaccc

SEQ ID NO: 9311231 - DNA, 22 bp, Homo sapiens
ctctgaggtctaggaccatggc

SEQ ID NO: 9311232 - DNA, 22 bp, Homo sapiens
ctctctggaagggggagctgat

SEQ ID NO: 9311233 - DNA, 20 bp, Homo sapiens
ctctctggaaggtgggagcc

SEQ ID NO: 9311234 - DNA, 22 bp, Homo sapiens
tttctctcagcctgtagaaact

SEQ ID NO: 9311235 - DNA, 19 bp, Homo sapiens
tttctctccctcatcccga

SEQ ID NO: 9311236 - DNA, 22 bp, Homo sapiens
tttctctccccaagtggaattg

SEQ ID NO: 9311237 - DNA, 22 bp, Homo sapiens
tttctctctacagtactttcat

SEQ ID NO: 9311238 - DNA, 22 bp, Homo sapiens
tttctctcctccaaaccaaaga

SEQ ID NO: 9311239 - DNA, 22 bp, Homo sapiens
tttctctctacagtactttcat

SEQ ID NO: 9311240 - DNA, 19 bp, Homo sapiens
tttctctccctcatcccga

SEQ ID NO: 9311241 - DNA, 22 bp, Homo sapiens
tttctctcttaaggagtttaaa

SEQ ID NO: 9311242 - DNA, 22 bp, Homo sapiens
tttctctctggccctgattgtc

SEQ ID NO: 9311243 - DNA, 22 bp, Homo sapiens
tttctctctggccctgattgtc

SEQ ID NO: 9311244 - DNA, 16 bp, Homo sapiens
tttctctctgctattt

SEQ ID NO: 9311245 - DNA, 22 bp, Homo sapiens
tttctctctgactgggagctga

SEQ ID NO: 9311246 - DNA, 22 bp, Homo sapiens
tttctctctatttagacaggta

SEQ ID NO: 9311247 - DNA, 22 bp, Homo sapiens
ctctagggaagaatgagagccc

SEQ ID NO: 9311248 - DNA, 22 bp, Homo sapiens
ctctcaaagaaattgcctgtca

SEQ ID NO: 9311249 - DNA, 22 bp, Homo sapiens
ctctcaaatgtcattcctctat

SEQ ID NO: 9311250 - DNA, 20 bp, Homo sapiens
ctctcacagctccctcagcc

SEQ ID NO: 9311251 - DNA, 22 bp, Homo sapiens
ctcactggcaagactacaggtg

SEQ ID NO: 9311252 - DNA, 22 bp, Homo sapiens
ttcttcagtgcccctctagtag

SEQ ID NO: 9311253 - DNA, 22 bp, Homo sapiens
ttgaaggacatcctatttctag

SEQ ID NO: 9311254 - DNA, 22 bp, Homo sapiens
ttgaaggacatcttgtttctag

SEQ ID NO: 9311255 - DNA, 22 bp, Homo sapiens
ttcttcccttcattccaccacc

SEQ ID NO: 9311256 - DNA, 22 bp, Homo sapiens
ttgaaggaggctcctttttaaa

SEQ ID NO: 9311257 - DNA, 21 bp, Homo sapiens
ttgaaggatcacttctgtacc

SEQ ID NO: 9311258 - DNA, 22 bp, Homo sapiens
ttgaaggaggcgaaaattggtc

SEQ ID NO: 9311259 - DNA, 23 bp, Homo sapiens
ttgaaggagaaagctttcttggt

SEQ ID NO: 9311260 - DNA, 22 bp, Homo sapiens
ttctcttttgtgatgtgagatg

SEQ ID NO: 9311261 - DNA, 22 bp, Homo sapiens
ttctgaaaacacactttgcagc

SEQ ID NO: 9311262 - DNA, 22 bp, Homo sapiens
ttcttcagggaagcttgttaat

SEQ ID NO: 9311263 - DNA, 22 bp, Homo sapiens
ttcttcagtctaggcctttctt

SEQ ID NO: 9311264 - DNA, 22 bp, Homo sapiens
ttcttcaggtggttttggtaac

SEQ ID NO: 9311265 - DNA, 22 bp, Homo sapiens
ttcttcaggatacgtcatccag

SEQ ID NO: 9311266 - DNA, 21 bp, Homo sapiens
ttcttcaggccaatgctcatt

SEQ ID NO: 9311267 - DNA, 22 bp, Homo sapiens
ttcttaatcccacaaatcttca

SEQ ID NO: 9311268 - DNA, 22 bp, Homo sapiens
ttcttaatacctattttctacc

SEQ ID NO: 9311269 - DNA, 22 bp, Homo sapiens
ttcttaaagaggcaaaacacag

SEQ ID NO: 9311270 - DNA, 20 bp, Homo sapiens
ttcttaaagacctcactttg

SEQ ID NO: 9311271 - DNA, 20 bp, Homo sapiens
ttcttaaagacctcactttg

SEQ ID NO: 9311272 - DNA, 22 bp, Homo sapiens
ctcagccagacatgacccagtc

SEQ ID NO: 9311273 - DNA, 22 bp, Homo sapiens
ctcagccaggagagtgttcaca

SEQ ID NO: 9311274 - DNA, 22 bp, Homo sapiens
ctcagccagtgatctttccttt

SEQ ID NO: 9311275 - DNA, 22 bp, Homo sapiens
ctcaggccaggtttctcccaca

SEQ ID NO: 9311276 - DNA, 22 bp, Homo sapiens
ctcaggccaataagctccagcc

SEQ ID NO: 9311277 - DNA, 22 bp, Homo sapiens
ttgcaaaaactgcaattacttt

SEQ ID NO: 9311278 - DNA, 23 bp, Homo sapiens
ttgcaaaatgcaattgagttaga

SEQ ID NO: 9311279 - DNA, 23 bp, Homo sapiens
ttgcaaaatgagtcttgagtgaa

SEQ ID NO: 9311280 - DNA, 22 bp, Homo sapiens
ttgatattttgcacgcttggta

SEQ ID NO: 9311281 - DNA, 22 bp, Homo sapiens
ttgcaaaaaccacaattacttt

SEQ ID NO: 9311282 - DNA, 22 bp, Homo sapiens
ttgctgagcagtgtttaattgt

SEQ ID NO: 9311283 - DNA, 22 bp, Homo sapiens
ctcaggcctgagtggcagtccc

SEQ ID NO: 9311284 - DNA, 22 bp, Homo sapiens
ttgcacagatgcacatggttgc

SEQ ID NO: 9311285 - DNA, 22 bp, Homo sapiens
ttgctgccttgtctcagggtct

SEQ ID NO: 9311286 - DNA, 22 bp, Homo sapiens
ttgctgtaagtatctttctacc

SEQ ID NO: 9311287 - DNA, 22 bp, Homo sapiens
ttgctgtaccaaagattcctga

SEQ ID NO: 9311288 - DNA, 22 bp, Homo sapiens
ttgctgtagctcatttcactct

SEQ ID NO: 9311289 - DNA, 22 bp, Homo sapiens
ttgctgtaggctgattgctgaa

SEQ ID NO: 9311290 - DNA, 22 bp, Homo sapiens
ttgctgtagtgttctgatgtca

SEQ ID NO: 9311291 - DNA, 20 bp, Homo sapiens
cgcagcagtggaagtggaat

SEQ ID NO: 9311292 - DNA, 22 bp, Homo sapiens
ttcagggctgacaagcctattg

SEQ ID NO: 9311293 - DNA, 22 bp, Homo sapiens
ttcagggctgacaagcctattg

SEQ ID NO: 9311294 - DNA, 23 bp, Homo sapiens
ttcagggcctcagaggtgaagct

SEQ ID NO: 9311295 - DNA, 23 bp, Homo sapiens
ttcagggcctcagaggtgaagct

SEQ ID NO: 9311296 - DNA, 22 bp, Homo sapiens
ttcagggccctgagagggcagt

SEQ ID NO: 9311297 - DNA, 22 bp, Homo sapiens
ttcagggccctgagagggcagt

SEQ ID NO: 9311298 - DNA, 22 bp, Homo sapiens
cggctgggtagaggtgccgggt

SEQ ID NO: 9311299 - DNA, 22 bp, Homo sapiens
ttcagtttgaattctgtagaac

SEQ ID NO: 9311300 - DNA, 22 bp, Homo sapiens
ttccaaattaaaatgtacaatg

SEQ ID NO: 9311301 - DNA, 21 bp, Homo sapiens
cggcttcattttcttctggtt

SEQ ID NO: 9311302 - DNA, 22 bp, Homo sapiens
cggctgggttcggctgcaggcc

SEQ ID NO: 9311303 - DNA, 22 bp, Homo sapiens
cggctgggttcggctgcaggcc

SEQ ID NO: 9311304 - DNA, 22 bp, Homo sapiens
cggcttcagtaattccatgtcc

SEQ ID NO: 9311305 - DNA, 22 bp, Homo sapiens
cggcttcagtaattccatgtcc

SEQ ID NO: 9311306 - DNA, 22 bp, Homo sapiens
cggcttcagctcaggcccctcg

SEQ ID NO: 9311307 - DNA, 22 bp, Homo sapiens
cggcttcaaagggagcgagatc

SEQ ID NO: 9311308 - DNA, 21 bp, Homo sapiens
cggcttcattttcttctggtt

SEQ ID NO: 9311309 - DNA, 22 bp, Homo sapiens
cggcttcatgagaaatgacaga

SEQ ID NO: 9311310 - DNA, 22 bp, Homo sapiens
cggcttcatctttacttcaaga

SEQ ID NO: 9311311 - DNA, 22 bp, Homo sapiens
cggcttcagtctcatcatcgcc

SEQ ID NO: 9311312 - DNA, 22 bp, Homo sapiens
cggcttccagcaggtgctgcgc

SEQ ID NO: 9311313 - DNA, 22 bp, Homo sapiens
cggcttccagcaggtgctgcgc

SEQ ID NO: 9311314 - DNA, 19 bp, Homo sapiens
cgtccaggtgctggaagat

SEQ ID NO: 9311315 - DNA, 22 bp, Homo sapiens
cgtcatcacggcaagcatctcc

SEQ ID NO: 9311316 - DNA, 22 bp, Homo sapiens
cgtcatcctttggatgaatcac

SEQ ID NO: 9311317 - DNA, 22 bp, Homo sapiens
ttcctctcctcccaccaggtga

SEQ ID NO: 9311318 - DNA, 22 bp, Homo sapiens
ttcctctcctcacatgagtcac

SEQ ID NO: 9311319 - DNA, 22 bp, Homo sapiens
ttcctccttgtcctagttactg

SEQ ID NO: 9311320 - DNA, 22 bp, Homo sapiens
ttcctctcaacatgcctgccgg

SEQ ID NO: 9311321 - DNA, 22 bp, Homo sapiens
ttcctctcgctctccggggccc

SEQ ID NO: 9311322 - DNA, 22 bp, Homo sapiens
ttcctccagcctggagcacttc

SEQ ID NO: 9311323 - DNA, 22 bp, Homo sapiens
ctagttgtttaatattgattga

SEQ ID NO: 9311324 - DNA, 18 bp, Homo sapiens
ctagggctgtggctctca

SEQ ID NO: 9311325 - DNA, 22 bp, Homo sapiens
ctagtgtacaagtggtggagat

SEQ ID NO: 9311326 - DNA, 22 bp, Homo sapiens
ttctcctgggaggggttgccca

SEQ ID NO: 9311327 - DNA, 21 bp, Homo sapiens
ttctcctgttttgcaccacag

SEQ ID NO: 9311328 - DNA, 22 bp, Homo sapiens
ttctcctttgtaattctcatcc

SEQ ID NO: 9311329 - DNA, 22 bp, Homo sapiens
ttctcagtgaagtttagaacat

SEQ ID NO: 9311330 - DNA, 22 bp, Homo sapiens
ttctcaggtgaggctgaggctg

SEQ ID NO: 9311331 - DNA, 22 bp, Homo sapiens
ttctcatggtgtctttatacat

SEQ ID NO: 9311332 - DNA, 22 bp, Homo sapiens
ttctcctgcgcaggcccaggga

SEQ ID NO: 9311333 - DNA, 19 bp, Homo sapiens
ttctaccttactgtaggct

SEQ ID NO: 9311334 - DNA, 22 bp, Homo sapiens
ttctacctaccctctgcataca

SEQ ID NO: 9311335 - DNA, 22 bp, Homo sapiens
ctacataaatatttatgtgtct

SEQ ID NO: 9311336 - DNA, 22 bp, Homo sapiens
ctacatcaagtaatcttcaaaa

SEQ ID NO: 9311337 - DNA, 22 bp, Homo sapiens
ctacataatctggatttgtctg

SEQ ID NO: 9311338 - DNA, 22 bp, Homo sapiens
ctacattaaattggcttactta

SEQ ID NO: 9311339 - DNA, 22 bp, Homo sapiens
ttacaataccacatcacctcat

SEQ ID NO: 9311340 - DNA, 20 bp, Homo sapiens
ttacaagtttctaataacca

SEQ ID NO: 9311341 - DNA, 22 bp, Homo sapiens
ttaatatacaattttacgggct

SEQ ID NO: 9311342 - DNA, 22 bp, Homo sapiens
ttaaggaaacatttttccatag

SEQ ID NO: 9311343 - DNA, 22 bp, Homo sapiens
cctgtacaagctcttggtgaca

SEQ ID NO: 9311344 - DNA, 22 bp, Homo sapiens
ttaaaagtctgatgatttacat

SEQ ID NO: 9311345 - DNA, 22 bp, Homo sapiens
ttaaaagggtaagcagcaactt

SEQ ID NO: 9311346 - DNA, 22 bp, Homo sapiens
cctggtttgggtgccagtgagt

SEQ ID NO: 9311347 - DNA, 22 bp, Homo sapiens
cctgtaactccttggctcaagt

SEQ ID NO: 9311348 - DNA, 22 bp, Homo sapiens
ttaaaatcacagtcacccagta

SEQ ID NO: 9311349 - DNA, 22 bp, Homo sapiens
ttaaaatccagtgttggtggat

SEQ ID NO: 9311350 - DNA, 22 bp, Homo sapiens
ttaaaatagccagtgcccctct

SEQ ID NO: 9311351 - DNA, 22 bp, Homo sapiens
ttaaaatctaaagcagttgtct

SEQ ID NO: 9311352 - DNA, 22 bp, Homo sapiens
ttaaaatcgctgttgcttctgt

SEQ ID NO: 9311353 - DNA, 22 bp, Homo sapiens
tgtttatacctgcaacctgtca

SEQ ID NO: 9311354 - DNA, 22 bp, Homo sapiens
tgttggctattattattactgc

SEQ ID NO: 9311355 - DNA, 22 bp, Homo sapiens
cctggggagccgcctgagcccc

SEQ ID NO: 9311356 - DNA, 23 bp, Homo sapiens
cctggggcacttgagtcctcatc

SEQ ID NO: 9311357 - DNA, 22 bp, Homo sapiens
cctggggagccgcctgagcccc

SEQ ID NO: 9311358 - DNA, 23 bp, Homo sapiens
cctggggagctgtatccagagtg

SEQ ID NO: 9311359 - DNA, 22 bp, Homo sapiens
tgtttcttctcacacaaactca

SEQ ID NO: 9311360 - DNA, 22 bp, Homo sapiens
tgttggcagattgtctagggtt

SEQ ID NO: 9311361 - DNA, 22 bp, Homo sapiens
cctgctcctgctattcttctgg

SEQ ID NO: 9311362 - DNA, 22 bp, Homo sapiens
cctgctccatgctcaccatcag

SEQ ID NO: 9311363 - DNA, 22 bp, Homo sapiens
cctgctccatgctcaccatcag

SEQ ID NO: 9311364 - DNA, 22 bp, Homo sapiens
tgttgcacggccttcacagagc

SEQ ID NO: 9311365 - DNA, 22 bp, Homo sapiens
cctgcgtcgtgtgggcagtgac

SEQ ID NO: 9311366 - DNA, 22 bp, Homo sapiens
cctgcgtccacggctgggagac

SEQ ID NO: 9311367 - DNA, 22 bp, Homo sapiens
cctgctcatgggtccctggcag

SEQ ID NO: 9311368 - DNA, 21 bp, Homo sapiens
ccttctccacagggtctccgg

SEQ ID NO: 9311369 - DNA, 21 bp, Homo sapiens
ccttctcttgcttcagcttca

SEQ ID NO: 9311370 - DNA, 20 bp, Homo sapiens
ccttctctggaattgcctcc

SEQ ID NO: 9311371 - DNA, 22 bp, Homo sapiens
ttacagaaggaacactactcag

SEQ ID NO: 9311372 - DNA, 22 bp, Homo sapiens
ttacagaactgtcttgaaattt

SEQ ID NO: 9311373 - DNA, 20 bp, Homo sapiens
ttacagaaatgatgttattt

SEQ ID NO: 9311374 - DNA, 22 bp, Homo sapiens
ttacaatgagacgttcttatct

SEQ ID NO: 9311375 - DNA, 22 bp, Homo sapiens
ccttggcttgtgggctgcagcc

SEQ ID NO: 9311376 - DNA, 22 bp, Homo sapiens
ccttggcttgcacacggccacc

SEQ ID NO: 9311377 - DNA, 22 bp, Homo sapiens
ccttggcttccttccctctaga

SEQ ID NO: 9311378 - DNA, 22 bp, Homo sapiens
ccttggctgtgctgccctttgc

SEQ ID NO: 9311379 - DNA, 22 bp, Homo sapiens
ccttggctgtgctgccctttgc

SEQ ID NO: 9311380 - DNA, 22 bp, Homo sapiens
ccttggctgtgttgcctgccct

SEQ ID NO: 9311381 - DNA, 19 bp, Homo sapiens
ccttgcctgtccctgcagc

SEQ ID NO: 9311382 - DNA, 22 bp, Homo sapiens
ccttggctggaattactctggg

SEQ ID NO: 9311383 - DNA, 22 bp, Homo sapiens
ccttggctgcttatatgtctgt

SEQ ID NO: 9311384 - DNA, 22 bp, Homo sapiens
ccttggctggaattactctggg

SEQ ID NO: 9311385 - DNA, 22 bp, Homo sapiens
ttacgcagctgctccaggaagc

SEQ ID NO: 9311386 - DNA, 22 bp, Homo sapiens
cctttaaatggatgttcaactg

SEQ ID NO: 9311387 - DNA, 22 bp, Homo sapiens
ttatcctggtggcccctaaatc

SEQ ID NO: 9311388 - DNA, 22 bp, Homo sapiens
ccttgtcttgcacagatgcagc

SEQ ID NO: 9311389 - DNA, 22 bp, Homo sapiens
ccttgggtctaggccagggagt

SEQ ID NO: 9311390 - DNA, 22 bp, Homo sapiens
ttattcacatgggctcattcta

SEQ ID NO: 9311391 - DNA, 22 bp, Homo sapiens
ttattcacaaatgttgccctgt

SEQ ID NO: 9311392 - DNA, 22 bp, Homo sapiens
ttattcacttcttggtccctca

SEQ ID NO: 9311393 - DNA, 21 bp, Homo sapiens
cgcagagcgaacttgcggcgc

SEQ ID NO: 9311394 - DNA, 22 bp, Homo sapiens
cgcagagggcaggcagtgctgg

SEQ ID NO: 9311395 - DNA, 22 bp, Homo sapiens
cgcagagggagccgcgggctgc

SEQ ID NO: 9311396 - DNA, 22 bp, Homo sapiens
cgcagagggcaggcagtgctgg

SEQ ID NO: 9311397 - DNA, 19 bp, Homo sapiens
cgcagagggcttctgagag

SEQ ID NO: 9311398 - DNA, 22 bp, Homo sapiens
cgcagcagccccgtggtaggtg

SEQ ID NO: 9311399 - DNA, 22 bp, Homo sapiens
cctttggccctgagagatgatt

SEQ ID NO: 9311400 - DNA, 22 bp, Homo sapiens
cctttggcattttgaggatgcg

SEQ ID NO: 9311401 - DNA, 22 bp, Homo sapiens
cctttggccgctttatggagga

SEQ ID NO: 9311402 - DNA, 22 bp, Homo sapiens
cctttggctgcatagggaaggg

SEQ ID NO: 9311403 - DNA, 22 bp, Homo sapiens
cgcaactcagcaacttaactgc

SEQ ID NO: 9311404 - DNA, 22 bp, Homo sapiens
cgcacattagaagtaactaatg

SEQ ID NO: 9311405 - DNA, 22 bp, Homo sapiens
cgatggagaggtcctgatagtt

SEQ ID NO: 9311406 - DNA, 22 bp, Homo sapiens
cgaggtgggcagatcacagagt

SEQ ID NO: 9311407 - DNA, 22 bp, Homo sapiens
ttatgtatgaatatagtagaag

SEQ ID NO: 9311408 - DNA, 22 bp, Homo sapiens
cctttctgatggcctcccagcc

SEQ ID NO: 9311409 - DNA, 22 bp, Homo sapiens
tatctgttctgcttgattttga

SEQ ID NO: 9311410 - DNA, 22 bp, Homo sapiens
tatctgttagctaatgaatgag

SEQ ID NO: 9311411 - DNA, 23 bp, Homo sapiens
tatctgttctctgagtgtttggt

SEQ ID NO: 9311412 - DNA, 22 bp, Homo sapiens
tatctgttcatgtttatatgtc

SEQ ID NO: 9311413 - DNA, 22 bp, Homo sapiens
tatctgttccaatggagtcagg

SEQ ID NO: 9311414 - DNA, 22 bp, Homo sapiens
tatctgttccaggcactcagct

SEQ ID NO: 9311415 - DNA, 22 bp, Homo sapiens
tatctgttaggatcagagctgg

SEQ ID NO: 9311416 - DNA, 22 bp, Homo sapiens
tatctgttatgggctgaattgc

SEQ ID NO: 9311417 - DNA, 22 bp, Homo sapiens
tatctgttaaaacaagctttaa

SEQ ID NO: 9311418 - DNA, 22 bp, Homo sapiens
tatctgttcaatggaagatgac

SEQ ID NO: 9311419 - DNA, 22 bp, Homo sapiens
tatctagtttgtctagctttgc

SEQ ID NO: 9311420 - DNA, 22 bp, Homo sapiens
tatctataagtactaacatggt

SEQ ID NO: 9311421 - DNA, 22 bp, Homo sapiens
tatctataatgttttacttcct

SEQ ID NO: 9311422 - DNA, 22 bp, Homo sapiens
tatatttaaatccaggttgaaa

SEQ ID NO: 9311423 - DNA, 22 bp, Homo sapiens
tatatttaatcctagagccatt

SEQ ID NO: 9311424 - DNA, 22 bp, Homo sapiens
tatatttaatcctagagccatt

SEQ ID NO: 9311425 - DNA, 22 bp, Homo sapiens
tatatttaattagttgctggat

SEQ ID NO: 9311426 - DNA, 22 bp, Homo sapiens
tatatttaattagttgctggat

SEQ ID NO: 9311427 - DNA, 22 bp, Homo sapiens
tatatttaattagttgctggat

SEQ ID NO: 9311428 - DNA, 22 bp, Homo sapiens
tatatttaatcctagagccatt

SEQ ID NO: 9311429 - DNA, 18 bp, Homo sapiens
tatatttcacacatattc

SEQ ID NO: 9311430 - DNA, 22 bp, Homo sapiens
tatatttaaatccaggttgaaa

SEQ ID NO: 9311431 - DNA, 22 bp, Homo sapiens
tatgcataattggataagtaga

SEQ ID NO: 9311432 - DNA, 22 bp, Homo sapiens
tatgcatacaatgagatattcc

SEQ ID NO: 9311433 - DNA, 22 bp, Homo sapiens
tatctttggtagctttcctaag

SEQ ID NO: 9311434 - DNA, 22 bp, Homo sapiens
tatgcagtgagcactatttata

SEQ ID NO: 9311435 - DNA, 22 bp, Homo sapiens
tatgcacattcacacaaaaatg

SEQ ID NO: 9311436 - DNA, 22 bp, Homo sapiens
tatctttctgtcctagattctg

SEQ ID NO: 9311437 - DNA, 22 bp, Homo sapiens
tatctgtttttacagtgtcttt

SEQ ID NO: 9311438 - DNA, 19 bp, Homo sapiens
tatctgtttcctgcttgtc

SEQ ID NO: 9311439 - DNA, 22 bp, Homo sapiens
tatctgtttattgttactgtca

SEQ ID NO: 9311440 - DNA, 22 bp, Homo sapiens
tatctgtttcctatgcatgtga

SEQ ID NO: 9311441 - DNA, 22 bp, Homo sapiens
tatctgtttctgaggatacatg

SEQ ID NO: 9311442 - DNA, 22 bp, Homo sapiens
tatctgtttgctcacaggtgtt

SEQ ID NO: 9311443 - DNA, 22 bp, Homo sapiens
tatctgttcttagctatagatg

SEQ ID NO: 9311444 - DNA, 22 bp, Homo sapiens
tatctgttggctcctagttgta

SEQ ID NO: 9311445 - DNA, 22 bp, Homo sapiens
tatctgttggctttggaaataa

SEQ ID NO: 9311446 - DNA, 22 bp, Homo sapiens
tatctgttgtagtacagatgat

SEQ ID NO: 9311447 - DNA, 22 bp, Homo sapiens
tatctgttgtccatgcagaaag

SEQ ID NO: 9311448 - DNA, 22 bp, Homo sapiens
tatctgttgtcttttacatgta

SEQ ID NO: 9311449 - DNA, 20 bp, Homo sapiens
tatcttactttagtcatttg

SEQ ID NO: 9311450 - DNA, 22 bp, Homo sapiens
tatagaggccaccaacatgaaa

SEQ ID NO: 9311451 - DNA, 22 bp, Homo sapiens
tatagacttggcatgcatgttc

SEQ ID NO: 9311452 - DNA, 22 bp, Homo sapiens
tatatgttgatactaattctgg

SEQ ID NO: 9311453 - DNA, 22 bp, Homo sapiens
tatattacatagtgtttgagat

SEQ ID NO: 9311454 - DNA, 22 bp, Homo sapiens
tatattagtggaatgatatgaa

SEQ ID NO: 9311455 - DNA, 22 bp, Homo sapiens
tatactattattgtcagtttat

SEQ ID NO: 9311456 - DNA, 22 bp, Homo sapiens
tatactctggaattttattctt

SEQ ID NO: 9311457 - DNA, 22 bp, Homo sapiens
tatactttcctgcaactttgat

SEQ ID NO: 9311458 - DNA, 22 bp, Homo sapiens
tagttaatgtgaggcacctagt

SEQ ID NO: 9311459 - DNA, 22 bp, Homo sapiens
tagttaaaataatggagatgtt

SEQ ID NO: 9311460 - DNA, 22 bp, Homo sapiens
tatgttgtagctagtaataaat

SEQ ID NO: 9311461 - DNA, 22 bp, Homo sapiens
tatgcctggggtgctcaggcca

SEQ ID NO: 9311462 - DNA, 17 bp, Homo sapiens
tatgtgtgtgtttatac

SEQ ID NO: 9311463 - DNA, 22 bp, Homo sapiens
tattcatagtaaacaaaagtgg

SEQ ID NO: 9311464 - DNA, 22 bp, Homo sapiens
tattcactttgggagagccatt

SEQ ID NO: 9311465 - DNA, 22 bp, Homo sapiens
tattgagtaattattacttcaa

SEQ ID NO: 9311466 - DNA, 22 bp, Homo sapiens
tatttccagcagtaagaagaca

SEQ ID NO: 9311467 - DNA, 22 bp, Homo sapiens
tatttccaggccccactctaga

SEQ ID NO: 9311468 - DNA, 22 bp, Homo sapiens
tatttgtccaggtaaatttcag

SEQ ID NO: 9311469 - DNA, 22 bp, Homo sapiens
tatttgttgagttgttatgtct

SEQ ID NO: 9311470 - DNA, 22 bp, Homo sapiens
tattgggtaaagatccagtttt

SEQ ID NO: 9311471 - DNA, 22 bp, Homo sapiens
tattgggtaaagatccagtttt

SEQ ID NO: 9311472 - DNA, 18 bp, Homo sapiens
tatttcacttttgggcat

SEQ ID NO: 9311473 - DNA, 22 bp, Homo sapiens
tatttcactccgagactctatg

SEQ ID NO: 9311474 - DNA, 22 bp, Homo sapiens
tatttcactattctctgtaact

SEQ ID NO: 9311475 - DNA, 22 bp, Homo sapiens
tatttcacctaaaagtgtcaaa

SEQ ID NO: 9311476 - DNA, 22 bp, Homo sapiens
tatttcacagcagctcatttaa

SEQ ID NO: 9311477 - DNA, 22 bp, Homo sapiens
tatttcacataccacagagtgt

SEQ ID NO: 9311478 - DNA, 22 bp, Homo sapiens
taggctaggctgaaggttttgg

SEQ ID NO: 9311479 - DNA, 22 bp, Homo sapiens
taggctaggctgaaggttttgg

SEQ ID NO: 9311480 - DNA, 22 bp, Homo sapiens
taggctcagggctgggtgacgg

SEQ ID NO: 9311481 - DNA, 22 bp, Homo sapiens
taggctcctgagtccacagcac

SEQ ID NO: 9311482 - DNA, 22 bp, Homo sapiens
taggctcctgaggactccatgc

SEQ ID NO: 9311483 - DNA, 22 bp, Homo sapiens
taggctcctctcacattctatt

SEQ ID NO: 9311484 - DNA, 22 bp, Homo sapiens
taggctcccagatcgtttgctg

SEQ ID NO: 9311485 - DNA, 22 bp, Homo sapiens
taggctccaagagcgaactcag

SEQ ID NO: 9311486 - DNA, 22 bp, Homo sapiens
taggctcagtgagtagggagtt

SEQ ID NO: 9311487 - DNA, 22 bp, Homo sapiens
taggctccagtgtgtggcgagt

SEQ ID NO: 9311488 - DNA, 22 bp, Homo sapiens
taggctcattaagtccccaggg

SEQ ID NO: 9311489 - DNA, 22 bp, Homo sapiens
taggacaggtgaggggctgtgg

SEQ ID NO: 9311490 - DNA, 20 bp, Homo sapiens
taggacagggcctggcttct

SEQ ID NO: 9311491 - DNA, 22 bp, Homo sapiens
taggcctggatctctgggagca

SEQ ID NO: 9311492 - DNA, 22 bp, Homo sapiens
taggacaggatcatgatgctgg

SEQ ID NO: 9311493 - DNA, 20 bp, Homo sapiens
taggacaggcagccgagggg

SEQ ID NO: 9311494 - DNA, 22 bp, Homo sapiens
taggacaggctaaaagggataa

SEQ ID NO: 9311495 - DNA, 22 bp, Homo sapiens
taggaatggcagcagccggggg

SEQ ID NO: 9311496 - DNA, 22 bp, Homo sapiens
taggaatgcagatgcataataa

SEQ ID NO: 9311497 - DNA, 22 bp, Homo sapiens
taggaatgcatgggggattctg

SEQ ID NO: 9311498 - DNA, 22 bp, Homo sapiens
taggaatgcagtgagacacaga

SEQ ID NO: 9311499 - DNA, 22 bp, Homo sapiens
taggaatgatgtatttttctct

SEQ ID NO: 9311500 - DNA, 22 bp, Homo sapiens
taggaatgattggaattccagg

SEQ ID NO: 9311501 - DNA, 22 bp, Homo sapiens
taggaatggaacactttgattt

SEQ ID NO: 9311502 - DNA, 22 bp, Homo sapiens
taggaatgggcaagacaaagaa

SEQ ID NO: 9311503 - DNA, 19 bp, Homo sapiens
taggaatgtagaatcctag

SEQ ID NO: 9311504 - DNA, 22 bp, Homo sapiens
taggaatggtgctcagcagaaa

SEQ ID NO: 9311505 - DNA, 22 bp, Homo sapiens
taggaatgggctatcccaagct

SEQ ID NO: 9311506 - DNA, 22 bp, Homo sapiens
taggaatgtaatctctgttatg

SEQ ID NO: 9311507 - DNA, 22 bp, Homo sapiens
taggaatgtttttatcaactta

SEQ ID NO: 9311508 - DNA, 22 bp, Homo sapiens
taggaatgtggcaggcagaaca

SEQ ID NO: 9311509 - DNA, 22 bp, Homo sapiens
taggaatgtctatgcagtgagg

SEQ ID NO: 9311510 - DNA, 22 bp, Homo sapiens
taggaatgaaaatggccataga

SEQ ID NO: 9311511 - DNA, 22 bp, Homo sapiens
taggaatgaaagtgttttgaaa

SEQ ID NO: 9311512 - DNA, 22 bp, Homo sapiens
taggaatgaagaagtatgatat

SEQ ID NO: 9311513 - DNA, 22 bp, Homo sapiens
taggaatgaaggataaggtgtg

SEQ ID NO: 9311514 - DNA, 22 bp, Homo sapiens
taggaatgagaaagaattagat

SEQ ID NO: 9311515 - DNA, 22 bp, Homo sapiens
taggaatgagagggtgaggatt

SEQ ID NO: 9311516 - DNA, 22 bp, Homo sapiens
taggaatgataatagtaaagag

SEQ ID NO: 9311517 - DNA, 22 bp, Homo sapiens
tagccattgacttaaagcttat

SEQ ID NO: 9311518 - DNA, 22 bp, Homo sapiens
tagccatttttattaatgctgg

SEQ ID NO: 9311519 - DNA, 22 bp, Homo sapiens
tagtcacagtacaggataaaga

SEQ ID NO: 9311520 - DNA, 22 bp, Homo sapiens
tagtcacatgatcacaggatcg

SEQ ID NO: 9311521 - DNA, 22 bp, Homo sapiens
tagtcacaggaagtttcaatgt

SEQ ID NO: 9311522 - DNA, 22 bp, Homo sapiens
tagtcacacaattgtgtacatt

SEQ ID NO: 9311523 - DNA, 22 bp, Homo sapiens
tagtcacaaccttcaagttgtc

SEQ ID NO: 9311524 - DNA, 22 bp, Homo sapiens
tagtatttgcagatttgtgtca

SEQ ID NO: 9311525 - DNA, 17 bp, Homo sapiens
tagtcaagtttacatgt

SEQ ID NO: 9311526 - DNA, 22 bp, Homo sapiens
tagtagcagggggtacctctca

SEQ ID NO: 9311527 - DNA, 22 bp, Homo sapiens
tagtagcaaaactcatctcttt

SEQ ID NO: 9311528 - DNA, 22 bp, Homo sapiens
tagtagcaggaatctgaaggta

SEQ ID NO: 9311529 - DNA, 22 bp, Homo sapiens
tagtagcaacaagaaacaaata

SEQ ID NO: 9311530 - DNA, 22 bp, Homo sapiens
tagtagcaccagtcatatttga

SEQ ID NO: 9311531 - DNA, 22 bp, Homo sapiens
tagtagcatttggaaaaattgg

SEQ ID NO: 9311532 - DNA, 22 bp, Homo sapiens
tagtaaaagtttagttgaaagt

SEQ ID NO: 9311533 - DNA, 22 bp, Homo sapiens
taggtttactgaattagtggaa

SEQ ID NO: 9311534 - DNA, 22 bp, Homo sapiens
taggtttaggagtgaaggtgaa

SEQ ID NO: 9311535 - DNA, 22 bp, Homo sapiens
taggctgggagcctgaggctag

SEQ ID NO: 9311536 - DNA, 22 bp, Homo sapiens
taggctgggaagaaagattctc

SEQ ID NO: 9311537 - DNA, 22 bp, Homo sapiens
taggctgggaagaaagattctc

SEQ ID NO: 9311538 - DNA, 22 bp, Homo sapiens
taggctggaacttaggcagagg

SEQ ID NO: 9311539 - DNA, 22 bp, Homo sapiens
taggctggaacttaggcagagg

SEQ ID NO: 9311540 - DNA, 22 bp, Homo sapiens
taggctggaggaagcagtgcct

SEQ ID NO: 9311541 - DNA, 22 bp, Homo sapiens
taggctggaggaagcagtgcct

SEQ ID NO: 9311542 - DNA, 22 bp, Homo sapiens
taggctggaggaagcagtgcct

SEQ ID NO: 9311543 - DNA, 22 bp, Homo sapiens
tagaaggaggactggcagtgtt

SEQ ID NO: 9311544 - DNA, 22 bp, Homo sapiens
tagaagcagtaatagaaatagg

SEQ ID NO: 9311545 - DNA, 22 bp, Homo sapiens
tagaagtggattgaagtttgga

SEQ ID NO: 9311546 - DNA, 22 bp, Homo sapiens
tagaagtggcaacactcagaaa

SEQ ID NO: 9311547 - DNA, 22 bp, Homo sapiens
tagaagtgaaagacttgatgtc

SEQ ID NO: 9311548 - DNA, 18 bp, Homo sapiens
tagaagtgtgctatacaa

SEQ ID NO: 9311549 - DNA, 22 bp, Homo sapiens
tagaagtgggaatataaaatat

SEQ ID NO: 9311550 - DNA, 22 bp, Homo sapiens
tagaagtgtctgtgaaatatac

SEQ ID NO: 9311551 - DNA, 22 bp, Homo sapiens
tagaagttgaactaaaaatatt

SEQ ID NO: 9311552 - DNA, 23 bp, Homo sapiens
tagaatcctctgagatggaatag

SEQ ID NO: 9311553 - DNA, 22 bp, Homo sapiens
tactttcatgggttttctttat

SEQ ID NO: 9311554 - DNA, 22 bp, Homo sapiens
tactttcatgtctatacatatt

SEQ ID NO: 9311555 - DNA, 22 bp, Homo sapiens
tagaagcagcaggagtaaaggc

SEQ ID NO: 9311556 - DNA, 19 bp, Homo sapiens
tagaagcagggaagctgag

SEQ ID NO: 9311557 - DNA, 22 bp, Homo sapiens
tactttctgtccttctgttaaa

SEQ ID NO: 9311558 - DNA, 19 bp, Homo sapiens
tagaagcactaggcaaact

SEQ ID NO: 9311559 - DNA, 22 bp, Homo sapiens
tagaagcactgacagagtttga

SEQ ID NO: 9311560 - DNA, 19 bp, Homo sapiens
tagaagcactaggcaaact

SEQ ID NO: 9311561 - DNA, 21 bp, Homo sapiens
tagaagcacataggttcaaag

SEQ ID NO: 9311562 - DNA, 22 bp, Homo sapiens
tagaagcaccactcatcacgtg

SEQ ID NO: 9311563 - DNA, 22 bp, Homo sapiens
tactttcttgttcctttcataa

SEQ ID NO: 9311564 - DNA, 22 bp, Homo sapiens
tagaggattttgcatttcatat

SEQ ID NO: 9311565 - DNA, 22 bp, Homo sapiens
tagaggagcggcgagctgagct

SEQ ID NO: 9311566 - DNA, 22 bp, Homo sapiens
tagaggcaccctggaggagact

SEQ ID NO: 9311567 - DNA, 22 bp, Homo sapiens
tagagcagttggcagctgtatt

SEQ ID NO: 9311568 - DNA, 22 bp, Homo sapiens
tagccaggcaattatgggtgat

SEQ ID NO: 9311569 - DNA, 22 bp, Homo sapiens
tagccaggtcacactgtgtgtt

SEQ ID NO: 9311570 - DNA, 22 bp, Homo sapiens
tagccagggagacactgtggag

SEQ ID NO: 9311571 - DNA, 22 bp, Homo sapiens
tagcatttcccaaatgcatttg

SEQ ID NO: 9311572 - DNA, 22 bp, Homo sapiens
tagcatttggcaccagttattt

SEQ ID NO: 9311573 - DNA, 22 bp, Homo sapiens
tagccacatgcagactttcatg

SEQ ID NO: 9311574 - DNA, 22 bp, Homo sapiens
tagcatttcactgatcttcact

SEQ ID NO: 9311575 - DNA, 22 bp, Homo sapiens
tagcatttcactgatcttcact

SEQ ID NO: 9311576 - DNA, 21 bp, Homo sapiens
tagcagtgaatccatacgggt

SEQ ID NO: 9311577 - DNA, 22 bp, Homo sapiens
tagcactatatgttagctatta

SEQ ID NO: 9311578 - DNA, 22 bp, Homo sapiens
tagcactatttttcactatcct

SEQ ID NO: 9311579 - DNA, 22 bp, Homo sapiens
tagcactacttaggtacagcca

SEQ ID NO: 9311580 - DNA, 22 bp, Homo sapiens
tagcagaacaatagtcaatgat

SEQ ID NO: 9311581 - DNA, 22 bp, Homo sapiens
tagcaccacttcatgctttcag

SEQ ID NO: 9311582 - DNA, 22 bp, Homo sapiens
tagcaccatgatggaagagctg

SEQ ID NO: 9311583 - DNA, 22 bp, Homo sapiens
tagcaccatttaaacatctctg

SEQ ID NO: 9311584 - DNA, 22 bp, Homo sapiens
tagcaccacaatcaagatacag

SEQ ID NO: 9311585 - DNA, 22 bp, Homo sapiens
tagcaccactggtgggaaaaac

SEQ ID NO: 9311586 - DNA, 22 bp, Homo sapiens
tagcaccaggaaggtttaggat

SEQ ID NO: 9311587 - DNA, 22 bp, Homo sapiens
tagcaccatacccggcagctcg

SEQ ID NO: 9311588 - DNA, 22 bp, Homo sapiens
tagcaccaatatgtgcttttca

SEQ ID NO: 9311589 - DNA, 22 bp, Homo sapiens
tagcaccaaacatatactcagt

SEQ ID NO: 9311590 - DNA, 22 bp, Homo sapiens
tagcaccaaaactgaagaacat

SEQ ID NO: 9311591 - DNA, 22 bp, Homo sapiens
tagatgtttgagaagtttatgt

SEQ ID NO: 9311592 - DNA, 22 bp, Homo sapiens
tagattttgcatttctaacaag

SEQ ID NO: 9311593 - DNA, 22 bp, Homo sapiens
tagcacacagcttggggaccag

SEQ ID NO: 9311594 - DNA, 22 bp, Homo sapiens
tagcacacactgcatctacaaa

SEQ ID NO: 9311595 - DNA, 22 bp, Homo sapiens
tagcacactgcatatgaagatt

SEQ ID NO: 9311596 - DNA, 22 bp, Homo sapiens
tagcacactgccttcactgagg

SEQ ID NO: 9311597 - DNA, 22 bp, Homo sapiens
tagcacactaaagatattaaca

SEQ ID NO: 9311598 - DNA, 22 bp, Homo sapiens
tagcacacaaataaaggagaaa

SEQ ID NO: 9311599 - DNA, 22 bp, Homo sapiens
tagcacacgcattagcaaatca

SEQ ID NO: 9311600 - DNA, 22 bp, Homo sapiens
tacataataaggggcatggtgt

SEQ ID NO: 9311601 - DNA, 22 bp, Homo sapiens
tacataatgagctagttaagtt

SEQ ID NO: 9311602 - DNA, 22 bp, Homo sapiens
tacataattgtctttgtcctca

SEQ ID NO: 9311603 - DNA, 22 bp, Homo sapiens
tacataattaatctttaagttc

SEQ ID NO: 9311604 - DNA, 22 bp, Homo sapiens
tacatgtatgtttatcttgaga

SEQ ID NO: 9311605 - DNA, 22 bp, Homo sapiens
tactgaaagtggtcaacagtgg

SEQ ID NO: 9311606 - DNA, 22 bp, Homo sapiens
tactgaaatagcactctgatgc

SEQ ID NO: 9311607 - DNA, 22 bp, Homo sapiens
tacgcctgtaatcccagcactt

SEQ ID NO: 9311608 - DNA, 22 bp, Homo sapiens
tactaaatagtttaattcctca

SEQ ID NO: 9311609 - DNA, 22 bp, Homo sapiens
tacctggggctgggctttgatt

SEQ ID NO: 9311610 - DNA, 22 bp, Homo sapiens
tacttctgccttagagaacact

SEQ ID NO: 9311611 - DNA, 22 bp, Homo sapiens
tacttacttgtcataattctgg

SEQ ID NO: 9311612 - DNA, 22 bp, Homo sapiens
tactgtaatgagattagcttcc

SEQ ID NO: 9311613 - DNA, 22 bp, Homo sapiens
tacttcaatttgtatatgtgaa

SEQ ID NO: 9311614 - DNA, 22 bp, Homo sapiens
tacttcaaccttctctattaga

SEQ ID NO: 9311615 - DNA, 22 bp, Homo sapiens
tactgataagagttgtaggagt

SEQ ID NO: 9311616 - DNA, 18 bp, Homo sapiens
tactgagcaacaggagaa

SEQ ID NO: 9311617 - DNA, 22 bp, Homo sapiens
tactgcttcatatagggatgta

SEQ ID NO: 9311618 - DNA, 22 bp, Homo sapiens
tactgctgaatggtgctgggca

SEQ ID NO: 9311619 - DNA, 22 bp, Homo sapiens
tacacatatgtgtgtatatgtg

SEQ ID NO: 9311620 - DNA, 22 bp, Homo sapiens
tacacatatgtccattaatcag

SEQ ID NO: 9311621 - DNA, 22 bp, Homo sapiens
tacacattacataatactatct

SEQ ID NO: 9311622 - DNA, 22 bp, Homo sapiens
tacaatgtaattctgattatgt

SEQ ID NO: 9311623 - DNA, 22 bp, Homo sapiens
tacaatgattagctaacttgcc

SEQ ID NO: 9311624 - DNA, 22 bp, Homo sapiens
tacaatgagctgagccagaggc

SEQ ID NO: 9311625 - DNA, 19 bp, Homo sapiens
tacaatgatgttacctttg

SEQ ID NO: 9311626 - DNA, 22 bp, Homo sapiens
tacaatgatgatactttactgg

SEQ ID NO: 9311627 - DNA, 22 bp, Homo sapiens
tacaatgagctgtacatctcca

SEQ ID NO: 9311628 - DNA, 22 bp, Homo sapiens
tacaatgactctcagtttggct

SEQ ID NO: 9311629 - DNA, 22 bp, Homo sapiens
tacaatgaccatattatgtaag

SEQ ID NO: 9311630 - DNA, 22 bp, Homo sapiens
taattttacttcctgagcacct

SEQ ID NO: 9311631 - DNA, 22 bp, Homo sapiens
taattttaactgtgctgtttgg

SEQ ID NO: 9311632 - DNA, 22 bp, Homo sapiens
taatttcttcatctctgcagct

SEQ ID NO: 9311633 - DNA, 22 bp, Homo sapiens
taatttctggagggagaaagag

SEQ ID NO: 9311634 - DNA, 22 bp, Homo sapiens
taatttctagggactaaggtgc

SEQ ID NO: 9311635 - DNA, 22 bp, Homo sapiens
taattttatgacagtgtatttt

SEQ ID NO: 9311636 - DNA, 22 bp, Homo sapiens
taagttacacttaacttactag

SEQ ID NO: 9311637 - DNA, 22 bp, Homo sapiens
taagcagcgtaaaagccaggga

SEQ ID NO: 9311638 - DNA, 22 bp, Homo sapiens
taagcaccactccaaaattgtt

SEQ ID NO: 9311639 - DNA, 22 bp, Homo sapiens
taagcagaaaaagtgggagtta

SEQ ID NO: 9311640 - DNA, 22 bp, Homo sapiens
taagttttaagcaatctgataa

SEQ ID NO: 9311641 - DNA, 22 bp, Homo sapiens
taagttttctggaataacttgg

SEQ ID NO: 9311642 - DNA, 22 bp, Homo sapiens
taagtttctccaaagcacagaa

SEQ ID NO: 9311643 - DNA, 18 bp, Homo sapiens
taatgataagccttgaag

SEQ ID NO: 9311644 - DNA, 22 bp, Homo sapiens
taatgatgtgtgcaaactgaat

SEQ ID NO: 9311645 - DNA, 22 bp, Homo sapiens
taatgcttaattttcacaagcc

SEQ ID NO: 9311646 - DNA, 22 bp, Homo sapiens
taatttcactgatatgaagtca

SEQ ID NO: 9311647 - DNA, 22 bp, Homo sapiens
taatttcactgatatgaagtca

SEQ ID NO: 9311648 - DNA, 22 bp, Homo sapiens
taatttctaattcattttcagt

SEQ ID NO: 9311649 - DNA, 22 bp, Homo sapiens
taatttctaattcattttcagt

SEQ ID NO: 9311650 - DNA, 22 bp, Homo sapiens
taatttcacagttcaacgcaca

SEQ ID NO: 9311651 - DNA, 22 bp, Homo sapiens
gttagctttaaacatgatcatt

SEQ ID NO: 9311652 - DNA, 22 bp, Homo sapiens
gttagcttgagcatttgccatg

SEQ ID NO: 9311653 - DNA, 22 bp, Homo sapiens
gttagcatgattcctgctcatt

SEQ ID NO: 9311654 - DNA, 22 bp, Homo sapiens
gttagcatttgtttaatatcag

SEQ ID NO: 9311655 - DNA, 22 bp, Homo sapiens
gttagcatgacttagaatcagg

SEQ ID NO: 9311656 - DNA, 18 bp, Homo sapiens
gttagcttcctgttgccc

SEQ ID NO: 9311657 - DNA, 22 bp, Homo sapiens
gttagcttagtagctgtttctt

SEQ ID NO: 9311658 - DNA, 22 bp, Homo sapiens
gttagcttctgggccaaggagg

SEQ ID NO: 9311659 - DNA, 22 bp, Homo sapiens
gttagagggaaaaatcatttgc

SEQ ID NO: 9311660 - DNA, 22 bp, Homo sapiens
gtgttaaatttctaatttgtga

SEQ ID NO: 9311661 - DNA, 22 bp, Homo sapiens
gtgttagtttgctaaggataat

SEQ ID NO: 9311662 - DNA, 22 bp, Homo sapiens
gttactcttccccggggtctgg

SEQ ID NO: 9311663 - DNA, 22 bp, Homo sapiens
gttagaataaaaggtcagagag

SEQ ID NO: 9311664 - DNA, 22 bp, Homo sapiens
gttactcttgagaggctgaggt

SEQ ID NO: 9311665 - DNA, 22 bp, Homo sapiens
gttacaaaggtcataaaagtgt

SEQ ID NO: 9311666 - DNA, 22 bp, Homo sapiens
gttagtagtaaagcagggattc

SEQ ID NO: 9311667 - DNA, 22 bp, Homo sapiens
gttagtaggttgcaaatttgga

SEQ ID NO: 9311668 - DNA, 22 bp, Homo sapiens
gttagtaggaggtggtatcttg

SEQ ID NO: 9311669 - DNA, 22 bp, Homo sapiens
gttagtagcatttcatgacatg

SEQ ID NO: 9311670 - DNA, 22 bp, Homo sapiens
gttagtgcttattaaatagtat

SEQ ID NO: 9311671 - DNA, 22 bp, Homo sapiens
gttagtttgaacttgtctatgt

SEQ ID NO: 9311672 - DNA, 22 bp, Homo sapiens
gttataaaggtgataatggtca

SEQ ID NO: 9311673 - DNA, 22 bp, Homo sapiens
gttataaaatgcacagttgttt

SEQ ID NO: 9311674 - DNA, 22 bp, Homo sapiens
gtgtgtgttcaataaatttaag

SEQ ID NO: 9311675 - DNA, 22 bp, Homo sapiens
gtgtgtgtgtaaaaatccagag

SEQ ID NO: 9311676 - DNA, 22 bp, Homo sapiens
gtgtgtgtgcatctcttttatt

SEQ ID NO: 9311677 - DNA, 22 bp, Homo sapiens
gtgtgtgtgcctgcacacacac

SEQ ID NO: 9311678 - DNA, 22 bp, Homo sapiens
gtgctttatatgtgggtatcca

SEQ ID NO: 9311679 - DNA, 23 bp, Homo sapiens
gtgctttatgatctgctgtccct

SEQ ID NO: 9311680 - DNA, 21 bp, Homo sapiens
gtgcttttccttaatgttctt

SEQ ID NO: 9311681 - DNA, 22 bp, Homo sapiens
gtgctttactggcagtgatgta

SEQ ID NO: 9311682 - DNA, 22 bp, Homo sapiens
gtgctttaccttattggtctcg

SEQ ID NO: 9311683 - DNA, 22 bp, Homo sapiens
gtgctttagttcttgcaactgg

SEQ ID NO: 9311684 - DNA, 22 bp, Homo sapiens
gtgctttagctgagttggtcaa

SEQ ID NO: 9311685 - DNA, 22 bp, Homo sapiens
gtgctttactgtgttgccttta

SEQ ID NO: 9311686 - DNA, 22 bp, Homo sapiens
gtgctttaggtgtttggctgaa

SEQ ID NO: 9311687 - DNA, 22 bp, Homo sapiens
gtgctttaataagatttcactt

SEQ ID NO: 9311688 - DNA, 22 bp, Homo sapiens
gtgctttaaagacagttatgct

SEQ ID NO: 9311689 - DNA, 22 bp, Homo sapiens
gtgctttaaaccactgtgctgt

SEQ ID NO: 9311690 - DNA, 22 bp, Homo sapiens
gtgctttaaaaataggagatga

SEQ ID NO: 9311691 - DNA, 22 bp, Homo sapiens
gtgtgtgtatctgcctatcaca

SEQ ID NO: 9311692 - DNA, 22 bp, Homo sapiens
gtgtgtgtctccgcggccgtag

SEQ ID NO: 9311693 - DNA, 22 bp, Homo sapiens
gtgtgtgtgcatataacatata

SEQ ID NO: 9311694 - DNA, 22 bp, Homo sapiens
gtttcgtcaggcttattctatc

SEQ ID NO: 9311695 - DNA, 22 bp, Homo sapiens
gtttatatgtgtgccactctta

SEQ ID NO: 9311696 - DNA, 22 bp, Homo sapiens
gtttatatgaacttcataccca

SEQ ID NO: 9311697 - DNA, 22 bp, Homo sapiens
gtttataatccaactctgctcc

SEQ ID NO: 9311698 - DNA, 22 bp, Homo sapiens
gtttataatgtctgtgccaaaa

SEQ ID NO: 9311699 - DNA, 22 bp, Homo sapiens
gtttataaggtaaaggagagag

SEQ ID NO: 9311700 - DNA, 22 bp, Homo sapiens
gtttataaggcccaatatttct

SEQ ID NO: 9311701 - DNA, 22 bp, Homo sapiens
gtttataaggcccaatatttct

SEQ ID NO: 9311702 - DNA, 18 bp, Homo sapiens
gtttctcccaggcggggc

SEQ ID NO: 9311703 - DNA, 22 bp, Homo sapiens
gtttctcctctgtgtcttgttt

SEQ ID NO: 9311704 - DNA, 22 bp, Homo sapiens
gtttctgagcacttttattgca

SEQ ID NO: 9311705 - DNA, 22 bp, Homo sapiens
gtttctgagagccacacacagc

SEQ ID NO: 9311706 - DNA, 22 bp, Homo sapiens
gtttctgaagggattacttggt

SEQ ID NO: 9311707 - DNA, 22 bp, Homo sapiens
gtttctctttgaagcctggctg

SEQ ID NO: 9311708 - DNA, 22 bp, Homo sapiens
gtttctgagcacttttattgca

SEQ ID NO: 9311709 - DNA, 20 bp, Homo sapiens
gtttctgattcagtaggtct

SEQ ID NO: 9311710 - DNA, 22 bp, Homo sapiens
gtttctgattctagaggcaggc

SEQ ID NO: 9311711 - DNA, 22 bp, Homo sapiens
gtttataaattctgcttttgtt

SEQ ID NO: 9311712 - DNA, 22 bp, Homo sapiens
gtttacaaatattttaaatggt

SEQ ID NO: 9311713 - DNA, 22 bp, Homo sapiens
gttcctgggaggcatgggctgg

SEQ ID NO: 9311714 - DNA, 22 bp, Homo sapiens
gttccagacttgccagtggaag

SEQ ID NO: 9311715 - DNA, 23 bp, Homo sapiens
gttttcaacacaataaatgtaac

SEQ ID NO: 9311716 - DNA, 22 bp, Homo sapiens
gttttataattgcttcataaga

SEQ ID NO: 9311717 - DNA, 22 bp, Homo sapiens
gttttataggctgttgctatat

SEQ ID NO: 9311718 - DNA, 22 bp, Homo sapiens
gttttataggctgttgctatat

SEQ ID NO: 9311719 - DNA, 22 bp, Homo sapiens
gttttatatgtctctgctgaca

SEQ ID NO: 9311720 - DNA, 22 bp, Homo sapiens
gttttatatgtctctgctgaca

SEQ ID NO: 9311721 - DNA, 22 bp, Homo sapiens
gttttataggtgaaatattact

SEQ ID NO: 9311722 - DNA, 22 bp, Homo sapiens
taaacatcaggaatgaaaacct

SEQ ID NO: 9311723 - DNA, 22 bp, Homo sapiens
taaacatcagtacaaagactaa

SEQ ID NO: 9311724 - DNA, 22 bp, Homo sapiens
taaagtttggcagacaataaca

SEQ ID NO: 9311725 - DNA, 21 bp, Homo sapiens
taaataataagttgctgagat

SEQ ID NO: 9311726 - DNA, 21 bp, Homo sapiens
taaataataagttgctgagat

SEQ ID NO: 9311727 - DNA, 21 bp, Homo sapiens
taaataataagttgctgagat

SEQ ID NO: 9311728 - DNA, 22 bp, Homo sapiens
taaagacacccagggagggact

SEQ ID NO: 9311729 - DNA, 22 bp, Homo sapiens
taaagacaataggaaagttgtt

SEQ ID NO: 9311730 - DNA, 22 bp, Homo sapiens
taaagacaatttcgagctgtag

SEQ ID NO: 9311731 - DNA, 22 bp, Homo sapiens
taaagaacacagggaatagcac

SEQ ID NO: 9311732 - DNA, 22 bp, Homo sapiens
taaactgtgtaatatgatgtct

SEQ ID NO: 9311733 - DNA, 22 bp, Homo sapiens
taaagacaaatgacattacggc

SEQ ID NO: 9311734 - DNA, 22 bp, Homo sapiens
taaagacaaacccactagggtt

SEQ ID NO: 9311735 - DNA, 22 bp, Homo sapiens
taaatacagtcatttgagccat

SEQ ID NO: 9311736 - DNA, 22 bp, Homo sapiens
taagatcagttcaaacatgtgt

SEQ ID NO: 9311737 - DNA, 22 bp, Homo sapiens
taactgtatttttctgagattc

SEQ ID NO: 9311738 - DNA, 22 bp, Homo sapiens
taactgtattttaggtctcatt

SEQ ID NO: 9311739 - DNA, 22 bp, Homo sapiens
taactgtacaactggttagtca

SEQ ID NO: 9311740 - DNA, 22 bp, Homo sapiens
tccaggccattgactgcatcct

SEQ ID NO: 9311741 - DNA, 19 bp, Homo sapiens
tccaggccattcccagagc

SEQ ID NO: 9311742 - DNA, 20 bp, Homo sapiens
tccaggcccactcagctgaa

SEQ ID NO: 9311743 - DNA, 20 bp, Homo sapiens
tccaggcccactcagctgaa

SEQ ID NO: 9311744 - DNA, 22 bp, Homo sapiens
tccaggccattgactgcatcct

SEQ ID NO: 9311745 - DNA, 22 bp, Homo sapiens
tccaggccattgactgcatcct

SEQ ID NO: 9311746 - DNA, 20 bp, Homo sapiens
tccaggcccactcagctgaa

SEQ ID NO: 9311747 - DNA, 22 bp, Homo sapiens
tccaggcccagacggggtgagg

SEQ ID NO: 9311748 - DNA, 22 bp, Homo sapiens
tccaggcccactcggtggggct

SEQ ID NO: 9311749 - DNA, 22 bp, Homo sapiens
tccaggcccactcggtggggct

SEQ ID NO: 9311750 - DNA, 22 bp, Homo sapiens
tccaggcccactcagctgaaat

SEQ ID NO: 9311751 - DNA, 22 bp, Homo sapiens
tccaggccagggtaagaggaga

SEQ ID NO: 9311752 - DNA, 19 bp, Homo sapiens
tccaggccattcccagagc

SEQ ID NO: 9311753 - DNA, 21 bp, Homo sapiens
tccaggccatggtggggaggc

SEQ ID NO: 9311754 - DNA, 21 bp, Homo sapiens
tccaggccatggtggggaggc

SEQ ID NO: 9311755 - DNA, 22 bp, Homo sapiens
tccagggacctccctgagagct

SEQ ID NO: 9311756 - DNA, 22 bp, Homo sapiens
tccagggacctccctgagagct

SEQ ID NO: 9311757 - DNA, 22 bp, Homo sapiens
tccagggacagcgctggagcta

SEQ ID NO: 9311758 - DNA, 22 bp, Homo sapiens
tccaggccctgggatgggagca

SEQ ID NO: 9311759 - DNA, 22 bp, Homo sapiens
tccaggccgcaggggcagcccc

SEQ ID NO: 9311760 - DNA, 22 bp, Homo sapiens
tccaggccctgggatgggagca

SEQ ID NO: 9311761 - DNA, 22 bp, Homo sapiens
tccaggcctaggccaagtgatt

SEQ ID NO: 9311762 - DNA, 21 bp, Homo sapiens
tccaggcctcaggaagggatg

SEQ ID NO: 9311763 - DNA, 22 bp, Homo sapiens
tccaggccgcatagttactctg

SEQ ID NO: 9311764 - DNA, 23 bp, Homo sapiens
tccagtctcctgaaaggcagcgt

SEQ ID NO: 9311765 - DNA, 22 bp, Homo sapiens
tccagggatctttagagtcttt

SEQ ID NO: 9311766 - DNA, 23 bp, Homo sapiens
tccagggattaatgaagtcagtc

SEQ ID NO: 9311767 - DNA, 22 bp, Homo sapiens
tccagggatgtcctgtagcact

SEQ ID NO: 9311768 - DNA, 22 bp, Homo sapiens
tccagggcaccagcgtccccct

SEQ ID NO: 9311769 - DNA, 20 bp, Homo sapiens
tccagggcaactagagtgtg

SEQ ID NO: 9311770 - DNA, 20 bp, Homo sapiens
tccagggcaactagagtgtg

SEQ ID NO: 9311771 - DNA, 20 bp, Homo sapiens
tccagggcaactagagtgtg

SEQ ID NO: 9311772 - DNA, 20 bp, Homo sapiens
tccagggcaaactcatcacc

SEQ ID NO: 9311773 - DNA, 20 bp, Homo sapiens
tccagggcaaactcatcacc

SEQ ID NO: 9311774 - DNA, 22 bp, Homo sapiens
tcccagcagggccgaccagcct

SEQ ID NO: 9311775 - DNA, 22 bp, Homo sapiens
tcccagcagatgagctgaccta

SEQ ID NO: 9311776 - DNA, 22 bp, Homo sapiens
tcccagcaggagtccagttccc

SEQ ID NO: 9311777 - DNA, 22 bp, Homo sapiens
tcccagattcctgctcttatat

SEQ ID NO: 9311778 - DNA, 22 bp, Homo sapiens
tcccagcagatgagctgaccta

SEQ ID NO: 9311779 - DNA, 22 bp, Homo sapiens
tcccagcttagatttgctcatt

SEQ ID NO: 9311780 - DNA, 21 bp, Homo sapiens
tcccagctgggtcagtgctgc

SEQ ID NO: 9311781 - DNA, 22 bp, Homo sapiens
tcccagctgagattgagcaagg

SEQ ID NO: 9311782 - DNA, 22 bp, Homo sapiens
tcccaggatgtgcgtgccgccg

SEQ ID NO: 9311783 - DNA, 22 bp, Homo sapiens
tcccaggatgaagacagtgttg

SEQ ID NO: 9311784 - DNA, 22 bp, Homo sapiens
tcccaggatctgagggcagaga

SEQ ID NO: 9311785 - DNA, 19 bp, Homo sapiens
tcccaggaagcaaatgtca

SEQ ID NO: 9311786 - DNA, 22 bp, Homo sapiens
tcccaggaaggattcggcattt

SEQ ID NO: 9311787 - DNA, 19 bp, Homo sapiens
tcccaggaaccttttattt

SEQ ID NO: 9311788 - DNA, 22 bp, Homo sapiens
tcccaggaagatcccagggacc

SEQ ID NO: 9311789 - DNA, 22 bp, Homo sapiens
tcccaggaaaacactcgaggac

SEQ ID NO: 9311790 - DNA, 17 bp, Homo sapiens
tcccaggaacagggaat

SEQ ID NO: 9311791 - DNA, 23 bp, Homo sapiens
tccaggagcatgctggctggcga

SEQ ID NO: 9311792 - DNA, 21 bp, Homo sapiens
tccaggacttgagaattccag

SEQ ID NO: 9311793 - DNA, 22 bp, Homo sapiens
tccaggacagagtagaagcagc

SEQ ID NO: 9311794 - DNA, 22 bp, Homo sapiens
tccaggacagcggcaggcagat

SEQ ID NO: 9311795 - DNA, 22 bp, Homo sapiens
tccaggacagcggcaggcagat

SEQ ID NO: 9311796 - DNA, 22 bp, Homo sapiens
tccaggaccaaagacacatgta

SEQ ID NO: 9311797 - DNA, 22 bp, Homo sapiens
tccaggactagcatttctgata

SEQ ID NO: 9311798 - DNA, 22 bp, Homo sapiens
tccaggacctgactgggcctgc

SEQ ID NO: 9311799 - DNA, 23 bp, Homo sapiens
tccaggaccctggtagacacaca

SEQ ID NO: 9311800 - DNA, 22 bp, Homo sapiens
tccaggacctcccaggctagag

SEQ ID NO: 9311801 - DNA, 18 bp, Homo sapiens
tccaggactctgcgtggc

SEQ ID NO: 9311802 - DNA, 22 bp, Homo sapiens
tccaggactataggaaagacac

SEQ ID NO: 9311803 - DNA, 22 bp, Homo sapiens
tccaggactggttcacacggtg

SEQ ID NO: 9311804 - DNA, 22 bp, Homo sapiens
tccaggacttagtgacctaaaa

SEQ ID NO: 9311805 - DNA, 22 bp, Homo sapiens
tccaggactttcttaaggcact

SEQ ID NO: 9311806 - DNA, 22 bp, Homo sapiens
tccaggacttggcaggagatga

SEQ ID NO: 9311807 - DNA, 22 bp, Homo sapiens
tccaggacttggcaggagatga

SEQ ID NO: 9311808 - DNA, 22 bp, Homo sapiens
tccagccttctcaaggctggct

SEQ ID NO: 9311809 - DNA, 22 bp, Homo sapiens
tccagcctggttgcgggcatcc

SEQ ID NO: 9311810 - DNA, 19 bp, Homo sapiens
tccagcctgctgtttctct

SEQ ID NO: 9311811 - DNA, 19 bp, Homo sapiens
tccagcctgctgtttctct

SEQ ID NO: 9311812 - DNA, 22 bp, Homo sapiens
tccagcctggttgcgggcatcc

SEQ ID NO: 9311813 - DNA, 22 bp, Homo sapiens
tccagcctgaactttgtccaga

SEQ ID NO: 9311814 - DNA, 23 bp, Homo sapiens
tccagcctcttgctctcacatgc

SEQ ID NO: 9311815 - DNA, 20 bp, Homo sapiens
tccagccctgcttctctctt

SEQ ID NO: 9311816 - DNA, 22 bp, Homo sapiens
tccagccttgccacttttctgt

SEQ ID NO: 9311817 - DNA, 22 bp, Homo sapiens
tccagccttctcaaggctggct

SEQ ID NO: 9311818 - DNA, 22 bp, Homo sapiens
tccagccttccttttcactctc

SEQ ID NO: 9311819 - DNA, 22 bp, Homo sapiens
tccagaaactgctgagataaga

SEQ ID NO: 9311820 - DNA, 22 bp, Homo sapiens
tccagaaaattttacagtgcct

SEQ ID NO: 9311821 - DNA, 22 bp, Homo sapiens
tccagccctcctgggatcacag

SEQ ID NO: 9311822 - DNA, 22 bp, Homo sapiens
tccactctaattactaccttct

SEQ ID NO: 9311823 - DNA, 22 bp, Homo sapiens
tccactgctcattccacaggca

SEQ ID NO: 9311824 - DNA, 22 bp, Homo sapiens
tccagaaaattcagaaattgtt

SEQ ID NO: 9311825 - DNA, 21 bp, Homo sapiens
tccaccctctctgctcccagt

SEQ ID NO: 9311826 - DNA, 22 bp, Homo sapiens
tccactccttatgccagacggt

SEQ ID NO: 9311827 - DNA, 22 bp, Homo sapiens
tccacccccagacagctggtga

SEQ ID NO: 9311828 - DNA, 22 bp, Homo sapiens
tccacccagcacactgtggtag

SEQ ID NO: 9311829 - DNA, 19 bp, Homo sapiens
tccaccccagccagctctg

SEQ ID NO: 9311830 - DNA, 19 bp, Homo sapiens
tccaccccagccagctctg

SEQ ID NO: 9311831 - DNA, 22 bp, Homo sapiens
tccaccacttcctgcagccatt

SEQ ID NO: 9311832 - DNA, 22 bp, Homo sapiens
tccacattctctgttacagata

SEQ ID NO: 9311833 - DNA, 22 bp, Homo sapiens
tcatgttatcagacacagagta

SEQ ID NO: 9311834 - DNA, 22 bp, Homo sapiens
tcatgtttggagtttgctcact

SEQ ID NO: 9311835 - DNA, 22 bp, Homo sapiens
tcatgttattgactcataatat

SEQ ID NO: 9311836 - DNA, 22 bp, Homo sapiens
tcatgtttctcttacagcagct

SEQ ID NO: 9311837 - DNA, 22 bp, Homo sapiens
tcatgtttttgccatatgactc

SEQ ID NO: 9311838 - DNA, 22 bp, Homo sapiens
tcattaatcccggggtccaggg

SEQ ID NO: 9311839 - DNA, 22 bp, Homo sapiens
tcattaatttgcttagacttat

SEQ ID NO: 9311840 - DNA, 22 bp, Homo sapiens
tcattacacagttcagtggaaa

SEQ ID NO: 9311841 - DNA, 22 bp, Homo sapiens
tcattaaatgtttgttgtgcca

SEQ ID NO: 9311842 - DNA, 22 bp, Homo sapiens
tccacagggatgcctgcggctt

SEQ ID NO: 9311843 - DNA, 22 bp, Homo sapiens
tcctcagtcagctccgttcttg

SEQ ID NO: 9311844 - DNA, 22 bp, Homo sapiens
tcctcagtctctaaggcctcag

SEQ ID NO: 9311845 - DNA, 22 bp, Homo sapiens
tccgaggcgcaccggcgctcct

SEQ ID NO: 9311846 - DNA, 22 bp, Homo sapiens
tccgggcaactgaagggaggtt

SEQ ID NO: 9311847 - DNA, 22 bp, Homo sapiens
tcctccagaccacttctgtgcg

SEQ ID NO: 9311848 - DNA, 22 bp, Homo sapiens
tcctccagcttctcttttgggg

SEQ ID NO: 9311849 - DNA, 22 bp, Homo sapiens
tcctccagaaactgaggcagaa

SEQ ID NO: 9311850 - DNA, 22 bp, Homo sapiens
tcctcatgccgggtctcacgct

SEQ ID NO: 9311851 - DNA, 22 bp, Homo sapiens
tcctcctcctcacagtcacctg

SEQ ID NO: 9311852 - DNA, 22 bp, Homo sapiens
tcctcctcctcacagtcacctg

SEQ ID NO: 9311853 - DNA, 21 bp, Homo sapiens
tcctcctccactaggctagcc

SEQ ID NO: 9311854 - DNA, 22 bp, Homo sapiens
tcctcccttgactcctgctttt

SEQ ID NO: 9311855 - DNA, 22 bp, Homo sapiens
tcctccctgggagcttctgagt

SEQ ID NO: 9311856 - DNA, 22 bp, Homo sapiens
tcctccctgtaccattcctctg

SEQ ID NO: 9311857 - DNA, 22 bp, Homo sapiens
tcctcccttctcactgggaagg

SEQ ID NO: 9311858 - DNA, 22 bp, Homo sapiens
tcctccctaaatcctagactgt

SEQ ID NO: 9311859 - DNA, 23 bp, Homo sapiens
tcctccctgacttctacagcaca

SEQ ID NO: 9311860 - DNA, 21 bp, Homo sapiens
tcctccctgagctgtggggga

SEQ ID NO: 9311861 - DNA, 22 bp, Homo sapiens
tcctccagggggatcttcagcc

SEQ ID NO: 9311862 - DNA, 22 bp, Homo sapiens
tcctccagtcttggtgaggttg

SEQ ID NO: 9311863 - DNA, 22 bp, Homo sapiens
tcctccaggtctagggtggctt

SEQ ID NO: 9311864 - DNA, 22 bp, Homo sapiens
tcctccagtggcccagtccttc

SEQ ID NO: 9311865 - DNA, 22 bp, Homo sapiens
tccctgcatttgggagagtgtc

SEQ ID NO: 9311866 - DNA, 22 bp, Homo sapiens
tccctgccaatgattggagcaa

SEQ ID NO: 9311867 - DNA, 22 bp, Homo sapiens
tccctgccctcagtgcacccgg

SEQ ID NO: 9311868 - DNA, 22 bp, Homo sapiens
tccctgggcacaatctgctggc

SEQ ID NO: 9311869 - DNA, 22 bp, Homo sapiens
tccctgggccacagctgtgagc

SEQ ID NO: 9311870 - DNA, 22 bp, Homo sapiens
tccctgcagcaggtgatcaatg

SEQ ID NO: 9311871 - DNA, 21 bp, Homo sapiens
tccctgagttctctgagcatc

SEQ ID NO: 9311872 - DNA, 22 bp, Homo sapiens
tccctgatgccttgatccgtgg

SEQ ID NO: 9311873 - DNA, 22 bp, Homo sapiens
tcccaggattttaggctctcag

SEQ ID NO: 9311874 - DNA, 22 bp, Homo sapiens
tcccaggcaaaggcagctcatt

SEQ ID NO: 9311875 - DNA, 22 bp, Homo sapiens
tcccaggatgtttatggctggt

SEQ ID NO: 9311876 - DNA, 22 bp, Homo sapiens
tcccaggatgttggcggcaggt

SEQ ID NO: 9311877 - DNA, 22 bp, Homo sapiens
tcccaggatgtttatggctggt

SEQ ID NO: 9311878 - DNA, 19 bp, Homo sapiens
tcccaggcaaaggcttctc

SEQ ID NO: 9311879 - DNA, 22 bp, Homo sapiens
tcccaggcagcttctttcatca

SEQ ID NO: 9311880 - DNA, 23 bp, Homo sapiens
tccctgagatgctgctctgtccc

SEQ ID NO: 9311881 - DNA, 22 bp, Homo sapiens
tccctgagtgtatgtggtgaac

SEQ ID NO: 9311882 - DNA, 19 bp, Homo sapiens
tccctgagttccagcccag

SEQ ID NO: 9311883 - DNA, 22 bp, Homo sapiens
tccctgaggaaggggtgtggtg

SEQ ID NO: 9311884 - DNA, 22 bp, Homo sapiens
tccctgggcctatcttagctcc

SEQ ID NO: 9311885 - DNA, 22 bp, Homo sapiens
tccctgggcctcctgctatgca

SEQ ID NO: 9311886 - DNA, 22 bp, Homo sapiens
tccctggggaagggcaagcaag

SEQ ID NO: 9311887 - DNA, 22 bp, Homo sapiens
tcccttctggcagcagtgtgag

SEQ ID NO: 9311888 - DNA, 22 bp, Homo sapiens
tcccttgtcctgtgggaagagc

SEQ ID NO: 9311889 - DNA, 18 bp, Homo sapiens
tcccttctcccttgcctc

SEQ ID NO: 9311890 - DNA, 18 bp, Homo sapiens
tcccttctcccttgcctc

SEQ ID NO: 9311891 - DNA, 19 bp, Homo sapiens
tcccttctatagtaataaa

SEQ ID NO: 9311892 - DNA, 22 bp, Homo sapiens
tcccttaaaactcatgtgttgt

SEQ ID NO: 9311893 - DNA, 22 bp, Homo sapiens
tcaattaagaggctaagttact

SEQ ID NO: 9311894 - DNA, 22 bp, Homo sapiens
tcacacagctgctctgttttat

SEQ ID NO: 9311895 - DNA, 22 bp, Homo sapiens
tcacacagctgacagagccttt

SEQ ID NO: 9311896 - DNA, 22 bp, Homo sapiens
tcacacagctcctttccttagt

SEQ ID NO: 9311897 - DNA, 22 bp, Homo sapiens
tcacacagctagtaagggccga

SEQ ID NO: 9311898 - DNA, 22 bp, Homo sapiens
tcacacagcagccccgggtgtt

SEQ ID NO: 9311899 - DNA, 22 bp, Homo sapiens
tcacacagattggtagagctga

SEQ ID NO: 9311900 - DNA, 23 bp, Homo sapiens
tcacacagctggtcaggtacaga

SEQ ID NO: 9311901 - DNA, 22 bp, Homo sapiens
tcacacagcttggagttatggt

SEQ ID NO: 9311902 - DNA, 22 bp, Homo sapiens
tcacacacataatctaagatta

SEQ ID NO: 9311903 - DNA, 23 bp, Homo sapiens
tcaaacaggtttcagagcatctt

SEQ ID NO: 9311904 - DNA, 22 bp, Homo sapiens
tcacatagtggggcattggaat

SEQ ID NO: 9311905 - DNA, 22 bp, Homo sapiens
tcacagcatttttagaaagatt

SEQ ID NO: 9311906 - DNA, 20 bp, Homo sapiens
tcacatcctctcccaacatg

SEQ ID NO: 9311907 - DNA, 22 bp, Homo sapiens
tcacatctccatgtgttgttca

SEQ ID NO: 9311908 - DNA, 22 bp, Homo sapiens
tcacatctctcattgcctctgc

SEQ ID NO: 9311909 - DNA, 22 bp, Homo sapiens
tcacagcaacactggggcagac

SEQ ID NO: 9311910 - DNA, 22 bp, Homo sapiens
tcacagcaaccctgaggcgagt

SEQ ID NO: 9311911 - DNA, 22 bp, Homo sapiens
tcacagcaccaggatctctcca

SEQ ID NO: 9311912 - DNA, 22 bp, Homo sapiens
tcacagcaccctgaggtgctgg

SEQ ID NO: 9311913 - DNA, 22 bp, Homo sapiens
tcacagcagaatttaggaggca

SEQ ID NO: 9311914 - DNA, 22 bp, Homo sapiens
tcacagcagaatttaggaggca

SEQ ID NO: 9311915 - DNA, 22 bp, Homo sapiens
tcacagcagggtaacaggaaga

SEQ ID NO: 9311916 - DNA, 22 bp, Homo sapiens
tcacagcattcgcaatggacag

SEQ ID NO: 9311917 - DNA, 22 bp, Homo sapiens
tcacagcattgtcacaaggctg

SEQ ID NO: 9311918 - DNA, 22 bp, Homo sapiens
tcacagcagtaaagaaaacact

SEQ ID NO: 9311919 - DNA, 21 bp, Homo sapiens
tcacagagccacagaattggt

SEQ ID NO: 9311920 - DNA, 22 bp, Homo sapiens
tcacagcaaaagtgtgcagagc

SEQ ID NO: 9311921 - DNA, 22 bp, Homo sapiens
tcacagcaaatgctgcttctca

SEQ ID NO: 9311922 - DNA, 22 bp, Homo sapiens
tcacagagagaatattgtgttt

SEQ ID NO: 9311923 - DNA, 22 bp, Homo sapiens
tcacagacccttgctgagctct

SEQ ID NO: 9311924 - DNA, 22 bp, Homo sapiens
tcacagacatggtgaggtaaca

SEQ ID NO: 9311925 - DNA, 22 bp, Homo sapiens
tcacagagagtgacttgttgct

SEQ ID NO: 9311926 - DNA, 22 bp, Homo sapiens
tcacagacaccttggccacagt

SEQ ID NO: 9311927 - DNA, 22 bp, Homo sapiens
tcacagacacagggagaagcat

SEQ ID NO: 9311928 - DNA, 22 bp, Homo sapiens
tcacagacacattaaacatgtg

SEQ ID NO: 9311929 - DNA, 22 bp, Homo sapiens
tcacagacactgggttattgca

SEQ ID NO: 9311930 - DNA, 22 bp, Homo sapiens
tcacagacagaagggatgggat

SEQ ID NO: 9311931 - DNA, 19 bp, Homo sapiens
tcacagacagagcaatcac

SEQ ID NO: 9311932 - DNA, 18 bp, Homo sapiens
tcacagacagctgtcttt

SEQ ID NO: 9311933 - DNA, 22 bp, Homo sapiens
tcacagacaattgttttggtgt

SEQ ID NO: 9311934 - DNA, 22 bp, Homo sapiens
tcacacagtggtaaaaccctga

SEQ ID NO: 9311935 - DNA, 22 bp, Homo sapiens
tcacacagggttctggtctcat

SEQ ID NO: 9311936 - DNA, 22 bp, Homo sapiens
tcacacaggtttgcaatgattt

SEQ ID NO: 9311937 - DNA, 22 bp, Homo sapiens
tcacacagggtcggaaagagtg

SEQ ID NO: 9311938 - DNA, 22 bp, Homo sapiens
tcacacagtgagaaagtgcgga

SEQ ID NO: 9311939 - DNA, 22 bp, Homo sapiens
tcacacagtgagcggggctcag

SEQ ID NO: 9311940 - DNA, 22 bp, Homo sapiens
tcactgggcatcggagctgaaa

SEQ ID NO: 9311941 - DNA, 22 bp, Homo sapiens
tcactggggcccacatcaacat

SEQ ID NO: 9311942 - DNA, 22 bp, Homo sapiens
tcagaacagtgcctggcactaa

SEQ ID NO: 9311943 - DNA, 22 bp, Homo sapiens
tcagaacatatattttgtgatg

SEQ ID NO: 9311944 - DNA, 22 bp, Homo sapiens
tcacccctacatttcccttgct

SEQ ID NO: 9311945 - DNA, 22 bp, Homo sapiens
tcacccctggcccagtcttgga

SEQ ID NO: 9311946 - DNA, 22 bp, Homo sapiens
tcaccccttgtgaatgctgctc

SEQ ID NO: 9311947 - DNA, 22 bp, Homo sapiens
tcacccctaccaaggagcactg

SEQ ID NO: 9311948 - DNA, 22 bp, Homo sapiens
tcacccctccattctctcatgt

SEQ ID NO: 9311949 - DNA, 22 bp, Homo sapiens
tcaccttgtgatctccctgcct

SEQ ID NO: 9311950 - DNA, 22 bp, Homo sapiens
tcacgagggccctgggcagctg

SEQ ID NO: 9311951 - DNA, 22 bp, Homo sapiens
tcagaggctacagtctgggagt

SEQ ID NO: 9311952 - DNA, 21 bp, Homo sapiens
tcagaggcactgagagcaatg

SEQ ID NO: 9311953 - DNA, 22 bp, Homo sapiens
tcagaggccaaactgagcaggg

SEQ ID NO: 9311954 - DNA, 22 bp, Homo sapiens
tcagagagctggtgggcagagg

SEQ ID NO: 9311955 - DNA, 20 bp, Homo sapiens
tcagagagagggtgccactt

SEQ ID NO: 9311956 - DNA, 23 bp, Homo sapiens
tcagagagctgttgagagctgcc

SEQ ID NO: 9311957 - DNA, 22 bp, Homo sapiens
tcagaggaataatgctgcattt

SEQ ID NO: 9311958 - DNA, 22 bp, Homo sapiens
tcagaggaatttgcttttcatg

SEQ ID NO: 9311959 - DNA, 21 bp, Homo sapiens
tcagaagagctgcctcttggt

SEQ ID NO: 9311960 - DNA, 22 bp, Homo sapiens
tcagaagaaaagacttttagag

SEQ ID NO: 9311961 - DNA, 22 bp, Homo sapiens
tcagaagaagagactccacagc

SEQ ID NO: 9311962 - DNA, 22 bp, Homo sapiens
tcagaacatcctggtttaaaat

SEQ ID NO: 9311963 - DNA, 22 bp, Homo sapiens
tcagaacattacattttgagct

SEQ ID NO: 9311964 - DNA, 22 bp, Homo sapiens
tcagaacattctcattgactgc

SEQ ID NO: 9311965 - DNA, 22 bp, Homo sapiens
tcagaacatttgggactttggg

SEQ ID NO: 9311966 - DNA, 22 bp, Homo sapiens
tcagagaatctctccttagttt

SEQ ID NO: 9311967 - DNA, 23 bp, Homo sapiens
tcagagaatggtatgcttttcct

SEQ ID NO: 9311968 - DNA, 22 bp, Homo sapiens
tcagagaatgtccttcttcatt

SEQ ID NO: 9311969 - DNA, 22 bp, Homo sapiens
tcagagacaccagagagctgtg

SEQ ID NO: 9311970 - DNA, 22 bp, Homo sapiens
tcaggagcagcatgggtgagag

SEQ ID NO: 9311971 - DNA, 22 bp, Homo sapiens
tcaggagatggtctttataggc

SEQ ID NO: 9311972 - DNA, 22 bp, Homo sapiens
tcaggagatgtaaccttagctg

SEQ ID NO: 9311973 - DNA, 22 bp, Homo sapiens
tcaggaaatggaattcttgtgt

SEQ ID NO: 9311974 - DNA, 22 bp, Homo sapiens
tcaggaaatggacatctttgct

SEQ ID NO: 9311975 - DNA, 22 bp, Homo sapiens
tcaggaaatggtgatttggttg

SEQ ID NO: 9311976 - DNA, 22 bp, Homo sapiens
tcaggaaaggcagagtgtctgt

SEQ ID NO: 9311977 - DNA, 22 bp, Homo sapiens
tcaggaaagagtgtatccatca

SEQ ID NO: 9311978 - DNA, 22 bp, Homo sapiens
tcagctttctctcgccatcagg

SEQ ID NO: 9311979 - DNA, 22 bp, Homo sapiens
tcagctttctcagaggcctaac

SEQ ID NO: 9311980 - DNA, 22 bp, Homo sapiens
tcaggagggtgacaggccctgg

SEQ ID NO: 9311981 - DNA, 22 bp, Homo sapiens
tcaggagctcaggctgatggaa

SEQ ID NO: 9311982 - DNA, 22 bp, Homo sapiens
tcaggagcctgaaagaggtcta

SEQ ID NO: 9311983 - DNA, 22 bp, Homo sapiens
tcaggagcagctgtaggaaggg

SEQ ID NO: 9311984 - DNA, 22 bp, Homo sapiens
tcaggcaggaagggaggacttg

SEQ ID NO: 9311985 - DNA, 22 bp, Homo sapiens
tcaggcaggaagggaggacttg

SEQ ID NO: 9311986 - DNA, 22 bp, Homo sapiens
tcaggcaggatcccagggaagg

SEQ ID NO: 9311987 - DNA, 22 bp, Homo sapiens
tcaggcaggatcccagggaagg

SEQ ID NO: 9311988 - DNA, 21 bp, Homo sapiens
tcaggcaggcgcagagggaag

SEQ ID NO: 9311989 - DNA, 21 bp, Homo sapiens
tcaggcaggcgcagagggaag

SEQ ID NO: 9311990 - DNA, 22 bp, Homo sapiens
tcaggcaggtggctggctatgg

SEQ ID NO: 9311991 - DNA, 22 bp, Homo sapiens
tcaggcaggttggctgcaggtc

SEQ ID NO: 9311992 - DNA, 22 bp, Homo sapiens
tcaggcaggttggctgcaggtc

SEQ ID NO: 9311993 - DNA, 21 bp, Homo sapiens
tcaggcaggtcccactgaaca

SEQ ID NO: 9311994 - DNA, 22 bp, Homo sapiens
tcaggcaggctcagaggaaaac

SEQ ID NO: 9311995 - DNA, 22 bp, Homo sapiens
tcaggcaggctcagaggaaaac

SEQ ID NO: 9311996 - DNA, 22 bp, Homo sapiens
tcaggaggtccgcccgggaggg

SEQ ID NO: 9311997 - DNA, 22 bp, Homo sapiens
tcaggaggtaaggtaaaacaga

SEQ ID NO: 9311998 - DNA, 22 bp, Homo sapiens
tcaggcagatgcagggatggat

SEQ ID NO: 9311999 - DNA, 22 bp, Homo sapiens
tcaggcagatgcagggatggat

SEQ ID NO: 9312000 - DNA, 22 bp, Homo sapiens
tcaggcagctccaggaatggta

SEQ ID NO: 9312001 - DNA, 22 bp, Homo sapiens
tcaggcagctccaggaatggta

SEQ ID NO: 9312002 - DNA, 23 bp, Homo sapiens
tcaggcagctggggtagttggag

SEQ ID NO: 9312003 - DNA, 22 bp, Homo sapiens
tcagcccttcctggagctttta

SEQ ID NO: 9312004 - DNA, 22 bp, Homo sapiens
tcagctttctatgttgctaaac

SEQ ID NO: 9312005 - DNA, 22 bp, Homo sapiens
tcagctttctcaaagaagctgg

SEQ ID NO: 9312006 - DNA, 18 bp, Homo sapiens
tcagcttccagcatgttt

SEQ ID NO: 9312007 - DNA, 22 bp, Homo sapiens
tcagcttccctatctgaccata

SEQ ID NO: 9312008 - DNA, 22 bp, Homo sapiens
tcagcttctcaaaatggcttag

SEQ ID NO: 9312009 - DNA, 22 bp, Homo sapiens
tcagcttcgcctgaggtatggg

SEQ ID NO: 9312010 - DNA, 22 bp, Homo sapiens
tcagcttcgcctgaggtatggg

SEQ ID NO: 9312011 - DNA, 22 bp, Homo sapiens
tcagcttcctctgtggttccag

SEQ ID NO: 9312012 - DNA, 22 bp, Homo sapiens
tcagcttctttcacttaacatg

SEQ ID NO: 9312013 - DNA, 19 bp, Homo sapiens
tcagcttctgtgtattgta

SEQ ID NO: 9312014 - DNA, 22 bp, Homo sapiens
tcagcttctccaagtgacatgg

SEQ ID NO: 9312015 - DNA, 22 bp, Homo sapiens
tcagcttctcaaaatggcttag

SEQ ID NO: 9312016 - DNA, 22 bp, Homo sapiens
tcagcttcaaatttggtgaagt

SEQ ID NO: 9312017 - DNA, 22 bp, Homo sapiens
tcagcttcacccagagttgtag

SEQ ID NO: 9312018 - DNA, 22 bp, Homo sapiens
tcagcttcacccagagttgtag

SEQ ID NO: 9312019 - DNA, 22 bp, Homo sapiens
tcagcttcagatcagctagaga

SEQ ID NO: 9312020 - DNA, 22 bp, Homo sapiens
tcagcttcagatcagctagaga

SEQ ID NO: 9312021 - DNA, 23 bp, Homo sapiens
tcagcttcattgtcttctatggc

SEQ ID NO: 9312022 - DNA, 18 bp, Homo sapiens
tcagcttccagcatgttt

SEQ ID NO: 9312023 - DNA, 22 bp, Homo sapiens
tcagccagggctctggcctcag

SEQ ID NO: 9312024 - DNA, 22 bp, Homo sapiens
tcagaggtggtaaaggacagca

SEQ ID NO: 9312025 - DNA, 22 bp, Homo sapiens
tcagaggtggtaaaggacagca

SEQ ID NO: 9312026 - DNA, 22 bp, Homo sapiens
tcagaggttcttctcagtggcc

SEQ ID NO: 9312027 - DNA, 22 bp, Homo sapiens
tcagaggttccggccataacca

SEQ ID NO: 9312028 - DNA, 22 bp, Homo sapiens
tcagaggttacccatgggacag

SEQ ID NO: 9312029 - DNA, 22 bp, Homo sapiens
tcagagtacgcatgctctgatt

SEQ ID NO: 9312030 - DNA, 20 bp, Homo sapiens
tcagaggctgccagctgggg

SEQ ID NO: 9312031 - DNA, 21 bp, Homo sapiens
tcagagggccctggaggctca

SEQ ID NO: 9312032 - DNA, 22 bp, Homo sapiens
tcagaggtggcaggggtgtcca

SEQ ID NO: 9312033 - DNA, 22 bp, Homo sapiens
tcagaggtggcccctgccctca

SEQ ID NO: 9312034 - DNA, 22 bp, Homo sapiens
tcagaggtggagatagttggga

SEQ ID NO: 9312035 - DNA, 22 bp, Homo sapiens
tcagaggtgcaagaagttctga

SEQ ID NO: 9312036 - DNA, 22 bp, Homo sapiens
tcagaggtgagcttcttgctaa

SEQ ID NO: 9312037 - DNA, 22 bp, Homo sapiens
tcagaggtccctagcaggagtg

SEQ ID NO: 9312038 - DNA, 22 bp, Homo sapiens
tcagaggtgagcatgtgaccaa

SEQ ID NO: 9312039 - DNA, 22 bp, Homo sapiens
tcagaggtccctagcaggagtg

SEQ ID NO: 9312040 - DNA, 22 bp, Homo sapiens
tcagaggtagtagcagagttga

SEQ ID NO: 9312041 - DNA, 22 bp, Homo sapiens
tcagaggtcacacagcaagttt

SEQ ID NO: 9312042 - DNA, 22 bp, Homo sapiens
tcagaggtcagcagcttgccca

SEQ ID NO: 9312043 - DNA, 22 bp, Homo sapiens
tcagaggtaaaaactcactgta

SEQ ID NO: 9312044 - DNA, 18 bp, Homo sapiens
tcagaggtacagaaaagt

SEQ ID NO: 9312045 - DNA, 22 bp, Homo sapiens
tcagaggtaagggctgagagga

SEQ ID NO: 9312046 - DNA, 22 bp, Homo sapiens
tcaggtgacctgagccactatg

SEQ ID NO: 9312047 - DNA, 22 bp, Homo sapiens
tcaggtcccactgctagtaagt

SEQ ID NO: 9312048 - DNA, 22 bp, Homo sapiens
tcaggtccccaactcttctcac

SEQ ID NO: 9312049 - DNA, 22 bp, Homo sapiens
tcaggtccccaactcttctcac

SEQ ID NO: 9312050 - DNA, 22 bp, Homo sapiens
tcaggtcctctgggtcccagcc

SEQ ID NO: 9312051 - DNA, 22 bp, Homo sapiens
tcaggtccttactgtgctccct

SEQ ID NO: 9312052 - DNA, 22 bp, Homo sapiens
tcaggtccttttggtgtatatt

SEQ ID NO: 9312053 - DNA, 22 bp, Homo sapiens
tcaggtccagctcctgtgcctc

SEQ ID NO: 9312054 - DNA, 22 bp, Homo sapiens
tcaggtccaagatggccatcca

SEQ ID NO: 9312055 - DNA, 22 bp, Homo sapiens
tcagggtgaaattgggtcctgg

SEQ ID NO: 9312056 - DNA, 22 bp, Homo sapiens
tcagggcagcctaaggcacctc

SEQ ID NO: 9312057 - DNA, 22 bp, Homo sapiens
tcagggcagcctaaggcacctc

SEQ ID NO: 9312058 - DNA, 22 bp, Homo sapiens
tcagggctgccgggcagaccgt

SEQ ID NO: 9312059 - DNA, 22 bp, Homo sapiens
tcagggctttggcttttactct

SEQ ID NO: 9312060 - DNA, 22 bp, Homo sapiens
tcagggctgtggttccttttct

SEQ ID NO: 9312061 - DNA, 22 bp, Homo sapiens
tcagggctgtggttccttttct

SEQ ID NO: 9312062 - DNA, 22 bp, Homo sapiens
tcagggctggcttttgcagagc

SEQ ID NO: 9312063 - DNA, 22 bp, Homo sapiens
tcagggcagaatccaaagaatt

SEQ ID NO: 9312064 - DNA, 22 bp, Homo sapiens
tcagggcacattctgcagtggc

SEQ ID NO: 9312065 - DNA, 22 bp, Homo sapiens
tcaggggcttgaggtgcatgtc

SEQ ID NO: 9312066 - DNA, 22 bp, Homo sapiens
tcaggggcccttccctcagcag

SEQ ID NO: 9312067 - DNA, 22 bp, Homo sapiens
tcaggggaaatctctcagcgaa

SEQ ID NO: 9312068 - DNA, 22 bp, Homo sapiens
tcagggcacaggcctgtgggtt

SEQ ID NO: 9312069 - DNA, 22 bp, Homo sapiens
tcagggcaaagggcagagtttg

SEQ ID NO: 9312070 - DNA, 22 bp, Homo sapiens
tcagggcaaagggcagagtttg

SEQ ID NO: 9312071 - DNA, 22 bp, Homo sapiens
tcagggcaagtctcagaaggtt

SEQ ID NO: 9312072 - DNA, 22 bp, Homo sapiens
tcagggcaaaagggaaaccatt

SEQ ID NO: 9312073 - DNA, 22 bp, Homo sapiens
tcagggcaaaagggaaaccatt

SEQ ID NO: 9312074 - DNA, 22 bp, Homo sapiens
tcagggactgttactgcctttg

SEQ ID NO: 9312075 - DNA, 22 bp, Homo sapiens
tcagggactgcagagggaagct

SEQ ID NO: 9312076 - DNA, 22 bp, Homo sapiens
tcagggactaggtgctgcctga

SEQ ID NO: 9312077 - DNA, 21 bp, Homo sapiens
tcagggactaggtactgggga

SEQ ID NO: 9312078 - DNA, 22 bp, Homo sapiens
tcaggcctttgaacttggagtg

SEQ ID NO: 9312079 - DNA, 22 bp, Homo sapiens
tcaggcctttcttcagagcttc

SEQ ID NO: 9312080 - DNA, 22 bp, Homo sapiens
tcaggctccctgctgggctctg

SEQ ID NO: 9312081 - DNA, 22 bp, Homo sapiens
tcaggctcaggttaggggccaa

SEQ ID NO: 9312082 - DNA, 22 bp, Homo sapiens
tcaggctccctgctgggctctg

SEQ ID NO: 9312083 - DNA, 22 bp, Homo sapiens
tcaggctcaggttaggggccaa

SEQ ID NO: 9312084 - DNA, 22 bp, Homo sapiens
tcaggctctacacttgacacac

SEQ ID NO: 9312085 - DNA, 22 bp, Homo sapiens
tcaggctctcagaccaacagca

SEQ ID NO: 9312086 - DNA, 18 bp, Homo sapiens
tcaggctctctggctaga

SEQ ID NO: 9312087 - DNA, 22 bp, Homo sapiens
tcatcctgtctcactttttgct

SEQ ID NO: 9312088 - DNA, 22 bp, Homo sapiens
tcatcctgtatcctcagaccat

SEQ ID NO: 9312089 - DNA, 22 bp, Homo sapiens
tcatcctgcactggctcctcct

SEQ ID NO: 9312090 - DNA, 22 bp, Homo sapiens
tcatcctggagaagctccttcg

SEQ ID NO: 9312091 - DNA, 22 bp, Homo sapiens
tcatctcagagaggtatgttag

SEQ ID NO: 9312092 - DNA, 22 bp, Homo sapiens
tcatctccatacggtctcgcag

SEQ ID NO: 9312093 - DNA, 22 bp, Homo sapiens
tcatctcagggcgacatcatgt

SEQ ID NO: 9312094 - DNA, 22 bp, Homo sapiens
tcatccagtatgactggtgtct

SEQ ID NO: 9312095 - DNA, 22 bp, Homo sapiens
tcatccagttgtggagagggaa

SEQ ID NO: 9312096 - DNA, 22 bp, Homo sapiens
tcatccagttcacatggtgagt

SEQ ID NO: 9312097 - DNA, 22 bp, Homo sapiens
tcatcctgaagaacctgcttcc

SEQ ID NO: 9312098 - DNA, 20 bp, Homo sapiens
tcatatttttgccctgggcc

SEQ ID NO: 9312099 - DNA, 22 bp, Homo sapiens
tcatattttgcaaggtcagcta

SEQ ID NO: 9312100 - DNA, 22 bp, Homo sapiens
tcatatttgggggtgtgtgttt

SEQ ID NO: 9312101 - DNA, 22 bp, Homo sapiens
tcatccagcctcatcaggagct

SEQ ID NO: 9312102 - DNA, 22 bp, Homo sapiens
tcatccaggaaaagatttggaa

SEQ ID NO: 9312103 - DNA, 22 bp, Homo sapiens
tcatccagtaccatggaaggca

SEQ ID NO: 9312104 - DNA, 22 bp, Homo sapiens
tcagtttttaagagttatgcga

SEQ ID NO: 9312105 - DNA, 22 bp, Homo sapiens
tcagtttttaaatgatataatt

SEQ ID NO: 9312106 - DNA, 22 bp, Homo sapiens
tcataaaaatagactctaaagt

SEQ ID NO: 9312107 - DNA, 22 bp, Homo sapiens
gggctggctcccaggtgttgaa

SEQ ID NO: 9312108 - DNA, 20 bp, Homo sapiens
gggctggctcaactggatcc

SEQ ID NO: 9312109 - DNA, 22 bp, Homo sapiens
gggctggctaagacttttctgt

SEQ ID NO: 9312110 - DNA, 22 bp, Homo sapiens
gggctggcgggaaaggcaattc

SEQ ID NO: 9312111 - DNA, 20 bp, Homo sapiens
gggctggcgcatggggaaag

SEQ ID NO: 9312112 - DNA, 22 bp, Homo sapiens
gggctggcgggaaaggcaattc

SEQ ID NO: 9312113 - DNA, 20 bp, Homo sapiens
gggctggcgcatggggaaag

SEQ ID NO: 9312114 - DNA, 22 bp, Homo sapiens
gggctccagcagaggcagccgg

SEQ ID NO: 9312115 - DNA, 22 bp, Homo sapiens
gggctccagcagaggcagccgg

SEQ ID NO: 9312116 - DNA, 22 bp, Homo sapiens
gggctccagccactggctgagg

SEQ ID NO: 9312117 - DNA, 22 bp, Homo sapiens
gggctccagccaggtgtcccca

SEQ ID NO: 9312118 - DNA, 22 bp, Homo sapiens
gggctccagccagctccttgtg

SEQ ID NO: 9312119 - DNA, 21 bp, Homo sapiens
gggctccagagatgtagcttc

SEQ ID NO: 9312120 - DNA, 22 bp, Homo sapiens
gggctccacgcacgcgagaggt

SEQ ID NO: 9312121 - DNA, 22 bp, Homo sapiens
gggctccagaggctcaccctgg

SEQ ID NO: 9312122 - DNA, 22 bp, Homo sapiens
gggctccacgcacgcgagaggt

SEQ ID NO: 9312123 - DNA, 22 bp, Homo sapiens
gggctccagattgcagcgatca

SEQ ID NO: 9312124 - DNA, 22 bp, Homo sapiens
gggctccagagtccatgttctt

SEQ ID NO: 9312125 - DNA, 22 bp, Homo sapiens
gggctccacagcagtgagtgga

SEQ ID NO: 9312126 - DNA, 22 bp, Homo sapiens
gggctccacctagggacactgg

SEQ ID NO: 9312127 - DNA, 22 bp, Homo sapiens
gggctccagtttggccaggaag

SEQ ID NO: 9312128 - DNA, 22 bp, Homo sapiens
gggctccagtttggccaggaag

SEQ ID NO: 9312129 - DNA, 22 bp, Homo sapiens
gggctccatcacaggctccatc

SEQ ID NO: 9312130 - DNA, 22 bp, Homo sapiens
gggctccatcggacttgggttt

SEQ ID NO: 9312131 - DNA, 23 bp, Homo sapiens
gggctccagtctctgctcagttg

SEQ ID NO: 9312132 - DNA, 22 bp, Homo sapiens
gggctccagttgtccccaggat

SEQ ID NO: 9312133 - DNA, 22 bp, Homo sapiens
gggctccagggcccgagtcgtc

SEQ ID NO: 9312134 - DNA, 22 bp, Homo sapiens
gggctccaggcaggcaggaaat

SEQ ID NO: 9312135 - DNA, 22 bp, Homo sapiens
gggctccaggcaggcaggaaat

SEQ ID NO: 9312136 - DNA, 22 bp, Homo sapiens
gggctccaggagccctaagaga

SEQ ID NO: 9312137 - DNA, 20 bp, Homo sapiens
gggctccagctgtgattctt

SEQ ID NO: 9312138 - DNA, 22 bp, Homo sapiens
gggctccagcccgggaccaggt

SEQ ID NO: 9312139 - DNA, 22 bp, Homo sapiens
gggctccagctgtttgccatga

SEQ ID NO: 9312140 - DNA, 22 bp, Homo sapiens
gggcatgagaggcaggcaagtg

SEQ ID NO: 9312141 - DNA, 22 bp, Homo sapiens
gggcctctcccttctcacgcat

SEQ ID NO: 9312142 - DNA, 22 bp, Homo sapiens
gggcctcatgatggctcaggaa

SEQ ID NO: 9312143 - DNA, 22 bp, Homo sapiens
gggcctgactgagagctcctca

SEQ ID NO: 9312144 - DNA, 22 bp, Homo sapiens
gggcctggcatgcagccccgtt

SEQ ID NO: 9312145 - DNA, 22 bp, Homo sapiens
gggcctggggtgacgtacccct

SEQ ID NO: 9312146 - DNA, 22 bp, Homo sapiens
gggctccaaggaggccagcctg

SEQ ID NO: 9312147 - DNA, 22 bp, Homo sapiens
gggcctggggacaccaccatga

SEQ ID NO: 9312148 - DNA, 22 bp, Homo sapiens
gggcctgggaacttgcatttag

SEQ ID NO: 9312149 - DNA, 21 bp, Homo sapiens
gggcctggctgcgcaggacgg

SEQ ID NO: 9312150 - DNA, 21 bp, Homo sapiens
gggcctggctgcgcaggacgg

SEQ ID NO: 9312151 - DNA, 22 bp, Homo sapiens
gggctgggaatggctaagtatg

SEQ ID NO: 9312152 - DNA, 22 bp, Homo sapiens
gggctgggaatggctaagtatg

SEQ ID NO: 9312153 - DNA, 22 bp, Homo sapiens
gggctgggatggcttgaagatt

SEQ ID NO: 9312154 - DNA, 22 bp, Homo sapiens
gggctggctgattttcctctct

SEQ ID NO: 9312155 - DNA, 22 bp, Homo sapiens
gggctggctcccaggtgttgaa

SEQ ID NO: 9312156 - DNA, 22 bp, Homo sapiens
gggctggctctgtctagaaagg

SEQ ID NO: 9312157 - DNA, 22 bp, Homo sapiens
gggctggctgattttcctctct

SEQ ID NO: 9312158 - DNA, 22 bp, Homo sapiens
gggctgggcatggtgttccctc

SEQ ID NO: 9312159 - DNA, 22 bp, Homo sapiens
gggctggggctcaataatttgt

SEQ ID NO: 9312160 - DNA, 22 bp, Homo sapiens
gggctgggattgcttgctgtga

SEQ ID NO: 9312161 - DNA, 22 bp, Homo sapiens
ggggatggtgggaaggcaatct

SEQ ID NO: 9312162 - DNA, 22 bp, Homo sapiens
ggggatggaggcgtgtggtcct

SEQ ID NO: 9312163 - DNA, 22 bp, Homo sapiens
ggggatggaatgtagtagtgat

SEQ ID NO: 9312164 - DNA, 22 bp, Homo sapiens
ggggatggattccgggtccctg

SEQ ID NO: 9312165 - DNA, 22 bp, Homo sapiens
gggggccttattcatctgccag

SEQ ID NO: 9312166 - DNA, 22 bp, Homo sapiens
gggggccagtgtctcttccttg

SEQ ID NO: 9312167 - DNA, 23 bp, Homo sapiens
gggggccgtcctggggattatag

SEQ ID NO: 9312168 - DNA, 22 bp, Homo sapiens
ggggcttctttctgccaccgac

SEQ ID NO: 9312169 - DNA, 22 bp, Homo sapiens
ggggctgtttttggaatggctg

SEQ ID NO: 9312170 - DNA, 22 bp, Homo sapiens
gggggaagaaagaacatggcat

SEQ ID NO: 9312171 - DNA, 22 bp, Homo sapiens
gggggaagactgggctagtgat

SEQ ID NO: 9312172 - DNA, 21 bp, Homo sapiens
gggggaagaggagttgctagt

SEQ ID NO: 9312173 - DNA, 22 bp, Homo sapiens
gggggaagaggcatgaagtcct

SEQ ID NO: 9312174 - DNA, 22 bp, Homo sapiens
gggggaagtaattataaaccaa

SEQ ID NO: 9312175 - DNA, 22 bp, Homo sapiens
ggtgcatgtgagaaagactggg

SEQ ID NO: 9312176 - DNA, 20 bp, Homo sapiens
ggtgcaggtaacgctgtgct

SEQ ID NO: 9312177 - DNA, 22 bp, Homo sapiens
ggtgaagtaataccaggtgtac

SEQ ID NO: 9312178 - DNA, 22 bp, Homo sapiens
ggtgaaggtcagagcaggaaaa

SEQ ID NO: 9312179 - DNA, 22 bp, Homo sapiens
ggtgaaatatttttgatatgtt

SEQ ID NO: 9312180 - DNA, 22 bp, Homo sapiens
ggtcttcaggtctagttggtat

SEQ ID NO: 9312181 - DNA, 22 bp, Homo sapiens
ggtcttcagctttgcatgtctt

SEQ ID NO: 9312182 - DNA, 22 bp, Homo sapiens
ggtctgggcttgagtccttttg

SEQ ID NO: 9312183 - DNA, 22 bp, Homo sapiens
ggtcccagaattggttagcaca

SEQ ID NO: 9312184 - DNA, 22 bp, Homo sapiens
ggtctggggcaggcatctgaca

SEQ ID NO: 9312185 - DNA, 17 bp, Homo sapiens
ggtctggggccattggc

SEQ ID NO: 9312186 - DNA, 22 bp, Homo sapiens
ggtctgggtttccccaccacac

SEQ ID NO: 9312187 - DNA, 22 bp, Homo sapiens
ggtgggcaacatttggcctgag

SEQ ID NO: 9312188 - DNA, 21 bp, Homo sapiens
ggtgggcacaggagagcagag

SEQ ID NO: 9312189 - DNA, 22 bp, Homo sapiens
ggtgggagtggaacgtggaaga

SEQ ID NO: 9312190 - DNA, 22 bp, Homo sapiens
ggtgggaggcaggctgctccca

SEQ ID NO: 9312191 - DNA, 22 bp, Homo sapiens
ggtgggagccaacacccttctg

SEQ ID NO: 9312192 - DNA, 22 bp, Homo sapiens
ggtgggagagctctgtctccag

SEQ ID NO: 9312193 - DNA, 22 bp, Homo sapiens
ggtgggagagcttgctttgatg

SEQ ID NO: 9312194 - DNA, 23 bp, Homo sapiens
ggtgggagattatccagaattat

SEQ ID NO: 9312195 - DNA, 22 bp, Homo sapiens
ggtgccaggctgtagtcagggt

SEQ ID NO: 9312196 - DNA, 22 bp, Homo sapiens
ggtgccagagtggcccaggggc

SEQ ID NO: 9312197 - DNA, 22 bp, Homo sapiens
ggtgctcaagagggcatcctct

SEQ ID NO: 9312198 - DNA, 22 bp, Homo sapiens
ggtgcggagactccatgaggcc

SEQ ID NO: 9312199 - DNA, 22 bp, Homo sapiens
ggtgcccttcagacagtgggca

SEQ ID NO: 9312200 - DNA, 23 bp, Homo sapiens
ggtaccagcacagagtggagagg

SEQ ID NO: 9312201 - DNA, 22 bp, Homo sapiens
ggtacaatggaccataaaagct

SEQ ID NO: 9312202 - DNA, 22 bp, Homo sapiens
ggtaacttgagtgtgttgttca

SEQ ID NO: 9312203 - DNA, 22 bp, Homo sapiens
ggtaaactaaccattttaattt

SEQ ID NO: 9312204 - DNA, 22 bp, Homo sapiens
ggtaaattttatgttatgtata

SEQ ID NO: 9312205 - DNA, 22 bp, Homo sapiens
ggtaaaatgcagattcttagcc

SEQ ID NO: 9312206 - DNA, 22 bp, Homo sapiens
gggtccagcgacagcaggctca

SEQ ID NO: 9312207 - DNA, 23 bp, Homo sapiens
gggtccagccaattccaaggaaa

SEQ ID NO: 9312208 - DNA, 22 bp, Homo sapiens
gggtccagcgacagcaggctca

SEQ ID NO: 9312209 - DNA, 22 bp, Homo sapiens
gggtccagcgacagcaggctca

SEQ ID NO: 9312210 - DNA, 22 bp, Homo sapiens
gggtccagatggtgagagttaa

SEQ ID NO: 9312211 - DNA, 16 bp, Homo sapiens
gggtccagatctgctc

SEQ ID NO: 9312212 - DNA, 22 bp, Homo sapiens
gggtccagaatgagaatgggct

SEQ ID NO: 9312213 - DNA, 22 bp, Homo sapiens
gggtccagaatgagaatgggct

SEQ ID NO: 9312214 - DNA, 22 bp, Homo sapiens
gggtccagacactccagaggaa

SEQ ID NO: 9312215 - DNA, 22 bp, Homo sapiens
gggtccagactatgaagaactt

SEQ ID NO: 9312216 - DNA, 22 bp, Homo sapiens
gggtccagagcctcagcccaga

SEQ ID NO: 9312217 - DNA, 22 bp, Homo sapiens
gggtccagagttgaagaggtta

SEQ ID NO: 9312218 - DNA, 22 bp, Homo sapiens
gggtccagagttttcccgccct

SEQ ID NO: 9312219 - DNA, 23 bp, Homo sapiens
gggtccagagacaggcatgggtg

SEQ ID NO: 9312220 - DNA, 23 bp, Homo sapiens
gggtccagagaagccattagggc

SEQ ID NO: 9312221 - DNA, 23 bp, Homo sapiens
gggtccagagaagccattagggc

SEQ ID NO: 9312222 - DNA, 23 bp, Homo sapiens
gggtccagagacaggcatgggtg

SEQ ID NO: 9312223 - DNA, 23 bp, Homo sapiens
gggtccagagacaggcatgggtg

SEQ ID NO: 9312224 - DNA, 22 bp, Homo sapiens
gggtcaggcctcaaggtgggct

SEQ ID NO: 9312225 - DNA, 18 bp, Homo sapiens
ggtcaggggcggagagaa

SEQ ID NO: 9312226 - DNA, 22 bp, Homo sapiens
ggtcagggggatctgtgaggta

SEQ ID NO: 9312227 - DNA, 22 bp, Homo sapiens
ggtcagggggatctgtgaggta

SEQ ID NO: 9312228 - DNA, 18 bp, Homo sapiens
ggtcaggggcggagagaa

SEQ ID NO: 9312229 - DNA, 22 bp, Homo sapiens
ggtcagggttccaggtatcttc

SEQ ID NO: 9312230 - DNA, 22 bp, Homo sapiens
ggtcagggttccaggtatcttc

SEQ ID NO: 9312231 - DNA, 22 bp, Homo sapiens
ggtcagggtataatcaagtgag

SEQ ID NO: 9312232 - DNA, 19 bp, Homo sapiens
ggtccagacttcagactag

SEQ ID NO: 9312233 - DNA, 22 bp, Homo sapiens
ggtccagagtccttgctagaga

SEQ ID NO: 9312234 - DNA, 23 bp, Homo sapiens
ggtccaggaaaggcagcagcacc

SEQ ID NO: 9312235 - DNA, 22 bp, Homo sapiens
ggtccagggaactttgaaggat

SEQ ID NO: 9312236 - DNA, 22 bp, Homo sapiens
ggtccagggggtagatatgtga

SEQ ID NO: 9312237 - DNA, 22 bp, Homo sapiens
ggtagcacagggcactgatctc

SEQ ID NO: 9312238 - DNA, 22 bp, Homo sapiens
ggtagctgcagcaggctggcaa

SEQ ID NO: 9312239 - DNA, 22 bp, Homo sapiens
ggtagctgcagcaggctggcaa

SEQ ID NO: 9312240 - DNA, 20 bp, Homo sapiens
ggtagctgctgcagttggta

SEQ ID NO: 9312241 - DNA, 22 bp, Homo sapiens
ggtaggagtattttgcagcagt

SEQ ID NO: 9312242 - DNA, 22 bp, Homo sapiens
ggtagcacattgcattaggaga

SEQ ID NO: 9312243 - DNA, 22 bp, Homo sapiens
ggtcagctctttgggctggtgg

SEQ ID NO: 9312244 - DNA, 22 bp, Homo sapiens
ggtcagcatctggttgagggca

SEQ ID NO: 9312245 - DNA, 22 bp, Homo sapiens
gtgatgttatgaagatgaatgt

SEQ ID NO: 9312246 - DNA, 22 bp, Homo sapiens
gtgatggagtcaaggctagaac

SEQ ID NO: 9312247 - DNA, 22 bp, Homo sapiens
gtgatatttttaaagattaagg

SEQ ID NO: 9312248 - DNA, 22 bp, Homo sapiens
gtgaggcagggaaagaggataa

SEQ ID NO: 9312249 - DNA, 22 bp, Homo sapiens
gtcttctgtctgtctggcatgt

SEQ ID NO: 9312250 - DNA, 22 bp, Homo sapiens
gtgaggtgggctggccagagac

SEQ ID NO: 9312251 - DNA, 22 bp, Homo sapiens
gtgaggtgggctgggctctatg

SEQ ID NO: 9312252 - DNA, 22 bp, Homo sapiens
gtgaggctactcagctgtccga

SEQ ID NO: 9312253 - DNA, 22 bp, Homo sapiens
gtgaggcagggaaagaggataa

SEQ ID NO: 9312254 - DNA, 22 bp, Homo sapiens
gtgaggcagggaaagaggataa

SEQ ID NO: 9312255 - DNA, 22 bp, Homo sapiens
gtctctctgctaggcctccagt

SEQ ID NO: 9312256 - DNA, 22 bp, Homo sapiens
gtctctctgctaggcctccagt

SEQ ID NO: 9312257 - DNA, 22 bp, Homo sapiens
gtctctatcatagctgaaccct

SEQ ID NO: 9312258 - DNA, 22 bp, Homo sapiens
gtctctcaaaactagaagagaa

SEQ ID NO: 9312259 - DNA, 22 bp, Homo sapiens
gtctcctgtcctgcaggatgga

SEQ ID NO: 9312260 - DNA, 22 bp, Homo sapiens
gtctcctggcttttgtcccagt

SEQ ID NO: 9312261 - DNA, 22 bp, Homo sapiens
gtctcctgagactgcagtcacc

SEQ ID NO: 9312262 - DNA, 22 bp, Homo sapiens
gtctcctgaggcatccattgaa

SEQ ID NO: 9312263 - DNA, 22 bp, Homo sapiens
gtctcctgccacactcagtccc

SEQ ID NO: 9312264 - DNA, 22 bp, Homo sapiens
gtctcctggctgcagctaagac

SEQ ID NO: 9312265 - DNA, 22 bp, Homo sapiens
gtctcctggaaatatgcccata

SEQ ID NO: 9312266 - DNA, 22 bp, Homo sapiens
gtgcaagtccagaaagaactct

SEQ ID NO: 9312267 - DNA, 22 bp, Homo sapiens
gtgcaaaagtaactgtggtttt

SEQ ID NO: 9312268 - DNA, 22 bp, Homo sapiens
gtgcacacaagcaatgcactta

SEQ ID NO: 9312269 - DNA, 22 bp, Homo sapiens
gtgcaaaaggcattgtggtttt

SEQ ID NO: 9312270 - DNA, 22 bp, Homo sapiens
gtgcaaaagtaaatgtggtttt

SEQ ID NO: 9312271 - DNA, 22 bp, Homo sapiens
gtgcaaaagcaattgcagtttt

SEQ ID NO: 9312272 - DNA, 22 bp, Homo sapiens
gtgcaaaagcagttgtggtttt

SEQ ID NO: 9312273 - DNA, 22 bp, Homo sapiens
gtgcaaaaataattgtggtttt

SEQ ID NO: 9312274 - DNA, 22 bp, Homo sapiens
gtgcctctgagctctgctacag

SEQ ID NO: 9312275 - DNA, 22 bp, Homo sapiens
gtgctgtcaattgctttcagta

SEQ ID NO: 9312276 - DNA, 22 bp, Homo sapiens
gtgctgggtgctgcagacaggt

SEQ ID NO: 9312277 - DNA, 22 bp, Homo sapiens
gtgctggggagataggaagaga

SEQ ID NO: 9312278 - DNA, 22 bp, Homo sapiens
gtgctgggattacaggtgtgag

SEQ ID NO: 9312279 - DNA, 22 bp, Homo sapiens
gtccctggatctgggacagctg

SEQ ID NO: 9312280 - DNA, 22 bp, Homo sapiens
gtccctggagctgagcagtgct

SEQ ID NO: 9312281 - DNA, 22 bp, Homo sapiens
gtcctcagatgctgctgaaatg

SEQ ID NO: 9312282 - DNA, 22 bp, Homo sapiens
gtcctcagaagcctgcttagct

SEQ ID NO: 9312283 - DNA, 22 bp, Homo sapiens
gtcctcagagtgggcaggtcct

SEQ ID NO: 9312284 - DNA, 21 bp, Homo sapiens
gtcctcacgctccggcctccc

SEQ ID NO: 9312285 - DNA, 22 bp, Homo sapiens
gtcctcaggcttgagtgtttat

SEQ ID NO: 9312286 - DNA, 22 bp, Homo sapiens
gtcctcagggagtcccagtcat

SEQ ID NO: 9312287 - DNA, 22 bp, Homo sapiens
gtcctcagcaccagaactaggg

SEQ ID NO: 9312288 - DNA, 21 bp, Homo sapiens
gtcctcagctgatgggagctg

SEQ ID NO: 9312289 - DNA, 22 bp, Homo sapiens
gtcctcaggaaagcagataaca

SEQ ID NO: 9312290 - DNA, 22 bp, Homo sapiens
gtcctcaggaaggctttctgac

SEQ ID NO: 9312291 - DNA, 22 bp, Homo sapiens
gtcctcagtaagagggcctctg

SEQ ID NO: 9312292 - DNA, 22 bp, Homo sapiens
gtcctcagggaatgtggcgggt

SEQ ID NO: 9312293 - DNA, 22 bp, Homo sapiens
gtcctcagtcagtttggtgggg

SEQ ID NO: 9312294 - DNA, 22 bp, Homo sapiens
gtcaattagctaaaatttggta

SEQ ID NO: 9312295 - DNA, 22 bp, Homo sapiens
gtcaattagtggcaatttcata

SEQ ID NO: 9312296 - DNA, 22 bp, Homo sapiens
gtcaggtcttggaagataggct

SEQ ID NO: 9312297 - DNA, 22 bp, Homo sapiens
gtcagtggtgcttaaagtttca

SEQ ID NO: 9312298 - DNA, 23 bp, Homo sapiens
gtaatgatgggaatttacttaga

SEQ ID NO: 9312299 - DNA, 22 bp, Homo sapiens
gtagaccatttatctggggagt

SEQ ID NO: 9312300 - DNA, 22 bp, Homo sapiens
gtagcccacctggggagggcga

SEQ ID NO: 9312301 - DNA, 22 bp, Homo sapiens
gtagcattctgagttcgcagag

SEQ ID NO: 9312302 - DNA, 22 bp, Homo sapiens
gtagcacatgattttgatatgt

SEQ ID NO: 9312303 - DNA, 22 bp, Homo sapiens
gtaataagaaacagcaattatt

SEQ ID NO: 9312304 - DNA, 22 bp, Homo sapiens
gtaacatagtttgtgcttcatc

SEQ ID NO: 9312305 - DNA, 22 bp, Homo sapiens
gtaaatgcgattgactgatgga

SEQ ID NO: 9312306 - DNA, 22 bp, Homo sapiens
gtaaatgtcctgctacagagtg

SEQ ID NO: 9312307 - DNA, 22 bp, Homo sapiens
ggtgggcagctcttggcaggca

SEQ ID NO: 9312308 - DNA, 22 bp, Homo sapiens
ggtgggcagctcttggcaggca

SEQ ID NO: 9312309 - DNA, 22 bp, Homo sapiens
ggtgggcaggcgaggcccaggt

SEQ ID NO: 9312310 - DNA, 22 bp, Homo sapiens
ggcagggtgtggagttgggaca

SEQ ID NO: 9312311 - DNA, 22 bp, Homo sapiens
ggcagggtggccctccagtgag

SEQ ID NO: 9312312 - DNA, 22 bp, Homo sapiens
ggcagggtttacaatagcaata

SEQ ID NO: 9312313 - DNA, 22 bp, Homo sapiens
ggcaggtacagcaagaggacaa

SEQ ID NO: 9312314 - DNA, 19 bp, Homo sapiens
ggcaggtagagggccagtc

SEQ ID NO: 9312315 - DNA, 17 bp, Homo sapiens
ggcagggtgctgggtat

SEQ ID NO: 9312316 - DNA, 17 bp, Homo sapiens
ggcagggtgctgggtat

SEQ ID NO: 9312317 - DNA, 22 bp, Homo sapiens
ggcagggtggcagaggctcaga

SEQ ID NO: 9312318 - DNA, 22 bp, Homo sapiens
ggcaggtgacggggatgagtat

SEQ ID NO: 9312319 - DNA, 22 bp, Homo sapiens
ggcaggtcaggtccatgaccaa

SEQ ID NO: 9312320 - DNA, 22 bp, Homo sapiens
ggcaggtagcctagaggaggtt

SEQ ID NO: 9312321 - DNA, 22 bp, Homo sapiens
ggcaggtcatcaactgtaattt

SEQ ID NO: 9312322 - DNA, 22 bp, Homo sapiens
ggcaggagctctccagtttgcc

SEQ ID NO: 9312323 - DNA, 22 bp, Homo sapiens
ggcaggaggaagagttagcacc

SEQ ID NO: 9312324 - DNA, 22 bp, Homo sapiens
ggcaggagataaaatattagtt

SEQ ID NO: 9312325 - DNA, 18 bp, Homo sapiens
ggcaggagcaagaatagg

SEQ ID NO: 9312326 - DNA, 18 bp, Homo sapiens
ggcaggagcaagaatagg

SEQ ID NO: 9312327 - DNA, 22 bp, Homo sapiens
ggcaggagctcaggttggttcc

SEQ ID NO: 9312328 - DNA, 22 bp, Homo sapiens
ggcaggagaatggcgtgaactc

SEQ ID NO: 9312329 - DNA, 22 bp, Homo sapiens
ggcagggtgcctggctcctgtt

SEQ ID NO: 9312330 - DNA, 22 bp, Homo sapiens
ggcagggtaaaccgaggtaagt

SEQ ID NO: 9312331 - DNA, 22 bp, Homo sapiens
ggcaggggtgaggccactctga

SEQ ID NO: 9312332 - DNA, 22 bp, Homo sapiens
ggcaggggtggccttcctttgg

SEQ ID NO: 9312333 - DNA, 22 bp, Homo sapiens
ggcaggggttcattttgtctta

SEQ ID NO: 9312334 - DNA, 22 bp, Homo sapiens
ggccagcttctggacaaagtcc

SEQ ID NO: 9312335 - DNA, 22 bp, Homo sapiens
ggccagctttctgtcttctagg

SEQ ID NO: 9312336 - DNA, 22 bp, Homo sapiens
ggccaggaacgatcctaccctt

SEQ ID NO: 9312337 - DNA, 22 bp, Homo sapiens
ggccaggaacttttgggatggg

SEQ ID NO: 9312338 - DNA, 19 bp, Homo sapiens
ggccagctgtctcctgcta

SEQ ID NO: 9312339 - DNA, 22 bp, Homo sapiens
ggccagctgtggggccgagcct

SEQ ID NO: 9312340 - DNA, 22 bp, Homo sapiens
ggccagctgggccaccaggtgc

SEQ ID NO: 9312341 - DNA, 22 bp, Homo sapiens
ggccagctgtaagctgctgaat

SEQ ID NO: 9312342 - DNA, 22 bp, Homo sapiens
ggcatgagtaacgtgagtgagg

SEQ ID NO: 9312343 - DNA, 19 bp, Homo sapiens
ggcatccacagctggagag

SEQ ID NO: 9312344 - DNA, 22 bp, Homo sapiens
ggcatcctgggactggcttctt

SEQ ID NO: 9312345 - DNA, 20 bp, Homo sapiens
ggcatccttctgacccagag

SEQ ID NO: 9312346 - DNA, 22 bp, Homo sapiens
ggcatcctctagaagctggaaa

SEQ ID NO: 9312347 - DNA, 19 bp, Homo sapiens
ggcatctccactcctaccc

SEQ ID NO: 9312348 - DNA, 21 bp, Homo sapiens
ggcatgagggcagtgagcaga

SEQ ID NO: 9312349 - DNA, 20 bp, Homo sapiens
ggcatgagatgtgagggagg

SEQ ID NO: 9312350 - DNA, 22 bp, Homo sapiens
ggcatcttgttgctcaaatcta

SEQ ID NO: 9312351 - DNA, 22 bp, Homo sapiens
ggcctggaatgctttcctacca

SEQ ID NO: 9312352 - DNA, 22 bp, Homo sapiens
ggcctgcttctcagtgagcttg

SEQ ID NO: 9312353 - DNA, 22 bp, Homo sapiens
ggcctgctttccgagcctgcag

SEQ ID NO: 9312354 - DNA, 22 bp, Homo sapiens
ggcctgctggctccagcgcccg

SEQ ID NO: 9312355 - DNA, 22 bp, Homo sapiens
ggcctgctgggccccacagtcc

SEQ ID NO: 9312356 - DNA, 22 bp, Homo sapiens
ggcctgctggggcctcagacac

SEQ ID NO: 9312357 - DNA, 22 bp, Homo sapiens
ggcctgctttacaggatcaact

SEQ ID NO: 9312358 - DNA, 22 bp, Homo sapiens
ggcctgcttctctgggctttct

SEQ ID NO: 9312359 - DNA, 22 bp, Homo sapiens
ggcctgctgtgtactgatgtca

SEQ ID NO: 9312360 - DNA, 22 bp, Homo sapiens
ggcctgcttactgattgttgtt

SEQ ID NO: 9312361 - DNA, 22 bp, Homo sapiens
ggcctgctgtagcttttgttct

SEQ ID NO: 9312362 - DNA, 19 bp, Homo sapiens
ggcctgcccaatgtctgct

SEQ ID NO: 9312363 - DNA, 22 bp, Homo sapiens
ggcctgctattggtgggcagac

SEQ ID NO: 9312364 - DNA, 22 bp, Homo sapiens
ggcctgctaacctgaaacggag

SEQ ID NO: 9312365 - DNA, 22 bp, Homo sapiens
ggcctgctcaaacagattcctg

SEQ ID NO: 9312366 - DNA, 22 bp, Homo sapiens
ggcctgctgacccaagtcctgt

SEQ ID NO: 9312367 - DNA, 22 bp, Homo sapiens
ggcctgctctgtttagaggggg

SEQ ID NO: 9312368 - DNA, 22 bp, Homo sapiens
ggcctgctgcagtgtgacagtt

SEQ ID NO: 9312369 - DNA, 22 bp, Homo sapiens
ggcctgctgctatgacttcctg

SEQ ID NO: 9312370 - DNA, 22 bp, Homo sapiens
ggcctgctgctggttagatggg

SEQ ID NO: 9312371 - DNA, 22 bp, Homo sapiens
ggcctgctcagtcctctttctt

SEQ ID NO: 9312372 - DNA, 22 bp, Homo sapiens
ggcctgctccgggggctgagct

SEQ ID NO: 9312373 - DNA, 22 bp, Homo sapiens
ggcctgctctgcagcctctaca

SEQ ID NO: 9312374 - DNA, 22 bp, Homo sapiens
ggcctgctctggctgtggtcag

SEQ ID NO: 9312375 - DNA, 23 bp, Homo sapiens
ggcctggcccagggccctgatga

SEQ ID NO: 9312376 - DNA, 22 bp, Homo sapiens
ggcctggcatggggactaaggg

SEQ ID NO: 9312377 - DNA, 22 bp, Homo sapiens
ggcctggcctccagatgtgggc

SEQ ID NO: 9312378 - DNA, 23 bp, Homo sapiens
ggcctggcccagggccctgatga

SEQ ID NO: 9312379 - DNA, 19 bp, Homo sapiens
ggcctggctatccctgctg

SEQ ID NO: 9312380 - DNA, 22 bp, Homo sapiens
ggcggtggcgtgaaggtggctg

SEQ ID NO: 9312381 - DNA, 21 bp, Homo sapiens
ggccctggttacgcctcctct

SEQ ID NO: 9312382 - DNA, 22 bp, Homo sapiens
ggcctaagtggttaaatggctt

SEQ ID NO: 9312383 - DNA, 22 bp, Homo sapiens
ggccctgggcagaggagtgggc

SEQ ID NO: 9312384 - DNA, 22 bp, Homo sapiens
ggccctgggccctctagcttgt

SEQ ID NO: 9312385 - DNA, 22 bp, Homo sapiens
ggccaggagcagaatcgcctgc

SEQ ID NO: 9312386 - DNA, 22 bp, Homo sapiens
ggccagctttgagctgcaggaa

SEQ ID NO: 9312387 - DNA, 22 bp, Homo sapiens
ggccaggagatggacaccacat

SEQ ID NO: 9312388 - DNA, 22 bp, Homo sapiens
ggccaggccaagagggttggaa

SEQ ID NO: 9312389 - DNA, 22 bp, Homo sapiens
ggccaggcactgtgtgagatat

SEQ ID NO: 9312390 - DNA, 22 bp, Homo sapiens
ggcagcagggctgtctccctac

SEQ ID NO: 9312391 - DNA, 22 bp, Homo sapiens
ggcagcagggctgtctccctac

SEQ ID NO: 9312392 - DNA, 22 bp, Homo sapiens
ggcagccatgctccaggtgcag

SEQ ID NO: 9312393 - DNA, 22 bp, Homo sapiens
ggcagcagtaggagctaatctt

SEQ ID NO: 9312394 - DNA, 22 bp, Homo sapiens
ggcagccagtagggccagcctg

SEQ ID NO: 9312395 - DNA, 22 bp, Homo sapiens
ggcagccagcacgcagttgatg

SEQ ID NO: 9312396 - DNA, 22 bp, Homo sapiens
ggcagctgttggctctctagga

SEQ ID NO: 9312397 - DNA, 22 bp, Homo sapiens
ggcagcttctcccaggctgttt

SEQ ID NO: 9312398 - DNA, 22 bp, Homo sapiens
ggcagcttcctaggagagggca

SEQ ID NO: 9312399 - DNA, 23 bp, Homo sapiens
ggattggccccaggagtatgggt

SEQ ID NO: 9312400 - DNA, 22 bp, Homo sapiens
ggatttcttccttcctcagaag

SEQ ID NO: 9312401 - DNA, 18 bp, Homo sapiens
ggcactggtgatgcagag

SEQ ID NO: 9312402 - DNA, 18 bp, Homo sapiens
ggcactggtgatgcagag

SEQ ID NO: 9312403 - DNA, 22 bp, Homo sapiens
ggcagaagataggacagggaat

SEQ ID NO: 9312404 - DNA, 22 bp, Homo sapiens
ggcagaagaaaggctaagtctc

SEQ ID NO: 9312405 - DNA, 20 bp, Homo sapiens
ggcagcaggagtttcctctt

SEQ ID NO: 9312406 - DNA, 22 bp, Homo sapiens
ggagatggtctgttctcatatt

SEQ ID NO: 9312407 - DNA, 22 bp, Homo sapiens
ggagatggctggcaggtagatg

SEQ ID NO: 9312408 - DNA, 22 bp, Homo sapiens
ggagcaagtcccaggcactagt

SEQ ID NO: 9312409 - DNA, 22 bp, Homo sapiens
ggagatggtggaagctggtgca

SEQ ID NO: 9312410 - DNA, 22 bp, Homo sapiens
ggatctggggtagagcagtggg

SEQ ID NO: 9312411 - DNA, 17 bp, Homo sapiens
ggagcagatccaccatt

SEQ ID NO: 9312412 - DNA, 22 bp, Homo sapiens
ggagcagatgtcttcatggcct

SEQ ID NO: 9312413 - DNA, 22 bp, Homo sapiens
ggagcagagctgggcttggctg

SEQ ID NO: 9312414 - DNA, 22 bp, Homo sapiens
ggagcagacataaccttacaga

SEQ ID NO: 9312415 - DNA, 22 bp, Homo sapiens
ggagcagagcatttcacagcct

SEQ ID NO: 9312416 - DNA, 22 bp, Homo sapiens
ggagcagagcatttcacagcct

SEQ ID NO: 9312417 - DNA, 22 bp, Homo sapiens
ggagcagagctcttcatctgca

SEQ ID NO: 9312418 - DNA, 22 bp, Homo sapiens
ggatgcaggagttgaagaagga

SEQ ID NO: 9312419 - DNA, 22 bp, Homo sapiens
ggatgcccactatctgctggct

SEQ ID NO: 9312420 - DNA, 18 bp, Homo sapiens
ggatgctgtgtgctcctt

SEQ ID NO: 9312421 - DNA, 22 bp, Homo sapiens
ggatgctgggagacagcaggca

SEQ ID NO: 9312422 - DNA, 22 bp, Homo sapiens
ggatgctgctatcaggcttcga

SEQ ID NO: 9312423 - DNA, 22 bp, Homo sapiens
ggatgctgctgcacatcctgca

SEQ ID NO: 9312424 - DNA, 22 bp, Homo sapiens
ggatgctgattccagtctccag

SEQ ID NO: 9312425 - DNA, 22 bp, Homo sapiens
ggatggaggttctcagatgctc

SEQ ID NO: 9312426 - DNA, 22 bp, Homo sapiens
ggatggcaggacaaggacccag

SEQ ID NO: 9312427 - DNA, 22 bp, Homo sapiens
ggatggcagacagtgagtggct

SEQ ID NO: 9312428 - DNA, 22 bp, Homo sapiens
ggatggaggttctcagatgctc

SEQ ID NO: 9312429 - DNA, 22 bp, Homo sapiens
ggatggctgtaaaaggtgggaa

SEQ ID NO: 9312430 - DNA, 22 bp, Homo sapiens
ggatgggaacttggtagggcat

SEQ ID NO: 9312431 - DNA, 22 bp, Homo sapiens
ggattcagcgaggcagcctgga

SEQ ID NO: 9312432 - DNA, 22 bp, Homo sapiens
ggattagtcttactcgtccaat

SEQ ID NO: 9312433 - DNA, 22 bp, Homo sapiens
ggattagtgcggtggccttggg

SEQ ID NO: 9312434 - DNA, 22 bp, Homo sapiens
ggatgttgattgaatggccatt

SEQ ID NO: 9312435 - DNA, 22 bp, Homo sapiens
gggcactggaggccaaggagct

SEQ ID NO: 9312436 - DNA, 22 bp, Homo sapiens
gggcactgctttgctctgtcac

SEQ ID NO: 9312437 - DNA, 22 bp, Homo sapiens
gggcacagtctaaagttgggcc

SEQ ID NO: 9312438 - DNA, 19 bp, Homo sapiens
gggcagtggcactagggag

SEQ ID NO: 9312439 - DNA, 19 bp, Homo sapiens
gggcagtggcactagggag

SEQ ID NO: 9312440 - DNA, 22 bp, Homo sapiens
gggcagtgacaaaggggatgaa

SEQ ID NO: 9312441 - DNA, 22 bp, Homo sapiens
gggcagtgaatattggtgggaa

SEQ ID NO: 9312442 - DNA, 22 bp, Homo sapiens
gggcagtgacaaaggggatgaa

SEQ ID NO: 9312443 - DNA, 22 bp, Homo sapiens
gggcagtgaatattggtgggaa

SEQ ID NO: 9312444 - DNA, 22 bp, Homo sapiens
gggcaggttattggagtaggga

SEQ ID NO: 9312445 - DNA, 22 bp, Homo sapiens
gggcaggttattggagtaggga

SEQ ID NO: 9312446 - DNA, 22 bp, Homo sapiens
gggcaggttggcatcccgggca

SEQ ID NO: 9312447 - DNA, 23 bp, Homo sapiens
gggcaggtttttataggcttcag

SEQ ID NO: 9312448 - DNA, 22 bp, Homo sapiens
gggagggatctgctaggcaatg

SEQ ID NO: 9312449 - DNA, 22 bp, Homo sapiens
gggagggaggtgctggttcacg

SEQ ID NO: 9312450 - DNA, 22 bp, Homo sapiens
gggagctggatcgcgcgcccgg

SEQ ID NO: 9312451 - DNA, 22 bp, Homo sapiens
gggagctggagttgtgttgcct

SEQ ID NO: 9312452 - DNA, 22 bp, Homo sapiens
gggagctggagctggaagactc

SEQ ID NO: 9312453 - DNA, 22 bp, Homo sapiens
gggagctggatgattgaggcaa

SEQ ID NO: 9312454 - DNA, 22 bp, Homo sapiens
gggagctggcctactattagat

SEQ ID NO: 9312455 - DNA, 21 bp, Homo sapiens
gggagggatggaaatgatgtt

SEQ ID NO: 9312456 - DNA, 22 bp, Homo sapiens
gggaggtgatggcaagcagcgg

SEQ ID NO: 9312457 - DNA, 22 bp, Homo sapiens
gggaaggctgcctgagggatgg

SEQ ID NO: 9312458 - DNA, 22 bp, Homo sapiens
gggaagggacttgtttaaggtc

SEQ ID NO: 9312459 - DNA, 22 bp, Homo sapiens
gggaagggagctgggtatttag

SEQ ID NO: 9312460 - DNA, 22 bp, Homo sapiens
ggctttgcaggcagcatcaagg

SEQ ID NO: 9312461 - DNA, 23 bp, Homo sapiens
ggctttgctctgggttctagggt

SEQ ID NO: 9312462 - DNA, 21 bp, Homo sapiens
ggctttgctcagcttaccaaa

SEQ ID NO: 9312463 - DNA, 22 bp, Homo sapiens
ggctttgcttaacgtgcttcta

SEQ ID NO: 9312464 - DNA, 22 bp, Homo sapiens
ggctttgcaaaatcggcttctg

SEQ ID NO: 9312465 - DNA, 22 bp, Homo sapiens
ggctttgcaaactcattccaca

SEQ ID NO: 9312466 - DNA, 22 bp, Homo sapiens
ggctttattttgcatgaatgct

SEQ ID NO: 9312467 - DNA, 22 bp, Homo sapiens
ggctttcaacacaggctttcct

SEQ ID NO: 9312468 - DNA, 22 bp, Homo sapiens
ggctttcagccaaaggacaacc

SEQ ID NO: 9312469 - DNA, 22 bp, Homo sapiens
ggctttctatgaactcaaaggc

SEQ ID NO: 9312470 - DNA, 21 bp, Homo sapiens
ggctttatgctcacccagcct

SEQ ID NO: 9312471 - DNA, 22 bp, Homo sapiens
ggctttatgtttttcatgtggt

SEQ ID NO: 9312472 - DNA, 22 bp, Homo sapiens
ggctttattaactcatccgtaa

SEQ ID NO: 9312473 - DNA, 22 bp, Homo sapiens
ggctttattaagcagggtaagt

SEQ ID NO: 9312474 - DNA, 22 bp, Homo sapiens
ggctttattaagcagggtaagt

SEQ ID NO: 9312475 - DNA, 22 bp, Homo sapiens
ggctttattatgtggccatgtg

SEQ ID NO: 9312476 - DNA, 22 bp, Homo sapiens
ggctttatttcactgtaccata

SEQ ID NO: 9312477 - DNA, 22 bp, Homo sapiens
ggctttatttgcagccattgtt

SEQ ID NO: 9312478 - DNA, 22 bp, Homo sapiens
ggctttatcaaatgagaccctg

SEQ ID NO: 9312479 - DNA, 22 bp, Homo sapiens
ggctttatattgtttgagcaga

SEQ ID NO: 9312480 - DNA, 22 bp, Homo sapiens
ggctttatgcagggatagaaat

SEQ ID NO: 9312481 - DNA, 22 bp, Homo sapiens
ggctttatgcacagcagatggt

SEQ ID NO: 9312482 - DNA, 22 bp, Homo sapiens
ggctttatgcacagcagatggt

SEQ ID NO: 9312483 - DNA, 22 bp, Homo sapiens
ggctttatagggtagaggatca

SEQ ID NO: 9312484 - DNA, 22 bp, Homo sapiens
ggctttatagggtagaggatca

SEQ ID NO: 9312485 - DNA, 22 bp, Homo sapiens
ggctgtgcctcaaggctactca

SEQ ID NO: 9312486 - DNA, 20 bp, Homo sapiens
ggctgtgcccttccgtggcc

SEQ ID NO: 9312487 - DNA, 22 bp, Homo sapiens
ggctgtgcctcaaggctactca

SEQ ID NO: 9312488 - DNA, 22 bp, Homo sapiens
ggctgtgcctctggcagcacat

SEQ ID NO: 9312489 - DNA, 22 bp, Homo sapiens
gggagctgagaaacaacattct

SEQ ID NO: 9312490 - DNA, 22 bp, Homo sapiens
gggagctgacctgcaggttccc

SEQ ID NO: 9312491 - DNA, 22 bp, Homo sapiens
gggagctgacctgcaggttccc

SEQ ID NO: 9312492 - DNA, 21 bp, Homo sapiens
gggagctgacagcagcacggc

SEQ ID NO: 9312493 - DNA, 22 bp, Homo sapiens
gggagctgagctctgagccacg

SEQ ID NO: 9312494 - DNA, 22 bp, Homo sapiens
gggagctgagctctgagccacg

SEQ ID NO: 9312495 - DNA, 19 bp, Homo sapiens
gggagctgaggtctttggt

SEQ ID NO: 9312496 - DNA, 22 bp, Homo sapiens
gggagctgaggagccccgtcgg

SEQ ID NO: 9312497 - DNA, 22 bp, Homo sapiens
gggagctgagctggaagagaat

SEQ ID NO: 9312498 - DNA, 22 bp, Homo sapiens
gggagctgagggacctctgtgg

SEQ ID NO: 9312499 - DNA, 22 bp, Homo sapiens
gggaagtgatggagccaggatt

SEQ ID NO: 9312500 - DNA, 22 bp, Homo sapiens
gggaagtgagctggaatcaagg

SEQ ID NO: 9312501 - DNA, 22 bp, Homo sapiens
ggctgagggccagggctagtct

SEQ ID NO: 9312502 - DNA, 22 bp, Homo sapiens
ggctgagggccagggctagtct

SEQ ID NO: 9312503 - DNA, 22 bp, Homo sapiens
ggctgaggggcccagaggaaca

SEQ ID NO: 9312504 - DNA, 22 bp, Homo sapiens
ggctgagggtatagctgtccca

SEQ ID NO: 9312505 - DNA, 22 bp, Homo sapiens
ggctgagggtatagctgtccca

SEQ ID NO: 9312506 - DNA, 22 bp, Homo sapiens
ggctgagggttaagatcagaca

SEQ ID NO: 9312507 - DNA, 22 bp, Homo sapiens
ggctggacatagacatagccat

SEQ ID NO: 9312508 - DNA, 21 bp, Homo sapiens
ggctggactgtgctttccttc

SEQ ID NO: 9312509 - DNA, 22 bp, Homo sapiens
ggctggacttggtcctgttttg

SEQ ID NO: 9312510 - DNA, 22 bp, Homo sapiens
ggctggaccatgctgccccttc

SEQ ID NO: 9312511 - DNA, 22 bp, Homo sapiens
ggctggaccatgctgccccttc

SEQ ID NO: 9312512 - DNA, 22 bp, Homo sapiens
ggctggactctgggcctctcca

SEQ ID NO: 9312513 - DNA, 22 bp, Homo sapiens
ggctggacgatctccccttcct

SEQ ID NO: 9312514 - DNA, 22 bp, Homo sapiens
ggctgggtacagggcagtgtgc

SEQ ID NO: 9312515 - DNA, 21 bp, Homo sapiens
ggctgggtcatgcagctggcc

SEQ ID NO: 9312516 - DNA, 22 bp, Homo sapiens
ggctgggtcccagctgggagga

SEQ ID NO: 9312517 - DNA, 22 bp, Homo sapiens
ggctggtgagttcagagaaccc

SEQ ID NO: 9312518 - DNA, 21 bp, Homo sapiens
ggctggtcgcgtgcatgtctc

SEQ ID NO: 9312519 - DNA, 22 bp, Homo sapiens
ggctgggttatttatggccaag

SEQ ID NO: 9312520 - DNA, 22 bp, Homo sapiens
ggctgggttctgagaaagagta

SEQ ID NO: 9312521 - DNA, 22 bp, Homo sapiens
ggctggtcctttctctgtccta

SEQ ID NO: 9312522 - DNA, 17 bp, Homo sapiens
ggctgtgccaggtgaga

SEQ ID NO: 9312523 - DNA, 17 bp, Homo sapiens
ggctgtgccaggtgaga

SEQ ID NO: 9312524 - DNA, 22 bp, Homo sapiens
ggctgtgccctcacatggggca

SEQ ID NO: 9312525 - DNA, 22 bp, Homo sapiens
ggctgtgcagggcagagtctca

SEQ ID NO: 9312526 - DNA, 22 bp, Homo sapiens
ggctgtgcaccatccacctccc

SEQ ID NO: 9312527 - DNA, 22 bp, Homo sapiens
ggctgtgcagggcagagtctca

SEQ ID NO: 9312528 - DNA, 22 bp, Homo sapiens
ggctggtggggaaagaggacca

SEQ ID NO: 9312529 - DNA, 22 bp, Homo sapiens
ggctctgggtctgtggggagcg

SEQ ID NO: 9312530 - DNA, 22 bp, Homo sapiens
ggctctgtgagaacaaaggcta

SEQ ID NO: 9312531 - DNA, 22 bp, Homo sapiens
ggctctgtcacctatgagctga

SEQ ID NO: 9312532 - DNA, 22 bp, Homo sapiens
ggctctgtaagtgttgcaggta

SEQ ID NO: 9312533 - DNA, 22 bp, Homo sapiens
ggctctgtttactttcagaggc

SEQ ID NO: 9312534 - DNA, 22 bp, Homo sapiens
ggctctgtggctggccatgatg

SEQ ID NO: 9312535 - DNA, 22 bp, Homo sapiens
ggctctgtttactttcagaggc

SEQ ID NO: 9312536 - DNA, 22 bp, Homo sapiens
ggctcctgagaatgggccatca

SEQ ID NO: 9312537 - DNA, 18 bp, Homo sapiens
ggctccgacgggccgtgc

SEQ ID NO: 9312538 - DNA, 22 bp, Homo sapiens
ggctcctgaaagactatgggaa

SEQ ID NO: 9312539 - DNA, 22 bp, Homo sapiens
ggctctggggaagctctcttca

SEQ ID NO: 9312540 - DNA, 22 bp, Homo sapiens
ggctctgggtaaggcgtttgac

SEQ ID NO: 9312541 - DNA, 22 bp, Homo sapiens
ggctctggggggaagtctgttg

SEQ ID NO: 9312542 - DNA, 22 bp, Homo sapiens
ggcgttgctctccccaggctca

SEQ ID NO: 9312543 - DNA, 22 bp, Homo sapiens
ggctacagactgcataagggca

SEQ ID NO: 9312544 - DNA, 22 bp, Homo sapiens
ggcggtggttgagaggacggcg

SEQ ID NO: 9312545 - DNA, 18 bp, Homo sapiens
ggcgggtgttttattcac

SEQ ID NO: 9312546 - DNA, 22 bp, Homo sapiens
ggctaggcctcaggcctgcctg

SEQ ID NO: 9312547 - DNA, 22 bp, Homo sapiens
ggctagaaactcaggcaagaaa

SEQ ID NO: 9312548 - DNA, 22 bp, Homo sapiens
ggctacagtggcactgggcttt

SEQ ID NO: 9312549 - DNA, 22 bp, Homo sapiens
ggctacagggcctggccaaggt

SEQ ID NO: 9312550 - DNA, 22 bp, Homo sapiens
ggctacagtggctcagtgctgg

SEQ ID NO: 9312551 - DNA, 22 bp, Homo sapiens
ggctacagtggctcagtgctgg

SEQ ID NO: 9312552 - DNA, 22 bp, Homo sapiens
ggctaggcgggcacatggtgga

SEQ ID NO: 9312553 - DNA, 22 bp, Homo sapiens
ggctccaggctcctatttcact

SEQ ID NO: 9312554 - DNA, 23 bp, Homo sapiens
ggctccaggcctgacgggcgcgg

SEQ ID NO: 9312555 - DNA, 22 bp, Homo sapiens
ggctccatccaaggccttctag

SEQ ID NO: 9312556 - DNA, 22 bp, Homo sapiens
ggctccagtttgtgccttcagc

SEQ ID NO: 9312557 - DNA, 22 bp, Homo sapiens
ggctccagggagtggagagaag

SEQ ID NO: 9312558 - DNA, 22 bp, Homo sapiens
ggctcccaggagggcctggagg

SEQ ID NO: 9312559 - DNA, 22 bp, Homo sapiens
ggctccatgctccgcttcttgt

SEQ ID NO: 9312560 - DNA, 22 bp, Homo sapiens
ggctccatgctgagctttgaat

SEQ ID NO: 9312561 - DNA, 22 bp, Homo sapiens
gcccacagtacgaggctcaggc

SEQ ID NO: 9312562 - DNA, 22 bp, Homo sapiens
gcccactgagtgactccctcag

SEQ ID NO: 9312563 - DNA, 22 bp, Homo sapiens
gccaggtggtctggctccagag

SEQ ID NO: 9312564 - DNA, 22 bp, Homo sapiens
gccaggtgggagacagacagca

SEQ ID NO: 9312565 - DNA, 22 bp, Homo sapiens
gccaggtgtcctcacagtgagg

SEQ ID NO: 9312566 - DNA, 22 bp, Homo sapiens
gccaggtgtagtggccacacct

SEQ ID NO: 9312567 - DNA, 22 bp, Homo sapiens
gccaggtctgggtagcagagga

SEQ ID NO: 9312568 - DNA, 22 bp, Homo sapiens
gccaggtctcataaatgcagct

SEQ ID NO: 9312569 - DNA, 22 bp, Homo sapiens
gccaggagaatgctagcagagg

SEQ ID NO: 9312570 - DNA, 22 bp, Homo sapiens
gccaggagagctccttcaggtt

SEQ ID NO: 9312571 - DNA, 22 bp, Homo sapiens
gccaggaggctgctgtgtaggc

SEQ ID NO: 9312572 - DNA, 22 bp, Homo sapiens
gccaggagccctgggcaagttc

SEQ ID NO: 9312573 - DNA, 19 bp, Homo sapiens
gccaggacatcctcctgct

SEQ ID NO: 9312574 - DNA, 21 bp, Homo sapiens
gccaggaccagcagaccactt

SEQ ID NO: 9312575 - DNA, 22 bp, Homo sapiens
gccaggaccctggagggcatct

SEQ ID NO: 9312576 - DNA, 22 bp, Homo sapiens
gccaggacctcagatgcagggc

SEQ ID NO: 9312577 - DNA, 22 bp, Homo sapiens
gccaggactgagaatgggagca

SEQ ID NO: 9312578 - DNA, 22 bp, Homo sapiens
gccaggagaaaaggcgaatgat

SEQ ID NO: 9312579 - DNA, 22 bp, Homo sapiens
gccaggagaaaaggcgaatgat

SEQ ID NO: 9312580 - DNA, 22 bp, Homo sapiens
gccaggacctcccagagctttc

SEQ ID NO: 9312581 - DNA, 22 bp, Homo sapiens
gccaggactcttcctagaaggt

SEQ ID NO: 9312582 - DNA, 22 bp, Homo sapiens
gccaggactagagggaggtgag

SEQ ID NO: 9312583 - DNA, 22 bp, Homo sapiens
gccaggacggtgaatgggctac

SEQ ID NO: 9312584 - DNA, 19 bp, Homo sapiens
gccctgagagcttgggttc

SEQ ID NO: 9312585 - DNA, 22 bp, Homo sapiens
gccctgagactgagcatgggtt

SEQ ID NO: 9312586 - DNA, 19 bp, Homo sapiens
gccctgaccttggctgctc

SEQ ID NO: 9312587 - DNA, 22 bp, Homo sapiens
gccctgacactttgcagctgag

SEQ ID NO: 9312588 - DNA, 22 bp, Homo sapiens
gccctgagccaccaatgccatt

SEQ ID NO: 9312589 - DNA, 22 bp, Homo sapiens
gccctgagcactgctgctgggg

SEQ ID NO: 9312590 - DNA, 22 bp, Homo sapiens
gccctgagcacacagtagcaaa

SEQ ID NO: 9312591 - DNA, 20 bp, Homo sapiens
gcctcagagggtttgagttt

SEQ ID NO: 9312592 - DNA, 22 bp, Homo sapiens
gccctgagggtctgggttccca

SEQ ID NO: 9312593 - DNA, 22 bp, Homo sapiens
gcctaaggatatgctttgcttg

SEQ ID NO: 9312594 - DNA, 22 bp, Homo sapiens
gcctcagaatcatttatcatct

SEQ ID NO: 9312595 - DNA, 22 bp, Homo sapiens
gcctcagaaagcttttattcat

SEQ ID NO: 9312596 - DNA, 22 bp, Homo sapiens
gcccaggggcagcgcatagtgg

SEQ ID NO: 9312597 - DNA, 22 bp, Homo sapiens
gcccagggcttcaaagagagaa

SEQ ID NO: 9312598 - DNA, 22 bp, Homo sapiens
gcccagggcagggcaagagtga

SEQ ID NO: 9312599 - DNA, 22 bp, Homo sapiens
gcccagggcagggcaagagtga

SEQ ID NO: 9312600 - DNA, 22 bp, Homo sapiens
gcccagggctgcaagtggacgc

SEQ ID NO: 9312601 - DNA, 22 bp, Homo sapiens
gcccagggcgatggtcggggcc

SEQ ID NO: 9312602 - DNA, 21 bp, Homo sapiens
gcatttggttttgtcaatgct

SEQ ID NO: 9312603 - DNA, 22 bp, Homo sapiens
gcatttggtttggctcaggcca

SEQ ID NO: 9312604 - DNA, 22 bp, Homo sapiens
gcatttggaattgtgtatagaa

SEQ ID NO: 9312605 - DNA, 22 bp, Homo sapiens
gcatctgtgtttctagctagga

SEQ ID NO: 9312606 - DNA, 22 bp, Homo sapiens
gcatctgtgaatttgatataca

SEQ ID NO: 9312607 - DNA, 21 bp, Homo sapiens
gcatgaaaacagcctgtgctc

SEQ ID NO: 9312608 - DNA, 22 bp, Homo sapiens
gcatgatgaaggaggaggagtc

SEQ ID NO: 9312609 - DNA, 22 bp, Homo sapiens
gcatgaggttcttggccagcat

SEQ ID NO: 9312610 - DNA, 22 bp, Homo sapiens
gcatccaggtagagcttgcggg

SEQ ID NO: 9312611 - DNA, 22 bp, Homo sapiens
gcatccaggactatatgatgat

SEQ ID NO: 9312612 - DNA, 20 bp, Homo sapiens
gcatccagacacccagctgc

SEQ ID NO: 9312613 - DNA, 22 bp, Homo sapiens
gcatctaatccagtccagcatc

SEQ ID NO: 9312614 - DNA, 22 bp, Homo sapiens
gcatccttttttcctgccctgc

SEQ ID NO: 9312615 - DNA, 22 bp, Homo sapiens
gcatccttcctgctgggcctgg

SEQ ID NO: 9312616 - DNA, 22 bp, Homo sapiens
gcatccttgggcccagctcctg

SEQ ID NO: 9312617 - DNA, 22 bp, Homo sapiens
gcatccagtcttggctcctgga

SEQ ID NO: 9312618 - DNA, 22 bp, Homo sapiens
gcatccagtcttggctcctgga

SEQ ID NO: 9312619 - DNA, 22 bp, Homo sapiens
gcagtcagacaggaggagctcc

SEQ ID NO: 9312620 - DNA, 22 bp, Homo sapiens
gcagtatctatgtgatgggttg

SEQ ID NO: 9312621 - DNA, 19 bp, Homo sapiens
gcagggctctcccagatgc

SEQ ID NO: 9312622 - DNA, 22 bp, Homo sapiens
gcagggctccccaggcccgagg

SEQ ID NO: 9312623 - DNA, 22 bp, Homo sapiens
gcagggctcattctagtacaat

SEQ ID NO: 9312624 - DNA, 22 bp, Homo sapiens
gcagggctcagccgctcccacc

SEQ ID NO: 9312625 - DNA, 22 bp, Homo sapiens
gcagggctcagccgctcccacc

SEQ ID NO: 9312626 - DNA, 22 bp, Homo sapiens
gcagggctcaacaggacacccc

SEQ ID NO: 9312627 - DNA, 22 bp, Homo sapiens
gcagggctcattgccaggcatt

SEQ ID NO: 9312628 - DNA, 22 bp, Homo sapiens
gcagggctccactgtggccaag

SEQ ID NO: 9312629 - DNA, 22 bp, Homo sapiens
gcagggctccactgtggccaag

SEQ ID NO: 9312630 - DNA, 22 bp, Homo sapiens
gcagtcatggaaaaatgtatac

SEQ ID NO: 9312631 - DNA, 22 bp, Homo sapiens
gcagtcatcagtcctttaatta

SEQ ID NO: 9312632 - DNA, 22 bp, Homo sapiens
gccagagcacaggctggtagta

SEQ ID NO: 9312633 - DNA, 23 bp, Homo sapiens
gccaagtagggggaaagcccgtg

SEQ ID NO: 9312634 - DNA, 22 bp, Homo sapiens
gccagagccggcttcacaggat

SEQ ID NO: 9312635 - DNA, 22 bp, Homo sapiens
gccagagccggcttcacaggat

SEQ ID NO: 9312636 - DNA, 21 bp, Homo sapiens
gccagagcagtacaatgaggt

SEQ ID NO: 9312637 - DNA, 22 bp, Homo sapiens
gccagagcagaatagagtggcc

SEQ ID NO: 9312638 - DNA, 22 bp, Homo sapiens
gcatttgttgagttgccagcta

SEQ ID NO: 9312639 - DNA, 22 bp, Homo sapiens
gcattttaataagattcatagg

SEQ ID NO: 9312640 - DNA, 22 bp, Homo sapiens
gccaagcttggaaggatcatgg

SEQ ID NO: 9312641 - DNA, 22 bp, Homo sapiens
gccaagctgtttttcagagacg

SEQ ID NO: 9312642 - DNA, 22 bp, Homo sapiens
gccaagctcaccttctgatgga

SEQ ID NO: 9312643 - DNA, 22 bp, Homo sapiens
gccaaggcctctgcaggatgag

SEQ ID NO: 9312644 - DNA, 22 bp, Homo sapiens
gccagagctgagacacgagtcc

SEQ ID NO: 9312645 - DNA, 22 bp, Homo sapiens
gccagaggcccaaggacagctg

SEQ ID NO: 9312646 - DNA, 22 bp, Homo sapiens
gccagcaggttgtcaaggagct

SEQ ID NO: 9312647 - DNA, 22 bp, Homo sapiens
gccagcagtatgtcctggcagt

SEQ ID NO: 9312648 - DNA, 22 bp, Homo sapiens
gcaagagtggaacaaaggcagc

SEQ ID NO: 9312649 - DNA, 23 bp, Homo sapiens
gcaagagacagagcatcctgttc

SEQ ID NO: 9312650 - DNA, 22 bp, Homo sapiens
gagggggaaagtccctggagtc

SEQ ID NO: 9312651 - DNA, 22 bp, Homo sapiens
gagggggcgaacagaagcaagg

SEQ ID NO: 9312652 - DNA, 22 bp, Homo sapiens
gcacagctcagcatgggaggac

SEQ ID NO: 9312653 - DNA, 22 bp, Homo sapiens
gcacaggcaatagatacagcta

SEQ ID NO: 9312654 - DNA, 22 bp, Homo sapiens
gcaagctgcttaagctcattgt

SEQ ID NO: 9312655 - DNA, 16 bp, Homo sapiens
gcaagccatcaggcaa

SEQ ID NO: 9312656 - DNA, 22 bp, Homo sapiens
gcaagctgatgtgatagtgaaa

SEQ ID NO: 9312657 - DNA, 22 bp, Homo sapiens
gcaagcagatctccggagggaa

SEQ ID NO: 9312658 - DNA, 22 bp, Homo sapiens
gcaagcagactgggcccctgtg

SEQ ID NO: 9312659 - DNA, 22 bp, Homo sapiens
gcaagcagttcgcagcccgcct

SEQ ID NO: 9312660 - DNA, 22 bp, Homo sapiens
gcaagctggctgttagaggatg

SEQ ID NO: 9312661 - DNA, 22 bp, Homo sapiens
gcaagctgtgatttatgtgaat

SEQ ID NO: 9312662 - DNA, 22 bp, Homo sapiens
gcaagctgtgccttctcaggat

SEQ ID NO: 9312663 - DNA, 22 bp, Homo sapiens
gcacagcatgaagagaggaagc

SEQ ID NO: 9312664 - DNA, 22 bp, Homo sapiens
gcagaggagcaagctggacacc

SEQ ID NO: 9312665 - DNA, 22 bp, Homo sapiens
gcagaggagatgaagatacttt

SEQ ID NO: 9312666 - DNA, 22 bp, Homo sapiens
gcagaggacagggatttagatt

SEQ ID NO: 9312667 - DNA, 22 bp, Homo sapiens
gcagaggacacaggagggcaag

SEQ ID NO: 9312668 - DNA, 22 bp, Homo sapiens
gcagaggacacaggagggcaag

SEQ ID NO: 9312669 - DNA, 22 bp, Homo sapiens
gcactgggctccaggaaggagg

SEQ ID NO: 9312670 - DNA, 18 bp, Homo sapiens
gcacttcacccagctagt

SEQ ID NO: 9312671 - DNA, 22 bp, Homo sapiens
gcacttgaagaattgaactgga

SEQ ID NO: 9312672 - DNA, 22 bp, Homo sapiens
gcacttgacccccagagctggt

SEQ ID NO: 9312673 - DNA, 23 bp, Homo sapiens
gcactcatctgaagctatggtgc

SEQ ID NO: 9312674 - DNA, 22 bp, Homo sapiens
gcacaggcacagagggccactg

SEQ ID NO: 9312675 - DNA, 22 bp, Homo sapiens
gcacaggcatcaggctttttct

SEQ ID NO: 9312676 - DNA, 22 bp, Homo sapiens
gcactgacatttcaagaacagc

SEQ ID NO: 9312677 - DNA, 22 bp, Homo sapiens
gcaggaggttgagccaggactg

SEQ ID NO: 9312678 - DNA, 22 bp, Homo sapiens
gcaggaggttgagccaggactg

SEQ ID NO: 9312679 - DNA, 22 bp, Homo sapiens
gcaggaggttgagccaggactg

SEQ ID NO: 9312680 - DNA, 22 bp, Homo sapiens
gcaggagtatgcagctatggtt

SEQ ID NO: 9312681 - DNA, 22 bp, Homo sapiens
gcaggagtatctatacattaaa

SEQ ID NO: 9312682 - DNA, 22 bp, Homo sapiens
gcaggagtcagccctaccttga

SEQ ID NO: 9312683 - DNA, 22 bp, Homo sapiens
gcaggagtcactgacttggtcc

SEQ ID NO: 9312684 - DNA, 22 bp, Homo sapiens
gcaggagtgacatggatgtgga

SEQ ID NO: 9312685 - DNA, 22 bp, Homo sapiens
gcaggagtggagaccatgggga

SEQ ID NO: 9312686 - DNA, 22 bp, Homo sapiens
gcaggagtgtatttgcatgtaa

SEQ ID NO: 9312687 - DNA, 22 bp, Homo sapiens
gcaggcctctgttgagggcctt

SEQ ID NO: 9312688 - DNA, 22 bp, Homo sapiens
gcaggagttaggcgtcgtggat

SEQ ID NO: 9312689 - DNA, 22 bp, Homo sapiens
gcagctggacccacacggctta

SEQ ID NO: 9312690 - DNA, 22 bp, Homo sapiens
gcagctggatttcaagagggag

SEQ ID NO: 9312691 - DNA, 22 bp, Homo sapiens
gcaggctgatgactggagttgg

SEQ ID NO: 9312692 - DNA, 22 bp, Homo sapiens
gcagggctaggtcttctagggc

SEQ ID NO: 9312693 - DNA, 22 bp, Homo sapiens
gcagggctaatggggcaagtag

SEQ ID NO: 9312694 - DNA, 22 bp, Homo sapiens
gcagggctagatatttgcaagt

SEQ ID NO: 9312695 - DNA, 22 bp, Homo sapiens
gcagggctagatatttgcaagt

SEQ ID NO: 9312696 - DNA, 22 bp, Homo sapiens
gcagggctattggaaggagatg

SEQ ID NO: 9312697 - DNA, 22 bp, Homo sapiens
gcagggctaggtcttctagggc

SEQ ID NO: 9312698 - DNA, 22 bp, Homo sapiens
gcagggcggcccagagcaggcc

SEQ ID NO: 9312699 - DNA, 22 bp, Homo sapiens
gcagggcggcccagagcaggcc

SEQ ID NO: 9312700 - DNA, 22 bp, Homo sapiens
gcagggcgcgtttgagcgggct

SEQ ID NO: 9312701 - DNA, 22 bp, Homo sapiens
gcaggctcttctttctgcccag

SEQ ID NO: 9312702 - DNA, 22 bp, Homo sapiens
gcaggctcgttggaagtcccct

SEQ ID NO: 9312703 - DNA, 22 bp, Homo sapiens
gcaggctccaaggcctgggaga

SEQ ID NO: 9312704 - DNA, 22 bp, Homo sapiens
gcaggctccaaggcctgggaga

SEQ ID NO: 9312705 - DNA, 22 bp, Homo sapiens
gcaggctccaggccggcccctt

SEQ ID NO: 9312706 - DNA, 22 bp, Homo sapiens
gcaggctcccttgcagagcagg

SEQ ID NO: 9312707 - DNA, 22 bp, Homo sapiens
gcaggctcgttggaagtcccct

SEQ ID NO: 9312708 - DNA, 20 bp, Homo sapiens
gcaggctccgggcttgggag

SEQ ID NO: 9312709 - DNA, 22 bp, Homo sapiens
gcaggctcaaaagctggtagga

SEQ ID NO: 9312710 - DNA, 22 bp, Homo sapiens
gcaggctcaaaagctggtagga

SEQ ID NO: 9312711 - DNA, 22 bp, Homo sapiens
gcaggctccaactggaggagtt

SEQ ID NO: 9312712 - DNA, 22 bp, Homo sapiens
gcaggctcagagcagattagca

SEQ ID NO: 9312713 - DNA, 22 bp, Homo sapiens
gcaggctcagagcagattagca

SEQ ID NO: 9312714 - DNA, 22 bp, Homo sapiens
gcaggctcactctgtttggctc

SEQ ID NO: 9312715 - DNA, 22 bp, Homo sapiens
gcagaggaggacccaggaatta

SEQ ID NO: 9312716 - DNA, 22 bp, Homo sapiens
gcagcaggaataggataagcaa

SEQ ID NO: 9312717 - DNA, 22 bp, Homo sapiens
gcagcaggaatttaaatttata

SEQ ID NO: 9312718 - DNA, 22 bp, Homo sapiens
gcagcaggagagtttgtcctgc

SEQ ID NO: 9312719 - DNA, 22 bp, Homo sapiens
gcagcaggagagtaatagcggt

SEQ ID NO: 9312720 - DNA, 22 bp, Homo sapiens
gcagcaggactgccgttaaagt

SEQ ID NO: 9312721 - DNA, 22 bp, Homo sapiens
gcagcaggtctgtcaatgtcat

SEQ ID NO: 9312722 - DNA, 22 bp, Homo sapiens
gcagcaggcacttaccgttgct

SEQ ID NO: 9312723 - DNA, 22 bp, Homo sapiens
gcagcaggtgtgcttttaatga

SEQ ID NO: 9312724 - DNA, 22 bp, Homo sapiens
gcagcaggatggccaattgcca

SEQ ID NO: 9312725 - DNA, 22 bp, Homo sapiens
gcagcaggcacggtctcgacat

SEQ ID NO: 9312726 - DNA, 22 bp, Homo sapiens
gcagcatcctgggccacagtcc

SEQ ID NO: 9312727 - DNA, 22 bp, Homo sapiens
gctggcaggatagaagtctaat

SEQ ID NO: 9312728 - DNA, 22 bp, Homo sapiens
gctggcaggataacttctaagc

SEQ ID NO: 9312729 - DNA, 22 bp, Homo sapiens
gctggcagagacaagaagacta

SEQ ID NO: 9312730 - DNA, 22 bp, Homo sapiens
gctggcagaatttcttcttgct

SEQ ID NO: 9312731 - DNA, 22 bp, Homo sapiens
gctggcagacttcctctggaac

SEQ ID NO: 9312732 - DNA, 22 bp, Homo sapiens
gctggcagaatttcttcttgct

SEQ ID NO: 9312733 - DNA, 22 bp, Homo sapiens
gctgggaggaatttggggaata

SEQ ID NO: 9312734 - DNA, 22 bp, Homo sapiens
gctgggagaggccctgaagtga

SEQ ID NO: 9312735 - DNA, 22 bp, Homo sapiens
gctgggaatgattttggagagg

SEQ ID NO: 9312736 - DNA, 20 bp, Homo sapiens
gctgggacgcccggtccgga

SEQ ID NO: 9312737 - DNA, 22 bp, Homo sapiens
gctgggaaccatgggaaggcag

SEQ ID NO: 9312738 - DNA, 22 bp, Homo sapiens
gctgggaaccatgggaaggcag

SEQ ID NO: 9312739 - DNA, 22 bp, Homo sapiens
gctgggaagaacaggagagaat

SEQ ID NO: 9312740 - DNA, 22 bp, Homo sapiens
gctgggaagtgcaagatcaagg

SEQ ID NO: 9312741 - DNA, 22 bp, Homo sapiens
gctggctgcacaggggctcact

SEQ ID NO: 9312742 - DNA, 18 bp, Homo sapiens
gctggctgcacttctgct

SEQ ID NO: 9312743 - DNA, 22 bp, Homo sapiens
gctggctgcagattttagaggt

SEQ ID NO: 9312744 - DNA, 18 bp, Homo sapiens
gctggctgcacttctgct

SEQ ID NO: 9312745 - DNA, 22 bp, Homo sapiens
gctggctgccaatttcagagct

SEQ ID NO: 9312746 - DNA, 22 bp, Homo sapiens
gctggctgcctggttatgcctt

SEQ ID NO: 9312747 - DNA, 22 bp, Homo sapiens
gctgggtgtcacggggctcgtg

SEQ ID NO: 9312748 - DNA, 22 bp, Homo sapiens
gctgggtggatcggaggctctg

SEQ ID NO: 9312749 - DNA, 19 bp, Homo sapiens
gctgggtggggtccacagc

SEQ ID NO: 9312750 - DNA, 22 bp, Homo sapiens
gctggggtctgtgaggagggct

SEQ ID NO: 9312751 - DNA, 20 bp, Homo sapiens
gctgggggtgtgctgagtga

SEQ ID NO: 9312752 - DNA, 20 bp, Homo sapiens
gctgggggtgtgctgagtga

SEQ ID NO: 9312753 - DNA, 22 bp, Homo sapiens
gctggggtgtggtggataagct

SEQ ID NO: 9312754 - DNA, 16 bp, Homo sapiens
gctgggagggagaggt

SEQ ID NO: 9312755 - DNA, 23 bp, Homo sapiens
gcttccattctagtttgctgtgc

SEQ ID NO: 9312756 - DNA, 22 bp, Homo sapiens
gcttccatttgctaggggattt

SEQ ID NO: 9312757 - DNA, 22 bp, Homo sapiens
gcttccatgtatgctcttgaca

SEQ ID NO: 9312758 - DNA, 22 bp, Homo sapiens
gcttccatgttgctgctggtca

SEQ ID NO: 9312759 - DNA, 22 bp, Homo sapiens
gcttccagtaagttgctgccat

SEQ ID NO: 9312760 - DNA, 22 bp, Homo sapiens
gcttccagtcctcagaggctgg

SEQ ID NO: 9312761 - DNA, 22 bp, Homo sapiens
gctgtgcagtctttggtgtgcc

SEQ ID NO: 9312762 - DNA, 22 bp, Homo sapiens
gctgtgcagagcacagggtccc

SEQ ID NO: 9312763 - DNA, 22 bp, Homo sapiens
gctgtgagtacaaggccctggg

SEQ ID NO: 9312764 - DNA, 22 bp, Homo sapiens
gctgtgagtggaggaggctgag

SEQ ID NO: 9312765 - DNA, 22 bp, Homo sapiens
gctgtgagggcttctgaggcat

SEQ ID NO: 9312766 - DNA, 22 bp, Homo sapiens
gctgtgagaaacagggagtgtc

SEQ ID NO: 9312767 - DNA, 22 bp, Homo sapiens
gctgtgagcactgctgggtgga

SEQ ID NO: 9312768 - DNA, 22 bp, Homo sapiens
ggacagagggcaggagcccaga

SEQ ID NO: 9312769 - DNA, 22 bp, Homo sapiens
ggacccaggtagggaggaagat

SEQ ID NO: 9312770 - DNA, 22 bp, Homo sapiens
ggacagagcagacgagcagcgg

SEQ ID NO: 9312771 - DNA, 22 bp, Homo sapiens
ggagaggcgatgagtcacagcc

SEQ ID NO: 9312772 - DNA, 22 bp, Homo sapiens
ggacggctctctggcactgtgg

SEQ ID NO: 9312773 - DNA, 22 bp, Homo sapiens
ggaaatattttgtctaatttgt

SEQ ID NO: 9312774 - DNA, 22 bp, Homo sapiens
ggaaatattgattgctctgtat

SEQ ID NO: 9312775 - DNA, 22 bp, Homo sapiens
ggaaagctcagatcttgttgga

SEQ ID NO: 9312776 - DNA, 22 bp, Homo sapiens
gcttcctaaatgcacagggcag

SEQ ID NO: 9312777 - DNA, 22 bp, Homo sapiens
gcttcctcaccttctcttgcat

SEQ ID NO: 9312778 - DNA, 22 bp, Homo sapiens
gcttccgcgatgtcctaggtgg

SEQ ID NO: 9312779 - DNA, 22 bp, Homo sapiens
gcttcctccatctggggcttgc

SEQ ID NO: 9312780 - DNA, 22 bp, Homo sapiens
gcttcctccagggaggggcctg

SEQ ID NO: 9312781 - DNA, 22 bp, Homo sapiens
ggaaccttagtgttcttttacc

SEQ ID NO: 9312782 - DNA, 22 bp, Homo sapiens
ggaacatttaaattcttatttg

SEQ ID NO: 9312783 - DNA, 21 bp, Homo sapiens
ggaacattgttaatagtctct

SEQ ID NO: 9312784 - DNA, 20 bp, Homo sapiens
ggaagccagggtgcagggga

SEQ ID NO: 9312785 - DNA, 20 bp, Homo sapiens
ggaagccagcatccttgagg

SEQ ID NO: 9312786 - DNA, 22 bp, Homo sapiens
ggaagccagagtgctgggcagg

SEQ ID NO: 9312787 - DNA, 22 bp, Homo sapiens
ggaagctgttgtgagtgcagca

SEQ ID NO: 9312788 - DNA, 22 bp, Homo sapiens
gctgccagctcactctcctgag

SEQ ID NO: 9312789 - DNA, 22 bp, Homo sapiens
gctgccagccagggtgggatcc

SEQ ID NO: 9312790 - DNA, 22 bp, Homo sapiens
gctgccagcccagcaaggtgtg

SEQ ID NO: 9312791 - DNA, 22 bp, Homo sapiens
gctgccagcccagcaaggtgtg

SEQ ID NO: 9312792 - DNA, 22 bp, Homo sapiens
gctgccagccctcggggtctga

SEQ ID NO: 9312793 - DNA, 22 bp, Homo sapiens
gctgccaggccctggggctatg

SEQ ID NO: 9312794 - DNA, 21 bp, Homo sapiens
gctgccaggattttgcaggaa

SEQ ID NO: 9312795 - DNA, 22 bp, Homo sapiens
gctgccagctttccttggctga

SEQ ID NO: 9312796 - DNA, 22 bp, Homo sapiens
gctgccagtagttggagctcca

SEQ ID NO: 9312797 - DNA, 22 bp, Homo sapiens
gctgccaggggcagctgtctca

SEQ ID NO: 9312798 - DNA, 20 bp, Homo sapiens
gctgccagtgcctgatgctt

SEQ ID NO: 9312799 - DNA, 22 bp, Homo sapiens
gctgccagtgtggcatgatgca

SEQ ID NO: 9312800 - DNA, 22 bp, Homo sapiens
gctgccagtgtggcatgatgca

SEQ ID NO: 9312801 - DNA, 22 bp, Homo sapiens
gctgcagctgtaggacacaatt

SEQ ID NO: 9312802 - DNA, 22 bp, Homo sapiens
gctgcagactgggaggcaggtg

SEQ ID NO: 9312803 - DNA, 22 bp, Homo sapiens
gctgcagctcgccttccggcct

SEQ ID NO: 9312804 - DNA, 22 bp, Homo sapiens
gctgcagaatttccttctcatt

SEQ ID NO: 9312805 - DNA, 22 bp, Homo sapiens
gctgcaggagctggagctgtgg

SEQ ID NO: 9312806 - DNA, 22 bp, Homo sapiens
gctgccagaagaggaggggtta

SEQ ID NO: 9312807 - DNA, 22 bp, Homo sapiens
gctgccagcacagttcagctgt

SEQ ID NO: 9312808 - DNA, 22 bp, Homo sapiens
gctgaagttgcctattttaata

SEQ ID NO: 9312809 - DNA, 22 bp, Homo sapiens
gctgaaggtatgagttttatct

SEQ ID NO: 9312810 - DNA, 22 bp, Homo sapiens
gctctgcctttgtcttacacgg

SEQ ID NO: 9312811 - DNA, 22 bp, Homo sapiens
gctctgcctggtcgcgtgctgg

SEQ ID NO: 9312812 - DNA, 22 bp, Homo sapiens
gctctgccctgggccgttgtaa

SEQ ID NO: 9312813 - DNA, 22 bp, Homo sapiens
gctctgcctcccctagtgttac

SEQ ID NO: 9312814 - DNA, 17 bp, Homo sapiens
gctctgcctctcccacc

SEQ ID NO: 9312815 - DNA, 17 bp, Homo sapiens
gctctgcctctcccacc

SEQ ID NO: 9312816 - DNA, 22 bp, Homo sapiens
gctctgcctctttgctgcgtca

SEQ ID NO: 9312817 - DNA, 22 bp, Homo sapiens
gctctccaaaccctgtggcttt

SEQ ID NO: 9312818 - DNA, 22 bp, Homo sapiens
gctctgcccaggaccgtccttg

SEQ ID NO: 9312819 - DNA, 17 bp, Homo sapiens
gctctgccccagcctct

SEQ ID NO: 9312820 - DNA, 22 bp, Homo sapiens
gctctgcccagtgccctgagac

SEQ ID NO: 9312821 - DNA, 18 bp, Homo sapiens
gctctgcccaggctgccc

SEQ ID NO: 9312822 - DNA, 18 bp, Homo sapiens
gctctgcccaggctgccc

SEQ ID NO: 9312823 - DNA, 22 bp, Homo sapiens
gctctgctgaagccccttgcat

SEQ ID NO: 9312824 - DNA, 22 bp, Homo sapiens
gctctgctgagatatctgggag

SEQ ID NO: 9312825 - DNA, 22 bp, Homo sapiens
gctctgctggaagttctctgga

SEQ ID NO: 9312826 - DNA, 22 bp, Homo sapiens
gctctggctactgtggctaccg

SEQ ID NO: 9312827 - DNA, 22 bp, Homo sapiens
gctctggcccaaaccctttcta

SEQ ID NO: 9312828 - DNA, 23 bp, Homo sapiens
gctctggcagcttgtgtcagcac

SEQ ID NO: 9312829 - DNA, 22 bp, Homo sapiens
gctctggctactccaccctgtt

SEQ ID NO: 9312830 - DNA, 22 bp, Homo sapiens
gctcctggtctggagcttcaag

SEQ ID NO: 9312831 - DNA, 22 bp, Homo sapiens
gctcagggaaagagctcctgtc

SEQ ID NO: 9312832 - DNA, 22 bp, Homo sapiens
gctcaggctctcccaggggaat

SEQ ID NO: 9312833 - DNA, 22 bp, Homo sapiens
gctctcagaagtaacttgtcca

SEQ ID NO: 9312834 - DNA, 22 bp, Homo sapiens
gctctcagaagagccaggctac

SEQ ID NO: 9312835 - DNA, 22 bp, Homo sapiens
gctctcactttaggttggaccg

SEQ ID NO: 9312836 - DNA, 22 bp, Homo sapiens
gctctcagatgctccagcagcc

SEQ ID NO: 9312837 - DNA, 22 bp, Homo sapiens
gctctcagcccactgaggggaa

SEQ ID NO: 9312838 - DNA, 21 bp, Homo sapiens
gctctcagctgcctgctggtt

SEQ ID NO: 9312839 - DNA, 17 bp, Homo sapiens
gccttctctgccctcac

SEQ ID NO: 9312840 - DNA, 22 bp, Homo sapiens
gccttctctgtgagctcctagg

SEQ ID NO: 9312841 - DNA, 22 bp, Homo sapiens
gccttctctgtgagctcctagg

SEQ ID NO: 9312842 - DNA, 22 bp, Homo sapiens
gccttctctgtgagctcctagg

SEQ ID NO: 9312843 - DNA, 22 bp, Homo sapiens
gcggccttgtggcggagcaggc

SEQ ID NO: 9312844 - DNA, 22 bp, Homo sapiens
gcggcaggagtaaaggaggaag

SEQ ID NO: 9312845 - DNA, 22 bp, Homo sapiens
gcgggccaccttggagagcgct

SEQ ID NO: 9312846 - DNA, 22 bp, Homo sapiens
gcgctcaggtgccaggcctgcg

SEQ ID NO: 9312847 - DNA, 22 bp, Homo sapiens
gcggagggagataggccttgct

SEQ ID NO: 9312848 - DNA, 22 bp, Homo sapiens
gctcacagccggctggcagggg

SEQ ID NO: 9312849 - DNA, 22 bp, Homo sapiens
gctcacagccggctggcagggg

SEQ ID NO: 9312850 - DNA, 22 bp, Homo sapiens
gctcacagcccaggccagcgtg

SEQ ID NO: 9312851 - DNA, 22 bp, Homo sapiens
gctcacagagggtgcttaatac

SEQ ID NO: 9312852 - DNA, 22 bp, Homo sapiens
gctcacaggtctgtggctattg

SEQ ID NO: 9312853 - DNA, 22 bp, Homo sapiens
gctcacagtacagtgctggctc

SEQ ID NO: 9312854 - DNA, 22 bp, Homo sapiens
gctcacagtctgctgagtgcag

SEQ ID NO: 9312855 - DNA, 22 bp, Homo sapiens
gctcaagccatcttagtagccc

SEQ ID NO: 9312856 - DNA, 22 bp, Homo sapiens
gctcaagccttctgcccacctc

SEQ ID NO: 9312857 - DNA, 22 bp, Homo sapiens
gctcaagccttctgcccacctc

SEQ ID NO: 9312858 - DNA, 22 bp, Homo sapiens
gcctcaggccgccctgctgctc

SEQ ID NO: 9312859 - DNA, 22 bp, Homo sapiens
gcctcaggcctatagctgctgt

SEQ ID NO: 9312860 - DNA, 22 bp, Homo sapiens
gcctcagggataggatgagcat

SEQ ID NO: 9312861 - DNA, 22 bp, Homo sapiens
gcctggctgccggccttggcaa

SEQ ID NO: 9312862 - DNA, 22 bp, Homo sapiens
gcctggctgctggttctgagga

SEQ ID NO: 9312863 - DNA, 21 bp, Homo sapiens
gcctggctagaagctcctagc

SEQ ID NO: 9312864 - DNA, 22 bp, Homo sapiens
gcctggctagttagtgtcaggt

SEQ ID NO: 9312865 - DNA, 22 bp, Homo sapiens
gcctggctatggcctcccccat

SEQ ID NO: 9312866 - DNA, 22 bp, Homo sapiens
gcctggctagttagtgtcaggt

SEQ ID NO: 9312867 - DNA, 22 bp, Homo sapiens
gcctggctgccggccttggcaa

SEQ ID NO: 9312868 - DNA, 22 bp, Homo sapiens
gcctggctgccggccttggcaa

SEQ ID NO: 9312869 - DNA, 22 bp, Homo sapiens
gcctggctgaggtggggaggca

SEQ ID NO: 9312870 - DNA, 22 bp, Homo sapiens
gcctggcttgccagccctggcg

SEQ ID NO: 9312871 - DNA, 22 bp, Homo sapiens
gcctggcttggggctcagtggt

SEQ ID NO: 9312872 - DNA, 21 bp, Homo sapiens
gcctggcttcacaggcactga

SEQ ID NO: 9312873 - DNA, 22 bp, Homo sapiens
gcctggcttcccttggagcatt

SEQ ID NO: 9312874 - DNA, 22 bp, Homo sapiens
gcctggcttcccttggagcatt

SEQ ID NO: 9312875 - DNA, 18 bp, Homo sapiens
gcctggcttcggagccgc

SEQ ID NO: 9312876 - DNA, 22 bp, Homo sapiens
gcctggctggtagagggggctc

SEQ ID NO: 9312877 - DNA, 22 bp, Homo sapiens
gcctggctgtctggcaaggttc

SEQ ID NO: 9312878 - DNA, 22 bp, Homo sapiens
gcctggctggtcactgcctggc

SEQ ID NO: 9312879 - DNA, 22 bp, Homo sapiens
gcctggctgcttagcctacttc

SEQ ID NO: 9312880 - DNA, 19 bp, Homo sapiens
gcctggctgggatgagccc

SEQ ID NO: 9312881 - DNA, 22 bp, Homo sapiens
gcctggggccagcttgggctga

SEQ ID NO: 9312882 - DNA, 22 bp, Homo sapiens
gcctggtctctttcatgtcagt

SEQ ID NO: 9312883 - DNA, 22 bp, Homo sapiens
gcctggtggacactgggcatca

SEQ ID NO: 9312884 - DNA, 22 bp, Homo sapiens
gccttagcctgcacttcctgtt

SEQ ID NO: 9312885 - DNA, 22 bp, Homo sapiens
gccttattacctgcactttgaa

SEQ ID NO: 9312886 - DNA, 22 bp, Homo sapiens
gccttattttacttggattctg

SEQ ID NO: 9312887 - DNA, 18 bp, Homo sapiens
gccttcagactgcatgct

SEQ ID NO: 9312888 - DNA, 22 bp, Homo sapiens
gccttcagagtaccatgtcctc

SEQ ID NO: 9312889 - DNA, 22 bp, Homo sapiens
gccttcagagtaccatgtcctc

SEQ ID NO: 9312890 - DNA, 22 bp, Homo sapiens
gccttcagtagtgtcagctgta

SEQ ID NO: 9312891 - DNA, 22 bp, Homo sapiens
gccttcaggaaatcagtccttg

SEQ ID NO: 9312892 - DNA, 22 bp, Homo sapiens
ttttttccaggaagccactgga

SEQ ID NO: 9312893 - DNA, 22 bp, Homo sapiens
ttttttccagcttctagaggcc

SEQ ID NO: 9312894 - DNA, 22 bp, Homo sapiens
tttctagatattcgcagataga

SEQ ID NO: 9312895 - DNA, 22 bp, Homo sapiens
tttctatatgaggagctaaagt

SEQ ID NO: 9312896 - DNA, 22 bp, Homo sapiens
tttgacattgccaatttgctca

SEQ ID NO: 9312897 - DNA, 21 bp, Homo sapiens
tttgacagctcagagggcatt

SEQ ID NO: 9312898 - DNA, 23 bp, Homo sapiens
tttgacagcgtggtttctgtggg

SEQ ID NO: 9312899 - DNA, 22 bp, Homo sapiens
tttgaaattggctcattggttt

SEQ ID NO: 9312900 - DNA, 21 bp, Homo sapiens
tttgcttcaattccagaagct

SEQ ID NO: 9312901 - DNA, 22 bp, Homo sapiens
tttgcttgacccttgtgctgaa

SEQ ID NO: 9312902 - DNA, 22 bp, Homo sapiens
tttgctgaccccattctgagtc

SEQ ID NO: 9312903 - DNA, 22 bp, Homo sapiens
tttgctgatattttgctgatac

SEQ ID NO: 9312904 - DNA, 22 bp, Homo sapiens
tttgctgagttgaagtttgagg

SEQ ID NO: 9312905 - DNA, 22 bp, Homo sapiens
tttgctgctgtatatggagccc

SEQ ID NO: 9312906 - DNA, 22 bp, Homo sapiens
tttgagcaccctatgtgtttac

SEQ ID NO: 9312907 - DNA, 22 bp, Homo sapiens
tttgagatagtctagagtaact

SEQ ID NO: 9312908 - DNA, 22 bp, Homo sapiens
tttgagctatgggcttggattt

SEQ ID NO: 9312909 - DNA, 22 bp, Homo sapiens
tttgcagttccatccaggcaga

SEQ ID NO: 9312910 - DNA, 22 bp, Homo sapiens
tttgtcatatcacacaattttg

SEQ ID NO: 9312911 - DNA, 22 bp, Homo sapiens
tttgggttagaagagctaagga

SEQ ID NO: 9312912 - DNA, 22 bp, Homo sapiens
tttgggttccttgagcttaatg

SEQ ID NO: 9312913 - DNA, 22 bp, Homo sapiens
tttggctaactgcaaaaagtac

SEQ ID NO: 9312914 - DNA, 22 bp, Homo sapiens
tttggctactgtacagaaagcc

SEQ ID NO: 9312915 - DNA, 22 bp, Homo sapiens
tttggctacttgatattctgaa

SEQ ID NO: 9312916 - DNA, 22 bp, Homo sapiens
tttggctaaggaaaaggagcta

SEQ ID NO: 9312917 - DNA, 22 bp, Homo sapiens
tttggctaaggggcttctcaac

SEQ ID NO: 9312918 - DNA, 22 bp, Homo sapiens
tttggctaagttgtaatgtaaa

SEQ ID NO: 9312919 - DNA, 22 bp, Homo sapiens
tttggctaattaggtgctgatt

SEQ ID NO: 9312920 - DNA, 22 bp, Homo sapiens
tttggcatttttcagatgactg

SEQ ID NO: 9312921 - DNA, 22 bp, Homo sapiens
tttggcaggtggcagctctggg

SEQ ID NO: 9312922 - DNA, 22 bp, Homo sapiens
tttggctcggctgctgatggtg

SEQ ID NO: 9312923 - DNA, 22 bp, Homo sapiens
tttggctatgtgatacatgtca

SEQ ID NO: 9312924 - DNA, 22 bp, Homo sapiens
tttggctaggttaagactggga

SEQ ID NO: 9312925 - DNA, 22 bp, Homo sapiens
tttggctagccaagaaacaaaa

SEQ ID NO: 9312926 - DNA, 20 bp, Homo sapiens
tttggcttcaagtgcattgc

SEQ ID NO: 9312927 - DNA, 21 bp, Homo sapiens
tttggcttctctgctgcagcc

SEQ ID NO: 9312928 - DNA, 22 bp, Homo sapiens
tttggctttagtgccttctgat

SEQ ID NO: 9312929 - DNA, 22 bp, Homo sapiens
tttggcttgcactggcaccaac

SEQ ID NO: 9312930 - DNA, 22 bp, Homo sapiens
tttggcttaacttacatgatat

SEQ ID NO: 9312931 - DNA, 22 bp, Homo sapiens
ttttattgggagtcctctactg

SEQ ID NO: 9312932 - DNA, 22 bp, Homo sapiens
ttttattggtaatgataaaagt

SEQ ID NO: 9312933 - DNA, 22 bp, Homo sapiens
ttttacctgaaccacacagtat

SEQ ID NO: 9312934 - DNA, 20 bp, Homo sapiens
ttttccagaaagtatcattg

SEQ ID NO: 9312935 - DNA, 16 bp, Homo sapiens
ttttattgtgacagcc

SEQ ID NO: 9312936 - DNA, 22 bp, Homo sapiens
ttttattgtctgtattgcctat

SEQ ID NO: 9312937 - DNA, 22 bp, Homo sapiens
ttttattgtcaatgaagacaga

SEQ ID NO: 9312938 - DNA, 22 bp, Homo sapiens
ttttattgtctcccagttctgg

SEQ ID NO: 9312939 - DNA, 22 bp, Homo sapiens
tttgtctaattgcaaggcaagt

SEQ ID NO: 9312940 - DNA, 22 bp, Homo sapiens
tttgtcttaaatcttgttactg

SEQ ID NO: 9312941 - DNA, 22 bp, Homo sapiens
tttgtcttaaatcttgttactg

SEQ ID NO: 9312942 - DNA, 22 bp, Homo sapiens
tttgtcttcatccttcgagctg

SEQ ID NO: 9312943 - DNA, 20 bp, Homo sapiens
tttgtgccaagtagccagtg

SEQ ID NO: 9312944 - DNA, 19 bp, Homo sapiens
tttgtgccaggaaggttgt

SEQ ID NO: 9312945 - DNA, 22 bp, Homo sapiens
tttgtgccctgtagatccccag

SEQ ID NO: 9312946 - DNA, 22 bp, Homo sapiens
tttgtgcctatacatgcgactg

SEQ ID NO: 9312947 - DNA, 22 bp, Homo sapiens
tttgtgcctcatcatccaaggt

SEQ ID NO: 9312948 - DNA, 22 bp, Homo sapiens
ttttacaagctgagtcgttaaa

SEQ ID NO: 9312949 - DNA, 23 bp, Homo sapiens
ttttaatttggacataagaagat

SEQ ID NO: 9312950 - DNA, 22 bp, Homo sapiens
ttttaattttgcaaatctggtg

SEQ ID NO: 9312951 - DNA, 22 bp, Homo sapiens
ttttacaaatgaggagctggag

SEQ ID NO: 9312952 - DNA, 22 bp, Homo sapiens
ttttccagcataggtacatata

SEQ ID NO: 9312953 - DNA, 22 bp, Homo sapiens
ttttccagattggacttagtcc

SEQ ID NO: 9312954 - DNA, 22 bp, Homo sapiens
ttttccagatggatactagaat

SEQ ID NO: 9312955 - DNA, 22 bp, Homo sapiens
ttttccagatgaattccacagt

SEQ ID NO: 9312956 - DNA, 23 bp, Homo sapiens
ttttccagaatcgactctgtaga

SEQ ID NO: 9312957 - DNA, 22 bp, Homo sapiens
ttttccagagctgtctcttgca

SEQ ID NO: 9312958 - DNA, 22 bp, Homo sapiens
ttttccttcacctcttgagcct

SEQ ID NO: 9312959 - DNA, 22 bp, Homo sapiens
ttttggcttttcctcagcaagc

SEQ ID NO: 9312960 - DNA, 22 bp, Homo sapiens
ttttggctctgtctgtatcttt

SEQ ID NO: 9312961 - DNA, 22 bp, Homo sapiens
ttttggctctgtctgtatcttt

SEQ ID NO: 9312962 - DNA, 22 bp, Homo sapiens
ttttggctgtagctggaaatct

SEQ ID NO: 9312963 - DNA, 22 bp, Homo sapiens
ttttggcttaaagagaatgtat

SEQ ID NO: 9312964 - DNA, 19 bp, Homo sapiens
ttttggctggagtgatctg

SEQ ID NO: 9312965 - DNA, 22 bp, Homo sapiens
ttttggctcttggtaggtcaga

SEQ ID NO: 9312966 - DNA, 22 bp, Homo sapiens
tttttgttgcagagaggccact

SEQ ID NO: 9312967 - DNA, 22 bp, Homo sapiens
tttttgtggtatattgcaacaa

SEQ ID NO: 9312968 - DNA, 22 bp, Homo sapiens
tttttgtgaaatctccagacat

SEQ ID NO: 9312969 - DNA, 22 bp, Homo sapiens
ttttttatatcaactgaagtct

SEQ ID NO: 9312970 - DNA, 22 bp, Homo sapiens
ttttttatagcaatgaacccac

SEQ ID NO: 9312971 - DNA, 22 bp, Homo sapiens
tttcatctctctaaaagacagt

SEQ ID NO: 9312972 - DNA, 22 bp, Homo sapiens
tttcataatgtcacagtcaaaa

SEQ ID NO: 9312973 - DNA, 22 bp, Homo sapiens
tttccagtctctgcctccaagg

SEQ ID NO: 9312974 - DNA, 22 bp, Homo sapiens
tttccagagggtgctcagggcg

SEQ ID NO: 9312975 - DNA, 22 bp, Homo sapiens
tttccaaataaggtcacattct

SEQ ID NO: 9312976 - DNA, 22 bp, Homo sapiens
tttcctttgcccaatacatgtc

SEQ ID NO: 9312977 - DNA, 22 bp, Homo sapiens
tttcctttgggagcatgaattt

SEQ ID NO: 9312978 - DNA, 22 bp, Homo sapiens
tttctaaggccagagactgctg

SEQ ID NO: 9312979 - DNA, 22 bp, Homo sapiens
tttcgtttgcttatataataga

SEQ ID NO: 9312980 - DNA, 22 bp, Homo sapiens
tttccttttataaggcttgagg

SEQ ID NO: 9312981 - DNA, 22 bp, Homo sapiens
tttccttttataaggcttgagg

SEQ ID NO: 9312982 - DNA, 22 bp, Homo sapiens
tttcctttgtgcaggccttggg

SEQ ID NO: 9312983 - DNA, 22 bp, Homo sapiens
tttcacatggtactgcctgttt

SEQ ID NO: 9312984 - DNA, 22 bp, Homo sapiens
tttcacatggtactgcctgttt

SEQ ID NO: 9312985 - DNA, 22 bp, Homo sapiens
tttcacatcctgaagccccact

SEQ ID NO: 9312986 - DNA, 20 bp, Homo sapiens
tttcacatctgtccctttaa

SEQ ID NO: 9312987 - DNA, 22 bp, Homo sapiens
tttcacaggccttttgtagccc

SEQ ID NO: 9312988 - DNA, 22 bp, Homo sapiens
tttcacaggggcaacctccatg

SEQ ID NO: 9312989 - DNA, 22 bp, Homo sapiens
tttcacatatcaactctatcct

SEQ ID NO: 9312990 - DNA, 23 bp, Homo sapiens
tttcacagcttttattctgcatc

SEQ ID NO: 9312991 - DNA, 22 bp, Homo sapiens
tttcacattcagatatagactt

SEQ ID NO: 9312992 - DNA, 22 bp, Homo sapiens
tttcacattcagatatagactt

SEQ ID NO: 9312993 - DNA, 22 bp, Homo sapiens
tttcacatgtggaatgccaggt

SEQ ID NO: 9312994 - DNA, 22 bp, Homo sapiens
tttcaagcataactgggaagag

SEQ ID NO: 9312995 - DNA, 22 bp, Homo sapiens
tttcaagctgtggtaactgaga

SEQ ID NO: 9312996 - DNA, 22 bp, Homo sapiens
tttcaagctgtggtaactgaga

SEQ ID NO: 9312997 - DNA, 22 bp, Homo sapiens
tttcaaggccttctggttcagt

SEQ ID NO: 9312998 - DNA, 22 bp, Homo sapiens
tttcaaggctaatccacagtat

SEQ ID NO: 9312999 - DNA, 22 bp, Homo sapiens
tttcaaggctagttttaattag

SEQ ID NO: 9313000 - DNA, 22 bp, Homo sapiens
tttcaagggaatatgaaattca

SEQ ID NO: 9313001 - DNA, 17 bp, Homo sapiens
tttcaaggttacgttcc

SEQ ID NO: 9313002 - DNA, 22 bp, Homo sapiens
tttcaagtcattctataatatc

SEQ ID NO: 9313003 - DNA, 22 bp, Homo sapiens
tttcaagtactgtaaacatgct

SEQ ID NO: 9313004 - DNA, 21 bp, Homo sapiens
tttatttatataggacacatg

SEQ ID NO: 9313005 - DNA, 21 bp, Homo sapiens
tttatttatataggacacatg

SEQ ID NO: 9313006 - DNA, 22 bp, Homo sapiens
tttatttataagccacttgctg

SEQ ID NO: 9313007 - DNA, 22 bp, Homo sapiens
tttatttataagccacttgctg

SEQ ID NO: 9313008 - DNA, 22 bp, Homo sapiens
tttatttataagccacttgctg

SEQ ID NO: 9313009 - DNA, 22 bp, Homo sapiens
tttatttatccttctggattgc

SEQ ID NO: 9313010 - DNA, 21 bp, Homo sapiens
tttatttatataggacacatg

SEQ ID NO: 9313011 - DNA, 22 bp, Homo sapiens
tttcaagttgttgcattaaatg

SEQ ID NO: 9313012 - DNA, 22 bp, Homo sapiens
tttcaagtggggacatttgaga

SEQ ID NO: 9313013 - DNA, 22 bp, Homo sapiens
tttatgaactacagatataact

SEQ ID NO: 9313014 - DNA, 22 bp, Homo sapiens
tttatgaactacagatataact

SEQ ID NO: 9313015 - DNA, 21 bp, Homo sapiens
tttatgtacttcatagagtag

SEQ ID NO: 9313016 - DNA, 22 bp, Homo sapiens
tttattgcatacacaaatgtca

SEQ ID NO: 9313017 - DNA, 19 bp, Homo sapiens
tttatgtcattgaggtcat

SEQ ID NO: 9313018 - DNA, 16 bp, Homo sapiens
tttatttactagtgtt

SEQ ID NO: 9313019 - DNA, 22 bp, Homo sapiens
tttattgtcaatctattcccag

SEQ ID NO: 9313020 - DNA, 22 bp, Homo sapiens
tttattgggtgcagtgcccaca

SEQ ID NO: 9313021 - DNA, 20 bp, Homo sapiens
tttattggcctttcaggaac

SEQ ID NO: 9313022 - DNA, 22 bp, Homo sapiens
tttattgggcctggaggatcta

SEQ ID NO: 9313023 - DNA, 22 bp, Homo sapiens
tttattggaacacagccatgac

SEQ ID NO: 9313024 - DNA, 22 bp, Homo sapiens
tttattggatatttacaagata

SEQ ID NO: 9313025 - DNA, 22 bp, Homo sapiens
tttattggatggatggatggat

SEQ ID NO: 9313026 - DNA, 22 bp, Homo sapiens
tttattggatgggtcagctcta

SEQ ID NO: 9313027 - DNA, 22 bp, Homo sapiens
tttattggatgggtcagctcta

SEQ ID NO: 9313028 - DNA, 22 bp, Homo sapiens
tttattggaacacagccatgac

SEQ ID NO: 9313029 - DNA, 22 bp, Homo sapiens
tttattgctgtgttagggacag

SEQ ID NO: 9313030 - DNA, 22 bp, Homo sapiens
tttattgctcagcagttagttg

SEQ ID NO: 9313031 - DNA, 22 bp, Homo sapiens
tttattgctagcccttggtcca

SEQ ID NO: 9313032 - DNA, 22 bp, Homo sapiens
tttattgctagcccttggtcca

SEQ ID NO: 9313033 - DNA, 22 bp, Homo sapiens
tttattgccctgtagtacagga

SEQ ID NO: 9313034 - DNA, 22 bp, Homo sapiens
tttattgctggccacctgtagc

SEQ ID NO: 9313035 - DNA, 22 bp, Homo sapiens
tttattgctgagaaggattcca

SEQ ID NO: 9313036 - DNA, 22 bp, Homo sapiens
tttattgctgagaaggattcca

SEQ ID NO: 9313037 - DNA, 22 bp, Homo sapiens
tttatctggactgtgatataaa

SEQ ID NO: 9313038 - DNA, 22 bp, Homo sapiens
tttatctgtatatctcaagtgt

SEQ ID NO: 9313039 - DNA, 22 bp, Homo sapiens
tttatctgtagagcttcaccta

SEQ ID NO: 9313040 - DNA, 22 bp, Homo sapiens
tttatctgtcatttcccatatc

SEQ ID NO: 9313041 - DNA, 22 bp, Homo sapiens
tttagcttgttggaacaattga

SEQ ID NO: 9313042 - DNA, 22 bp, Homo sapiens
tttagcttgttggaacaattga

SEQ ID NO: 9313043 - DNA, 22 bp, Homo sapiens
tttagctttgaaggatatggtt

SEQ ID NO: 9313044 - DNA, 22 bp, Homo sapiens
tttagctttacctcatagattt

SEQ ID NO: 9313045 - DNA, 22 bp, Homo sapiens
tttagcatcgaagtaaatttag

SEQ ID NO: 9313046 - DNA, 23 bp, Homo sapiens
tttagcatgaagcagctggagaa

SEQ ID NO: 9313047 - DNA, 22 bp, Homo sapiens
tttagcattactaaaatgaaaa

SEQ ID NO: 9313048 - DNA, 22 bp, Homo sapiens
tttagcttcatttggcgtgatt

SEQ ID NO: 9313049 - DNA, 23 bp, Homo sapiens
tttagcttccctttagttagggg

SEQ ID NO: 9313050 - DNA, 22 bp, Homo sapiens
tttagcttgaaagttttggagg

SEQ ID NO: 9313051 - DNA, 22 bp, Homo sapiens
tttagcttgaatcttgtttaaa

SEQ ID NO: 9313052 - DNA, 22 bp, Homo sapiens
tttagcttcagttctagcttct

SEQ ID NO: 9313053 - DNA, 22 bp, Homo sapiens
tttagcttcatcttcaagctgg

SEQ ID NO: 9313054 - DNA, 19 bp, Homo sapiens
tttagcttacgtttcattg

SEQ ID NO: 9313055 - DNA, 22 bp, Homo sapiens
tttacacttattatgaagcttt

SEQ ID NO: 9313056 - DNA, 22 bp, Homo sapiens
tttacagagaatgtacataaag

SEQ ID NO: 9313057 - DNA, 22 bp, Homo sapiens
tttacagatgtggaaagtgagc

SEQ ID NO: 9313058 - DNA, 22 bp, Homo sapiens
tttacagatgaggaaactgaga

SEQ ID NO: 9313059 - DNA, 22 bp, Homo sapiens
tttacactgtgaaacaggtatc

SEQ ID NO: 9313060 - DNA, 22 bp, Homo sapiens
tttaaattatagttaatgtctg

SEQ ID NO: 9313061 - DNA, 22 bp, Homo sapiens
tttaacttaatctgcttgatga

SEQ ID NO: 9313062 - DNA, 23 bp, Homo sapiens
tttaactttccaataattcattg

SEQ ID NO: 9313063 - DNA, 22 bp, Homo sapiens
ttgttgttataggtggtacaag

SEQ ID NO: 9313064 - DNA, 22 bp, Homo sapiens
ttgctataaatggtctatcttt

SEQ ID NO: 9313065 - DNA, 22 bp, Homo sapiens
ttgctaataaagtttttatgtg

SEQ ID NO: 9313066 - DNA, 22 bp, Homo sapiens
ttgctaaaggattttgtattta

SEQ ID NO: 9313067 - DNA, 23 bp, Homo sapiens
ttgcttccactgtaagtggagaa

SEQ ID NO: 9313068 - DNA, 22 bp, Homo sapiens
ttgcttccagtccaagtctgtt

SEQ ID NO: 9313069 - DNA, 22 bp, Homo sapiens
ttgcttccccctgttctagttc

SEQ ID NO: 9313070 - DNA, 22 bp, Homo sapiens
ttgcttcctctagtttcttgaa

SEQ ID NO: 9313071 - DNA, 22 bp, Homo sapiens
ttgcttcctcctagccacttgc

SEQ ID NO: 9313072 - DNA, 22 bp, Homo sapiens
ttgcttcctcgaggccagcgtg

SEQ ID NO: 9313073 - DNA, 22 bp, Homo sapiens
ttgcttcagtcagtgctgccca

SEQ ID NO: 9313074 - DNA, 22 bp, Homo sapiens
ttgcttcatatttgtggcttgc

SEQ ID NO: 9313075 - DNA, 22 bp, Homo sapiens
ttgcttcattaagttctcacag

SEQ ID NO: 9313076 - DNA, 22 bp, Homo sapiens
ttgcttcatttcctcaggcttt

SEQ ID NO: 9313077 - DNA, 22 bp, Homo sapiens
ttgcctgctacggtcttcactg

SEQ ID NO: 9313078 - DNA, 22 bp, Homo sapiens
ttgcccactcagccctgtggag

SEQ ID NO: 9313079 - DNA, 22 bp, Homo sapiens
ttgcccactcatgcttttgata

SEQ ID NO: 9313080 - DNA, 22 bp, Homo sapiens
ttgcccaccttcttttcgtgcc

SEQ ID NO: 9313081 - DNA, 22 bp, Homo sapiens
ttgcctttaagtataactgctg

SEQ ID NO: 9313082 - DNA, 22 bp, Homo sapiens
ttgccttatagtgctctgcatt

SEQ ID NO: 9313083 - DNA, 22 bp, Homo sapiens
ttgccttgttattctctcagaa

SEQ ID NO: 9313084 - DNA, 22 bp, Homo sapiens
ttgcctgggcaacatagaactc

SEQ ID NO: 9313085 - DNA, 22 bp, Homo sapiens
ttgcctgggctagtaagccaga

SEQ ID NO: 9313086 - DNA, 22 bp, Homo sapiens
ttgcctgggctagtaagccaga

SEQ ID NO: 9313087 - DNA, 22 bp, Homo sapiens
ttgcctggatggtccccagaga

SEQ ID NO: 9313088 - DNA, 22 bp, Homo sapiens
ttgcctggattctaccacagaa

SEQ ID NO: 9313089 - DNA, 22 bp, Homo sapiens
ttgcctggagggacatggagac

SEQ ID NO: 9313090 - DNA, 22 bp, Homo sapiens
ttgcctggagggacatggagac

SEQ ID NO: 9313091 - DNA, 22 bp, Homo sapiens
ttgccagataggcatgaaaagt

SEQ ID NO: 9313092 - DNA, 21 bp, Homo sapiens
ttgcattttaagtttactgct

SEQ ID NO: 9313093 - DNA, 22 bp, Homo sapiens
ttgcatttttagatgcttctgt

SEQ ID NO: 9313094 - DNA, 18 bp, Homo sapiens
ttgagtctagccatggaa

SEQ ID NO: 9313095 - DNA, 22 bp, Homo sapiens
ttgagtctcctcagcagggcta

SEQ ID NO: 9313096 - DNA, 22 bp, Homo sapiens
ttgcatttgatcttgggttctc

SEQ ID NO: 9313097 - DNA, 22 bp, Homo sapiens
ttgcatttgagaaagttctcct

SEQ ID NO: 9313098 - DNA, 22 bp, Homo sapiens
ttgcatttcctgtactgtttga

SEQ ID NO: 9313099 - DNA, 22 bp, Homo sapiens
ttggaacatgccggggtccagg

SEQ ID NO: 9313100 - DNA, 22 bp, Homo sapiens
ttgctttatgtgtatgacttga

SEQ ID NO: 9313101 - DNA, 22 bp, Homo sapiens
ttgctttatctcttatgcctca

SEQ ID NO: 9313102 - DNA, 22 bp, Homo sapiens
ttgctttatctaagcatggcca

SEQ ID NO: 9313103 - DNA, 22 bp, Homo sapiens
ttgctttattcacatctatatt

SEQ ID NO: 9313104 - DNA, 22 bp, Homo sapiens
ttgctttattcctagcccttgt

SEQ ID NO: 9313105 - DNA, 22 bp, Homo sapiens
ttgctttagggcaaatatttca

SEQ ID NO: 9313106 - DNA, 22 bp, Homo sapiens
ttgctttagggcaaatatttca

SEQ ID NO: 9313107 - DNA, 22 bp, Homo sapiens
ttgctttaggtatagaatccat

SEQ ID NO: 9313108 - DNA, 22 bp, Homo sapiens
ttgctttaggatttaagtggca

SEQ ID NO: 9313109 - DNA, 22 bp, Homo sapiens
ttgctttatattcaagagagga

SEQ ID NO: 9313110 - DNA, 20 bp, Homo sapiens
ttgctttatcagacatgata

SEQ ID NO: 9313111 - DNA, 22 bp, Homo sapiens
ttgctttaaggtatctggagaa

SEQ ID NO: 9313112 - DNA, 15 bp, Homo sapiens
ttgctttaagacatg

SEQ ID NO: 9313113 - DNA, 22 bp, Homo sapiens
ttgcttgtcttccctttacctc

SEQ ID NO: 9313114 - DNA, 22 bp, Homo sapiens
ttgctttaactagtaaatgggg

SEQ ID NO: 9313115 - DNA, 22 bp, Homo sapiens
ttgctttaaaatggctaagtct

SEQ ID NO: 9313116 - DNA, 22 bp, Homo sapiens
ttgctttacatgttctggtaaa

SEQ ID NO: 9313117 - DNA, 22 bp, Homo sapiens
ttgctttacaaaaattgatggt

SEQ ID NO: 9313118 - DNA, 22 bp, Homo sapiens
ttgctttaatgagattttgcca

SEQ ID NO: 9313119 - DNA, 22 bp, Homo sapiens
ttgctttacggcaaggccccag

SEQ ID NO: 9313120 - DNA, 22 bp, Homo sapiens
ttgctttacctgtggtatattt

SEQ ID NO: 9313121 - DNA, 22 bp, Homo sapiens
ttgctttaccatttgatctcta

SEQ ID NO: 9313122 - DNA, 22 bp, Homo sapiens
ttgctttactttgccattcgtt

SEQ ID NO: 9313123 - DNA, 22 bp, Homo sapiens
ttgctttagaatctgcttctgg

SEQ ID NO: 9313124 - DNA, 22 bp, Homo sapiens
ttgcttcttagatattcctctc

SEQ ID NO: 9313125 - DNA, 22 bp, Homo sapiens
ttgcttcttagatattcctctc

SEQ ID NO: 9313126 - DNA, 22 bp, Homo sapiens
ttgcttgactttgtgtacctgt

SEQ ID NO: 9313127 - DNA, 18 bp, Homo sapiens
ttgcttcttttctctagg

SEQ ID NO: 9313128 - DNA, 23 bp, Homo sapiens
ttgcttctgtgcaattcagtact

SEQ ID NO: 9313129 - DNA, 22 bp, Homo sapiens
ttgcttctggaactttctgttc

SEQ ID NO: 9313130 - DNA, 22 bp, Homo sapiens
ttgcttcctttacagatgggca

SEQ ID NO: 9313131 - DNA, 22 bp, Homo sapiens
ttgcttccttgagctggtctga

SEQ ID NO: 9313132 - DNA, 22 bp, Homo sapiens
ttgcttcctggcagggcgagcg

SEQ ID NO: 9313133 - DNA, 22 bp, Homo sapiens
ttgcttcctctgtgcaatcctc

SEQ ID NO: 9313134 - DNA, 22 bp, Homo sapiens
ttgcttcctggatgtgactttg

SEQ ID NO: 9313135 - DNA, 22 bp, Homo sapiens
ttggcaatgtctaaacacattt

SEQ ID NO: 9313136 - DNA, 22 bp, Homo sapiens
ttggcaatgatctcaatcttct

SEQ ID NO: 9313137 - DNA, 22 bp, Homo sapiens
ttggcaaaggactcaaagcagg

SEQ ID NO: 9313138 - DNA, 22 bp, Homo sapiens
ttggctaacacgcgttttgttc

SEQ ID NO: 9313139 - DNA, 22 bp, Homo sapiens
ttggctaacctgggttatcagc

SEQ ID NO: 9313140 - DNA, 22 bp, Homo sapiens
ttgggcttgtctgggaaactgc

SEQ ID NO: 9313141 - DNA, 22 bp, Homo sapiens
ttgggctgaagtagagggcaga

SEQ ID NO: 9313142 - DNA, 22 bp, Homo sapiens
ttgggctcctgttgatcctgtc

SEQ ID NO: 9313143 - DNA, 22 bp, Homo sapiens
ttggcttccaggggcttttaca

SEQ ID NO: 9313144 - DNA, 22 bp, Homo sapiens
ttggcttctgatgtattcctga

SEQ ID NO: 9313145 - DNA, 22 bp, Homo sapiens
ttggcttcattgatctcacttt

SEQ ID NO: 9313146 - DNA, 22 bp, Homo sapiens
ttggcttgatgactggcagtgt

SEQ ID NO: 9313147 - DNA, 22 bp, Homo sapiens
ttggcttcttgtgaaatctgag

SEQ ID NO: 9313148 - DNA, 18 bp, Homo sapiens
ttggcttctttccttcct

SEQ ID NO: 9313149 - DNA, 22 bp, Homo sapiens
ttggcttctgttttggctctgt

SEQ ID NO: 9313150 - DNA, 22 bp, Homo sapiens
ttggcttctgttttggctctgt

SEQ ID NO: 9313151 - DNA, 22 bp, Homo sapiens
ttggctttctctgtatctgaat

SEQ ID NO: 9313152 - DNA, 18 bp, Homo sapiens
ttggctttgagaactggt

SEQ ID NO: 9313153 - DNA, 18 bp, Homo sapiens
ttggctttgagaactggt

SEQ ID NO: 9313154 - DNA, 22 bp, Homo sapiens
ttggctttctctgtatctgaat

SEQ ID NO: 9313155 - DNA, 22 bp, Homo sapiens
ttgtattcattgcttacccaat

SEQ ID NO: 9313156 - DNA, 22 bp, Homo sapiens
ttgtattccagccaccacaggc

SEQ ID NO: 9313157 - DNA, 22 bp, Homo sapiens
ttgtattaattgaaatgaatgc

SEQ ID NO: 9313158 - DNA, 22 bp, Homo sapiens
ttgtattctttatgacttccct

SEQ ID NO: 9313159 - DNA, 22 bp, Homo sapiens
ttgtattcctgggtcaaggaga

SEQ ID NO: 9313160 - DNA, 22 bp, Homo sapiens
ttgtattctttatgacttccct

SEQ ID NO: 9313161 - DNA, 22 bp, Homo sapiens
ttgtatagtaagtgaatgttta

SEQ ID NO: 9313162 - DNA, 22 bp, Homo sapiens
ttgtagcagggatcagaataca

SEQ ID NO: 9313163 - DNA, 22 bp, Homo sapiens
ttggggtacgcaggtctgggag

SEQ ID NO: 9313164 - DNA, 22 bp, Homo sapiens
ttggggctctgaaaaagatgta

SEQ ID NO: 9313165 - DNA, 22 bp, Homo sapiens
ttgttcctgccaagccaagcct

SEQ ID NO: 9313166 - DNA, 22 bp, Homo sapiens
ttgttcattagcgcttgggcac

SEQ ID NO: 9313167 - DNA, 21 bp, Homo sapiens
ttgttcctatctgcctcctgc

SEQ ID NO: 9313168 - DNA, 19 bp, Homo sapiens
ttgttcattgtgtgtcctt

SEQ ID NO: 9313169 - DNA, 22 bp, Homo sapiens
ttgttcatcgtccttgctctgt

SEQ ID NO: 9313170 - DNA, 22 bp, Homo sapiens
ttgtgcttgccctggaggtgcg

SEQ ID NO: 9313171 - DNA, 22 bp, Homo sapiens
ttgtgcctggggtctgacagcc

SEQ ID NO: 9313172 - DNA, 22 bp, Homo sapiens
ttgtgcctggcttgtattcaca

SEQ ID NO: 9313173 - DNA, 22 bp, Homo sapiens
ttgtgctagaaccagtacagaa

SEQ ID NO: 9313174 - DNA, 22 bp, Homo sapiens
ttgtgcctttgcttttacaagt

SEQ ID NO: 9313175 - DNA, 22 bp, Homo sapiens
ttgtgcaatttaaaatcttcct

SEQ ID NO: 9313176 - DNA, 22 bp, Homo sapiens
ttgtgagcatgtgcagcctctg

SEQ ID NO: 9313177 - DNA, 22 bp, Homo sapiens
ttccatattggaaggcacaggc

SEQ ID NO: 9313178 - DNA, 22 bp, Homo sapiens
ttccatccatgtcccgtttctg

SEQ ID NO: 9313179 - DNA, 22 bp, Homo sapiens
ttccatccatatcttgttgagg

SEQ ID NO: 9313180 - DNA, 22 bp, Homo sapiens
ttccatatttgtgtggcaaaag

SEQ ID NO: 9313181 - DNA, 22 bp, Homo sapiens
ttccatcctaataaaagaagtt

SEQ ID NO: 9313182 - DNA, 22 bp, Homo sapiens
ttcccccacctggggtacagga

SEQ ID NO: 9313183 - DNA, 22 bp, Homo sapiens
ttccccagggaagctcctgcgc

SEQ ID NO: 9313184 - DNA, 22 bp, Homo sapiens
ttccccaggtgattctcatggc

SEQ ID NO: 9313185 - DNA, 22 bp, Homo sapiens
ttcatttttaccgcgtgtcaaa

SEQ ID NO: 9313186 - DNA, 22 bp, Homo sapiens
ttcatcaggcatcatgctcaag

SEQ ID NO: 9313187 - DNA, 22 bp, Homo sapiens
ttccaaggcccagcagagagga

SEQ ID NO: 9313188 - DNA, 22 bp, Homo sapiens
ttccaaggccagacagggcagt

SEQ ID NO: 9313189 - DNA, 22 bp, Homo sapiens
ttccatacgactgaggtctcgg

SEQ ID NO: 9313190 - DNA, 22 bp, Homo sapiens
ttccaaggtgttctgctggttt

SEQ ID NO: 9313191 - DNA, 22 bp, Homo sapiens
ttcagacaataagagtcatctc

SEQ ID NO: 9313192 - DNA, 22 bp, Homo sapiens
ttcatattatgatttgaaatgc

SEQ ID NO: 9313193 - DNA, 22 bp, Homo sapiens
ttcatatttgaaacagaagtta

SEQ ID NO: 9313194 - DNA, 22 bp, Homo sapiens
ttcatatttctttaaggacttt

SEQ ID NO: 9313195 - DNA, 22 bp, Homo sapiens
ttcatattcaaatactctgctt

SEQ ID NO: 9313196 - DNA, 22 bp, Homo sapiens
ttcatattgcttccgtggagtg

SEQ ID NO: 9313197 - DNA, 22 bp, Homo sapiens
ttcatatttgaaacagaagtta

SEQ ID NO: 9313198 - DNA, 22 bp, Homo sapiens
ttcatattttctgcttgctcac

SEQ ID NO: 9313199 - DNA, 22 bp, Homo sapiens
ttcataggaaatagtgttcttt

SEQ ID NO: 9313200 - DNA, 22 bp, Homo sapiens
ttcatagatctcaattttgagg

SEQ ID NO: 9313201 - DNA, 22 bp, Homo sapiens
ttcatagtgtttccttccagtg

SEQ ID NO: 9313202 - DNA, 22 bp, Homo sapiens
ttcactgtcctgcaactctaga

SEQ ID NO: 9313203 - DNA, 22 bp, Homo sapiens
ttcaagtaacacaaatgcaccc

SEQ ID NO: 9313204 - DNA, 20 bp, Homo sapiens
ttcaatatgaccctggggag

SEQ ID NO: 9313205 - DNA, 22 bp, Homo sapiens
ttcaatcattgcaaagtaatgg

SEQ ID NO: 9313206 - DNA, 21 bp, Homo sapiens
ttagttctaccacttgcattc

SEQ ID NO: 9313207 - DNA, 22 bp, Homo sapiens
ttataactttggatatgacaag

SEQ ID NO: 9313208 - DNA, 22 bp, Homo sapiens
ttagttgtaaaatggaatttgt

SEQ ID NO: 9313209 - DNA, 22 bp, Homo sapiens
ttatacacaattcttttactac

SEQ ID NO: 9313210 - DNA, 22 bp, Homo sapiens
ttatgctaaatgaatcaagtca

SEQ ID NO: 9313211 - DNA, 22 bp, Homo sapiens
ttatgcttttagaatttagcat

SEQ ID NO: 9313212 - DNA, 23 bp, Homo sapiens
ttatgctttggcactcttgttag

SEQ ID NO: 9313213 - DNA, 22 bp, Homo sapiens
ttatgctttgtgggcctacttt

SEQ ID NO: 9313214 - DNA, 22 bp, Homo sapiens
ttatgcttgttcacagaggtca

SEQ ID NO: 9313215 - DNA, 22 bp, Homo sapiens
ttatgcttcctgattggactct

SEQ ID NO: 9313216 - DNA, 22 bp, Homo sapiens
ttatgcttccctgaggatctta

SEQ ID NO: 9313217 - DNA, 22 bp, Homo sapiens
ttatgcttaaaatcactaggat

SEQ ID NO: 9313218 - DNA, 22 bp, Homo sapiens
ttatgcttccctgaggatctta

SEQ ID NO: 9313219 - DNA, 22 bp, Homo sapiens
ttatgcttgcagatttaagggt

SEQ ID NO: 9313220 - DNA, 22 bp, Homo sapiens
ttatgctagttgaaataacaca

SEQ ID NO: 9313221 - DNA, 23 bp, Homo sapiens
ttatggagtgccagacatttggc

SEQ ID NO: 9313222 - DNA, 22 bp, Homo sapiens
tcctctgctcagcattcctcac

SEQ ID NO: 9313223 - DNA, 23 bp, Homo sapiens
tcctcgcaggagggagatgatgc

SEQ ID NO: 9313224 - DNA, 20 bp, Homo sapiens
ttatttgtttactttggtcc

SEQ ID NO: 9313225 - DNA, 22 bp, Homo sapiens
ttatttatatctctgcagttta

SEQ ID NO: 9313226 - DNA, 22 bp, Homo sapiens
ttatttatatctctgcagttta

SEQ ID NO: 9313227 - DNA, 22 bp, Homo sapiens
ttatttatatctctgcagttta

SEQ ID NO: 9313228 - DNA, 22 bp, Homo sapiens
ttatttatggcactgttggtgg

SEQ ID NO: 9313229 - DNA, 22 bp, Homo sapiens
ttatttatggcactgttggtgg

SEQ ID NO: 9313230 - DNA, 22 bp, Homo sapiens
ttattttaccttcctctgagct

SEQ ID NO: 9313231 - DNA, 22 bp, Homo sapiens
ttattttaccttcctctgagct

SEQ ID NO: 9313232 - DNA, 22 bp, Homo sapiens
ttcaaggaaaccagcatttggt

SEQ ID NO: 9313233 - DNA, 22 bp, Homo sapiens
ttcaaggaagaagtggctttga

SEQ ID NO: 9313234 - DNA, 22 bp, Homo sapiens
ttcaaacaactcatttatgcaa

SEQ ID NO: 9313235 - DNA, 22 bp, Homo sapiens
ttcaagaaggtacatttacatc

SEQ ID NO: 9313236 - DNA, 23 bp, Homo sapiens
ttcaagatacggtttccaggctg

SEQ ID NO: 9313237 - DNA, 18 bp, Homo sapiens
ttcaagagtttctctagg

SEQ ID NO: 9313238 - DNA, 19 bp, Homo sapiens
ttctcagagcttgcagcac

SEQ ID NO: 9313239 - DNA, 19 bp, Homo sapiens
ttctccagcctgacctgag

SEQ ID NO: 9313240 - DNA, 22 bp, Homo sapiens
ttctaactggcttgacagtttc

SEQ ID NO: 9313241 - DNA, 22 bp, Homo sapiens
ttctatatttatgggcatcacc

SEQ ID NO: 9313242 - DNA, 22 bp, Homo sapiens
ttctatattggaagtgagaaat

SEQ ID NO: 9313243 - DNA, 22 bp, Homo sapiens
ttctatcatacttgaatacatt

SEQ ID NO: 9313244 - DNA, 22 bp, Homo sapiens
ttctcacagtacctaacatgta

SEQ ID NO: 9313245 - DNA, 22 bp, Homo sapiens
ttctcacattcagaacttttat

SEQ ID NO: 9313246 - DNA, 22 bp, Homo sapiens
ttctcacactttccactgaggt

SEQ ID NO: 9313247 - DNA, 22 bp, Homo sapiens
ttctcacaggatttcttttagt

SEQ ID NO: 9313248 - DNA, 22 bp, Homo sapiens
ttctcacaggctggaatgatga

SEQ ID NO: 9313249 - DNA, 22 bp, Homo sapiens
ttctcacagaagcacgaagcct

SEQ ID NO: 9313250 - DNA, 22 bp, Homo sapiens
ttctcacaggaagtaggacttt

SEQ ID NO: 9313251 - DNA, 22 bp, Homo sapiens
ttctcacaaatccatccaggag

SEQ ID NO: 9313252 - DNA, 22 bp, Homo sapiens
ttctcacaattcttgtatttgc

SEQ ID NO: 9313253 - DNA, 22 bp, Homo sapiens
ttccctctccaggagccctgag

SEQ ID NO: 9313254 - DNA, 22 bp, Homo sapiens
ttccctccgaacctcagtgctg

SEQ ID NO: 9313255 - DNA, 22 bp, Homo sapiens
ttccctgatcacgtgtcaggag

SEQ ID NO: 9313256 - DNA, 22 bp, Homo sapiens
ttccctgaagacctcatgtgac

SEQ ID NO: 9313257 - DNA, 22 bp, Homo sapiens
ttccctgagtctccctgagtct

SEQ ID NO: 9313258 - DNA, 22 bp, Homo sapiens
ttcgttttctaggaccaacaga

SEQ ID NO: 9313259 - DNA, 22 bp, Homo sapiens
ttcggctttccagtttgtctcg

SEQ ID NO: 9313260 - DNA, 22 bp, Homo sapiens
ttcggcttcttagaggcgctcc

SEQ ID NO: 9313261 - DNA, 20 bp, Homo sapiens
ttcgctgggagtggccaggc

SEQ ID NO: 9313262 - DNA, 22 bp, Homo sapiens
ttctctttctgctgggctggaa

SEQ ID NO: 9313263 - DNA, 22 bp, Homo sapiens
ttctgatataacactctagcta

SEQ ID NO: 9313264 - DNA, 22 bp, Homo sapiens
ttctgattgttggaggatgctt

SEQ ID NO: 9313265 - DNA, 19 bp, Homo sapiens
ttctgccctctcttctagc

SEQ ID NO: 9313266 - DNA, 23 bp, Homo sapiens
ttctgcatgtttcagagctggga

SEQ ID NO: 9313267 - DNA, 22 bp, Homo sapiens
ttctccatttaacttccttatg

SEQ ID NO: 9313268 - DNA, 22 bp, Homo sapiens
ttctccctgccaaagctgcctc

SEQ ID NO: 9313269 - DNA, 21 bp, Homo sapiens
ttctccccagcgaatcctcgg

SEQ ID NO: 9313270 - DNA, 22 bp, Homo sapiens
ttctcctctacatagactgtgc

SEQ ID NO: 9313271 - DNA, 22 bp, Homo sapiens
ttctcctctgcaatgactggca

SEQ ID NO: 9313272 - DNA, 17 bp, Homo sapiens
ttctcctctgtgtcctt

SEQ ID NO: 9313273 - DNA, 21 bp, Homo sapiens
ttctcctccaagttgctcctg

SEQ ID NO: 9313274 - DNA, 17 bp, Homo sapiens
ttctcctctgtgtcctt

SEQ ID NO: 9313275 - DNA, 22 bp, Homo sapiens
ttctcctctgttaccttgcaaa

SEQ ID NO: 9313276 - DNA, 22 bp, Homo sapiens
ttctcctcactgcagcctttca

SEQ ID NO: 9313277 - DNA, 22 bp, Homo sapiens
ttctcctcagcaaggcagcttt

SEQ ID NO: 9313278 - DNA, 22 bp, Homo sapiens
ttctcccctttagggcctacgg

SEQ ID NO: 9313279 - DNA, 22 bp, Homo sapiens
ttctcttagctgtaaagtcaat

SEQ ID NO: 9313280 - DNA, 22 bp, Homo sapiens
ttctcttatctggcattattgg

SEQ ID NO: 9313281 - DNA, 22 bp, Homo sapiens
ttctcttagctgtaaagtcaat

SEQ ID NO: 9313282 - DNA, 22 bp, Homo sapiens
ttctcttcatctcagtaaatgt

SEQ ID NO: 9313283 - DNA, 22 bp, Homo sapiens
ttctcttccagccgggcttgca

SEQ ID NO: 9313284 - DNA, 22 bp, Homo sapiens
ttctcttccagccgggcttgca

SEQ ID NO: 9313285 - DNA, 22 bp, Homo sapiens
ttctcttctgttcagtgcccaa

SEQ ID NO: 9313286 - DNA, 23 bp, Homo sapiens
ttctctttagatttacattactc

SEQ ID NO: 9313287 - DNA, 22 bp, Homo sapiens
ttcttcagactccctctttaag

SEQ ID NO: 9313288 - DNA, 22 bp, Homo sapiens
ttcttcagatggtgagacctcc

SEQ ID NO: 9313289 - DNA, 23 bp, Homo sapiens
ttcttcagccttatagccctggg

SEQ ID NO: 9313290 - DNA, 22 bp, Homo sapiens
ttcttcctcagcagggctgcct

SEQ ID NO: 9313291 - DNA, 22 bp, Homo sapiens
ttcttctaaatgtgcttattaa

SEQ ID NO: 9313292 - DNA, 22 bp, Homo sapiens
ttcttctcagggtcccacatgg

SEQ ID NO: 9313293 - DNA, 22 bp, Homo sapiens
ttcttctccgaggagggctggt

SEQ ID NO: 9313294 - DNA, 22 bp, Homo sapiens
ttcttcctctgtaaaaggtgac

SEQ ID NO: 9313295 - DNA, 22 bp, Homo sapiens
ttcttcctcagcagggctgcct

SEQ ID NO: 9313296 - DNA, 22 bp, Homo sapiens
ttcttctacctctgagacttgt

SEQ ID NO: 9313297 - DNA, 22 bp, Homo sapiens
ttctttctttgtagtcctgaac

SEQ ID NO: 9313298 - DNA, 22 bp, Homo sapiens
ttctttgaatagatgttcccag

SEQ ID NO: 9313299 - DNA, 22 bp, Homo sapiens
ttctttgcccttaatgaaataa

SEQ ID NO: 9313300 - DNA, 22 bp, Homo sapiens
ttctttgcccatgtttcctaag

SEQ ID NO: 9313301 - DNA, 23 bp, Homo sapiens
ttctttggaattgggctgcaagg

SEQ ID NO: 9313302 - DNA, 22 bp, Homo sapiens
ttctttgggcaattgctggccc

SEQ ID NO: 9313303 - DNA, 22 bp, Homo sapiens
ttctttgggattgtagctgtct

SEQ ID NO: 9313304 - DNA, 22 bp, Homo sapiens
ttctttggcttacgtctggcct

SEQ ID NO: 9313305 - DNA, 22 bp, Homo sapiens
ttctttggctgccagtctggag

SEQ ID NO: 9313306 - DNA, 22 bp, Homo sapiens
ttctttggggtctccagcatag

SEQ ID NO: 9313307 - DNA, 22 bp, Homo sapiens
ttctttggggaatattctggtt

SEQ ID NO: 9313308 - DNA, 22 bp, Homo sapiens
ttctttcttagcaatctatggt

SEQ ID NO: 9313309 - DNA, 22 bp, Homo sapiens
ttctttcttctcaggctgggta

SEQ ID NO: 9313310 - DNA, 22 bp, Homo sapiens
ttcttctgattgccttctgcaa

SEQ ID NO: 9313311 - DNA, 22 bp, Homo sapiens
ttcttctgattgccttctgcaa

SEQ ID NO: 9313312 - DNA, 22 bp, Homo sapiens
ttcttctgttgaaagggtagag

SEQ ID NO: 9313313 - DNA, 22 bp, Homo sapiens
ttcttctgaaacataatcaata

SEQ ID NO: 9313314 - DNA, 22 bp, Homo sapiens
ttgagggtctggatctgctgct

SEQ ID NO: 9313315 - DNA, 22 bp, Homo sapiens
ttgagacacaaggcacagtaag

SEQ ID NO: 9313316 - DNA, 19 bp, Homo sapiens
ttgagaaatgggaaaagca

SEQ ID NO: 9313317 - DNA, 22 bp, Homo sapiens
ttgaaaaaattggtagaggatg

SEQ ID NO: 9313318 - DNA, 22 bp, Homo sapiens
ttgaaaacatttatattagaat

SEQ ID NO: 9313319 - DNA, 22 bp, Homo sapiens
ttgagaaacctggcagtagaga

SEQ ID NO: 9313320 - DNA, 21 bp, Homo sapiens
ttgaccaagggtgcgtgctcc

SEQ ID NO: 9313321 - DNA, 22 bp, Homo sapiens
agcagggtcctgaggtgagtca

SEQ ID NO: 9313322 - DNA, 22 bp, Homo sapiens
agcagggtatgttagagctgta

SEQ ID NO: 9313323 - DNA, 22 bp, Homo sapiens
agcaggggtggaaggtagcttt

SEQ ID NO: 9313324 - DNA, 22 bp, Homo sapiens
agcaggggtctctgctaatgaa

SEQ ID NO: 9313325 - DNA, 22 bp, Homo sapiens
agcaggggtaacagaaggaaag

SEQ ID NO: 9313326 - DNA, 22 bp, Homo sapiens
agcaggggtaacagaaggaaag

SEQ ID NO: 9313327 - DNA, 22 bp, Homo sapiens
agcagggggccacagtcacagc

SEQ ID NO: 9313328 - DNA, 22 bp, Homo sapiens
agcagggggagttagactagat

SEQ ID NO: 9313329 - DNA, 22 bp, Homo sapiens
agcagggggagttagactagat

SEQ ID NO: 9313330 - DNA, 22 bp, Homo sapiens
agcagggggcatccttgccctt

SEQ ID NO: 9313331 - DNA, 23 bp, Homo sapiens
agcaggctgcttctccacagctg

SEQ ID NO: 9313332 - DNA, 22 bp, Homo sapiens
agcagggctggggcacgagcca

SEQ ID NO: 9313333 - DNA, 22 bp, Homo sapiens
agcaggctgccttccaaagcct

SEQ ID NO: 9313334 - DNA, 22 bp, Homo sapiens
agcaggctgctggcgttgaagt

SEQ ID NO: 9313335 - DNA, 23 bp, Homo sapiens
agcaggctgcttctccacagctg

SEQ ID NO: 9313336 - DNA, 22 bp, Homo sapiens
agcagggctttgtctctgtgaa

SEQ ID NO: 9313337 - DNA, 22 bp, Homo sapiens
agcaggggctcctccacagcca

SEQ ID NO: 9313338 - DNA, 22 bp, Homo sapiens
agcaggggctcctccacagcca

SEQ ID NO: 9313339 - DNA, 22 bp, Homo sapiens
caccctttgctgctcttcctcc

SEQ ID NO: 9313340 - DNA, 22 bp, Homo sapiens
cacctagggtttcgcctttctt

SEQ ID NO: 9313341 - DNA, 22 bp, Homo sapiens
cacctgagactcctcaccatga

SEQ ID NO: 9313342 - DNA, 22 bp, Homo sapiens
cactgctacctctgcctcccgg

SEQ ID NO: 9313343 - DNA, 22 bp, Homo sapiens
cactgctcgctgcagcatggcc

SEQ ID NO: 9313344 - DNA, 22 bp, Homo sapiens
cacacactgttaatgtaggagt

SEQ ID NO: 9313345 - DNA, 22 bp, Homo sapiens
cacacactcttcctggcaccta

SEQ ID NO: 9313346 - DNA, 22 bp, Homo sapiens
cacacacagttttgtattctgt

SEQ ID NO: 9313347 - DNA, 23 bp, Homo sapiens
agcaggataattttattatgccc

SEQ ID NO: 9313348 - DNA, 22 bp, Homo sapiens
agcaggagtttgatgcttttat

SEQ ID NO: 9313349 - DNA, 22 bp, Homo sapiens
agcaggcacaagaaagggaggt

SEQ ID NO: 9313350 - DNA, 22 bp, Homo sapiens
agcagctgccactggaatagga

SEQ ID NO: 9313351 - DNA, 22 bp, Homo sapiens
agcagctgccagagagagttcc

SEQ ID NO: 9313352 - DNA, 22 bp, Homo sapiens
agcagctgatggggaaggagtt

SEQ ID NO: 9313353 - DNA, 22 bp, Homo sapiens
agcagctgcagagggctccccc

SEQ ID NO: 9313354 - DNA, 22 bp, Homo sapiens
agcagctgcagggagggtctgc

SEQ ID NO: 9313355 - DNA, 22 bp, Homo sapiens
cacagtgttccagagcagtggt

SEQ ID NO: 9313356 - DNA, 22 bp, Homo sapiens
cacagtgtttgatttaggggcc

SEQ ID NO: 9313357 - DNA, 22 bp, Homo sapiens
agcaggcaggaatggtggaaca

SEQ ID NO: 9313358 - DNA, 22 bp, Homo sapiens
agcaggcaggaaggcagcactg

SEQ ID NO: 9313359 - DNA, 22 bp, Homo sapiens
agcaggcagctgggggagttga

SEQ ID NO: 9313360 - DNA, 22 bp, Homo sapiens
agcaggcagcctaggaagtgaa

SEQ ID NO: 9313361 - DNA, 22 bp, Homo sapiens
agcaggcactatgccaggatct

SEQ ID NO: 9313362 - DNA, 22 bp, Homo sapiens
agcaggcagccatttggaaggc

SEQ ID NO: 9313363 - DNA, 22 bp, Homo sapiens
agcaggctgatgggcatgcttg

SEQ ID NO: 9313364 - DNA, 22 bp, Homo sapiens
agcaggctgagcacccaggggg

SEQ ID NO: 9313365 - DNA, 22 bp, Homo sapiens
agcaggctgatgggcatgcttg

SEQ ID NO: 9313366 - DNA, 17 bp, Homo sapiens
agcaggctgcagaggcc

SEQ ID NO: 9313367 - DNA, 20 bp, Homo sapiens
agcaggctgcagggtgaaat

SEQ ID NO: 9313368 - DNA, 20 bp, Homo sapiens
agcaggctgcagggtgaaat

SEQ ID NO: 9313369 - DNA, 22 bp, Homo sapiens
agcaggctccttccttctctgg

SEQ ID NO: 9313370 - DNA, 22 bp, Homo sapiens
agcaggctgagcacccaggggg

SEQ ID NO: 9313371 - DNA, 22 bp, Homo sapiens
agcaggctccttccttctctgg

SEQ ID NO: 9313372 - DNA, 22 bp, Homo sapiens
agcaggctccaggctggccatc

SEQ ID NO: 9313373 - DNA, 22 bp, Homo sapiens
agcaaagagtaattttgttttg

SEQ ID NO: 9313374 - DNA, 22 bp, Homo sapiens
agcaaacctgcagccttctgag

SEQ ID NO: 9313375 - DNA, 22 bp, Homo sapiens
agcaaagaagggttcttcatta

SEQ ID NO: 9313376 - DNA, 22 bp, Homo sapiens
caaatagacttcaatctcttga

SEQ ID NO: 9313377 - DNA, 22 bp, Homo sapiens
agcacagtttcttttccttgtc

SEQ ID NO: 9313378 - DNA, 22 bp, Homo sapiens
agcacagtgaatggtttactca

SEQ ID NO: 9313379 - DNA, 22 bp, Homo sapiens
agcaccaggccatggggtccct

SEQ ID NO: 9313380 - DNA, 22 bp, Homo sapiens
caagagacgggcaaggcaagag

SEQ ID NO: 9313381 - DNA, 22 bp, Homo sapiens
agcaccagcaactatgggctgc

SEQ ID NO: 9313382 - DNA, 22 bp, Homo sapiens
agcaccagcgtgggggccgttg

SEQ ID NO: 9313383 - DNA, 22 bp, Homo sapiens
agcaccaggaaagaaggggcca

SEQ ID NO: 9313384 - DNA, 22 bp, Homo sapiens
agcaccagctcaaggtgcacct

SEQ ID NO: 9313385 - DNA, 22 bp, Homo sapiens
caaatagtttttcatgtattat

SEQ ID NO: 9313386 - DNA, 22 bp, Homo sapiens
caaattaatgtgtctcaaaata

SEQ ID NO: 9313387 - DNA, 22 bp, Homo sapiens
caaatagtgtcacattgtgagg

SEQ ID NO: 9313388 - DNA, 22 bp, Homo sapiens
caacagctcagacacgggacct

SEQ ID NO: 9313389 - DNA, 22 bp, Homo sapiens
caacagctggaggcttggcccg

SEQ ID NO: 9313390 - DNA, 23 bp, Homo sapiens
caacagctgttagatatgggctt

SEQ ID NO: 9313391 - DNA, 22 bp, Homo sapiens
agcagcaggctgtgtggactga

SEQ ID NO: 9313392 - DNA, 22 bp, Homo sapiens
agcagcaggctagggaactgct

SEQ ID NO: 9313393 - DNA, 22 bp, Homo sapiens
agcagcaggctagggaactgct

SEQ ID NO: 9313394 - DNA, 22 bp, Homo sapiens
agcagcagctctgttgccctac

SEQ ID NO: 9313395 - DNA, 22 bp, Homo sapiens
agcagcagattatggtctacat

SEQ ID NO: 9313396 - DNA, 20 bp, Homo sapiens
agcagcagatgttggaggtg

SEQ ID NO: 9313397 - DNA, 22 bp, Homo sapiens
agcagcaggagccgtggggtga

SEQ ID NO: 9313398 - DNA, 22 bp, Homo sapiens
agcagcaggaggccattgtctt

SEQ ID NO: 9313399 - DNA, 22 bp, Homo sapiens
caagcactgttaggttgcttgc

SEQ ID NO: 9313400 - DNA, 22 bp, Homo sapiens
caagcaacgactttcaagctgt

SEQ ID NO: 9313401 - DNA, 22 bp, Homo sapiens
caagcagacagtaggcctagaa

SEQ ID NO: 9313402 - DNA, 22 bp, Homo sapiens
caagcaacgactttcaagctgt

SEQ ID NO: 9313403 - DNA, 20 bp, Homo sapiens
cacaagaggagttccctgag

SEQ ID NO: 9313404 - DNA, 22 bp, Homo sapiens
cacaaggctttcatctggcata

SEQ ID NO: 9313405 - DNA, 22 bp, Homo sapiens
caatttttgtacttatagtact

SEQ ID NO: 9313406 - DNA, 22 bp, Homo sapiens
agcagcagggtcattgctcttt

SEQ ID NO: 9313407 - DNA, 22 bp, Homo sapiens
caattttttccatgctcttaca

SEQ ID NO: 9313408 - DNA, 22 bp, Homo sapiens
agcctggatcctaggctcagct

SEQ ID NO: 9313409 - DNA, 20 bp, Homo sapiens
agcctggcaaacacccccag

SEQ ID NO: 9313410 - DNA, 22 bp, Homo sapiens
cagcagggcccccgggtgcgcc

SEQ ID NO: 9313411 - DNA, 23 bp, Homo sapiens
agcctggcacctgcagatcggag

SEQ ID NO: 9313412 - DNA, 22 bp, Homo sapiens
agcctggcactgaggcagggcg

SEQ ID NO: 9313413 - DNA, 22 bp, Homo sapiens
agcctggcactgaggcagggcg

SEQ ID NO: 9313414 - DNA, 22 bp, Homo sapiens
cagcagctgactccaagagagc

SEQ ID NO: 9313415 - DNA, 22 bp, Homo sapiens
cagcagcattgctctggattcc

SEQ ID NO: 9313416 - DNA, 22 bp, Homo sapiens
agcctgagagccaagctgtgca

SEQ ID NO: 9313417 - DNA, 22 bp, Homo sapiens
cagaggtgacccatagtacctc

SEQ ID NO: 9313418 - DNA, 21 bp, Homo sapiens
cagaggtcatcctgaggacaa

SEQ ID NO: 9313419 - DNA, 22 bp, Homo sapiens
cagaggtccctgttcttaagga

SEQ ID NO: 9313420 - DNA, 22 bp, Homo sapiens
cagaggtgctggagtgagtcct

SEQ ID NO: 9313421 - DNA, 19 bp, Homo sapiens
cagaggtgatatatgccca

SEQ ID NO: 9313422 - DNA, 22 bp, Homo sapiens
cagaggtgcatacaggtcatta

SEQ ID NO: 9313423 - DNA, 22 bp, Homo sapiens
agcctctgctggccctggcact

SEQ ID NO: 9313424 - DNA, 18 bp, Homo sapiens
agcctctggcagagagaa

SEQ ID NO: 9313425 - DNA, 22 bp, Homo sapiens
agcctctgcacgggcacgggtg

SEQ ID NO: 9313426 - DNA, 22 bp, Homo sapiens
agcctctgatggctcccaagga

SEQ ID NO: 9313427 - DNA, 22 bp, Homo sapiens
agcctctgtgactcacaggtca

SEQ ID NO: 9313428 - DNA, 22 bp, Homo sapiens
agcctctggtcctccctcagct

SEQ ID NO: 9313429 - DNA, 22 bp, Homo sapiens
agcctctggccctagactgctt

SEQ ID NO: 9313430 - DNA, 22 bp, Homo sapiens
cagcgtctcgttgtgggcctcg

SEQ ID NO: 9313431 - DNA, 22 bp, Homo sapiens
agctcaggcaactctgggcccc

SEQ ID NO: 9313432 - DNA, 22 bp, Homo sapiens
cagctaagccacactcagatgg

SEQ ID NO: 9313433 - DNA, 22 bp, Homo sapiens
cagctaagaatgtctgagatca

SEQ ID NO: 9313434 - DNA, 22 bp, Homo sapiens
cagctcaggcactggcgcggga

SEQ ID NO: 9313435 - DNA, 22 bp, Homo sapiens
cagctcagtctggagagatgca

SEQ ID NO: 9313436 - DNA, 21 bp, Homo sapiens
agctcagccgggcacagtggc

SEQ ID NO: 9313437 - DNA, 22 bp, Homo sapiens
agctcagccctcctgtgcagct

SEQ ID NO: 9313438 - DNA, 22 bp, Homo sapiens
agctcagcttcctctccatgct

SEQ ID NO: 9313439 - DNA, 22 bp, Homo sapiens
agctcagcactgtcagcactcc

SEQ ID NO: 9313440 - DNA, 22 bp, Homo sapiens
agctcctgagtagctttactca

SEQ ID NO: 9313441 - DNA, 23 bp, Homo sapiens
agctcctgaggccagcctctcct

SEQ ID NO: 9313442 - DNA, 22 bp, Homo sapiens
agctcctgatacatgcaggaat

SEQ ID NO: 9313443 - DNA, 22 bp, Homo sapiens
cagctcagtcttgaagcactgg

SEQ ID NO: 9313444 - DNA, 22 bp, Homo sapiens
cagctcagtcttgaagcactgg

SEQ ID NO: 9313445 - DNA, 22 bp, Homo sapiens
cagctcagtgatgccttcacag

SEQ ID NO: 9313446 - DNA, 22 bp, Homo sapiens
cagctccaaagccccactgtcc

SEQ ID NO: 9313447 - DNA, 18 bp, Homo sapiens
agctcctgaactctgtgg

SEQ ID NO: 9313448 - DNA, 22 bp, Homo sapiens
cagcagggtaggttgtatcagt

SEQ ID NO: 9313449 - DNA, 22 bp, Homo sapiens
cagcagggggcagcgcagatca

SEQ ID NO: 9313450 - DNA, 22 bp, Homo sapiens
cagcagttgtttcggattggga

SEQ ID NO: 9313451 - DNA, 22 bp, Homo sapiens
cagccctgagagaaccatctat

SEQ ID NO: 9313452 - DNA, 22 bp, Homo sapiens
cagccctgagaaggaggatctc

SEQ ID NO: 9313453 - DNA, 22 bp, Homo sapiens
cagccctgcagagggcgctcct

SEQ ID NO: 9313454 - DNA, 22 bp, Homo sapiens
cagccctgagttagcccacgga

SEQ ID NO: 9313455 - DNA, 22 bp, Homo sapiens
cagccctgagcaaggcttttaa

SEQ ID NO: 9313456 - DNA, 20 bp, Homo sapiens
agccacctcatttccctacc

SEQ ID NO: 9313457 - DNA, 22 bp, Homo sapiens
agccactggcctgggcagctct

SEQ ID NO: 9313458 - DNA, 22 bp, Homo sapiens
agccactggtaaactggtagga

SEQ ID NO: 9313459 - DNA, 20 bp, Homo sapiens
agccagaagaaggctggaga

SEQ ID NO: 9313460 - DNA, 21 bp, Homo sapiens
cagaatccagtctcttattac

SEQ ID NO: 9313461 - DNA, 22 bp, Homo sapiens
agccactgtgcaggagcagtgt

SEQ ID NO: 9313462 - DNA, 22 bp, Homo sapiens
agccactgtgtgaccagctgtc

SEQ ID NO: 9313463 - DNA, 22 bp, Homo sapiens
cagaatggcttttatggctcag

SEQ ID NO: 9313464 - DNA, 22 bp, Homo sapiens
agcccaggctggagtgcagtgg

SEQ ID NO: 9313465 - DNA, 20 bp, Homo sapiens
agcccaggcctgtgtgagtc

SEQ ID NO: 9313466 - DNA, 22 bp, Homo sapiens
agcccagggaaccaggaagtgg

SEQ ID NO: 9313467 - DNA, 22 bp, Homo sapiens
agcccagggaaccaggaagtgg

SEQ ID NO: 9313468 - DNA, 22 bp, Homo sapiens
cagaggctcttcctcactgccc

SEQ ID NO: 9313469 - DNA, 22 bp, Homo sapiens
cagagggagccctccaggagca

SEQ ID NO: 9313470 - DNA, 22 bp, Homo sapiens
cagagggagccctccaggagca

SEQ ID NO: 9313471 - DNA, 22 bp, Homo sapiens
cagagggacagtgtaatgcata

SEQ ID NO: 9313472 - DNA, 22 bp, Homo sapiens
agcccaggcagagggatgcttg

SEQ ID NO: 9313473 - DNA, 22 bp, Homo sapiens
agcccaggcagagggatgcttg

SEQ ID NO: 9313474 - DNA, 20 bp, Homo sapiens
cagaggcattttcagactct

SEQ ID NO: 9313475 - DNA, 22 bp, Homo sapiens
cagaggcattactgaaaaggtg

SEQ ID NO: 9313476 - DNA, 21 bp, Homo sapiens
cagaggcaggtcctgggacgg

SEQ ID NO: 9313477 - DNA, 21 bp, Homo sapiens
cagaggcaggtcctgggacgg

SEQ ID NO: 9313478 - DNA, 21 bp, Homo sapiens
cagaggcaggctctgtgtgtg

SEQ ID NO: 9313479 - DNA, 22 bp, Homo sapiens
agccatcctactacctcagcat

SEQ ID NO: 9313480 - DNA, 22 bp, Homo sapiens
agcccaagctatgaggtgacct

SEQ ID NO: 9313481 - DNA, 22 bp, Homo sapiens
cagagaaagggtgaattccttc

SEQ ID NO: 9313482 - DNA, 22 bp, Homo sapiens
cagagaaagaagcccattcatt

SEQ ID NO: 9313483 - DNA, 22 bp, Homo sapiens
agcccagagacaatgctcagta

SEQ ID NO: 9313484 - DNA, 22 bp, Homo sapiens
agcccactgttttcatttctct

SEQ ID NO: 9313485 - DNA, 22 bp, Homo sapiens
agaggcagaagtgttcaaaccc

SEQ ID NO: 9313486 - DNA, 22 bp, Homo sapiens
attattatggttgctcttttcc

SEQ ID NO: 9313487 - DNA, 22 bp, Homo sapiens
attattattttagagagaggcc

SEQ ID NO: 9313488 - DNA, 21 bp, Homo sapiens
attattatttctgtgtccagc

SEQ ID NO: 9313489 - DNA, 22 bp, Homo sapiens
attattattgttgatgttaggg

SEQ ID NO: 9313490 - DNA, 22 bp, Homo sapiens
attattagacttatatggtagt

SEQ ID NO: 9313491 - DNA, 22 bp, Homo sapiens
attattagtgatgttgttactg

SEQ ID NO: 9313492 - DNA, 22 bp, Homo sapiens
attattaggtgctctctgacaa

SEQ ID NO: 9313493 - DNA, 22 bp, Homo sapiens
attattagattcttaattgtaa

SEQ ID NO: 9313494 - DNA, 22 bp, Homo sapiens
attattataaagtgcatgacct

SEQ ID NO: 9313495 - DNA, 22 bp, Homo sapiens
attattatatagggaaagtccc

SEQ ID NO: 9313496 - DNA, 21 bp, Homo sapiens
attattataaagaccacaggg

SEQ ID NO: 9313497 - DNA, 22 bp, Homo sapiens
agaggaggctctgggatcgtcc

SEQ ID NO: 9313498 - DNA, 22 bp, Homo sapiens
agaggagcctcagtttgcagcc

SEQ ID NO: 9313499 - DNA, 22 bp, Homo sapiens
atgtttacaattcagtattaca

SEQ ID NO: 9313500 - DNA, 22 bp, Homo sapiens
atgtttatggagcaggtattag

SEQ ID NO: 9313501 - DNA, 21 bp, Homo sapiens
agagctggtaggtaggtaggt

SEQ ID NO: 9313502 - DNA, 21 bp, Homo sapiens
agagctgggacttgcctgaga

SEQ ID NO: 9313503 - DNA, 22 bp, Homo sapiens
agagctgtggatagtcctggat

SEQ ID NO: 9313504 - DNA, 22 bp, Homo sapiens
agagctgtgttaagaacaggcc

SEQ ID NO: 9313505 - DNA, 22 bp, Homo sapiens
agagctgttcaacgtagcaatg

SEQ ID NO: 9313506 - DNA, 22 bp, Homo sapiens
agagctgttcagcagccaggtt

SEQ ID NO: 9313507 - DNA, 22 bp, Homo sapiens
agagctgtagcttcctagagcc

SEQ ID NO: 9313508 - DNA, 22 bp, Homo sapiens
agagctgtatccccttaccagt

SEQ ID NO: 9313509 - DNA, 22 bp, Homo sapiens
agagctgtgctttgcaccacgt

SEQ ID NO: 9313510 - DNA, 17 bp, Homo sapiens
agaggcagatacttgga

SEQ ID NO: 9313511 - DNA, 17 bp, Homo sapiens
agaggcagatacttgga

SEQ ID NO: 9313512 - DNA, 17 bp, Homo sapiens
agaggcagatacttgga

SEQ ID NO: 9313513 - DNA, 22 bp, Homo sapiens
agaggcagcagtcatactacag

SEQ ID NO: 9313514 - DNA, 22 bp, Homo sapiens
agaggcaggaagagctgatttt

SEQ ID NO: 9313515 - DNA, 22 bp, Homo sapiens
agaggcagccgtatttcaaagg

SEQ ID NO: 9313516 - DNA, 22 bp, Homo sapiens
agaggcaggaggttgacttgag

SEQ ID NO: 9313517 - DNA, 22 bp, Homo sapiens
agaggcaggaagagctgatttt

SEQ ID NO: 9313518 - DNA, 22 bp, Homo sapiens
agaggctcctagccactggctt

SEQ ID NO: 9313519 - DNA, 22 bp, Homo sapiens
agaggcggagcttgcagtgagc

SEQ ID NO: 9313520 - DNA, 22 bp, Homo sapiens
agaggcggaggttgcagtgagc

SEQ ID NO: 9313521 - DNA, 22 bp, Homo sapiens
attcattggcttgaactccacc

SEQ ID NO: 9313522 - DNA, 22 bp, Homo sapiens
attccagagaggttctggaggt

SEQ ID NO: 9313523 - DNA, 22 bp, Homo sapiens
attccagaataccggcaagatg

SEQ ID NO: 9313524 - DNA, 23 bp, Homo sapiens
attccagagctagagtcaagtgg

SEQ ID NO: 9313525 - DNA, 22 bp, Homo sapiens
attccagatgaattgcatagtt

SEQ ID NO: 9313526 - DNA, 22 bp, Homo sapiens
agagggaatgtgattgcaccat

SEQ ID NO: 9313527 - DNA, 22 bp, Homo sapiens
agaggctgtctcatattttgta

SEQ ID NO: 9313528 - DNA, 18 bp, Homo sapiens
agagggaaagcaggctga

SEQ ID NO: 9313529 - DNA, 17 bp, Homo sapiens
agagggaaaatgcggtt

SEQ ID NO: 9313530 - DNA, 22 bp, Homo sapiens
agagggaaatccaggagtgctt

SEQ ID NO: 9313531 - DNA, 22 bp, Homo sapiens
agagggaacggatcccagcgcg

SEQ ID NO: 9313532 - DNA, 22 bp, Homo sapiens
attcccacagctggtataaata

SEQ ID NO: 9313533 - DNA, 22 bp, Homo sapiens
attcccaccaacaatgtacagg

SEQ ID NO: 9313534 - DNA, 17 bp, Homo sapiens
atttcctcagggctgag

SEQ ID NO: 9313535 - DNA, 22 bp, Homo sapiens
atttccagcagcatatttgtct

SEQ ID NO: 9313536 - DNA, 22 bp, Homo sapiens
atttcctatacagttgtccata

SEQ ID NO: 9313537 - DNA, 22 bp, Homo sapiens
atttccagcataggcttattga

SEQ ID NO: 9313538 - DNA, 16 bp, Homo sapiens
atttccagattatgca

SEQ ID NO: 9313539 - DNA, 17 bp, Homo sapiens
atttccagagtggccct

SEQ ID NO: 9313540 - DNA, 22 bp, Homo sapiens
atttgctttgggacagcttaaa

SEQ ID NO: 9313541 - DNA, 21 bp, Homo sapiens
atttggatattgctggcaaat

SEQ ID NO: 9313542 - DNA, 22 bp, Homo sapiens
atttctcctccagatggtggtt

SEQ ID NO: 9313543 - DNA, 22 bp, Homo sapiens
atttctccttgttgcaatgcag

SEQ ID NO: 9313544 - DNA, 22 bp, Homo sapiens
atttccttcagtgtttaatact

SEQ ID NO: 9313545 - DNA, 22 bp, Homo sapiens
atttctcatcaagtgccaactc

SEQ ID NO: 9313546 - DNA, 22 bp, Homo sapiens
atttctcagttcctactgttta

SEQ ID NO: 9313547 - DNA, 22 bp, Homo sapiens
atttgtgttgtattaagctgct

SEQ ID NO: 9313548 - DNA, 22 bp, Homo sapiens
atttgtgccaaattatttctaa

SEQ ID NO: 9313549 - DNA, 22 bp, Homo sapiens
atttgtgcatatcccatccacc

SEQ ID NO: 9313550 - DNA, 22 bp, Homo sapiens
atttgtgataatttgttacagc

SEQ ID NO: 9313551 - DNA, 22 bp, Homo sapiens
atttggctagcttatggttata

SEQ ID NO: 9313552 - DNA, 22 bp, Homo sapiens
atttggctaattaaatttggag

SEQ ID NO: 9313553 - DNA, 22 bp, Homo sapiens
atttggctaccatgaggatggg

SEQ ID NO: 9313554 - DNA, 22 bp, Homo sapiens
atttggctattgaattattcct

SEQ ID NO: 9313555 - DNA, 22 bp, Homo sapiens
atttggctgggtgttagaaaga

SEQ ID NO: 9313556 - DNA, 22 bp, Homo sapiens
atttggctgactcactaattgt

SEQ ID NO: 9313557 - DNA, 22 bp, Homo sapiens
atttggctgtagtaactggatc

SEQ ID NO: 9313558 - DNA, 22 bp, Homo sapiens
atttggcaaataatttgagggt

SEQ ID NO: 9313559 - DNA, 22 bp, Homo sapiens
atttggcaaaagttagaagaaa

SEQ ID NO: 9313560 - DNA, 22 bp, Homo sapiens
atttggattcttatttagcact

SEQ ID NO: 9313561 - DNA, 22 bp, Homo sapiens
atttggcaaaaattagcagtag

SEQ ID NO: 9313562 - DNA, 22 bp, Homo sapiens
atttggcaatgctagagaagtt

SEQ ID NO: 9313563 - DNA, 22 bp, Homo sapiens
atttggcagccacagcaatctt

SEQ ID NO: 9313564 - DNA, 18 bp, Homo sapiens
atttggcagatgatgaac

SEQ ID NO: 9313565 - DNA, 22 bp, Homo sapiens
atttggcatagagtatcattct

SEQ ID NO: 9313566 - DNA, 22 bp, Homo sapiens
attttttgttaactcaggatag

SEQ ID NO: 9313567 - DNA, 22 bp, Homo sapiens
atttgttgaataaattagtatt

SEQ ID NO: 9313568 - DNA, 22 bp, Homo sapiens
atttattgaagcttattacgtt

SEQ ID NO: 9313569 - DNA, 22 bp, Homo sapiens
agataaaatggttcaaaggcta

SEQ ID NO: 9313570 - DNA, 22 bp, Homo sapiens
agataaaatggttcaaaggcta

SEQ ID NO: 9313571 - DNA, 17 bp, Homo sapiens
atttcacttagcatgag

SEQ ID NO: 9313572 - DNA, 22 bp, Homo sapiens
atttcacattaatttgatgctc

SEQ ID NO: 9313573 - DNA, 22 bp, Homo sapiens
atttcacagctgtcagtgttac

SEQ ID NO: 9313574 - DNA, 22 bp, Homo sapiens
attgctgactttaatattatat

SEQ ID NO: 9313575 - DNA, 22 bp, Homo sapiens
attgctgactcaataattgaag

SEQ ID NO: 9313576 - DNA, 22 bp, Homo sapiens
agaggtctatgctaggggaact

SEQ ID NO: 9313577 - DNA, 22 bp, Homo sapiens
agaggtctgactcagcagatta

SEQ ID NO: 9313578 - DNA, 21 bp, Homo sapiens
agaggtcattgggctggttct

SEQ ID NO: 9313579 - DNA, 21 bp, Homo sapiens
agaggtcattgggctggttct

SEQ ID NO: 9313580 - DNA, 22 bp, Homo sapiens
attgctgaaatgaaaggatatg

SEQ ID NO: 9313581 - DNA, 22 bp, Homo sapiens
attgctgaaagtattttatgac

SEQ ID NO: 9313582 - DNA, 21 bp, Homo sapiens
attgctctgttgtgtctagaa

SEQ ID NO: 9313583 - DNA, 22 bp, Homo sapiens
attgctctgcaatcctccccaa

SEQ ID NO: 9313584 - DNA, 22 bp, Homo sapiens
attgcctgaaaacagaaagtct

SEQ ID NO: 9313585 - DNA, 22 bp, Homo sapiens
attgccttgtcagatttctttt

SEQ ID NO: 9313586 - DNA, 22 bp, Homo sapiens
attgcctgccactctgtgagga

SEQ ID NO: 9313587 - DNA, 22 bp, Homo sapiens
attgcctggggaagagggtgtt

SEQ ID NO: 9313588 - DNA, 22 bp, Homo sapiens
attgcctgttgaagattcgaca

SEQ ID NO: 9313589 - DNA, 22 bp, Homo sapiens
agaggtctgagcaatctcaagc

SEQ ID NO: 9313590 - DNA, 22 bp, Homo sapiens
agagtttcttgtgagcactgac

SEQ ID NO: 9313591 - DNA, 22 bp, Homo sapiens
agaagtccccccagcatcgtag

SEQ ID NO: 9313592 - DNA, 21 bp, Homo sapiens
agaagtccccactctgtcgca

SEQ ID NO: 9313593 - DNA, 22 bp, Homo sapiens
agaagtcaagtggtctatgaaa

SEQ ID NO: 9313594 - DNA, 22 bp, Homo sapiens
atgaaactctaacttaacaagt

SEQ ID NO: 9313595 - DNA, 22 bp, Homo sapiens
agaagtttggatgccatcatag

SEQ ID NO: 9313596 - DNA, 22 bp, Homo sapiens
agaagtggtgtgtggccgagct

SEQ ID NO: 9313597 - DNA, 23 bp, Homo sapiens
agaagtggaatggccgtggggtc

SEQ ID NO: 9313598 - DNA, 22 bp, Homo sapiens
agaagtggtctgtcttccagat

SEQ ID NO: 9313599 - DNA, 20 bp, Homo sapiens
agaagtggctgcagacacta

SEQ ID NO: 9313600 - DNA, 22 bp, Homo sapiens
agaagtttatttatgccccaat

SEQ ID NO: 9313601 - DNA, 22 bp, Homo sapiens
atgaaagtgaaggtttactaag

SEQ ID NO: 9313602 - DNA, 22 bp, Homo sapiens
atgaaagtggcttgattaaatg

SEQ ID NO: 9313603 - DNA, 22 bp, Homo sapiens
atgaaagatgatttaaagtact

SEQ ID NO: 9313604 - DNA, 22 bp, Homo sapiens
agacaaatggtaattatgtcta

SEQ ID NO: 9313605 - DNA, 22 bp, Homo sapiens
agacaaattgggacattgtgtt

SEQ ID NO: 9313606 - DNA, 22 bp, Homo sapiens
agacaaatgaacaaatatgtga

SEQ ID NO: 9313607 - DNA, 22 bp, Homo sapiens
agacaaataactttttatgtcc

SEQ ID NO: 9313608 - DNA, 22 bp, Homo sapiens
agacaaagacagcatctcaggt

SEQ ID NO: 9313609 - DNA, 22 bp, Homo sapiens
agacaaagaaaccgtagaagca

SEQ ID NO: 9313610 - DNA, 23 bp, Homo sapiens
agacaaacttccttcactgcacc

SEQ ID NO: 9313611 - DNA, 18 bp, Homo sapiens
agaattgctgcttcttct

SEQ ID NO: 9313612 - DNA, 22 bp, Homo sapiens
agaattgctaactctcctcctg

SEQ ID NO: 9313613 - DNA, 22 bp, Homo sapiens
agacagacatagaaattagtaa

SEQ ID NO: 9313614 - DNA, 22 bp, Homo sapiens
atgacaaaggctgaaagggaaa

SEQ ID NO: 9313615 - DNA, 22 bp, Homo sapiens
atgcacataggccaaatcattt

SEQ ID NO: 9313616 - DNA, 22 bp, Homo sapiens
atgcaagacataaataatcttt

SEQ ID NO: 9313617 - DNA, 22 bp, Homo sapiens
agacagcatgatacatgatgct

SEQ ID NO: 9313618 - DNA, 22 bp, Homo sapiens
agacagcatttctagcaccagg

SEQ ID NO: 9313619 - DNA, 22 bp, Homo sapiens
agacagctaataaatgagtgtg

SEQ ID NO: 9313620 - DNA, 22 bp, Homo sapiens
agacaggacacaagctgcataa

SEQ ID NO: 9313621 - DNA, 22 bp, Homo sapiens
atgtatttgcttgttatggatt

SEQ ID NO: 9313622 - DNA, 22 bp, Homo sapiens
atgtggggacaaaatgatggcc

SEQ ID NO: 9313623 - DNA, 22 bp, Homo sapiens
atgtggggactctgagagaatt

SEQ ID NO: 9313624 - DNA, 22 bp, Homo sapiens
atgtgggccgtgcgggtgtcct

SEQ ID NO: 9313625 - DNA, 22 bp, Homo sapiens
agagcctgggcagctcctctgg

SEQ ID NO: 9313626 - DNA, 22 bp, Homo sapiens
agagatggagagcactggggct

SEQ ID NO: 9313627 - DNA, 22 bp, Homo sapiens
agagatggagagcactggggct

SEQ ID NO: 9313628 - DNA, 22 bp, Homo sapiens
agagatgctgacgtttacattt

SEQ ID NO: 9313629 - DNA, 22 bp, Homo sapiens
agagatgccacctttttgctgt

SEQ ID NO: 9313630 - DNA, 22 bp, Homo sapiens
agagatgaatcttgagactctg

SEQ ID NO: 9313631 - DNA, 22 bp, Homo sapiens
agagatggccttaggtgggaat

SEQ ID NO: 9313632 - DNA, 22 bp, Homo sapiens
agagcagcctcagctccctgtg

SEQ ID NO: 9313633 - DNA, 19 bp, Homo sapiens
agagccagacagcatagga

SEQ ID NO: 9313634 - DNA, 19 bp, Homo sapiens
agagccagacagcatagga

SEQ ID NO: 9313635 - DNA, 19 bp, Homo sapiens
agagccagacagcatagga

SEQ ID NO: 9313636 - DNA, 22 bp, Homo sapiens
agagccactgggagacagagca

SEQ ID NO: 9313637 - DNA, 22 bp, Homo sapiens
atggctagcaccgcgttgctgg

SEQ ID NO: 9313638 - DNA, 22 bp, Homo sapiens
atggctaaacctgaactggtct

SEQ ID NO: 9313639 - DNA, 22 bp, Homo sapiens
atggctaatacgccactggaca

SEQ ID NO: 9313640 - DNA, 22 bp, Homo sapiens
agagaagcattcttctcagggc

SEQ ID NO: 9313641 - DNA, 22 bp, Homo sapiens
agagaagcattcttctcagggc

SEQ ID NO: 9313642 - DNA, 22 bp, Homo sapiens
agagaagcagggagtcatctgt

SEQ ID NO: 9313643 - DNA, 19 bp, Homo sapiens
agagaccacagagctgcct

SEQ ID NO: 9313644 - DNA, 23 bp, Homo sapiens
agacccagagactggctctgctc

SEQ ID NO: 9313645 - DNA, 22 bp, Homo sapiens
atggccagcttataggggctca

SEQ ID NO: 9313646 - DNA, 22 bp, Homo sapiens
agaccattccctggaagaatat

SEQ ID NO: 9313647 - DNA, 22 bp, Homo sapiens
agacattttacattcttccatt

SEQ ID NO: 9313648 - DNA, 22 bp, Homo sapiens
agaccacagtcaggctcctggt

SEQ ID NO: 9313649 - DNA, 22 bp, Homo sapiens
agacattttggaaagtattact

SEQ ID NO: 9313650 - DNA, 22 bp, Homo sapiens
agggctgcctgactccagagcc

SEQ ID NO: 9313651 - DNA, 22 bp, Homo sapiens
accctccactttatctgtcttt

SEQ ID NO: 9313652 - DNA, 20 bp, Homo sapiens
accctccactgttcactgtg

SEQ ID NO: 9313653 - DNA, 22 bp, Homo sapiens
agggggcatcaggtcctggctc

SEQ ID NO: 9313654 - DNA, 22 bp, Homo sapiens
aggggcctggacatggacgcgc

SEQ ID NO: 9313655 - DNA, 22 bp, Homo sapiens
acccaggagagagctataaaat

SEQ ID NO: 9313656 - DNA, 22 bp, Homo sapiens
agggctgacagtgaggagtcaa

SEQ ID NO: 9313657 - DNA, 22 bp, Homo sapiens
acccaggagacggaggtgcagt

SEQ ID NO: 9313658 - DNA, 22 bp, Homo sapiens
acccaggagacaggttgcagtg

SEQ ID NO: 9313659 - DNA, 22 bp, Homo sapiens
acccaggactctcttccagtag

SEQ ID NO: 9313660 - DNA, 22 bp, Homo sapiens
acccaggacatgggcacccgtg

SEQ ID NO: 9313661 - DNA, 22 bp, Homo sapiens
acccaggacacagagatgaccc

SEQ ID NO: 9313662 - DNA, 22 bp, Homo sapiens
acccaggacttggcaacctcat

SEQ ID NO: 9313663 - DNA, 22 bp, Homo sapiens
acccaggaaaacatggtgcaga

SEQ ID NO: 9313664 - DNA, 22 bp, Homo sapiens
acccaggacaaaataaccaggt

SEQ ID NO: 9313665 - DNA, 22 bp, Homo sapiens
acccagagcagagcttggcttc

SEQ ID NO: 9313666 - DNA, 22 bp, Homo sapiens
accaggctggagtgcagtggcg

SEQ ID NO: 9313667 - DNA, 19 bp, Homo sapiens
accaggcctcagaggccct

SEQ ID NO: 9313668 - DNA, 22 bp, Homo sapiens
accaggcctggctgggcagcca

SEQ ID NO: 9313669 - DNA, 22 bp, Homo sapiens
accagcagttatgaggccagga

SEQ ID NO: 9313670 - DNA, 22 bp, Homo sapiens
accagcagggctgggccaatgg

SEQ ID NO: 9313671 - DNA, 20 bp, Homo sapiens
acatttgtatctcccagtgg

SEQ ID NO: 9313672 - DNA, 22 bp, Homo sapiens
acatttgtatatatgcagcata

SEQ ID NO: 9313673 - DNA, 22 bp, Homo sapiens
acatttgtaggacagaggaaga

SEQ ID NO: 9313674 - DNA, 22 bp, Homo sapiens
acatttgtacattggcatgtct

SEQ ID NO: 9313675 - DNA, 18 bp, Homo sapiens
acatttggggagttaagt

SEQ ID NO: 9313676 - DNA, 22 bp, Homo sapiens
acatttggtaacacttgagcat

SEQ ID NO: 9313677 - DNA, 22 bp, Homo sapiens
acatttgtatgcgtttttactg

SEQ ID NO: 9313678 - DNA, 22 bp, Homo sapiens
accagcagctgccagagtggag

SEQ ID NO: 9313679 - DNA, 22 bp, Homo sapiens
aggctttaagtggcctacagct

SEQ ID NO: 9313680 - DNA, 22 bp, Homo sapiens
aggctttaattatctacaggag

SEQ ID NO: 9313681 - DNA, 23 bp, Homo sapiens
aggctttaatctgatattcagat

SEQ ID NO: 9313682 - DNA, 22 bp, Homo sapiens
aggctttacgtcttcccctggg

SEQ ID NO: 9313683 - DNA, 20 bp, Homo sapiens
aggcttggcttggcaggaac

SEQ ID NO: 9313684 - DNA, 22 bp, Homo sapiens
aggcttggtgccaaggagcctg

SEQ ID NO: 9313685 - DNA, 17 bp, Homo sapiens
accagcctctcctgggg

SEQ ID NO: 9313686 - DNA, 22 bp, Homo sapiens
accagcctggccaacatggcaa

SEQ ID NO: 9313687 - DNA, 22 bp, Homo sapiens
accagctcagaagccagaaaga

SEQ ID NO: 9313688 - DNA, 22 bp, Homo sapiens
accagcctgtctgagtcgtggg

SEQ ID NO: 9313689 - DNA, 22 bp, Homo sapiens
agggcacttcagtcagactgag

SEQ ID NO: 9313690 - DNA, 22 bp, Homo sapiens
accagctcataattttcaaaac

SEQ ID NO: 9313691 - DNA, 18 bp, Homo sapiens
aggcctgcccagcactgt

SEQ ID NO: 9313692 - DNA, 22 bp, Homo sapiens
aggcctgcccgtgggacctgtg

SEQ ID NO: 9313693 - DNA, 22 bp, Homo sapiens
aggctgagaaagtgggaagatg

SEQ ID NO: 9313694 - DNA, 22 bp, Homo sapiens
acattgctgcattctccttccc

SEQ ID NO: 9313695 - DNA, 22 bp, Homo sapiens
acattgtataatgattatcaca

SEQ ID NO: 9313696 - DNA, 22 bp, Homo sapiens
aggctgagctggtagtgagtac

SEQ ID NO: 9313697 - DNA, 22 bp, Homo sapiens
aggctgagctggtagtgagtac

SEQ ID NO: 9313698 - DNA, 22 bp, Homo sapiens
acatttggcatcttgtaacact

SEQ ID NO: 9313699 - DNA, 22 bp, Homo sapiens
acatttggcttttggagtaaga

SEQ ID NO: 9313700 - DNA, 22 bp, Homo sapiens
acatttggacaatagtagacaa

SEQ ID NO: 9313701 - DNA, 22 bp, Homo sapiens
acatttggcaagaaagagaaac

SEQ ID NO: 9313702 - DNA, 22 bp, Homo sapiens
acatttgagtcatatttgctta

SEQ ID NO: 9313703 - DNA, 22 bp, Homo sapiens
acatttgagatgccttttaggt

SEQ ID NO: 9313704 - DNA, 22 bp, Homo sapiens
acatttgataattataaagaca

SEQ ID NO: 9313705 - DNA, 22 bp, Homo sapiens
acatttgacatttagtatcagc

SEQ ID NO: 9313706 - DNA, 22 bp, Homo sapiens
acatttgaaattctgaacagat

SEQ ID NO: 9313707 - DNA, 22 bp, Homo sapiens
acatttgactgtagatacttgc

SEQ ID NO: 9313708 - DNA, 22 bp, Homo sapiens
acatttgactacatttatatat

SEQ ID NO: 9313709 - DNA, 22 bp, Homo sapiens
acatttgactctgttcatatta

SEQ ID NO: 9313710 - DNA, 22 bp, Homo sapiens
aggcctgagccccaggtttgtt

SEQ ID NO: 9313711 - DNA, 21 bp, Homo sapiens
aggcctcttcatggccatgat

SEQ ID NO: 9313712 - DNA, 22 bp, Homo sapiens
aggcctctgttccccatgtttt

SEQ ID NO: 9313713 - DNA, 22 bp, Homo sapiens
aggccagggcactgctctttag

SEQ ID NO: 9313714 - DNA, 22 bp, Homo sapiens
aggccaggggtgagcacttctg

SEQ ID NO: 9313715 - DNA, 22 bp, Homo sapiens
acatcacagagcccagataaag

SEQ ID NO: 9313716 - DNA, 22 bp, Homo sapiens
acatattttgaaagctttctaa

SEQ ID NO: 9313717 - DNA, 22 bp, Homo sapiens
acatgctctccaaggacagagc

SEQ ID NO: 9313718 - DNA, 22 bp, Homo sapiens
acaggcagattaagggtaggca

SEQ ID NO: 9313719 - DNA, 22 bp, Homo sapiens
acaggcagcaaaatcagcctca

SEQ ID NO: 9313720 - DNA, 22 bp, Homo sapiens
acaggcaggcgggacagcccga

SEQ ID NO: 9313721 - DNA, 22 bp, Homo sapiens
acaggcagcgtcattgctgctc

SEQ ID NO: 9313722 - DNA, 22 bp, Homo sapiens
acaggcagccctctccctggtt

SEQ ID NO: 9313723 - DNA, 22 bp, Homo sapiens
acagggaaggagcatagaaaaa

SEQ ID NO: 9313724 - DNA, 22 bp, Homo sapiens
acaggcaggcttcggccagagc

SEQ ID NO: 9313725 - DNA, 22 bp, Homo sapiens
acagggaaggacatgacttggc

SEQ ID NO: 9313726 - DNA, 22 bp, Homo sapiens
acaggcagggaccttggctaag

SEQ ID NO: 9313727 - DNA, 22 bp, Homo sapiens
aggacacactgttctcacgtaa

SEQ ID NO: 9313728 - DNA, 22 bp, Homo sapiens
aggacaatctctcctttatcag

SEQ ID NO: 9313729 - DNA, 22 bp, Homo sapiens
aggacaattagactctttgttt

SEQ ID NO: 9313730 - DNA, 22 bp, Homo sapiens
aggacaattagtctggcttggc

SEQ ID NO: 9313731 - DNA, 22 bp, Homo sapiens
aggacaattgagagtttgttga

SEQ ID NO: 9313732 - DNA, 22 bp, Homo sapiens
aggacacacaaagagtgagaac

SEQ ID NO: 9313733 - DNA, 22 bp, Homo sapiens
acaggggcaggcaggacccttt

SEQ ID NO: 9313734 - DNA, 19 bp, Homo sapiens
acagggcttggcctgacat

SEQ ID NO: 9313735 - DNA, 22 bp, Homo sapiens
acagggcttgttgaaagcggag

SEQ ID NO: 9313736 - DNA, 22 bp, Homo sapiens
acagggcttgttgaaagcggag

SEQ ID NO: 9313737 - DNA, 22 bp, Homo sapiens
acagggcttgtgacaactttaa

SEQ ID NO: 9313738 - DNA, 22 bp, Homo sapiens
acagggcttttaatcagtagtt

SEQ ID NO: 9313739 - DNA, 19 bp, Homo sapiens
acagggcttggcctgacat

SEQ ID NO: 9313740 - DNA, 22 bp, Homo sapiens
acagggctatattcctcagagt

SEQ ID NO: 9313741 - DNA, 22 bp, Homo sapiens
acagggctatattcctcagagt

SEQ ID NO: 9313742 - DNA, 21 bp, Homo sapiens
acagggcttcagggagggtta

SEQ ID NO: 9313743 - DNA, 22 bp, Homo sapiens
aggaagaaactgagctctgaca

SEQ ID NO: 9313744 - DNA, 22 bp, Homo sapiens
aggaagaaactgagctctgaca

SEQ ID NO: 9313745 - DNA, 22 bp, Homo sapiens
agctctgggtcacggctgccga

SEQ ID NO: 9313746 - DNA, 22 bp, Homo sapiens
agctctggggtggagcccagga

SEQ ID NO: 9313747 - DNA, 22 bp, Homo sapiens
agctctggtactgctgaccgaa

SEQ ID NO: 9313748 - DNA, 22 bp, Homo sapiens
agctgagagcccctgccctgtg

SEQ ID NO: 9313749 - DNA, 23 bp, Homo sapiens
acaggaggggacaggtggccgtg

SEQ ID NO: 9313750 - DNA, 22 bp, Homo sapiens
acaggagtgaatctggcactta

SEQ ID NO: 9313751 - DNA, 22 bp, Homo sapiens
acaggagtggagaggtgcctct

SEQ ID NO: 9313752 - DNA, 22 bp, Homo sapiens
acaggagtagggctggtggaga

SEQ ID NO: 9313753 - DNA, 22 bp, Homo sapiens
agctggcactagcgtttccaag

SEQ ID NO: 9313754 - DNA, 22 bp, Homo sapiens
acaggcacctccaggggtatgt

SEQ ID NO: 9313755 - DNA, 22 bp, Homo sapiens
acaggcagagtcaggttgggtt

SEQ ID NO: 9313756 - DNA, 22 bp, Homo sapiens
acaggagttcagaggacacccc

SEQ ID NO: 9313757 - DNA, 22 bp, Homo sapiens
acaggagttaaggctgagttga

SEQ ID NO: 9313758 - DNA, 20 bp, Homo sapiens
acagtttattttacttggtt

SEQ ID NO: 9313759 - DNA, 22 bp, Homo sapiens
aggatgccttcattgcatggcc

SEQ ID NO: 9313760 - DNA, 21 bp, Homo sapiens
aggatggaaaggactaggggt

SEQ ID NO: 9313761 - DNA, 22 bp, Homo sapiens
aggatggaattaggtagcaagt

SEQ ID NO: 9313762 - DNA, 22 bp, Homo sapiens
aggatggattctgtatgtggga

SEQ ID NO: 9313763 - DNA, 17 bp, Homo sapiens
aggcagctcagaacatc

SEQ ID NO: 9313764 - DNA, 21 bp, Homo sapiens
acataggcgaatgttcgggag

SEQ ID NO: 9313765 - DNA, 22 bp, Homo sapiens
aggcagctaagatggataatga

SEQ ID NO: 9313766 - DNA, 22 bp, Homo sapiens
acataggccaatatccagagct

SEQ ID NO: 9313767 - DNA, 22 bp, Homo sapiens
aggcagctctgtggcctcccag

SEQ ID NO: 9313768 - DNA, 22 bp, Homo sapiens
acatattaactgcactacacta

SEQ ID NO: 9313769 - DNA, 22 bp, Homo sapiens
acatatttccatgcagcatgtc

SEQ ID NO: 9313770 - DNA, 22 bp, Homo sapiens
acatatttccatgcagcatgtc

SEQ ID NO: 9313771 - DNA, 22 bp, Homo sapiens
acagtgtggtttgagcactggg

SEQ ID NO: 9313772 - DNA, 22 bp, Homo sapiens
aggacacacttctgaggtcttt

SEQ ID NO: 9313773 - DNA, 22 bp, Homo sapiens
aggacacaggcaggaggagatc

SEQ ID NO: 9313774 - DNA, 22 bp, Homo sapiens
aggacacagctgctctgcagag

SEQ ID NO: 9313775 - DNA, 18 bp, Homo sapiens
acagtaaagaaaggaatt

SEQ ID NO: 9313776 - DNA, 22 bp, Homo sapiens
acagtaaacaatgcagcaaatt

SEQ ID NO: 9313777 - DNA, 22 bp, Homo sapiens
acagtaaagccttctggttgac

SEQ ID NO: 9313778 - DNA, 16 bp, Homo sapiens
acagtaaagctggaca

SEQ ID NO: 9313779 - DNA, 22 bp, Homo sapiens
acagtaaataatgcatgttgat

SEQ ID NO: 9313780 - DNA, 22 bp, Homo sapiens
acagtaaatattaagcctgagt

SEQ ID NO: 9313781 - DNA, 22 bp, Homo sapiens
acagtaaaacatttttattagg

SEQ ID NO: 9313782 - DNA, 22 bp, Homo sapiens
acagtaaaaagccttagaattt

SEQ ID NO: 9313783 - DNA, 22 bp, Homo sapiens
acagtaaaattaagggcagtta

SEQ ID NO: 9313784 - DNA, 22 bp, Homo sapiens
acagtaaaaagccttagaattt

SEQ ID NO: 9313785 - DNA, 22 bp, Homo sapiens
aggagcagaactgttgtggagg

SEQ ID NO: 9313786 - DNA, 22 bp, Homo sapiens
aggagcagaactgattctgact

SEQ ID NO: 9313787 - DNA, 22 bp, Homo sapiens
aggagcagaatttaatgtgcag

SEQ ID NO: 9313788 - DNA, 22 bp, Homo sapiens
ataaacaagactggccaacttt

SEQ ID NO: 9313789 - DNA, 22 bp, Homo sapiens
ataaaatttgctactgttaaat

SEQ ID NO: 9313790 - DNA, 22 bp, Homo sapiens
ataaaatttgctactgttaaat

SEQ ID NO: 9313791 - DNA, 22 bp, Homo sapiens
ataaacagtaaatgtgagcagt

SEQ ID NO: 9313792 - DNA, 22 bp, Homo sapiens
ataaacagagtagttgctactg

SEQ ID NO: 9313793 - DNA, 22 bp, Homo sapiens
ataatgagaatacagtaactat

SEQ ID NO: 9313794 - DNA, 22 bp, Homo sapiens
ataatgagcttttgaatactga

SEQ ID NO: 9313795 - DNA, 22 bp, Homo sapiens
ataatgaatgcagagttatttt

SEQ ID NO: 9313796 - DNA, 22 bp, Homo sapiens
ataaaaactgacccatcctttg

SEQ ID NO: 9313797 - DNA, 22 bp, Homo sapiens
actgtcacctaaattttcattg

SEQ ID NO: 9313798 - DNA, 22 bp, Homo sapiens
actgtataaggcataggtaagc

SEQ ID NO: 9313799 - DNA, 22 bp, Homo sapiens
actgtatatacagctcaaggaa

SEQ ID NO: 9313800 - DNA, 22 bp, Homo sapiens
actgtacatgtaaacattgtca

SEQ ID NO: 9313801 - DNA, 22 bp, Homo sapiens
actgtacatgcatcttgtctat

SEQ ID NO: 9313802 - DNA, 22 bp, Homo sapiens
actgtactttcccaagcacaca

SEQ ID NO: 9313803 - DNA, 22 bp, Homo sapiens
actgggaagatggaggcaagca

SEQ ID NO: 9313804 - DNA, 22 bp, Homo sapiens
acttaccagagaggatccgccc

SEQ ID NO: 9313805 - DNA, 22 bp, Homo sapiens
atacaggatgctgaacatctct

SEQ ID NO: 9313806 - DNA, 22 bp, Homo sapiens
atacagcagtgaataagataaa

SEQ ID NO: 9313807 - DNA, 22 bp, Homo sapiens
atactgtaatacctaaatgaac

SEQ ID NO: 9313808 - DNA, 22 bp, Homo sapiens
atactgaaggcattcagataac

SEQ ID NO: 9313809 - DNA, 22 bp, Homo sapiens
atactgaattaggtaaagcata

SEQ ID NO: 9313810 - DNA, 22 bp, Homo sapiens
atactgtagaggcatagctagt

SEQ ID NO: 9313811 - DNA, 22 bp, Homo sapiens
actttatttcctattgcatcca

SEQ ID NO: 9313812 - DNA, 22 bp, Homo sapiens
actttcaaaagagaagtcatga

SEQ ID NO: 9313813 - DNA, 22 bp, Homo sapiens
atactgtatatttcacatcttg

SEQ ID NO: 9313814 - DNA, 22 bp, Homo sapiens
acttctgtcctccaagccacgt

SEQ ID NO: 9313815 - DNA, 22 bp, Homo sapiens
atatttcacgtaggttgttttc

SEQ ID NO: 9313816 - DNA, 22 bp, Homo sapiens
atatttataaggcaggcaagta

SEQ ID NO: 9313817 - DNA, 22 bp, Homo sapiens
agaaagctccccatgagatgat

SEQ ID NO: 9313818 - DNA, 22 bp, Homo sapiens
atatttcatggggttccatact

SEQ ID NO: 9313819 - DNA, 22 bp, Homo sapiens
atatttcatggggttccatact

SEQ ID NO: 9313820 - DNA, 22 bp, Homo sapiens
atatttataagcaagcaggact

SEQ ID NO: 9313821 - DNA, 22 bp, Homo sapiens
atatttataagcaagcaggact

SEQ ID NO: 9313822 - DNA, 22 bp, Homo sapiens
atatttataagcaagcaggact

SEQ ID NO: 9313823 - DNA, 22 bp, Homo sapiens
atatttataaggcaggcaagta

SEQ ID NO: 9313824 - DNA, 22 bp, Homo sapiens
atattctgggttagatatgttt

SEQ ID NO: 9313825 - DNA, 22 bp, Homo sapiens
atattctgcttttgatgcattc

SEQ ID NO: 9313826 - DNA, 22 bp, Homo sapiens
atattacacacggtatcacggg

SEQ ID NO: 9313827 - DNA, 22 bp, Homo sapiens
atattcctgtttttaacacttt

SEQ ID NO: 9313828 - DNA, 22 bp, Homo sapiens
atattccttttaaagagttaca

SEQ ID NO: 9313829 - DNA, 22 bp, Homo sapiens
atattcctgacttaatttttga

SEQ ID NO: 9313830 - DNA, 22 bp, Homo sapiens
atattctataagcagttggaag

SEQ ID NO: 9313831 - DNA, 22 bp, Homo sapiens
atattctgcctcactacagttg

SEQ ID NO: 9313832 - DNA, 22 bp, Homo sapiens
agaaaaggttgaaagtaggatt

SEQ ID NO: 9313833 - DNA, 17 bp, Homo sapiens
atatgctttgtatttat

SEQ ID NO: 9313834 - DNA, 22 bp, Homo sapiens
atatgcttgtcacacacatcca

SEQ ID NO: 9313835 - DNA, 22 bp, Homo sapiens
atatgctttgggattagatcat

SEQ ID NO: 9313836 - DNA, 22 bp, Homo sapiens
atatgcttacagcttaaaatcc

SEQ ID NO: 9313837 - DNA, 22 bp, Homo sapiens
atatgcttccaagttattccac

SEQ ID NO: 9313838 - DNA, 22 bp, Homo sapiens
atatgcttccccttctttttgg

SEQ ID NO: 9313839 - DNA, 22 bp, Homo sapiens
atatgcttatgatgtctcaagt

SEQ ID NO: 9313840 - DNA, 22 bp, Homo sapiens
atatgcttccaagttattccac

SEQ ID NO: 9313841 - DNA, 22 bp, Homo sapiens
atatgcttccccttctttttgg

SEQ ID NO: 9313842 - DNA, 22 bp, Homo sapiens
atatgcttatgatggttaattt

SEQ ID NO: 9313843 - DNA, 22 bp, Homo sapiens
atatgcttgggactgatacagt

SEQ ID NO: 9313844 - DNA, 22 bp, Homo sapiens
atatgcttgactctttcacatc

SEQ ID NO: 9313845 - DNA, 18 bp, Homo sapiens
atatgcttgagctaagga

SEQ ID NO: 9313846 - DNA, 23 bp, Homo sapiens
actttcccatagcatggcttcct

SEQ ID NO: 9313847 - DNA, 22 bp, Homo sapiens
actttcagaattgtacagagtc

SEQ ID NO: 9313848 - DNA, 22 bp, Homo sapiens
actttcaattcactgagatata

SEQ ID NO: 9313849 - DNA, 22 bp, Homo sapiens
actttcaacttggtgggagagc

SEQ ID NO: 9313850 - DNA, 22 bp, Homo sapiens
actttatttcctattgcatcca

SEQ ID NO: 9313851 - DNA, 22 bp, Homo sapiens
actttcaagcaagaacactttg

SEQ ID NO: 9313852 - DNA, 22 bp, Homo sapiens
atctaaaaggagctctttatct

SEQ ID NO: 9313853 - DNA, 22 bp, Homo sapiens
atctaaagtgtttcatgaaaga

SEQ ID NO: 9313854 - DNA, 21 bp, Homo sapiens
atctcacagcccagagaagcc

SEQ ID NO: 9313855 - DNA, 22 bp, Homo sapiens
atctcacatcctcagtagtgca

SEQ ID NO: 9313856 - DNA, 22 bp, Homo sapiens
atctcacaggactgaaacgtaa

SEQ ID NO: 9313857 - DNA, 22 bp, Homo sapiens
atctcacagaggcccaccagga

SEQ ID NO: 9313858 - DNA, 22 bp, Homo sapiens
atctcacactgggtttgagggt

SEQ ID NO: 9313859 - DNA, 22 bp, Homo sapiens
agaacagctgcaaaacttaatc

SEQ ID NO: 9313860 - DNA, 22 bp, Homo sapiens
atcatctgcctcatcactgcat

SEQ ID NO: 9313861 - DNA, 22 bp, Homo sapiens
atcatctgcacagatcctattt

SEQ ID NO: 9313862 - DNA, 22 bp, Homo sapiens
atcatctggcattcagattggc

SEQ ID NO: 9313863 - DNA, 22 bp, Homo sapiens
atcatctgtctccttgtatgtt

SEQ ID NO: 9313864 - DNA, 22 bp, Homo sapiens
atcatctgtcccaaataagaga

SEQ ID NO: 9313865 - DNA, 22 bp, Homo sapiens
atcatctgggttaatgtgctca

SEQ ID NO: 9313866 - DNA, 22 bp, Homo sapiens
atcatcctagaaggaagctagg

SEQ ID NO: 9313867 - DNA, 22 bp, Homo sapiens
atcatctgtctctgcagttgaa

SEQ ID NO: 9313868 - DNA, 18 bp, Homo sapiens
atcctgggagcagacagc

SEQ ID NO: 9313869 - DNA, 22 bp, Homo sapiens
atcgagatgaaacgcatgtttt

SEQ ID NO: 9313870 - DNA, 22 bp, Homo sapiens
atcgctttacagcctgcttcct

SEQ ID NO: 9313871 - DNA, 22 bp, Homo sapiens
agaaagtttatttcttgatgga

SEQ ID NO: 9313872 - DNA, 22 bp, Homo sapiens
agaaagtttattcctatctagc

SEQ ID NO: 9313873 - DNA, 23 bp, Homo sapiens
agaaagtttgtgccttgtgacac

SEQ ID NO: 9313874 - DNA, 22 bp, Homo sapiens
agaacagcagtagtatacagta

SEQ ID NO: 9313875 - DNA, 22 bp, Homo sapiens
agaacagctgattccatgtcaa

SEQ ID NO: 9313876 - DNA, 22 bp, Homo sapiens
agaacagcacaggaagtgtatc

SEQ ID NO: 9313877 - DNA, 22 bp, Homo sapiens
agaaagttagcagactcttggc

SEQ ID NO: 9313878 - DNA, 22 bp, Homo sapiens
agaaagttcactggtatatttt

SEQ ID NO: 9313879 - DNA, 22 bp, Homo sapiens
agaaagttatcacaaaattgag

SEQ ID NO: 9313880 - DNA, 22 bp, Homo sapiens
actgaggatggataggtcatat

SEQ ID NO: 9313881 - DNA, 22 bp, Homo sapiens
actgaggacagtgaggagggct

SEQ ID NO: 9313882 - DNA, 22 bp, Homo sapiens
actctgtttgcaggtagctcag

SEQ ID NO: 9313883 - DNA, 22 bp, Homo sapiens
agtgcagggggaaagggtgtct

SEQ ID NO: 9313884 - DNA, 22 bp, Homo sapiens
actcttcaagggcctagaggtg

SEQ ID NO: 9313885 - DNA, 22 bp, Homo sapiens
agtctttacatgtgttatatat

SEQ ID NO: 9313886 - DNA, 22 bp, Homo sapiens
agtctttagagtcttagtgttt

SEQ ID NO: 9313887 - DNA, 22 bp, Homo sapiens
agtcttgaaagcacattagagt

SEQ ID NO: 9313888 - DNA, 22 bp, Homo sapiens
actcctggtttgtgtcctggct

SEQ ID NO: 9313889 - DNA, 22 bp, Homo sapiens
actcctgggttgcagtcctcaa

SEQ ID NO: 9313890 - DNA, 22 bp, Homo sapiens
actgcacttcagcctgggtgac

SEQ ID NO: 9313891 - DNA, 22 bp, Homo sapiens
agtggcagtggctgggcagagc

SEQ ID NO: 9313892 - DNA, 22 bp, Homo sapiens
agtggcagtagatgagctggtt

SEQ ID NO: 9313893 - DNA, 22 bp, Homo sapiens
actgcacttcagcctgggtgtc

SEQ ID NO: 9313894 - DNA, 22 bp, Homo sapiens
agtgttggagtcttggctgcag

SEQ ID NO: 9313895 - DNA, 22 bp, Homo sapiens
agtgttcttcttcaaagctctg

SEQ ID NO: 9313896 - DNA, 22 bp, Homo sapiens
agtgtttaaaaatggaaatgca

SEQ ID NO: 9313897 - DNA, 22 bp, Homo sapiens
agtgtttaagttacacacatat

SEQ ID NO: 9313898 - DNA, 22 bp, Homo sapiens
agtgtttacagagtagtggaaa

SEQ ID NO: 9313899 - DNA, 22 bp, Homo sapiens
agtgtttaatgccttttccagc

SEQ ID NO: 9313900 - DNA, 22 bp, Homo sapiens
agtgtttaacttcgtcctgaag

SEQ ID NO: 9313901 - DNA, 22 bp, Homo sapiens
agtgtttaaactgaagtgatga

SEQ ID NO: 9313902 - DNA, 22 bp, Homo sapiens
agtgtttatattatggaaatat

SEQ ID NO: 9313903 - DNA, 22 bp, Homo sapiens
agtgtttagttaagatttcaaa

SEQ ID NO: 9313904 - DNA, 22 bp, Homo sapiens
agtgtttatcagacaagccctg

SEQ ID NO: 9313905 - DNA, 22 bp, Homo sapiens
agtgtttacagagtagtggaaa

SEQ ID NO: 9313906 - DNA, 22 bp, Homo sapiens
agtgtttacatataaggccctt

SEQ ID NO: 9313907 - DNA, 22 bp, Homo sapiens
agtgtttacattgaagcttgta

SEQ ID NO: 9313908 - DNA, 22 bp, Homo sapiens
agtgtttacattgaagcttgta

SEQ ID NO: 9313909 - DNA, 22 bp, Homo sapiens
agtgtttactcaaagggttcca

SEQ ID NO: 9313910 - DNA, 22 bp, Homo sapiens
agtgtttaccccaatcagttta

SEQ ID NO: 9313911 - DNA, 22 bp, Homo sapiens
agtgtttactccctgccctcca

SEQ ID NO: 9313912 - DNA, 20 bp, Homo sapiens
agtgtttagaatactattat

SEQ ID NO: 9313913 - DNA, 22 bp, Homo sapiens
agtgtttagaggaggaaagatg

SEQ ID NO: 9313914 - DNA, 22 bp, Homo sapiens
agtgtttagtcaagtaagacgc

SEQ ID NO: 9313915 - DNA, 22 bp, Homo sapiens
agtgtttagggaatcaaggggt

SEQ ID NO: 9313916 - DNA, 22 bp, Homo sapiens
agtgtttagcatgaagttcatt

SEQ ID NO: 9313917 - DNA, 22 bp, Homo sapiens
agtgtttagtgatgaaagagaa

SEQ ID NO: 9313918 - DNA, 22 bp, Homo sapiens
agtgtgtgaccttttaatttaa

SEQ ID NO: 9313919 - DNA, 22 bp, Homo sapiens
actgcttttgatctcttctgta

SEQ ID NO: 9313920 - DNA, 22 bp, Homo sapiens
actgcttttctaagattctgtg

SEQ ID NO: 9313921 - DNA, 22 bp, Homo sapiens
actgcttttcagagtctgcctg

SEQ ID NO: 9313922 - DNA, 21 bp, Homo sapiens
agtgtagttctagtttttaac

SEQ ID NO: 9313923 - DNA, 22 bp, Homo sapiens
accctctagagggaagcacttt

SEQ ID NO: 9313924 - DNA, 22 bp, Homo sapiens
acctgcaggggtgctctctggg

SEQ ID NO: 9313925 - DNA, 22 bp, Homo sapiens
aggtccagttgccagaatggcc

SEQ ID NO: 9313926 - DNA, 22 bp, Homo sapiens
acctggcactacaggcacctgt

SEQ ID NO: 9313927 - DNA, 22 bp, Homo sapiens
aggtggcatgcctgagacataa

SEQ ID NO: 9313928 - DNA, 22 bp, Homo sapiens
aggtggcatttacaccatggga

SEQ ID NO: 9313929 - DNA, 22 bp, Homo sapiens
aggtctccttgtgggtcttgcc

SEQ ID NO: 9313930 - DNA, 22 bp, Homo sapiens
aggtctcactttgtggaagtga

SEQ ID NO: 9313931 - DNA, 22 bp, Homo sapiens
aggtctcactttgtggaagtga

SEQ ID NO: 9313932 - DNA, 20 bp, Homo sapiens
aggtctcagagcaagagccc

SEQ ID NO: 9313933 - DNA, 22 bp, Homo sapiens
aggtctcccaagggccagggag

SEQ ID NO: 9313934 - DNA, 22 bp, Homo sapiens
aggtccagttttcagttctcat

SEQ ID NO: 9313935 - DNA, 22 bp, Homo sapiens
aggtctagatttatagacagca

SEQ ID NO: 9313936 - DNA, 22 bp, Homo sapiens
aggtctagatttatagacagca

SEQ ID NO: 9313937 - DNA, 22 bp, Homo sapiens
aggtctaggagtctgaaagtat

SEQ ID NO: 9313938 - DNA, 22 bp, Homo sapiens
aggtctcaagttgagaaggcag

SEQ ID NO: 9313939 - DNA, 22 bp, Homo sapiens
aggtctcaatctcaggtggtca

SEQ ID NO: 9313940 - DNA, 22 bp, Homo sapiens
aggtctcaagagaaaagtggtg

SEQ ID NO: 9313941 - DNA, 22 bp, Homo sapiens
agtatttgatcagatgatagta

SEQ ID NO: 9313942 - DNA, 22 bp, Homo sapiens
agtatttgttgattgatatgaa

SEQ ID NO: 9313943 - DNA, 22 bp, Homo sapiens
actaggaaggcatatgggcaga

SEQ ID NO: 9313944 - DNA, 22 bp, Homo sapiens
actaggaattcaagtagacaga

SEQ ID NO: 9313945 - DNA, 22 bp, Homo sapiens
actaggggctcaggcccaggga

SEQ ID NO: 9313946 - DNA, 22 bp, Homo sapiens
actagtcatttaggtgatatta

SEQ ID NO: 9313947 - DNA, 22 bp, Homo sapiens
actcaggaaatgagaggctctc

SEQ ID NO: 9313948 - DNA, 22 bp, Homo sapiens
actcaggaaatgaagactggtt

SEQ ID NO: 9313949 - DNA, 22 bp, Homo sapiens
actcaggaatggggctgggact

SEQ ID NO: 9313950 - DNA, 22 bp, Homo sapiens
acgcccagactcccatactttg

SEQ ID NO: 9313951 - DNA, 22 bp, Homo sapiens
acgcctgtaatcccagcacttt

SEQ ID NO: 9313952 - DNA, 22 bp, Homo sapiens
acggcttcttgactgtgggttg

SEQ ID NO: 9313953 - DNA, 22 bp, Homo sapiens
agtaaaactcacaaaaggatgg

SEQ ID NO: 9313954 - DNA, 22 bp, Homo sapiens
agtaaaatcaccatctctttgt

SEQ ID NO: 9313955 - DNA, 22 bp, Homo sapiens
agtaaaacagagaaatcactca

SEQ ID NO: 9313956 - DNA, 22 bp, Homo sapiens
agtaaaatttctgctgaggaga

SEQ ID NO: 9313957 - DNA, 22 bp, Homo sapiens
aattagctttccgccatcacac

SEQ ID NO: 9313958 - DNA, 22 bp, Homo sapiens
aattagctttacctaggattgt

SEQ ID NO: 9313959 - DNA, 22 bp, Homo sapiens
aattaggcatattataaggcat

SEQ ID NO: 9313960 - DNA, 20 bp, Homo sapiens
aattaggctgtgtaagtctt

SEQ ID NO: 9313961 - DNA, 22 bp, Homo sapiens
aattagcttatgtgtacttttc

SEQ ID NO: 9313962 - DNA, 22 bp, Homo sapiens
aattagcttcagcttgtggggc

SEQ ID NO: 9313963 - DNA, 20 bp, Homo sapiens
aattagcttaagtcaatcag

SEQ ID NO: 9313964 - DNA, 22 bp, Homo sapiens
aattagctgtcaatgaggatct

SEQ ID NO: 9313965 - DNA, 19 bp, Homo sapiens
aatgtttaagagaaaaagg

SEQ ID NO: 9313966 - DNA, 22 bp, Homo sapiens
aatgttccacagatatagcatg

SEQ ID NO: 9313967 - DNA, 22 bp, Homo sapiens
aatgttgatgttttcagtgagc

SEQ ID NO: 9313968 - DNA, 22 bp, Homo sapiens
aattagttcacgtcctgtgctt

SEQ ID NO: 9313969 - DNA, 22 bp, Homo sapiens
aattatgaggtagatatcacat

SEQ ID NO: 9313970 - DNA, 22 bp, Homo sapiens
aattatgattggtctaaaccag

SEQ ID NO: 9313971 - DNA, 22 bp, Homo sapiens
aattgcttttcaagggtacagc

SEQ ID NO: 9313972 - DNA, 22 bp, Homo sapiens
aattgcttttatttagggccag

SEQ ID NO: 9313973 - DNA, 22 bp, Homo sapiens
aattgcttttgggggcagttac

SEQ ID NO: 9313974 - DNA, 22 bp, Homo sapiens
aatttagattgataaacatgga

SEQ ID NO: 9313975 - DNA, 22 bp, Homo sapiens
aatttataataaatagggcttt

SEQ ID NO: 9313976 - DNA, 22 bp, Homo sapiens
agagctgggacttggactcaat

SEQ ID NO: 9313977 - DNA, 22 bp, Homo sapiens
aatttacagttgctgatggtac

SEQ ID NO: 9313978 - DNA, 20 bp, Homo sapiens
aatttactcacagaatgaat

SEQ ID NO: 9313979 - DNA, 22 bp, Homo sapiens
aatttacacttcatttggaggg

SEQ ID NO: 9313980 - DNA, 22 bp, Homo sapiens
agacagggtcttgatcagagct

SEQ ID NO: 9313981 - DNA, 22 bp, Homo sapiens
agacaggctttgctgtatatca

SEQ ID NO: 9313982 - DNA, 22 bp, Homo sapiens
agacagggagggagcgcggctg

SEQ ID NO: 9313983 - DNA, 22 bp, Homo sapiens
agacagggccactcatcctcac

SEQ ID NO: 9313984 - DNA, 23 bp, Homo sapiens
agacagaggctgaggctggccgc

SEQ ID NO: 9313985 - DNA, 22 bp, Homo sapiens
aatgcaatgcagcacctccttg

SEQ ID NO: 9313986 - DNA, 22 bp, Homo sapiens
aatgcaatgcagcacctccttg

SEQ ID NO: 9313987 - DNA, 22 bp, Homo sapiens
aatgcaaactccactggagcag

SEQ ID NO: 9313988 - DNA, 22 bp, Homo sapiens
aatgcaaacagcccagaatcca

SEQ ID NO: 9313989 - DNA, 22 bp, Homo sapiens
aatgcaaagagttgcttatcaa

SEQ ID NO: 9313990 - DNA, 22 bp, Homo sapiens
aatgcaaagctctttaatcctt

SEQ ID NO: 9313991 - DNA, 22 bp, Homo sapiens
aatgcaaagcaagcagagattt

SEQ ID NO: 9313992 - DNA, 22 bp, Homo sapiens
aatgcaaacttcttgttacttg

SEQ ID NO: 9313993 - DNA, 22 bp, Homo sapiens
aatgcaaatgtaagggtgggat

SEQ ID NO: 9313994 - DNA, 22 bp, Homo sapiens
aatgcaaattatcaggcttctc

SEQ ID NO: 9313995 - DNA, 22 bp, Homo sapiens
aatgcaaattctagggccctat

SEQ ID NO: 9313996 - DNA, 22 bp, Homo sapiens
aatgcaaagtgaggtgagtggc

SEQ ID NO: 9313997 - DNA, 22 bp, Homo sapiens
agaaggggagaagctaccagga

SEQ ID NO: 9313998 - DNA, 22 bp, Homo sapiens
agaaggggcccaaggatgtcag

SEQ ID NO: 9313999 - DNA, 22 bp, Homo sapiens
agaggccccaggtgagcatgcc

SEQ ID NO: 9314000 - DNA, 22 bp, Homo sapiens
aattttctgcctagcaaaaact

SEQ ID NO: 9314001 - DNA, 22 bp, Homo sapiens
aatttgtgttatacctgctcct

SEQ ID NO: 9314002 - DNA, 22 bp, Homo sapiens
acaaatgactatttggtacagg

SEQ ID NO: 9314003 - DNA, 22 bp, Homo sapiens
acaaacttcccagacaagctcc

SEQ ID NO: 9314004 - DNA, 21 bp, Homo sapiens
acaaactgaaatgagtttcct

SEQ ID NO: 9314005 - DNA, 22 bp, Homo sapiens
acaaactgaatgggttttctgt

SEQ ID NO: 9314006 - DNA, 22 bp, Homo sapiens
acaaactgggataggatcctgt

SEQ ID NO: 9314007 - DNA, 19 bp, Homo sapiens
acaaactgagtacacttgt

SEQ ID NO: 9314008 - DNA, 22 bp, Homo sapiens
acaaatgcaagttttatgtcaa

SEQ ID NO: 9314009 - DNA, 20 bp, Homo sapiens
acaaatgcattctgtgacat

SEQ ID NO: 9314010 - DNA, 20 bp, Homo sapiens
acaaatgcattctgtgacat

SEQ ID NO: 9314011 - DNA, 23 bp, Homo sapiens
acaaatgcccatacatctagttc

SEQ ID NO: 9314012 - DNA, 22 bp, Homo sapiens
acaaaattacctagttattttc

SEQ ID NO: 9314013 - DNA, 22 bp, Homo sapiens
acaaggtttaaatagccatcag

SEQ ID NO: 9314014 - DNA, 22 bp, Homo sapiens
acaagtagtaaattattaggtg

SEQ ID NO: 9314015 - DNA, 22 bp, Homo sapiens
acaagtaggtgcacttcaatag

SEQ ID NO: 9314016 - DNA, 22 bp, Homo sapiens
acaaggttgttctgaggattta

SEQ ID NO: 9314017 - DNA, 22 bp, Homo sapiens
acaaggttcttagagctgggat

SEQ ID NO: 9314018 - DNA, 22 bp, Homo sapiens
acaaggttcttgtggaggaatt

SEQ ID NO: 9314019 - DNA, 22 bp, Homo sapiens
acaaggctttggagggttctta

SEQ ID NO: 9314020 - DNA, 22 bp, Homo sapiens
acaattagtgatcagtgatgcc

SEQ ID NO: 9314021 - DNA, 22 bp, Homo sapiens
agatgggtaactggagtctgct

SEQ ID NO: 9314022 - DNA, 22 bp, Homo sapiens
agcaaggaaagtaggcacggaa

SEQ ID NO: 9314023 - DNA, 22 bp, Homo sapiens
agcaagctacctagatagtcta

SEQ ID NO: 9314024 - DNA, 21 bp, Homo sapiens
agcaccagttttatgccaggc

SEQ ID NO: 9314025 - DNA, 22 bp, Homo sapiens
agcaagattgaggcttcctcag

SEQ ID NO: 9314026 - DNA, 22 bp, Homo sapiens
agcaagcagaaatgccatggca

SEQ ID NO: 9314027 - DNA, 22 bp, Homo sapiens
agcaagcagaaatgccatggca

SEQ ID NO: 9314028 - DNA, 22 bp, Homo sapiens
agcaagcattgctggttaggtc

SEQ ID NO: 9314029 - DNA, 22 bp, Homo sapiens
agcaagctaacataggagattg

SEQ ID NO: 9314030 - DNA, 22 bp, Homo sapiens
agcaagctgttcttggagagta

SEQ ID NO: 9314031 - DNA, 22 bp, Homo sapiens
agcaagctgtcaagagagctga

SEQ ID NO: 9314032 - DNA, 22 bp, Homo sapiens
agcaaggaaactatggagagat

SEQ ID NO: 9314033 - DNA, 22 bp, Homo sapiens
acacatatctaagatagatgac

SEQ ID NO: 9314034 - DNA, 20 bp, Homo sapiens
agcaggaaaagtgccagtct

SEQ ID NO: 9314035 - DNA, 22 bp, Homo sapiens
agcagcttgttaaaaagttcca

SEQ ID NO: 9314036 - DNA, 22 bp, Homo sapiens
agcagcagtcctttgtgtaatt

SEQ ID NO: 9314037 - DNA, 22 bp, Homo sapiens
agcagcaggtgacctcgatgcc

SEQ ID NO: 9314038 - DNA, 21 bp, Homo sapiens
acacaggcagtgtcccgaggt

SEQ ID NO: 9314039 - DNA, 22 bp, Homo sapiens
acacaggcaagagtgcaggtct

SEQ ID NO: 9314040 - DNA, 22 bp, Homo sapiens
acacaggcaatgtgagtgggag

SEQ ID NO: 9314041 - DNA, 22 bp, Homo sapiens
agcagcagtgtgtggtcatgtt

SEQ ID NO: 9314042 - DNA, 23 bp, Homo sapiens
agcagcagtgagaggtgtcttac

SEQ ID NO: 9314043 - DNA, 22 bp, Homo sapiens
agcagcagtgacagccgaaagc

SEQ ID NO: 9314044 - DNA, 22 bp, Homo sapiens
acaatttgaggctactcaattg

SEQ ID NO: 9314045 - DNA, 22 bp, Homo sapiens
agcacccttcagcccagcctgg

SEQ ID NO: 9314046 - DNA, 22 bp, Homo sapiens
acaatttatccattgtatagtt

SEQ ID NO: 9314047 - DNA, 22 bp, Homo sapiens
acaattgctaatgcttctgttg

SEQ ID NO: 9314048 - DNA, 23 bp, Homo sapiens
acacatttttcccgttctgaggt

SEQ ID NO: 9314049 - DNA, 22 bp, Homo sapiens
acacatttgggctcctacataa

SEQ ID NO: 9314050 - DNA, 22 bp, Homo sapiens
acacattttcaacactgtcaag

SEQ ID NO: 9314051 - DNA, 22 bp, Homo sapiens
acacattttggctaggtggaga

SEQ ID NO: 9314052 - DNA, 22 bp, Homo sapiens
acacattttctaacagggatca

SEQ ID NO: 9314053 - DNA, 22 bp, Homo sapiens
acacatttgcataatacctcat

SEQ ID NO: 9314054 - DNA, 22 bp, Homo sapiens
acacatttgctaaaatgagctc

SEQ ID NO: 9314055 - DNA, 22 bp, Homo sapiens
acacatttctctttttgtaagt

SEQ ID NO: 9314056 - DNA, 22 bp, Homo sapiens
acacatttctctttttgtaagt

SEQ ID NO: 9314057 - DNA, 22 bp, Homo sapiens
agcagggcccactaggggagat

SEQ ID NO: 9314058 - DNA, 22 bp, Homo sapiens
agcagggcatgaataagggttt

SEQ ID NO: 9314059 - DNA, 22 bp, Homo sapiens
agcagggcagttaaagggtcct

SEQ ID NO: 9314060 - DNA, 18 bp, Homo sapiens
agcagggcattttgccat

SEQ ID NO: 9314061 - DNA, 18 bp, Homo sapiens
agcagggcattttgccat

SEQ ID NO: 9314062 - DNA, 22 bp, Homo sapiens
agcagggccaacagtaaacacc

SEQ ID NO: 9314063 - DNA, 22 bp, Homo sapiens
acagaaattgctaatagctcat

SEQ ID NO: 9314064 - DNA, 19 bp, Homo sapiens
acagaaattagttattttc

SEQ ID NO: 9314065 - DNA, 22 bp, Homo sapiens
acagaacaagacctgcttattg

SEQ ID NO: 9314066 - DNA, 22 bp, Homo sapiens
agccacagggggtgagggacaa

SEQ ID NO: 9314067 - DNA, 17 bp, Homo sapiens
agcctgccccatgctgc

SEQ ID NO: 9314068 - DNA, 21 bp, Homo sapiens
agcctgcctgaactctgtggc

SEQ ID NO: 9314069 - DNA, 22 bp, Homo sapiens
agcctgcctgtgaggctttgag

SEQ ID NO: 9314070 - DNA, 22 bp, Homo sapiens
agcctgcctcagactcaggata

SEQ ID NO: 9314071 - DNA, 20 bp, Homo sapiens
agcctgccagctggcccaga

SEQ ID NO: 9314072 - DNA, 20 bp, Homo sapiens
agcctgccagctggcccaga

SEQ ID NO: 9314073 - DNA, 22 bp, Homo sapiens
agcctgccaggcgctgcctgga

SEQ ID NO: 9314074 - DNA, 22 bp, Homo sapiens
agcctgccaggcgctgcctgga

SEQ ID NO: 9314075 - DNA, 17 bp, Homo sapiens
agcctgctgatctcaca

SEQ ID NO: 9314076 - DNA, 22 bp, Homo sapiens
agcctgcgatcccacctggcct

SEQ ID NO: 9314077 - DNA, 22 bp, Homo sapiens
agctagggcaaatatgagatac

SEQ ID NO: 9314078 - DNA, 22 bp, Homo sapiens
agctaggggaccaaggtggccc

SEQ ID NO: 9314079 - DNA, 22 bp, Homo sapiens
agctagtatttcattgaggatt

SEQ ID NO: 9314080 - DNA, 22 bp, Homo sapiens
agctatcagtaggaccatgttc

SEQ ID NO: 9314081 - DNA, 19 bp, Homo sapiens
agctcctgttcagcagctc

SEQ ID NO: 9314082 - DNA, 18 bp, Homo sapiens
agctctggggagatgggc

SEQ ID NO: 9314083 - DNA, 22 bp, Homo sapiens
agctctggggcctgtcccacat

SEQ ID NO: 9314084 - DNA, 22 bp, Homo sapiens
acagcaggatttggcgatgttg

SEQ ID NO: 9314085 - DNA, 22 bp, Homo sapiens
acagcaggagccttcatatgct

SEQ ID NO: 9314086 - DNA, 22 bp, Homo sapiens
acagcaggaattaacatataag

SEQ ID NO: 9314087 - DNA, 22 bp, Homo sapiens
acagcaggcacacaaggataga

SEQ ID NO: 9314088 - DNA, 22 bp, Homo sapiens
acagcaggcatgaagaaatgtt

SEQ ID NO: 9314089 - DNA, 22 bp, Homo sapiens
acagcaggcatgaatgacactg

SEQ ID NO: 9314090 - DNA, 22 bp, Homo sapiens
agctcctgtgtgcccacctgct

SEQ ID NO: 9314091 - DNA, 22 bp, Homo sapiens
acagaggtggacctcagcaggc

SEQ ID NO: 9314092 - DNA, 23 bp, Homo sapiens
acagaggtccaaacagtataagc

SEQ ID NO: 9314093 - DNA, 22 bp, Homo sapiens
agcccctgggagtagctgctgc

SEQ ID NO: 9314094 - DNA, 22 bp, Homo sapiens
agcccctgggagtagctgctgc

SEQ ID NO: 9314095 - DNA, 22 bp, Homo sapiens
agcccctgctgggtgtagctca

SEQ ID NO: 9314096 - DNA, 22 bp, Homo sapiens
agcccctctgtggctctgcctc

SEQ ID NO: 9314097 - DNA, 22 bp, Homo sapiens
agcccctgctgggtgtagctca

SEQ ID NO: 9314098 - DNA, 22 bp, Homo sapiens
acagagcatataaagtgctttg

SEQ ID NO: 9314099 - DNA, 22 bp, Homo sapiens
acagagcatcagatgaaatcaa

SEQ ID NO: 9314100 - DNA, 23 bp, Homo sapiens
agcccctcatatctgctttctct

SEQ ID NO: 9314101 - DNA, 22 bp, Homo sapiens
agccccccaagggccttctctt

SEQ ID NO: 9314102 - DNA, 22 bp, Homo sapiens
agcccccaggagtctccacgcc

SEQ ID NO: 9314103 - DNA, 22 bp, Homo sapiens
agccatcctcccacctcagcct

SEQ ID NO: 9314104 - DNA, 22 bp, Homo sapiens
agccatcctccacagccttgat

SEQ ID NO: 9314105 - DNA, 21 bp, Homo sapiens
agccatcctgaatggtgccat

SEQ ID NO: 9314106 - DNA, 22 bp, Homo sapiens
agccatggtctcagggccataa

SEQ ID NO: 9314107 - DNA, 22 bp, Homo sapiens
agccatttcatacacctgcagc

SEQ ID NO: 9314108 - DNA, 22 bp, Homo sapiens
agccatgttggggaaggtgggc

SEQ ID NO: 9314109 - DNA, 22 bp, Homo sapiens
agccatggcgccactagaggga

SEQ ID NO: 9314110 - DNA, 17 bp, Homo sapiens
acagagcacatcaagat

SEQ ID NO: 9314111 - DNA, 22 bp, Homo sapiens
acagagaggtaaaatatatagt

SEQ ID NO: 9314112 - DNA, 22 bp, Homo sapiens
acagggcttagtggaaattttt

SEQ ID NO: 9314113 - DNA, 22 bp, Homo sapiens
acagggcttagaacttggcctc

SEQ ID NO: 9314114 - DNA, 22 bp, Homo sapiens
acagggcttagaaatctgttgc

SEQ ID NO: 9314115 - DNA, 23 bp, Homo sapiens
acagggctgtccagggctaggtc

SEQ ID NO: 9314116 - DNA, 22 bp, Homo sapiens
acagggctggggcacttggctg

SEQ ID NO: 9314117 - DNA, 22 bp, Homo sapiens
acagggctggcgttgggacaga

SEQ ID NO: 9314118 - DNA, 22 bp, Homo sapiens
acagggctggcgttgggacaga

SEQ ID NO: 9314119 - DNA, 22 bp, Homo sapiens
acagggctggggaaagaggcta

SEQ ID NO: 9314120 - DNA, 22 bp, Homo sapiens
acagggctggggaaagaggcta

SEQ ID NO: 9314121 - DNA, 23 bp, Homo sapiens
acagggctggcagctgcaagacc

SEQ ID NO: 9314122 - DNA, 22 bp, Homo sapiens
acagggctgaggctggcttctt

SEQ ID NO: 9314123 - DNA, 23 bp, Homo sapiens
acagggctggcagctgcaagacc

SEQ ID NO: 9314124 - DNA, 19 bp, Homo sapiens
acagggctctggacgccat

SEQ ID NO: 9314125 - DNA, 22 bp, Homo sapiens
acagggctgaggctggcttctt

SEQ ID NO: 9314126 - DNA, 22 bp, Homo sapiens
acagggctcccagcaggtctgt

SEQ ID NO: 9314127 - DNA, 22 bp, Homo sapiens
acagggctcctaggtggtgtgc

SEQ ID NO: 9314128 - DNA, 22 bp, Homo sapiens
acagggctccttgggctgacac

SEQ ID NO: 9314129 - DNA, 22 bp, Homo sapiens
acagggctccttgggctgacac

SEQ ID NO: 9314130 - DNA, 22 bp, Homo sapiens
acagggctcgtcgggccctcgg

SEQ ID NO: 9314131 - DNA, 22 bp, Homo sapiens
acagggctcgtcgggccctcgg

SEQ ID NO: 9314132 - DNA, 22 bp, Homo sapiens
acagggctctgacaccaaggta

SEQ ID NO: 9314133 - DNA, 22 bp, Homo sapiens
aaggaaagctgtggttctgaga

SEQ ID NO: 9314134 - DNA, 22 bp, Homo sapiens
aaggaaagattctctctctaga

SEQ ID NO: 9314135 - DNA, 22 bp, Homo sapiens
aaggaaatacaacatgtattca

SEQ ID NO: 9314136 - DNA, 22 bp, Homo sapiens
acaggcagttgaggtttgtgtg

SEQ ID NO: 9314137 - DNA, 22 bp, Homo sapiens
acaggcagttgaggtttgtgtg

SEQ ID NO: 9314138 - DNA, 22 bp, Homo sapiens
acaggcattgggatggaggttg

SEQ ID NO: 9314139 - DNA, 22 bp, Homo sapiens
acaggcaggtcctgtcccagct

SEQ ID NO: 9314140 - DNA, 22 bp, Homo sapiens
acaggcaggtcctgtcccagct

SEQ ID NO: 9314141 - DNA, 22 bp, Homo sapiens
acaggcagtgggccagatttgt

SEQ ID NO: 9314142 - DNA, 22 bp, Homo sapiens
acaggcaggttgagaaacattt

SEQ ID NO: 9314143 - DNA, 22 bp, Homo sapiens
aagccaggtgtttaggccagcg

SEQ ID NO: 9314144 - DNA, 22 bp, Homo sapiens
aagccagggtttgtggatctat

SEQ ID NO: 9314145 - DNA, 22 bp, Homo sapiens
aagccaggtgtgcccaggatcc

SEQ ID NO: 9314146 - DNA, 18 bp, Homo sapiens
aagccaggtcaagataag

SEQ ID NO: 9314147 - DNA, 22 bp, Homo sapiens
aagccaggtgttgtggtaagag

SEQ ID NO: 9314148 - DNA, 22 bp, Homo sapiens
aagccaggctgcacttgctggg

SEQ ID NO: 9314149 - DNA, 22 bp, Homo sapiens
aagccaggccattctctggttc

SEQ ID NO: 9314150 - DNA, 22 bp, Homo sapiens
aagccagggattcctgagggag

SEQ ID NO: 9314151 - DNA, 22 bp, Homo sapiens
aagccagggtcaggggcctcct

SEQ ID NO: 9314152 - DNA, 22 bp, Homo sapiens
aagccaggggctgcttaggaga

SEQ ID NO: 9314153 - DNA, 22 bp, Homo sapiens
aagccaggggttggtatgctat

SEQ ID NO: 9314154 - DNA, 22 bp, Homo sapiens
aaggcagagatattcttgatct

SEQ ID NO: 9314155 - DNA, 21 bp, Homo sapiens
acagttctgccggcatctttc

SEQ ID NO: 9314156 - DNA, 22 bp, Homo sapiens
aaggcagatataaagactagag

SEQ ID NO: 9314157 - DNA, 22 bp, Homo sapiens
aaggcagctcagctcatggcag

SEQ ID NO: 9314158 - DNA, 22 bp, Homo sapiens
aaggcagccttttgagttgatt

SEQ ID NO: 9314159 - DNA, 22 bp, Homo sapiens
aaggcaggatgggaaaagattt

SEQ ID NO: 9314160 - DNA, 22 bp, Homo sapiens
aaggcagggaaagtggattagg

SEQ ID NO: 9314161 - DNA, 22 bp, Homo sapiens
aaggcagggaaagtggattagg

SEQ ID NO: 9314162 - DNA, 22 bp, Homo sapiens
aaggcaggatgcggacccatct

SEQ ID NO: 9314163 - DNA, 22 bp, Homo sapiens
aaggcaggagctgtatcttatt

SEQ ID NO: 9314164 - DNA, 22 bp, Homo sapiens
aaggcaggtattgatgccacag

SEQ ID NO: 9314165 - DNA, 22 bp, Homo sapiens
aaggaagaagactctttactcc

SEQ ID NO: 9314166 - DNA, 22 bp, Homo sapiens
aaggcagaaagggatgtgagtg

SEQ ID NO: 9314167 - DNA, 19 bp, Homo sapiens
aaggcagaagttggatatg

SEQ ID NO: 9314168 - DNA, 22 bp, Homo sapiens
aaggcagaaattcaactactgg

SEQ ID NO: 9314169 - DNA, 21 bp, Homo sapiens
aaggcagaagcatggaatgag

SEQ ID NO: 9314170 - DNA, 22 bp, Homo sapiens
acagtagagtaaatggttagat

SEQ ID NO: 9314171 - DNA, 22 bp, Homo sapiens
aaggaaattaggttattttgct

SEQ ID NO: 9314172 - DNA, 22 bp, Homo sapiens
aaggaaatgaagctgatgttgg

SEQ ID NO: 9314173 - DNA, 22 bp, Homo sapiens
aaggctttatgtgaccaaaaga

SEQ ID NO: 9314174 - DNA, 22 bp, Homo sapiens
aaggcttggaccagctacagtg

SEQ ID NO: 9314175 - DNA, 22 bp, Homo sapiens
aaggctgtggttctatacagaa

SEQ ID NO: 9314176 - DNA, 22 bp, Homo sapiens
aaggctgtttgagcactggagc

SEQ ID NO: 9314177 - DNA, 22 bp, Homo sapiens
acatgtgtggccgctgtagaca

SEQ ID NO: 9314178 - DNA, 22 bp, Homo sapiens
aaggctgggaaacatgcaggcc

SEQ ID NO: 9314179 - DNA, 22 bp, Homo sapiens
aaggctggtttccttgatgttt

SEQ ID NO: 9314180 - DNA, 22 bp, Homo sapiens
aaggctggtttccttgatgttt

SEQ ID NO: 9314181 - DNA, 22 bp, Homo sapiens
acatgtgtggacatgaatctac

SEQ ID NO: 9314182 - DNA, 22 bp, Homo sapiens
aagggcaggaaaagatggatgt

SEQ ID NO: 9314183 - DNA, 22 bp, Homo sapiens
aagggccatcttggactcccca

SEQ ID NO: 9314184 - DNA, 22 bp, Homo sapiens
aagggaaactttcacaatgtcc

SEQ ID NO: 9314185 - DNA, 22 bp, Homo sapiens
aagggaaatcctcagcccagga

SEQ ID NO: 9314186 - DNA, 22 bp, Homo sapiens
aaggcttttaactactgtttta

SEQ ID NO: 9314187 - DNA, 22 bp, Homo sapiens
aaggcttttgggaattttcaac

SEQ ID NO: 9314188 - DNA, 22 bp, Homo sapiens
aaggcttttgttcctatttagt

SEQ ID NO: 9314189 - DNA, 22 bp, Homo sapiens
aaggctttcagctaacttgatt

SEQ ID NO: 9314190 - DNA, 22 bp, Homo sapiens
accccaggtctccaggctctgg

SEQ ID NO: 9314191 - DNA, 22 bp, Homo sapiens
accccaggtcatctgagagtcc

SEQ ID NO: 9314192 - DNA, 22 bp, Homo sapiens
accccaggtccaggttacagag

SEQ ID NO: 9314193 - DNA, 22 bp, Homo sapiens
accccagggctgccagcctcct

SEQ ID NO: 9314194 - DNA, 22 bp, Homo sapiens
accccaggcccagggaagaggc

SEQ ID NO: 9314195 - DNA, 23 bp, Homo sapiens
accccaggcatcgcattcctctt

SEQ ID NO: 9314196 - DNA, 22 bp, Homo sapiens
aagtcacaagcatatatgcatt

SEQ ID NO: 9314197 - DNA, 22 bp, Homo sapiens
aagtcacaaagtgctgtacatg

SEQ ID NO: 9314198 - DNA, 22 bp, Homo sapiens
aagtagaaaaccgcactggact

SEQ ID NO: 9314199 - DNA, 22 bp, Homo sapiens
accccaggagctgtgcctagtc

SEQ ID NO: 9314200 - DNA, 22 bp, Homo sapiens
accccaggaagtggaggtcatg

SEQ ID NO: 9314201 - DNA, 22 bp, Homo sapiens
aagtagaatctcaggtaggcta

SEQ ID NO: 9314202 - DNA, 23 bp, Homo sapiens
aagtacctacacattatttcaga

SEQ ID NO: 9314203 - DNA, 22 bp, Homo sapiens
aagggctgaaagaccttgggca

SEQ ID NO: 9314204 - DNA, 22 bp, Homo sapiens
aagggctgaatgaagggttgaa

SEQ ID NO: 9314205 - DNA, 22 bp, Homo sapiens
aagggctgaatgaagggttgaa

SEQ ID NO: 9314206 - DNA, 22 bp, Homo sapiens
aagggctgagaagtggggctgg

SEQ ID NO: 9314207 - DNA, 22 bp, Homo sapiens
aagggctgagcacagtgagcca

SEQ ID NO: 9314208 - DNA, 22 bp, Homo sapiens
aagggctgagcacagtgagcca

SEQ ID NO: 9314209 - DNA, 21 bp, Homo sapiens
aaggtagcatgggttgcagcc

SEQ ID NO: 9314210 - DNA, 22 bp, Homo sapiens
aaggtgctcacgggctcaggga

SEQ ID NO: 9314211 - DNA, 18 bp, Homo sapiens
aaggtctgtctggtaggt

SEQ ID NO: 9314212 - DNA, 22 bp, Homo sapiens
aaggtctgttctaggtgagggt

SEQ ID NO: 9314213 - DNA, 22 bp, Homo sapiens
aaggtgggtggatcacgaggtc

SEQ ID NO: 9314214 - DNA, 22 bp, Homo sapiens
aaggtggcgctggagctggtcc

SEQ ID NO: 9314215 - DNA, 22 bp, Homo sapiens
aaggtggcgctggagctggtcc

SEQ ID NO: 9314216 - DNA, 22 bp, Homo sapiens
aaggtggccctgagcatgacaa

SEQ ID NO: 9314217 - DNA, 19 bp, Homo sapiens
aaggtggcagcaggtatta

SEQ ID NO: 9314218 - DNA, 22 bp, Homo sapiens
accatgtgttttacacatggta

SEQ ID NO: 9314219 - DNA, 22 bp, Homo sapiens
accatgtgtttagatgtggcag

SEQ ID NO: 9314220 - DNA, 22 bp, Homo sapiens
accatgtcatttattggccaaa

SEQ ID NO: 9314221 - DNA, 22 bp, Homo sapiens
agaaaacataggagacaggaaa

SEQ ID NO: 9314222 - DNA, 22 bp, Homo sapiens
agaaaacagaaagtcattggtg

SEQ ID NO: 9314223 - DNA, 22 bp, Homo sapiens
agaaaaatcttggcgcttgtct

SEQ ID NO: 9314224 - DNA, 22 bp, Homo sapiens
aatcctggaatgagtttgctga

SEQ ID NO: 9314225 - DNA, 22 bp, Homo sapiens
aatgaacaagagagagaacttt

SEQ ID NO: 9314226 - DNA, 22 bp, Homo sapiens
aatgaacatgggagtactaata

SEQ ID NO: 9314227 - DNA, 22 bp, Homo sapiens
agaaagttttgtgctatatatg

SEQ ID NO: 9314228 - DNA, 22 bp, Homo sapiens
agaaagttttgtgctatatatg

SEQ ID NO: 9314229 - DNA, 22 bp, Homo sapiens
aatgactaataagttttactgt

SEQ ID NO: 9314230 - DNA, 20 bp, Homo sapiens
aatgagatgacttagaggaa

SEQ ID NO: 9314231 - DNA, 22 bp, Homo sapiens
aatgagacacgtgaagcagatg

SEQ ID NO: 9314232 - DNA, 22 bp, Homo sapiens
aatgagatggaggactcttaat

SEQ ID NO: 9314233 - DNA, 22 bp, Homo sapiens
agaagggaactcagagatgatt

SEQ ID NO: 9314234 - DNA, 22 bp, Homo sapiens
agaagggagagaaagttggtta

SEQ ID NO: 9314235 - DNA, 22 bp, Homo sapiens
acttgtgttaccaaggtttggt

SEQ ID NO: 9314236 - DNA, 22 bp, Homo sapiens
acttgtctttgtaaaatagaaa

SEQ ID NO: 9314237 - DNA, 22 bp, Homo sapiens
aatcaagaataagttgtaaagc

SEQ ID NO: 9314238 - DNA, 22 bp, Homo sapiens
acttgttttatctgtcaataga

SEQ ID NO: 9314239 - DNA, 22 bp, Homo sapiens
acttgtttacaagcagttctga

SEQ ID NO: 9314240 - DNA, 22 bp, Homo sapiens
aatcctcagtttaagaatctgt

SEQ ID NO: 9314241 - DNA, 22 bp, Homo sapiens
aatcctcacattggcccagcca

SEQ ID NO: 9314242 - DNA, 22 bp, Homo sapiens
acttgaaaagctcagcagtagt

SEQ ID NO: 9314243 - DNA, 22 bp, Homo sapiens
acttgaaaccttggcaaacaat

SEQ ID NO: 9314244 - DNA, 22 bp, Homo sapiens
aatatatttgaatcaggaacaa

SEQ ID NO: 9314245 - DNA, 22 bp, Homo sapiens
aatatatagaagtacccgttgt

SEQ ID NO: 9314246 - DNA, 22 bp, Homo sapiens
aagttactggcaagggctgcag

SEQ ID NO: 9314247 - DNA, 22 bp, Homo sapiens
aagttactggcaagggctgcag

SEQ ID NO: 9314248 - DNA, 22 bp, Homo sapiens
aagttagaaataagggctctcc

SEQ ID NO: 9314249 - DNA, 22 bp, Homo sapiens
aagttagagattccatcatgct

SEQ ID NO: 9314250 - DNA, 22 bp, Homo sapiens
aagtgttttgtaaacagaaaag

SEQ ID NO: 9314251 - DNA, 22 bp, Homo sapiens
actcccactccagagtagaagc

SEQ ID NO: 9314252 - DNA, 22 bp, Homo sapiens
actcccagctcagggctttccc

SEQ ID NO: 9314253 - DNA, 22 bp, Homo sapiens
actcccagaacatgctcttctt

SEQ ID NO: 9314254 - DNA, 22 bp, Homo sapiens
actccaggttttttcactgaag

SEQ ID NO: 9314255 - DNA, 22 bp, Homo sapiens
actccaggttttctctcaagtt

SEQ ID NO: 9314256 - DNA, 22 bp, Homo sapiens
actccaggtaggcacattgaca

SEQ ID NO: 9314257 - DNA, 20 bp, Homo sapiens
actccaggtggcatgaggac

SEQ ID NO: 9314258 - DNA, 20 bp, Homo sapiens
actccaggtggcatgaggac

SEQ ID NO: 9314259 - DNA, 22 bp, Homo sapiens
actccaggtgtgttggactcta

SEQ ID NO: 9314260 - DNA, 22 bp, Homo sapiens
aagtcacagaacccattgtaac

SEQ ID NO: 9314261 - DNA, 22 bp, Homo sapiens
aagtcagataggtgagtccaaa

SEQ ID NO: 9314262 - DNA, 22 bp, Homo sapiens
aagtcagcactccaggaagcca

SEQ ID NO: 9314263 - DNA, 22 bp, Homo sapiens
aagtgctttcatatagtcttaa

SEQ ID NO: 9314264 - DNA, 22 bp, Homo sapiens
aagtgctttaaaatttcctgag

SEQ ID NO: 9314265 - DNA, 22 bp, Homo sapiens
aagtgctttacaaatgtctgtt

SEQ ID NO: 9314266 - DNA, 20 bp, Homo sapiens
actgcctttaggtatccttg

SEQ ID NO: 9314267 - DNA, 22 bp, Homo sapiens
aataatttccagccaactggaa

SEQ ID NO: 9314268 - DNA, 22 bp, Homo sapiens
aataattttagctcagagttgt

SEQ ID NO: 9314269 - DNA, 22 bp, Homo sapiens
aataattgtcaactatgctaca

SEQ ID NO: 9314270 - DNA, 22 bp, Homo sapiens
aagtttaacttgaattctttct

SEQ ID NO: 9314271 - DNA, 22 bp, Homo sapiens
aagttgttgttgaggtgggtaa

SEQ ID NO: 9314272 - DNA, 22 bp, Homo sapiens
aagttgtagatgaagtaattca

SEQ ID NO: 9314273 - DNA, 22 bp, Homo sapiens
aagtttatgttggtaagatatc

SEQ ID NO: 9314274 - DNA, 22 bp, Homo sapiens
aataagacacacaactgtcaag

SEQ ID NO: 9314275 - DNA, 22 bp, Homo sapiens
aaacctgaagtacgttacataa

SEQ ID NO: 9314276 - DNA, 22 bp, Homo sapiens
aaacagcttgtaaggtgtaatt

SEQ ID NO: 9314277 - DNA, 22 bp, Homo sapiens
aaacaatgacaacacagctgcg

SEQ ID NO: 9314278 - DNA, 22 bp, Homo sapiens
aaacaatgaaattcattcttca

SEQ ID NO: 9314279 - DNA, 22 bp, Homo sapiens
aaacaatgtacacatgaatgtt

SEQ ID NO: 9314280 - DNA, 22 bp, Homo sapiens
aaaggtcaagctggactcaggt

SEQ ID NO: 9314281 - DNA, 22 bp, Homo sapiens
aaaggtcagctgccatcgttct

SEQ ID NO: 9314282 - DNA, 22 bp, Homo sapiens
aaaggtcagacttaggctgggc

SEQ ID NO: 9314283 - DNA, 22 bp, Homo sapiens
aaacagtgtttttatgatttat

SEQ ID NO: 9314284 - DNA, 22 bp, Homo sapiens
aaagagttaagagtcttaagct

SEQ ID NO: 9314285 - DNA, 22 bp, Homo sapiens
aaagagttctatgatctttcca

SEQ ID NO: 9314286 - DNA, 22 bp, Homo sapiens
aaagagttctatgatctttcca

SEQ ID NO: 9314287 - DNA, 22 bp, Homo sapiens
aaagagttccaagtcattttat

SEQ ID NO: 9314288 - DNA, 22 bp, Homo sapiens
aaattacagccttgggtagctt

SEQ ID NO: 9314289 - DNA, 22 bp, Homo sapiens
aaattacagatcaccaatgcat

SEQ ID NO: 9314290 - DNA, 22 bp, Homo sapiens
aaattagaaatactttcaaagc

SEQ ID NO: 9314291 - DNA, 22 bp, Homo sapiens
aaattgtctctattttgattcg

SEQ ID NO: 9314292 - DNA, 22 bp, Homo sapiens
aaattactttacactttcatct

SEQ ID NO: 9314293 - DNA, 22 bp, Homo sapiens
aaatgcagattcatgagcccca

SEQ ID NO: 9314294 - DNA, 22 bp, Homo sapiens
aaatgcagattcctaggcccca

SEQ ID NO: 9314295 - DNA, 22 bp, Homo sapiens
aaatgcagacagcttcacacac

SEQ ID NO: 9314296 - DNA, 22 bp, Homo sapiens
aaatgcagatccctgaatctca

SEQ ID NO: 9314297 - DNA, 22 bp, Homo sapiens
aaatgcagattcttaggcccca

SEQ ID NO: 9314298 - DNA, 22 bp, Homo sapiens
aaatgcagattttgatgcagca

SEQ ID NO: 9314299 - DNA, 22 bp, Homo sapiens
aaatgcagattgtcattcagga

SEQ ID NO: 9314300 - DNA, 22 bp, Homo sapiens
aaagacacaaatgtagaccaaa

SEQ ID NO: 9314301 - DNA, 22 bp, Homo sapiens
aaatgcagaatgatttcatcta

SEQ ID NO: 9314302 - DNA, 22 bp, Homo sapiens
aaatgcagaatctcagacccca

SEQ ID NO: 9314303 - DNA, 22 bp, Homo sapiens
aaatgcagcagctaattgaaaa

SEQ ID NO: 9314304 - DNA, 22 bp, Homo sapiens
aaagaggcaatcaatgtagcaa

SEQ ID NO: 9314305 - DNA, 22 bp, Homo sapiens
aaagaatctatatatcaccacc

SEQ ID NO: 9314306 - DNA, 22 bp, Homo sapiens
aaagaatcacatccttcagcaa

SEQ ID NO: 9314307 - DNA, 22 bp, Homo sapiens
aaagaatagcctttgtccaaat

SEQ ID NO: 9314308 - DNA, 21 bp, Homo sapiens
aaactgaccttgcctgagaca

SEQ ID NO: 9314309 - DNA, 22 bp, Homo sapiens
aaactctgtagctaaacataat

SEQ ID NO: 9314310 - DNA, 22 bp, Homo sapiens
aaactctgtagctaaacataat

SEQ ID NO: 9314311 - DNA, 17 bp, Homo sapiens
aaactgaaaaattcact

SEQ ID NO: 9314312 - DNA, 22 bp, Homo sapiens
aaactcatgccattaatccttt

SEQ ID NO: 9314313 - DNA, 22 bp, Homo sapiens
aaaatccacaacgctcatttca

SEQ ID NO: 9314314 - DNA, 23 bp, Homo sapiens
aaaatcattaatttaccctgaaa

SEQ ID NO: 9314315 - DNA, 22 bp, Homo sapiens
aaaatcctgctgactcgagatg

SEQ ID NO: 9314316 - DNA, 22 bp, Homo sapiens
aaaatcagtacactttattttg

SEQ ID NO: 9314317 - DNA, 22 bp, Homo sapiens
aaaattttgccctatccttcat

SEQ ID NO: 9314318 - DNA, 22 bp, Homo sapiens
aaaaacagaatgtgtctaactc

SEQ ID NO: 9314319 - DNA, 22 bp, Homo sapiens
aaaaacacaactgtctttctct

SEQ ID NO: 9314320 - DNA, 22 bp, Homo sapiens
aaaaacacaactgtctttctct

SEQ ID NO: 9314321 - DNA, 22 bp, Homo sapiens
aaaaaagattgatggtggatgc

SEQ ID NO: 9314322 - DNA, 23 bp, Homo sapiens
aaaaaaccatgtaggcactcagt

SEQ ID NO: 9314323 - DNA, 22 bp, Homo sapiens
aaaaaatcagatctttggttaa

SEQ ID NO: 9314324 - DNA, 22 bp, Homo sapiens
aaaaaccattgtcttcagtctc

SEQ ID NO: 9314325 - DNA, 22 bp, Homo sapiens
aaaatagttaacgttcagagta

SEQ ID NO: 9314326 - DNA, 22 bp, Homo sapiens
aaaagacatctatttcaggcag

SEQ ID NO: 9314327 - DNA, 22 bp, Homo sapiens
aaaagacatatgtgggcattct

SEQ ID NO: 9314328 - DNA, 22 bp, Homo sapiens
aaaagacaggtgtctgcggccc

SEQ ID NO: 9314329 - DNA, 22 bp, Homo sapiens
aaaagacaggtgtctgcggccc

SEQ ID NO: 9314330 - DNA, 22 bp, Homo sapiens
aaacactgtgtcaaactggggc

SEQ ID NO: 9314331 - DNA, 22 bp, Homo sapiens
aaacactgtgggacatcttact

SEQ ID NO: 9314332 - DNA, 22 bp, Homo sapiens
aaaaatcacttttataggcagc

SEQ ID NO: 9314333 - DNA, 22 bp, Homo sapiens
aaaatgaataagttaacccagg

SEQ ID NO: 9314334 - DNA, 22 bp, Homo sapiens
aaatagcataaaataggaagct

SEQ ID NO: 9314335 - DNA, 22 bp, Homo sapiens
aaatagcattgtatttagctga

SEQ ID NO: 9314336 - DNA, 22 bp, Homo sapiens
aaatagcttttcataattctca

SEQ ID NO: 9314337 - DNA, 22 bp, Homo sapiens
aaatagctgaaagttcctagat

SEQ ID NO: 9314338 - DNA, 22 bp, Homo sapiens
aaatagctgtatttaccctgta

SEQ ID NO: 9314339 - DNA, 22 bp, Homo sapiens
aaatagctacatgatctctagg

SEQ ID NO: 9314340 - DNA, 22 bp, Homo sapiens
aaatccattctgttttaaaagt

SEQ ID NO: 9314341 - DNA, 22 bp, Homo sapiens
aaatagattgctgaggcattac

SEQ ID NO: 9314342 - DNA, 22 bp, Homo sapiens
aaataatgttaggcctttgctc

SEQ ID NO: 9314343 - DNA, 22 bp, Homo sapiens
aaataactttctgtgtatagtc

SEQ ID NO: 9314344 - DNA, 22 bp, Homo sapiens
aaataactttctgtgtatagtc

SEQ ID NO: 9314345 - DNA, 22 bp, Homo sapiens
aagcacagactccctctgagtg

SEQ ID NO: 9314346 - DNA, 23 bp, Homo sapiens
aaatcctgcctcttgtatttatc

SEQ ID NO: 9314347 - DNA, 22 bp, Homo sapiens
aaatccttttctatacagcata

SEQ ID NO: 9314348 - DNA, 22 bp, Homo sapiens
aaatcctgtccatttaccagat

SEQ ID NO: 9314349 - DNA, 22 bp, Homo sapiens
aaatgcagttggtggggatatg

SEQ ID NO: 9314350 - DNA, 20 bp, Homo sapiens
aaatgcagttctgccttggc

SEQ ID NO: 9314351 - DNA, 22 bp, Homo sapiens
aaatgcagtttcctgagaccca

SEQ ID NO: 9314352 - DNA, 22 bp, Homo sapiens
aaatgcatgagaaagtattctg

SEQ ID NO: 9314353 - DNA, 22 bp, Homo sapiens
aaatgcatcagctcataagaga

SEQ ID NO: 9314354 - DNA, 22 bp, Homo sapiens
aaatgcaggttcttgagccaag

SEQ ID NO: 9314355 - DNA, 22 bp, Homo sapiens
aaatgcagtggttctacttctc

SEQ ID NO: 9314356 - DNA, 21 bp, Homo sapiens
aaatgcagtctctgagatctg

SEQ ID NO: 9314357 - DNA, 21 bp, Homo sapiens
aaatgcaggctctttgttttc

SEQ ID NO: 9314358 - DNA, 23 bp, Homo sapiens
aaatgcagggtcgcaggttacag

SEQ ID NO: 9314359 - DNA, 20 bp, Homo sapiens
aaatgcagggctgctgcgga

SEQ ID NO: 9314360 - DNA, 22 bp, Homo sapiens
aaatgcaggtagtatttatttt

SEQ ID NO: 9314361 - DNA, 22 bp, Homo sapiens
aaatgcagctgggcatgagagg

SEQ ID NO: 9314362 - DNA, 22 bp, Homo sapiens
aaatgcaggaaattatgctttt

SEQ ID NO: 9314363 - DNA, 22 bp, Homo sapiens
aaatgcaggattaacagctttg

SEQ ID NO: 9314364 - DNA, 22 bp, Homo sapiens
aaatggcagcccagaggtaagg

SEQ ID NO: 9314365 - DNA, 22 bp, Homo sapiens
aagcatctcattcttgcctgtc

SEQ ID NO: 9314366 - DNA, 22 bp, Homo sapiens
aaagtggggtctagagggcctg

SEQ ID NO: 9314367 - DNA, 22 bp, Homo sapiens
aaagtgggaacaatggagagtg

SEQ ID NO: 9314368 - DNA, 22 bp, Homo sapiens
aaagtgctggtattacaggtgt

SEQ ID NO: 9314369 - DNA, 22 bp, Homo sapiens
aaagtgctttaggatatttgga

SEQ ID NO: 9314370 - DNA, 22 bp, Homo sapiens
aaagtattcttgactgtttttc

SEQ ID NO: 9314371 - DNA, 22 bp, Homo sapiens
aaagtatttgtgatttttacca

SEQ ID NO: 9314372 - DNA, 22 bp, Homo sapiens
aaagtagagttgtggaattact

SEQ ID NO: 9314373 - DNA, 22 bp, Homo sapiens
aaagtagatttctcatggcgaa

SEQ ID NO: 9314374 - DNA, 22 bp, Homo sapiens
aacgttaatattttataagtct

SEQ ID NO: 9314375 - DNA, 22 bp, Homo sapiens
aaagtagaacattttcttatct

SEQ ID NO: 9314376 - DNA, 22 bp, Homo sapiens
aaagtagaggcattgatcaggt

SEQ ID NO: 9314377 - DNA, 22 bp, Homo sapiens
aaaggaagattgagcttttcca

SEQ ID NO: 9314378 - DNA, 22 bp, Homo sapiens
aaagcttttcagtatgttcatg

SEQ ID NO: 9314379 - DNA, 22 bp, Homo sapiens
aaaggaaaataagtagttccat

SEQ ID NO: 9314380 - DNA, 22 bp, Homo sapiens
aaaggaaaataagtagttccat

SEQ ID NO: 9314381 - DNA, 22 bp, Homo sapiens
aaagatcaatagataaagctac

SEQ ID NO: 9314382 - DNA, 22 bp, Homo sapiens
aaagatcacactgtggggcagt

SEQ ID NO: 9314383 - DNA, 22 bp, Homo sapiens
aaagatcagaggatagctgagt

SEQ ID NO: 9314384 - DNA, 22 bp, Homo sapiens
aaagccagtggtatgagagaaa

SEQ ID NO: 9314385 - DNA, 22 bp, Homo sapiens
aaagccagttcttagagaaagc

SEQ ID NO: 9314386 - DNA, 22 bp, Homo sapiens
aacaaaacatttgtcttgtttc

SEQ ID NO: 9314387 - DNA, 22 bp, Homo sapiens
aacaaacaaacattttgtcatc

SEQ ID NO: 9314388 - DNA, 22 bp, Homo sapiens
aaattttctctctaagacttaa

SEQ ID NO: 9314389 - DNA, 22 bp, Homo sapiens
aaagctggcttttacaggggct

SEQ ID NO: 9314390 - DNA, 22 bp, Homo sapiens
aaagcttctaggcctattgctt

SEQ ID NO: 9314391 - DNA, 22 bp, Homo sapiens
aaagcttctattcacttacttg

SEQ ID NO: 9314392 - DNA, 22 bp, Homo sapiens
aaagctcttactgtactagtga

SEQ ID NO: 9314393 - DNA, 23 bp, Homo sapiens
aacgtcctcaacaggattgcacc

SEQ ID NO: 9314394 - DNA, 22 bp, Homo sapiens
aacgtcctcacctgtaacttgg

SEQ ID NO: 9314395 - DNA, 22 bp, Homo sapiens
aactgcagttacttttgcacca

SEQ ID NO: 9314396 - DNA, 22 bp, Homo sapiens
aactgcagttacctttgcacca

SEQ ID NO: 9314397 - DNA, 22 bp, Homo sapiens
aatcatctccgaaaaaagagta

SEQ ID NO: 9314398 - DNA, 22 bp, Homo sapiens
aacttacaaggatgatagctgc

SEQ ID NO: 9314399 - DNA, 22 bp, Homo sapiens
aacttaaacccactcatgtaga

SEQ ID NO: 9314400 - DNA, 22 bp, Homo sapiens
aactgtttcagaaatattgttg

SEQ ID NO: 9314401 - DNA, 22 bp, Homo sapiens
aatgatatagcagacatagcct

SEQ ID NO: 9314402 - DNA, 22 bp, Homo sapiens
aatgatatttattgaatagatg

SEQ ID NO: 9314403 - DNA, 22 bp, Homo sapiens
aatgatatgcaaattatcatca

SEQ ID NO: 9314404 - DNA, 22 bp, Homo sapiens
aatgataccaaacatgtagata

SEQ ID NO: 9314405 - DNA, 22 bp, Homo sapiens
aatgataccgccaatattacca

SEQ ID NO: 9314406 - DNA, 22 bp, Homo sapiens
aatagtttgaatttatcagatg

SEQ ID NO: 9314407 - DNA, 22 bp, Homo sapiens
aacaggagaggggaatgtagag

SEQ ID NO: 9314408 - DNA, 22 bp, Homo sapiens
aacaggagagtaaatatatgat

SEQ ID NO: 9314409 - DNA, 22 bp, Homo sapiens
aacaggaggccttccagtccag

SEQ ID NO: 9314410 - DNA, 22 bp, Homo sapiens
aacaggagtcattgtcattatt

SEQ ID NO: 9314411 - DNA, 22 bp, Homo sapiens
aacaggcaggagaattctgcct

SEQ ID NO: 9314412 - DNA, 22 bp, Homo sapiens
aacaggcttcttctgggctcct

SEQ ID NO: 9314413 - DNA, 22 bp, Homo sapiens
aacaggctcttcatttccagag

SEQ ID NO: 9314414 - DNA, 22 bp, Homo sapiens
aacaggctccttgtgaatggat

SEQ ID NO: 9314415 - DNA, 22 bp, Homo sapiens
aacaggcttccaggagggacga

SEQ ID NO: 9314416 - DNA, 22 bp, Homo sapiens
aacagtaaaaatcatttagttg

SEQ ID NO: 9314417 - DNA, 22 bp, Homo sapiens
aacagtaaaaatcatttagttg

SEQ ID NO: 9314418 - DNA, 22 bp, Homo sapiens
aaattcttcaggtaattttgat

SEQ ID NO: 9314419 - DNA, 22 bp, Homo sapiens
aaattctttggcctactttgaa

SEQ ID NO: 9314420 - DNA, 22 bp, Homo sapiens
aaattctttggcctactttgaa

SEQ ID NO: 9314421 - DNA, 22 bp, Homo sapiens
aaattgcagatgctaaatgact

SEQ ID NO: 9314422 - DNA, 22 bp, Homo sapiens
aaattgcaaccaggtctctgtc

SEQ ID NO: 9314423 - DNA, 22 bp, Homo sapiens
aaattgattaaagtccgtgctt

SEQ ID NO: 9314424 - DNA, 22 bp, Homo sapiens
aacaaactcaaatggaagagtg

SEQ ID NO: 9314425 - DNA, 20 bp, Homo sapiens
aacaaactacaaaattatgt

SEQ ID NO: 9314426 - DNA, 22 bp, Homo sapiens
aacaaacattacctggtgctgg

SEQ ID NO: 9314427 - DNA, 22 bp, Homo sapiens
aacaaacagttaagtgtggatg

SEQ ID NO: 9314428 - DNA, 22 bp, Homo sapiens
aaattttagaccaggcaaaact

SEQ ID NO: 9314429 - DNA, 22 bp, Homo sapiens
aaattcctgtcatttgcacttt

SEQ ID NO: 9314430 - DNA, 22 bp, Homo sapiens
aaatgttctaaattacatgtga

SEQ ID NO: 9314431 - DNA, 22 bp, Homo sapiens
aaatgttcctttggattaaact

SEQ ID NO: 9314432 - DNA, 22 bp, Homo sapiens
aaatgttccattattgtgtaat

SEQ ID NO: 9314433 - DNA, 22 bp, Homo sapiens
aaatgtgttcctttgctacaga

SEQ ID NO: 9314434 - DNA, 19 bp, Homo sapiens
aagctgagggctgtccacc

SEQ ID NO: 9314435 - DNA, 19 bp, Homo sapiens
aaatgtgcactgttttcca

SEQ ID NO: 9314436 - DNA, 22 bp, Homo sapiens
aaatgtgctaaagtattaacat

SEQ ID NO: 9314437 - DNA, 22 bp, Homo sapiens
aaatgtgtcatattcaaagtca

SEQ ID NO: 9314438 - DNA, 22 bp, Homo sapiens
aaatgtgtgcacaaagacagct

SEQ ID NO: 9314439 - DNA, 22 bp, Homo sapiens
aaatgtgcttgtgatcagctgt

SEQ ID NO: 9314440 - DNA, 22 bp, Homo sapiens
aaatgtgcttgtgatcagctgt

SEQ ID NO: 9314441 - DNA, 22 bp, Homo sapiens
aaatgtgcttcttactctcaat

SEQ ID NO: 9314442 - DNA, 22 bp, Homo sapiens
aacaaagtcgttgcctagaaga

SEQ ID NO: 9314443 - DNA, 22 bp, Homo sapiens
aaggtccacaactggtaaatgg

SEQ ID NO: 9314444 - DNA, 22 bp, Homo sapiens
aaggtccagaggtcccgtcacc

SEQ ID NO: 9314445 - DNA, 20 bp, Homo sapiens
aaggtccaaactctgtgttc

SEQ ID NO: 9314446 - DNA, 22 bp, Homo sapiens
aaggtccagtggaaactagagt

SEQ ID NO: 9314447 - DNA, 22 bp, Homo sapiens
aagtcattatctcttctaatct

SEQ ID NO: 9314448 - DNA, 22 bp, Homo sapiens
aagtccaggctggcgtagagtc

SEQ ID NO: 9314449 - DNA, 22 bp, Homo sapiens
aagtccagggatcaaagtaggc

SEQ ID NO: 9314450 - DNA, 22 bp, Homo sapiens
aagtccagcatttgggtagatt

SEQ ID NO: 9314451 - DNA, 23 bp, Homo sapiens
aagtccagaaggagaactgggag

SEQ ID NO: 9314452 - DNA, 17 bp, Homo sapiens
aagtccagagttgagca

SEQ ID NO: 9314453 - DNA, 22 bp, Homo sapiens
aaggtctgagttttgccaggcc

SEQ ID NO: 9314454 - DNA, 22 bp, Homo sapiens
aaggtccagtttgaattactgt

SEQ ID NO: 9314455 - DNA, 22 bp, Homo sapiens
aaggtccatgactcggcatagt

SEQ ID NO: 9314456 - DNA, 22 bp, Homo sapiens
aacagcaggtcctggcatgggt

SEQ ID NO: 9314457 - DNA, 22 bp, Homo sapiens
aacagcagggacttgaatggaa

SEQ ID NO: 9314458 - DNA, 22 bp, Homo sapiens
aacagcagggatggggtggcca

SEQ ID NO: 9314459 - DNA, 22 bp, Homo sapiens
aacagcagggatggggtggcca

SEQ ID NO: 9314460 - DNA, 22 bp, Homo sapiens
acacaggggaaagtggagctga

SEQ ID NO: 9314461 - DNA, 22 bp, Homo sapiens
acacagggggcattctaggagt

SEQ ID NO: 9314462 - DNA, 22 bp, Homo sapiens
acacagggtctagagttaggcc

SEQ ID NO: 9314463 - DNA, 22 bp, Homo sapiens
aagattgccccatttacactgc

SEQ ID NO: 9314464 - DNA, 19 bp, Homo sapiens
aagattgccttgttccatt

SEQ ID NO: 9314465 - DNA, 22 bp, Homo sapiens
aagatttaccactttattcaag

SEQ ID NO: 9314466 - DNA, 22 bp, Homo sapiens
aagattctgtatttctaacaat

SEQ ID NO: 9314467 - DNA, 22 bp, Homo sapiens
aagattcttaaatttgtttctc

SEQ ID NO: 9314468 - DNA, 18 bp, Homo sapiens
aagattctgcttctctct

SEQ ID NO: 9314469 - DNA, 18 bp, Homo sapiens
aagaggctgttctgtggg

SEQ ID NO: 9314470 - DNA, 22 bp, Homo sapiens
aagaggctggcattgatggtag

SEQ ID NO: 9314471 - DNA, 22 bp, Homo sapiens
aagaggcttcagatccttcaga

SEQ ID NO: 9314472 - DNA, 22 bp, Homo sapiens
aagcacagggactcaggaccgg

SEQ ID NO: 9314473 - DNA, 22 bp, Homo sapiens
aagcacaggagacgcacagcca

SEQ ID NO: 9314474 - DNA, 22 bp, Homo sapiens
aagcacacttggctctgtgtac

SEQ ID NO: 9314475 - DNA, 22 bp, Homo sapiens
aagatttagggccagtttacat

SEQ ID NO: 9314476 - DNA, 21 bp, Homo sapiens
acactgcaggtgaagtgcact

SEQ ID NO: 9314477 - DNA, 22 bp, Homo sapiens
acactgctaaacagtaaagatg

SEQ ID NO: 9314478 - DNA, 22 bp, Homo sapiens
aagcagcatgctatgctggtgg

SEQ ID NO: 9314479 - DNA, 22 bp, Homo sapiens
aagcagcatgtgggttatcggg

SEQ ID NO: 9314480 - DNA, 22 bp, Homo sapiens
aagcagcatgattgtaatacta

SEQ ID NO: 9314481 - DNA, 22 bp, Homo sapiens
aagcagcattcagtgaaatgtg

SEQ ID NO: 9314482 - DNA, 22 bp, Homo sapiens
aagcagcattcagtgaaatgtg

SEQ ID NO: 9314483 - DNA, 22 bp, Homo sapiens
aagcagcattgtaaccaatgcc

SEQ ID NO: 9314484 - DNA, 22 bp, Homo sapiens
aagcagcatcctgggcagacct

SEQ ID NO: 9314485 - DNA, 22 bp, Homo sapiens
acagagtaggtgctgtcgactg

SEQ ID NO: 9314486 - DNA, 22 bp, Homo sapiens
aagcataacttgctgcacatag

SEQ ID NO: 9314487 - DNA, 22 bp, Homo sapiens
acagaggtttccattgaggttt

SEQ ID NO: 9314488 - DNA, 17 bp, Homo sapiens
acagaggttatacagac

SEQ ID NO: 9314489 - DNA, 22 bp, Homo sapiens
aagcagcattgtggtaggggag

SEQ ID NO: 9314490 - DNA, 22 bp, Homo sapiens
aagcagccactggccagttata

SEQ ID NO: 9314491 - DNA, 22 bp, Homo sapiens
aagcagctgatttcacagctca

SEQ ID NO: 9314492 - DNA, 22 bp, Homo sapiens
acagaggtgtgtgtaggacagt

SEQ ID NO: 9314493 - DNA, 22 bp, Homo sapiens
acagaggtgttccagacctagg

SEQ ID NO: 9314494 - DNA, 22 bp, Homo sapiens
acagaggttaggatgggttgta

SEQ ID NO: 9314495 - DNA, 22 bp, Homo sapiens
acagcagcttcctgactgtact

SEQ ID NO: 9314496 - DNA, 22 bp, Homo sapiens
aagccaagttggaagactgaat

SEQ ID NO: 9314497 - DNA, 22 bp, Homo sapiens
aagccaggaagagagccttcac

SEQ ID NO: 9314498 - DNA, 22 bp, Homo sapiens
aagccaggataaagttgtttta

SEQ ID NO: 9314499 - DNA, 22 bp, Homo sapiens
aagccaggcatgcttggacagt

SEQ ID NO: 9314500 - DNA, 22 bp, Homo sapiens
aagccaggagcgaggcctcggc

SEQ ID NO: 9314501 - DNA, 22 bp, Homo sapiens
aagccaggaccaaactcatcct

SEQ ID NO: 9314502 - DNA, 22 bp, Homo sapiens
aagccaggaatggagtcttcgc

SEQ ID NO: 9314503 - DNA, 22 bp, Homo sapiens
aagccaggaagggagctgtccc

SEQ ID NO: 9314504 - DNA, 19 bp, Homo sapiens
aagcattagccaaagcatt

SEQ ID NO: 9314505 - DNA, 22 bp, Homo sapiens
aagcatttctgtttatctatcg

SEQ ID NO: 9314506 - DNA, 22 bp, Homo sapiens
acaaggctgaacagtgaagccg

SEQ ID NO: 9314507 - DNA, 22 bp, Homo sapiens
acaaggctgtggggagaactga

SEQ ID NO: 9314508 - DNA, 19 bp, Homo sapiens
acaaggctgggagagcgcc

SEQ ID NO: 9314509 - DNA, 22 bp, Homo sapiens
acaaggctgctgtgattgggaa

SEQ ID NO: 9314510 - DNA, 22 bp, Homo sapiens
acaaggctgctgtgattgggaa

SEQ ID NO: 9314511 - DNA, 20 bp, Homo sapiens
aagagctgactcacagtggt

SEQ ID NO: 9314512 - DNA, 22 bp, Homo sapiens
aagagcagtgttttactcagct

SEQ ID NO: 9314513 - DNA, 22 bp, Homo sapiens
aagagctggagctgctacagga

SEQ ID NO: 9314514 - DNA, 22 bp, Homo sapiens
aagagctggattgtgctgcaga

SEQ ID NO: 9314515 - DNA, 22 bp, Homo sapiens
aagaggaactgggggctgagtc

SEQ ID NO: 9314516 - DNA, 21 bp, Homo sapiens
aagagctgtcaggaaggctgc

SEQ ID NO: 9314517 - DNA, 22 bp, Homo sapiens
aagagctggtcacaggtccatt

SEQ ID NO: 9314518 - DNA, 22 bp, Homo sapiens
aagagctggctcttgcagcagc

SEQ ID NO: 9314519 - DNA, 22 bp, Homo sapiens
acaaagatgtttaaagcattta

SEQ ID NO: 9314520 - DNA, 22 bp, Homo sapiens
acaaagcacgagtgccatggac

SEQ ID NO: 9314521 - DNA, 22 bp, Homo sapiens
acaaagatcttgctttcctact

SEQ ID NO: 9314522 - DNA, 22 bp, Homo sapiens
acaaagattcatttgcattatt

SEQ ID NO: 9314523 - DNA, 22 bp, Homo sapiens
acaaagcacgagtgccatggac

SEQ ID NO: 9314524 - DNA, 22 bp, Homo sapiens
acaaggaggtctggggggccct

SEQ ID NO: 9314525 - DNA, 22 bp, Homo sapiens
acaaggagaagaaattggtcat

SEQ ID NO: 9314526 - DNA, 22 bp, Homo sapiens
aagacagctcaggacagattca

SEQ ID NO: 9314527 - DNA, 22 bp, Homo sapiens
aagacagtgacagtcacaattg

SEQ ID NO: 9314528 - DNA, 22 bp, Homo sapiens
aattgtcttctccttcctggca

SEQ ID NO: 9314529 - DNA, 22 bp, Homo sapiens
aattggctatattatttagcct

SEQ ID NO: 9314530 - DNA, 22 bp, Homo sapiens
aattggcttccattttctgttt

SEQ ID NO: 9314531 - DNA, 22 bp, Homo sapiens
aattggctttgtggtttctgca

SEQ ID NO: 9314532 - DNA, 22 bp, Homo sapiens
aattggtttgagttgtctctat

SEQ ID NO: 9314533 - DNA, 22 bp, Homo sapiens
aagaagcactttcctacatgtt

SEQ ID NO: 9314534 - DNA, 22 bp, Homo sapiens
aacttagtttagggtattgatt

SEQ ID NO: 9314535 - DNA, 22 bp, Homo sapiens
gcagggcaaacccaggtgttca

SEQ ID NO: 9314536 - DNA, 22 bp, Homo sapiens
gcagggcagtaagagctagagt

SEQ ID NO: 9314537 - DNA, 22 bp, Homo sapiens
gcagggcagtgtgtctgtgggg

SEQ ID NO: 9314538 - DNA, 20 bp, Homo sapiens
attctgctttctgatagagc

SEQ ID NO: 9314539 - DNA, 22 bp, Homo sapiens
attctgcttcttatttcacgtg

SEQ ID NO: 9314540 - DNA, 16 bp, Homo sapiens
attctgctgcctgctc

SEQ ID NO: 9314541 - DNA, 22 bp, Homo sapiens
attctgcttaagggaggctgtc

SEQ ID NO: 9314542 - DNA, 22 bp, Homo sapiens
attctgctggtaactctataaa

SEQ ID NO: 9314543 - DNA, 22 bp, Homo sapiens
attctgcttttgctgacctacc

SEQ ID NO: 9314544 - DNA, 20 bp, Homo sapiens
attctgctttgaaaataagg

SEQ ID NO: 9314545 - DNA, 22 bp, Homo sapiens
attctgctgcctagtttatgaa

SEQ ID NO: 9314546 - DNA, 22 bp, Homo sapiens
attctgctgcacaccttccccc

SEQ ID NO: 9314547 - DNA, 22 bp, Homo sapiens
attctgctcatgagctcccggg

SEQ ID NO: 9314548 - DNA, 22 bp, Homo sapiens
attctgctcccaggtgatgctg

SEQ ID NO: 9314549 - DNA, 22 bp, Homo sapiens
attctgctccacactgattcat

SEQ ID NO: 9314550 - DNA, 22 bp, Homo sapiens
attctgctcattttatttccag

SEQ ID NO: 9314551 - DNA, 22 bp, Homo sapiens
attctgatgcttcacaaaggta

SEQ ID NO: 9314552 - DNA, 22 bp, Homo sapiens
gcaggcaggtggcatcttgtga

SEQ ID NO: 9314553 - DNA, 20 bp, Homo sapiens
gcaggcagggaatgggggtg

SEQ ID NO: 9314554 - DNA, 22 bp, Homo sapiens
attctgcataatttcctggcag

SEQ ID NO: 9314555 - DNA, 22 bp, Homo sapiens
attctgcctcacaggcagctgg

SEQ ID NO: 9314556 - DNA, 22 bp, Homo sapiens
attctgctagtaacagatgaag

SEQ ID NO: 9314557 - DNA, 22 bp, Homo sapiens
attctgctagttaatatctctc

SEQ ID NO: 9314558 - DNA, 22 bp, Homo sapiens
attctgctagttaatatctctc

SEQ ID NO: 9314559 - DNA, 22 bp, Homo sapiens
attctgcattgctcacaaagat

SEQ ID NO: 9314560 - DNA, 22 bp, Homo sapiens
attcttttaaatggcagtagta

SEQ ID NO: 9314561 - DNA, 19 bp, Homo sapiens
attctttggtgtccatttc

SEQ ID NO: 9314562 - DNA, 22 bp, Homo sapiens
attctttggacaataagtggtg

SEQ ID NO: 9314563 - DNA, 20 bp, Homo sapiens
gcagggcatcttggccccca

SEQ ID NO: 9314564 - DNA, 22 bp, Homo sapiens
gcagggcatccctgagcgggtg

SEQ ID NO: 9314565 - DNA, 22 bp, Homo sapiens
gcagggcatagaggcacggagg

SEQ ID NO: 9314566 - DNA, 22 bp, Homo sapiens
gcagggcatccctgagcgggtg

SEQ ID NO: 9314567 - DNA, 22 bp, Homo sapiens
gcagggcatagaggcacggagg

SEQ ID NO: 9314568 - DNA, 22 bp, Homo sapiens
attcttttttaaggaatagaac

SEQ ID NO: 9314569 - DNA, 22 bp, Homo sapiens
attgcaaatggtttggtcatct

SEQ ID NO: 9314570 - DNA, 16 bp, Homo sapiens
gcagtaaaatggttag

SEQ ID NO: 9314571 - DNA, 22 bp, Homo sapiens
gcagtaaaaaaggatatgtgca

SEQ ID NO: 9314572 - DNA, 22 bp, Homo sapiens
gcagtaaagcctgagatatatg

SEQ ID NO: 9314573 - DNA, 22 bp, Homo sapiens
gcagtaaataattttgtgtata

SEQ ID NO: 9314574 - DNA, 22 bp, Homo sapiens
gcagtaaattgagagtcatgtt

SEQ ID NO: 9314575 - DNA, 22 bp, Homo sapiens
gcagtaaaggtgacaatatagg

SEQ ID NO: 9314576 - DNA, 22 bp, Homo sapiens
gcatggcagaacacctcgcccg

SEQ ID NO: 9314577 - DNA, 22 bp, Homo sapiens
attgcaagtgctagctaaaata

SEQ ID NO: 9314578 - DNA, 22 bp, Homo sapiens
attgcacagctgaatattttgg

SEQ ID NO: 9314579 - DNA, 22 bp, Homo sapiens
attcacaaaatgatatagatac

SEQ ID NO: 9314580 - DNA, 17 bp, Homo sapiens
attcatgaacatgtcct

SEQ ID NO: 9314581 - DNA, 22 bp, Homo sapiens
attccacagctcagcctctctt

SEQ ID NO: 9314582 - DNA, 22 bp, Homo sapiens
attccacataggccttcatgac

SEQ ID NO: 9314583 - DNA, 22 bp, Homo sapiens
attctcagttcactagtttctt

SEQ ID NO: 9314584 - DNA, 22 bp, Homo sapiens
attctgactttcatctgccttt

SEQ ID NO: 9314585 - DNA, 22 bp, Homo sapiens
attctgatatcttattctagct

SEQ ID NO: 9314586 - DNA, 22 bp, Homo sapiens
attctgatcattcaagatgtca

SEQ ID NO: 9314587 - DNA, 22 bp, Homo sapiens
gcagctgttcagctggccagat

SEQ ID NO: 9314588 - DNA, 22 bp, Homo sapiens
gcagcttcctgagtgtggacag

SEQ ID NO: 9314589 - DNA, 22 bp, Homo sapiens
gcagcttcagtaggtgaagaca

SEQ ID NO: 9314590 - DNA, 22 bp, Homo sapiens
gcagcttcaagatactttttct

SEQ ID NO: 9314591 - DNA, 22 bp, Homo sapiens
gcagcttcagccagagggccag

SEQ ID NO: 9314592 - DNA, 22 bp, Homo sapiens
gcagcttggggacatgaaaaga

SEQ ID NO: 9314593 - DNA, 22 bp, Homo sapiens
gcaggcaggagcccaactgcct

SEQ ID NO: 9314594 - DNA, 22 bp, Homo sapiens
gcaggcaggcttccttgaactg

SEQ ID NO: 9314595 - DNA, 22 bp, Homo sapiens
gcaggcaggcttccttgaactg

SEQ ID NO: 9314596 - DNA, 20 bp, Homo sapiens
gcaggcagggaatgggggtg

SEQ ID NO: 9314597 - DNA, 22 bp, Homo sapiens
gatggatactataggaggcaca

SEQ ID NO: 9314598 - DNA, 22 bp, Homo sapiens
gatggagtctgaagctgggaac

SEQ ID NO: 9314599 - DNA, 22 bp, Homo sapiens
gatggagtctgaagctgggaac

SEQ ID NO: 9314600 - DNA, 22 bp, Homo sapiens
gatggaggagatggcagggtgc

SEQ ID NO: 9314601 - DNA, 22 bp, Homo sapiens
gatggaggagatggcagggtgc

SEQ ID NO: 9314602 - DNA, 22 bp, Homo sapiens
gatggcaggtagtggtctcatc

SEQ ID NO: 9314603 - DNA, 22 bp, Homo sapiens
gatggcagcagcagccagggat

SEQ ID NO: 9314604 - DNA, 22 bp, Homo sapiens
gatggcagtcaaccaggtgagg

SEQ ID NO: 9314605 - DNA, 22 bp, Homo sapiens
gagtggggaaagccaggacaga

SEQ ID NO: 9314606 - DNA, 22 bp, Homo sapiens
gagtggggcgtggatccagcgt

SEQ ID NO: 9314607 - DNA, 22 bp, Homo sapiens
gattctgctgtccctaagtgcc

SEQ ID NO: 9314608 - DNA, 20 bp, Homo sapiens
gattcctctgagaactggag

SEQ ID NO: 9314609 - DNA, 22 bp, Homo sapiens
gattctgcgatgaggacgagct

SEQ ID NO: 9314610 - DNA, 22 bp, Homo sapiens
gattctgcttaccatttgatct

SEQ ID NO: 9314611 - DNA, 22 bp, Homo sapiens
gatgtggggttgagggaccagc

SEQ ID NO: 9314612 - DNA, 22 bp, Homo sapiens
attatgcttaggaaaatatgaa

SEQ ID NO: 9314613 - DNA, 18 bp, Homo sapiens
attatgctcattacagtg

SEQ ID NO: 9314614 - DNA, 22 bp, Homo sapiens
attatggtaaagttaatatgta

SEQ ID NO: 9314615 - DNA, 22 bp, Homo sapiens
attatgctcacctggcaacttg

SEQ ID NO: 9314616 - DNA, 22 bp, Homo sapiens
attatgctggtttacacatttt

SEQ ID NO: 9314617 - DNA, 22 bp, Homo sapiens
attatgctcttcatctctgtag

SEQ ID NO: 9314618 - DNA, 22 bp, Homo sapiens
gcaccaggcttagagccccagg

SEQ ID NO: 9314619 - DNA, 22 bp, Homo sapiens
gcacacaggcagtttccagcca

SEQ ID NO: 9314620 - DNA, 22 bp, Homo sapiens
gcacacagctagattaccattc

SEQ ID NO: 9314621 - DNA, 22 bp, Homo sapiens
gcacacagccagctgagggcta

SEQ ID NO: 9314622 - DNA, 22 bp, Homo sapiens
gcacacagaattgattcactgt

SEQ ID NO: 9314623 - DNA, 22 bp, Homo sapiens
gcacacagactaaccatatttc

SEQ ID NO: 9314624 - DNA, 22 bp, Homo sapiens
gcacacagagaggtggtatgtc

SEQ ID NO: 9314625 - DNA, 22 bp, Homo sapiens
gcacacagattaggaaacagaa

SEQ ID NO: 9314626 - DNA, 16 bp, Homo sapiens
gcacacagccagcctt

SEQ ID NO: 9314627 - DNA, 22 bp, Homo sapiens
attatatttgaaaggttggaag

SEQ ID NO: 9314628 - DNA, 22 bp, Homo sapiens
attagtttggtgcaaaagtaat

SEQ ID NO: 9314629 - DNA, 22 bp, Homo sapiens
attataggcttgagccaccgtg

SEQ ID NO: 9314630 - DNA, 22 bp, Homo sapiens
gctctgctgtggaatcctctcc

SEQ ID NO: 9314631 - DNA, 20 bp, Homo sapiens
caaagacatgctaggggtgg

SEQ ID NO: 9314632 - DNA, 22 bp, Homo sapiens
caaagacacgggaaacaacgtt

SEQ ID NO: 9314633 - DNA, 22 bp, Homo sapiens
caaagaatagtgagaagatgta

SEQ ID NO: 9314634 - DNA, 22 bp, Homo sapiens
gctccagggaacagaatgtact

SEQ ID NO: 9314635 - DNA, 22 bp, Homo sapiens
gctccagggaacagaatgtact

SEQ ID NO: 9314636 - DNA, 22 bp, Homo sapiens
gctcccaggatgaggagccagg

SEQ ID NO: 9314637 - DNA, 22 bp, Homo sapiens
gctcccagggacactggccact

SEQ ID NO: 9314638 - DNA, 22 bp, Homo sapiens
gctcccaggcatggaggtaatt

SEQ ID NO: 9314639 - DNA, 22 bp, Homo sapiens
gctcccaggttcttgggccttg

SEQ ID NO: 9314640 - DNA, 22 bp, Homo sapiens
gctcccaggttcttgggccttg

SEQ ID NO: 9314641 - DNA, 22 bp, Homo sapiens
gctcccagggaccgcagggcag

SEQ ID NO: 9314642 - DNA, 22 bp, Homo sapiens
gctcccagggaccgcagggcag

SEQ ID NO: 9314643 - DNA, 22 bp, Homo sapiens
gctcccagggcagcgcagaaga

SEQ ID NO: 9314644 - DNA, 22 bp, Homo sapiens
gctccccagcttagccctggct

SEQ ID NO: 9314645 - DNA, 22 bp, Homo sapiens
gctcccagtctgatggaggaga

SEQ ID NO: 9314646 - DNA, 22 bp, Homo sapiens
gctcccagtctgatggaggaga

SEQ ID NO: 9314647 - DNA, 22 bp, Homo sapiens
gctcccagttcccaaagtgacc

SEQ ID NO: 9314648 - DNA, 20 bp, Homo sapiens
caaaagcaatgaagttatga

SEQ ID NO: 9314649 - DNA, 22 bp, Homo sapiens
caaaagcagcaagtttatatgt

SEQ ID NO: 9314650 - DNA, 22 bp, Homo sapiens
caaaagcaaagtccctgaatgt

SEQ ID NO: 9314651 - DNA, 22 bp, Homo sapiens
gctcagagagtttcacaagttt

SEQ ID NO: 9314652 - DNA, 22 bp, Homo sapiens
gctcagagagaggctcaccatt

SEQ ID NO: 9314653 - DNA, 21 bp, Homo sapiens
gctcagagagggtaattaacc

SEQ ID NO: 9314654 - DNA, 22 bp, Homo sapiens
gctcagagagattaaataattt

SEQ ID NO: 9314655 - DNA, 19 bp, Homo sapiens
gctcagagacacctgttgc

SEQ ID NO: 9314656 - DNA, 22 bp, Homo sapiens
gctcagagaatttactgctgcc

SEQ ID NO: 9314657 - DNA, 22 bp, Homo sapiens
gctcagagagaggatatgttat

SEQ ID NO: 9314658 - DNA, 22 bp, Homo sapiens
gctcagagaagcggtttcgcct

SEQ ID NO: 9314659 - DNA, 22 bp, Homo sapiens
gctcagagaaattataggaatt

SEQ ID NO: 9314660 - DNA, 22 bp, Homo sapiens
gctcagagaagttaaggaattt

SEQ ID NO: 9314661 - DNA, 22 bp, Homo sapiens
gctcagagaagttgtgcctggc

SEQ ID NO: 9314662 - DNA, 22 bp, Homo sapiens
gctcagagaatcagcagacacc

SEQ ID NO: 9314663 - DNA, 22 bp, Homo sapiens
gctcagagaaaactggggcttg

SEQ ID NO: 9314664 - DNA, 22 bp, Homo sapiens
gctcagagaaagattagtccct

SEQ ID NO: 9314665 - DNA, 22 bp, Homo sapiens
atttggtgcctgggaaatctct

SEQ ID NO: 9314666 - DNA, 22 bp, Homo sapiens
atttggtgttcatcttttagtg

SEQ ID NO: 9314667 - DNA, 22 bp, Homo sapiens
atttggtggttccttttccgaa

SEQ ID NO: 9314668 - DNA, 22 bp, Homo sapiens
atttggtgaggtagccattgtt

SEQ ID NO: 9314669 - DNA, 22 bp, Homo sapiens
atttggtgttgtttggagccta

SEQ ID NO: 9314670 - DNA, 23 bp, Homo sapiens
atttggtgttggttctgccaccc

SEQ ID NO: 9314671 - DNA, 22 bp, Homo sapiens
atttggcttacacgatattttc

SEQ ID NO: 9314672 - DNA, 22 bp, Homo sapiens
atttggcttctctaatactata

SEQ ID NO: 9314673 - DNA, 22 bp, Homo sapiens
atttggcttggcaacaactttc

SEQ ID NO: 9314674 - DNA, 21 bp, Homo sapiens
attttcattaattcagtgtgg

SEQ ID NO: 9314675 - DNA, 22 bp, Homo sapiens
gccttccctggctaggcaagca

SEQ ID NO: 9314676 - DNA, 22 bp, Homo sapiens
gcctgtgctgttccctctgcca

SEQ ID NO: 9314677 - DNA, 22 bp, Homo sapiens
attttccttctaagaggaaggt

SEQ ID NO: 9314678 - DNA, 22 bp, Homo sapiens
attgtactagaaattgtattca

SEQ ID NO: 9314679 - DNA, 22 bp, Homo sapiens
attgtacatatgatgtatgtaa

SEQ ID NO: 9314680 - DNA, 22 bp, Homo sapiens
attgtacataaaatgtatgtct

SEQ ID NO: 9314681 - DNA, 20 bp, Homo sapiens
gcatggcatgtagtgaagtg

SEQ ID NO: 9314682 - DNA, 22 bp, Homo sapiens
gccagctgccaagttgtgagat

SEQ ID NO: 9314683 - DNA, 22 bp, Homo sapiens
gccagccagtttgctgatggct

SEQ ID NO: 9314684 - DNA, 22 bp, Homo sapiens
atttataacgtgcagccagggt

SEQ ID NO: 9314685 - DNA, 22 bp, Homo sapiens
atttagtttaggaaaagtaggt

SEQ ID NO: 9314686 - DNA, 22 bp, Homo sapiens
atttatattttgggagctcctg

SEQ ID NO: 9314687 - DNA, 22 bp, Homo sapiens
atttataacgtgcagccagggt

SEQ ID NO: 9314688 - DNA, 22 bp, Homo sapiens
atttatgattagcctattgttg

SEQ ID NO: 9314689 - DNA, 22 bp, Homo sapiens
atttattaagcatctgctatgt

SEQ ID NO: 9314690 - DNA, 21 bp, Homo sapiens
atttatgtttggggtggaatg

SEQ ID NO: 9314691 - DNA, 22 bp, Homo sapiens
atttattatgggatttggcaca

SEQ ID NO: 9314692 - DNA, 22 bp, Homo sapiens
gccatcatatcccctgtgacct

SEQ ID NO: 9314693 - DNA, 22 bp, Homo sapiens
atttattacctcggagtttctg

SEQ ID NO: 9314694 - DNA, 19 bp, Homo sapiens
gccatcctgcccttgacat

SEQ ID NO: 9314695 - DNA, 22 bp, Homo sapiens
gccatcctgatgacaggccact

SEQ ID NO: 9314696 - DNA, 23 bp, Homo sapiens
gccatcctaaaacccctgtctgt

SEQ ID NO: 9314697 - DNA, 22 bp, Homo sapiens
gccatcctctgagcactaggca

SEQ ID NO: 9314698 - DNA, 22 bp, Homo sapiens
gccatctcggagctatcaaagg

SEQ ID NO: 9314699 - DNA, 22 bp, Homo sapiens
gccatcctggattcagaccaaa

SEQ ID NO: 9314700 - DNA, 20 bp, Homo sapiens
gccatgaggggaggtgactg

SEQ ID NO: 9314701 - DNA, 20 bp, Homo sapiens
gccatgaggggaggtgactg

SEQ ID NO: 9314702 - DNA, 22 bp, Homo sapiens
atttattggtttgcatggtgaa

SEQ ID NO: 9314703 - DNA, 22 bp, Homo sapiens
atttattggtttgcatggtgaa

SEQ ID NO: 9314704 - DNA, 19 bp, Homo sapiens
atttattgtatgattccat

SEQ ID NO: 9314705 - DNA, 22 bp, Homo sapiens
atttcaagaaggcagcagtggt

SEQ ID NO: 9314706 - DNA, 22 bp, Homo sapiens
atttcaagaaggcagcagtggt

SEQ ID NO: 9314707 - DNA, 22 bp, Homo sapiens
gcccaggagttgaatgcagcag

SEQ ID NO: 9314708 - DNA, 22 bp, Homo sapiens
atttcttacataacaaattgtt

SEQ ID NO: 9314709 - DNA, 22 bp, Homo sapiens
gccctgtcctcctgactgagtg

SEQ ID NO: 9314710 - DNA, 23 bp, Homo sapiens
atttcctaaaagataatcattac

SEQ ID NO: 9314711 - DNA, 22 bp, Homo sapiens
gccctggggaaggtgtctccaa

SEQ ID NO: 9314712 - DNA, 22 bp, Homo sapiens
gaggctcctcattcagtatgct

SEQ ID NO: 9314713 - DNA, 22 bp, Homo sapiens
gaggctcctccttacatttacc

SEQ ID NO: 9314714 - DNA, 22 bp, Homo sapiens
gaggctccttgaaagggggact

SEQ ID NO: 9314715 - DNA, 22 bp, Homo sapiens
gaggctccggtagtagccttga

SEQ ID NO: 9314716 - DNA, 22 bp, Homo sapiens
gaggctccgtgctgctgccctg

SEQ ID NO: 9314717 - DNA, 22 bp, Homo sapiens
gaggctccctttaggtccagat

SEQ ID NO: 9314718 - DNA, 22 bp, Homo sapiens
gaggctcccaaggggctaggcc

SEQ ID NO: 9314719 - DNA, 22 bp, Homo sapiens
gaggctccctcaactctgggtg

SEQ ID NO: 9314720 - DNA, 22 bp, Homo sapiens
gaggctccccatgaggccccag

SEQ ID NO: 9314721 - DNA, 22 bp, Homo sapiens
gaggctccagcgacacctaggc

SEQ ID NO: 9314722 - DNA, 22 bp, Homo sapiens
gaggctccagcgacacctaggc

SEQ ID NO: 9314723 - DNA, 22 bp, Homo sapiens
gaggctccatggaggagtatgg

SEQ ID NO: 9314724 - DNA, 22 bp, Homo sapiens
gaggcctgggttggaggtgcat

SEQ ID NO: 9314725 - DNA, 22 bp, Homo sapiens
atgtattatggttttccttaag

SEQ ID NO: 9314726 - DNA, 22 bp, Homo sapiens
atgtatgatatttccagtatca

SEQ ID NO: 9314727 - DNA, 22 bp, Homo sapiens
gaggcacagagtaggtgcacac

SEQ ID NO: 9314728 - DNA, 22 bp, Homo sapiens
gaggcacagtgtttggtcagtg

SEQ ID NO: 9314729 - DNA, 22 bp, Homo sapiens
gaggcacagtgtttggtcagtg

SEQ ID NO: 9314730 - DNA, 22 bp, Homo sapiens
atgtagctgcagatgataatgc

SEQ ID NO: 9314731 - DNA, 22 bp, Homo sapiens
gaggaggggcacttgtctccta

SEQ ID NO: 9314732 - DNA, 22 bp, Homo sapiens
atgggcagagtggggacaggaa

SEQ ID NO: 9314733 - DNA, 22 bp, Homo sapiens
atgggcagctgcagcagtggtg

SEQ ID NO: 9314734 - DNA, 22 bp, Homo sapiens
gaggagggagctggaagctctt

SEQ ID NO: 9314735 - DNA, 22 bp, Homo sapiens
atgttagttttatatttgtggg

SEQ ID NO: 9314736 - DNA, 22 bp, Homo sapiens
atgttagttttggtgagagtac

SEQ ID NO: 9314737 - DNA, 22 bp, Homo sapiens
atgttagtgaccaaatctttct

SEQ ID NO: 9314738 - DNA, 22 bp, Homo sapiens
atgttagtgtcactttgtacaa

SEQ ID NO: 9314739 - DNA, 22 bp, Homo sapiens
atgttagttgaattgaggagtg

SEQ ID NO: 9314740 - DNA, 22 bp, Homo sapiens
atgttagtttgtagagtagatg

SEQ ID NO: 9314741 - DNA, 22 bp, Homo sapiens
atgttagtgatagtaaatagtg

SEQ ID NO: 9314742 - DNA, 22 bp, Homo sapiens
gaggtgtgaggaatgaatgggg

SEQ ID NO: 9314743 - DNA, 22 bp, Homo sapiens
atgttacagttgagtaaattaa

SEQ ID NO: 9314744 - DNA, 22 bp, Homo sapiens
atgttacagaaagcaaagatga

SEQ ID NO: 9314745 - DNA, 22 bp, Homo sapiens
atgttagaaggaatgttaaaag

SEQ ID NO: 9314746 - DNA, 22 bp, Homo sapiens
atgttagtgaagttgctcaaat

SEQ ID NO: 9314747 - DNA, 20 bp, Homo sapiens
atgtgaggggttgaagtggg

SEQ ID NO: 9314748 - DNA, 22 bp, Homo sapiens
atgtgaggtagataggatgcag

SEQ ID NO: 9314749 - DNA, 22 bp, Homo sapiens
atgtgcttcataatcttctcat

SEQ ID NO: 9314750 - DNA, 22 bp, Homo sapiens
atgtgcttatggtctctggttg

SEQ ID NO: 9314751 - DNA, 22 bp, Homo sapiens
atgtgcttggacattctaggaa

SEQ ID NO: 9314752 - DNA, 22 bp, Homo sapiens
atgtgctttccaatgctgtagg

SEQ ID NO: 9314753 - DNA, 22 bp, Homo sapiens
atgtgctttctttgtttcataa

SEQ ID NO: 9314754 - DNA, 22 bp, Homo sapiens
atgggagagggtaggaattact

SEQ ID NO: 9314755 - DNA, 22 bp, Homo sapiens
atgggagggtggaaaggctctg

SEQ ID NO: 9314756 - DNA, 22 bp, Homo sapiens
atggcagacgaggcagcagggg

SEQ ID NO: 9314757 - DNA, 22 bp, Homo sapiens
atggcagacctgggctggagaa

SEQ ID NO: 9314758 - DNA, 22 bp, Homo sapiens
atggctccaagatggagagcca

SEQ ID NO: 9314759 - DNA, 18 bp, Homo sapiens
atggctccagtgtcttcc

SEQ ID NO: 9314760 - DNA, 22 bp, Homo sapiens
atggctccagcttggcttcacc

SEQ ID NO: 9314761 - DNA, 22 bp, Homo sapiens
gagcccagtctgctcctgcgcc

SEQ ID NO: 9314762 - DNA, 22 bp, Homo sapiens
atgggcaaggggtaaggacact

SEQ ID NO: 9314763 - DNA, 17 bp, Homo sapiens
gagcccctttccaagtt

SEQ ID NO: 9314764 - DNA, 22 bp, Homo sapiens
gagctgcagagctcgaaggaac

SEQ ID NO: 9314765 - DNA, 22 bp, Homo sapiens
atgggcagagtggggacaggaa

SEQ ID NO: 9314766 - DNA, 21 bp, Homo sapiens
atgggcagaggcagagaggct

SEQ ID NO: 9314767 - DNA, 22 bp, Homo sapiens
atggcaccttccccagagctca

SEQ ID NO: 9314768 - DNA, 22 bp, Homo sapiens
atggcagacctgggctggagaa

SEQ ID NO: 9314769 - DNA, 22 bp, Homo sapiens
atggcagacacaggcaggcaga

SEQ ID NO: 9314770 - DNA, 22 bp, Homo sapiens
atggatattggccaaactcatt

SEQ ID NO: 9314771 - DNA, 22 bp, Homo sapiens
atgctggcagccgagtgctcca

SEQ ID NO: 9314772 - DNA, 22 bp, Homo sapiens
atgctggcagccgagtgctcca

SEQ ID NO: 9314773 - DNA, 22 bp, Homo sapiens
atgctggcagccgagtgctcca

SEQ ID NO: 9314774 - DNA, 22 bp, Homo sapiens
atgcttaaccttggtgtacaat

SEQ ID NO: 9314775 - DNA, 18 bp, Homo sapiens
gagaagtgcatacattat

SEQ ID NO: 9314776 - DNA, 17 bp, Homo sapiens
gagaagttttgctaccg

SEQ ID NO: 9314777 - DNA, 22 bp, Homo sapiens
gagaagtttttcttattacatg

SEQ ID NO: 9314778 - DNA, 22 bp, Homo sapiens
gagaagtgcagagtggttaagc

SEQ ID NO: 9314779 - DNA, 17 bp, Homo sapiens
cttgttttccactggga

SEQ ID NO: 9314780 - DNA, 22 bp, Homo sapiens
cttgttttaaactgttgtggct

SEQ ID NO: 9314781 - DNA, 22 bp, Homo sapiens
ctttattagatgtagactttct

SEQ ID NO: 9314782 - DNA, 22 bp, Homo sapiens
ctttattagatgtagactttct

SEQ ID NO: 9314783 - DNA, 22 bp, Homo sapiens
ctttattcctacaagattttct

SEQ ID NO: 9314784 - DNA, 22 bp, Homo sapiens
ctttattcctacaagattttct

SEQ ID NO: 9314785 - DNA, 22 bp, Homo sapiens
ctttattcctacaagattttct

SEQ ID NO: 9314786 - DNA, 22 bp, Homo sapiens
ctttattctgcaaattgccttg

SEQ ID NO: 9314787 - DNA, 22 bp, Homo sapiens
ctttattctgcaaattgccttg

SEQ ID NO: 9314788 - DNA, 22 bp, Homo sapiens
ctttattgtccttcttaggtgg

SEQ ID NO: 9314789 - DNA, 22 bp, Homo sapiens
ctttacttcagcaagctttcct

SEQ ID NO: 9314790 - DNA, 22 bp, Homo sapiens
ctttactgtttggtgctctatt

SEQ ID NO: 9314791 - DNA, 22 bp, Homo sapiens
ctttatgttggggtgtcttagt

SEQ ID NO: 9314792 - DNA, 22 bp, Homo sapiens
ctttacttgctttgttacaaaa

SEQ ID NO: 9314793 - DNA, 22 bp, Homo sapiens
ctttatgtgtactttccatttt

SEQ ID NO: 9314794 - DNA, 18 bp, Homo sapiens
cttctcccatcttggcca

SEQ ID NO: 9314795 - DNA, 22 bp, Homo sapiens
cttctccctggcttctgcacac

SEQ ID NO: 9314796 - DNA, 22 bp, Homo sapiens
cttctccctggcttctgcacac

SEQ ID NO: 9314797 - DNA, 22 bp, Homo sapiens
cttctcctctgagtcctgggag

SEQ ID NO: 9314798 - DNA, 22 bp, Homo sapiens
cttctccctgggggctctttat

SEQ ID NO: 9314799 - DNA, 22 bp, Homo sapiens
cttctcctaaggtcagaattgc

SEQ ID NO: 9314800 - DNA, 22 bp, Homo sapiens
cttctccagccacgcccactcc

SEQ ID NO: 9314801 - DNA, 22 bp, Homo sapiens
cttctccagccacgcccactcc

SEQ ID NO: 9314802 - DNA, 22 bp, Homo sapiens
cttctccagccacgcccactcc

SEQ ID NO: 9314803 - DNA, 22 bp, Homo sapiens
atctttcatctctattatttga

SEQ ID NO: 9314804 - DNA, 22 bp, Homo sapiens
atctttctatggtactttctcc

SEQ ID NO: 9314805 - DNA, 22 bp, Homo sapiens
atctttctccatatacatcttt

SEQ ID NO: 9314806 - DNA, 22 bp, Homo sapiens
atctttctatttctaaaaacta

SEQ ID NO: 9314807 - DNA, 22 bp, Homo sapiens
atctttcaatcaggaaaaatct

SEQ ID NO: 9314808 - DNA, 22 bp, Homo sapiens
atctttcactttttgtggatga

SEQ ID NO: 9314809 - DNA, 22 bp, Homo sapiens
atctttcaggcctagtgtttaa

SEQ ID NO: 9314810 - DNA, 22 bp, Homo sapiens
atctttcagggccatttgtatt

SEQ ID NO: 9314811 - DNA, 22 bp, Homo sapiens
ctttttataccgtgccagttga

SEQ ID NO: 9314812 - DNA, 22 bp, Homo sapiens
ctttttatctcttaatgatgtt

SEQ ID NO: 9314813 - DNA, 22 bp, Homo sapiens
ctttttatagctatgtcctatg

SEQ ID NO: 9314814 - DNA, 22 bp, Homo sapiens
atgagatgaggaatggccctcc

SEQ ID NO: 9314815 - DNA, 22 bp, Homo sapiens
atgagatgtgtctaatggaacc

SEQ ID NO: 9314816 - DNA, 18 bp, Homo sapiens
atgagaggtgtcagaaga

SEQ ID NO: 9314817 - DNA, 22 bp, Homo sapiens
atgagaggtttcgtcagaggaa

SEQ ID NO: 9314818 - DNA, 22 bp, Homo sapiens
atgagaggtttcgtcagaggaa

SEQ ID NO: 9314819 - DNA, 22 bp, Homo sapiens
atgagatgttcaggagtctgag

SEQ ID NO: 9314820 - DNA, 22 bp, Homo sapiens
atgagaatggtgattctgcaga

SEQ ID NO: 9314821 - DNA, 22 bp, Homo sapiens
atgagaatgcattcatgttttg

SEQ ID NO: 9314822 - DNA, 22 bp, Homo sapiens
atgacacttggtgatactttgt

SEQ ID NO: 9314823 - DNA, 22 bp, Homo sapiens
atgacagacagaagggattttt

SEQ ID NO: 9314824 - DNA, 22 bp, Homo sapiens
atgacagaaggcctccctgaca

SEQ ID NO: 9314825 - DNA, 22 bp, Homo sapiens
ctttggcttgccctggcagtac

SEQ ID NO: 9314826 - DNA, 22 bp, Homo sapiens
ctttggcttgccctggcagtac

SEQ ID NO: 9314827 - DNA, 22 bp, Homo sapiens
ctttggcttttagatatccatt

SEQ ID NO: 9314828 - DNA, 22 bp, Homo sapiens
ctttggctgtcctcttggctgg

SEQ ID NO: 9314829 - DNA, 22 bp, Homo sapiens
ctttggctggcaccccagcggg

SEQ ID NO: 9314830 - DNA, 22 bp, Homo sapiens
ctttggctgggcaaagggaggt

SEQ ID NO: 9314831 - DNA, 22 bp, Homo sapiens
ctttggcttgcactattacact

SEQ ID NO: 9314832 - DNA, 22 bp, Homo sapiens
ctttggctgacgaggaggaggc

SEQ ID NO: 9314833 - DNA, 22 bp, Homo sapiens
ctttggctgcattcgagttgct

SEQ ID NO: 9314834 - DNA, 22 bp, Homo sapiens
ctttggctgggcaaagggaggt

SEQ ID NO: 9314835 - DNA, 22 bp, Homo sapiens
ctttggctgacgaggaggaggc

SEQ ID NO: 9314836 - DNA, 22 bp, Homo sapiens
ctttggctgcattcgagttgct

SEQ ID NO: 9314837 - DNA, 22 bp, Homo sapiens
ctttctttcgaagacgtgatta

SEQ ID NO: 9314838 - DNA, 20 bp, Homo sapiens
ctttgcctattctctgcctg

SEQ ID NO: 9314839 - DNA, 23 bp, Homo sapiens
ctttgccacccagagcctgacag

SEQ ID NO: 9314840 - DNA, 22 bp, Homo sapiens
ctttgcttctccaacctgctca

SEQ ID NO: 9314841 - DNA, 22 bp, Homo sapiens
ctttgcttactggtgtctgcat

SEQ ID NO: 9314842 - DNA, 22 bp, Homo sapiens
ctttggctaacaaatcagcttg

SEQ ID NO: 9314843 - DNA, 22 bp, Homo sapiens
ctttggctgacaggtttctggt

SEQ ID NO: 9314844 - DNA, 22 bp, Homo sapiens
ctttggctacaagcgctgcaat

SEQ ID NO: 9314845 - DNA, 22 bp, Homo sapiens
ctttggctcatggttttatcca

SEQ ID NO: 9314846 - DNA, 22 bp, Homo sapiens
ctttggctctttagaattccct

SEQ ID NO: 9314847 - DNA, 20 bp, Homo sapiens
gaagtcctgttatatccttt

SEQ ID NO: 9314848 - DNA, 20 bp, Homo sapiens
gaagtcctttcactcttccc

SEQ ID NO: 9314849 - DNA, 22 bp, Homo sapiens
gaagtcatccactatgggggag

SEQ ID NO: 9314850 - DNA, 22 bp, Homo sapiens
gaagtcatgctcccatcttgct

SEQ ID NO: 9314851 - DNA, 22 bp, Homo sapiens
gaagtcctcctatcttgctctt

SEQ ID NO: 9314852 - DNA, 22 bp, Homo sapiens
atgcagttttcaaagactattc

SEQ ID NO: 9314853 - DNA, 22 bp, Homo sapiens
gaagtagattcgttgcatcttg

SEQ ID NO: 9314854 - DNA, 22 bp, Homo sapiens
gaagtagaaagcctcgtaaata

SEQ ID NO: 9314855 - DNA, 22 bp, Homo sapiens
gaagtagaaaactcagtttcaa

SEQ ID NO: 9314856 - DNA, 22 bp, Homo sapiens
atgccactgcacttcagcctgg

SEQ ID NO: 9314857 - DNA, 19 bp, Homo sapiens
gaatttatctcttcagtcc

SEQ ID NO: 9314858 - DNA, 22 bp, Homo sapiens
gaatttcaagcagtgcaatgtt

SEQ ID NO: 9314859 - DNA, 22 bp, Homo sapiens
atgccactgcactccagcctgg

SEQ ID NO: 9314860 - DNA, 22 bp, Homo sapiens
atgccactgcactccagcctag

SEQ ID NO: 9314861 - DNA, 22 bp, Homo sapiens
gacaggaaaggggtctgttttc

SEQ ID NO: 9314862 - DNA, 22 bp, Homo sapiens
atgctatacatatgacatcaca

SEQ ID NO: 9314863 - DNA, 17 bp, Homo sapiens
gaatttcttggtcaaaa

SEQ ID NO: 9314864 - DNA, 22 bp, Homo sapiens
gaatttctggaccctttgagaa

SEQ ID NO: 9314865 - DNA, 22 bp, Homo sapiens
gaatttgtgctcaggaagatta

SEQ ID NO: 9314866 - DNA, 22 bp, Homo sapiens
gaatttgtcccttgatataaaa

SEQ ID NO: 9314867 - DNA, 22 bp, Homo sapiens
atgcctggactgtatcccagat

SEQ ID NO: 9314868 - DNA, 22 bp, Homo sapiens
atgctaaggcccaggagaaaat

SEQ ID NO: 9314869 - DNA, 22 bp, Homo sapiens
atgatgttaccagtacttagag

SEQ ID NO: 9314870 - DNA, 22 bp, Homo sapiens
atgatgttgataaattacttta

SEQ ID NO: 9314871 - DNA, 22 bp, Homo sapiens
atgatgttgataaattacttta

SEQ ID NO: 9314872 - DNA, 22 bp, Homo sapiens
atgatgttattttcagaaacat

SEQ ID NO: 9314873 - DNA, 22 bp, Homo sapiens
atgatgttaccagtacttagag

SEQ ID NO: 9314874 - DNA, 22 bp, Homo sapiens
atgagctagaaaaccatgtgga

SEQ ID NO: 9314875 - DNA, 22 bp, Homo sapiens
gaaggaggcgttagccctagga

SEQ ID NO: 9314876 - DNA, 22 bp, Homo sapiens
gaagctggggtgctgagggcaa

SEQ ID NO: 9314877 - DNA, 22 bp, Homo sapiens
gaagctaatgatttattttctg

SEQ ID NO: 9314878 - DNA, 22 bp, Homo sapiens
gaagctccgtactatgactttt

SEQ ID NO: 9314879 - DNA, 22 bp, Homo sapiens
gtgagatggagttggtgtcttt

SEQ ID NO: 9314880 - DNA, 22 bp, Homo sapiens
gtgagagtgtttggaaatagaa

SEQ ID NO: 9314881 - DNA, 22 bp, Homo sapiens
gtgagagggctgggctcatgat

SEQ ID NO: 9314882 - DNA, 22 bp, Homo sapiens
gtcctgtcccccaaggctgtgg

SEQ ID NO: 9314883 - DNA, 22 bp, Homo sapiens
cagccctgtctatgactgatga

SEQ ID NO: 9314884 - DNA, 22 bp, Homo sapiens
cagccctgtccaatgtctgctc

SEQ ID NO: 9314885 - DNA, 22 bp, Homo sapiens
cagccctgaaacaacctcctct

SEQ ID NO: 9314886 - DNA, 22 bp, Homo sapiens
cagccctggcccaggtgcctta

SEQ ID NO: 9314887 - DNA, 22 bp, Homo sapiens
gtccagagtattcaagtaactt

SEQ ID NO: 9314888 - DNA, 20 bp, Homo sapiens
gtccagagtaatgtgctgac

SEQ ID NO: 9314889 - DNA, 22 bp, Homo sapiens
cagccaggacagggaaactagt

SEQ ID NO: 9314890 - DNA, 22 bp, Homo sapiens
cagccaggatggagaactgttg

SEQ ID NO: 9314891 - DNA, 22 bp, Homo sapiens
cagccaggcccagatcatgctg

SEQ ID NO: 9314892 - DNA, 22 bp, Homo sapiens
cagccaggcccagatcatgctg

SEQ ID NO: 9314893 - DNA, 22 bp, Homo sapiens
cagccaggcccagatcatgctg

SEQ ID NO: 9314894 - DNA, 22 bp, Homo sapiens
cagccaggagcctctgcaacta

SEQ ID NO: 9314895 - DNA, 22 bp, Homo sapiens
cagccaggagctccccctgctc

SEQ ID NO: 9314896 - DNA, 22 bp, Homo sapiens
cagccaggactcccatttagga

SEQ ID NO: 9314897 - DNA, 22 bp, Homo sapiens
cagccaggagcctctgcaacta

SEQ ID NO: 9314898 - DNA, 22 bp, Homo sapiens
cagccaggagcctctgcaacta

SEQ ID NO: 9314899 - DNA, 22 bp, Homo sapiens
gtccagagaggcaggaggctac

SEQ ID NO: 9314900 - DNA, 22 bp, Homo sapiens
gtccagagccggaagagtgaca

SEQ ID NO: 9314901 - DNA, 22 bp, Homo sapiens
gtccagagccggaagagtgaca

SEQ ID NO: 9314902 - DNA, 22 bp, Homo sapiens
gtccagagatggacgagcagat

SEQ ID NO: 9314903 - DNA, 22 bp, Homo sapiens
gtccagagggctgcaggatgct

SEQ ID NO: 9314904 - DNA, 22 bp, Homo sapiens
gtccagagctggcacactgtca

SEQ ID NO: 9314905 - DNA, 21 bp, Homo sapiens
gtcacacaggcctggagctga

SEQ ID NO: 9314906 - DNA, 22 bp, Homo sapiens
gtcacaagggagcctgggcgca

SEQ ID NO: 9314907 - DNA, 22 bp, Homo sapiens
gtcacacagagccctgtgctca

SEQ ID NO: 9314908 - DNA, 22 bp, Homo sapiens
gtcagatctttggggatgctgt

SEQ ID NO: 9314909 - DNA, 22 bp, Homo sapiens
gtcagcagtggcagctcccggg

SEQ ID NO: 9314910 - DNA, 22 bp, Homo sapiens
gtacacataggttactgattaa

SEQ ID NO: 9314911 - DNA, 22 bp, Homo sapiens
cagcagcctagaagctctacca

SEQ ID NO: 9314912 - DNA, 20 bp, Homo sapiens
gtacacttcatgtttcacct

SEQ ID NO: 9314913 - DNA, 20 bp, Homo sapiens
gtacacatatatgtatgtgt

SEQ ID NO: 9314914 - DNA, 23 bp, Homo sapiens
gtacacatagtgtagttatattt

SEQ ID NO: 9314915 - DNA, 22 bp, Homo sapiens
gtagaaaaagcagtaagtctca

SEQ ID NO: 9314916 - DNA, 22 bp, Homo sapiens
gtagaaaattaggatgaggctt

SEQ ID NO: 9314917 - DNA, 22 bp, Homo sapiens
gtaggcagataggagtgcagcc

SEQ ID NO: 9314918 - DNA, 22 bp, Homo sapiens
gtaggctgtgtgaggctagaga

SEQ ID NO: 9314919 - DNA, 22 bp, Homo sapiens
gtaggcagtggttggaagagaa

SEQ ID NO: 9314920 - DNA, 22 bp, Homo sapiens
cagcaaaggggatgcgtcctaa

SEQ ID NO: 9314921 - DNA, 22 bp, Homo sapiens
cagcaaagcaggctcctagaac

SEQ ID NO: 9314922 - DNA, 22 bp, Homo sapiens
cagcaaagcttgttccttcctg

SEQ ID NO: 9314923 - DNA, 22 bp, Homo sapiens
cagcaaagcttaatttatatct

SEQ ID NO: 9314924 - DNA, 22 bp, Homo sapiens
cagcagcagattcagcgtctgg

SEQ ID NO: 9314925 - DNA, 22 bp, Homo sapiens
cagcagcctacaatgcacagaa

SEQ ID NO: 9314926 - DNA, 22 bp, Homo sapiens
cagcagccctttggctgaactg

SEQ ID NO: 9314927 - DNA, 22 bp, Homo sapiens
cagatttagagtggggcttgga

SEQ ID NO: 9314928 - DNA, 22 bp, Homo sapiens
gggctgtggagccgcgagggct

SEQ ID NO: 9314929 - DNA, 22 bp, Homo sapiens
gggctgtggagccgcgagggct

SEQ ID NO: 9314930 - DNA, 22 bp, Homo sapiens
gggctgtggagccgcgagggct

SEQ ID NO: 9314931 - DNA, 18 bp, Homo sapiens
gggctgtgagatgggaag

SEQ ID NO: 9314932 - DNA, 18 bp, Homo sapiens
gggctgtgagatgggaag

SEQ ID NO: 9314933 - DNA, 22 bp, Homo sapiens
gggctgtgctgagtaggaggtg

SEQ ID NO: 9314934 - DNA, 22 bp, Homo sapiens
gggctggatctcacgtgagacc

SEQ ID NO: 9314935 - DNA, 22 bp, Homo sapiens
gggctggaggaccggcctcgga

SEQ ID NO: 9314936 - DNA, 22 bp, Homo sapiens
gggctggaggaccggcctcgga

SEQ ID NO: 9314937 - DNA, 22 bp, Homo sapiens
gggctggaggagatccagaggc

SEQ ID NO: 9314938 - DNA, 22 bp, Homo sapiens
ggggcctctgggaacccctgtg

SEQ ID NO: 9314939 - DNA, 22 bp, Homo sapiens
ggggcctcgccgccgcctctgc

SEQ ID NO: 9314940 - DNA, 22 bp, Homo sapiens
ggggcctgtagagcttcaggga

SEQ ID NO: 9314941 - DNA, 22 bp, Homo sapiens
ggggcctgcgaggttcaacttc

SEQ ID NO: 9314942 - DNA, 19 bp, Homo sapiens
ggggcctgtgatggtcaca

SEQ ID NO: 9314943 - DNA, 22 bp, Homo sapiens
ggggtgagctgggcctgtgcct

SEQ ID NO: 9314944 - DNA, 22 bp, Homo sapiens
ggggccttttctgaatgtggaa

SEQ ID NO: 9314945 - DNA, 22 bp, Homo sapiens
ggggccttggatctgtgccccg

SEQ ID NO: 9314946 - DNA, 20 bp, Homo sapiens
ggtcctgccttcatcacttc

SEQ ID NO: 9314947 - DNA, 23 bp, Homo sapiens
ggtcctgcccccggtcgcccaaa

SEQ ID NO: 9314948 - DNA, 22 bp, Homo sapiens
ggtcctgaggggagctgaaggt

SEQ ID NO: 9314949 - DNA, 22 bp, Homo sapiens
ggtcctggcagctctgtgtcca

SEQ ID NO: 9314950 - DNA, 18 bp, Homo sapiens
ggtcaagaaagtaaggca

SEQ ID NO: 9314951 - DNA, 19 bp, Homo sapiens
cagatgagaaaagtgaggt

SEQ ID NO: 9314952 - DNA, 22 bp, Homo sapiens
gggttaggttctagaggcacaa

SEQ ID NO: 9314953 - DNA, 22 bp, Homo sapiens
gggttcagactaaagctatgca

SEQ ID NO: 9314954 - DNA, 22 bp, Homo sapiens
gggtgtgttacaatgatgccga

SEQ ID NO: 9314955 - DNA, 20 bp, Homo sapiens
gggtgtgggcccggccaggc

SEQ ID NO: 9314956 - DNA, 22 bp, Homo sapiens
gggtgtggctgcgtgccaataa

SEQ ID NO: 9314957 - DNA, 22 bp, Homo sapiens
gggtgtgcaggtcatggcgtct

SEQ ID NO: 9314958 - DNA, 22 bp, Homo sapiens
gggtgggatctgtggagcctca

SEQ ID NO: 9314959 - DNA, 22 bp, Homo sapiens
gggttcaggttggcctgagcac

SEQ ID NO: 9314960 - DNA, 22 bp, Homo sapiens
gggttcagagtcaggtgtgata

SEQ ID NO: 9314961 - DNA, 22 bp, Homo sapiens
gggttcagtgatgccttcagga

SEQ ID NO: 9314962 - DNA, 22 bp, Homo sapiens
gggttccaaacatagtcttcct

SEQ ID NO: 9314963 - DNA, 22 bp, Homo sapiens
gggtccaggtcttcaggcagag

SEQ ID NO: 9314964 - DNA, 22 bp, Homo sapiens
gggtccaggtttagtcatttgt

SEQ ID NO: 9314965 - DNA, 22 bp, Homo sapiens
gggtccagtttcatctgaggtt

SEQ ID NO: 9314966 - DNA, 22 bp, Homo sapiens
gggtccagtttcatctgaggtt

SEQ ID NO: 9314967 - DNA, 22 bp, Homo sapiens
gggtccagtagttggtggccgt

SEQ ID NO: 9314968 - DNA, 22 bp, Homo sapiens
gggtccagtagttggtggccgt

SEQ ID NO: 9314969 - DNA, 22 bp, Homo sapiens
gggtgggatctgtggagcctca

SEQ ID NO: 9314970 - DNA, 22 bp, Homo sapiens
gggcaggggtagcattccaagt

SEQ ID NO: 9314971 - DNA, 22 bp, Homo sapiens
gggcaggggtcagtggccccaa

SEQ ID NO: 9314972 - DNA, 18 bp, Homo sapiens
cagagcagaggtggagcg

SEQ ID NO: 9314973 - DNA, 22 bp, Homo sapiens
cagagcagaaggtccaagcctg

SEQ ID NO: 9314974 - DNA, 22 bp, Homo sapiens
gggcaggtactgggtggtgagc

SEQ ID NO: 9314975 - DNA, 22 bp, Homo sapiens
cagagcaggcccactgccctcc

SEQ ID NO: 9314976 - DNA, 22 bp, Homo sapiens
gggcaggtacaagatgcttctt

SEQ ID NO: 9314977 - DNA, 22 bp, Homo sapiens
gggcaggtactgggtggtgagc

SEQ ID NO: 9314978 - DNA, 22 bp, Homo sapiens
gggcaggggtcagtggccccaa

SEQ ID NO: 9314979 - DNA, 22 bp, Homo sapiens
cagagccactgtctgccaggca

SEQ ID NO: 9314980 - DNA, 22 bp, Homo sapiens
cagagccaaacctcagggcccg

SEQ ID NO: 9314981 - DNA, 19 bp, Homo sapiens
cagagcagtggttcctgaa

SEQ ID NO: 9314982 - DNA, 22 bp, Homo sapiens
cagagcagtggggttggtcaga

SEQ ID NO: 9314983 - DNA, 22 bp, Homo sapiens
cagagcagtgaggagttgtgta

SEQ ID NO: 9314984 - DNA, 20 bp, Homo sapiens
cagagcagtgcccaggcggc

SEQ ID NO: 9314985 - DNA, 22 bp, Homo sapiens
cagagcagtggagagtaggtct

SEQ ID NO: 9314986 - DNA, 20 bp, Homo sapiens
cagagcagtgcccaggcggc

SEQ ID NO: 9314987 - DNA, 20 bp, Homo sapiens
gggaggcattggtccctcac

SEQ ID NO: 9314988 - DNA, 22 bp, Homo sapiens
cagagacacttaacaggaatgg

SEQ ID NO: 9314989 - DNA, 22 bp, Homo sapiens
cagagacaacctggtagagaaa

SEQ ID NO: 9314990 - DNA, 22 bp, Homo sapiens
gggatgagagtagggtgtgaaa

SEQ ID NO: 9314991 - DNA, 22 bp, Homo sapiens
cagagcagaaacctgggtgatt

SEQ ID NO: 9314992 - DNA, 22 bp, Homo sapiens
cagagcagaagcggtcctcaca

SEQ ID NO: 9314993 - DNA, 22 bp, Homo sapiens
gggatgagagctgggacagaag

SEQ ID NO: 9314994 - DNA, 22 bp, Homo sapiens
gggatgagagctgggacagaag

SEQ ID NO: 9314995 - DNA, 22 bp, Homo sapiens
gggatctttctgatgctgtggc

SEQ ID NO: 9314996 - DNA, 22 bp, Homo sapiens
gggatctttctgatgctgtggc

SEQ ID NO: 9314997 - DNA, 22 bp, Homo sapiens
gggatcttgaaacagctggatt

SEQ ID NO: 9314998 - DNA, 21 bp, Homo sapiens
gggatcttgtactggcgtgga

SEQ ID NO: 9314999 - DNA, 22 bp, Homo sapiens
gggagctgccttagaccggagg

SEQ ID NO: 9315000 - DNA, 22 bp, Homo sapiens
gggagctgccaccacccctggg

SEQ ID NO: 9315001 - DNA, 22 bp, Homo sapiens
gggagctgcggtcttgcgaaga

SEQ ID NO: 9315002 - DNA, 20 bp, Homo sapiens
gggagctggaattgtcttag

SEQ ID NO: 9315003 - DNA, 21 bp, Homo sapiens
gggagctggaaactgggtgac

SEQ ID NO: 9315004 - DNA, 22 bp, Homo sapiens
gggagctgctgaacacaagggt

SEQ ID NO: 9315005 - DNA, 22 bp, Homo sapiens
gggaggcacgaggcgcgcagtg

SEQ ID NO: 9315006 - DNA, 22 bp, Homo sapiens
gggaggcagtgctggaggctgg

SEQ ID NO: 9315007 - DNA, 22 bp, Homo sapiens
gggaggcagtgctggaggctgg

SEQ ID NO: 9315008 - DNA, 22 bp, Homo sapiens
gggaggcagtgctggaggctgg

SEQ ID NO: 9315009 - DNA, 22 bp, Homo sapiens
gggagctgcacacgccccggaa

SEQ ID NO: 9315010 - DNA, 22 bp, Homo sapiens
gggagctgatgatgtaagtccc

SEQ ID NO: 9315011 - DNA, 22 bp, Homo sapiens
gggagctgatcaggtggattca

SEQ ID NO: 9315012 - DNA, 22 bp, Homo sapiens
gggagccaaggagagaggcctt

SEQ ID NO: 9315013 - DNA, 22 bp, Homo sapiens
ggctggcaagtcagtgctgatg

SEQ ID NO: 9315014 - DNA, 22 bp, Homo sapiens
ggctggcaagtgtctgctcatg

SEQ ID NO: 9315015 - DNA, 22 bp, Homo sapiens
ggctggcacagagggctggtgt

SEQ ID NO: 9315016 - DNA, 22 bp, Homo sapiens
ggctggcacctgccctccgctg

SEQ ID NO: 9315017 - DNA, 22 bp, Homo sapiens
ggctggcacgaagccctgctgg

SEQ ID NO: 9315018 - DNA, 22 bp, Homo sapiens
ggctggcactctgtccagtgtc

SEQ ID NO: 9315019 - DNA, 22 bp, Homo sapiens
ggctggcacgaagccctgctgg

SEQ ID NO: 9315020 - DNA, 22 bp, Homo sapiens
ggctggcactgaggagagctct

SEQ ID NO: 9315021 - DNA, 22 bp, Homo sapiens
ggctggcactgaggagagctct

SEQ ID NO: 9315022 - DNA, 22 bp, Homo sapiens
cagaaacacttgtagagaagtt

SEQ ID NO: 9315023 - DNA, 22 bp, Homo sapiens
cagaaacacttgtagagaagtt

SEQ ID NO: 9315024 - DNA, 22 bp, Homo sapiens
cagaaacacttgtagagaagtt

SEQ ID NO: 9315025 - DNA, 22 bp, Homo sapiens
cagacaattaagtaattgaggt

SEQ ID NO: 9315026 - DNA, 21 bp, Homo sapiens
caatcacttttgcaccaagct

SEQ ID NO: 9315027 - DNA, 22 bp, Homo sapiens
caattgctttgtggaagccttt

SEQ ID NO: 9315028 - DNA, 22 bp, Homo sapiens
caattgcttttccaagggcaga

SEQ ID NO: 9315029 - DNA, 22 bp, Homo sapiens
caattgctttcttaccaagaga

SEQ ID NO: 9315030 - DNA, 22 bp, Homo sapiens
caattgctgatatgcagaagac

SEQ ID NO: 9315031 - DNA, 18 bp, Homo sapiens
caatagaaacagtaggaa

SEQ ID NO: 9315032 - DNA, 22 bp, Homo sapiens
caatagaaaactcaatacttaa

SEQ ID NO: 9315033 - DNA, 20 bp, Homo sapiens
caatagaatgtggagataag

SEQ ID NO: 9315034 - DNA, 22 bp, Homo sapiens
caatagaaggcacagataggta

SEQ ID NO: 9315035 - DNA, 22 bp, Homo sapiens
caaggctgcttcagactagtga

SEQ ID NO: 9315036 - DNA, 22 bp, Homo sapiens
caaggctgtgcagggtccatat

SEQ ID NO: 9315037 - DNA, 22 bp, Homo sapiens
caaggctgctgcgggtcgcacc

SEQ ID NO: 9315038 - DNA, 22 bp, Homo sapiens
caaggccttgctgtctcctcct

SEQ ID NO: 9315039 - DNA, 22 bp, Homo sapiens
ggagaagggacagactcagctt

SEQ ID NO: 9315040 - DNA, 22 bp, Homo sapiens
ggagagaggagcccactgctgt

SEQ ID NO: 9315041 - DNA, 22 bp, Homo sapiens
ggactgggtaggagcccagggc

SEQ ID NO: 9315042 - DNA, 22 bp, Homo sapiens
cacacaggtatatatatgtaca

SEQ ID NO: 9315043 - DNA, 22 bp, Homo sapiens
ggacatggagcatgtagagaaa

SEQ ID NO: 9315044 - DNA, 22 bp, Homo sapiens
ggacatggagctccatggaggc

SEQ ID NO: 9315045 - DNA, 22 bp, Homo sapiens
ggaagctgaacttagcaaggaa

SEQ ID NO: 9315046 - DNA, 22 bp, Homo sapiens
ggaagctgaacttagcaaggaa

SEQ ID NO: 9315047 - DNA, 22 bp, Homo sapiens
ggaagcggccctgagcgcaggg

SEQ ID NO: 9315048 - DNA, 22 bp, Homo sapiens
ggaagctgcataactagcgtgg

SEQ ID NO: 9315049 - DNA, 22 bp, Homo sapiens
ggaagctgggatctctctcccg

SEQ ID NO: 9315050 - DNA, 22 bp, Homo sapiens
ggaagctgccagtccaccagct

SEQ ID NO: 9315051 - DNA, 22 bp, Homo sapiens
caagcctgtctcaccagtgcta

SEQ ID NO: 9315052 - DNA, 22 bp, Homo sapiens
gctgggctcaccaggccactag

SEQ ID NO: 9315053 - DNA, 22 bp, Homo sapiens
gctgggcttgtggccagctggg

SEQ ID NO: 9315054 - DNA, 22 bp, Homo sapiens
gctggggactccccaccatagc

SEQ ID NO: 9315055 - DNA, 22 bp, Homo sapiens
gctggggagcaagagtagtgag

SEQ ID NO: 9315056 - DNA, 22 bp, Homo sapiens
gctggggagcaagagtagtgag

SEQ ID NO: 9315057 - DNA, 17 bp, Homo sapiens
gctggctgacccatgcc

SEQ ID NO: 9315058 - DNA, 22 bp, Homo sapiens
gctggctgagatctgttttcct

SEQ ID NO: 9315059 - DNA, 22 bp, Homo sapiens
gctggctgacagatttggggtg

SEQ ID NO: 9315060 - DNA, 22 bp, Homo sapiens
gctggctgaatcttctgcaata

SEQ ID NO: 9315061 - DNA, 22 bp, Homo sapiens
gctggctgacagagatttaaaa

SEQ ID NO: 9315062 - DNA, 20 bp, Homo sapiens
gctggctgaactgaaagcaa

SEQ ID NO: 9315063 - DNA, 22 bp, Homo sapiens
gctggctgaggtctagctcttt

SEQ ID NO: 9315064 - DNA, 22 bp, Homo sapiens
gctggctgagttctgtcgtctg

SEQ ID NO: 9315065 - DNA, 22 bp, Homo sapiens
gctggctgaggtctagctcttt

SEQ ID NO: 9315066 - DNA, 22 bp, Homo sapiens
gctggctgagcactggtttata

SEQ ID NO: 9315067 - DNA, 22 bp, Homo sapiens
caagaagctttccctgcttgca

SEQ ID NO: 9315068 - DNA, 22 bp, Homo sapiens
caagaaggctatatgggccagg

SEQ ID NO: 9315069 - DNA, 22 bp, Homo sapiens
gctggacccggcccctcacctc

SEQ ID NO: 9315070 - DNA, 22 bp, Homo sapiens
caagaagccgagctacaggctc

SEQ ID NO: 9315071 - DNA, 22 bp, Homo sapiens
caagaagcaaggtcagggccca

SEQ ID NO: 9315072 - DNA, 22 bp, Homo sapiens
caagaagcaaggtcagggccca

SEQ ID NO: 9315073 - DNA, 22 bp, Homo sapiens
caagaagcccttcctgggtgga

SEQ ID NO: 9315074 - DNA, 22 bp, Homo sapiens
gctctggaccctgccagcctta

SEQ ID NO: 9315075 - DNA, 22 bp, Homo sapiens
gctctggactggggcctgagaa

SEQ ID NO: 9315076 - DNA, 22 bp, Homo sapiens
gctctggagatggagccttgag

SEQ ID NO: 9315077 - DNA, 22 bp, Homo sapiens
gctctgcttgcatcatgactgc

SEQ ID NO: 9315078 - DNA, 22 bp, Homo sapiens
gctctggaagcatctgagagga

SEQ ID NO: 9315079 - DNA, 22 bp, Homo sapiens
gctctggatccggctgggtctg

SEQ ID NO: 9315080 - DNA, 18 bp, Homo sapiens
gctctggaggtagcatta

SEQ ID NO: 9315081 - DNA, 23 bp, Homo sapiens
gctctggagctgggcctggcagg

SEQ ID NO: 9315082 - DNA, 22 bp, Homo sapiens
caaagtcagggaagagtggctg

SEQ ID NO: 9315083 - DNA, 22 bp, Homo sapiens
gctgccctgcctcagactcctc

SEQ ID NO: 9315084 - DNA, 22 bp, Homo sapiens
gctgccctgtccggctctcctg

SEQ ID NO: 9315085 - DNA, 22 bp, Homo sapiens
gctgccctgactccagcagcct

SEQ ID NO: 9315086 - DNA, 22 bp, Homo sapiens
caaattttgtgtgttctctagt

SEQ ID NO: 9315087 - DNA, 22 bp, Homo sapiens
caactttatgattggtttgtca

SEQ ID NO: 9315088 - DNA, 22 bp, Homo sapiens
caagaacagtttgccaaattgg

SEQ ID NO: 9315089 - DNA, 22 bp, Homo sapiens
cacctgcctcatttgtccctgc

SEQ ID NO: 9315090 - DNA, 22 bp, Homo sapiens
caccaggctgagcctctcatct

SEQ ID NO: 9315091 - DNA, 22 bp, Homo sapiens
caccaggctgaaccagagggga

SEQ ID NO: 9315092 - DNA, 20 bp, Homo sapiens
caccaggcgctctgagaaca

SEQ ID NO: 9315093 - DNA, 22 bp, Homo sapiens
ggccaggctggtctcagacttc

SEQ ID NO: 9315094 - DNA, 22 bp, Homo sapiens
ggccaggctgccctgggagcag

SEQ ID NO: 9315095 - DNA, 22 bp, Homo sapiens
cacctgctccctcagttccagc

SEQ ID NO: 9315096 - DNA, 22 bp, Homo sapiens
cactcagaggtttgattgctca

SEQ ID NO: 9315097 - DNA, 22 bp, Homo sapiens
cactatttcctggattttgacg

SEQ ID NO: 9315098 - DNA, 22 bp, Homo sapiens
cactattttctcttcagatggc

SEQ ID NO: 9315099 - DNA, 22 bp, Homo sapiens
cactagtcctggtttcatgcta

SEQ ID NO: 9315100 - DNA, 19 bp, Homo sapiens
cactagtctagatgggatg

SEQ ID NO: 9315101 - DNA, 23 bp, Homo sapiens
cacggcagcctccgagggtgctg

SEQ ID NO: 9315102 - DNA, 22 bp, Homo sapiens
cactgcactccagcctgggaga

SEQ ID NO: 9315103 - DNA, 22 bp, Homo sapiens
cactctctcaggctttccttgt

SEQ ID NO: 9315104 - DNA, 22 bp, Homo sapiens
cactccctctagttgcattctg

SEQ ID NO: 9315105 - DNA, 22 bp, Homo sapiens
cactcccttcaggagcctagga

SEQ ID NO: 9315106 - DNA, 21 bp, Homo sapiens
cactctcccaatccttgctga

SEQ ID NO: 9315107 - DNA, 21 bp, Homo sapiens
cactctcccaatccttgctga

SEQ ID NO: 9315108 - DNA, 22 bp, Homo sapiens
cactctccagcacaccccattt

SEQ ID NO: 9315109 - DNA, 22 bp, Homo sapiens
ggctctgcttcctggaattgtg

SEQ ID NO: 9315110 - DNA, 22 bp, Homo sapiens
cactgcactccagcctgggtca

SEQ ID NO: 9315111 - DNA, 22 bp, Homo sapiens
cactgcactccagcctgggtga

SEQ ID NO: 9315112 - DNA, 22 bp, Homo sapiens
cactttaactcacatttcagct

SEQ ID NO: 9315113 - DNA, 22 bp, Homo sapiens
cacttgatatcttatatttaat

SEQ ID NO: 9315114 - DNA, 22 bp, Homo sapiens
cacttgatgttgtcactattgc

SEQ ID NO: 9315115 - DNA, 22 bp, Homo sapiens
cacttctctgataatctcagtt

SEQ ID NO: 9315116 - DNA, 22 bp, Homo sapiens
ggctctggaaagtgtccttgat

SEQ ID NO: 9315117 - DNA, 20 bp, Homo sapiens
ggctctggaatctggtgggc

SEQ ID NO: 9315118 - DNA, 22 bp, Homo sapiens
cacttagtctcaccagttcagt

SEQ ID NO: 9315119 - DNA, 22 bp, Homo sapiens
ggcaatagttgtgggttcttta

SEQ ID NO: 9315120 - DNA, 22 bp, Homo sapiens
ggcaataatgacattttaaaaa

SEQ ID NO: 9315121 - DNA, 22 bp, Homo sapiens
cacatgaaggctggggtcgtga

SEQ ID NO: 9315122 - DNA, 19 bp, Homo sapiens
cacatgagggctgagggac

SEQ ID NO: 9315123 - DNA, 22 bp, Homo sapiens
ggcagagtcagaggtggttctg

SEQ ID NO: 9315124 - DNA, 22 bp, Homo sapiens
ggcagagtgctctgggcagggg

SEQ ID NO: 9315125 - DNA, 22 bp, Homo sapiens
ggcagagttggtggagtcagtt

SEQ ID NO: 9315126 - DNA, 22 bp, Homo sapiens
ggcagagttggtggagtcagtt

SEQ ID NO: 9315127 - DNA, 22 bp, Homo sapiens
ggcagatgacagaccagtatgt

SEQ ID NO: 9315128 - DNA, 22 bp, Homo sapiens
ggcagatggaagaggctgggtc

SEQ ID NO: 9315129 - DNA, 18 bp, Homo sapiens
ggcagatgacaggagaga

SEQ ID NO: 9315130 - DNA, 20 bp, Homo sapiens
ggcagatgcagagctatgca

SEQ ID NO: 9315131 - DNA, 22 bp, Homo sapiens
cacattcaattacacagatagg

SEQ ID NO: 9315132 - DNA, 22 bp, Homo sapiens
cacatgtgtatatgtgaggggg

SEQ ID NO: 9315133 - DNA, 22 bp, Homo sapiens
cacatgttcttaacttctgttt

SEQ ID NO: 9315134 - DNA, 22 bp, Homo sapiens
cacattcctggtgctcagcagc

SEQ ID NO: 9315135 - DNA, 22 bp, Homo sapiens
caccactggaggtcttggcttt

SEQ ID NO: 9315136 - DNA, 22 bp, Homo sapiens
caccactgtatccctagcactt

SEQ ID NO: 9315137 - DNA, 22 bp, Homo sapiens
caccagctactccagggccgtg

SEQ ID NO: 9315138 - DNA, 22 bp, Homo sapiens
cacattcaggtggcatgttaga

SEQ ID NO: 9315139 - DNA, 22 bp, Homo sapiens
cacattcagggcagaccactca

SEQ ID NO: 9315140 - DNA, 22 bp, Homo sapiens
caccagctccaccagggcaggt

SEQ ID NO: 9315141 - DNA, 22 bp, Homo sapiens
caccaggagccatcaggagtcc

SEQ ID NO: 9315142 - DNA, 22 bp, Homo sapiens
cacagggctttgatggctgagt

SEQ ID NO: 9315143 - DNA, 18 bp, Homo sapiens
cacaggcaggtgataggt

SEQ ID NO: 9315144 - DNA, 22 bp, Homo sapiens
cacagggcaggccccaggcctc

SEQ ID NO: 9315145 - DNA, 22 bp, Homo sapiens
cacaggcctgtctctttctaac

SEQ ID NO: 9315146 - DNA, 22 bp, Homo sapiens
cacaggaggttaggaagtggtc

SEQ ID NO: 9315147 - DNA, 22 bp, Homo sapiens
ggagagcctccacggcttctgt

SEQ ID NO: 9315148 - DNA, 22 bp, Homo sapiens
cacaggcagccttgtagaagaa

SEQ ID NO: 9315149 - DNA, 21 bp, Homo sapiens
cacaggtgggtcagtgaggcc

SEQ ID NO: 9315150 - DNA, 22 bp, Homo sapiens
ggcaagtgatcctggagcaccg

SEQ ID NO: 9315151 - DNA, 22 bp, Homo sapiens
ggcaagtcaggaagttgacatt

SEQ ID NO: 9315152 - DNA, 22 bp, Homo sapiens
ggcaaggtactctagagcacat

SEQ ID NO: 9315153 - DNA, 22 bp, Homo sapiens
ggcaaggtactctagagcacat

SEQ ID NO: 9315154 - DNA, 22 bp, Homo sapiens
ggcaagtaatacaggattattt

SEQ ID NO: 9315155 - DNA, 22 bp, Homo sapiens
ggcaaggtgctacagacagtga

SEQ ID NO: 9315156 - DNA, 22 bp, Homo sapiens
ggcaagtatttgtgcatctaca

SEQ ID NO: 9315157 - DNA, 22 bp, Homo sapiens
atatcattctgatgtatatctt

SEQ ID NO: 9315158 - DNA, 20 bp, Homo sapiens
ctgggccatccttttacaat

SEQ ID NO: 9315159 - DNA, 22 bp, Homo sapiens
ctgggcctctcagctcccgcgg

SEQ ID NO: 9315160 - DNA, 22 bp, Homo sapiens
ctgggccatctctctgcaagtg

SEQ ID NO: 9315161 - DNA, 22 bp, Homo sapiens
ctgggccatctctctgcaagtg

SEQ ID NO: 9315162 - DNA, 20 bp, Homo sapiens
ctgggctgggctacagggtc

SEQ ID NO: 9315163 - DNA, 22 bp, Homo sapiens
ctgggctgggtttaccctcttc

SEQ ID NO: 9315164 - DNA, 22 bp, Homo sapiens
ctgggctgtaatgtggcactga

SEQ ID NO: 9315165 - DNA, 22 bp, Homo sapiens
ctgggctgtaatgtggcactga

SEQ ID NO: 9315166 - DNA, 22 bp, Homo sapiens
ctgggctgatttagtcacgttt

SEQ ID NO: 9315167 - DNA, 22 bp, Homo sapiens
ctgggcctgccaccatcttagg

SEQ ID NO: 9315168 - DNA, 22 bp, Homo sapiens
atatattttttgagacagagtc

SEQ ID NO: 9315169 - DNA, 22 bp, Homo sapiens
atatattttgcggtcacgtggc

SEQ ID NO: 9315170 - DNA, 22 bp, Homo sapiens
atatattttgcggtcacgtggc

SEQ ID NO: 9315171 - DNA, 22 bp, Homo sapiens
atagtacatgggtgtcctcaca

SEQ ID NO: 9315172 - DNA, 22 bp, Homo sapiens
atagtagcgagatctcagctca

SEQ ID NO: 9315173 - DNA, 22 bp, Homo sapiens
atagtagctttgatgcctttat

SEQ ID NO: 9315174 - DNA, 22 bp, Homo sapiens
atagtagaaggcatatttggaa

SEQ ID NO: 9315175 - DNA, 23 bp, Homo sapiens
atagtagcagtatgacaggccat

SEQ ID NO: 9315176 - DNA, 22 bp, Homo sapiens
atagtagcattttctccatgta

SEQ ID NO: 9315177 - DNA, 22 bp, Homo sapiens
atagtatgttgtggtaaataat

SEQ ID NO: 9315178 - DNA, 22 bp, Homo sapiens
atagtatgagctcatacacttg

SEQ ID NO: 9315179 - DNA, 23 bp, Homo sapiens
atagtcatgtaaaatatttgaag

SEQ ID NO: 9315180 - DNA, 22 bp, Homo sapiens
atagtcactgccttccatttgt

SEQ ID NO: 9315181 - DNA, 22 bp, Homo sapiens
ctgtatttcccacattctctat

SEQ ID NO: 9315182 - DNA, 22 bp, Homo sapiens
ctgtaatcccagctactcggga

SEQ ID NO: 9315183 - DNA, 20 bp, Homo sapiens
ctgtatcaggttacaaagta

SEQ ID NO: 9315184 - DNA, 22 bp, Homo sapiens
ctgtatgattccatttctataa

SEQ ID NO: 9315185 - DNA, 22 bp, Homo sapiens
ctgtatgaaattgtcattttta

SEQ ID NO: 9315186 - DNA, 22 bp, Homo sapiens
ctggggatcctttttgcatcta

SEQ ID NO: 9315187 - DNA, 22 bp, Homo sapiens
ctggggagtgaaattcttaaat

SEQ ID NO: 9315188 - DNA, 22 bp, Homo sapiens
ctggggagtgaaggtaattaca

SEQ ID NO: 9315189 - DNA, 22 bp, Homo sapiens
ctggggaggatgctacgacctg

SEQ ID NO: 9315190 - DNA, 22 bp, Homo sapiens
ctggggaggcagggctgcccct

SEQ ID NO: 9315191 - DNA, 22 bp, Homo sapiens
ctgggctgttctgcccctgggt

SEQ ID NO: 9315192 - DNA, 22 bp, Homo sapiens
ctgggctgtcccaaccccatcc

SEQ ID NO: 9315193 - DNA, 22 bp, Homo sapiens
ctgggctgtcccagggcggcag

SEQ ID NO: 9315194 - DNA, 22 bp, Homo sapiens
ctgggctgtcccagggcggcag

SEQ ID NO: 9315195 - DNA, 22 bp, Homo sapiens
ctgggctgtcccagggcggcag

SEQ ID NO: 9315196 - DNA, 22 bp, Homo sapiens
ctgggctgtcaatggccctctg

SEQ ID NO: 9315197 - DNA, 22 bp, Homo sapiens
ctgggctgtcagttttgtttta

SEQ ID NO: 9315198 - DNA, 22 bp, Homo sapiens
ctgggctgtggtgtggcccaaa

SEQ ID NO: 9315199 - DNA, 23 bp, Homo sapiens
ctgggctgtcctgaggtcacctc

SEQ ID NO: 9315200 - DNA, 19 bp, Homo sapiens
ctggtcctgactgaggggt

SEQ ID NO: 9315201 - DNA, 17 bp, Homo sapiens
ctggggatgtgggactc

SEQ ID NO: 9315202 - DNA, 19 bp, Homo sapiens
ctgtgcaggccgggctgag

SEQ ID NO: 9315203 - DNA, 22 bp, Homo sapiens
ctgtgcctccaagtggtctctg

SEQ ID NO: 9315204 - DNA, 22 bp, Homo sapiens
ctgtgcctcagtgtcctcgagt

SEQ ID NO: 9315205 - DNA, 22 bp, Homo sapiens
ctgtgcctaagatgcatgtctc

SEQ ID NO: 9315206 - DNA, 22 bp, Homo sapiens
ctgtgcctccagtctcgcttct

SEQ ID NO: 9315207 - DNA, 22 bp, Homo sapiens
ctgtgcctgccttgttcactga

SEQ ID NO: 9315208 - DNA, 20 bp, Homo sapiens
ctgtgcctcctgctagtcct

SEQ ID NO: 9315209 - DNA, 22 bp, Homo sapiens
ctgtgccttctgcctggaacat

SEQ ID NO: 9315210 - DNA, 22 bp, Homo sapiens
ctgtgccttagtattctcattt

SEQ ID NO: 9315211 - DNA, 22 bp, Homo sapiens
ctgtgtccaatggccttagcag

SEQ ID NO: 9315212 - DNA, 22 bp, Homo sapiens
ctgttatttatgctgctccatt

SEQ ID NO: 9315213 - DNA, 22 bp, Homo sapiens
ctgttattccccttgctgtggt

SEQ ID NO: 9315214 - DNA, 22 bp, Homo sapiens
ctgttactggacgcacgcagct

SEQ ID NO: 9315215 - DNA, 22 bp, Homo sapiens
ctgttatctgttattgccagtt

SEQ ID NO: 9315216 - DNA, 22 bp, Homo sapiens
ctgttagtgatcaaagggagag

SEQ ID NO: 9315217 - DNA, 22 bp, Homo sapiens
ctgttatattggtatatttaca

SEQ ID NO: 9315218 - DNA, 18 bp, Homo sapiens
ctgttagtagatatttac

SEQ ID NO: 9315219 - DNA, 22 bp, Homo sapiens
ctgttagtcttttgcaggagag

SEQ ID NO: 9315220 - DNA, 22 bp, Homo sapiens
ctgttagtaatgaagagaatgg

SEQ ID NO: 9315221 - DNA, 22 bp, Homo sapiens
ctgtttattctcatctaaaatg

SEQ ID NO: 9315222 - DNA, 21 bp, Homo sapiens
ctgtttatttcacctgggtgc

SEQ ID NO: 9315223 - DNA, 22 bp, Homo sapiens
ctgtttattgagcaatctgcca

SEQ ID NO: 9315224 - DNA, 22 bp, Homo sapiens
ctgtttatggaggtaaggcatc

SEQ ID NO: 9315225 - DNA, 22 bp, Homo sapiens
ctgtttattacactggatagca

SEQ ID NO: 9315226 - DNA, 22 bp, Homo sapiens
ctgtttatctctaacctgttta

SEQ ID NO: 9315227 - DNA, 22 bp, Homo sapiens
ctgtttatgaagctgtggttta

SEQ ID NO: 9315228 - DNA, 20 bp, Homo sapiens
ctgtttattagaagtggatt

SEQ ID NO: 9315229 - DNA, 22 bp, Homo sapiens
ctgtttattacgtaattaatat

SEQ ID NO: 9315230 - DNA, 22 bp, Homo sapiens
ctgttatttggaggatgcttgg

SEQ ID NO: 9315231 - DNA, 22 bp, Homo sapiens
ctgtttatctctaacctgttta

SEQ ID NO: 9315232 - DNA, 22 bp, Homo sapiens
ctgtttatctaggagttgcagg

SEQ ID NO: 9315233 - DNA, 22 bp, Homo sapiens
ctgtttatccctttggtcagca

SEQ ID NO: 9315234 - DNA, 22 bp, Homo sapiens
atcattccacatgtaccactag

SEQ ID NO: 9315235 - DNA, 22 bp, Homo sapiens
atcattaaatataagcttcaca

SEQ ID NO: 9315236 - DNA, 22 bp, Homo sapiens
ctgtgtccccctcagccaggtg

SEQ ID NO: 9315237 - DNA, 22 bp, Homo sapiens
cttcagtttatcccatcatcca

SEQ ID NO: 9315238 - DNA, 22 bp, Homo sapiens
cttcatgaggaagatttcacaa

SEQ ID NO: 9315239 - DNA, 23 bp, Homo sapiens
cttcatgagagccctgaggaaaa

SEQ ID NO: 9315240 - DNA, 22 bp, Homo sapiens
cttcatatctctgtagagtttt

SEQ ID NO: 9315241 - DNA, 22 bp, Homo sapiens
cttcatggtaaatctgccttta

SEQ ID NO: 9315242 - DNA, 22 bp, Homo sapiens
cttcagagtgcagaagattggg

SEQ ID NO: 9315243 - DNA, 22 bp, Homo sapiens
cttcagagcttgttaaaactgt

SEQ ID NO: 9315244 - DNA, 22 bp, Homo sapiens
cttcagagagtccagggactgc

SEQ ID NO: 9315245 - DNA, 22 bp, Homo sapiens
cttcagagaacttgatcgctgc

SEQ ID NO: 9315246 - DNA, 22 bp, Homo sapiens
cttcagagaacttgatcgctgc

SEQ ID NO: 9315247 - DNA, 22 bp, Homo sapiens
ctgtttccctccagggggtgga

SEQ ID NO: 9315248 - DNA, 22 bp, Homo sapiens
ctgtttcagctactgttccatg

SEQ ID NO: 9315249 - DNA, 22 bp, Homo sapiens
ctgtttcatgtcttccgcagct

SEQ ID NO: 9315250 - DNA, 22 bp, Homo sapiens
ctgtttcaatttgaggatcagc

SEQ ID NO: 9315251 - DNA, 22 bp, Homo sapiens
ctgtttcaccactggctctttg

SEQ ID NO: 9315252 - DNA, 22 bp, Homo sapiens
atccttcagtggaagacagtag

SEQ ID NO: 9315253 - DNA, 22 bp, Homo sapiens
cttcagcagcctcttgcataaa

SEQ ID NO: 9315254 - DNA, 19 bp, Homo sapiens
cttcagcatctccggagct

SEQ ID NO: 9315255 - DNA, 22 bp, Homo sapiens
cttcagcatctttttcttgggg

SEQ ID NO: 9315256 - DNA, 22 bp, Homo sapiens
atccttcaattagaaccaattg

SEQ ID NO: 9315257 - DNA, 22 bp, Homo sapiens
atccttcaatgggaagttttag

SEQ ID NO: 9315258 - DNA, 23 bp, Homo sapiens
cttcagcagaaacataaattctc

SEQ ID NO: 9315259 - DNA, 22 bp, Homo sapiens
cttcagcagatgcaaaacccct

SEQ ID NO: 9315260 - DNA, 22 bp, Homo sapiens
cttcagcacctcagctggagag

SEQ ID NO: 9315261 - DNA, 22 bp, Homo sapiens
cttcagcagatgtgctagagat

SEQ ID NO: 9315262 - DNA, 22 bp, Homo sapiens
cttcagcaccatagctccttct

SEQ ID NO: 9315263 - DNA, 22 bp, Homo sapiens
cttcagcaccatagctccttct

SEQ ID NO: 9315264 - DNA, 22 bp, Homo sapiens
cttcagagtgcagaagattggg

SEQ ID NO: 9315265 - DNA, 22 bp, Homo sapiens
cttcagcaactttggaatgttt

SEQ ID NO: 9315266 - DNA, 21 bp, Homo sapiens
cttcagcaaatacttggcagg

SEQ ID NO: 9315267 - DNA, 22 bp, Homo sapiens
ctgccctcgggccctcccatag

SEQ ID NO: 9315268 - DNA, 22 bp, Homo sapiens
ctgccctcgggccctcccatag

SEQ ID NO: 9315269 - DNA, 22 bp, Homo sapiens
ctgccctcccagttggtccgtg

SEQ ID NO: 9315270 - DNA, 22 bp, Homo sapiens
ctgccctctagggatgcactgg

SEQ ID NO: 9315271 - DNA, 22 bp, Homo sapiens
ctgccctggtcccatggctgat

SEQ ID NO: 9315272 - DNA, 22 bp, Homo sapiens
ctgccctctagaggaggactga

SEQ ID NO: 9315273 - DNA, 22 bp, Homo sapiens
ctgccctctagggatgcactgg

SEQ ID NO: 9315274 - DNA, 22 bp, Homo sapiens
agttttctgttctacaatttga

SEQ ID NO: 9315275 - DNA, 22 bp, Homo sapiens
agttttctgttctacaatttga

SEQ ID NO: 9315276 - DNA, 22 bp, Homo sapiens
agttttcctttattgagtacca

SEQ ID NO: 9315277 - DNA, 22 bp, Homo sapiens
agttttctctgtgttctgctta

SEQ ID NO: 9315278 - DNA, 21 bp, Homo sapiens
agttttccattagggagggag

SEQ ID NO: 9315279 - DNA, 22 bp, Homo sapiens
agttttcacactcaccaaaagg

SEQ ID NO: 9315280 - DNA, 22 bp, Homo sapiens
ataagtttgtctttgtaaagat

SEQ ID NO: 9315281 - DNA, 22 bp, Homo sapiens
ctgccctgtggctctgagtcat

SEQ ID NO: 9315282 - DNA, 22 bp, Homo sapiens
ataagcctgattcacttgtcat

SEQ ID NO: 9315283 - DNA, 22 bp, Homo sapiens
ctgccctgtctgcagcctggct

SEQ ID NO: 9315284 - DNA, 22 bp, Homo sapiens
ctgcctgcttctgagccagagg

SEQ ID NO: 9315285 - DNA, 18 bp, Homo sapiens
ctgcctgctctccagctt

SEQ ID NO: 9315286 - DNA, 22 bp, Homo sapiens
ctgagtgggtttctgcttgtca

SEQ ID NO: 9315287 - DNA, 22 bp, Homo sapiens
ctgatatgatgggtgattttca

SEQ ID NO: 9315288 - DNA, 22 bp, Homo sapiens
agttttattgtcccagaggtga

SEQ ID NO: 9315289 - DNA, 22 bp, Homo sapiens
ctgatattctttgagctgctaa

SEQ ID NO: 9315290 - DNA, 22 bp, Homo sapiens
ctgatattctattttgcttgct

SEQ ID NO: 9315291 - DNA, 22 bp, Homo sapiens
ctgatattattgaagctggagt

SEQ ID NO: 9315292 - DNA, 22 bp, Homo sapiens
ctgatattcattatggagctcc

SEQ ID NO: 9315293 - DNA, 22 bp, Homo sapiens
agttttatgttcacagaaggat

SEQ ID NO: 9315294 - DNA, 22 bp, Homo sapiens
agtttctcttaatctagtatct

SEQ ID NO: 9315295 - DNA, 22 bp, Homo sapiens
agtttctctcagtatagaatag

SEQ ID NO: 9315296 - DNA, 22 bp, Homo sapiens
agtttatttttgataagtcttg

SEQ ID NO: 9315297 - DNA, 22 bp, Homo sapiens
agtttattctgcttggccctcc

SEQ ID NO: 9315298 - DNA, 22 bp, Homo sapiens
agtttattctgcttggccctcc

SEQ ID NO: 9315299 - DNA, 22 bp, Homo sapiens
agtttattgtatatggtagttt

SEQ ID NO: 9315300 - DNA, 22 bp, Homo sapiens
agtttattgtatatggtagttt

SEQ ID NO: 9315301 - DNA, 22 bp, Homo sapiens
agtgttcaggatctgaggccag

SEQ ID NO: 9315302 - DNA, 22 bp, Homo sapiens
ctgagaggcggaggttgcagtg

SEQ ID NO: 9315303 - DNA, 22 bp, Homo sapiens
agtgttaagagaaaattctgct

SEQ ID NO: 9315304 - DNA, 18 bp, Homo sapiens
agtgttaagtaagtagca

SEQ ID NO: 9315305 - DNA, 21 bp, Homo sapiens
agtgttaatggaaattatatt

SEQ ID NO: 9315306 - DNA, 22 bp, Homo sapiens
agtgttaatggtgtatattagg

SEQ ID NO: 9315307 - DNA, 19 bp, Homo sapiens
agtttattataggtgattc

SEQ ID NO: 9315308 - DNA, 22 bp, Homo sapiens
agtgttcatttattcattcact

SEQ ID NO: 9315309 - DNA, 22 bp, Homo sapiens
ataggccaatactgtagagttt

SEQ ID NO: 9315310 - DNA, 22 bp, Homo sapiens
atagggcctaaaaagtattgct

SEQ ID NO: 9315311 - DNA, 22 bp, Homo sapiens
atagtaagtgatagcatagact

SEQ ID NO: 9315312 - DNA, 22 bp, Homo sapiens
atagacaaacacgaagatgaca

SEQ ID NO: 9315313 - DNA, 22 bp, Homo sapiens
atagacagaaagataatagaat

SEQ ID NO: 9315314 - DNA, 22 bp, Homo sapiens
atagacaacacttattattcct

SEQ ID NO: 9315315 - DNA, 22 bp, Homo sapiens
atagacatagccgtaatttatt

SEQ ID NO: 9315316 - DNA, 22 bp, Homo sapiens
atagacagctacatagaatata

SEQ ID NO: 9315317 - DNA, 22 bp, Homo sapiens
atagaatatgacttttagatcc

SEQ ID NO: 9315318 - DNA, 22 bp, Homo sapiens
atagaaaggtctttggcagaca

SEQ ID NO: 9315319 - DNA, 19 bp, Homo sapiens
atagaaagggttaaagaca

SEQ ID NO: 9315320 - DNA, 22 bp, Homo sapiens
atagaaacagggaagcaaagca

SEQ ID NO: 9315321 - DNA, 22 bp, Homo sapiens
ctggccagtgactgctcacccg

SEQ ID NO: 9315322 - DNA, 22 bp, Homo sapiens
ctggccagaggttcctctgccc

SEQ ID NO: 9315323 - DNA, 22 bp, Homo sapiens
ctggagctgccagggctgccgc

SEQ ID NO: 9315324 - DNA, 22 bp, Homo sapiens
ataatttacaactgcttttaat

SEQ ID NO: 9315325 - DNA, 22 bp, Homo sapiens
ataatttaaattagtatgtgat

SEQ ID NO: 9315326 - DNA, 20 bp, Homo sapiens
ataatttaccctgcaccact

SEQ ID NO: 9315327 - DNA, 22 bp, Homo sapiens
atacagaaaatgatgcagagtt

SEQ ID NO: 9315328 - DNA, 22 bp, Homo sapiens
ataatcattttaattagtggtt

SEQ ID NO: 9315329 - DNA, 22 bp, Homo sapiens
ataattatctcagacacttgtt

SEQ ID NO: 9315330 - DNA, 22 bp, Homo sapiens
ataattcaggttttctggcaca

SEQ ID NO: 9315331 - DNA, 22 bp, Homo sapiens
ataattacattatactgttaga

SEQ ID NO: 9315332 - DNA, 16 bp, Homo sapiens
ataattactgctactt

SEQ ID NO: 9315333 - DNA, 20 bp, Homo sapiens
ataattacatagagattgcc

SEQ ID NO: 9315334 - DNA, 22 bp, Homo sapiens
agtctctttaatcacagtgtct

SEQ ID NO: 9315335 - DNA, 22 bp, Homo sapiens
agtctcttggcattctgaaaca

SEQ ID NO: 9315336 - DNA, 21 bp, Homo sapiens
agtctctctaataaatgcttg

SEQ ID NO: 9315337 - DNA, 22 bp, Homo sapiens
agtcatccaagagcctgggcag

SEQ ID NO: 9315338 - DNA, 22 bp, Homo sapiens
agtcatatattttgtttgtgca

SEQ ID NO: 9315339 - DNA, 19 bp, Homo sapiens
agtcatattgttcatcttg

SEQ ID NO: 9315340 - DNA, 17 bp, Homo sapiens
agtcatattgtgcagtt

SEQ ID NO: 9315341 - DNA, 22 bp, Homo sapiens
agtcattacagcaggcagaagg

SEQ ID NO: 9315342 - DNA, 22 bp, Homo sapiens
agtcattacggactagtactac

SEQ ID NO: 9315343 - DNA, 22 bp, Homo sapiens
agtcattaagacaactggagta

SEQ ID NO: 9315344 - DNA, 22 bp, Homo sapiens
agtcattaattagtaggaaggt

SEQ ID NO: 9315345 - DNA, 23 bp, Homo sapiens
agtcattaagaagttcaggaact

SEQ ID NO: 9315346 - DNA, 22 bp, Homo sapiens
agtcatttggagcaccttatta

SEQ ID NO: 9315347 - DNA, 22 bp, Homo sapiens
ctcaggagttggaggctacagt

SEQ ID NO: 9315348 - DNA, 22 bp, Homo sapiens
ctcaggcacgggtcagtgagcg

SEQ ID NO: 9315349 - DNA, 22 bp, Homo sapiens
ctcaggcacttttgtcacagac

SEQ ID NO: 9315350 - DNA, 22 bp, Homo sapiens
agtctgtgaaaagataggaagt

SEQ ID NO: 9315351 - DNA, 22 bp, Homo sapiens
agtctgcttttgtgaagagctg

SEQ ID NO: 9315352 - DNA, 22 bp, Homo sapiens
ctcccaggtgtcccttctgcca

SEQ ID NO: 9315353 - DNA, 21 bp, Homo sapiens
ctcccagggtgactgttcaac

SEQ ID NO: 9315354 - DNA, 21 bp, Homo sapiens
ctcccagggtgactgttcaac

SEQ ID NO: 9315355 - DNA, 22 bp, Homo sapiens
ctcctcagagagcagcttgggg

SEQ ID NO: 9315356 - DNA, 22 bp, Homo sapiens
ctcccaggttacatctgagcct

SEQ ID NO: 9315357 - DNA, 22 bp, Homo sapiens
ctcccagggtctaggctgctgg

SEQ ID NO: 9315358 - DNA, 22 bp, Homo sapiens
ctcccagggtagggagagacta

SEQ ID NO: 9315359 - DNA, 22 bp, Homo sapiens
ctcccaggggaactatcaagta

SEQ ID NO: 9315360 - DNA, 22 bp, Homo sapiens
ctcccaggggaactatcaagta

SEQ ID NO: 9315361 - DNA, 22 bp, Homo sapiens
ctcctccctgcgattgctctgc

SEQ ID NO: 9315362 - DNA, 22 bp, Homo sapiens
ctcctccccttgagtctgggat

SEQ ID NO: 9315363 - DNA, 18 bp, Homo sapiens
ctcctccctaagggctca

SEQ ID NO: 9315364 - DNA, 22 bp, Homo sapiens
ctcctcccacggtctcaggaag

SEQ ID NO: 9315365 - DNA, 22 bp, Homo sapiens
ctcctcccacggtctcaggaag

SEQ ID NO: 9315366 - DNA, 22 bp, Homo sapiens
agtgcaggagcctggccagagc

SEQ ID NO: 9315367 - DNA, 22 bp, Homo sapiens
ctcctcctggacacaggctgtg

SEQ ID NO: 9315368 - DNA, 23 bp, Homo sapiens
ctcctcgtaactctgtggtgggt

SEQ ID NO: 9315369 - DNA, 22 bp, Homo sapiens
ctcctctcaaaagtaggttgac

SEQ ID NO: 9315370 - DNA, 22 bp, Homo sapiens
ctcctctcaggctggatggcgc

SEQ ID NO: 9315371 - DNA, 22 bp, Homo sapiens
agtgactggtgtgaagttaaat

SEQ ID NO: 9315372 - DNA, 22 bp, Homo sapiens
agtgaccgaggcacttggcaac

SEQ ID NO: 9315373 - DNA, 22 bp, Homo sapiens
agtgcacttttccacatccata

SEQ ID NO: 9315374 - DNA, 22 bp, Homo sapiens
agtgcagagacctggtcaggca

SEQ ID NO: 9315375 - DNA, 22 bp, Homo sapiens
agtgatttgcagtatttactaa

SEQ ID NO: 9315376 - DNA, 22 bp, Homo sapiens
agtgcacaccttagtacaaagt

SEQ ID NO: 9315377 - DNA, 22 bp, Homo sapiens
agtgcagatttttagtcagctt

SEQ ID NO: 9315378 - DNA, 22 bp, Homo sapiens
agtgcagaggctgggaaatgct

SEQ ID NO: 9315379 - DNA, 18 bp, Homo sapiens
ctcaggcagagaagcttt

SEQ ID NO: 9315380 - DNA, 22 bp, Homo sapiens
ctccagttggccccagttggtt

SEQ ID NO: 9315381 - DNA, 17 bp, Homo sapiens
agtggcaggcagatggg

SEQ ID NO: 9315382 - DNA, 22 bp, Homo sapiens
agtggcaggcggagatgtagga

SEQ ID NO: 9315383 - DNA, 22 bp, Homo sapiens
agtggctgaagcatcaaaggca

SEQ ID NO: 9315384 - DNA, 22 bp, Homo sapiens
agtggctggcataggaacagac

SEQ ID NO: 9315385 - DNA, 22 bp, Homo sapiens
agtggctggacgacaagggtga

SEQ ID NO: 9315386 - DNA, 22 bp, Homo sapiens
agtgcaggccccaggccaggcc

SEQ ID NO: 9315387 - DNA, 22 bp, Homo sapiens
agtgcaggccccaggccaggcc

SEQ ID NO: 9315388 - DNA, 22 bp, Homo sapiens
agtgcaggccccaggccaggcc

SEQ ID NO: 9315389 - DNA, 22 bp, Homo sapiens
ctctctccttagctgcagacca

SEQ ID NO: 9315390 - DNA, 22 bp, Homo sapiens
ctctctgggcccagttggcacc

SEQ ID NO: 9315391 - DNA, 22 bp, Homo sapiens
ctctgagaggtgagaagcagca

SEQ ID NO: 9315392 - DNA, 22 bp, Homo sapiens
ctctgagaatatgagctctttg

SEQ ID NO: 9315393 - DNA, 19 bp, Homo sapiens
agtggctgggcagaagcaa

SEQ ID NO: 9315394 - DNA, 22 bp, Homo sapiens
agtggctggtctaaggtcacag

SEQ ID NO: 9315395 - DNA, 22 bp, Homo sapiens
agtggctgtcttccaaaatctg

SEQ ID NO: 9315396 - DNA, 22 bp, Homo sapiens
agtggctgtcctggctctaact

SEQ ID NO: 9315397 - DNA, 22 bp, Homo sapiens
agtgggagggccatatggtgaa

SEQ ID NO: 9315398 - DNA, 22 bp, Homo sapiens
agtgggagagaagcaagtagta

SEQ ID NO: 9315399 - DNA, 22 bp, Homo sapiens
ctgagaggatgctgcagtggag

SEQ ID NO: 9315400 - DNA, 22 bp, Homo sapiens
ctgaagcaggaacagcgagatt

SEQ ID NO: 9315401 - DNA, 18 bp, Homo sapiens
agtgtgtgccctttcagg

SEQ ID NO: 9315402 - DNA, 22 bp, Homo sapiens
agtgtgtgcctttggatacctg

SEQ ID NO: 9315403 - DNA, 22 bp, Homo sapiens
agtgtgtgctgttccccggagg

SEQ ID NO: 9315404 - DNA, 21 bp, Homo sapiens
agtgtgtgtggaatgagaata

SEQ ID NO: 9315405 - DNA, 21 bp, Homo sapiens
agtgtgtgataggcaggaaga

SEQ ID NO: 9315406 - DNA, 22 bp, Homo sapiens
agtgtgtgtttgggcggtttat

SEQ ID NO: 9315407 - DNA, 19 bp, Homo sapiens
ctcttaaattgtctcttgc

SEQ ID NO: 9315408 - DNA, 20 bp, Homo sapiens
ctcttaaatgtaaagtaggc

SEQ ID NO: 9315409 - DNA, 22 bp, Homo sapiens
ctcttaaagcttccagtttcaa

SEQ ID NO: 9315410 - DNA, 22 bp, Homo sapiens
ctcttaaataacatcattgctt

SEQ ID NO: 9315411 - DNA, 22 bp, Homo sapiens
ctcttacacagattcctctagc

SEQ ID NO: 9315412 - DNA, 19 bp, Homo sapiens
ctcttacagaatagacaca

SEQ ID NO: 9315413 - DNA, 22 bp, Homo sapiens
ctcttaaaaacttgatatattt

SEQ ID NO: 9315414 - DNA, 22 bp, Homo sapiens
ctcttaaagaatgttccagctg

SEQ ID NO: 9315415 - DNA, 22 bp, Homo sapiens
agtggggacttatgccagcatt

SEQ ID NO: 9315416 - DNA, 22 bp, Homo sapiens
agtggggaggtccaggccaccc

SEQ ID NO: 9315417 - DNA, 22 bp, Homo sapiens
agtggggaggtccaggccaccc

SEQ ID NO: 9315418 - DNA, 20 bp, Homo sapiens
agtggggagtcaggagtgcc

SEQ ID NO: 9315419 - DNA, 20 bp, Homo sapiens
agtggggagtcaggagtgcc

SEQ ID NO: 9315420 - DNA, 22 bp, Homo sapiens
agtggggaagagcatgggccct

SEQ ID NO: 9315421 - DNA, 22 bp, Homo sapiens
agtggggaagagcatgggccct

SEQ ID NO: 9315422 - DNA, 22 bp, Homo sapiens
agtggggacaatgagagcaggt

SEQ ID NO: 9315423 - DNA, 22 bp, Homo sapiens
cctgcctggagctgagtgtgga

SEQ ID NO: 9315424 - DNA, 22 bp, Homo sapiens
cctgcctggagctgagtgtgga

SEQ ID NO: 9315425 - DNA, 22 bp, Homo sapiens
cctgcctggatcagccatcctg

SEQ ID NO: 9315426 - DNA, 22 bp, Homo sapiens
cctgcctggatcagccatcctg

SEQ ID NO: 9315427 - DNA, 22 bp, Homo sapiens
cctgcctggcccaccttgccac

SEQ ID NO: 9315428 - DNA, 22 bp, Homo sapiens
cctgcctggcccaccttgccac

SEQ ID NO: 9315429 - DNA, 22 bp, Homo sapiens
cctggagcaggagctgcagagg

SEQ ID NO: 9315430 - DNA, 22 bp, Homo sapiens
cctgcctggctgtcagcagagc

SEQ ID NO: 9315431 - DNA, 22 bp, Homo sapiens
agggtggcacctggaagggatg

SEQ ID NO: 9315432 - DNA, 20 bp, Homo sapiens
agggtggcaagttagtgaca

SEQ ID NO: 9315433 - DNA, 19 bp, Homo sapiens
agggtggcaaaggagggtg

SEQ ID NO: 9315434 - DNA, 20 bp, Homo sapiens
agggtggcaagttagtgaca

SEQ ID NO: 9315435 - DNA, 22 bp, Homo sapiens
agggtggcactggtggctctat

SEQ ID NO: 9315436 - DNA, 22 bp, Homo sapiens
cctgcctgcgtcctctgagggc

SEQ ID NO: 9315437 - DNA, 22 bp, Homo sapiens
agggtgctaatctcattcacat

SEQ ID NO: 9315438 - DNA, 22 bp, Homo sapiens
agggtgctgccggacaggtggg

SEQ ID NO: 9315439 - DNA, 22 bp, Homo sapiens
aggggcttcccttcctgggtag

SEQ ID NO: 9315440 - DNA, 22 bp, Homo sapiens
aggggctgtggaaaccaactct

SEQ ID NO: 9315441 - DNA, 22 bp, Homo sapiens
cctggctcagaccccagttctg

SEQ ID NO: 9315442 - DNA, 23 bp, Homo sapiens
cctggctcaccccttatgtccag

SEQ ID NO: 9315443 - DNA, 22 bp, Homo sapiens
cctggctcagagtatgtcatcg

SEQ ID NO: 9315444 - DNA, 22 bp, Homo sapiens
cctggctcagcagctctttctc

SEQ ID NO: 9315445 - DNA, 22 bp, Homo sapiens
cctggctcagcagctctttctc

SEQ ID NO: 9315446 - DNA, 22 bp, Homo sapiens
cctggctcaaggcgaggactcc

SEQ ID NO: 9315447 - DNA, 23 bp, Homo sapiens
cctggctcaccccttatgtccag

SEQ ID NO: 9315448 - DNA, 22 bp, Homo sapiens
cctggcctttgaacgctagact

SEQ ID NO: 9315449 - DNA, 22 bp, Homo sapiens
cctggctaggagagctgggctc

SEQ ID NO: 9315450 - DNA, 22 bp, Homo sapiens
cctggagcccctctggccagcc

SEQ ID NO: 9315451 - DNA, 22 bp, Homo sapiens
agggtggcttaattccaaaggg

SEQ ID NO: 9315452 - DNA, 22 bp, Homo sapiens
cctggccagcagccccttcctc

SEQ ID NO: 9315453 - DNA, 22 bp, Homo sapiens
cctggccttaagggcagggagc

SEQ ID NO: 9315454 - DNA, 22 bp, Homo sapiens
cctgggcaggccggacgctggg

SEQ ID NO: 9315455 - DNA, 22 bp, Homo sapiens
cctgggcagggagaccaggctc

SEQ ID NO: 9315456 - DNA, 22 bp, Homo sapiens
aggtgctgtttgtcagcagttt

SEQ ID NO: 9315457 - DNA, 22 bp, Homo sapiens
cctgggcagtgctggagttgaa

SEQ ID NO: 9315458 - DNA, 22 bp, Homo sapiens
cctgggcagggctggactctca

SEQ ID NO: 9315459 - DNA, 22 bp, Homo sapiens
cctgggtgtcatgggcagctgg

SEQ ID NO: 9315460 - DNA, 22 bp, Homo sapiens
aggtggagtgtgcagggagagc

SEQ ID NO: 9315461 - DNA, 18 bp, Homo sapiens
aggtctgaggaagagcct

SEQ ID NO: 9315462 - DNA, 22 bp, Homo sapiens
aggtctgagcaggggagaacag

SEQ ID NO: 9315463 - DNA, 17 bp, Homo sapiens
aggtctgagagtatctg

SEQ ID NO: 9315464 - DNA, 20 bp, Homo sapiens
aggtctgattccagaatcag

SEQ ID NO: 9315465 - DNA, 22 bp, Homo sapiens
aggtctggaaacagcagggaga

SEQ ID NO: 9315466 - DNA, 22 bp, Homo sapiens
aggtctgacttcaagcctgtgg

SEQ ID NO: 9315467 - DNA, 22 bp, Homo sapiens
aggtctgaaagcctcagtcaca

SEQ ID NO: 9315468 - DNA, 22 bp, Homo sapiens
aggtattattagcatctctatt

SEQ ID NO: 9315469 - DNA, 22 bp, Homo sapiens
aggtctggtgagagcaggtgct

SEQ ID NO: 9315470 - DNA, 23 bp, Homo sapiens
aggtctggacccttggcccctgc

SEQ ID NO: 9315471 - DNA, 22 bp, Homo sapiens
aggtctggaggcggagtcagga

SEQ ID NO: 9315472 - DNA, 22 bp, Homo sapiens
aggtctggaggcggagtcagga

SEQ ID NO: 9315473 - DNA, 22 bp, Homo sapiens
aggtgagggtgccagtgcatgg

SEQ ID NO: 9315474 - DNA, 22 bp, Homo sapiens
aggtctgtgaattcctgagaaa

SEQ ID NO: 9315475 - DNA, 22 bp, Homo sapiens
aggtctggtgagagcaggtgct

SEQ ID NO: 9315476 - DNA, 22 bp, Homo sapiens
aggtctggtgttgggcctgaaa

SEQ ID NO: 9315477 - DNA, 23 bp, Homo sapiens
cgtgcttccaggcccagctgagc

SEQ ID NO: 9315478 - DNA, 22 bp, Homo sapiens
ctaaaattatcaagataattcc

SEQ ID NO: 9315479 - DNA, 22 bp, Homo sapiens
ctaaacaagggattataattga

SEQ ID NO: 9315480 - DNA, 22 bp, Homo sapiens
ctaaacaatgaacaaagcactg

SEQ ID NO: 9315481 - DNA, 22 bp, Homo sapiens
ctaaacaagatactaatgaggt

SEQ ID NO: 9315482 - DNA, 22 bp, Homo sapiens
cgcgctgcagacagcggaggcc

SEQ ID NO: 9315483 - DNA, 22 bp, Homo sapiens
cgcggtggcggcctccagcgcc

SEQ ID NO: 9315484 - DNA, 22 bp, Homo sapiens
cgtgccactgcactctagcctg

SEQ ID NO: 9315485 - DNA, 22 bp, Homo sapiens
cgcggtggcggcctccagcgcc

SEQ ID NO: 9315486 - DNA, 22 bp, Homo sapiens
cggtcaggtgcagcgttggcac

SEQ ID NO: 9315487 - DNA, 22 bp, Homo sapiens
ctacacagttctgcctaatggc

SEQ ID NO: 9315488 - DNA, 21 bp, Homo sapiens
ctacacagctttctataggaa

SEQ ID NO: 9315489 - DNA, 22 bp, Homo sapiens
ctacagaaacactggacatgtg

SEQ ID NO: 9315490 - DNA, 22 bp, Homo sapiens
ctacacttgatggagtttcctt

SEQ ID NO: 9315491 - DNA, 22 bp, Homo sapiens
agtcactttctacttggtttct

SEQ ID NO: 9315492 - DNA, 22 bp, Homo sapiens
ctacaatgacagaattgagtag

SEQ ID NO: 9315493 - DNA, 22 bp, Homo sapiens
aggtgtgggaaacgggtgacct

SEQ ID NO: 9315494 - DNA, 19 bp, Homo sapiens
aggtgtgggggctgcagac

SEQ ID NO: 9315495 - DNA, 19 bp, Homo sapiens
aggtgtgggggctgcagac

SEQ ID NO: 9315496 - DNA, 22 bp, Homo sapiens
aggtgtggctggggcagaggcc

SEQ ID NO: 9315497 - DNA, 22 bp, Homo sapiens
aggttggcctcagggaggctct

SEQ ID NO: 9315498 - DNA, 22 bp, Homo sapiens
aggttggcctcagggaggctct

SEQ ID NO: 9315499 - DNA, 22 bp, Homo sapiens
aggtttagttctgcttatattg

SEQ ID NO: 9315500 - DNA, 22 bp, Homo sapiens
aggttcagtctttggacccctc

SEQ ID NO: 9315501 - DNA, 22 bp, Homo sapiens
aggttcacacacacaaaaagat

SEQ ID NO: 9315502 - DNA, 22 bp, Homo sapiens
aggttcagacgcataataggca

SEQ ID NO: 9315503 - DNA, 20 bp, Homo sapiens
cctttattatttgtatgatg

SEQ ID NO: 9315504 - DNA, 20 bp, Homo sapiens
cctttattatttgtatgatg

SEQ ID NO: 9315505 - DNA, 22 bp, Homo sapiens
cctttatgtcactctggagagc

SEQ ID NO: 9315506 - DNA, 21 bp, Homo sapiens
aggtttatttcaacttcagga

SEQ ID NO: 9315507 - DNA, 22 bp, Homo sapiens
aggtttatgtttggtgcaggag

SEQ ID NO: 9315508 - DNA, 22 bp, Homo sapiens
aggtttatctgaacccggggaa

SEQ ID NO: 9315509 - DNA, 22 bp, Homo sapiens
agtaatcaatttttcggtggat

SEQ ID NO: 9315510 - DNA, 22 bp, Homo sapiens
cgcctgctctcactggacagct

SEQ ID NO: 9315511 - DNA, 22 bp, Homo sapiens
cgcctgctctgtttccatgtgg

SEQ ID NO: 9315512 - DNA, 22 bp, Homo sapiens
cgcctgctctgtttccatgtgg

SEQ ID NO: 9315513 - DNA, 22 bp, Homo sapiens
cgcctgctgatcttgttctctt

SEQ ID NO: 9315514 - DNA, 22 bp, Homo sapiens
cgcctgcttaacgaattgtgtt

SEQ ID NO: 9315515 - DNA, 22 bp, Homo sapiens
aggctgaggggcgagggaccct

SEQ ID NO: 9315516 - DNA, 22 bp, Homo sapiens
aggctgaggggcgagggaccct

SEQ ID NO: 9315517 - DNA, 22 bp, Homo sapiens
ccatggctgcaattcttctgga

SEQ ID NO: 9315518 - DNA, 22 bp, Homo sapiens
ccatggcttctttctctgccag

SEQ ID NO: 9315519 - DNA, 22 bp, Homo sapiens
ccatgcagccacgtctagctaa

SEQ ID NO: 9315520 - DNA, 22 bp, Homo sapiens
aggctgagtcgggaggatcact

SEQ ID NO: 9315521 - DNA, 18 bp, Homo sapiens
ccatggctccctcctgcc

SEQ ID NO: 9315522 - DNA, 22 bp, Homo sapiens
aggctgaggtgtgctgtgatcg

SEQ ID NO: 9315523 - DNA, 22 bp, Homo sapiens
aggctgaggtaggaggatcgct

SEQ ID NO: 9315524 - DNA, 22 bp, Homo sapiens
cccagagccggtggtgctcaca

SEQ ID NO: 9315525 - DNA, 22 bp, Homo sapiens
aggctggcgtcaggggctgtac

SEQ ID NO: 9315526 - DNA, 22 bp, Homo sapiens
aggctggcgtcaggggctgtac

SEQ ID NO: 9315527 - DNA, 17 bp, Homo sapiens
aggctggctcacaggga

SEQ ID NO: 9315528 - DNA, 22 bp, Homo sapiens
aggctggctgacttctgaagca

SEQ ID NO: 9315529 - DNA, 22 bp, Homo sapiens
aggctggctcggcttttctgtc

SEQ ID NO: 9315530 - DNA, 22 bp, Homo sapiens
aggctggctgaaaaacaccctt

SEQ ID NO: 9315531 - DNA, 22 bp, Homo sapiens
aggctggctcggcttttctgtc

SEQ ID NO: 9315532 - DNA, 22 bp, Homo sapiens
cccagagccgctcccctacttc

SEQ ID NO: 9315533 - DNA, 22 bp, Homo sapiens
aggctgcctcttttgagagggt

SEQ ID NO: 9315534 - DNA, 22 bp, Homo sapiens
aggctgctcacctccctgtctg

SEQ ID NO: 9315535 - DNA, 22 bp, Homo sapiens
ccatgggcactgggtggaggta

SEQ ID NO: 9315536 - DNA, 22 bp, Homo sapiens
ccatgtacatgaacacggcggc

SEQ ID NO: 9315537 - DNA, 20 bp, Homo sapiens
aggctgcctaaggctctgca

SEQ ID NO: 9315538 - DNA, 22 bp, Homo sapiens
ccatgtgattccattaggctga

SEQ ID NO: 9315539 - DNA, 22 bp, Homo sapiens
ccatgtgatgtctcgtcagtcc

SEQ ID NO: 9315540 - DNA, 20 bp, Homo sapiens
aggctgcctaaggctctgca

SEQ ID NO: 9315541 - DNA, 22 bp, Homo sapiens
aggctcctagcctgtggctggt

SEQ ID NO: 9315542 - DNA, 22 bp, Homo sapiens
aggctcctatcgctttcagcaa

SEQ ID NO: 9315543 - DNA, 20 bp, Homo sapiens
aggctcctccaggatgtgtg

SEQ ID NO: 9315544 - DNA, 22 bp, Homo sapiens
ccagggaagtagttgtgagagc

SEQ ID NO: 9315545 - DNA, 22 bp, Homo sapiens
aggctcctgcaggtgaggtgct

SEQ ID NO: 9315546 - DNA, 22 bp, Homo sapiens
aggctcctgagaggcagaggct

SEQ ID NO: 9315547 - DNA, 22 bp, Homo sapiens
aggctcctgatcctggggtctg

SEQ ID NO: 9315548 - DNA, 22 bp, Homo sapiens
ccagggtcttggagaggagtgc

SEQ ID NO: 9315549 - DNA, 22 bp, Homo sapiens
ccagggtcttcgaggcagcaat

SEQ ID NO: 9315550 - DNA, 22 bp, Homo sapiens
ccagggtcttcgaggcagcaat

SEQ ID NO: 9315551 - DNA, 22 bp, Homo sapiens
ccagggcttaacttttcaggag

SEQ ID NO: 9315552 - DNA, 22 bp, Homo sapiens
ccagggctggtgggagatgctg

SEQ ID NO: 9315553 - DNA, 20 bp, Homo sapiens
aggctcctgtacctgaggaa

SEQ ID NO: 9315554 - DNA, 22 bp, Homo sapiens
aggctccttatggctttggggt

SEQ ID NO: 9315555 - DNA, 22 bp, Homo sapiens
ccagggtcttggagaggagtgc

SEQ ID NO: 9315556 - DNA, 22 bp, Homo sapiens
ccaggagctggcatgtggagag

SEQ ID NO: 9315557 - DNA, 22 bp, Homo sapiens
ccaggagcgggaaaaggaagaa

SEQ ID NO: 9315558 - DNA, 22 bp, Homo sapiens
aggctcagtctgttcatgcact

SEQ ID NO: 9315559 - DNA, 22 bp, Homo sapiens
aggctcagtgatgtaaaatata

SEQ ID NO: 9315560 - DNA, 22 bp, Homo sapiens
aggctcagtatagctggcaagt

SEQ ID NO: 9315561 - DNA, 22 bp, Homo sapiens
aggctcagtcccggcccgcgcc

SEQ ID NO: 9315562 - DNA, 22 bp, Homo sapiens
aggctcaggtgcctcattcaca

SEQ ID NO: 9315563 - DNA, 22 bp, Homo sapiens
aggctcagcctgggcctagagc

SEQ ID NO: 9315564 - DNA, 22 bp, Homo sapiens
aggctcagtttggtttccattg

SEQ ID NO: 9315565 - DNA, 22 bp, Homo sapiens
aggctccaaattaccaagctct

SEQ ID NO: 9315566 - DNA, 16 bp, Homo sapiens
aggctccaagagctgt

SEQ ID NO: 9315567 - DNA, 22 bp, Homo sapiens
aggctccaaattaccaagctct

SEQ ID NO: 9315568 - DNA, 22 bp, Homo sapiens
aggctccaagaggttaagtcac

SEQ ID NO: 9315569 - DNA, 22 bp, Homo sapiens
aggctcagttctgtggtgagcc

SEQ ID NO: 9315570 - DNA, 22 bp, Homo sapiens
aggctcagttctgtggtgagcc

SEQ ID NO: 9315571 - DNA, 22 bp, Homo sapiens
aggctcagtgcaaatcattctg

SEQ ID NO: 9315572 - DNA, 22 bp, Homo sapiens
aggctcagttcacgtcaacttt

SEQ ID NO: 9315573 - DNA, 22 bp, Homo sapiens
aggctccaccctacagagctcc

SEQ ID NO: 9315574 - DNA, 22 bp, Homo sapiens
aggctccaccctacagagctcc

SEQ ID NO: 9315575 - DNA, 22 bp, Homo sapiens
aggctccaccagtcaggtgcat

SEQ ID NO: 9315576 - DNA, 22 bp, Homo sapiens
aggctccaccccgccagacctt

SEQ ID NO: 9315577 - DNA, 23 bp, Homo sapiens
aggctccacatgggcactttgca

SEQ ID NO: 9315578 - DNA, 22 bp, Homo sapiens
aggcatggatgtagcagtgacc

SEQ ID NO: 9315579 - DNA, 22 bp, Homo sapiens
aggcatggcactgagcagcttc

SEQ ID NO: 9315580 - DNA, 22 bp, Homo sapiens
aggcatggatggatccagggct

SEQ ID NO: 9315581 - DNA, 22 bp, Homo sapiens
aggcatggatgtagcagtgacc

SEQ ID NO: 9315582 - DNA, 22 bp, Homo sapiens
aggcatggatgtagcagtgacc

SEQ ID NO: 9315583 - DNA, 23 bp, Homo sapiens
aggcatggcatggatggtggctc

SEQ ID NO: 9315584 - DNA, 23 bp, Homo sapiens
aggcatggcatggatggtggctc

SEQ ID NO: 9315585 - DNA, 22 bp, Homo sapiens
aggcatggcactgagcagcttc

SEQ ID NO: 9315586 - DNA, 22 bp, Homo sapiens
aggcatggacatttcggcagct

SEQ ID NO: 9315587 - DNA, 22 bp, Homo sapiens
aggcatggacatttcggcagct

SEQ ID NO: 9315588 - DNA, 22 bp, Homo sapiens
aggcatggacatttcggcagct

SEQ ID NO: 9315589 - DNA, 22 bp, Homo sapiens
ccagagcagaaccggaacacca

SEQ ID NO: 9315590 - DNA, 22 bp, Homo sapiens
aggccagaaatgtcagggagtg

SEQ ID NO: 9315591 - DNA, 22 bp, Homo sapiens
ccagcactgctctcagactgag

SEQ ID NO: 9315592 - DNA, 22 bp, Homo sapiens
ccagcactgctctcagactgag

SEQ ID NO: 9315593 - DNA, 22 bp, Homo sapiens
ccagagtgacgtgaagtgtgaa

SEQ ID NO: 9315594 - DNA, 17 bp, Homo sapiens
ccagagagtagttagga

SEQ ID NO: 9315595 - DNA, 22 bp, Homo sapiens
aggcagggtgatgataatgatt

SEQ ID NO: 9315596 - DNA, 17 bp, Homo sapiens
aggcaggtaagagttat

SEQ ID NO: 9315597 - DNA, 22 bp, Homo sapiens
aggcaggggagctggaagggta

SEQ ID NO: 9315598 - DNA, 22 bp, Homo sapiens
aggcaggggagctggaagggta

SEQ ID NO: 9315599 - DNA, 22 bp, Homo sapiens
aggcaggggagctggaagggta

SEQ ID NO: 9315600 - DNA, 22 bp, Homo sapiens
aggcagggtcttgctatgttgc

SEQ ID NO: 9315601 - DNA, 22 bp, Homo sapiens
aggcagggtcttgctatgttgc

SEQ ID NO: 9315602 - DNA, 22 bp, Homo sapiens
ccaggacaagtgtggccatggc

SEQ ID NO: 9315603 - DNA, 22 bp, Homo sapiens
ccaggacaattcgtcactttct

SEQ ID NO: 9315604 - DNA, 22 bp, Homo sapiens
ccaggagagcagaagcccaggc

SEQ ID NO: 9315605 - DNA, 22 bp, Homo sapiens
ccaggagatgatgttggggatt

SEQ ID NO: 9315606 - DNA, 22 bp, Homo sapiens
ccaggagcgcgtgaacaggctg

SEQ ID NO: 9315607 - DNA, 22 bp, Homo sapiens
aggcccagagagccagttagtg

SEQ ID NO: 9315608 - DNA, 22 bp, Homo sapiens
ccagcctgaaatgcctcatcct

SEQ ID NO: 9315609 - DNA, 21 bp, Homo sapiens
aggcccagagtcttgggggga

SEQ ID NO: 9315610 - DNA, 19 bp, Homo sapiens
aggcccagcgctgggggct

SEQ ID NO: 9315611 - DNA, 19 bp, Homo sapiens
aggcccagcgctgggggct

SEQ ID NO: 9315612 - DNA, 22 bp, Homo sapiens
ccagcttctctctgatgcagct

SEQ ID NO: 9315613 - DNA, 22 bp, Homo sapiens
ccagcttctctgttccagcccc

SEQ ID NO: 9315614 - DNA, 22 bp, Homo sapiens
aggccagagttaaggagaacag

SEQ ID NO: 9315615 - DNA, 22 bp, Homo sapiens
aggccagagttaaggagaacag

SEQ ID NO: 9315616 - DNA, 17 bp, Homo sapiens
aggccagatgaggcaag

SEQ ID NO: 9315617 - DNA, 22 bp, Homo sapiens
cccaggagttggaggctgcagt

SEQ ID NO: 9315618 - DNA, 23 bp, Homo sapiens
cccaggagtttcactgcaaaggt

SEQ ID NO: 9315619 - DNA, 22 bp, Homo sapiens
agggaaattaatgtgagcaatg

SEQ ID NO: 9315620 - DNA, 21 bp, Homo sapiens
agggaaatccagtcacttttc

SEQ ID NO: 9315621 - DNA, 23 bp, Homo sapiens
agggaaatactgcaatttttgga

SEQ ID NO: 9315622 - DNA, 22 bp, Homo sapiens
agggaaataatctattctgagg

SEQ ID NO: 9315623 - DNA, 22 bp, Homo sapiens
cccaggagtttgagttcagcat

SEQ ID NO: 9315624 - DNA, 22 bp, Homo sapiens
cccagggctgcagatggaggct

SEQ ID NO: 9315625 - DNA, 22 bp, Homo sapiens
cccagggctgcagatggaggct

SEQ ID NO: 9315626 - DNA, 22 bp, Homo sapiens
cccagggccctggacagctaca

SEQ ID NO: 9315627 - DNA, 22 bp, Homo sapiens
cccagggcttgagtcatccatg

SEQ ID NO: 9315628 - DNA, 22 bp, Homo sapiens
cccagggcttttctcactagac

SEQ ID NO: 9315629 - DNA, 22 bp, Homo sapiens
cccagggcttttctcactagac

SEQ ID NO: 9315630 - DNA, 19 bp, Homo sapiens
aggcttggaacagccttat

SEQ ID NO: 9315631 - DNA, 22 bp, Homo sapiens
cccaggagttggaggctacggt

SEQ ID NO: 9315632 - DNA, 22 bp, Homo sapiens
aggcttctacgtggtcccaggg

SEQ ID NO: 9315633 - DNA, 22 bp, Homo sapiens
aggctggctggcaggggacaca

SEQ ID NO: 9315634 - DNA, 22 bp, Homo sapiens
aggctggctgagctgcagcctg

SEQ ID NO: 9315635 - DNA, 22 bp, Homo sapiens
aggctggctgagctgcagcctg

SEQ ID NO: 9315636 - DNA, 22 bp, Homo sapiens
aggctggctgagctgcagcctg

SEQ ID NO: 9315637 - DNA, 22 bp, Homo sapiens
aggcttcactcgacatgccaat

SEQ ID NO: 9315638 - DNA, 22 bp, Homo sapiens
aggcttcactcgacatgccaat

SEQ ID NO: 9315639 - DNA, 22 bp, Homo sapiens
aggcttcacctgcacctgagct

SEQ ID NO: 9315640 - DNA, 22 bp, Homo sapiens
aggcttcacattttctaggcct

SEQ ID NO: 9315641 - DNA, 22 bp, Homo sapiens
aggcttcaattccttacccagt

SEQ ID NO: 9315642 - DNA, 22 bp, Homo sapiens
aggcttcaaggttcttggcagg

SEQ ID NO: 9315643 - DNA, 22 bp, Homo sapiens
aggcttcacgatgggtgaggtg

SEQ ID NO: 9315644 - DNA, 22 bp, Homo sapiens
aggcttcacgatgggtgaggtg

SEQ ID NO: 9315645 - DNA, 22 bp, Homo sapiens
aggcttcacctgcacctgagct

SEQ ID NO: 9315646 - DNA, 22 bp, Homo sapiens
aggcttcaccagactcttaatc

SEQ ID NO: 9315647 - DNA, 22 bp, Homo sapiens
aggcttcacctgcacctgagct

SEQ ID NO: 9315648 - DNA, 22 bp, Homo sapiens
aggcttcacctgcacctgagct

SEQ ID NO: 9315649 - DNA, 22 bp, Homo sapiens
agggagaaggtttagctgtgag

SEQ ID NO: 9315650 - DNA, 22 bp, Homo sapiens
agggactgagctaggatctagt

SEQ ID NO: 9315651 - DNA, 22 bp, Homo sapiens
agggagaacagttgcagcagac

SEQ ID NO: 9315652 - DNA, 22 bp, Homo sapiens
agggagaacagttgcagcagac

SEQ ID NO: 9315653 - DNA, 22 bp, Homo sapiens
agggatcagcagagggtgtggt

SEQ ID NO: 9315654 - DNA, 22 bp, Homo sapiens
agggatcagtagggacggcagc

SEQ ID NO: 9315655 - DNA, 22 bp, Homo sapiens
ccctctggctcttctcaggccg

SEQ ID NO: 9315656 - DNA, 17 bp, Homo sapiens
ccctctggggagggagg

SEQ ID NO: 9315657 - DNA, 22 bp, Homo sapiens
ccctctctgacttctgaacttg

SEQ ID NO: 9315658 - DNA, 22 bp, Homo sapiens
ccctctctctatcgggccccag

SEQ ID NO: 9315659 - DNA, 22 bp, Homo sapiens
ccctctcttagaagaaacacag

SEQ ID NO: 9315660 - DNA, 22 bp, Homo sapiens
ccctctctcggttgctgtggtt

SEQ ID NO: 9315661 - DNA, 22 bp, Homo sapiens
agggcagagatctgagtgggca

SEQ ID NO: 9315662 - DNA, 22 bp, Homo sapiens
agggcagagagatgaatgggat

SEQ ID NO: 9315663 - DNA, 22 bp, Homo sapiens
ccctggaggagcttagagcttg

SEQ ID NO: 9315664 - DNA, 22 bp, Homo sapiens
aggggctggagttcgaggttac

SEQ ID NO: 9315665 - DNA, 22 bp, Homo sapiens
aggggctggcttatctgagagt

SEQ ID NO: 9315666 - DNA, 22 bp, Homo sapiens
cctgaggaggtgaagtctccat

SEQ ID NO: 9315667 - DNA, 22 bp, Homo sapiens
cctgaggagattgtggctgggg

SEQ ID NO: 9315668 - DNA, 22 bp, Homo sapiens
cctgaggatgccagcatgggtg

SEQ ID NO: 9315669 - DNA, 22 bp, Homo sapiens
cctgaggatgccagcatgggtg

SEQ ID NO: 9315670 - DNA, 22 bp, Homo sapiens
cctgaggatattcaccagcatg

SEQ ID NO: 9315671 - DNA, 22 bp, Homo sapiens
cctgaggcccctgaggatagca

SEQ ID NO: 9315672 - DNA, 22 bp, Homo sapiens
cctgaggcaaggacttggtggc

SEQ ID NO: 9315673 - DNA, 22 bp, Homo sapiens
cctgaggattgttggtgcttcc

SEQ ID NO: 9315674 - DNA, 22 bp, Homo sapiens
cctgaggattgttggtgcttcc

SEQ ID NO: 9315675 - DNA, 22 bp, Homo sapiens
aggggaatgggtagactgttga

SEQ ID NO: 9315676 - DNA, 22 bp, Homo sapiens
cctgagagtgcgtgcctcctta

SEQ ID NO: 9315677 - DNA, 22 bp, Homo sapiens
cctgaggacagtgtgaccatgg

SEQ ID NO: 9315678 - DNA, 22 bp, Homo sapiens
cctgaggacacacgctgcagga

SEQ ID NO: 9315679 - DNA, 22 bp, Homo sapiens
cctgaggacacacgctgcagga

SEQ ID NO: 9315680 - DNA, 19 bp, Homo sapiens
cctgaggaaaagatgattg

SEQ ID NO: 9315681 - DNA, 22 bp, Homo sapiens
cctgagctttaaaagccatgta

SEQ ID NO: 9315682 - DNA, 19 bp, Homo sapiens
cctctgccagcccgcctct

SEQ ID NO: 9315683 - DNA, 19 bp, Homo sapiens
cctctgccagcccgcctct

SEQ ID NO: 9315684 - DNA, 22 bp, Homo sapiens
cctctgggagactgctactgag

SEQ ID NO: 9315685 - DNA, 22 bp, Homo sapiens
agggctgagtggtgcagtcaaa

SEQ ID NO: 9315686 - DNA, 22 bp, Homo sapiens
cctcctgcacttgctttccttc

SEQ ID NO: 9315687 - DNA, 21 bp, Homo sapiens
cctcctgcccgcaagctaggg

SEQ ID NO: 9315688 - DNA, 23 bp, Homo sapiens
agggctccttgttgattagcatt

SEQ ID NO: 9315689 - DNA, 22 bp, Homo sapiens
agggctcctatgccccatggac

SEQ ID NO: 9315690 - DNA, 22 bp, Homo sapiens
agggctcctatgatgctctgcc

SEQ ID NO: 9315691 - DNA, 22 bp, Homo sapiens
agggctccgggcaggcgatgga

SEQ ID NO: 9315692 - DNA, 22 bp, Homo sapiens
agggctcccgtgaggtgactgc

SEQ ID NO: 9315693 - DNA, 22 bp, Homo sapiens
agggctccaggggctgggtgac

SEQ ID NO: 9315694 - DNA, 22 bp, Homo sapiens
agggctcagttgcctggagccc

SEQ ID NO: 9315695 - DNA, 22 bp, Homo sapiens
agggctcataattcctgacttc

SEQ ID NO: 9315696 - DNA, 22 bp, Homo sapiens
ccgcaaggcagaggttgcagtg

SEQ ID NO: 9315697 - DNA, 22 bp, Homo sapiens
ccgcccacactaaatatgagcg

SEQ ID NO: 9315698 - DNA, 22 bp, Homo sapiens
ccgaggctggagtgcagtggcg

SEQ ID NO: 9315699 - DNA, 22 bp, Homo sapiens
ccgaggctggagtgcagtggcg

SEQ ID NO: 9315700 - DNA, 22 bp, Homo sapiens
ccctttccatggctctcctagg

SEQ ID NO: 9315701 - DNA, 22 bp, Homo sapiens
ccctttcccttctggctcaggg

SEQ ID NO: 9315702 - DNA, 22 bp, Homo sapiens
ccctttcctgaagaatattttt

SEQ ID NO: 9315703 - DNA, 22 bp, Homo sapiens
agggccagagtctgtgtagata

SEQ ID NO: 9315704 - DNA, 22 bp, Homo sapiens
ccctggaggcggagcttgcagt

SEQ ID NO: 9315705 - DNA, 22 bp, Homo sapiens
ccctggaggcaaaggttgcagt

SEQ ID NO: 9315706 - DNA, 22 bp, Homo sapiens
cagggagctctgggccggactc

SEQ ID NO: 9315707 - DNA, 22 bp, Homo sapiens
cagggatggcgctggctgcccg

SEQ ID NO: 9315708 - DNA, 22 bp, Homo sapiens
cagggatgggatggagtcagtt

SEQ ID NO: 9315709 - DNA, 22 bp, Homo sapiens
caggctggagttacctttaggg

SEQ ID NO: 9315710 - DNA, 22 bp, Homo sapiens
caggctggagtgcagttgtgca

SEQ ID NO: 9315711 - DNA, 22 bp, Homo sapiens
caggctggagtgcagttgtgca

SEQ ID NO: 9315712 - DNA, 22 bp, Homo sapiens
caggctgctgacaggcttggag

SEQ ID NO: 9315713 - DNA, 22 bp, Homo sapiens
caggctgctgcctagaatgaca

SEQ ID NO: 9315714 - DNA, 22 bp, Homo sapiens
caggctggacattagatacata

SEQ ID NO: 9315715 - DNA, 22 bp, Homo sapiens
caggctggacattagatacata

SEQ ID NO: 9315716 - DNA, 22 bp, Homo sapiens
caggctggagtgcagtgtcgcc

SEQ ID NO: 9315717 - DNA, 22 bp, Homo sapiens
caggctggagtgcagtgtcgcc

SEQ ID NO: 9315718 - DNA, 22 bp, Homo sapiens
caggctggagtgcagtggtgcc

SEQ ID NO: 9315719 - DNA, 22 bp, Homo sapiens
caggctggagtgcagtggtgcc

SEQ ID NO: 9315720 - DNA, 22 bp, Homo sapiens
caggctggagtacaattgtgtg

SEQ ID NO: 9315721 - DNA, 22 bp, Homo sapiens
caggctgcggtcggctctggtc

SEQ ID NO: 9315722 - DNA, 22 bp, Homo sapiens
caggctgcggccgtgtgagcat

SEQ ID NO: 9315723 - DNA, 22 bp, Homo sapiens
agctggggcatttatccactaa

SEQ ID NO: 9315724 - DNA, 18 bp, Homo sapiens
agctggggcctctggtcc

SEQ ID NO: 9315725 - DNA, 22 bp, Homo sapiens
caggctcactttctcagtcaca

SEQ ID NO: 9315726 - DNA, 22 bp, Homo sapiens
caggctcactgtaaggtcagct

SEQ ID NO: 9315727 - DNA, 22 bp, Homo sapiens
caggctcagctctggccagtgc

SEQ ID NO: 9315728 - DNA, 22 bp, Homo sapiens
caggctcagtcagaaaatgtat

SEQ ID NO: 9315729 - DNA, 22 bp, Homo sapiens
caggctccacaggggaatccgg

SEQ ID NO: 9315730 - DNA, 22 bp, Homo sapiens
caggctccaagccctctgatgt

SEQ ID NO: 9315731 - DNA, 22 bp, Homo sapiens
caggctccactgtaggcagctc

SEQ ID NO: 9315732 - DNA, 22 bp, Homo sapiens
caggctcagccacaggggaagg

SEQ ID NO: 9315733 - DNA, 22 bp, Homo sapiens
caggctcagcaggagcctgacc

SEQ ID NO: 9315734 - DNA, 22 bp, Homo sapiens
caggctcagaagccagtggagc

SEQ ID NO: 9315735 - DNA, 22 bp, Homo sapiens
caggctcagaagccagtggagc

SEQ ID NO: 9315736 - DNA, 22 bp, Homo sapiens
caggctcagatgccctgcgctg

SEQ ID NO: 9315737 - DNA, 22 bp, Homo sapiens
cagggcctgagggctgctctgc

SEQ ID NO: 9315738 - DNA, 22 bp, Homo sapiens
cagggcctgagggctgctctgc

SEQ ID NO: 9315739 - DNA, 22 bp, Homo sapiens
cagggcctctgtgggctctctc

SEQ ID NO: 9315740 - DNA, 22 bp, Homo sapiens
cagggatgtctctggaagggag

SEQ ID NO: 9315741 - DNA, 22 bp, Homo sapiens
cagggcctccccggcagtcttt

SEQ ID NO: 9315742 - DNA, 22 bp, Homo sapiens
cagggctctgccttgagggatg

SEQ ID NO: 9315743 - DNA, 22 bp, Homo sapiens
cagggcttgatctgcatcctgc

SEQ ID NO: 9315744 - DNA, 22 bp, Homo sapiens
cagggcttgcaggagaaagttt

SEQ ID NO: 9315745 - DNA, 22 bp, Homo sapiens
cagggcttgccttgccccggcg

SEQ ID NO: 9315746 - DNA, 22 bp, Homo sapiens
cagggcttgcaggagaaagttt

SEQ ID NO: 9315747 - DNA, 22 bp, Homo sapiens
cagggctcgctcttgcccttcg

SEQ ID NO: 9315748 - DNA, 22 bp, Homo sapiens
cagggctcgctgccagcttcag

SEQ ID NO: 9315749 - DNA, 22 bp, Homo sapiens
cagggctcccttgcaaggaggg

SEQ ID NO: 9315750 - DNA, 22 bp, Homo sapiens
cagggtgcatacccatgcatac

SEQ ID NO: 9315751 - DNA, 22 bp, Homo sapiens
cagggtgacaagtggcaaggag

SEQ ID NO: 9315752 - DNA, 22 bp, Homo sapiens
caggggctgaaatgttggggtt

SEQ ID NO: 9315753 - DNA, 22 bp, Homo sapiens
caggggctccctgggtgccagt

SEQ ID NO: 9315754 - DNA, 22 bp, Homo sapiens
caggggctctaatgcatgatca

SEQ ID NO: 9315755 - DNA, 22 bp, Homo sapiens
cagggtgcctcccgctcgccgg

SEQ ID NO: 9315756 - DNA, 22 bp, Homo sapiens
cagggtgcctgtcctcagcaaa

SEQ ID NO: 9315757 - DNA, 22 bp, Homo sapiens
cagggtgcgccactcagatgta

SEQ ID NO: 9315758 - DNA, 22 bp, Homo sapiens
cagggtgcgggagatgtgcacc

SEQ ID NO: 9315759 - DNA, 22 bp, Homo sapiens
caggtcctttagtgtccagaac

SEQ ID NO: 9315760 - DNA, 20 bp, Homo sapiens
caggtgagcagatctgggtg

SEQ ID NO: 9315761 - DNA, 22 bp, Homo sapiens
caggtgagctctatctagggag

SEQ ID NO: 9315762 - DNA, 22 bp, Homo sapiens
caggtgaggctgaacagatgaa

SEQ ID NO: 9315763 - DNA, 22 bp, Homo sapiens
caggtgagtaacaatgggtgat

SEQ ID NO: 9315764 - DNA, 22 bp, Homo sapiens
agctggccggcctccaggtgga

SEQ ID NO: 9315765 - DNA, 22 bp, Homo sapiens
agctggcctccgggtgcctggg

SEQ ID NO: 9315766 - DNA, 22 bp, Homo sapiens
agctggccattgtgagtggcct

SEQ ID NO: 9315767 - DNA, 20 bp, Homo sapiens
agctggcccacaggtgtggg

SEQ ID NO: 9315768 - DNA, 20 bp, Homo sapiens
agctggcccccggtggcctg

SEQ ID NO: 9315769 - DNA, 22 bp, Homo sapiens
caggccagcgtccagaacaagc

SEQ ID NO: 9315770 - DNA, 22 bp, Homo sapiens
caggccagcagggcctccgtgg

SEQ ID NO: 9315771 - DNA, 22 bp, Homo sapiens
caggaggacatactggctcaca

SEQ ID NO: 9315772 - DNA, 22 bp, Homo sapiens
caggaggattgcttgaggccag

SEQ ID NO: 9315773 - DNA, 22 bp, Homo sapiens
caggaggattgcttgaggccag

SEQ ID NO: 9315774 - DNA, 22 bp, Homo sapiens
caggaggaggtgaggtagaact

SEQ ID NO: 9315775 - DNA, 22 bp, Homo sapiens
caggcactggccagtcagcaca

SEQ ID NO: 9315776 - DNA, 22 bp, Homo sapiens
agctgcagagaaaagaggctgg

SEQ ID NO: 9315777 - DNA, 22 bp, Homo sapiens
caggaaggcgcggctgtgcctg

SEQ ID NO: 9315778 - DNA, 22 bp, Homo sapiens
cagctgagaccagaatgcaggt

SEQ ID NO: 9315779 - DNA, 22 bp, Homo sapiens
cagctgagaaaggcaggctcac

SEQ ID NO: 9315780 - DNA, 22 bp, Homo sapiens
aggatttaatcagttggcattt

SEQ ID NO: 9315781 - DNA, 22 bp, Homo sapiens
catgtccatttatgcacagaaa

SEQ ID NO: 9315782 - DNA, 22 bp, Homo sapiens
catggcagaaacctgagctgct

SEQ ID NO: 9315783 - DNA, 22 bp, Homo sapiens
catggaggagttaggtgtgagt

SEQ ID NO: 9315784 - DNA, 22 bp, Homo sapiens
aggaggggcaatgatagtctgg

SEQ ID NO: 9315785 - DNA, 22 bp, Homo sapiens
aggagggctaggaaaaccagga

SEQ ID NO: 9315786 - DNA, 22 bp, Homo sapiens
aggagggcaggctggctgccta

SEQ ID NO: 9315787 - DNA, 21 bp, Homo sapiens
aggagggcacaaggccaggaa

SEQ ID NO: 9315788 - DNA, 22 bp, Homo sapiens
catttgtttataagttccccag

SEQ ID NO: 9315789 - DNA, 21 bp, Homo sapiens
aggcagcaggatccagggaca

SEQ ID NO: 9315790 - DNA, 19 bp, Homo sapiens
aggcagcaggccagggatg

SEQ ID NO: 9315791 - DNA, 22 bp, Homo sapiens
catgtccacagttctgagaggc

SEQ ID NO: 9315792 - DNA, 22 bp, Homo sapiens
aggcactgtggaagacatggtt

SEQ ID NO: 9315793 - DNA, 22 bp, Homo sapiens
ccaaggacgtacaggagataat

SEQ ID NO: 9315794 - DNA, 22 bp, Homo sapiens
ccaagggctgagatacatctag

SEQ ID NO: 9315795 - DNA, 22 bp, Homo sapiens
ccaagggctctgacttgcctgc

SEQ ID NO: 9315796 - DNA, 18 bp, Homo sapiens
aggcaggctggagtgact

SEQ ID NO: 9315797 - DNA, 18 bp, Homo sapiens
aggcaggctggagtgact

SEQ ID NO: 9315798 - DNA, 22 bp, Homo sapiens
ccaagtagttgagactacaggt

SEQ ID NO: 9315799 - DNA, 22 bp, Homo sapiens
ccaaaggggcttaggatgaagg

SEQ ID NO: 9315800 - DNA, 23 bp, Homo sapiens
aggcagcaggttgtccagggtga

SEQ ID NO: 9315801 - DNA, 22 bp, Homo sapiens
ccaagcatggggttcagtagga

SEQ ID NO: 9315802 - DNA, 22 bp, Homo sapiens
aggacatgtaaatggagaggga

SEQ ID NO: 9315803 - DNA, 22 bp, Homo sapiens
caggtgggagcgaggagctact

SEQ ID NO: 9315804 - DNA, 22 bp, Homo sapiens
caggtgggaccatgatagggca

SEQ ID NO: 9315805 - DNA, 22 bp, Homo sapiens
caggtgggaccatgatagggca

SEQ ID NO: 9315806 - DNA, 22 bp, Homo sapiens
caggtgggagccacagcgtaca

SEQ ID NO: 9315807 - DNA, 22 bp, Homo sapiens
caggtgggagccacagcgtaca

SEQ ID NO: 9315808 - DNA, 22 bp, Homo sapiens
caggtggcttctccctaggcca

SEQ ID NO: 9315809 - DNA, 22 bp, Homo sapiens
aggaccagaggccagagtcagc

SEQ ID NO: 9315810 - DNA, 22 bp, Homo sapiens
aggaccaggtctaatgaagaca

SEQ ID NO: 9315811 - DNA, 22 bp, Homo sapiens
aggaccatcctaaggtaggcaa

SEQ ID NO: 9315812 - DNA, 22 bp, Homo sapiens
aggagaagtaaggctagatgat

SEQ ID NO: 9315813 - DNA, 19 bp, Homo sapiens
aggagaagtagcagaaatt

SEQ ID NO: 9315814 - DNA, 22 bp, Homo sapiens
cagtggcctttcctgctgctca

SEQ ID NO: 9315815 - DNA, 22 bp, Homo sapiens
cagtgctatttggacacaggga

SEQ ID NO: 9315816 - DNA, 22 bp, Homo sapiens
aggactcacatagcttcagatg

SEQ ID NO: 9315817 - DNA, 18 bp, Homo sapiens
aggactcctgggagttgg

SEQ ID NO: 9315818 - DNA, 23 bp, Homo sapiens
cagtggtcagaacgtgggagggt

SEQ ID NO: 9315819 - DNA, 22 bp, Homo sapiens
catattcaaggggtaaggcaaa

SEQ ID NO: 9315820 - DNA, 22 bp, Homo sapiens
catatttagtgtttggagatcg

SEQ ID NO: 9315821 - DNA, 22 bp, Homo sapiens
catatttagtgtttggagatcg

SEQ ID NO: 9315822 - DNA, 22 bp, Homo sapiens
catatttagtgtttggagatcg

SEQ ID NO: 9315823 - DNA, 22 bp, Homo sapiens
catatttatagatctggcattt

SEQ ID NO: 9315824 - DNA, 22 bp, Homo sapiens
catatttatagatctggcattt

SEQ ID NO: 9315825 - DNA, 22 bp, Homo sapiens
catatttatagatctggcattt

SEQ ID NO: 9315826 - DNA, 22 bp, Homo sapiens
catatttattcttctgccagtg

SEQ ID NO: 9315827 - DNA, 22 bp, Homo sapiens
catatttattcttctgccagtg

SEQ ID NO: 9315828 - DNA, 22 bp, Homo sapiens
catatttattcttctgccagtg

SEQ ID NO: 9315829 - DNA, 21 bp, Homo sapiens
aggaggctgtctctttcagct

SEQ ID NO: 9315830 - DNA, 22 bp, Homo sapiens
aggagggagcttaagccaggca

SEQ ID NO: 9315831 - DNA, 22 bp, Homo sapiens
catagccatctttagcttccag

SEQ ID NO: 9315832 - DNA, 22 bp, Homo sapiens
catagagtgatgtaaggtatgt

SEQ ID NO: 9315833 - DNA, 22 bp, Homo sapiens
catagagtgatgtaaggtatgt

SEQ ID NO: 9315834 - DNA, 22 bp, Homo sapiens
tctctcttgtcaccccatctgc

SEQ ID NO: 9315835 - DNA, 22 bp, Homo sapiens
tctctcttgtcaccccatctgc

SEQ ID NO: 9315836 - DNA, 22 bp, Homo sapiens
tctctgagttctcctccagccc

SEQ ID NO: 9315837 - DNA, 22 bp, Homo sapiens
tctctgagttgtaaaaaatagt

SEQ ID NO: 9315838 - DNA, 22 bp, Homo sapiens
tctcctggctcaccaggctgga

SEQ ID NO: 9315839 - DNA, 17 bp, Homo sapiens
tctcctggctctatcag

SEQ ID NO: 9315840 - DNA, 17 bp, Homo sapiens
tctcctggctctatcag

SEQ ID NO: 9315841 - DNA, 23 bp, Homo sapiens
tctcctggctgcactgtggccac

SEQ ID NO: 9315842 - DNA, 21 bp, Homo sapiens
tctctgggaggacttgtgaga

SEQ ID NO: 9315843 - DNA, 21 bp, Homo sapiens
tctctgggaggacttgtgaga

SEQ ID NO: 9315844 - DNA, 22 bp, Homo sapiens
tctctgggacactgggtcagtt

SEQ ID NO: 9315845 - DNA, 22 bp, Homo sapiens
tctctgccacagcttctgcctt

SEQ ID NO: 9315846 - DNA, 22 bp, Homo sapiens
tctctgccaccatgagatgggc

SEQ ID NO: 9315847 - DNA, 22 bp, Homo sapiens
tctctgcccatcctcagtccac

SEQ ID NO: 9315848 - DNA, 22 bp, Homo sapiens
tctctgcccaagtttctcaagt

SEQ ID NO: 9315849 - DNA, 22 bp, Homo sapiens
tctctgcccatcctcagtccac

SEQ ID NO: 9315850 - DNA, 22 bp, Homo sapiens
tctctgcccatgagcaatctgc

SEQ ID NO: 9315851 - DNA, 22 bp, Homo sapiens
tctctgggaatgggcctgggta

SEQ ID NO: 9315852 - DNA, 22 bp, Homo sapiens
ccagcagctgcaaagcctgggt

SEQ ID NO: 9315853 - DNA, 22 bp, Homo sapiens
ccagcagctgacaccagtccca

SEQ ID NO: 9315854 - DNA, 22 bp, Homo sapiens
ccagcagctttattggctctcc

SEQ ID NO: 9315855 - DNA, 22 bp, Homo sapiens
ccagcagggcagtgccctggac

SEQ ID NO: 9315856 - DNA, 22 bp, Homo sapiens
ccagcaggggaatatttttagg

SEQ ID NO: 9315857 - DNA, 22 bp, Homo sapiens
ccagcagccctcttccaagact

SEQ ID NO: 9315858 - DNA, 22 bp, Homo sapiens
ccagcagcatcctgcagcactt

SEQ ID NO: 9315859 - DNA, 22 bp, Homo sapiens
ccagccctgtaaggatgaggca

SEQ ID NO: 9315860 - DNA, 19 bp, Homo sapiens
ccagccctgtcacttcttg

SEQ ID NO: 9315861 - DNA, 22 bp, Homo sapiens
ccagccctgtcaccaactggag

SEQ ID NO: 9315862 - DNA, 22 bp, Homo sapiens
ccagccacagcttccagctcct

SEQ ID NO: 9315863 - DNA, 22 bp, Homo sapiens
tctgagaggattcctgtcccga

SEQ ID NO: 9315864 - DNA, 22 bp, Homo sapiens
ccagcccttcccaactggccag

SEQ ID NO: 9315865 - DNA, 22 bp, Homo sapiens
tctgcagaaggaatcagctgag

SEQ ID NO: 9315866 - DNA, 22 bp, Homo sapiens
tctgcagaagccatggccttgc

SEQ ID NO: 9315867 - DNA, 22 bp, Homo sapiens
tctgatattggacaattcaggg

SEQ ID NO: 9315868 - DNA, 22 bp, Homo sapiens
tctgatatgaatgtctagctct

SEQ ID NO: 9315869 - DNA, 22 bp, Homo sapiens
tctgcagaattcgaggaagaaa

SEQ ID NO: 9315870 - DNA, 22 bp, Homo sapiens
tctgatatctctccctgggtca

SEQ ID NO: 9315871 - DNA, 22 bp, Homo sapiens
ccagcatcagcacccaaggagc

SEQ ID NO: 9315872 - DNA, 22 bp, Homo sapiens
ccagcagggttggtttcttctg

SEQ ID NO: 9315873 - DNA, 19 bp, Homo sapiens
ccagcaggttcatttcagg

SEQ ID NO: 9315874 - DNA, 22 bp, Homo sapiens
ccagcaggtgtagggctcatgg

SEQ ID NO: 9315875 - DNA, 22 bp, Homo sapiens
tctcttaaaagattttaatgac

SEQ ID NO: 9315876 - DNA, 22 bp, Homo sapiens
tctgaatgtatcgaattgaggc

SEQ ID NO: 9315877 - DNA, 19 bp, Homo sapiens
tctgaatgggatgagttgg

SEQ ID NO: 9315878 - DNA, 22 bp, Homo sapiens
tctgaatgttaggaaactttct

SEQ ID NO: 9315879 - DNA, 22 bp, Homo sapiens
tctgaatgcacttagttaccaa

SEQ ID NO: 9315880 - DNA, 22 bp, Homo sapiens
ccagcatcgacttcctgcctga

SEQ ID NO: 9315881 - DNA, 22 bp, Homo sapiens
ccagcatctgtcctttccctca

SEQ ID NO: 9315882 - DNA, 22 bp, Homo sapiens
tcctgactaggagggctaaggt

SEQ ID NO: 9315883 - DNA, 22 bp, Homo sapiens
ccacatctggtggccagtgcta

SEQ ID NO: 9315884 - DNA, 22 bp, Homo sapiens
ccacatttactggatgctcagg

SEQ ID NO: 9315885 - DNA, 22 bp, Homo sapiens
ccacatttactgatgtatgtat

SEQ ID NO: 9315886 - DNA, 22 bp, Homo sapiens
tcctctccatgtctcacgccac

SEQ ID NO: 9315887 - DNA, 22 bp, Homo sapiens
tcctctctgcactggccctgcc

SEQ ID NO: 9315888 - DNA, 22 bp, Homo sapiens
tcctctctgcactggccctgcc

SEQ ID NO: 9315889 - DNA, 18 bp, Homo sapiens
tcctctctttccccaggg

SEQ ID NO: 9315890 - DNA, 22 bp, Homo sapiens
ccacatttggagaagatacttt

SEQ ID NO: 9315891 - DNA, 22 bp, Homo sapiens
ccacattttgctttgcctaggt

SEQ ID NO: 9315892 - DNA, 20 bp, Homo sapiens
ccacattttactgtttgcca

SEQ ID NO: 9315893 - DNA, 22 bp, Homo sapiens
ccacatttttgatactctcact

SEQ ID NO: 9315894 - DNA, 22 bp, Homo sapiens
tcctttccagcctcacctcagc

SEQ ID NO: 9315895 - DNA, 22 bp, Homo sapiens
tcgcgggttgcacatggccatc

SEQ ID NO: 9315896 - DNA, 22 bp, Homo sapiens
tcgctgaggctgcacggctgcc

SEQ ID NO: 9315897 - DNA, 22 bp, Homo sapiens
tcgcctccaaagagttcctgag

SEQ ID NO: 9315898 - DNA, 19 bp, Homo sapiens
ccaccctgggagctcactc

SEQ ID NO: 9315899 - DNA, 22 bp, Homo sapiens
tcgctttaatggtcttcacagc

SEQ ID NO: 9315900 - DNA, 20 bp, Homo sapiens
tcggctggacactgtgcact

SEQ ID NO: 9315901 - DNA, 22 bp, Homo sapiens
tcggggtctttgacacgctctg

SEQ ID NO: 9315902 - DNA, 22 bp, Homo sapiens
tctccaggaaagacactggact

SEQ ID NO: 9315903 - DNA, 22 bp, Homo sapiens
tctccaggaaccatcatggtaa

SEQ ID NO: 9315904 - DNA, 22 bp, Homo sapiens
tctcctggccctgtcgccatct

SEQ ID NO: 9315905 - DNA, 22 bp, Homo sapiens
tctccctctttgtctgctttgg

SEQ ID NO: 9315906 - DNA, 22 bp, Homo sapiens
tctccctctttgtctgctttgg

SEQ ID NO: 9315907 - DNA, 22 bp, Homo sapiens
tctcccacagtctcccatggct

SEQ ID NO: 9315908 - DNA, 22 bp, Homo sapiens
tctccctcattcctgcttccat

SEQ ID NO: 9315909 - DNA, 22 bp, Homo sapiens
tctccctcattcctgcttccat

SEQ ID NO: 9315910 - DNA, 22 bp, Homo sapiens
tctccctctcagatttattcac

SEQ ID NO: 9315911 - DNA, 22 bp, Homo sapiens
ccacctctgagcccaaaccctg

SEQ ID NO: 9315912 - DNA, 22 bp, Homo sapiens
ccacctccacctattgccagcc

SEQ ID NO: 9315913 - DNA, 23 bp, Homo sapiens
tctcaagccagaccaggcctcgc

SEQ ID NO: 9315914 - DNA, 22 bp, Homo sapiens
tctcaacagtgcaagctgctcc

SEQ ID NO: 9315915 - DNA, 22 bp, Homo sapiens
tctccacaccagaaggagctga

SEQ ID NO: 9315916 - DNA, 22 bp, Homo sapiens
tctccacactttctctcccagg

SEQ ID NO: 9315917 - DNA, 21 bp, Homo sapiens
tccaagccttcaacacattca

SEQ ID NO: 9315918 - DNA, 22 bp, Homo sapiens
tccacagggcctttctggtgtg

SEQ ID NO: 9315919 - DNA, 22 bp, Homo sapiens
tccacaggtatttctccttgct

SEQ ID NO: 9315920 - DNA, 22 bp, Homo sapiens
tcattccatttccagctctgaa

SEQ ID NO: 9315921 - DNA, 20 bp, Homo sapiens
tcattccaaatagttcagca

SEQ ID NO: 9315922 - DNA, 22 bp, Homo sapiens
tcattctcagactcttggcctc

SEQ ID NO: 9315923 - DNA, 22 bp, Homo sapiens
tcattctggatgactttctaga

SEQ ID NO: 9315924 - DNA, 22 bp, Homo sapiens
tcatttatgtctttgccatcca

SEQ ID NO: 9315925 - DNA, 22 bp, Homo sapiens
tcatttatgcaggaatggcata

SEQ ID NO: 9315926 - DNA, 22 bp, Homo sapiens
catgaaaaatttactgttaaca

SEQ ID NO: 9315927 - DNA, 22 bp, Homo sapiens
tcatgaggatgactgacccctt

SEQ ID NO: 9315928 - DNA, 22 bp, Homo sapiens
tcatcagtttagaaaaaatatg

SEQ ID NO: 9315929 - DNA, 22 bp, Homo sapiens
cataacacattcatcagcagag

SEQ ID NO: 9315930 - DNA, 22 bp, Homo sapiens
tcatcagtgtccttatcactta

SEQ ID NO: 9315931 - DNA, 22 bp, Homo sapiens
tccagagaggcatatttacaag

SEQ ID NO: 9315932 - DNA, 22 bp, Homo sapiens
tccagccctgtggcttccaccc

SEQ ID NO: 9315933 - DNA, 19 bp, Homo sapiens
tccagactgtccaggctat

SEQ ID NO: 9315934 - DNA, 22 bp, Homo sapiens
tccagactgccctgcacatgtg

SEQ ID NO: 9315935 - DNA, 22 bp, Homo sapiens
tccagctcttgttgcccactgc

SEQ ID NO: 9315936 - DNA, 22 bp, Homo sapiens
tccagctcttgttgcccactgc

SEQ ID NO: 9315937 - DNA, 22 bp, Homo sapiens
tccagctcttcagttctgcaaa

SEQ ID NO: 9315938 - DNA, 17 bp, Homo sapiens
tccagcctcctctgctg

SEQ ID NO: 9315939 - DNA, 22 bp, Homo sapiens
tccagcctcctatttaccctaa

SEQ ID NO: 9315940 - DNA, 22 bp, Homo sapiens
tccagcctcatttctcctgctt

SEQ ID NO: 9315941 - DNA, 22 bp, Homo sapiens
tccagcctcatttctcctgctt

SEQ ID NO: 9315942 - DNA, 22 bp, Homo sapiens
tccagcctaggggaacagctgc

SEQ ID NO: 9315943 - DNA, 22 bp, Homo sapiens
tccagcctaatgttcttcccac

SEQ ID NO: 9315944 - DNA, 22 bp, Homo sapiens
tccaggcagcccttcctgactc

SEQ ID NO: 9315945 - DNA, 22 bp, Homo sapiens
tccaggcccatagacacttctc

SEQ ID NO: 9315946 - DNA, 22 bp, Homo sapiens
tccaggcccatggagcagagct

SEQ ID NO: 9315947 - DNA, 22 bp, Homo sapiens
tccaggcccatggagcagagct

SEQ ID NO: 9315948 - DNA, 22 bp, Homo sapiens
tccaggcccgagatgggctgga

SEQ ID NO: 9315949 - DNA, 22 bp, Homo sapiens
tccaggcccgagatgggctgga

SEQ ID NO: 9315950 - DNA, 22 bp, Homo sapiens
tccaggcccgagatgggctgga

SEQ ID NO: 9315951 - DNA, 22 bp, Homo sapiens
tccaggcccctgcctgggcctg

SEQ ID NO: 9315952 - DNA, 22 bp, Homo sapiens
tccaggccccagcaccttggga

SEQ ID NO: 9315953 - DNA, 22 bp, Homo sapiens
tccaggccccagaccgtactgc

SEQ ID NO: 9315954 - DNA, 22 bp, Homo sapiens
tccaggccccccacgctaatgg

SEQ ID NO: 9315955 - DNA, 22 bp, Homo sapiens
tccaggccccactgaagcccct

SEQ ID NO: 9315956 - DNA, 22 bp, Homo sapiens
tccaggctcccctgcgtgctcc

SEQ ID NO: 9315957 - DNA, 22 bp, Homo sapiens
tccaggctccctcaggatgcac

SEQ ID NO: 9315958 - DNA, 18 bp, Homo sapiens
tccaggctccaggctaac

SEQ ID NO: 9315959 - DNA, 22 bp, Homo sapiens
tccaggctcagtcaagcacttc

SEQ ID NO: 9315960 - DNA, 22 bp, Homo sapiens
catgtgtggtctgtggctatct

SEQ ID NO: 9315961 - DNA, 22 bp, Homo sapiens
tccaggctccctcaggatgcac

SEQ ID NO: 9315962 - DNA, 22 bp, Homo sapiens
catgttaaaatatacattctga

SEQ ID NO: 9315963 - DNA, 22 bp, Homo sapiens
tcccagagctctggaggttgga

SEQ ID NO: 9315964 - DNA, 22 bp, Homo sapiens
tcccagagcccaagttggagag

SEQ ID NO: 9315965 - DNA, 21 bp, Homo sapiens
tcccactctaaatggactgaa

SEQ ID NO: 9315966 - DNA, 22 bp, Homo sapiens
cattcattcagcaactgttatt

SEQ ID NO: 9315967 - DNA, 22 bp, Homo sapiens
tcccagccacagtttccacctg

SEQ ID NO: 9315968 - DNA, 22 bp, Homo sapiens
tcccagccaggctctaccactt

SEQ ID NO: 9315969 - DNA, 22 bp, Homo sapiens
tcccaggaatgtctgaaagtga

SEQ ID NO: 9315970 - DNA, 23 bp, Homo sapiens
tcccaggaatctgcatttttaac

SEQ ID NO: 9315971 - DNA, 22 bp, Homo sapiens
tcccaggaatccgtcctctaga

SEQ ID NO: 9315972 - DNA, 22 bp, Homo sapiens
tcccaggaattgaagccagtgt

SEQ ID NO: 9315973 - DNA, 22 bp, Homo sapiens
tcccaggacttccagttggagg

SEQ ID NO: 9315974 - DNA, 22 bp, Homo sapiens
tcccaggacatgggctctgctc

SEQ ID NO: 9315975 - DNA, 22 bp, Homo sapiens
tcccaggacccaggcattcaca

SEQ ID NO: 9315976 - DNA, 22 bp, Homo sapiens
tcccaggacaggccacatggaa

SEQ ID NO: 9315977 - DNA, 22 bp, Homo sapiens
catgtttgtaggtcctgcttgc

SEQ ID NO: 9315978 - DNA, 22 bp, Homo sapiens
catgttaatgaatttttgcagt

SEQ ID NO: 9315979 - DNA, 22 bp, Homo sapiens
catgttaatatgcattgagtac

SEQ ID NO: 9315980 - DNA, 22 bp, Homo sapiens
cattcatatttgcagtatacct

SEQ ID NO: 9315981 - DNA, 22 bp, Homo sapiens
cattcatacaagtttgtttcat

SEQ ID NO: 9315982 - DNA, 22 bp, Homo sapiens
tcccagggtcctcttctggaat

SEQ ID NO: 9315983 - DNA, 22 bp, Homo sapiens
cattgcaacttcaaactcctgg

SEQ ID NO: 9315984 - DNA, 22 bp, Homo sapiens
cattgaaacctaacataggctg

SEQ ID NO: 9315985 - DNA, 22 bp, Homo sapiens
cattgaatccttccttcagaag

SEQ ID NO: 9315986 - DNA, 22 bp, Homo sapiens
tcccaggagcaccttttgagcc

SEQ ID NO: 9315987 - DNA, 16 bp, Homo sapiens
tcccaggaggcggaac

SEQ ID NO: 9315988 - DNA, 22 bp, Homo sapiens
tcccaggaggtgcttcctagga

SEQ ID NO: 9315989 - DNA, 22 bp, Homo sapiens
tcccgggcaggtcgagcgagcc

SEQ ID NO: 9315990 - DNA, 22 bp, Homo sapiens
tcccgtcttgctgttgtctgcg

SEQ ID NO: 9315991 - DNA, 22 bp, Homo sapiens
tccccactctgggccaccacaa

SEQ ID NO: 9315992 - DNA, 18 bp, Homo sapiens
tcctcagcctcacctagc

SEQ ID NO: 9315993 - DNA, 22 bp, Homo sapiens
tcctcaggatctaggagtgctt

SEQ ID NO: 9315994 - DNA, 22 bp, Homo sapiens
tccctagtcgcatctgtggaga

SEQ ID NO: 9315995 - DNA, 22 bp, Homo sapiens
tccctaggtcctagtcacagta

SEQ ID NO: 9315996 - DNA, 22 bp, Homo sapiens
tccctcagaaattctctctgaa

SEQ ID NO: 9315997 - DNA, 22 bp, Homo sapiens
tcctctccatattttctgattt

SEQ ID NO: 9315998 - DNA, 22 bp, Homo sapiens
tcctctccatattttctgattt

SEQ ID NO: 9315999 - DNA, 22 bp, Homo sapiens
caggctggagtgcaatggcaca

SEQ ID NO: 9316000 - DNA, 22 bp, Homo sapiens
caggctggagtgcaatggcaca

SEQ ID NO: 9316001 - DNA, 22 bp, Homo sapiens
caggctggagtgcaatgacgcc

SEQ ID NO: 9316002 - DNA, 22 bp, Homo sapiens
caggctggagtgcaatgacgcc

SEQ ID NO: 9316003 - DNA, 22 bp, Homo sapiens
caggctggagtgcaatggcaca

SEQ ID NO: 9316004 - DNA, 22 bp, Homo sapiens
caggctggagtgcaatggtgct

SEQ ID NO: 9316005 - DNA, 22 bp, Homo sapiens
caggctggagtgcaatggtgct

SEQ ID NO: 9316006 - DNA, 22 bp, Homo sapiens
caggctggagtgcagtggcgcc

SEQ ID NO: 9316007 - DNA, 22 bp, Homo sapiens
tactgtctggcaattaagaatc

SEQ ID NO: 9316008 - DNA, 22 bp, Homo sapiens
caggctgccgtggggtccaggc

SEQ ID NO: 9316009 - DNA, 22 bp, Homo sapiens
caggctggagtacaattgtgtg

SEQ ID NO: 9316010 - DNA, 22 bp, Homo sapiens
caggctgcctggaagaggactg

SEQ ID NO: 9316011 - DNA, 22 bp, Homo sapiens
caggctggagtgagtgtagtgg

SEQ ID NO: 9316012 - DNA, 22 bp, Homo sapiens
caggctggagtgagtgtagtgg

SEQ ID NO: 9316013 - DNA, 22 bp, Homo sapiens
tagaatagtgttttcattatgg

SEQ ID NO: 9316014 - DNA, 22 bp, Homo sapiens
tagaatagtggctggcatattt

SEQ ID NO: 9316015 - DNA, 22 bp, Homo sapiens
tagaatactagtgaagtcatcg

SEQ ID NO: 9316016 - DNA, 22 bp, Homo sapiens
caggctggagtgcagtggcgct

SEQ ID NO: 9316017 - DNA, 22 bp, Homo sapiens
caggctggagtgcagtggggcg

SEQ ID NO: 9316018 - DNA, 22 bp, Homo sapiens
caggctggagtgcagtggggcg

SEQ ID NO: 9316019 - DNA, 22 bp, Homo sapiens
caggctggagtgcagtggggcg

SEQ ID NO: 9316020 - DNA, 22 bp, Homo sapiens
caggctggagtgcagtggcgct

SEQ ID NO: 9316021 - DNA, 22 bp, Homo sapiens
caggctggagtgcagtggcgct

SEQ ID NO: 9316022 - DNA, 22 bp, Homo sapiens
caggctggagtgcagtggcgcc

SEQ ID NO: 9316023 - DNA, 22 bp, Homo sapiens
caggctggagtgcagtggcgcc

SEQ ID NO: 9316024 - DNA, 20 bp, Homo sapiens
cagccctgtgacctggccct

SEQ ID NO: 9316025 - DNA, 22 bp, Homo sapiens
gtgaggggagtaaagccatgtt

SEQ ID NO: 9316026 - DNA, 22 bp, Homo sapiens
tactatttggaattttaaattg

SEQ ID NO: 9316027 - DNA, 22 bp, Homo sapiens
gtgaggggccaagagtagggca

SEQ ID NO: 9316028 - DNA, 22 bp, Homo sapiens
gtgaggggtggctgagcagttt

SEQ ID NO: 9316029 - DNA, 22 bp, Homo sapiens
tactatttggaattttaaattg

SEQ ID NO: 9316030 - DNA, 22 bp, Homo sapiens
tactatttttgcaacgtataca

SEQ ID NO: 9316031 - DNA, 22 bp, Homo sapiens
caggctgggctccggagataaa

SEQ ID NO: 9316032 - DNA, 22 bp, Homo sapiens
caggctgggctccggagataaa

SEQ ID NO: 9316033 - DNA, 22 bp, Homo sapiens
caggctgggctggtgttagagt

SEQ ID NO: 9316034 - DNA, 22 bp, Homo sapiens
caggctgggctggtgttagagt

SEQ ID NO: 9316035 - DNA, 22 bp, Homo sapiens
caggctggtcccagagcattgc

SEQ ID NO: 9316036 - DNA, 22 bp, Homo sapiens
caggctggtcccagagcattgc

SEQ ID NO: 9316037 - DNA, 22 bp, Homo sapiens
caggctggtcccagagcattgc

SEQ ID NO: 9316038 - DNA, 22 bp, Homo sapiens
caggctgggcagcctccccggc

SEQ ID NO: 9316039 - DNA, 22 bp, Homo sapiens
caggctgggcagcctccccggc

SEQ ID NO: 9316040 - DNA, 20 bp, Homo sapiens
tagagcttaggttttattct

SEQ ID NO: 9316041 - DNA, 22 bp, Homo sapiens
cagggcagaaggcactctactc

SEQ ID NO: 9316042 - DNA, 20 bp, Homo sapiens
cagggcacactgcagcctcg

SEQ ID NO: 9316043 - DNA, 22 bp, Homo sapiens
cagggcacagatcggggcgcac

SEQ ID NO: 9316044 - DNA, 21 bp, Homo sapiens
cagggcacacagaggatggta

SEQ ID NO: 9316045 - DNA, 22 bp, Homo sapiens
cagggcaagtttgagattattt

SEQ ID NO: 9316046 - DNA, 22 bp, Homo sapiens
cagggcaaagagagcacatgct

SEQ ID NO: 9316047 - DNA, 21 bp, Homo sapiens
cagggcaaccaagtccagaga

SEQ ID NO: 9316048 - DNA, 22 bp, Homo sapiens
cagggcaaagtcttctagaacc

SEQ ID NO: 9316049 - DNA, 21 bp, Homo sapiens
cagggcaaccaagtccagaga

SEQ ID NO: 9316050 - DNA, 22 bp, Homo sapiens
cagggcaaagagagcacatgct

SEQ ID NO: 9316051 - DNA, 22 bp, Homo sapiens
tagcattccatcactcagcacc

SEQ ID NO: 9316052 - DNA, 22 bp, Homo sapiens
tagcattatttcctctttttgt

SEQ ID NO: 9316053 - DNA, 22 bp, Homo sapiens
tagctaatggtgaagattcaga

SEQ ID NO: 9316054 - DNA, 22 bp, Homo sapiens
tagcaatgctctatgatgaaaa

SEQ ID NO: 9316055 - DNA, 22 bp, Homo sapiens
tagcattagtcagatatgtttt

SEQ ID NO: 9316056 - DNA, 22 bp, Homo sapiens
tagcattatctgtcttatcatt

SEQ ID NO: 9316057 - DNA, 22 bp, Homo sapiens
tagcaagaggtgaaggtttcat

SEQ ID NO: 9316058 - DNA, 22 bp, Homo sapiens
tagcaaggtgaagtatgggtga

SEQ ID NO: 9316059 - DNA, 22 bp, Homo sapiens
taggactgataaggggccagag

SEQ ID NO: 9316060 - DNA, 19 bp, Homo sapiens
taggaccctggtggccccc

SEQ ID NO: 9316061 - DNA, 20 bp, Homo sapiens
taggagcaatgagagtagaa

SEQ ID NO: 9316062 - DNA, 22 bp, Homo sapiens
cagggcctcattgtcagtcctg

SEQ ID NO: 9316063 - DNA, 21 bp, Homo sapiens
taggagctgatggggaagtag

SEQ ID NO: 9316064 - DNA, 22 bp, Homo sapiens
cagggctcactcggctggcgtc

SEQ ID NO: 9316065 - DNA, 22 bp, Homo sapiens
cagggctcagaagacagacctc

SEQ ID NO: 9316066 - DNA, 22 bp, Homo sapiens
cagggctagtgacaccccagtc

SEQ ID NO: 9316067 - DNA, 22 bp, Homo sapiens
cagggctcaccactgggatcct

SEQ ID NO: 9316068 - DNA, 22 bp, Homo sapiens
cagggctcactcggctggcgtc

SEQ ID NO: 9316069 - DNA, 22 bp, Homo sapiens
cagggctcaccactgggatcct

SEQ ID NO: 9316070 - DNA, 22 bp, Homo sapiens
cagggctcagggactgcagaaa

SEQ ID NO: 9316071 - DNA, 22 bp, Homo sapiens
cagggctcagggactgcagaaa

SEQ ID NO: 9316072 - DNA, 22 bp, Homo sapiens
cagggctcaggaaatcagacgt

SEQ ID NO: 9316073 - DNA, 22 bp, Homo sapiens
cagggctcaggctctgggattc

SEQ ID NO: 9316074 - DNA, 22 bp, Homo sapiens
cagggccttttagcatcttctc

SEQ ID NO: 9316075 - DNA, 21 bp, Homo sapiens
cagggctagagagaatgacaa

SEQ ID NO: 9316076 - DNA, 22 bp, Homo sapiens
cagggcggggtctgccggccct

SEQ ID NO: 9316077 - DNA, 22 bp, Homo sapiens
cagggcctgtcacgacgctcat

SEQ ID NO: 9316078 - DNA, 22 bp, Homo sapiens
tagctttaataagctgctgaat

SEQ ID NO: 9316079 - DNA, 22 bp, Homo sapiens
cagggcagccaggccccgtggg

SEQ ID NO: 9316080 - DNA, 22 bp, Homo sapiens
cagggcagagccaggatttcaa

SEQ ID NO: 9316081 - DNA, 22 bp, Homo sapiens
cagggcagagggaaactccttt

SEQ ID NO: 9316082 - DNA, 22 bp, Homo sapiens
tagctagggtaagacttggacc

SEQ ID NO: 9316083 - DNA, 22 bp, Homo sapiens
cagggctttttattagctgcct

SEQ ID NO: 9316084 - DNA, 22 bp, Homo sapiens
cagggctttgaacaggcatcaa

SEQ ID NO: 9316085 - DNA, 22 bp, Homo sapiens
caggggaaggagccttgaaact

SEQ ID NO: 9316086 - DNA, 22 bp, Homo sapiens
cagggctttcccttgtagaaat

SEQ ID NO: 9316087 - DNA, 22 bp, Homo sapiens
cagggcttggatctgtggtcag

SEQ ID NO: 9316088 - DNA, 22 bp, Homo sapiens
cagggctttgtgtgcctgggga

SEQ ID NO: 9316089 - DNA, 22 bp, Homo sapiens
cagggctttgaacaggcatcaa

SEQ ID NO: 9316090 - DNA, 22 bp, Homo sapiens
cagggctttgtaatatgagcac

SEQ ID NO: 9316091 - DNA, 22 bp, Homo sapiens
cagggctttcctgagaagtgat

SEQ ID NO: 9316092 - DNA, 21 bp, Homo sapiens
tagggcaggcattggaagaga

SEQ ID NO: 9316093 - DNA, 22 bp, Homo sapiens
tagggcaggtgaagaaaagcta

SEQ ID NO: 9316094 - DNA, 22 bp, Homo sapiens
tagggcaggggaggaatctgaa

SEQ ID NO: 9316095 - DNA, 22 bp, Homo sapiens
tatcatcttgttgtcatgcagc

SEQ ID NO: 9316096 - DNA, 22 bp, Homo sapiens
tatcatctgcaaagcacatcta

SEQ ID NO: 9316097 - DNA, 22 bp, Homo sapiens
caggggagttttatgcaacaga

SEQ ID NO: 9316098 - DNA, 22 bp, Homo sapiens
tatttctttcaggtatgtgttg

SEQ ID NO: 9316099 - DNA, 22 bp, Homo sapiens
cagtagcatgtaataaagacag

SEQ ID NO: 9316100 - DNA, 22 bp, Homo sapiens
cagtagcatgcttatcttttga

SEQ ID NO: 9316101 - DNA, 22 bp, Homo sapiens
tatttccacctattattttctg

SEQ ID NO: 9316102 - DNA, 21 bp, Homo sapiens
tatttccaaccctttatcctt

SEQ ID NO: 9316103 - DNA, 22 bp, Homo sapiens
cagggtgggcacccagcctcca

SEQ ID NO: 9316104 - DNA, 22 bp, Homo sapiens
cagggtggggaaatagcgccct

SEQ ID NO: 9316105 - DNA, 22 bp, Homo sapiens
caggttcccttgcagctaagtg

SEQ ID NO: 9316106 - DNA, 22 bp, Homo sapiens
caggttccctagcagcaaagcc

SEQ ID NO: 9316107 - DNA, 22 bp, Homo sapiens
caggttgaaagtggaggagcta

SEQ ID NO: 9316108 - DNA, 22 bp, Homo sapiens
tatttataacagtgagaacggg

SEQ ID NO: 9316109 - DNA, 22 bp, Homo sapiens
tatttcattctttatcaggagc

SEQ ID NO: 9316110 - DNA, 22 bp, Homo sapiens
cagtgagctcctgtctgtccct

SEQ ID NO: 9316111 - DNA, 22 bp, Homo sapiens
tcacagacctggtgggaggtgg

SEQ ID NO: 9316112 - DNA, 22 bp, Homo sapiens
tcacagactcaagggcatagga

SEQ ID NO: 9316113 - DNA, 22 bp, Homo sapiens
tcacagacgcctcccctcgcct

SEQ ID NO: 9316114 - DNA, 22 bp, Homo sapiens
tcacagacgcatcctcaggtag

SEQ ID NO: 9316115 - DNA, 22 bp, Homo sapiens
cagtgacacccagtctggccca

SEQ ID NO: 9316116 - DNA, 22 bp, Homo sapiens
cagtgacacgggctggcccacg

SEQ ID NO: 9316117 - DNA, 22 bp, Homo sapiens
cagtgacagcaagcagtgctgg

SEQ ID NO: 9316118 - DNA, 22 bp, Homo sapiens
cagtgacgtaaactgcatgtgc

SEQ ID NO: 9316119 - DNA, 22 bp, Homo sapiens
cagtgacaggttccatgccgca

SEQ ID NO: 9316120 - DNA, 22 bp, Homo sapiens
tatttcttttcgtgacttattg

SEQ ID NO: 9316121 - DNA, 22 bp, Homo sapiens
tcacaaatcattttatctgtgt

SEQ ID NO: 9316122 - DNA, 22 bp, Homo sapiens
tcacagactgtgttgctactca

SEQ ID NO: 9316123 - DNA, 22 bp, Homo sapiens
tcacagacttgtctccagggat

SEQ ID NO: 9316124 - DNA, 18 bp, Homo sapiens
tcacagacttactgggcc

SEQ ID NO: 9316125 - DNA, 22 bp, Homo sapiens
tcacagactggtcagtcaactt

SEQ ID NO: 9316126 - DNA, 22 bp, Homo sapiens
tcacagactcttgattgtctaa

SEQ ID NO: 9316127 - DNA, 21 bp, Homo sapiens
tcacagactggtcagtgaggc

SEQ ID NO: 9316128 - DNA, 22 bp, Homo sapiens
tcacaggagaatgtacttacca

SEQ ID NO: 9316129 - DNA, 22 bp, Homo sapiens
tcagctttgggggtctcaggag

SEQ ID NO: 9316130 - DNA, 22 bp, Homo sapiens
tcagctttggtcacattgagtt

SEQ ID NO: 9316131 - DNA, 22 bp, Homo sapiens
tcagcttttaaaaacaagaagt

SEQ ID NO: 9316132 - DNA, 22 bp, Homo sapiens
tcagctttgcaagttagaaaat

SEQ ID NO: 9316133 - DNA, 21 bp, Homo sapiens
cagtttaataacaaagaagga

SEQ ID NO: 9316134 - DNA, 22 bp, Homo sapiens
tcagctttttggattgcccaag

SEQ ID NO: 9316135 - DNA, 22 bp, Homo sapiens
tcaggaaaatactgcttatcca

SEQ ID NO: 9316136 - DNA, 22 bp, Homo sapiens
tcagcagaatgtggcatgtcac

SEQ ID NO: 9316137 - DNA, 22 bp, Homo sapiens
cagttaaaggcccaatatctgg

SEQ ID NO: 9316138 - DNA, 22 bp, Homo sapiens
cagtgtttgtatagaatatgca

SEQ ID NO: 9316139 - DNA, 22 bp, Homo sapiens
cagtgtttgtggaattcaggtg

SEQ ID NO: 9316140 - DNA, 22 bp, Homo sapiens
cagtgttttgagaagggcacgt

SEQ ID NO: 9316141 - DNA, 22 bp, Homo sapiens
cagtgttttgttacttgggcac

SEQ ID NO: 9316142 - DNA, 22 bp, Homo sapiens
cagtgtttgttgagaaaggcaa

SEQ ID NO: 9316143 - DNA, 22 bp, Homo sapiens
cagtgtttgcttaagttatatg

SEQ ID NO: 9316144 - DNA, 22 bp, Homo sapiens
cagtgtttctgtgcccagtggg

SEQ ID NO: 9316145 - DNA, 22 bp, Homo sapiens
cagtgtttctgagttccagctc

SEQ ID NO: 9316146 - DNA, 22 bp, Homo sapiens
cagtgtttccgtcagtatgtga

SEQ ID NO: 9316147 - DNA, 22 bp, Homo sapiens
cagttaaaatgtgctataagaa

SEQ ID NO: 9316148 - DNA, 23 bp, Homo sapiens
cagtgtgacaaaacttattactt

SEQ ID NO: 9316149 - DNA, 22 bp, Homo sapiens
cagtgtttagcacagtgcttgg

SEQ ID NO: 9316150 - DNA, 22 bp, Homo sapiens
cagtgggacatgggcactgggc

SEQ ID NO: 9316151 - DNA, 22 bp, Homo sapiens
cagtgggatatgggggcagcat

SEQ ID NO: 9316152 - DNA, 22 bp, Homo sapiens
cagtgggaatgaagtggaggcc

SEQ ID NO: 9316153 - DNA, 22 bp, Homo sapiens
cagtggcttcttcctagagcca

SEQ ID NO: 9316154 - DNA, 22 bp, Homo sapiens
cctgcctgcctgctggccggga

SEQ ID NO: 9316155 - DNA, 22 bp, Homo sapiens
cctgcctgtcatcgcctgcgcc

SEQ ID NO: 9316156 - DNA, 22 bp, Homo sapiens
cctgcctgtctttatcccctgt

SEQ ID NO: 9316157 - DNA, 22 bp, Homo sapiens
cctgcctgtctttatcccctgt

SEQ ID NO: 9316158 - DNA, 20 bp, Homo sapiens
cctgcctgtgtttgtgatga

SEQ ID NO: 9316159 - DNA, 23 bp, Homo sapiens
cctgcctgttctaactccatttc

SEQ ID NO: 9316160 - DNA, 18 bp, Homo sapiens
cctgccagtctggagcag

SEQ ID NO: 9316161 - DNA, 22 bp, Homo sapiens
cctgccaggcgagtctaggcca

SEQ ID NO: 9316162 - DNA, 22 bp, Homo sapiens
tgggtcacaaaggccagatgat

SEQ ID NO: 9316163 - DNA, 22 bp, Homo sapiens
tgggtcaccacttcagaggaga

SEQ ID NO: 9316164 - DNA, 22 bp, Homo sapiens
tgggtcactatttgcagagacg

SEQ ID NO: 9316165 - DNA, 22 bp, Homo sapiens
tggtctgttcaaggtggctgat

SEQ ID NO: 9316166 - DNA, 22 bp, Homo sapiens
cctgctggacaggggtgttcat

SEQ ID NO: 9316167 - DNA, 22 bp, Homo sapiens
tggtctgggcaaatccttctga

SEQ ID NO: 9316168 - DNA, 20 bp, Homo sapiens
cctgctgggaaccctctgaa

SEQ ID NO: 9316169 - DNA, 22 bp, Homo sapiens
cctgctgggacgtgtggttgcc

SEQ ID NO: 9316170 - DNA, 22 bp, Homo sapiens
cctgctggccagtggagggctg

SEQ ID NO: 9316171 - DNA, 22 bp, Homo sapiens
cctgctggcgcttgtctgggag

SEQ ID NO: 9316172 - DNA, 22 bp, Homo sapiens
cctgctggcagagggggttact

SEQ ID NO: 9316173 - DNA, 22 bp, Homo sapiens
cctgctggacgtggaggagggg

SEQ ID NO: 9316174 - DNA, 22 bp, Homo sapiens
cctgctggccactgctccacct

SEQ ID NO: 9316175 - DNA, 22 bp, Homo sapiens
cctgctgggcctgagcaatgag

SEQ ID NO: 9316176 - DNA, 22 bp, Homo sapiens
cctgctggtgtccaggctttgg

SEQ ID NO: 9316177 - DNA, 22 bp, Homo sapiens
cctgctgtcagcatcctcgcga

SEQ ID NO: 9316178 - DNA, 22 bp, Homo sapiens
cctgctgtagggcccctggggc

SEQ ID NO: 9316179 - DNA, 22 bp, Homo sapiens
cctgctgtcagcatcctcgcga

SEQ ID NO: 9316180 - DNA, 22 bp, Homo sapiens
cctgctgtgaccggggagcagg

SEQ ID NO: 9316181 - DNA, 22 bp, Homo sapiens
cctgctgtgaagccaggcctgt

SEQ ID NO: 9316182 - DNA, 22 bp, Homo sapiens
cctgctgtccctctgggctcca

SEQ ID NO: 9316183 - DNA, 22 bp, Homo sapiens
cctgctgtgaaactggcatatg

SEQ ID NO: 9316184 - DNA, 22 bp, Homo sapiens
tgtaaagacgcttatagcttgc

SEQ ID NO: 9316185 - DNA, 22 bp, Homo sapiens
cctgcttaacattgccatgaca

SEQ ID NO: 9316186 - DNA, 22 bp, Homo sapiens
cctgcttcagggatgatggcac

SEQ ID NO: 9316187 - DNA, 22 bp, Homo sapiens
cctgcttccttcaagtttatct

SEQ ID NO: 9316188 - DNA, 22 bp, Homo sapiens
tgtaatgagtcacttaccttaa

SEQ ID NO: 9316189 - DNA, 22 bp, Homo sapiens
tgtaatttcctgatgttagaac

SEQ ID NO: 9316190 - DNA, 22 bp, Homo sapiens
cctggagcttttccatcctgga

SEQ ID NO: 9316191 - DNA, 22 bp, Homo sapiens
tgtcaacacacctatctcaatt

SEQ ID NO: 9316192 - DNA, 22 bp, Homo sapiens
cctgacctccaagtggctctgg

SEQ ID NO: 9316193 - DNA, 22 bp, Homo sapiens
cctgacgaaaggcgtgctggag

SEQ ID NO: 9316194 - DNA, 22 bp, Homo sapiens
cctgacctatttttctcagctg

SEQ ID NO: 9316195 - DNA, 22 bp, Homo sapiens
cctgaggccctggctgtgctga

SEQ ID NO: 9316196 - DNA, 22 bp, Homo sapiens
cctgaggctcgcgcgcccctgg

SEQ ID NO: 9316197 - DNA, 22 bp, Homo sapiens
cctgaggctccacctccagaga

SEQ ID NO: 9316198 - DNA, 22 bp, Homo sapiens
cctgaggctggcccttccatcc

SEQ ID NO: 9316199 - DNA, 22 bp, Homo sapiens
cctgaggcttaatctgtcccaa

SEQ ID NO: 9316200 - DNA, 22 bp, Homo sapiens
tgggggtgtgccagggacctcc

SEQ ID NO: 9316201 - DNA, 22 bp, Homo sapiens
tgggggtgtcctggtgcacaca

SEQ ID NO: 9316202 - DNA, 22 bp, Homo sapiens
cctgcagaaagggtccccagga

SEQ ID NO: 9316203 - DNA, 22 bp, Homo sapiens
cctgcagaagagtccagctcat

SEQ ID NO: 9316204 - DNA, 22 bp, Homo sapiens
cctgcacttctcacagctgctg

SEQ ID NO: 9316205 - DNA, 22 bp, Homo sapiens
cctgcaagactatttagttcca

SEQ ID NO: 9316206 - DNA, 22 bp, Homo sapiens
cctgcaccaggcccagcatggt

SEQ ID NO: 9316207 - DNA, 22 bp, Homo sapiens
cctccctctttcagtcccacag

SEQ ID NO: 9316208 - DNA, 22 bp, Homo sapiens
tggctctcccaatacctttctg

SEQ ID NO: 9316209 - DNA, 22 bp, Homo sapiens
tggctctcagctcccagcagcc

SEQ ID NO: 9316210 - DNA, 22 bp, Homo sapiens
tggctctccagagcctatggta

SEQ ID NO: 9316211 - DNA, 22 bp, Homo sapiens
tggctctccagctctaaggcct

SEQ ID NO: 9316212 - DNA, 22 bp, Homo sapiens
tgggagcaggtgtgctagggaa

SEQ ID NO: 9316213 - DNA, 21 bp, Homo sapiens
tgggagagcgttgctgtcctc

SEQ ID NO: 9316214 - DNA, 22 bp, Homo sapiens
tgggagccattttagaggctgc

SEQ ID NO: 9316215 - DNA, 22 bp, Homo sapiens
tgggagcctggcaggccagagg

SEQ ID NO: 9316216 - DNA, 22 bp, Homo sapiens
tgggccagaagtatgcatgttt

SEQ ID NO: 9316217 - DNA, 22 bp, Homo sapiens
cctcttctgagtgagactccct

SEQ ID NO: 9316218 - DNA, 22 bp, Homo sapiens
cctgaatgcctgacatttcact

SEQ ID NO: 9316219 - DNA, 22 bp, Homo sapiens
cctgaagggactccagagagca

SEQ ID NO: 9316220 - DNA, 22 bp, Homo sapiens
cctcagctgcttccctggagcc

SEQ ID NO: 9316221 - DNA, 22 bp, Homo sapiens
tggcctggggacctgtgagacc

SEQ ID NO: 9316222 - DNA, 22 bp, Homo sapiens
tggcctctcctggcagcatcca

SEQ ID NO: 9316223 - DNA, 22 bp, Homo sapiens
tggcctctcctggcagcatcca

SEQ ID NO: 9316224 - DNA, 22 bp, Homo sapiens
tggcctctctaccaggcagcct

SEQ ID NO: 9316225 - DNA, 22 bp, Homo sapiens
tggcctcccctaacagcctctt

SEQ ID NO: 9316226 - DNA, 21 bp, Homo sapiens
tggcctcccacacttccatgg

SEQ ID NO: 9316227 - DNA, 22 bp, Homo sapiens
tggcctcagatttcaggggtgg

SEQ ID NO: 9316228 - DNA, 22 bp, Homo sapiens
tggcctcaatctgtcctccagc

SEQ ID NO: 9316229 - DNA, 22 bp, Homo sapiens
cctcacctcagtctgggcctca

SEQ ID NO: 9316230 - DNA, 22 bp, Homo sapiens
tggctaagcatgctccagctgc

SEQ ID NO: 9316231 - DNA, 22 bp, Homo sapiens
tggctaacaaggtgaaaccccg

SEQ ID NO: 9316232 - DNA, 22 bp, Homo sapiens
tggctaacaaggtgaaaccccg

SEQ ID NO: 9316233 - DNA, 22 bp, Homo sapiens
tggctaggacctctgcggagca

SEQ ID NO: 9316234 - DNA, 22 bp, Homo sapiens
tggctaggctccaagagctgga

SEQ ID NO: 9316235 - DNA, 19 bp, Homo sapiens
cctccccttggaccagcaa

SEQ ID NO: 9316236 - DNA, 23 bp, Homo sapiens
cctccccttcccacagctgggtg

SEQ ID NO: 9316237 - DNA, 22 bp, Homo sapiens
cctcccctgctcagaactctgg

SEQ ID NO: 9316238 - DNA, 22 bp, Homo sapiens
cctccctccattgccatcgtct

SEQ ID NO: 9316239 - DNA, 22 bp, Homo sapiens
cctcccctcagacagagactgg

SEQ ID NO: 9316240 - DNA, 22 bp, Homo sapiens
cctcccagatgtgcccaatgga

SEQ ID NO: 9316241 - DNA, 22 bp, Homo sapiens
tggctcagcgcggcctggtctt

SEQ ID NO: 9316242 - DNA, 22 bp, Homo sapiens
tggctcagcggtggcagcagac

SEQ ID NO: 9316243 - DNA, 22 bp, Homo sapiens
ccggctactcgggaggctgacg

SEQ ID NO: 9316244 - DNA, 22 bp, Homo sapiens
ccgggagcaggcgccaccgcca

SEQ ID NO: 9316245 - DNA, 22 bp, Homo sapiens
ccgggcctcgggacaccgggta

SEQ ID NO: 9316246 - DNA, 22 bp, Homo sapiens
cctcacccactacactcaaggg

SEQ ID NO: 9316247 - DNA, 22 bp, Homo sapiens
cctcacccagtcacctaggtgg

SEQ ID NO: 9316248 - DNA, 22 bp, Homo sapiens
cctcacagccctcctctagcac

SEQ ID NO: 9316249 - DNA, 22 bp, Homo sapiens
cctcacagaggggcagccatct

SEQ ID NO: 9316250 - DNA, 22 bp, Homo sapiens
ccgcggggcgtgggctcttacc

SEQ ID NO: 9316251 - DNA, 22 bp, Homo sapiens
ccctggagctgcttgcatgttg

SEQ ID NO: 9316252 - DNA, 22 bp, Homo sapiens
ccctaaggcagcccagtctgtg

SEQ ID NO: 9316253 - DNA, 22 bp, Homo sapiens
ccctaaggacacctgctgtcca

SEQ ID NO: 9316254 - DNA, 22 bp, Homo sapiens
tgcctgcctgcatagtcccacg

SEQ ID NO: 9316255 - DNA, 22 bp, Homo sapiens
tgcctccatgtttcagcatcta

SEQ ID NO: 9316256 - DNA, 22 bp, Homo sapiens
tgcctgccctttccacacagcc

SEQ ID NO: 9316257 - DNA, 22 bp, Homo sapiens
tgcctcagtttcatctgcagaa

SEQ ID NO: 9316258 - DNA, 17 bp, Homo sapiens
tgcctccagcagggtga

SEQ ID NO: 9316259 - DNA, 23 bp, Homo sapiens
tgcctccaccgagggccaggcat

SEQ ID NO: 9316260 - DNA, 22 bp, Homo sapiens
tgcctccaggaggggcagctct

SEQ ID NO: 9316261 - DNA, 22 bp, Homo sapiens
tgcctccaggaggggcagctct

SEQ ID NO: 9316262 - DNA, 22 bp, Homo sapiens
tgcctgctaggccctgctgggt

SEQ ID NO: 9316263 - DNA, 22 bp, Homo sapiens
tgcctgctatttgcctaaagtg

SEQ ID NO: 9316264 - DNA, 22 bp, Homo sapiens
tgcctgctccagtcctgtccac

SEQ ID NO: 9316265 - DNA, 22 bp, Homo sapiens
tgcctgctagatatccaggtga

SEQ ID NO: 9316266 - DNA, 22 bp, Homo sapiens
tgcctgctaggcactttcaaac

SEQ ID NO: 9316267 - DNA, 22 bp, Homo sapiens
tgctttattggaacctcatcct

SEQ ID NO: 9316268 - DNA, 22 bp, Homo sapiens
tgctttattgcatcagtgtggg

SEQ ID NO: 9316269 - DNA, 22 bp, Homo sapiens
tgctttatttataaaatagcaa

SEQ ID NO: 9316270 - DNA, 22 bp, Homo sapiens
tgctttattttaaatatgccat

SEQ ID NO: 9316271 - DNA, 22 bp, Homo sapiens
tgctttcaaaggctttctagat

SEQ ID NO: 9316272 - DNA, 22 bp, Homo sapiens
tgctttcacctgtttgcaccca

SEQ ID NO: 9316273 - DNA, 22 bp, Homo sapiens
tgctttcacctgtttgcaccca

SEQ ID NO: 9316274 - DNA, 22 bp, Homo sapiens
tgctttcacaccatgcctataa

SEQ ID NO: 9316275 - DNA, 22 bp, Homo sapiens
tgctttcattgcctgcggtttt

SEQ ID NO: 9316276 - DNA, 22 bp, Homo sapiens
tgctttcagccagtgtctggat

SEQ ID NO: 9316277 - DNA, 22 bp, Homo sapiens
tgctttcacttctctgcagcca

SEQ ID NO: 9316278 - DNA, 22 bp, Homo sapiens
tgctttcagatatctgtttcaa

SEQ ID NO: 9316279 - DNA, 22 bp, Homo sapiens
tggacaggtttgggtgcctgtt

SEQ ID NO: 9316280 - DNA, 22 bp, Homo sapiens
ccctgcctgtgggcatcaacat

SEQ ID NO: 9316281 - DNA, 22 bp, Homo sapiens
ccctgcctctgaagctgctcag

SEQ ID NO: 9316282 - DNA, 22 bp, Homo sapiens
ccctgcctctgaagctgctcag

SEQ ID NO: 9316283 - DNA, 22 bp, Homo sapiens
ccctgcctacagggttttcttt

SEQ ID NO: 9316284 - DNA, 22 bp, Homo sapiens
ccctgcctacagggttttcttt

SEQ ID NO: 9316285 - DNA, 22 bp, Homo sapiens
ccctgaggaccaggaaggaggg

SEQ ID NO: 9316286 - DNA, 22 bp, Homo sapiens
tggaagggaacaggtgggtgtt

SEQ ID NO: 9316287 - DNA, 22 bp, Homo sapiens
ccctgaggaccaggaaggaggg

SEQ ID NO: 9316288 - DNA, 17 bp, Homo sapiens
ccctgcaccctactctc

SEQ ID NO: 9316289 - DNA, 22 bp, Homo sapiens
ccctgctcttctgactcaagct

SEQ ID NO: 9316290 - DNA, 22 bp, Homo sapiens
ccctgctcttagtgcctgtgtg

SEQ ID NO: 9316291 - DNA, 22 bp, Homo sapiens
ccctgctcttctgactcaagct

SEQ ID NO: 9316292 - DNA, 23 bp, Homo sapiens
ccctgctcaggggtctgattctc

SEQ ID NO: 9316293 - DNA, 23 bp, Homo sapiens
ccctgctcaggggtctgattctc

SEQ ID NO: 9316294 - DNA, 22 bp, Homo sapiens
ccctgccttgtctgggctaggt

SEQ ID NO: 9316295 - DNA, 22 bp, Homo sapiens
ccctgccttgttggagcctatg

SEQ ID NO: 9316296 - DNA, 22 bp, Homo sapiens
ccctgctagaacctccaacatg

SEQ ID NO: 9316297 - DNA, 22 bp, Homo sapiens
ccctgccttcttggcctttaaa

SEQ ID NO: 9316298 - DNA, 22 bp, Homo sapiens
ccctgccttggggtccacaccg

SEQ ID NO: 9316299 - DNA, 22 bp, Homo sapiens
ccctgccttggggtccacaccg

SEQ ID NO: 9316300 - DNA, 22 bp, Homo sapiens
tggaggtgacggggcctcgttg

SEQ ID NO: 9316301 - DNA, 22 bp, Homo sapiens
tggaggtgagtgtggtacagca

SEQ ID NO: 9316302 - DNA, 22 bp, Homo sapiens
ccctggagctagtctgagcaga

SEQ ID NO: 9316303 - DNA, 22 bp, Homo sapiens
tggaggggcaatggagcgcgga

SEQ ID NO: 9316304 - DNA, 22 bp, Homo sapiens
tggaggtcttacccagggctat

SEQ ID NO: 9316305 - DNA, 22 bp, Homo sapiens
tggaggtctgcaaggcgctgga

SEQ ID NO: 9316306 - DNA, 22 bp, Homo sapiens
tggaggtctgcaaggcgctgga

SEQ ID NO: 9316307 - DNA, 22 bp, Homo sapiens
tggaggtcctgcaggatggcac

SEQ ID NO: 9316308 - DNA, 22 bp, Homo sapiens
tggaggtcgcgcgggtgctgca

SEQ ID NO: 9316309 - DNA, 22 bp, Homo sapiens
tggaggtcctggctgggtttta

SEQ ID NO: 9316310 - DNA, 22 bp, Homo sapiens
tggaggtcgctagcgagcgggc

SEQ ID NO: 9316311 - DNA, 19 bp, Homo sapiens
tggaggtccaggagtaggg

SEQ ID NO: 9316312 - DNA, 19 bp, Homo sapiens
tggaggtccaggagtaggg

SEQ ID NO: 9316313 - DNA, 18 bp, Homo sapiens
cccagctccacttccctc

SEQ ID NO: 9316314 - DNA, 22 bp, Homo sapiens
cccagctccagagccagaaaca

SEQ ID NO: 9316315 - DNA, 22 bp, Homo sapiens
cccagctcccatgttctccaat

SEQ ID NO: 9316316 - DNA, 21 bp, Homo sapiens
cccaggagaagaaaagatgca

SEQ ID NO: 9316317 - DNA, 22 bp, Homo sapiens
cccaggactcttcactgcagcc

SEQ ID NO: 9316318 - DNA, 22 bp, Homo sapiens
cccaggactctgacacccccaa

SEQ ID NO: 9316319 - DNA, 22 bp, Homo sapiens
cccaggacccttcaatggctcc

SEQ ID NO: 9316320 - DNA, 22 bp, Homo sapiens
cccaggaccatccttctgtgcc

SEQ ID NO: 9316321 - DNA, 22 bp, Homo sapiens
cccaggactcggcactctcctt

SEQ ID NO: 9316322 - DNA, 22 bp, Homo sapiens
cccaggactaatgagctctacg

SEQ ID NO: 9316323 - DNA, 22 bp, Homo sapiens
cccaggaccgcgcggctgagcg

SEQ ID NO: 9316324 - DNA, 22 bp, Homo sapiens
tgcagtcttccagctgcacaaa

SEQ ID NO: 9316325 - DNA, 22 bp, Homo sapiens
tgcagtggaagaggtggagatc

SEQ ID NO: 9316326 - DNA, 22 bp, Homo sapiens
tgcagtggaggccgtgagacag

SEQ ID NO: 9316327 - DNA, 22 bp, Homo sapiens
tgcagcagtttaatgcagggtt

SEQ ID NO: 9316328 - DNA, 22 bp, Homo sapiens
tgcagcagtttaatgcagggtt

SEQ ID NO: 9316329 - DNA, 22 bp, Homo sapiens
tgccctggttacactggagtcc

SEQ ID NO: 9316330 - DNA, 22 bp, Homo sapiens
cccaggaggttgaggctgcagt

SEQ ID NO: 9316331 - DNA, 22 bp, Homo sapiens
tgccctgatgatcctcctcgca

SEQ ID NO: 9316332 - DNA, 22 bp, Homo sapiens
cccaggaggcggaggttgcagt

SEQ ID NO: 9316333 - DNA, 22 bp, Homo sapiens
tgccctcctcctgagcccatgt

SEQ ID NO: 9316334 - DNA, 22 bp, Homo sapiens
tgccctccctgtactgtcagga

SEQ ID NO: 9316335 - DNA, 22 bp, Homo sapiens
tgccctctgcaggccgccatgg

SEQ ID NO: 9316336 - DNA, 22 bp, Homo sapiens
tgccctctgcctcctctgcaga

SEQ ID NO: 9316337 - DNA, 22 bp, Homo sapiens
tgccctctgcaggccgccatgg

SEQ ID NO: 9316338 - DNA, 22 bp, Homo sapiens
tgccctcttaggtctgcgcagc

SEQ ID NO: 9316339 - DNA, 21 bp, Homo sapiens
tgcatattcttctggtggctg

SEQ ID NO: 9316340 - DNA, 22 bp, Homo sapiens
cccaggaggcagagatagcagt

SEQ ID NO: 9316341 - DNA, 22 bp, Homo sapiens
cccaggaggcagaagttgcagt

SEQ ID NO: 9316342 - DNA, 22 bp, Homo sapiens
cccaggaggaggaaaaagctcg

SEQ ID NO: 9316343 - DNA, 22 bp, Homo sapiens
cccaggaggcagaggttgcagt

SEQ ID NO: 9316344 - DNA, 22 bp, Homo sapiens
cccaggaggccaaggttgcagt

SEQ ID NO: 9316345 - DNA, 22 bp, Homo sapiens
cccacaggcaggtgcatgggct

SEQ ID NO: 9316346 - DNA, 22 bp, Homo sapiens
tgcagaggtgttgctgagataa

SEQ ID NO: 9316347 - DNA, 22 bp, Homo sapiens
tgcagaggtttccaggcaagtt

SEQ ID NO: 9316348 - DNA, 22 bp, Homo sapiens
tgcagaggtttccaggcaagtt

SEQ ID NO: 9316349 - DNA, 22 bp, Homo sapiens
tgcagaggtgaaagactagcaa

SEQ ID NO: 9316350 - DNA, 22 bp, Homo sapiens
tgcagaggtgtgcattcttaag

SEQ ID NO: 9316351 - DNA, 22 bp, Homo sapiens
tgcagaggtgttgctgagataa

SEQ ID NO: 9316352 - DNA, 22 bp, Homo sapiens
cccacccagcctggctgagggg

SEQ ID NO: 9316353 - DNA, 22 bp, Homo sapiens
tgcagaggtttgtggtgttgct

SEQ ID NO: 9316354 - DNA, 22 bp, Homo sapiens
cccagagatcttgtcctttcca

SEQ ID NO: 9316355 - DNA, 22 bp, Homo sapiens
cccagagagctttctttgtgct

SEQ ID NO: 9316356 - DNA, 22 bp, Homo sapiens
cccagcagatggctatgtgcta

SEQ ID NO: 9316357 - DNA, 23 bp, Homo sapiens
cccagcagagatgaggaggggtc

SEQ ID NO: 9316358 - DNA, 18 bp, Homo sapiens
cccagcactttgggagcc

SEQ ID NO: 9316359 - DNA, 22 bp, Homo sapiens
tgattatgcatgagacagtact

SEQ ID NO: 9316360 - DNA, 22 bp, Homo sapiens
tgattagtccactataatccta

SEQ ID NO: 9316361 - DNA, 22 bp, Homo sapiens
cccaaagggcttcctgttctca

SEQ ID NO: 9316362 - DNA, 22 bp, Homo sapiens
cccaaacatccaggtgctggac

SEQ ID NO: 9316363 - DNA, 22 bp, Homo sapiens
cccaaaggctgtacttgtaacc

SEQ ID NO: 9316364 - DNA, 22 bp, Homo sapiens
cccaaaggaaggacaaggcaga

SEQ ID NO: 9316365 - DNA, 22 bp, Homo sapiens
cccaaaggcattttgctgacca

SEQ ID NO: 9316366 - DNA, 22 bp, Homo sapiens
ccatggagttcctctggtctat

SEQ ID NO: 9316367 - DNA, 23 bp, Homo sapiens
ccatggagcatggctcactaggc

SEQ ID NO: 9316368 - DNA, 22 bp, Homo sapiens
ccatggagcgggtgagtgagtg

SEQ ID NO: 9316369 - DNA, 22 bp, Homo sapiens
ccatggagttcctctggtctat

SEQ ID NO: 9316370 - DNA, 22 bp, Homo sapiens
ccatggcagccatgggagccac

SEQ ID NO: 9316371 - DNA, 22 bp, Homo sapiens
ccagtgttcataattttacact

SEQ ID NO: 9316372 - DNA, 22 bp, Homo sapiens
ccagtgttacggcttgaactat

SEQ ID NO: 9316373 - DNA, 22 bp, Homo sapiens
tgaggcaggtaagcaagttttg

SEQ ID NO: 9316374 - DNA, 22 bp, Homo sapiens
tgaggcaggtggattacaaggt

SEQ ID NO: 9316375 - DNA, 22 bp, Homo sapiens
tgaggcagtattctccattcca

SEQ ID NO: 9316376 - DNA, 22 bp, Homo sapiens
tgaggcagtattttagtgactt

SEQ ID NO: 9316377 - DNA, 22 bp, Homo sapiens
tgaggcagtattttagtgactt

SEQ ID NO: 9316378 - DNA, 22 bp, Homo sapiens
tgaggcagtcaccccctcctgc

SEQ ID NO: 9316379 - DNA, 18 bp, Homo sapiens
tgaggcagtcagtgatgg

SEQ ID NO: 9316380 - DNA, 22 bp, Homo sapiens
tgaggcagtgatgtttaagcac

SEQ ID NO: 9316381 - DNA, 22 bp, Homo sapiens
tgatgaggcttcttggtgaaca

SEQ ID NO: 9316382 - DNA, 22 bp, Homo sapiens
ccatggagcacctcacagaggc

SEQ ID NO: 9316383 - DNA, 22 bp, Homo sapiens
ccatggagcacctcacagaggc

SEQ ID NO: 9316384 - DNA, 19 bp, Homo sapiens
ccatggagagagatgcatt

SEQ ID NO: 9316385 - DNA, 22 bp, Homo sapiens
ccaggtccctggaatttatgag

SEQ ID NO: 9316386 - DNA, 22 bp, Homo sapiens
ccaggtcctgttttcaccacag

SEQ ID NO: 9316387 - DNA, 22 bp, Homo sapiens
tgagaggtgaggcatgaggcat

SEQ ID NO: 9316388 - DNA, 22 bp, Homo sapiens
ccagtggccatgcacgagcagc

SEQ ID NO: 9316389 - DNA, 22 bp, Homo sapiens
tgaggacatgagtgggacagag

SEQ ID NO: 9316390 - DNA, 22 bp, Homo sapiens
tgagctgggctgggctgagctg

SEQ ID NO: 9316391 - DNA, 22 bp, Homo sapiens
tgaggaatgtgacaaaaccaag

SEQ ID NO: 9316392 - DNA, 22 bp, Homo sapiens
tgacagaggctgagttagtctg

SEQ ID NO: 9316393 - DNA, 22 bp, Homo sapiens
ccagggcatgtaactaatggtg

SEQ ID NO: 9316394 - DNA, 22 bp, Homo sapiens
ccagggcatgggaagaactgaa

SEQ ID NO: 9316395 - DNA, 22 bp, Homo sapiens
tgacagagtccagaagtagtgt

SEQ ID NO: 9316396 - DNA, 22 bp, Homo sapiens
tgacagagtccagaagtagtgt

SEQ ID NO: 9316397 - DNA, 22 bp, Homo sapiens
tgacagaggcacccacaactat

SEQ ID NO: 9316398 - DNA, 22 bp, Homo sapiens
tgacagagctgggatttgaagc

SEQ ID NO: 9316399 - DNA, 22 bp, Homo sapiens
tgacagagcatgtagtgacagc

SEQ ID NO: 9316400 - DNA, 22 bp, Homo sapiens
tgacagagagcttttgactgtc

SEQ ID NO: 9316401 - DNA, 22 bp, Homo sapiens
tgacagagacagattgaagctt

SEQ ID NO: 9316402 - DNA, 19 bp, Homo sapiens
tgacagagagcagggtggt

SEQ ID NO: 9316403 - DNA, 23 bp, Homo sapiens
tgacagagcaagacttggtctca

SEQ ID NO: 9316404 - DNA, 22 bp, Homo sapiens
tgacagagaggtaagttatgaa

SEQ ID NO: 9316405 - DNA, 22 bp, Homo sapiens
tgacaattgcagacacagaagt

SEQ ID NO: 9316406 - DNA, 22 bp, Homo sapiens
tgacagagacagattgaagctt

SEQ ID NO: 9316407 - DNA, 21 bp, Homo sapiens
ccagggaagaaatgagggcag

SEQ ID NO: 9316408 - DNA, 22 bp, Homo sapiens
ccagggaaaggaggttgacttg

SEQ ID NO: 9316409 - DNA, 22 bp, Homo sapiens
ccaggctttctcctgactcaca

SEQ ID NO: 9316410 - DNA, 22 bp, Homo sapiens
ccaggctttcccagcctctcca

SEQ ID NO: 9316411 - DNA, 22 bp, Homo sapiens
ccaggcttttagctgcatggca

SEQ ID NO: 9316412 - DNA, 22 bp, Homo sapiens
tgacatttttgtacaaagtcag

SEQ ID NO: 9316413 - DNA, 22 bp, Homo sapiens
tgacatttttataagagtcaaa

SEQ ID NO: 9316414 - DNA, 22 bp, Homo sapiens
tgactttaataggattttgcat

SEQ ID NO: 9316415 - DNA, 22 bp, Homo sapiens
tgactttaataggattttgcat

SEQ ID NO: 9316416 - DNA, 22 bp, Homo sapiens
tgactttacagatatgtttcct

SEQ ID NO: 9316417 - DNA, 22 bp, Homo sapiens
tgactttacagatatgtttcct

SEQ ID NO: 9316418 - DNA, 17 bp, Homo sapiens
tgactttatttgcttgg

SEQ ID NO: 9316419 - DNA, 17 bp, Homo sapiens
tgactttatttgcttgg

SEQ ID NO: 9316420 - DNA, 22 bp, Homo sapiens
tgactttaagctatctgattct

SEQ ID NO: 9316421 - DNA, 22 bp, Homo sapiens
tgactttaagctatctgattct

SEQ ID NO: 9316422 - DNA, 21 bp, Homo sapiens
tcttgtgtgggaaacaatttg

SEQ ID NO: 9316423 - DNA, 22 bp, Homo sapiens
tcttgttacagtttattacatg

SEQ ID NO: 9316424 - DNA, 23 bp, Homo sapiens
tcttgtttcctttgcgctatcca

SEQ ID NO: 9316425 - DNA, 23 bp, Homo sapiens
tcttgtttcctttgcgctatcca

SEQ ID NO: 9316426 - DNA, 22 bp, Homo sapiens
tcttgtgtggtggaagatatgg

SEQ ID NO: 9316427 - DNA, 22 bp, Homo sapiens
tcttgttttgaactcatcagga

SEQ ID NO: 9316428 - DNA, 22 bp, Homo sapiens
tcttgtttggattttgggcagt

SEQ ID NO: 9316429 - DNA, 22 bp, Homo sapiens
tcttgtttctgtatataatgac

SEQ ID NO: 9316430 - DNA, 22 bp, Homo sapiens
tcttgtttcttctaagcagcag

SEQ ID NO: 9316431 - DNA, 22 bp, Homo sapiens
tcttgtaattaactagaaagat

SEQ ID NO: 9316432 - DNA, 22 bp, Homo sapiens
tcttgtatttgattccttccaa

SEQ ID NO: 9316433 - DNA, 22 bp, Homo sapiens
tcttgtatgtgtattttgctgt

SEQ ID NO: 9316434 - DNA, 20 bp, Homo sapiens
tctgcagataagggaaagac

SEQ ID NO: 9316435 - DNA, 22 bp, Homo sapiens
tctgcagagcattatagcaaaa

SEQ ID NO: 9316436 - DNA, 22 bp, Homo sapiens
tctgcagagcctcaggagaaca

SEQ ID NO: 9316437 - DNA, 22 bp, Homo sapiens
tctgcagacaggaagctgaggc

SEQ ID NO: 9316438 - DNA, 22 bp, Homo sapiens
tctgcagacaggaagctgaggc

SEQ ID NO: 9316439 - DNA, 22 bp, Homo sapiens
tctttattttatgcttgtgcaa

SEQ ID NO: 9316440 - DNA, 19 bp, Homo sapiens
ccaggcctggcgtctccgc

SEQ ID NO: 9316441 - DNA, 22 bp, Homo sapiens
tctttatttctgaatcccccat

SEQ ID NO: 9316442 - DNA, 22 bp, Homo sapiens
tctttatttaagtctgttgtaa

SEQ ID NO: 9316443 - DNA, 22 bp, Homo sapiens
tctttaagagttcatttgcatg

SEQ ID NO: 9316444 - DNA, 22 bp, Homo sapiens
ccaggctcagggcagactttca

SEQ ID NO: 9316445 - DNA, 22 bp, Homo sapiens
ccaggctcaggtgcgagagaca

SEQ ID NO: 9316446 - DNA, 17 bp, Homo sapiens
ccaggctccatcactgt

SEQ ID NO: 9316447 - DNA, 22 bp, Homo sapiens
ccaggctcaggcctgctcgttg

SEQ ID NO: 9316448 - DNA, 22 bp, Homo sapiens
ccaggctcagcgcgcacgtctg

SEQ ID NO: 9316449 - DNA, 22 bp, Homo sapiens
ccaggctcagctattaagaaac

SEQ ID NO: 9316450 - DNA, 22 bp, Homo sapiens
ccaggctcacagcatcccagga

SEQ ID NO: 9316451 - DNA, 17 bp, Homo sapiens
ccaggctataccaggct

SEQ ID NO: 9316452 - DNA, 22 bp, Homo sapiens
ccaggctcactgactaccacat

SEQ ID NO: 9316453 - DNA, 22 bp, Homo sapiens
ccaggctcactgactaccacat

SEQ ID NO: 9316454 - DNA, 22 bp, Homo sapiens
ccaggctcacctggagcccctg

SEQ ID NO: 9316455 - DNA, 22 bp, Homo sapiens
ccaggctcacagcatcccagga

SEQ ID NO: 9316456 - DNA, 22 bp, Homo sapiens
tgaaagcaggcgggctacttta

SEQ ID NO: 9316457 - DNA, 22 bp, Homo sapiens
tgaaagcagtgccatgattatg

SEQ ID NO: 9316458 - DNA, 22 bp, Homo sapiens
ccaggctcctcatgatcttgtt

SEQ ID NO: 9316459 - DNA, 22 bp, Homo sapiens
ccaggctccgcatagaccccac

SEQ ID NO: 9316460 - DNA, 22 bp, Homo sapiens
ccaggctccccaggaggccctt

SEQ ID NO: 9316461 - DNA, 22 bp, Homo sapiens
ccaggctccccaggaggccctt

SEQ ID NO: 9316462 - DNA, 17 bp, Homo sapiens
ccaggctccatcactgt

SEQ ID NO: 9316463 - DNA, 22 bp, Homo sapiens
ccaggctgctcacaagctgccc

SEQ ID NO: 9316464 - DNA, 22 bp, Homo sapiens
tgaacacataaaagcaaagggt

SEQ ID NO: 9316465 - DNA, 22 bp, Homo sapiens
tgaacacatattaggtgctcat

SEQ ID NO: 9316466 - DNA, 22 bp, Homo sapiens
tgaacacagcatattttgttac

SEQ ID NO: 9316467 - DNA, 22 bp, Homo sapiens
ccaggctgcagtcaaggggcat

SEQ ID NO: 9316468 - DNA, 22 bp, Homo sapiens
ccaggctgagcatgattggagc

SEQ ID NO: 9316469 - DNA, 22 bp, Homo sapiens
tgaagctttaggatgggttcat

SEQ ID NO: 9316470 - DNA, 17 bp, Homo sapiens
tgaagatgcatggcagc

SEQ ID NO: 9316471 - DNA, 22 bp, Homo sapiens
tgaaggaatgagtatactgttt

SEQ ID NO: 9316472 - DNA, 22 bp, Homo sapiens
tgaacagctatcttgtcagtgt

SEQ ID NO: 9316473 - DNA, 22 bp, Homo sapiens
ctctctggcccatcctgttgcc

SEQ ID NO: 9316474 - DNA, 19 bp, Homo sapiens
ctctctggcggtgtctgcg

SEQ ID NO: 9316475 - DNA, 22 bp, Homo sapiens
ctctctggtttcagcgaagggg

SEQ ID NO: 9316476 - DNA, 22 bp, Homo sapiens
ctctctttcattggtcgccttg

SEQ ID NO: 9316477 - DNA, 18 bp, Homo sapiens
ctctctttccactctttg

SEQ ID NO: 9316478 - DNA, 22 bp, Homo sapiens
tttctacagctggtgcaacttt

SEQ ID NO: 9316479 - DNA, 22 bp, Homo sapiens
tttctacagtactgatttcata

SEQ ID NO: 9316480 - DNA, 22 bp, Homo sapiens
tttcattaaagtcaaatctggt

SEQ ID NO: 9316481 - DNA, 20 bp, Homo sapiens
tttattcagcctaccctctt

SEQ ID NO: 9316482 - DNA, 22 bp, Homo sapiens
tttattccaaagcttgcacttt

SEQ ID NO: 9316483 - DNA, 22 bp, Homo sapiens
tttattccaaagcttgcacttt

SEQ ID NO: 9316484 - DNA, 22 bp, Homo sapiens
ctccttcatgtcatgtgtccgg

SEQ ID NO: 9316485 - DNA, 22 bp, Homo sapiens
ctcctgttgcactagttcctga

SEQ ID NO: 9316486 - DNA, 22 bp, Homo sapiens
ctccttcaaaagtcatagtaaa

SEQ ID NO: 9316487 - DNA, 22 bp, Homo sapiens
ctccaggccaagattaagtaat

SEQ ID NO: 9316488 - DNA, 22 bp, Homo sapiens
ctccaggccagggaagtggaca

SEQ ID NO: 9316489 - DNA, 22 bp, Homo sapiens
ctccaggccatggctgcggagg

SEQ ID NO: 9316490 - DNA, 22 bp, Homo sapiens
ctccaggccatggctgcggagg

SEQ ID NO: 9316491 - DNA, 22 bp, Homo sapiens
ctccaggcccacggccgcggcc

SEQ ID NO: 9316492 - DNA, 22 bp, Homo sapiens
tttatgattaatccaattctgt

SEQ ID NO: 9316493 - DNA, 22 bp, Homo sapiens
ctccaggcccacgtcgaggagg

SEQ ID NO: 9316494 - DNA, 22 bp, Homo sapiens
ctccaggcccacgtcgaggagg

SEQ ID NO: 9316495 - DNA, 22 bp, Homo sapiens
ctccaggagctgtgtctttctt

SEQ ID NO: 9316496 - DNA, 22 bp, Homo sapiens
ctccaggagggggatggctgta

SEQ ID NO: 9316497 - DNA, 19 bp, Homo sapiens
ctccaggatggctgggcga

SEQ ID NO: 9316498 - DNA, 16 bp, Homo sapiens
ctccaggcaagaatgg

SEQ ID NO: 9316499 - DNA, 22 bp, Homo sapiens
ctccaggagtggcctggacacc

SEQ ID NO: 9316500 - DNA, 22 bp, Homo sapiens
tttattcactggggtctgcccg

SEQ ID NO: 9316501 - DNA, 19 bp, Homo sapiens
tttattcacctttaccttg

SEQ ID NO: 9316502 - DNA, 22 bp, Homo sapiens
tttatgtaagtggaatgatgcc

SEQ ID NO: 9316503 - DNA, 22 bp, Homo sapiens
tttatgattattttaaagcagc

SEQ ID NO: 9316504 - DNA, 22 bp, Homo sapiens
tttatgcagatttgtacagtga

SEQ ID NO: 9316505 - DNA, 22 bp, Homo sapiens
tttatgcagcactttacatttg

SEQ ID NO: 9316506 - DNA, 22 bp, Homo sapiens
tttatgctgaggcccaggaata

SEQ ID NO: 9316507 - DNA, 22 bp, Homo sapiens
tttatgctcatccaaggaaggt

SEQ ID NO: 9316508 - DNA, 23 bp, Homo sapiens
tttatgctgtgattcacccagcc

SEQ ID NO: 9316509 - DNA, 22 bp, Homo sapiens
tttatgctgtactcttgggaag

SEQ ID NO: 9316510 - DNA, 23 bp, Homo sapiens
tttatgctgtgattcacccagcc

SEQ ID NO: 9316511 - DNA, 23 bp, Homo sapiens
tttatgctatactggaagggaaa

SEQ ID NO: 9316512 - DNA, 22 bp, Homo sapiens
tttatgctactcaatagtcagt

SEQ ID NO: 9316513 - DNA, 22 bp, Homo sapiens
tttatgctatactgctgacatg

SEQ ID NO: 9316514 - DNA, 22 bp, Homo sapiens
ttttgcttaatctagattttgc

SEQ ID NO: 9316515 - DNA, 22 bp, Homo sapiens
ttttgcctaagaatctctctga

SEQ ID NO: 9316516 - DNA, 22 bp, Homo sapiens
ctctgtgttcagcctagcagaa

SEQ ID NO: 9316517 - DNA, 20 bp, Homo sapiens
ctctgggctgcaccctcgcc

SEQ ID NO: 9316518 - DNA, 22 bp, Homo sapiens
ctctggctccatttccctatgt

SEQ ID NO: 9316519 - DNA, 22 bp, Homo sapiens
ctctggcctgcttcctcaggta

SEQ ID NO: 9316520 - DNA, 17 bp, Homo sapiens
ctctgggtgcctgtgtg

SEQ ID NO: 9316521 - DNA, 20 bp, Homo sapiens
ctctgggtcgagacagactt

SEQ ID NO: 9316522 - DNA, 17 bp, Homo sapiens
ctctgggtctcctgctt

SEQ ID NO: 9316523 - DNA, 19 bp, Homo sapiens
ctctggcctctggatgctg

SEQ ID NO: 9316524 - DNA, 22 bp, Homo sapiens
ctctggccgcagctcagctctg

SEQ ID NO: 9316525 - DNA, 22 bp, Homo sapiens
ctctggccccagtggccccttg

SEQ ID NO: 9316526 - DNA, 22 bp, Homo sapiens
ctctggccagagcctgcgggaa

SEQ ID NO: 9316527 - DNA, 22 bp, Homo sapiens
ctctggcctggggcctgctccc

SEQ ID NO: 9316528 - DNA, 22 bp, Homo sapiens
tttgcaaagaaattattgctgt

SEQ ID NO: 9316529 - DNA, 22 bp, Homo sapiens
tttgcaaagtgactattatatg

SEQ ID NO: 9316530 - DNA, 22 bp, Homo sapiens
tttgcaaaatgaggtgaagagt

SEQ ID NO: 9316531 - DNA, 22 bp, Homo sapiens
tttgcaaacacttaagaagaga

SEQ ID NO: 9316532 - DNA, 22 bp, Homo sapiens
ctctgcacccccggctcctcgt

SEQ ID NO: 9316533 - DNA, 22 bp, Homo sapiens
tttgaaaattagacacaggcta

SEQ ID NO: 9316534 - DNA, 22 bp, Homo sapiens
ctctgaatggacactccagtgt

SEQ ID NO: 9316535 - DNA, 22 bp, Homo sapiens
ctgcagcctaggtgcagctggg

SEQ ID NO: 9316536 - DNA, 22 bp, Homo sapiens
ctgcaggacagggaggagcaag

SEQ ID NO: 9316537 - DNA, 22 bp, Homo sapiens
ctgaggtgtggtctgggagtat

SEQ ID NO: 9316538 - DNA, 22 bp, Homo sapiens
ctgaggtgtttagtaggggcgg

SEQ ID NO: 9316539 - DNA, 22 bp, Homo sapiens
ctgaggtgtgaaatggtggcaa

SEQ ID NO: 9316540 - DNA, 22 bp, Homo sapiens
ctgaggtggggcctgggcatca

SEQ ID NO: 9316541 - DNA, 22 bp, Homo sapiens
ctgaggtggcctctgccgggga

SEQ ID NO: 9316542 - DNA, 22 bp, Homo sapiens
ctgaggtggaacagaggtgaag

SEQ ID NO: 9316543 - DNA, 22 bp, Homo sapiens
ctgaggtgagaggaggccatgt

SEQ ID NO: 9316544 - DNA, 19 bp, Homo sapiens
ctgaggtgaggggcatcat

SEQ ID NO: 9316545 - DNA, 22 bp, Homo sapiens
ctgaggtgctatggaggatacg

SEQ ID NO: 9316546 - DNA, 22 bp, Homo sapiens
ctgcaggaggatcctgagagtg

SEQ ID NO: 9316547 - DNA, 22 bp, Homo sapiens
ctgcaggatttcatgggctgac

SEQ ID NO: 9316548 - DNA, 22 bp, Homo sapiens
ctgcccaaatccttcttcctct

SEQ ID NO: 9316549 - DNA, 22 bp, Homo sapiens
ctgccccatggtccctggtggg

SEQ ID NO: 9316550 - DNA, 22 bp, Homo sapiens
ctgcccctgccaggcagctgtc

SEQ ID NO: 9316551 - DNA, 22 bp, Homo sapiens
ctgccccagcctggggccttct

SEQ ID NO: 9316552 - DNA, 22 bp, Homo sapiens
ctgccccaccccaacctgaggt

SEQ ID NO: 9316553 - DNA, 22 bp, Homo sapiens
ctgcccaggggagtgctgtcgg

SEQ ID NO: 9316554 - DNA, 22 bp, Homo sapiens
ctgagcagtgctttgcagtggg

SEQ ID NO: 9316555 - DNA, 22 bp, Homo sapiens
ctgagcagtctgactcaagcta

SEQ ID NO: 9316556 - DNA, 22 bp, Homo sapiens
ctgagcaggacagtgggagacc

SEQ ID NO: 9316557 - DNA, 22 bp, Homo sapiens
ctgagcagctccctgagtggtc

SEQ ID NO: 9316558 - DNA, 22 bp, Homo sapiens
ttttgcttatctgagtgcagcc

SEQ ID NO: 9316559 - DNA, 22 bp, Homo sapiens
ttttgcttttgtaacacagtgt

SEQ ID NO: 9316560 - DNA, 22 bp, Homo sapiens
ctcttcccagctccacgagagg

SEQ ID NO: 9316561 - DNA, 22 bp, Homo sapiens
ctcttcctacagtctgctatgc

SEQ ID NO: 9316562 - DNA, 22 bp, Homo sapiens
ctgaggctgagacaggtgaaat

SEQ ID NO: 9316563 - DNA, 22 bp, Homo sapiens
ctgaggctgcccagggccaggt

SEQ ID NO: 9316564 - DNA, 22 bp, Homo sapiens
ctgaggctccctcgggtctgct

SEQ ID NO: 9316565 - DNA, 22 bp, Homo sapiens
ctgaggctcagcgtgaggaaag

SEQ ID NO: 9316566 - DNA, 22 bp, Homo sapiens
ctgaggctctgggtgtcactgt

SEQ ID NO: 9316567 - DNA, 22 bp, Homo sapiens
ctgaggctctgagaaagccaaa

SEQ ID NO: 9316568 - DNA, 22 bp, Homo sapiens
ctgaggctgaagagggcctacg

SEQ ID NO: 9316569 - DNA, 17 bp, Homo sapiens
ctgaggggagtgctgtg

SEQ ID NO: 9316570 - DNA, 22 bp, Homo sapiens
ctgaggggaaaagtcaggatga

SEQ ID NO: 9316571 - DNA, 17 bp, Homo sapiens
ctgaggggagtgctgtg

SEQ ID NO: 9316572 - DNA, 23 bp, Homo sapiens
ctgaggggaaaagggcttcaggc

SEQ ID NO: 9316573 - DNA, 22 bp, Homo sapiens
ctgaggggaaaagtcaggatga

SEQ ID NO: 9316574 - DNA, 22 bp, Homo sapiens
ctgaggctggagtgcagtggtg

SEQ ID NO: 9316575 - DNA, 22 bp, Homo sapiens
ctgaggctcaagggcaggtggg

SEQ ID NO: 9316576 - DNA, 22 bp, Homo sapiens
ctgaggctagtataaagagcat

SEQ ID NO: 9316577 - DNA, 22 bp, Homo sapiens
ctgaggctaacctcgagagaca

SEQ ID NO: 9316578 - DNA, 22 bp, Homo sapiens
ctgagcatttgtgcagcttctc

SEQ ID NO: 9316579 - DNA, 22 bp, Homo sapiens
ctgagcagtttcttagggctca

SEQ ID NO: 9316580 - DNA, 22 bp, Homo sapiens
ctgagcagtggttcttgagcgc

SEQ ID NO: 9316581 - DNA, 22 bp, Homo sapiens
ctgaggccgtctgggtctgcag

SEQ ID NO: 9316582 - DNA, 22 bp, Homo sapiens
ctgagccaaaaagcagagcttg

SEQ ID NO: 9316583 - DNA, 22 bp, Homo sapiens
ctggagaaacatcaggcatagg

SEQ ID NO: 9316584 - DNA, 22 bp, Homo sapiens
ctggagaacagagctgtttaga

SEQ ID NO: 9316585 - DNA, 22 bp, Homo sapiens
ctggagaaaatccatgtgtatg

SEQ ID NO: 9316586 - DNA, 22 bp, Homo sapiens
ctgctgtcgccgagctgcatgc

SEQ ID NO: 9316587 - DNA, 22 bp, Homo sapiens
ctgctgtgagcactccagcctg

SEQ ID NO: 9316588 - DNA, 22 bp, Homo sapiens
ctgctctgaccctttcaccttc

SEQ ID NO: 9316589 - DNA, 22 bp, Homo sapiens
ctgctctgaccctttcaccttc

SEQ ID NO: 9316590 - DNA, 22 bp, Homo sapiens
ctgctctgtatatgagcaggaa

SEQ ID NO: 9316591 - DNA, 22 bp, Homo sapiens
ctgctctgtgcacttgttcagg

SEQ ID NO: 9316592 - DNA, 22 bp, Homo sapiens
ctgctctgtttcttagctgggt

SEQ ID NO: 9316593 - DNA, 22 bp, Homo sapiens
ctgctctgttcccccatcatct

SEQ ID NO: 9316594 - DNA, 22 bp, Homo sapiens
ctgctctgttaattaaactttg

SEQ ID NO: 9316595 - DNA, 22 bp, Homo sapiens
ctgcctgtgtgtgcctgcagaa

SEQ ID NO: 9316596 - DNA, 22 bp, Homo sapiens
ctgcctgtggacaccctggagg

SEQ ID NO: 9316597 - DNA, 22 bp, Homo sapiens
ctgcccctgccaggcagctgtc

SEQ ID NO: 9316598 - DNA, 22 bp, Homo sapiens
ctgcctgtttcctcttgctccc

SEQ ID NO: 9316599 - DNA, 22 bp, Homo sapiens
ctgccttcatctctgagctggg

SEQ ID NO: 9316600 - DNA, 22 bp, Homo sapiens
ctgccttcatctctgagctggg

SEQ ID NO: 9316601 - DNA, 22 bp, Homo sapiens
ctgccttccaaccccagactcc

SEQ ID NO: 9316602 - DNA, 22 bp, Homo sapiens
ctgccttccaaccccagactcc

SEQ ID NO: 9316603 - DNA, 22 bp, Homo sapiens
ctgctgtcatagccatccctcc

SEQ ID NO: 9316604 - DNA, 22 bp, Homo sapiens
ctgctgtcatctggcgctgtgc

SEQ ID NO: 9316605 - DNA, 22 bp, Homo sapiens
ctgctgtcccagcctcctcaca

SEQ ID NO: 9316606 - DNA, 22 bp, Homo sapiens
ctgctgggtctatgcaagtgga

SEQ ID NO: 9316607 - DNA, 22 bp, Homo sapiens
ctgctgggtccccctgctgatt

SEQ ID NO: 9316608 - DNA, 19 bp, Homo sapiens
ctgctgggtgctgagggag

SEQ ID NO: 9316609 - DNA, 22 bp, Homo sapiens
ctgctcttcccactcactccca

SEQ ID NO: 9316610 - DNA, 22 bp, Homo sapiens
ctgctcttcccactcactccca

SEQ ID NO: 9316611 - DNA, 22 bp, Homo sapiens
ctgctgaaaacaataatgatga

SEQ ID NO: 9316612 - DNA, 22 bp, Homo sapiens
ctgctgaagttgttggtctttt

SEQ ID NO: 9316613 - DNA, 22 bp, Homo sapiens
ctgctgagagatgccaatctca

SEQ ID NO: 9316614 - DNA, 22 bp, Homo sapiens
ctgctgagagccacgtggcaca

SEQ ID NO: 9316615 - DNA, 22 bp, Homo sapiens
ctgctgagaaaagactgaggga

SEQ ID NO: 9316616 - DNA, 22 bp, Homo sapiens
ctgctgagaaatgcatccagtt

SEQ ID NO: 9316617 - DNA, 22 bp, Homo sapiens
ctgctgagagctgaaggctgta

SEQ ID NO: 9316618 - DNA, 22 bp, Homo sapiens
ctgctgggaaggtctgctcagt

SEQ ID NO: 9316619 - DNA, 22 bp, Homo sapiens
ctccagataggagggggtcccc

SEQ ID NO: 9316620 - DNA, 22 bp, Homo sapiens
ttggctctgaaacccaagctct

SEQ ID NO: 9316621 - DNA, 22 bp, Homo sapiens
ttggctctgtgtctccactcaa

SEQ ID NO: 9316622 - DNA, 22 bp, Homo sapiens
ctccagagtcatcgagcattcc

SEQ ID NO: 9316623 - DNA, 22 bp, Homo sapiens
ctccagagtcatcgagcattcc

SEQ ID NO: 9316624 - DNA, 22 bp, Homo sapiens
ctccagaggcgacttgcatcac

SEQ ID NO: 9316625 - DNA, 22 bp, Homo sapiens
ctccagaggatgcaggtgaggg

SEQ ID NO: 9316626 - DNA, 22 bp, Homo sapiens
ctccagaggaaagcacatagtg

SEQ ID NO: 9316627 - DNA, 18 bp, Homo sapiens
ctccagagctgtgagaca

SEQ ID NO: 9316628 - DNA, 18 bp, Homo sapiens
ctccagagctgtgagaca

SEQ ID NO: 9316629 - DNA, 22 bp, Homo sapiens
ctccaggactgaggacagagct

SEQ ID NO: 9316630 - DNA, 22 bp, Homo sapiens
ctccaggacagattcagggcca

SEQ ID NO: 9316631 - DNA, 23 bp, Homo sapiens
ttggaagccagacagctgtgcag

SEQ ID NO: 9316632 - DNA, 22 bp, Homo sapiens
ttggaagccagaggaccaggga

SEQ ID NO: 9316633 - DNA, 22 bp, Homo sapiens
ttggaagcgagcacatggagga

SEQ ID NO: 9316634 - DNA, 22 bp, Homo sapiens
ctccactcaccagatgccagga

SEQ ID NO: 9316635 - DNA, 22 bp, Homo sapiens
ctccactcaacaagcccagtgt

SEQ ID NO: 9316636 - DNA, 20 bp, Homo sapiens
ttggagtctaaagactgggg

SEQ ID NO: 9316637 - DNA, 22 bp, Homo sapiens
ctcaggtcacggatctgagctg

SEQ ID NO: 9316638 - DNA, 22 bp, Homo sapiens
ctcagggtgcccggatcccagg

SEQ ID NO: 9316639 - DNA, 22 bp, Homo sapiens
ctcagtcagtttttgtgagaga

SEQ ID NO: 9316640 - DNA, 22 bp, Homo sapiens
ctcagggggaatcaggtcacag

SEQ ID NO: 9316641 - DNA, 22 bp, Homo sapiens
ctcagggcttgagtgtccagga

SEQ ID NO: 9316642 - DNA, 22 bp, Homo sapiens
ctcagggaattatttctgtcct

SEQ ID NO: 9316643 - DNA, 22 bp, Homo sapiens
ctcagggcggcgggcagcccag

SEQ ID NO: 9316644 - DNA, 22 bp, Homo sapiens
ctcagggcggcgggcagcccag

SEQ ID NO: 9316645 - DNA, 22 bp, Homo sapiens
ctcagggctggaaagccaggaa

SEQ ID NO: 9316646 - DNA, 22 bp, Homo sapiens
ctcagggctggaaagccaggaa

SEQ ID NO: 9316647 - DNA, 22 bp, Homo sapiens
ctcagggctctgcatgcacacg

SEQ ID NO: 9316648 - DNA, 22 bp, Homo sapiens
ctcagccccaatttgccctctt

SEQ ID NO: 9316649 - DNA, 23 bp, Homo sapiens
ctcagaggcctgtccagggtggt

SEQ ID NO: 9316650 - DNA, 22 bp, Homo sapiens
ctcagaggcaagcaaggagctg

SEQ ID NO: 9316651 - DNA, 22 bp, Homo sapiens
ctcaggacggccgggggagcct

SEQ ID NO: 9316652 - DNA, 22 bp, Homo sapiens
ctcaggaagcacaggccctaca

SEQ ID NO: 9316653 - DNA, 22 bp, Homo sapiens
ctcaggaggccattctcaaggt

SEQ ID NO: 9316654 - DNA, 22 bp, Homo sapiens
ctcaggaggtggtagaggccct

SEQ ID NO: 9316655 - DNA, 22 bp, Homo sapiens
ctcaggaggtggtagaggccct

SEQ ID NO: 9316656 - DNA, 22 bp, Homo sapiens
ctcaggaggtttcctgtctagg

SEQ ID NO: 9316657 - DNA, 22 bp, Homo sapiens
ctcaggagcttcctcagcccat

SEQ ID NO: 9316658 - DNA, 22 bp, Homo sapiens
ctcaggaggatgactgccttgg

SEQ ID NO: 9316659 - DNA, 22 bp, Homo sapiens
ctcaggagtagttcagcagctg

SEQ ID NO: 9316660 - DNA, 22 bp, Homo sapiens
ttgcagaaaacagttttcttgt

SEQ ID NO: 9316661 - DNA, 22 bp, Homo sapiens
ttctttctgaatacagttgagt

SEQ ID NO: 9316662 - DNA, 21 bp, Homo sapiens
ctcagagaaatgtctgggagc

SEQ ID NO: 9316663 - DNA, 22 bp, Homo sapiens
ctcagagaacctaagcggagga

SEQ ID NO: 9316664 - DNA, 22 bp, Homo sapiens
ctcagagaagatggatgaggta

SEQ ID NO: 9316665 - DNA, 22 bp, Homo sapiens
ctcagagaagtctttgctaaac

SEQ ID NO: 9316666 - DNA, 22 bp, Homo sapiens
ctcagagaaatgtcacaacaat

SEQ ID NO: 9316667 - DNA, 22 bp, Homo sapiens
ctcagagaaaaggagcaagggt

SEQ ID NO: 9316668 - DNA, 22 bp, Homo sapiens
ttctttctgtccataatgagac

SEQ ID NO: 9316669 - DNA, 22 bp, Homo sapiens
ttctttctgtcatggtgtactg

SEQ ID NO: 9316670 - DNA, 22 bp, Homo sapiens
ctcagagagtgaattcctgcct

SEQ ID NO: 9316671 - DNA, 22 bp, Homo sapiens
ctcagagaggttgaacaacttg

SEQ ID NO: 9316672 - DNA, 17 bp, Homo sapiens
ctcagagagggtaagta

SEQ ID NO: 9316673 - DNA, 19 bp, Homo sapiens
ctcagagaggggcagtgcc

SEQ ID NO: 9316674 - DNA, 21 bp, Homo sapiens
ctcagagacaaatgccatccc

SEQ ID NO: 9316675 - DNA, 22 bp, Homo sapiens
ctcagagagacaatgtgggaca

SEQ ID NO: 9316676 - DNA, 22 bp, Homo sapiens
ctcagagaggcagtggaagtca

SEQ ID NO: 9316677 - DNA, 22 bp, Homo sapiens
ctcagagagggcaccagggcca

SEQ ID NO: 9316678 - DNA, 22 bp, Homo sapiens
ctcagagagttaagtgaattac

SEQ ID NO: 9316679 - DNA, 22 bp, Homo sapiens
ctcagagagttaagtgaattac

SEQ ID NO: 9316680 - DNA, 18 bp, Homo sapiens
ctcagagatgcccttatt

SEQ ID NO: 9316681 - DNA, 22 bp, Homo sapiens
ctcagagcacttttgaaagctc

SEQ ID NO: 9316682 - DNA, 22 bp, Homo sapiens
ctcagagatatagtccctgctt

SEQ ID NO: 9316683 - DNA, 22 bp, Homo sapiens
ctcagagcacagtttatgacag

SEQ ID NO: 9316684 - DNA, 22 bp, Homo sapiens
ctcagagccagttagcaggtgc

SEQ ID NO: 9316685 - DNA, 21 bp, Homo sapiens
ctcagagcagttcagagggat

SEQ ID NO: 9316686 - DNA, 17 bp, Homo sapiens
ctcagagcaggacagaa

SEQ ID NO: 9316687 - DNA, 22 bp, Homo sapiens
ctcagagctcgtgggaccttgg

SEQ ID NO: 9316688 - DNA, 22 bp, Homo sapiens
ctcagagctcagctttgttagt

SEQ ID NO: 9316689 - DNA, 22 bp, Homo sapiens
ctcagagccccaggagggtgtg

SEQ ID NO: 9316690 - DNA, 22 bp, Homo sapiens
ctcagaggaggcagggtgtgcc

SEQ ID NO: 9316691 - DNA, 22 bp, Homo sapiens
ctcagagctgaggccagggaca

SEQ ID NO: 9316692 - DNA, 22 bp, Homo sapiens
ctcacccctgtaattccagcac

SEQ ID NO: 9316693 - DNA, 22 bp, Homo sapiens
ctatagaaacaacctctctttc

SEQ ID NO: 9316694 - DNA, 22 bp, Homo sapiens
ctatagagacacaaagtagatt

SEQ ID NO: 9316695 - DNA, 22 bp, Homo sapiens
ctcacaggttctgcagctcaca

SEQ ID NO: 9316696 - DNA, 22 bp, Homo sapiens
ttctggcttcatctgacaagcc

SEQ ID NO: 9316697 - DNA, 22 bp, Homo sapiens
ttctggctttacttcccatcca

SEQ ID NO: 9316698 - DNA, 23 bp, Homo sapiens
ttctggctgtgggtggcgtctct

SEQ ID NO: 9316699 - DNA, 22 bp, Homo sapiens
ttctggctaccctcctaatgtt

SEQ ID NO: 9316700 - DNA, 23 bp, Homo sapiens
ttctggctccgagctccatcttc

SEQ ID NO: 9316701 - DNA, 22 bp, Homo sapiens
ttctggctcatatgctaagaag

SEQ ID NO: 9316702 - DNA, 22 bp, Homo sapiens
ttctgcatctgaatttaagtac

SEQ ID NO: 9316703 - DNA, 22 bp, Homo sapiens
ttctgcatcccagaagaggaca

SEQ ID NO: 9316704 - DNA, 22 bp, Homo sapiens
cgtgtgtgtacctgcgcattta

SEQ ID NO: 9316705 - DNA, 20 bp, Homo sapiens
cgtgtgtggctattttgggt

SEQ ID NO: 9316706 - DNA, 22 bp, Homo sapiens
cgtttattttgaagattccact

SEQ ID NO: 9316707 - DNA, 22 bp, Homo sapiens
cgttagtaggatagtacaagtg

SEQ ID NO: 9316708 - DNA, 22 bp, Homo sapiens
cgttagtatacactgcaggcaa

SEQ ID NO: 9316709 - DNA, 23 bp, Homo sapiens
cgttagtatgtaagtcagttgga

SEQ ID NO: 9316710 - DNA, 22 bp, Homo sapiens
cgttctctcatgatcttcccga

SEQ ID NO: 9316711 - DNA, 20 bp, Homo sapiens
cgctccagtcgctggtgtgt

SEQ ID NO: 9316712 - DNA, 22 bp, Homo sapiens
cgccgtcccctaggaaagagct

SEQ ID NO: 9316713 - DNA, 22 bp, Homo sapiens
cgccggcttgaggcaggcggca

SEQ ID NO: 9316714 - DNA, 22 bp, Homo sapiens
cgctgccaggatcccctgccgg

SEQ ID NO: 9316715 - DNA, 22 bp, Homo sapiens
ttatttattgtgtacctactgt

SEQ ID NO: 9316716 - DNA, 22 bp, Homo sapiens
ttatttattgtgtacctactgt

SEQ ID NO: 9316717 - DNA, 22 bp, Homo sapiens
ttatttattcattctgtctgtc

SEQ ID NO: 9316718 - DNA, 22 bp, Homo sapiens
ttatttattcattctgtctgtc

SEQ ID NO: 9316719 - DNA, 22 bp, Homo sapiens
ttatttattcattctgtctgtc

SEQ ID NO: 9316720 - DNA, 22 bp, Homo sapiens
ttatttattcattctgtctgtc

SEQ ID NO: 9316721 - DNA, 22 bp, Homo sapiens
ttatttattgtgtacctactgt

SEQ ID NO: 9316722 - DNA, 22 bp, Homo sapiens
ttatttatgttaacagtcgaga

SEQ ID NO: 9316723 - DNA, 22 bp, Homo sapiens
ttatttatgttaacagtcgaga

SEQ ID NO: 9316724 - DNA, 22 bp, Homo sapiens
ttatttatgttaacagtcgaga

SEQ ID NO: 9316725 - DNA, 22 bp, Homo sapiens
ttatttatgttaacagtcgaga

SEQ ID NO: 9316726 - DNA, 22 bp, Homo sapiens
ttattcagattggctacaggat

SEQ ID NO: 9316727 - DNA, 22 bp, Homo sapiens
ttattcagcagggacttccttt

SEQ ID NO: 9316728 - DNA, 19 bp, Homo sapiens
ccttttttaacttcagcaa

SEQ ID NO: 9316729 - DNA, 22 bp, Homo sapiens
cgagagatgggttggcaggggc

SEQ ID NO: 9316730 - DNA, 22 bp, Homo sapiens
ttatccaagcagaagctgcaca

SEQ ID NO: 9316731 - DNA, 22 bp, Homo sapiens
ccttttgctctcccatccagaa

SEQ ID NO: 9316732 - DNA, 22 bp, Homo sapiens
cggcagagccctgagtcagcct

SEQ ID NO: 9316733 - DNA, 22 bp, Homo sapiens
cggcagagacggcgctttgaac

SEQ ID NO: 9316734 - DNA, 22 bp, Homo sapiens
cggcagagcggcgagcccctcc

SEQ ID NO: 9316735 - DNA, 22 bp, Homo sapiens
cggcagagcttcctgctcagcg

SEQ ID NO: 9316736 - DNA, 18 bp, Homo sapiens
cggcagagtgcttctagc

SEQ ID NO: 9316737 - DNA, 22 bp, Homo sapiens
cggcagagtgtgtgcgtgcatg

SEQ ID NO: 9316738 - DNA, 22 bp, Homo sapiens
cggcagggctccatgcatttct

SEQ ID NO: 9316739 - DNA, 22 bp, Homo sapiens
cggcagggttggttttctctga

SEQ ID NO: 9316740 - DNA, 22 bp, Homo sapiens
cggcagctccgcgccgtaggac

SEQ ID NO: 9316741 - DNA, 22 bp, Homo sapiens
cggagtcttgctatgttgccca

SEQ ID NO: 9316742 - DNA, 22 bp, Homo sapiens
ttcaaattaccacatttgctta

SEQ ID NO: 9316743 - DNA, 21 bp, Homo sapiens
ttcaaagtttgcctaaagatt

SEQ ID NO: 9316744 - DNA, 22 bp, Homo sapiens
cggcagctgattgcagagcacc

SEQ ID NO: 9316745 - DNA, 22 bp, Homo sapiens
cgggcaaggcgagactaggccc

SEQ ID NO: 9316746 - DNA, 22 bp, Homo sapiens
cgggcttcctccagggaagtgc

SEQ ID NO: 9316747 - DNA, 22 bp, Homo sapiens
cggggaagcggttctggcggta

SEQ ID NO: 9316748 - DNA, 22 bp, Homo sapiens
cggggctgcgctcttcctgccg

SEQ ID NO: 9316749 - DNA, 22 bp, Homo sapiens
cggggccctggggctgaaggtc

SEQ ID NO: 9316750 - DNA, 22 bp, Homo sapiens
cgtggggacccacgtgcagcac

SEQ ID NO: 9316751 - DNA, 22 bp, Homo sapiens
cgtgggagtggtgggtgctcag

SEQ ID NO: 9316752 - DNA, 22 bp, Homo sapiens
cgtgggagtggtgggtgctcag

SEQ ID NO: 9316753 - DNA, 22 bp, Homo sapiens
cgtgggaggaaaaatgggcttc

SEQ ID NO: 9316754 - DNA, 21 bp, Homo sapiens
cgtgactgggtccgtctggct

SEQ ID NO: 9316755 - DNA, 22 bp, Homo sapiens
ttaaattattgagggattgtca

SEQ ID NO: 9316756 - DNA, 22 bp, Homo sapiens
ttaaattttagaaacagactct

SEQ ID NO: 9316757 - DNA, 22 bp, Homo sapiens
ttacaaagcgctttacctctga

SEQ ID NO: 9316758 - DNA, 22 bp, Homo sapiens
ttacaaagcaggtcagctgaaa

SEQ ID NO: 9316759 - DNA, 21 bp, Homo sapiens
ttacaaagcaagtgctgtgtc

SEQ ID NO: 9316760 - DNA, 22 bp, Homo sapiens
ttacaaagattatattcagtta

SEQ ID NO: 9316761 - DNA, 22 bp, Homo sapiens
ttacagttaggtgtgtagtggt

SEQ ID NO: 9316762 - DNA, 22 bp, Homo sapiens
cctgtgtgtctgtcactgcaca

SEQ ID NO: 9316763 - DNA, 22 bp, Homo sapiens
ccttagcagggccgggcctggg

SEQ ID NO: 9316764 - DNA, 22 bp, Homo sapiens
ccttagcagggagtctgtccag

SEQ ID NO: 9316765 - DNA, 22 bp, Homo sapiens
ccttagcaacacttagcaactg

SEQ ID NO: 9316766 - DNA, 22 bp, Homo sapiens
ccttagcaactgtcatagagca

SEQ ID NO: 9316767 - DNA, 22 bp, Homo sapiens
ccttagcaaattggcatcttct

SEQ ID NO: 9316768 - DNA, 22 bp, Homo sapiens
ccttacctgattgctggcatcc

SEQ ID NO: 9316769 - DNA, 22 bp, Homo sapiens
ccttagaaatgtaccaaaggaa

SEQ ID NO: 9316770 - DNA, 22 bp, Homo sapiens
ttacaaagagtgccagagtgtg

SEQ ID NO: 9316771 - DNA, 22 bp, Homo sapiens
ccttagcatggctgtgctgtgt

SEQ ID NO: 9316772 - DNA, 22 bp, Homo sapiens
ccttagcattagaagctgtggg

SEQ ID NO: 9316773 - DNA, 22 bp, Homo sapiens
ttagttttctcatctatctcac

SEQ ID NO: 9316774 - DNA, 22 bp, Homo sapiens
ttagttttcccatctttatggt

SEQ ID NO: 9316775 - DNA, 22 bp, Homo sapiens
ttataaagattgttatgtatct

SEQ ID NO: 9316776 - DNA, 22 bp, Homo sapiens
ttataaagattgttatgtatct

SEQ ID NO: 9316777 - DNA, 22 bp, Homo sapiens
ttataaagatccttccagagtt

SEQ ID NO: 9316778 - DNA, 22 bp, Homo sapiens
ttataaagatccttccagagtt

SEQ ID NO: 9316779 - DNA, 22 bp, Homo sapiens
ttagtttataattcatttctgt

SEQ ID NO: 9316780 - DNA, 22 bp, Homo sapiens
ttatatttctggtagccttcag

SEQ ID NO: 9316781 - DNA, 22 bp, Homo sapiens
ttataacaacagtttactttaa

SEQ ID NO: 9316782 - DNA, 22 bp, Homo sapiens
ttataaagtgagaagtgctatg

SEQ ID NO: 9316783 - DNA, 22 bp, Homo sapiens
ttataaagtgagaagtgctatg

SEQ ID NO: 9316784 - DNA, 22 bp, Homo sapiens
ttataaaggtttgtgcatattt

SEQ ID NO: 9316785 - DNA, 22 bp, Homo sapiens
ttataaaggtttgtgcatattt

SEQ ID NO: 9316786 - DNA, 21 bp, Homo sapiens
ttagcaaagcaaacacatgct

SEQ ID NO: 9316787 - DNA, 22 bp, Homo sapiens
ttagcaaactctgttagattct

SEQ ID NO: 9316788 - DNA, 22 bp, Homo sapiens
ttagcacaggcaactccacata

SEQ ID NO: 9316789 - DNA, 23 bp, Homo sapiens
ttagcacatgcccagagggatga

SEQ ID NO: 9316790 - DNA, 22 bp, Homo sapiens
ttagcacaattatttcagttgt

SEQ ID NO: 9316791 - DNA, 22 bp, Homo sapiens
ttagcacaggagtctctgttat

SEQ ID NO: 9316792 - DNA, 22 bp, Homo sapiens
ttagcaccacacactttagagg

SEQ ID NO: 9316793 - DNA, 22 bp, Homo sapiens
ttagcaccctgatactagaatg

SEQ ID NO: 9316794 - DNA, 22 bp, Homo sapiens
ttagcaccagctatggatgtgc

SEQ ID NO: 9316795 - DNA, 22 bp, Homo sapiens
ttagcacccgggccagcggctg

SEQ ID NO: 9316796 - DNA, 18 bp, Homo sapiens
ttagcacctatgtgggta

SEQ ID NO: 9316797 - DNA, 22 bp, Homo sapiens
ttagcacctcattcccaccttc

SEQ ID NO: 9316798 - DNA, 22 bp, Homo sapiens
ttagcaccttaactgtggagat

SEQ ID NO: 9316799 - DNA, 22 bp, Homo sapiens
ttagcaccttgaacagaccctg

SEQ ID NO: 9316800 - DNA, 22 bp, Homo sapiens
ttagcaaatatcttgaaacagg

SEQ ID NO: 9316801 - DNA, 22 bp, Homo sapiens
ttacataacggtatgaaaaatg

SEQ ID NO: 9316802 - DNA, 22 bp, Homo sapiens
ttacataaaagttcacgtaggc

SEQ ID NO: 9316803 - DNA, 22 bp, Homo sapiens
ttacagtttctagtaatacttg

SEQ ID NO: 9316804 - DNA, 22 bp, Homo sapiens
ttacatacttactagatctatg

SEQ ID NO: 9316805 - DNA, 22 bp, Homo sapiens
ccttcaaaacactagtttttga

SEQ ID NO: 9316806 - DNA, 22 bp, Homo sapiens
ccttcaaactttcattaaccag

SEQ ID NO: 9316807 - DNA, 22 bp, Homo sapiens
ccttcaaagagtatttcctgag

SEQ ID NO: 9316808 - DNA, 22 bp, Homo sapiens
ccttcaaagtacacatctttat

SEQ ID NO: 9316809 - DNA, 22 bp, Homo sapiens
ccttcagcctagaacttgagag

SEQ ID NO: 9316810 - DNA, 22 bp, Homo sapiens
ccttcaaggcaaggagggctgg

SEQ ID NO: 9316811 - DNA, 22 bp, Homo sapiens
ccttcaagttcctggtccctgg

SEQ ID NO: 9316812 - DNA, 22 bp, Homo sapiens
ccttcaaatttagaacaagtga

SEQ ID NO: 9316813 - DNA, 22 bp, Homo sapiens
ccttcaaattctcttagctgaa

SEQ ID NO: 9316814 - DNA, 22 bp, Homo sapiens
gaaagacatagttgcaagatgg

SEQ ID NO: 9316815 - DNA, 22 bp, Homo sapiens
gaaatattcttgtcttgttttc

SEQ ID NO: 9316816 - DNA, 22 bp, Homo sapiens
gaaatattcttgtcttgttttc

SEQ ID NO: 9316817 - DNA, 22 bp, Homo sapiens
gaaatgtctctggatttgcttt

SEQ ID NO: 9316818 - DNA, 22 bp, Homo sapiens
gaacttggacctggtcctttgg

SEQ ID NO: 9316819 - DNA, 22 bp, Homo sapiens
gaactttaaaacaaagtacagt

SEQ ID NO: 9316820 - DNA, 19 bp, Homo sapiens
gaacttggccaggcacagt

SEQ ID NO: 9316821 - DNA, 22 bp, Homo sapiens
gaacttggcctgtctgtctggc

SEQ ID NO: 9316822 - DNA, 22 bp, Homo sapiens
gaacttgggagaagggagtgtg

SEQ ID NO: 9316823 - DNA, 22 bp, Homo sapiens
gaacttggtattccttttaaca

SEQ ID NO: 9316824 - DNA, 22 bp, Homo sapiens
gaagaaattgaattcatgagct

SEQ ID NO: 9316825 - DNA, 22 bp, Homo sapiens
gaaattgccagatctagtagat

SEQ ID NO: 9316826 - DNA, 22 bp, Homo sapiens
gaaattattgctagagactgca

SEQ ID NO: 9316827 - DNA, 22 bp, Homo sapiens
gaaatgttgtctctgcagcaat

SEQ ID NO: 9316828 - DNA, 22 bp, Homo sapiens
cttttgttaggagaaaacatca

SEQ ID NO: 9316829 - DNA, 22 bp, Homo sapiens
cttttgttaggagaaaacatca

SEQ ID NO: 9316830 - DNA, 22 bp, Homo sapiens
cttttgttctacagctggggaa

SEQ ID NO: 9316831 - DNA, 22 bp, Homo sapiens
ctttggatttttatcaggcaat

SEQ ID NO: 9316832 - DNA, 22 bp, Homo sapiens
ctttggaatattttattgagaa

SEQ ID NO: 9316833 - DNA, 22 bp, Homo sapiens
gaaacttttaaacctcatgagt

SEQ ID NO: 9316834 - DNA, 22 bp, Homo sapiens
gaaacctatttataacttctag

SEQ ID NO: 9316835 - DNA, 22 bp, Homo sapiens
gaaacgttaaaccatatgtaat

SEQ ID NO: 9316836 - DNA, 22 bp, Homo sapiens
ctttttgtgtatgctacagttg

SEQ ID NO: 9316837 - DNA, 22 bp, Homo sapiens
gaaaaatgctccaaatctgtgg

SEQ ID NO: 9316838 - DNA, 22 bp, Homo sapiens
gaaaaatgctccaaatctgtgg

SEQ ID NO: 9316839 - DNA, 22 bp, Homo sapiens
gaaaaatgagctgatgtcaggg

SEQ ID NO: 9316840 - DNA, 22 bp, Homo sapiens
cttcttcagaggccagcctctg

SEQ ID NO: 9316841 - DNA, 19 bp, Homo sapiens
cttcccctgttacctcact

SEQ ID NO: 9316842 - DNA, 22 bp, Homo sapiens
cttcccccaaatcaagagacct

SEQ ID NO: 9316843 - DNA, 19 bp, Homo sapiens
cttcccctgttacctcact

SEQ ID NO: 9316844 - DNA, 22 bp, Homo sapiens
cttcccaggtgctcttagcatg

SEQ ID NO: 9316845 - DNA, 22 bp, Homo sapiens
cttcccagcacctcagtctggc

SEQ ID NO: 9316846 - DNA, 22 bp, Homo sapiens
cttccaggtccttcttgagaag

SEQ ID NO: 9316847 - DNA, 22 bp, Homo sapiens
cttcaaagggtcactatttatc

SEQ ID NO: 9316848 - DNA, 22 bp, Homo sapiens
cttcacagcatgagctttggag

SEQ ID NO: 9316849 - DNA, 22 bp, Homo sapiens
cttcacaggcaagtctgttttt

SEQ ID NO: 9316850 - DNA, 22 bp, Homo sapiens
cttccaggtaggcctaaggcag

SEQ ID NO: 9316851 - DNA, 22 bp, Homo sapiens
cttcagaaccagccagaagagg

SEQ ID NO: 9316852 - DNA, 22 bp, Homo sapiens
cttcagaaataacaacaattac

SEQ ID NO: 9316853 - DNA, 22 bp, Homo sapiens
cttcacagtctttatttcctcc

SEQ ID NO: 9316854 - DNA, 22 bp, Homo sapiens
cttcacagtcaccctgctgtgt

SEQ ID NO: 9316855 - DNA, 22 bp, Homo sapiens
ctttctccagagctgcttattt

SEQ ID NO: 9316856 - DNA, 22 bp, Homo sapiens
ctttctcctactgggcgcggga

SEQ ID NO: 9316857 - DNA, 22 bp, Homo sapiens
ctttctccctgtcccaaactgg

SEQ ID NO: 9316858 - DNA, 22 bp, Homo sapiens
ctttctcaatgccggaaggcac

SEQ ID NO: 9316859 - DNA, 21 bp, Homo sapiens
ctttgcatctatatgttctca

SEQ ID NO: 9316860 - DNA, 22 bp, Homo sapiens
ctttccagatttgtccagttat

SEQ ID NO: 9316861 - DNA, 22 bp, Homo sapiens
ctttccagacctccttgtagct

SEQ ID NO: 9316862 - DNA, 22 bp, Homo sapiens
ctttccttaataagcaggtata

SEQ ID NO: 9316863 - DNA, 22 bp, Homo sapiens
ctttccttctcgtggttctcac

SEQ ID NO: 9316864 - DNA, 22 bp, Homo sapiens
ctttcctctggcactgtctggt

SEQ ID NO: 9316865 - DNA, 22 bp, Homo sapiens
cttgcctgccactacagctgaa

SEQ ID NO: 9316866 - DNA, 22 bp, Homo sapiens
cttgcctgaggaacagagggta

SEQ ID NO: 9316867 - DNA, 22 bp, Homo sapiens
cttcttccagttataagagctt

SEQ ID NO: 9316868 - DNA, 22 bp, Homo sapiens
cttcttcctgctgcagcctcca

SEQ ID NO: 9316869 - DNA, 22 bp, Homo sapiens
cttcttcctgaaagctggctct

SEQ ID NO: 9316870 - DNA, 22 bp, Homo sapiens
cttgctttatctggtttctcat

SEQ ID NO: 9316871 - DNA, 22 bp, Homo sapiens
cttgctttcagtctcggcctca

SEQ ID NO: 9316872 - DNA, 22 bp, Homo sapiens
cttgcttttgctgatgattaag

SEQ ID NO: 9316873 - DNA, 22 bp, Homo sapiens
cttgctttccaaatgactcact

SEQ ID NO: 9316874 - DNA, 22 bp, Homo sapiens
cttgctttccaaatgactcact

SEQ ID NO: 9316875 - DNA, 22 bp, Homo sapiens
cttgctttgtccagaaattcag

SEQ ID NO: 9316876 - DNA, 22 bp, Homo sapiens
ctgggccagcaactgcaatgga

SEQ ID NO: 9316877 - DNA, 22 bp, Homo sapiens
ctgggatggctccgctgctgct

SEQ ID NO: 9316878 - DNA, 19 bp, Homo sapiens
ctgggatgtctcctcccag

SEQ ID NO: 9316879 - DNA, 22 bp, Homo sapiens
ctgggagttgacgaggcttgta

SEQ ID NO: 9316880 - DNA, 22 bp, Homo sapiens
ctgggagtactgggggatgtca

SEQ ID NO: 9316881 - DNA, 22 bp, Homo sapiens
ctgggagtgaaaggagggctgc

SEQ ID NO: 9316882 - DNA, 22 bp, Homo sapiens
ctgggagtgaaaggagggctgc

SEQ ID NO: 9316883 - DNA, 17 bp, Homo sapiens
ctggagcctccaactcc

SEQ ID NO: 9316884 - DNA, 22 bp, Homo sapiens
ctgggcctcacacccaccaaat

SEQ ID NO: 9316885 - DNA, 22 bp, Homo sapiens
ctgggctcaaatcctatctcca

SEQ ID NO: 9316886 - DNA, 22 bp, Homo sapiens
ctgggcctccacgggccatcac

SEQ ID NO: 9316887 - DNA, 21 bp, Homo sapiens
ctgggctcatggtgttacaga

SEQ ID NO: 9316888 - DNA, 22 bp, Homo sapiens
ctggggtgagcagaaacagggg

SEQ ID NO: 9316889 - DNA, 22 bp, Homo sapiens
ctggggtggatgggtccaagtt

SEQ ID NO: 9316890 - DNA, 22 bp, Homo sapiens
ctggggtgtctcgtctgccatt

SEQ ID NO: 9316891 - DNA, 22 bp, Homo sapiens
ctgggggccttacggaactcca

SEQ ID NO: 9316892 - DNA, 22 bp, Homo sapiens
ctggggtgaaggattacctgag

SEQ ID NO: 9316893 - DNA, 22 bp, Homo sapiens
ctggggctggtgaggcaggctc

SEQ ID NO: 9316894 - DNA, 22 bp, Homo sapiens
ctggggctggtgaggcaggctc

SEQ ID NO: 9316895 - DNA, 22 bp, Homo sapiens
ctggggctggtgaggcaggctc

SEQ ID NO: 9316896 - DNA, 22 bp, Homo sapiens
ctgggggcaatggtcagagtgt

SEQ ID NO: 9316897 - DNA, 22 bp, Homo sapiens
ctgggctctaagggagcaccgt

SEQ ID NO: 9316898 - DNA, 22 bp, Homo sapiens
ctgggctccctcatgtgtctgc

SEQ ID NO: 9316899 - DNA, 22 bp, Homo sapiens
ctgggttggggttacatgactg

SEQ ID NO: 9316900 - DNA, 22 bp, Homo sapiens
ctgggttgatctcagccctaag

SEQ ID NO: 9316901 - DNA, 22 bp, Homo sapiens
ctgggttgccctgggcctgtga

SEQ ID NO: 9316902 - DNA, 22 bp, Homo sapiens
ctgggttcttggcacagcagga

SEQ ID NO: 9316903 - DNA, 22 bp, Homo sapiens
ctgggttccatgtagccaagag

SEQ ID NO: 9316904 - DNA, 22 bp, Homo sapiens
ctgggtgttcacccgaggcgct

SEQ ID NO: 9316905 - DNA, 22 bp, Homo sapiens
ctgggtgttcaggagctgggct

SEQ ID NO: 9316906 - DNA, 22 bp, Homo sapiens
ctgggtgtcaggagacatgatg

SEQ ID NO: 9316907 - DNA, 22 bp, Homo sapiens
ctgggtggaaagtgctgagaat

SEQ ID NO: 9316908 - DNA, 22 bp, Homo sapiens
ctggtgtggactccgcgcggag

SEQ ID NO: 9316909 - DNA, 22 bp, Homo sapiens
ctggtggttcaggagaatggct

SEQ ID NO: 9316910 - DNA, 22 bp, Homo sapiens
ctggtgtgattgagcccaggtg

SEQ ID NO: 9316911 - DNA, 22 bp, Homo sapiens
ctgtgtgtgaacacagcccagc

SEQ ID NO: 9316912 - DNA, 20 bp, Homo sapiens
ctgtggtgagcaggagagta

SEQ ID NO: 9316913 - DNA, 22 bp, Homo sapiens
ctgtggtggcacagcgggctgg

SEQ ID NO: 9316914 - DNA, 22 bp, Homo sapiens
ctgtgggctcctgcagctcagg

SEQ ID NO: 9316915 - DNA, 22 bp, Homo sapiens
ctgtggggaaagggtcctgctc

SEQ ID NO: 9316916 - DNA, 22 bp, Homo sapiens
ctgtgttttgattaaaaagcaa

SEQ ID NO: 9316917 - DNA, 22 bp, Homo sapiens
ctgtgtgtttatatcatttcct

SEQ ID NO: 9316918 - DNA, 22 bp, Homo sapiens
ctgtgttcagtgctactgagtt

SEQ ID NO: 9316919 - DNA, 22 bp, Homo sapiens
ctgtgtgtgtctgcagcatact

SEQ ID NO: 9316920 - DNA, 23 bp, Homo sapiens
ctgtgtgtgccgagggtggccac

SEQ ID NO: 9316921 - DNA, 22 bp, Homo sapiens
ctgtggcttcagcattcagagc

SEQ ID NO: 9316922 - DNA, 22 bp, Homo sapiens
ctgtgggcgcctgtcagcctca
